(12) United States Patent
Doucette-Stamm et al.

(10) Patent No.: US 7,416,862 B2
(45) Date of Patent: Aug. 26, 2008

(54) **NUCLEIC ACID AND AMINO ACID SEQUENCES RELATING TO *STAPHYLOCOCCUS EPIDERMIDIS* FOR DIAGNOSTICS AND THERAPEUTICS**

(75) Inventors: Lynn A. Doucette-Stamm, Framingham, MA (US); David Bush, Somerville, MA (US)

(73) Assignee: Wyeth, Madison, NJ (US)

( * ) Notice: Subject to any disclaimer, the term of this patent is extended or adjusted under 35 U.S.C. 154(b) by 275 days.

(21) Appl. No.: 10/902,441

(22) Filed: Jul. 30, 2004

(65) Prior Publication Data

US 2007/0037163 A1 Feb. 15, 2007

Related U.S. Application Data

(60) Continuation of application No. 10/092,411, filed on Mar. 7, 2002, now abandoned, which is a division of application No. 09/134,001, filed on Aug. 13, 1998, now Pat. No. 6,380,370.

(60) Provisional application No. 60/064,964, filed on Nov. 8, 1997, provisional application No. 60/055,779, filed on Aug. 14, 1997.

(51) Int. Cl.
*C12P 21/04* (2006.01)
*C12N 1/20* (2006.01)
*C07H 21/04* (2006.01)
*A61K 39/086* (2006.01)

(52) U.S. Cl. ............... 435/69.7; 435/6; 435/252.1; 435/252.3; 435/320.1; 435/882; 435/884; 536/23.1; 536/23.7; 536/24.33; 424/130.1; 424/184.1; 424/243.1

(58) Field of Classification Search ............ 424/165.1, 424/130.1, 150.1, 164.1, 243.1, 184.1; 435/6, 435/252.3, 320.1, 69.7, 882, 884, 252.1; 536/23.1, 23.7, 24.33
See application file for complete search history.

(56) References Cited

FOREIGN PATENT DOCUMENTS

WO 96/08582 3/1996
WO WO 01/34809 * 5/2001

OTHER PUBLICATIONS

Wieser et al, Int J Syst Evol Microbiol. May 2000; 50 Pt 3: 1087-93).*
Biochemistry 1999, Parikh et al, 38; 13623-13633.*
Infect Immun. 1994 May; 62(5): 1843-7.*
Antimicrobial Agents and Chemotherapy, Mar. 2001, p. 805-809, vol. 45, No. 3.*
Emerging Infectious Diseases 2005, vol. 11, (9) 1389-1393.*
BioEssays, vol. 18, No. 12, pp. 973 981(1996).*
Journal of Leukocyte Biology, vol. 61, No. 5, pp. 545 550 (1997).*
Journal of Molecular Biology, vol. 244, pp. 332 350 1994.*
"Peptide Hormones", edited by Parsons, J.A., University Park Press, Jun. 1976.*
The Journal of Cell Biology, 111:2129 2138, 1990.*
Molecular and Cellular Biology, 8(3): 1247 1252, 1988.*
Mol. Microbiol. 1991, 5(7): 1755 67.*
Martineau F, J Clin Microbiol. Dec. 1996: 34(12): 2888-93.*
Dunne WM Jr.Clin Microbiol Rev. Apr. 2002; 15(2): 155-66.*
Ip D et al, J Orthop Surg (Hong Kong). Aug. 2005; 13(2): 125-30.*
Gill SR, Fouts DE et al Bacteriol. Apr. 2005: 187(7): 2426-3.*
O'Gara JP, Humphreys H. J Med Microbiol. Jul. 2001;50(7):582-7.*
Risitano DC, Minerva Anestesiol. Sep. 2005; 71(9): 561-4.*

* cited by examiner

*Primary Examiner*—Susan Ungar
*Assistant Examiner*—Padma Baskar
(74) *Attorney, Agent, or Firm*—Drinker Biddle & Reath LLP

(57) ABSTRACT

The invention provides isolated polypeptide and nucleic acid sequences derived from *Staphylococcus epidermidis* that are useful in diagnosis and therapy of pathological conditions; antibodies against the polypeptides; and methods for the production of the polypeptides. The invention also provides methods for the detection, prevention and treatment of pathological conditions resulting from bacterial infection.

5 Claims, No Drawings

NUCLEIC ACID AND AMINO ACID SEQUENCES RELATING TO *STAPHYLOCOCCUS EPIDERMIDIS* FOR DIAGNOSTICS AND THERAPEUTICS

CROSS REFERENCE TO RELATED APPLICATIONS

This application is a continuation of application Ser. No. 10/092,411 filed Mar. 7, 2002, now abandoned, which is a divisional of application Ser. No. 09/134,001, filed on Aug. 13, 1998, now U.S. Pat. No. 6,380,370, issued Apr. 30, 2002, which claims priority of U.S. Provisional Application No. 60/064,964, filed Nov. 8, 1997, and U.S. Provisional Application No. 60/055,779, filed Aug. 14, 1997, all of which are hereby incorporated by reference in their entirety.

REFERENCE TO A SEQUENCE LISTING

A sequence listing submitted on CD-ROM is incorporated herein by reference.

FIELD OF THE INVENTION

The invention relates to isolated nucleic acids and polypeptides derived from *Staphylococcus epidermidis* that are useful as molecular targets for diagnostics, prophylaxis and treatment of pathological conditions, as well as materials and methods for the diagnosis, prevention, and amelioration of pathological conditions resulting from bacterial infection.

BACKGROUND OF THE INVENTION

*Staphylococcus epidermidis* (*S. epidemidis*) is a species of staphylococcal bacteria that are Gram-positive, nonmotile, nonpigmented and coagulase-negative cocci, which are mainly found on the skin and mucous membrane of warm-blooded animals. Their large numbers and ubiquitous distribution result in frequent contamination of specimens collected from or through the skin, making these organisms amongst the most frequently isolated in the clinical laboratory. In the past, *S. epidermidis* was rarely the cause of significant infections, but with the increasing use of implanted catheters and prosthetic devices, it has emerged as an important agent of hospital-acquired infections and has been recognized as a true pathogen (Lowy and Hammer, 1983, Ann Inten Med, 99: 834-9; Blum and Rodvold, 1987, Clin Pharm, 6: 464-75; Hamory, Parisi et al., 1987, Am J Infect Control, 15: 59-74). *S. epidermidis* is a major cause of infection of indwelling foreign devices such as, orthopedic devices, intravenous catheters, prosthetic heart valves, central nervous system shunts, and peritoneal dialysis catheters (Blum and Rodvold, 1987, Clin Pharm, 6: 464-75; Archer, 1988, J Antimicrob Chemother, 21 Suppl C: 133-8) (Lowy and Hammer, 1983, Ann Intern Med, 99: 834-9; Hamory, Parisi et al., *Staphylococcus* 1987, Am J Infect Control, 15: 59-74). In addition *S. epidermidis* is a common cause of postoperative wound infections, bacteremia of immunosuppressed patients, intensive-care unit patients and premature newborns (MacLowry, 1983, Am J Med, 75: 2-6) (Eykyn, 1988, Lancet, 1: 100-4). According to a national survey (Centers for Disease Control, 1981:7) *S. epidermidis* caused 8.9% of primary nosocomial bacteremias.

Treatment of *S. epidermidis* infections remains difficult because of the occult nature, association with foreign bodies, and frequent resistance to antimicrobial agents. Ordinarily, *S. epidermidis* is an organism with low virulence, however breaks in host defense caused by surgery, catheter placement, prosthesis insertion or immuno-suppression is prerequisite for infection. The presence of foreign bodies itself facilitates infection by protecting the organism from elimination by host defenses or antimicrobial therapy (Lowy and Hammer, 1983, Ann Intern Med, 99: 834-9). Furthermore, *S. epidermidis* due to its ability to produce extracellular polysaccharide material or slime, may be uniquely adapted to adhere to smooth surfaces such as plastics or metal. Slime producing strains of *S. epidermidis* appear to be more pathogenic than non-slime producing strains (Christensen, Simpson et al., 1983, Infect Immun, 40: 407-10; Peters and Pulverer, 1984, J Antimicrob Chemother, 14 Suppl D: 67-71; Gallimore, Gagnon et al., 1991, J Infect Dis, 164: 1220-3). This property and many factors are involved in the pathogenesis of device associated infections. Despite the increased recognition as a pathogen, *S. epidermidis* infections are difficult to diagnose. Differentiating clinically important from clinically unimportant bacterial isolates of *S. epidermidis* is difficult because of the high rate of contamination.

Although laboratory isolates of *S. epidermidis* have generally been susceptible to semisynthetic penicillins (methicillin, nafcillin, oxacillin), cephalosporins, amino-glycosides, vancomycin and rafampin, recent clinical isolates have had an increased resistance. Recent reports (Karchmer, 1985, Am J Med, 78: 116-27; Karchmer, 1991, J Hosp Infect, 18 Suppl A: 355-66) show that 83% of *S. epidermidis* isolates from patients with prosthetic valve endocarditis are methicillin resistant and 32% are gentamicin resistant as well. Multi-drug resistant staphylococci have emerged in the midst of high level use of penicillin and aminoglycosides (Centers for Disease Control and Prevention, 1993 *MMWR* 42:597; and S. Handwerger et al., 1993, *Clin Infect Dis* 16:750).

The use of antibiotics for therapeutics and prophylactic purposes, promotes the selection of resistant organisms and the spread of antibiotic resistance genes among bacteria. Previous studies have shown that virtually all staphylococci carry some antibiotic resistance genes on naturally occurring extrachromosomal mobile genetic elements, such as the plasmids. Survey and analysis of plasmids in clinical isolates of *S. epidermidis* have shown that more that 80% of isolates carry plasmids and in several cases more than one plasmid (Archer et al., 1982, Infect Immun, 35:627-632; Kloos et al., 1981, Can J Microbiol, 27:271-278; Moller, 1988, J Hosp Infect 12:19-27). Though the most important forms of resistance has been the inactivation of antibiotics, particularly penicillins and cephalosporins, recent clinical isolates have resistance to one or more of the following antibiotics, methicillin, tetracycline, erythromycin, gentamycin, kanamycin and chloramphenicol. In fact due to the wide spread occurrence of plasmids and their involvement in antibiotic resistance, plasmid profiling has been used as an epidemiological reagent to study nosocomial infections. This invention relates to isolated nucleic acids and polypeptides derived from *S. epidermidis* plasmids that are useful as molecular targets for diagnosis, prophylaxis and treatment of pathological conditions, as well as materials and methods for the diagnosis, prevention, and amelioration of pathological conditions resulting from bacterial infection.

These concerns point to the need for diagnostic tools and therapeutics aimed at proper identification of strain and eradication of virulence. The design of vaccines that will limit the spread of infection and halt transfer of resistance factors is very desirable.

SUMMARY OF THE INVENTION

The present invention fulfills the need for diagnostic tools and therapeutics by providing bacterial-specific compositions and methods for detecting, treating, and preventing bacterial infection, in particular S. epidermidis infection.

The present invention encompasses isolated nucleic acids and polypeptides derived from S. epidermidis that are useful as reagents for diagnosis of bacterial disease, components of effective antibacterial vaccines, and/or as targets for antibacterial drugs including anti-S. epidermidis drugs. They can also be used to detect the presence of S. epidermidis and other Staphylococcus species in a sample; and in screening compounds for the ability to interfere with the S. epidermidis life cycle or to inhibit S. epidermidis infection. They also has use as biocontrol agents for plants.

More specifically, this invention features compositions of nucleic acids corresponding to entire coding sequences of S. epidermidis proteins, including surface or secreted proteins or parts thereof, nucleic acids capable of binding mRNA from S. epidermidis proteins to block protein translation, and methods for producing S. epidermidis proteins or parts thereof using peptide synthesis and recombinant DNA techniques. This invention also features antibodies and nucleic acids useful as probes to detect S. epidermidis infection. In addition, vaccine compositions and methods for the protection or treatment of infection by S. epidermidis are within the scope of this invention.

The nucleotide sequences provided in SEQ ID NO: 1-SEQ ID NO: 2837, a fragment thereof, or a nucleotide sequence at least 99.5% identical to SEQ ID NO: 1-SEQ ID NO: 2837 may be "provided" in a variety of media to facilitate use thereof. As used herein, "provided" refers to a manufacture, other than an isolated nucleic acid molecule, which contains a nucleotide-sequence of the present invention, i.e., the nucleotide sequence provided in SEQ ID NO: 1-SEQ ID NO: 2837, a fragment thereof, or a nucleotide sequence at least 99.5% identical to a sequence contained within SEQ ID NO: 1-SEQ ID NO: 2837. Uses for and methods for providing nucleotide sequences in a variety of media is well known in the art (see e.g., EPO Publication No. EP 0 756 006).

In one application of this embodiment, a nucleotide sequence of the present invention can be recorded on computer readable media. As used herein, "computer readable media" refers to any media which can be read and accessed directly by a computer. Such media include, but are not limited to: magnetic storage media, such as floppy discs, hard disc storage media, and magnetic tape; optical storage media such as CD-ROM; electrical storage media such as RAM and ROM; and hybrids of these categories such as magnetic/optical storage media. A person skilled in the art can readily appreciate how any of the presently known computer readable media can be used to create a manufacture comprising computer readable media having recorded thereon a nucleotide sequence of the present invention.

As used herein, "recorded" refers to a process for storing information on computer readable media. A person skilled in the art can readily adopt any of the presently known methods for recording information on computer readable media to generate manufactures comprising the nucleotide sequence information of the present invention.

A variety of data storage structures are available to a person skilled in the art for creating a computer readable media having recorded thereon a nucleotide sequence of the present invention. The choice of the data storage structure will generally be based on the means chosen to access the stored information. In addition, a variety of data processor programs and formats can be used to store the nucleotide sequence information of the present invention on computer readable media. The sequence information can be represented in a word processing text file, formatted in commercially-available software such as WordPerfect and Microsoft Word, or represented in the form of an ASCII file, stored in a database application, such as DB2, Sybase, Oracle, or the like. A person skilled in the art can readily adapt any number of data processor structuring formats (e.g. text file or database) in order to obtain computer readable media having recorded thereon the nucleotide sequence information of the present invention.

By providing the nucleotide sequence of SEQ ID NO: 1-SEQ ID NO: 2837, a fragment thereof, or a nucleotide sequence at least 99.5% identical to SEQ ID NO: 1-SEQ ID NO: 2837 in computer readable form, a person skilled in the art can routinely access the coding sequence information for a variety of purposes. Computer software is publicly available which allows a person skilled in the art to access sequence information provided in a computer readable media. Examples of such computer software include programs of the "Staden Package", "DNA Star", "MacVector", GCG "Wisconsin Package" (Genetics Computer Group, Madison, Wis.) and "NCBI Toolbox" (National Center For Biotechnology Information).

Computer algorithms enable the identification of S. epidermidis open reading frames (ORFs) within SEQ ID NO: 1-SEQ ID NO: 2837 which contain homology to ORFs or proteins from other organisms. Examples of such similarity-search algorithms include the BLAST [Altschul et al., J. Mol. Biol. 215:403-410 (1990)] and Smith-Waterman [Smith and Waterman (1981) Advances in Applied Mathematics, 2:482-489] search algorithms. These algorithms are utilized on computer systems as exemplified below. The ORFs so identified represent protein encoding fragments within the S. epidermidis genome and are useful in producing commercially important proteins such as enzymes used in fermentation reactions and in the production of commercially useful metabolites.

The present invention further provides systems, particularly computer-based systems, which contain the sequence information described herein. Such systems are designed to identify commercially important fragments of the S. epidermidis genome. As used herein, "a computer-based system" refers to the hardware means, software means, and data storage means used to analyze the nucleotide sequence information of the present invention. The minimum hardware means of the computer-based systems of the present invention comprises a central processing unit (CPU), input means, output means, and data storage means. A person skilled in the art can readily appreciate that any one of the currently available computer-based systems is suitable for use in the present invention. The computer-based systems of the present invention comprise a data storage means having stored therein a nucleotide sequence of the present invention and the necessary hardware means and software means for supporting and implementing a search means. As used herein, "data storage means" refers to memory which can store nucleotide sequence information of the present invention, or a memory access means which can access manufactures having recorded thereon the nucleotide sequence information of the present invention.

As used herein, "search means" refers to one or more programs which are implemented on the computer-based system to compare a target sequence or target structural motif with the sequence information stored within the data storage means. Search means are used to identify fragments or regions of the *S. epidermidis* genome which are similar to, or "match", a particular target sequence or target motif. A variety of known algorithms are known in the art and have been disclosed publicly, and a variety of commercially available software for conducting homology-based similarity searches are available and can be used in the computer-based systems of the present invention. Examples of such software includes, but is not limited to, FASTA (GCG Wisconsin Package), Bic_SW (Compugen Bioccelerator), BLASTN2, BLASTP2, BLASTX2 (NCBI) and Motifs (GCG). A person skilled in the art can readily recognize that any one of the available algorithms or implementing software packages for conducting homology searches can be adapted for use in the present computer-based systems.

As used herein, a "target sequence" can be any DNA or amino acid sequence of six or more nucleotides or two or more amino acids. A person skilled in the art can readily recognize that the longer a target sequence is, the less likely a target sequence will be present as a random occurrence in the database. The most preferred sequence length of a target sequence is from about 10 to 100 amino acids or from about 30 to 300 nucleotide residues. However, it is well recognized that many genes are longer than 500 amino acids, or 1.5 kb in length, and that commercially important fragments of the *S. epidermidis* genome, such as sequence fragments involved in gene expression and protein processing, will often be shorter than 30 nucleotides.

As used herein, "a target structural motif," or "target motif," refers to any rationally selected sequence or combination of sequences in which the sequence(s) are chosen based on a specific functional domain or three-dimensional configuration which is formed upon the folding of the target polypeptide. There are a variety of target motifs known in the art. Protein target motifs include, but are not limited to, enzymatic active sites, membrane-spanning regions, and signal sequences. Nucleic acid target motifs include, but are not limited to, promoter sequences, hairpin structures and inducible expression elements (protein binding sequences).

A variety of structural formats for the input and output means can be used to input and output the information in the computer-based systems of the present invention. A preferred format for an output means ranks fragments of the *S. epidermidis* genome possessing varying degrees of homology to the target sequence or target motif. Such presentation provides a person skilled in the art with a ranking of sequences which contain various amounts of the target sequence or target motif and identifies the degree of homology contained in the identified fragment.

A variety of comparing means can be used to compare a target sequence or target motif with the data storage means to identify sequence fragments of the *S. epidermidis* genome. In the present examples, implementing software which implement the BLASTP2 and bic_SW algorithms (Altschul et al., J. Mol. Biol. 215:403-410 (1990); Compugen Biocellerator) was used to identify open reading frames within the *S. epidermidis* genome. A person skilled in the art can readily recognize that any one of the publicly available homology search programs can be used as the search means for the computer-based systems of the present invention.

The invention features *S. epidermidis* polypeptides, preferably a substantially pure preparation of a *S. epidermidis* polypeptide, or a recombinant *S. epidermidis* polypeptide. In preferred embodiments: the polypeptide has biological activity; the polypeptide has an amino acid sequence at least 60%, 70%, 80%, 90%, 95%, 98%, or 99% identical to an amino acid sequence of the invention contained in the Sequence Listing, preferably it has about 65% sequence identity with an ammo acid sequence of the invention contained in the Sequence Listing, and most preferably it has about 92% to about 99% sequence identity with an amino acid sequence of the invention contained in the Sequence Listing; the polypeptide has an amino acid sequence essentially the same as an amino acid sequence of the invention contained in the Sequence Listing; the polypeptide is at least 5, 10, 20, 50, 100, or 150 amino acid residues in length; the polypeptide includes at least 5, preferably at least 10, more preferably at least 20, more preferably at least 50, 100, or 150 contiguous amino acid residues of the invention contained in the Sequence Listing. In yet another preferred embodiment, the amino acid sequence which differs in sequence identity by about 7% to about 8% from the *S. epidermidis* amino acid sequences of the invention contained in the Sequence Listing is also encompassed by the invention.

In preferred embodiments: the *S. epidermidis* polypeptide is encoded by a nucleic acid of the invention contained in the Sequence Listing, or by a nucleic acid having at least 60%, 70%, 80%, 90%, 95%, 98%, or 99% homology with a nucleic acid of the invention contained in the Sequence Listing.

In a preferred embodiment, the subject *S. epidermidis* polypeptide differs in amino acid sequence at 1, 2, 3, 5, 10 or more residues from a sequence of the invention contained in the Sequence Listing. The differences, however, are such that the *S. epidermidis* polypeptide exhibits a *S. epidermidis* biological activity, e.g., the *S. epidermidis* polypeptide retains a biological activity of a naturally occurring *S. epidermidis* enzyme.

In preferred embodiments, the polypeptide includes all or a fragment of an amino acid sequence of the invention contained in the Sequence Listing; fused, in reading frame, to additional amino acid residues, preferably to residues encoded by genomic DNA 5' or 3' to the genomic DNA which encodes a sequence of the invention contained in the Sequence Listing.

In yet other preferred embodiments, the *S. epidermidis* polypeptide is a recombinant fusion protein having a first *S. epidermidis* polypeptide portion and a second polypeptide portion, e.g., a second polypeptide portion having an amino acid sequence unrelated to *S. epidermidis*. The second polypeptide portion can be, e.g., any of glutathione-S-transferase, a DNA binding domain, or a polymerase activating domain. In preferred embodiment the fusion protein can be used in a two-hybrid assay.

Polypeptides of the invention include those which arise as a result of alternative transcription events, alternative RNA splicing events, and alternative translational and postranslational events.

In a preferred embodiment, the encoded *S. epidermidis* polypeptide differs (e.g., by amino acid substitution, addition or deletion of at least one amino acid residue) in amino acid sequence at 1, 2, 3, 5, 10 or more residues, from a sequence of the invention contained in the Sequence Listing. The differences, however, are such that: the *S. epidermidis* encoded polypeptide exhibits a *S. epidermidis* biological activity, e.g., the encoded *S. epidermidis* enzyme retains a biological activity of a naturally occurring *S. epidermidis*.

In preferred embodiments, the encoded polypeptide includes all or a fragment of an amino acid sequence of the invention contained in the Sequence Listing; fused, in reading frame, to additional amino acid residues, preferably to residues encoded by genomic DNA 5' or 3' to the genomic DNA which encodes a sequence of the invention contained in the Sequence Listing.

The *S. epidermidis* strain, from which the nucleotide sequences have been sequenced, was deposited on Jul. 10, 1997 in the American Type Culture Collection (ATCC #55998) as strain 18972.

Included in the invention are: allelic variations; natural mutants; induced mutants; proteins encoded by DNA that hybridize under high or low stringency conditions to a nucleic acid which encodes a polypeptide of the invention contained in the Sequence Listing (for definitions of high and low stringency see Current Protocols in Molecular Biology, John Wiley & Sons, New York, 1989, 6.3.1-6.3.6, hereby incorporated by reference); and, polypeptides specifically bound by antisera to *S. epidermidis* polypeptides, especially by antisera to an active site or binding domain of *S. epidermidis* polypeptide. The invention also includes fragments, preferably biologically active fragments. These and other polypeptides are also referred to herein as *S. epidermidis* polypeptide analogs or variants.

The invention further provides nucleic acids, e.g., RNA or DNA, encoding a polypeptide of the invention. This includes double stranded nucleic acids as well as coding and antisense single strands.

In preferred embodiments, the subject *S. epidermidis* nucleic acid will include a transcriptional regulatory sequence, e.g. at least one of a transcriptional promoter or transcriptional enhancer sequence, operably linked to the *S. epidermidis* gene sequence, e.g., to render the *S. epidermidis* gene sequence suitable for expression in a recombinant host cell.

In yet a further preferred embodiment, the nucleic acid which encodes a *S. epidermidis* polypeptide of the invention, hybridizes under stringent conditions to a nucleic acid probe corresponding to at least 8 consecutive nucleotides of the invention contained in the Sequence Listing; more preferably to at least 12 consecutive nucleotides of the invention contained in the Sequence Listing; more preferably to at least 20 consecutive nucleotides of the invention contained in the Sequence Listing; more preferably to at least 40 consecutive nucleotides of the invention contained in the Sequence Listing.

In another aspect, the invention provides a substantially pure nucleic acid having a nucleotide sequence which encodes a *S. epidermidis* polypeptide. In preferred embodiments: the encoded polypeptide has biological activity; the encoded polypeptide has an amino acid sequence at least 60%, 70%, 80%, 90%, 95%, 98%, or 99% homologous to an amino acid sequence of the invention contained in the Sequence Listing; the encoded polypeptide has an amino acid sequence essentially the same as an amino acid sequence of the invention contained in the Sequence Listing; the encoded polypeptide is at least 5, 10, 20, 50, 100, or 150 amino acids in length; the encoded polypeptide comprises at least 5, preferably at least 10, more preferably at least 20, more preferably at least 50, 100, or 150 contiguous amino acids of the invention contained in the Sequence Listing.

In another aspect, the invention encompasses: a vector including a nucleic acid which encodes a *S. epidermidis* polypeptide or a *S. epidermidis* polypeptide variant as described herein; a host cell transfected with the vector; and a method of producing a recombinant *S. epidermidis* polypeptide or *S. epidermidis* polypeptide variant; including culturing the cell, e.g., in a cell culture medium, and isolating a*S. epidermidis* or *S. epidermidis* polypeptide variant, e.g., from the cell or from the cell culture medium.

One embodiment of the invention is directed to substantially isolated nucleic acids. Nucleic acids of the invention include sequences comprising at least about 8 nucleotides in length, more preferably at least about 12 nucleotides in length, even more preferably at least about 15-20 nucleotides in length, that correspond to a subsequence of any one of SEQ ID NO: 1-SEQ ID NO: 2837 or complements thereof. Alternatively, the nucleic acids comprise sequences contained within any ORF (open reading frame), including a complete protein-coding sequence, of which any of SEQ ID NO: 1-SEQ ID NO: 2837 forms a part. The invention encompasses sequence-conservative variants and function-conservative variants of these sequences. The nucleic acids may be DNA, RNA, DNA/RNA duplexes, protein-nucleic acid (PNA), or derivatives thereof.

In another aspect, the invention features, a purified recombinant nucleic acid having at least 50%, 60%, 70%, 80%, 90%, 95%, 98%, or 99% homology with a sequence of the invention contained in the Sequence Listing The invention also encompasses recombinant DNA (including DNA cloning and expression vectors) comprising these *S. epidermidis*-derived sequences; host cells comprising such DNA, including fungal, bacterial, yeast, plant, insect, and mammalian host cells; and methods for producing expression products comprising RNA and polypeptides encoded by the *S. epidermidis* sequences. These methods are carried out by incubating a host cell comprising a *S. epidermidis*-derived nucleic acid sequence under conditions in which the sequence is expressed. The host cell may be native or recombinant. The polypeptides can be obtained by (a) harvesting the incubated cells to produce a cell fraction and a medium fraction; and (b) recovering the *S. epidermidis* polypeptide from the cell fraction, the medium fraction, or both. The polypeptides can also be made by in vitro translation.

In another aspect, the invention features nucleic acids capable of binding mRNA of *S. epidermidis*. Such nucleic acid is capable of acting as antisense nucleic acid to control the translation of mRNA of *S. epidermidis*. A further aspect features a nucleic acid which is capable of binding specifically to a *S. epidermidis* nucleic acid. These nucleic acids are also referred to herein as complements and have utility as probes and as capture reagents.

In another aspect, the invention features an expression system comprising an open reading frame corresponding to *S. epidermidis* nucleic acid. The nucleic acid further comprises a control sequence compatible with an intended host. The expression system is useful for making polypeptides corresponding to *S. epidermidis* nucleic acid.

In another aspect, the invention encompasses: a vector including a nucleic acid which encodes a *S. epidermidis* polypeptide or a *S. epidermidis* polypeptide variant as described herein; a host cell transfected with the vector; and a method of producing a recombinant *S. epidermidis* polypeptide or *S. epidermidis* polypeptide variant; including culturing the cell, e.g., in a cell culture medium, and isolating the *S. epidermidis* or *S. epidermidis* polypeptide variant, e.g., from the cell or from the cell culture medium.

In yet another embodiment of the invention encompasses reagents for detecting bacterial infection, including *S. epidermidis* infection, which comprise at least one *S. epidermidis*-derived nucleic acid defined by any one of SEQ ID NO: 1-SEQ ID NO: 2837, or sequence-conservative or function-conservative variants thereof. Alternatively, the diagnostic reagents comprise polypeptide sequences that are contained within any open reading frames (ORFs), including complete protein-coding sequences, contained within any of SEQ ID NO: 1-SEQ ID NO: 2837, or polypeptide sequences contained within any of SEQ ID NO: 2838-SEQ ID NO: 5674, or polypeptides of which any of the above sequences forms a part, or antibodies directed against any of the above peptide sequences or function-conservative variants and/or fragments thereof.

The invention further provides antibodies, preferably monoclonal antibodies, which specifically bind to the polypeptides of the invention. Methods are also provided for producing antibodies in a host animal. The methods of the invention comprise immunizing an animal with at least one S. epidermidis-derived immunogenic component, wherein the immunogenic component comprises one or more of the polypeptides encoded by any one of SEQ ID NO: 1-SEQ ID NO: 2837 or sequence-conservative or function-conservative variants thereof; or polypeptides that are contained within any ORFs, including complete protein-coding sequences, of which any of SEQ ID NO: 1-SEQ ID NO: 2837 forms a part; or polypeptide sequences contained within any of SEQ ID NO: 2838-SEQ ID NO: 5674, or polypeptides of which any of SEQ ID NO: 2838-SEQ ID NO: 5674 forms a part. Host animals include any warm blooded animal, including without limitation mammals and birds. Such antibodies have utility as reagents for immuno assays to evaluate the abundance and distribution of S. epidermidis-specific antigens.

In yet another aspect, the invention provides diagnostic methods for detecting S. epidermidis antigenic components or anti-S. epidermidis antibodies in a sample. S. epidermidis antigenic components are detected by a process comprising: (i) contacting a sample suspected to contain a bacterial antigenic component with a bacterial-specific antibody, under conditions in which a stable antigen-antibody complex can form between the antibody and bacterial antigenic components in the sample; and (ii) detecting any antigen-antibody complex formed in step (i), wherein detection of an antigen-antibody complex indicates the presence of at least one bacterial antigenic component in the sample. In different embodiments of this method, the antibodies used are directed against a sequence encoded by any of SEQ ID NO: 1-SEQ ID NO: 2837 or sequence-conservative or function-conservative variants thereof, or against a polypeptide sequence contained in any of SEQ ID NO: 2838-SEQ ID NO: 5674 or function-conservative variants thereof.

In yet another aspect, the invention provides a method for detecting antibacterial-specific antibodies in a sample, which comprises: (i) contacting a sample suspected to contain antibacterial-specific antibodies with a S. epidermidis antigenic component, under conditions in which a stable antigen-antibody complex can form between the S. epidermidis antigenic component and antibacterial antibodies in the sample; and (ii) detecting any antigen-antibody complex formed in step (i), wherein detection of an antigen-antibody complex indicates the presence of antibacterial antibodies in the sample. In different embodiments of this method, the antigenic component is encoded by a sequence contained in any of SEQ ID NO: 1-SEQ ID NO: 2837 or sequence-conservative and function-conservative variants thereof, or is a polypeptide sequence contained in any of SEQ ID NO: 2838-SEQ ID NO: 5674 or function-conservative variants thereof.

In another aspect, the invention features a method of generating vaccines for immunizing an individual against S. epidermidis. The method includes: immunizing a subject with a S. epidermidis polypeptide, e.g., a surface or secreted polypeptide, or a combination of such peptides or active portion(s) thereof, and a pharmaceutically acceptable carrier. Such vaccines have therapeutic and prophylactic utilities.

In another aspect, the invention features a method of evaluating a compound, e.g. a polypeptide, e.g., a fragment of a host cell polypeptide, for the ability to bind a S. epidermidis polypeptide. The method includes: contacting the Staphylococcus compound with a S. epidermidis polypeptide and determining if the compound binds or otherwise interacts with a S. epidermidis polypeptide. Compounds which bind S. epidermidis are candidates as activators or inhibitors of the bacterial life cycle. These assays can be performed in vitro or in vivo.

In another aspect, the invention features a method of evaluating a compound, e.g. a polypeptide, e.g., a fragment of a host cell polypeptide, for the ability to bind a S. epidermidis nucleic acid, e.g., DNA or RNA. The method includes: contacting the Staphylococcus compound with a S. epidermidis nucleic acid and determining if the compound binds or otherwise interacts with a S. epidermidis polypeptide. Compounds which bind S. epidermidis are candidates as activators or inhibitors of the bacterial life cycle. These assays can be performed in vitro or in vivo.

A particularly preferred embodiment of the invention is directed to a method of screening test compounds for antibacterial activity, which method comprises: selecting as a target a bacterial specific sequence, which sequence is essential to the viability of a bacterial species; contacting a test compound with said target sequence; and selecting those test compounds which bind to said target sequence as potential anti-bacterial candidates. In one embodiment, the target sequence selected is specific to a single species, or even a single strain, i.e., the S. epidermidis 18972. In a second embodiment, the target sequence is common to at least two species of bacteria. In a third embodiment, the target sequence is common to a family of bacteria. The target sequence may be a nucleic acid sequence or a polypeptide sequence. Methods employing sequences common to more than one species of microorganism may be used to screen candidates for broad spectrum anti-bacterial activity.

The invention also provides methods for preventing or treating disease caused by certain bacteria, including S. epidermidis, which are carried out by administering to an animal in need of such treatment, in particular a warm-blooded vertebrate, including but not limited to birds and mammals, a compound that specifically inhibits or interferes with the function of a bacterial polypeptide or nucleic acid. In a particularly preferred embodiment, the mammal to be treated is human.

DETAILED DESCRIPTION OF THE INVENTION

The sequences of the present invention include the specific nucleic acid and amino acid sequences set forth in the Sequence Listing that forms a part of the present specification, and which are designated SEQ ID NO: 1-SEQ ID NO: 5674. Use of the terms "SEQ ID NO: 1-SEQ ID NO: 2837," "SEQ ID NO: 2838-SEQ ID NO: 5674," and "the sequences depicted in Table 2", etc., is intended, for convenience, to refer to each individual SEQ ID NO individually, and is not intended to refer to the genus of these sequences. In other words, it is a shorthand for listing all of these sequences individually. The invention encompasses each sequence individually, as well as any combination thereof.

Definitions

"Nucleic acid" or "polynucleotide" as used herein refers to purine- and pyrimidine-containing polymers of any length, either polyribonucleotides or polydeoxyribonucleotides or mixed polyribo-polydeoxyribo nucleotides. This includes single- and double-stranded molecules, i.e., DNA-DNA, DNA-RNA and RNA-RNA hybrids, as well as "protein nucleic acids" (PNA) formed by conjugating bases to an amino acid backbone. This also includes nucleic acids containing modified bases.

A nucleic acid or polypeptide sequence that is "derived from" a designated sequence refers to a sequence that corresponds to a region of the designated sequence. For nucleic acid sequences, this encompasses sequences that are homologous or complementary to the sequence, as well as "sequence-conservative variants" and "function-conservative variants." For polypeptide sequences, this encompasses "function-conservative variants." Sequence-conservative variants are those in which a change of one or more nucleotides in a given codon position results in no alteration in the amino acid encoded at that position. Function-conservative variants are those in which a given amino acid residue in a polypeptide has been changed without altering the overall conformation and function of the native polypeptide, including, but not limited to, replacement of an amino acid with one having similar physico-chemical properties (such as, for example, acidic, basic, hydrophobic, and the like); "Function-conservative" variants also include any polypeptides that have the ability to elicit antibodies specific to a designated polypeptide.

An "S. epidermidis-derived" nucleic acid or polypeptide sequence may or may not be present in other bacterial species, and may or may not be present in all S. epidermidis strains. This term is intended to refer to the source from which the sequence was originally isolated. Thus, a S. epidermidis-derived polypeptide, as used herein, may be used, e.g., as a target to screen for a broad spectrum antibacterial agent, to search for homologous proteins in other species of bacteria or in eukaryotic organisms such as fungi and humans, etc.

A purified or isolated polypeptide or a substantially pure preparation of a polypeptide are used interchangeably herein and, as used herein, mean a polypeptide that has been separated from other proteins, lipids, and nucleic acids with which it naturally occurs. Preferably, the polypeptide is also separated from substances, e.g., antibodies or gel matrix, e.g., polyacrylamide, which are used to purify it. Preferably, the polypeptide constitutes at least 10, 20, 50 70, 80 or 95% dry weight of the purified preparation. Preferably, the preparation contains: sufficient polypeptide to allow protein sequencing; at least 1, 10, or 100 mg of the polypeptide.

A purified preparation of cells refers to, in the case of plant or animal cells, an in vitro preparation of cells and not an entire intact plant or animal. In the case of cultured cells or microbial cells, it consists of a preparation of at least 10% and more preferably 50% of the subject cells.

A purified or isolated or a substantially pure nucleic acid, e.g., a substantially pure DNA, (are terms used interchangeably herein) is a nucleic acid which is one or both of the following: not immediately contiguous with both of the coding sequences with which it is immediately contiguous (i.e., one at the 5' end and one at the 3' end) in the naturally-occurring genome of the organism from which the nucleic acid is derived; or which is substantially free of a nucleic acid with which it occurs in the organism from which the nucleic acid is derived. The term includes, for example, a recombinant DNA which is incorporated into a vector, e.g., into an autonomously replicating plasmid or virus, or into the genomic DNA of a prokaryote or eukaryote, or which exists as a separate molecule (e.g., a cDNA or a genomic DNA fragment produced by PCR or restriction endonuclease treatment) independent of other DNA sequences. Substantially pure DNA also includes recombinant DNA which is part of a hybrid gene encoding additional S. epidermidis DNA sequence.

A "contig" as used herein is a nucleic acid representing a continuous stretch of genomic sequence of an organism.

An "open reading frame", also referred to herein as ORF, is a region of nucleic acid which encodes a polypeptide. This region may represent a portion of a coding sequence or a total sequence and can be determined from a stop to stop codon or from a start to stop codon.

As used herein, a "coding sequence" is a nucleic acid which is transcribed into messenger RNA and/or translated into a polypeptide when placed under the control of appropriate regulatory sequences. The boundaries of the coding sequence are determined by a translation start codon at the five prime terminus and a translation stop code at the three prime terminus. A coding sequence can include but is not limited to messenger RNA, synthetic DNA, and recombinant nucleic acid sequences.

A "complement" of a nucleic acid as used herein refers to an anti-parallel or antisense sequence that participates in Watson-Crick base-pairing with the original sequence.

A "gene product" is a protein or structural RNA which is specifically encoded by a gene.

As used herein, the term "probe" refers to a nucleic acid, peptide or other chemical entity which specifically binds to a molecule of interest. Probes are often associated with or capable of associating with a label. A label is a chemical moiety capable of detection. Typical labels comprise dyes, radioisotopes, luminescent and chemiluminescent moieties, fluorophores, enzymes, precipitating agents, amplification sequences, and the like. Similarly, a nucleic acid, peptide or other chemical entity which specifically binds to a molecule of interest and immobilizes such molecule is referred herein as a "capture ligand". Capture ligands are typically associated with or capable of associating with a support such as nitrocellulose, glass, nylon membranes, beads, particles and the like. The specificity of hybridization is dependent on conditions such as the base pair composition of the nucleotides, and the temperature and salt concentration of the reaction. These conditions are readily discernable to one of ordinary skill in the art using routine experimentation.

"Homologous" refers to the sequence similarity or sequence identity between two polypeptides or between two nucleic acid molecules. When a position in both of the two compared sequences is occupied by the same base or amino acid monomer subunit, e.g., if a position in each of two DNA molecules is occupied by adenine, then the molecules are homologous at that position. The percent of homology between two sequences is a function of the number of matching or homologous positions shared by the two sequences divided by the number of positions compared×100. For example, if 6 of 10 of the positions in two sequences are matched or homologous then the two sequences are 60% homologous. By way of example, the DNA sequences ATTGCC and TATGGC share 50% homology. Generally, a comparison is made when two sequences are aligned to give maximum homology.

Nucleic acids are hybridizable to each other when at least one strand of a nucleic acid can anneal to the other nucleic acid under defined stringency conditions. Stringency of hybridization is determined by: (a) the temperature at which hybridization and/or washing is performed; and (b) the ionic strength and polarity of the hybridization and washing solutions. Hybridization requires that the two nucleic acids contain complementary sequences; depending on the stringency of hybridization, however, mismatches may be tolerated. Typically, hybridization of two sequences at high stringency (such as, for example, in a solution of 0.5× SSC, at 65° C.) requires that the sequences be essentially completely homologous. Conditions of intermediate stringency (such as, for example, 2× SSC at 65° C.) and low stringency (such as, for example 2×SSC at 55° C.), require correspondingly less overall complementarity between the hybridizing sequences. (1× SSC is 0.15 M NaCl, 0.015 M Na citrate).

The terms peptides, proteins, and polypeptides are used interchangeably herein.

As used herein, the term "surface protein" refers to all surface accessible proteins, e.g. inner and outer membrane proteins, proteins adhering to the cell wall, and secreted proteins.

A polypeptide has S. epidermidis biological activity if it has one, two and preferably more of the following properties: (1) if when expressed in the course of a S. epidermidis infection, it can promote, or mediate the attachment of S. epidermidis to a cell; (2) it has an enzymatic activity, structural or regulatory function characteristic of a S. epidermidis protein; (3) or the gene which encodes it can rescue a lethal mutation in a S. epidermidis gene. A polypeptide has biological activity if it is an antagonist, agonist, or super-agonist of a polypeptide having one of the above-listed properties.

A biologically active fragment or analog is one having an in vivo or in vitro activity which is characteristic of the S. epidermidis polypeptides of the invention contained in the Sequence Listing, or of other naturally occurring S. epidermidis polypeptides, e.g., one or more of the biological activities described herein. Especially preferred are fragments which exist in vivo, e.g., fragments which arise from post transcriptional processing or which arise from translation of alternatively spliced RNA's. Fragments include those expressed in native or endogenous cells as well as those made in expression systems, e.g., in CHO (Chinese Hamster Ovary) cells. Because peptides such as S. epidermidis polypeptides often exhibit a range of physiological properties and because such properties may be attributable to different portions of the molecule, a useful S. epidermidis fragment or S. epidermidis analog is one which exhibits a biological activity in any biological assay for S. epidermidis activity. Most preferably the fragment or analog possesses 10%, preferably 40%, more preferably 60%, 70%, 80% or 90% or greater of the activity of S. epidermidis, in any in vivo or in vitro assay.

Analogs can differ from naturally occurring S. epidermidis polypeptides in amino acid sequence or in ways that do not involve sequence, or both. Non-sequence modifications include changes in acetylation, methylation, phosphorylation, carboxylation, or glycosylation. Preferred analogs include S. epidermidis polypeptides (or biologically active fragments thereof) whose sequences differ from the wild-type sequence by one or more conservative amino acid substitutions or by one or more non-conservative amino acid substitutions, deletions, or insertions which do not substantially diminish the biological activity of the S. epidermidis polypeptide. Conservative substitutions typically include the substitution of one amino acid for another with similar characteristics, e.g., substitutions within the following groups: valine, glycine; glycine, alanine; valine, isoleucine, leucine; aspartic acid, glutamic acid; asparagine, glutamine; serine, threonine; lysine, arginine; and phenylalanine, tyrosine. Other conservative substitutions can be made in view of the table below.

TABLE 1

CONSERVATIVE AMINO ACID REPLACEMENTS

| For Amino Acid | Code | Replace with any of |
|---|---|---|
| Alanine | A | D-Ala, Gly, beta-Ala, L-Cys, D-Cys |
| Arginine | R | D-Arg, Lys, D-Lys, homo-Arg, D-homo-Arg, Met, Ile, D-Met, D-Ile, Orn, D-Orn |
| Asparagine | N | D-Asn, Asp, D-Asp, Glu, D-Glu, Gln, D-Gln |
| Aspartic Acid | D | D-Asp, D-Asn, Asn, Glu, D-Glu, Gln, D-Gln |
| Cysteine | C | D-Cys, S-Me-Cys, Met, D-Met, Thr, D-Thr |
| Glutamine | Q | D-Gln, Asn, D-Asn, Glu, D-Glu, Asp, D-Asp |
| Glutamic Acid | E | D-Glu, D-Asp, Asp, Asn, D-Asn, Gln, D-Gln |
| Glycine | G | Ala, D-Ala, Pro, D-Pro, β-Ala, Acp |
| Isoleucine | I | D-Ile, Val, D-Val,Leu, D-Leu, Met, D-Met |
| Leucine | L | D-Leu, Val, D-Val, Leu, D-Leu, Met, D-Met |
| Lysine | K | D-Lys, Arg, D-Arg, homo-Arg, D-homo-Arg, Met, D-Met, Ile, D-Ile, Orn, D-Orn |
| Methionine | M | D-Met, S-Me-Cys, Ile, D-Ile, Leu, D-Leu, Val, D-Val |
| Phenylalanine | F | D-Phe, Tyr, D-Thr, L-Dopa, His, D-His, Trp, D-Trp, Trans-3,4, or 5-phenylproline, cis-3,4, or 5-phenylproline |
| Proline | P | D-Pro, L-I-thioazolidine-4-carboxylic acid, D-or L-1-oxazolidine-4-carboxylic acid |
| Serine | S | D-Ser, Thr, D-Thr, allo-Thr, Met, D-Met, Met(O), D-Met(O), L-Cys, D-Cys |
| Threonine | T | D-Thr, Ser, D-Ser, allo-Thr, Met, D-Met, Met(O), D-Met(O), Val, D-Val |
| Tyrosine | Y | D-Tyr, Phe, D-Phe, L-Dopa, His, D-His |
| Valine | V | D-Val, Leu, D-Leu, Ile, D-Ile, Met, D-Met |

Other analogs within the invention are those with modifications which increase peptide stability; such analogs may contain, for example, one or more non-peptide bonds (which replace the peptide bonds) in the peptide sequence. Also included are: analogs that include residues other than naturally occurring L-amino acids, e.g., D-amino acids or non-naturally occurring or synthetic amino acids, e.g., β or γ amino acids; and cyclic analogs.

As used herein, the term "fragment", as applied to a S. epidermidis analog, will ordinarily be at least about 20 residues, more typically at least about 40 residues, preferably at least about 60 residues in length. Fragments of S. epidermidis polypeptides can be generated by methods known to those skilled in the art. The ability of a Staphylococcus fragment to exhibit a biological activity of S. epidermidis polypeptide can be assessed by methods known to those skilled in the art as described herein. Also included are S. epidermidis polypeptides containing residues that are not required for biological activity of the peptide or that result from alternative mRNA splicing or alternative protein processing events.

An "immunogenic component" as used herein is a moiety, such as a S. epidermidis polypeptide, analog or fragment thereof, that is capable of eliciting a humoral and/or cellular immune response in a host animal.

An "antigenic component" as used herein is a moiety, such as a S. epidermidis polypeptide, analog or fragment thereof, that is capable of binding to a specific antibody with sufficiently high affinity to form a detectable antigen-antibody complex.

The term "antibody" as used herein is intended to include fragments thereof which are specifically reactive with S. epidermidis polypeptides.

As used herein, the term "cell-specific promoter" means a DNA sequence that serves as a promoter, i.e., regulates expression of a selected DNA sequence operably linked to the promoter, and which effects expression of the selected DNA sequence in specific cells of a tissue. The term also covers so-called "leaky" promoters, which regulate expression of a selected DNA primarily in one tissue, but cause expression in other tissues as well.

Misexpression, as used herein, refers to a non-wild type pattern of gene expression. It includes: expression at non-wild type levels, i.e., over or under expression; a pattern of expression that differs from wild type in terms of the time or stage at which the gene is expressed, e.g., increased or decreased expression (as compared with wild type) at a pre-determined developmental period or stage; a pattern of expression that differs from wild type in terms of increased expression (as compared with wild type) in a predetermined cell type or tissue type; a pattern of expression that differs from wild type in terms of the splicing size, amino acid sequence, post-translational modification, or biological activity of the expressed polypeptide; a pattern of expression that differs from wild type in terms of the effect of an environmental stimulus or extracellular stimulus on expression of the gene, e.g., a pattern of increased or decreased expression (as compared with wild type) in the presence of an increase or decrease in the strength of the stimulus.

As used herein, "host cells" and other such terms denoting microorganisms or higher eukaryotic cell lines cultured as unicellular entities refers to cells which can become or have been used as recipients for a recombinant vector or other transfer DNA, and include the progeny of the original cell which has been transfected. It is understood by individuals skilled in the art that the progeny of a single parental cell may not necessarily be completely identical in genomic or total DNA compliment to the original parent, due to accident or deliberate mutation.

As used herein, the term "control sequence" refers to a nucleic acid having a base sequence which is recognized by the host organism to effect the expression of encoded sequences to which they are ligated. The nature of such control sequences differs depending upon the host organism; in prokaryotes, such control sequences generally include a promoter, ribosomal binding site, terminators, and in some cases operators; in eukaryotes, generally such control sequences include promoters, terminators and in some instances, enhancers. The term control sequence is intended to include at a minimum, all components whose presence is necessary for expression, and may also include additional components whose presence is advantageous, for example, leader sequences.

As used herein, the term "operably linked" refers to sequences joined or ligated to function in their intended manner. For example, a control sequence is operably linked to coding sequence by ligation in such a way that expression of the coding sequence is achieved under conditions compatible with the control sequence and host cell.

The "metabolism" of a substance, as used herein, means any aspect of the expression, function, action, or regulation of the substance. The metabolism of a substance includes modifications, e.g., covalent or non-covalent modifications of the substance. The metabolism of a substance includes modifications, e.g., covalent or non-covalent modification, the substance induces in other substances. The metabolism of a substance also includes changes in the distribution of the substance. The metabolism of a substance includes changes the substance induces in the distribution of other substances.

A "sample" as used herein refers to a biological sample, such as, for example, tissue or fluid isloated from an individual (including without limitation plasma, serum, cerebrospinal fluid, lymph, tears, saliva and tissue sections) or from in vitro cell culture constituents, as well as samples from the environment.

Technical and scientific terms used herein have the meanings commonly understood by one of ordinary skill in the art to which the present invention pertains, unless otherwise defined. Reference is made herein to various methodologies known to those of skill in the art. Publications and other materials setting forth such known methodologies to which reference is made are incorporated herein by reference in their entireties as though set forth in full. The practice of the invention will employ, unless otherwise indicated, conventional techniques of chemistry, molecular biology, microbiology, recombinant DNA, and immunology, which are within the skill of the art. Such techniques are explained fully in the literature. See e.g., Sambrook, Fritsch, and Maniatis, *Molecular Cloning; Laboratory Manual* 2nd ed. (1989); *DNA Cloning*, Volumes I and II (D. N Glover ed. 1985); *Oligonucleotide Synthesis* (M. J. Gait ed, 1984); *Nucleic Acid Hybridization* (B. D. Hames & S. J. Higgins eds. 1984); the series, *Methods in Enzymoloqy* (Academic Press, Inc.), particularly Vol. 154 and Vol. 155 (Wu and Grossman, eds.); *PCR-A Practical Approach* (McPherson, Quirke, and Taylor, eds., 1991); *Immunology*, 2d Edition, 1989, Roitt et al., C. V. Mosby Company, and New York; *Advanced Immunology*, 2d Edition, 1991, Male et al., Grower Medical Publishing, New York; *DNA Cloning: A Practical Approach*, Volumes I and II, 1985 (D. N. Glover ed.); *Oligonucleotide Synthesis*, 1984, (M. L. Gait ed); *Transcription and Translation*, 1984 (Hames and Higgins ed.); *Animal Cell Culture*, 1986 (R. I. Freshney ed.); *Immobilized Cells and Enzymes*, 1986 (IRL Press); Perbal, 1984, *A Practical Guide to Molecular Cloning; and Gene Transfer Vectors for Mammalian Cells*, 1987 (J. H. Miller and M. P. Calos eds., Cold Spring Harbor Laboratory);

Any suitable materials and/or methods known to those of skill can be utilized in carrying out the present invention: however preferred materials and/or methods are described. Materials, reagents and the like to which reference is made in the following description and examples are obtainable from commercial sources, unless otherwise noted.

*S. epidermidis* Genomic Sequence

This invention provides nucleotide sequences of the genome of *S. epidermidis* which thus comprises a DNA sequence library of *S. epidermidis* genomic DNA. The detailed description that follows provides nucleotide sequences of *S. epidermidis*, and also describes how the sequences were obtained and how ORFs and protein-coding sequences were identified. Also described are methods of using the disclosed *S. epidermidis* sequences in methods including diagnostic and therapeutic applications. Furthermore, the library can be used as a database for identification and comparison of medically important sequences in this and other strains of *S. epidermidis*.

To determine the genomic sequence of *S. epidermidis*, DNA from strain 18972 of *S. epidermidis* was isolated after Zymolyase digestion, sodium dodecyl sulfate lysis, potassium acetate precipitation, phenol:chloroform extraction and ethanol precipitation (Soll, D. R., T. Srikantha and S. R. Lockhart: Characterizing Developmentally Regulated Genes in *S. epidermidis*. In Microbial Genome Methods. K. W. Adolph, editor. CRC Press. New York. p 17-37.). DNA was sheared hydrodynamically using an HPLC (Oefner, et. al., 1996) to an insert size of 2000-3000 bp. After size fractionation by gel electrophoresis the fragments were blunt-ended, ligated to adapter oligonucleotides and cloned into the pGTC (Thomann) vector to construct a "shotgun" subclone library DNA sequencing was achieved using established ABI sequencing methods on ABI377 automated DNA sequencers. The cloning and sequencing procedures are described in more detail in the Exemplification.

Individual sequence reads were assembled using PHRAP (P. Green, Abstracts of DOE Human Genome Program Contractor-Grantee Workshop V, January 1996, p. 157). The average contig length was about 3-4 kb.

All subsequent steps were based on sequencing by ABI377 automated DNA sequencing methods. The cloning and sequencing procedures are described in more detail in the Exemplification.

A variety of approaches are used to order the contigs so as to obtain a continuous sequence representing the entire S. epidermidis genome. Synthetic oligonucleotides are designed that are complementary to sequences at the end of each contig. These oligonucleotides may be hybridized to libaries of S. epidermidis genomic DNA in, for example, lambda phage vectors or plasmid vectors to identify clones that contain sequences corresponding to the junctional regions between individual contigs. Such clones are then used to isolate template DNA and the same oligonucleotides are used as primers in polymerase chain reaction (PCR) to amplify junctional fragments, the nucleotide sequence of which is then determined.

The S. epidermidis sequences were analyzed for the presence of open reading frames (ORFs) comprising at least 180 nucleotides. As a result of the analysis of ORFs based on stop-to-stop codon reads, it should be understood that these ORFs may not correspond to the ORF of a naturally-occurring S. epidermidis polypeptide. These ORFs may contain start codons which indicate the initiation of protein synthesis of a naturally-occurring S. epidermidis polypeptide. Such start codons within the ORFs provided herein were identified by those of ordinary skill in the relevant art, and the resulting ORF and the encoded S. epidermidis polypeptide is within the scope of this invention. For example, within the ORFs a codon such as AUG or GUG (encoding methionine or valine) which is part of the initiation signal for protein synthesis were identified and the portion of an ORF to corresponding to a naturally-occurring S. epidermidis polypeptide was recognized. The predicted coding regions were defined by evaluating the coding potential of such sequences with the program GENEMRIK™ (Borodovsky and McIninch, 1993, Comp. 17:123).

Each predicted ORF amino acid sequence was compared with all sequences found in current GENBANK, SWISS-PROT, and PIR databases using the BLAST algorithm. BLAST identifies local alignments occurring by chance between the ORF sequence and the sequence in the databank (Altschal et al., 1990, L Mol. Biol. 215:403-410). Homologous ORFs (probabilities less than $10^{-5}$ by chance) and ORF's that are probably non-homologous (probabilities greater than $10^{-5}$ by chance) but have good codon usage were identified. Both homologous, sequences and non-homologous sequences with good codon usage, are likely to encode proteins and are encompassed by the invention.

S. epidermidis Nucleic Acids

The present invention provides a library of S. epidermidis-derived nucleic acid sequences. The libraries provide probes, primers, and markers which are used as markers in epidemiological studies. The present invention also provides a library of S. epidermidis-derived nucleic acid sequences which comprise or encode targets for therapeutic drugs.

The nucleic acids of this invention may be obtained directly from the DNA of the above referenced S. epidermidis strain by using the polymerase chain reaction (PCR). See "PCR, A Practical Approach" (McPherson, Quirke, and Taylor, eds., IRL Press, Oxford, UK, 1991) for details about the PCR. High fidelity PCR is used to ensure a faithful DNA copy prior to expression. In addition, the authenticity of amplified products is verified by conventional sequencing methods. Clones carrying the desired sequences described in this invention may also be obtained by screening the libraries by means of the PCR or by hybridization of synthetic oligonucleotide probes to filter lifts of the library colonies or plaques as known in the art (see, e.g., Sambrook et al., Molecular Cloning, A Laboratory Manual 2nd edition, 1989, Cold Spring Harbor Press, NY).

It is also possible to obtain nucleic acids encoding S. epidermidis polypeptides from a cDNA library in accordance with protocols herein described. A cDNA encoding a S. epidermidis polypeptide can be obtained by isolating total mRNA from an appropriate strain. Double stranded cDNAs can then be prepared from the total mRNA. Subsequently, the cDNAs can be inserted into a suitable plasmid or viral (e.g., bacteriophage) vector using any one of a number of known techniques. Genes encoding S. epidermidis polypeptides can also be cloned using established polymerase chain reaction techniques in accordance with the nucleotide sequence information provided by the invention. The nucleic acids of the invention can be DNA or RNA. Preferred nucleic acids of the invention are contained in the Sequence Listing.

The nucleic acids of the invention can also be chemically synthesized using standard techniques. Various methods of chemically synthesizing polydeoxynucleotides are known, including solid-phase synthesis which, like peptide synthesis, has been fully automated in commercially available DNA synthesizers (See e.g., Itakura et al. U.S. Pat. No. 4,598,049; Caruthers et al. U.S. Pat. No. 4,458,066; and Itakura U.S. Pat. Nos. 4,401,796 and 4,373,071, incorporated by reference herein).

In another example, DNA can be chemically synthesized using, e.g., the phosphoramidite solid support method of Matteucci et al., 1981, J. Am. Chem. Soc. 103:3185, the method of Yoo et al., 1989, J. Biol. Chem. 764:17078, or other well known methods. This can be done by sequentially linking a series of oligonucleotide cassettes comprising pairs of synthetic oligonucleotides, as described below.

Nucleic acids isolated or synthesized in accordance with features of the present invention are useful, by way of example, without limitation, as probes, primers, capture ligands, antisense genes and for developing expression systems for the synthesis of proteins and peptides corresponding to such sequences. As probes, primers, capture ligands and antisense agents, the nucleic acid normally consists of all or part (approximately twenty or more nucleotides for specificity as well as the ability to form stable hybridization products) of the nucleic acids of the invention contained in the Sequence Listing. These uses are described in further detail below.

Probes

A nucleic acid isolated or synthesized in accordance with the sequence of the invention contained in the Sequence Listing can be used as a probe to specifically detect S. epidermidis. With the sequence information set forth in the present application, sequences of twenty or more nucleotides are identified which provide the desired inclusivity and exclusivity with respect to S. epidermidis, and extraneous nucleic acids likely to be encountered during hybridization conditions. More preferably, the sequence will comprise at least twenty to thirty nucleotides to convey stability to the hybridization product formed between the probe and the intended target molecules.

Sequences larger than 1000 nucleotides in length are difficult to synthesize but can be generated by recombinant DNA techniques. Individuals skilled in the art will readily recognize that the nucleic acids, for use as probes, can be provided with a label to facilitate detection of a hybridization product.

Nucleic acid isolated and synthesized in accordance with the sequence of the invention contained in the Sequence Listing can also be useful as probes to detect homologous regions (especially homologous genes) of other *Staphylococcus* species using appropriate stringency hybridization conditions as described herein.

Capture Ligand

For use as a capture ligand, the nucleic acid selected in the manner described above with respect to probes, can be readily associated with a support. The manner in which nucleic acid is associated with supports is well known. Nucleic acid having twenty or more nucleotides in a sequence of the invention contained in the Sequence Listing have utility to separate *S. epidermidis* nucleic acid from one strain from the nucleic acid of other another strain as well as from other organisms. Nucleic acid having twenty or more nucleotides in a sequence of the invention contained in the Sequence Listing can also have utility to separate other *Staphylococcus* species from each other and from other organisms. Preferably, the sequence will comprise at least twenty nucleotides to convey stability to the hybridization product formed between the probe and the intended target molecules. Sequences larger than 1000 nucleotides in length are difficult to synthesize but can be generated by recombinant DNA techniques.

Primers

Nucleic acid isolated or synthesized in accordance with the sequences described herein have utility as primers for the amplification of *S. epidermidis* nucleic acid. These nucleic acids may also have utility as primers for the amplification of nucleic acids in other *Staphylococcus* species. With respect to polymerase chain reaction (PCR) techniques, nucleic acid sequences of ≧10-15 nucleotides of the invention contained in the Sequence Listing have utility in conjunction with suitable enzymes and reagents to create copies of *S. epidermidis* nucleic acid. More preferably, the sequence will comprise twenty or more nucleotides to convey stability to the hybridization product formed between the primer and the intended target molecules. Binding conditions of primers greater than 100 nucleotides are more difficult to control to obtain specificity. High fidelity PCR can be used to ensure a faithful DNA copy prior to expression. In addition, amplified products can be checked by conventional sequencing methods.

The copies can be used in diagnostic assays to detect specific sequences, including genes from *S. epidermidis* and/or other *Staphylococcus* species. The copies can also be incorporated into cloning and expression vectors to generate polypeptides corresponding to the nucleic acid synthesized by PCR, as is described in greater detail herein.

The nucleic acids of the present invention find use as templates for the recombinant production of *S. epidermidis*-derived peptides or polypeptides Antisense Nucleic acid or nucleic acid-hybridizing derivatives isolated or synthesized in accordance with the sequences described herein have utility as antisense agents to prevent the expression of *S. epidermidis* genes. These sequences also have utility as antisense agents to prevent expression of genes of other *Staphylococcus* species.

In one embodiment, nucleic acid or derivatives corresponding to *S. epidermidis* nucleic acids is loaded into a suitable carrier such as a liposome or bacteriophage for introduction into bacterial cells. For example, a nucleic acid having twenty or more nucleotides is capable of binding to bacteria nucleic acid or bacteria messenger RNA. Preferably, the antisense nucleic acid is comprised of 20 or more nucleotides to provide necessary stability of a hybridization product of non-naturally occurring nucleic acid and bacterial nucleic acid and/or bacterial messenger RNA. Nucleic acid having a sequence greater than 1000 nucleotides in length is difficult to synthesize but can be generated by recombinant DNA techniques. Methods for loading antisense nucleic acid in liposomes is known in the art as exemplified by U.S. Pat. No. 4,241,046 issued Dec. 23, 1980 to Papahadjopoulos et al.

The present invention encompasses isolated polypeptides and nucleic acids derived from *S. epidermidis* that are useful as reagents for diagnosis of bacterial infection, components of effective anti-bacterial vaccines, and/or as targets for anti-bacterial drugs, including anti-S epidermidis drugs.

Expression of *S. epidermidis* Nucleic Acids

Table 2, which is appended herewith and which forms part of the present specification, provides a list of open reading frames (ORFs) in both strands and a putative identification of the particular function of a polypeptide which is encoded by each ORF, based on the homology match (determined by the BLAST algorithm) of the predicted polypeptide with known proteins encoded by ORFs in other organisms. An ORF is a region of nucleic acid which encodes a polypeptide. This region may represent a portion of a coding sequence or a total sequence and was determined from stop to stop codons. The first column contains a designation for the contig from which each ORF was identified (numbered arbitrarily). Each contig represents a continuous stretch of the genomic sequence of the organism. The second column lists the ORF designation. The third and fourth columns list the SEQ ID numbers for the nucleic acid and amino acid sequences corresponding to each ORF, respectively. The fifth and sixth columns list the length of the nucleic acid and the length of the amino acid, respectively. The nucleotide sequence corresponding to each ORF designation begins at the first nucleotide immediately following a stop codon and ends at the nucleotide immediately preceding the next downstream stop codon in the same reading frame. It will be recognized by one skilled in the art that the natural translation initiation sites will correspond to ATG, GTG, or TTG codons located within the ORFs. The natural initiation sites depend not only on the sequence of a start codon but also on the context of the DNA sequence adjacent to the start codon. Usually, a recognizable ribosome binding site is found within 20 nucleotides upstream from the initiation codon. In some cases where genes are translationally coupled and coordinately expressed together in "operons", ribosome binding sites are not present, but the initiation codon of a downstream gene may occur very close to, or overlap, the stop codon of the an upstream gene in the same operon. The correct start codons can be generally identified without undue experimentation because only a few codons need be tested. It is recognized that the translational machinery in bacteria initiates all polypeptide chains with the amino acid methionine, regardless of the sequence of the start codon. In some cases, polypeptides are post-translationally modified, resulting in an N-terminal amino acid other than methionine in vivo. The seventh and eighth columns provide metrics for assessing the likelihood of the homology match (determined by the BLASTP2 algorithm), as is known in the art, to the genes indicated in the eleventh column when the designated ORF was compared against a non-redundant comprehensive protein database. Specifically, the seventh column represents the "Blast Score" for the match (a higher score is a better match), and the eighth column represents the "P-value"

for the match (the probability that such a match can have occurred by chance; the lower the value, the more likely the match is valid). If a BLASTP2 score of less than 46 was obtained, no value is reported in the table the "P-value". Column nine, Subject Taxonomy," provides the name of the organism that was identified as having the closest homology match. The tenth column, "Subject Name," provides where available, either a public database accession number or our own sequence name. The eleventh column provides, where available, the Swissprot accession number (SP), the locus name (LN), the Organism (OR), Source of variant (SR), E.C. number (EC), the gene name (GN), the product name (PN), the Function Description (FN), Left End (LE), Right End (RE), Coding Direction (DI), and the description (DE) or notes (NT) for each ORF. Information that is not preceded by a code designation in the eleventh column represents a description of the ORF. This information allows one of ordinary skill in the art to determine a potential use for each identified coding sequence and, as a result, allows use of the polypeptides of the present invention for commercial and industrial purposes.

Using the information provided in SEQ ID NO: 1-SEQ ID NO: 2837 and in Table 2 together with routine cloning and sequencing methods, one of ordinary skill in the art will be able to clone and sequence all the nucleic acid fragments of interest including open reading frames (ORFs) encoding a large variety proteins of S. epidermidis.

Nucleic acid isolated or synthesized in accordance with the sequences described herein have utility to generate polypeptides. The nucleic acid of the invention exemplified in SEQ ID NO: 1-SEQ ID NO: 2837 and in Table 2 or fragments of said nucleic acid encoding active portions of S. epidermidis polypeptides can be cloned into suitable vectors or used to isolate nucleic acid. The isolated nucleic acid is combined with suitable DNA linkers and cloned into a suitable vector.

The function of a specific gene or operon can be ascertained by expression in a bacterial strain under conditions where the activity of the gene product(s) specified by the gene or operon in question can be specifically measured. Alternatively, a gene product may be produced in large quantities in an expressing strain for use as an antigen, an industrial reagent, for structural studies, etc. This expression can be accomplished in a mutant strain which lacks the activity of the gene to be tested, or in a strain that does not produce the same gene product(s). This includes, but is not limited to, Eucaryotic species such as the yeast *Saccharomyces cerevisiae, Methanobacterium* strains or other Archaea, and Eubacteria such as *E. coli, B. Subtilis, S. Aureus, S. Pneumonia* or *Pseudomonas putida*. In some cases the expression host will utilize the natural *S. epidermidis* promoter whereas in others, it will be necessary to drive the gene with a promoter sequence derived from the expressing organism (e.g., an *E. coli* beta-galactosidase promoter for expression in *E. coli*).

To express a gene product using the natural *S. epidermidis* promoter, a procedure such as the following can be used. A restriction fragment containing the gene of interest, together with its associated natural promoter element and regulatory sequences (identified using the DNA sequence data) is cloned into an appropriate recombinant plasmid containing an origin of replication that functions in the host organism and an appropriate selectable marker. This can be accomplished by a number of procedures known to those skilled in the art. It is most preferably done by cutting the plasmid and the fragment to be cloned with the same restriction enzyme to produce compatible ends that can be ligated to join the two pieces together. The recombinant plasmid is introduced into the host organism by, for example, electroporation and cells containing the recombinant plasmid are identified by selection for the marker on the plasmid. Expression of the desired gene product is detected using an assay specific for that gene product.

In the case of a gene that requires a different promoter, the body of the gene (coding sequence) is specifically excised and cloned into an appropriate expression plasmid. This subcloning can be done by several methods, but is most easily accomplished by PCR amplification of a specific fragment and ligation into an expression plasmid after treating the PCR product with a restriction enzyme or exonuclease to create suitable ends for cloning.

A suitable host cell for expression of a gene can be any procaryotic or eucaryotic cell. Suitable methods for transforming host cells can be found in Sambrook et al. (*Molecular Cloning: A Laboratory Manual*, 2nd Edition, Cold Spring Harbor Laboratory press (1989)), and other laboratory textbooks.

For example, a host cell transfected with a nucleic acid vector directing expression of a nucleotide sequence encoding a *S. epidermidis* polypeptide can be cultured under appropriate conditions to allow expression of the polypeptide to occur. Suitable media for cell culture are well known in the art. Polypeptides of the invention can be isolated from cell culture medium, host cells, or both using techniques known in the art for purifying proteins including ion-exchange chromatography, gel filtration chromatography, ultrafiltration, electrophoresis, and immunoaffinity purification with antibodies specific for such polypeptides. Additionally, in many situations, polypeptides can be produced by chemical cleavage of a native protein (e.g., tryptic digestion) and the cleavage products can then be purified by standard techniques.

In the case of membrane bound proteins, these can be isolated from a host cell by contacting a membrane-associated protein fraction with a detergent forming a solubilized complex, where the membrane-associated protein is no longer entirely embedded in the membrane fraction and is solubilized at least to an extent which allows it to be chromatographically isolated from the membrane fraction. Chromatographic techniques which can be used in the final purification step are known in the art and include hydrophobic interaction, lectin affinity, ion exchange, dye affinity and immunoaffinity.

One strategy to maximize recombinant *S. epidermidis* peptide expression in *E. coli* is to express the protein in a host bacteria with an impaired capacity to proteolytically cleave the recombinant protein (Gottesman, S., *Gene Expression Technology: Methods in Enzymology* 185, Academic Press, San Diego, Calif. (1990) 119-128). Another strategy would be to alter the nucleic acid encoding a *S. epidermidis* peptide to be inserted into an expression vector so that the individual codons for each amino acid would be those preferentially utilized in highly expressed *E. coli* proteins (Wada et al., (1992) *Nuc. Acids Res.* 20:2111-2118). Such alteration of nucleic acids of the invention can be carried out by standard DNA synthesis techniques.

The nucleic acids of the invention can also be chemically synthesized using standard techniques. Various methods of chemically synthesizing polydeoxynucleotides are known, including solid-phase synthesis which, like peptide synthesis, has been fully automated in commercially available DNA synthesizers (See, e.g., Itakura et al. U.S. Pat. No. 4,598,049; Caruthers et al. U.S. Pat. No. 4,458,066; and Itakura U.S. Pat. Nos. 4,401,796 and 4,373,071, incorporated by reference herein).

The present invention provides a library of *S. epidermidis*-derived nucleic acid sequences. The libraries provide probes, primers, and markers which can be used as markers in epidemiological studies. The present invention also provides a library of *S. epidermidis*-derived nucleic acid sequences which comprise or encode targets for therapeutic drugs.

Nucleic acids comprising any of the sequences disclosed herein or sub-sequences thereof can be prepared by standard methods using the nucleic acid sequence information provided in SEQ ID NO: 1-SEQ ID NO: 2837. For example, DNA can be chemically synthesized using, e.g., the phosphoramidite solid support method of Matteucci et al., 1981, *J. Am. Chem. Soc.* 103:3185, the method of Yoo et al., 1989, *J. Biol. Chem.* 764:17078, or other well known methods. This can be done by sequentially linking a series of oligonucleotide cassettes comprising pairs of synthetic oligonucleotides, as described below.

Of course, due to the degeneracy of the genetic code, many different nucleotide sequences can encode polypeptides having the amino acid sequences defined by SEQ ID NO: 2838-SEQ ID NO: 5674 or sub-sequences thereof. The codons can be selected for optimal expression in prokaryotic or eukaryotic systems. Such degenerate variants are also encompassed by this invention.

Insertion of nucleic acids (typically DNAs) encoding the polypeptides of the invention into a vector is easily accomplished when the termini of both the DNAs and the vector comprise compatible restriction sites. If this cannot be done, it may be necessary to modify the termini of the DNAs and/or vector by digesting back single-stranded DNA overhangs generated by restriction endonuclease cleavage to produce blunt ends, or to achieve the same result by filling in the single-stranded termini with an appropriate DNA polymerase.

Alternatively, any site desired may be produced, e.g., by ligating nucleotide sequences (linkers) onto the termini. Such linkers may comprise specific oligonucleotide sequences that define desired restriction sites. Restriction sites can also be generated by the use of the polymerase chain reaction (PCR). See, e.g., Saiki et al., 1988, *Science* 239:48. The cleaved vector and the DNA fragments may also be modified if required by homopolymeric tailing.

The nucleic acids of the invention may be isolated directly from cells. Alternatively, the polymerase chain reaction (PCR) method can be used to produce the nucleic acids of the invention, using either chemically synthesized strands or genomic material as templates. Primers used for PCR can be synthesized using the sequence information provided herein and can further be designed to introduce appropriate new restriction sites, if desirable, to facilitate incorporation into a given vector for recombinant expression.

The nucleic acids of the present invention may be flanked by natural *S. epidermidis* regulatory sequences, or may be associated with heterologous sequences, including promoters, enhancers, response elements, signal sequences, polyadenylation sequences, introns, 5'- and 3'-noncoding regions, and the like. The nucleic acids may also be modified by many means known in the art. Non-limiting examples of such modifications include methylation, "caps", substitution of one or more of the naturally occurring nucleotides with an analog, internucleotide modifications such as, for example, those with uncharged linkages (e.g., methyl phosphonates, phosphotriesters, phosphoroamidates, carbamates, etc.) and with charged linkages (e.g., phosphorothioates, phosphorodithioates, etc.). Nucleic acids may contain one or more additional covalently linked moieties, such as, for example, proteins (e.g., nucleases, toxins, antibodies, signal peptides, poly-L-lysine, etc.), intercalators (e.g., acridine, psoralen, etc.), chelators (e.g., metals, radioactive metals, iron, oxidative metals, etc.), and alkylators. PNAs are also included. The nucleic acid may be derivatized by formation of a methyl or ethyl phosphotriester or an alkyl phosphoramidate linkage. Furthermore, the nucleic acid sequences of the present invention may also be modified with a label capable of providing a detectable signal, either directly or indirectly. Exemplary labels include radioisotopes, fluorescent molecules, biotin, and the like.

The invention also provides nucleic acid vectors comprising the disclosed *S. epidermidis*-derived sequences or derivatives or fragments thereof. A large number of vectors, including plasmid and bacterial vectors, have been described for replication and/or expression in a variety of eukaryotic and prokaryotic hosts, and may be used for cloning or protein expression.

The encoded *S. epidermidis* polypeptides may be expressed by using many known vectors, such as pUC plasmids, pET plasmids (Novagen, Inc., Madison, Wis.), or pRSET or pREP (Invitrogen, San Diego, Calif.), and many appropriate host cells, using methods disclosed or cited herein or otherwise known to those skilled in the relevant art. The particular choice of vector/host is not critical to the practice of the invention.

Recombinant cloning vectors will often include one or more replication systems for cloning or expression, one or more markers for selection in the host, e.g. antibiotic resistance, and one or more expression cassettes. The inserted *S. epidermidis* coding sequences may be synthesized by standard methods, isolated from natural sources, or prepared as hybrids, etc. Ligation of the *S. epidermidis* coding sequences to transcriptional regulatory elements and/or to other amino acid coding sequences may be achieved by known methods. Suitable host cells may be transformed/transfected/infected as appropriate by any suitable method including electroporation, $CaCl_2$ mediated DNA uptake, bacterial infection, microinjection, microprojectile, or other established methods.

Appropriate host cells include bacteria, archebacteria, fungi, especially yeast, and plant and animal cells, especially mammalian cells. Of particular interest are *S. epidermidis*, *E. coli*, *B. Subtilis*, *Saccharomyces cerevisiae*, *Saccharomyces carlsbergensis*, *Schizosaccharomyces pombi*, SF9 cells, C129 cells, 293 cells, *Neurospora*, and CHO cells, COS cells, HeLa cells, and immortalized mammalian myeloid and lymphoid cell lines. Preferred replication systems include M13, ColE1, SV40, baculovirus, lambda, adenovirus, and the like. A large number of transcription initiation and termination regulatory regions have been isolated and shown to be effective in the transcription and translation of heterologous proteins in the various hosts. Examples of these regions, methods of isolation, manner of manipulation, etc. are known in the art. Under appropriate expression conditions, host cells can be used as a source of recombinantly produced *S. epidermidis*-derived peptides and polypeptides.

Advantageously, vectors may also include a transcription regulatory element (i.e., a promoter) operably linked to the *S. epidermidis* portion. The promoter may optionally contain operator portions and/or ribosome binding sites. Non-limiting examples of bacterial promoters compatible with *E. coli* include: b-lactamase (penicillinase) promoter; lactose promoter; tryptophan (trp) promoter; araBAD (arabinose) operon promoter; lambda-derived $P_1$ promoter and N gene ribosome binding site; and the hybrid tac promoter derived from sequences of the trp and lac UV5 promoters. Non-limiting examples of yeast promoters include 3-phosphoglycerate kinase promoter, glyceraldehyde-3-phosphate dehydrogenase (GAPDH) promoter, galactokinase (GAL1) promoter, galactoepimerase promoter, and alcohol dehydrogenase (ADH) promoter. Suitable promoters for mammalian cells include without limitation viral promoters such as that from Simian Virus 40 (SV40), Rous sarcoma virus (RSV), adenovirus (ADV), and bovine papilloma virus (BPV). Mammalian cells may also require terminator sequences, polyA addition sequences and enhancer sequences to increase expression. Sequences which cause amplification of the gene may also be desirable. Furthermore, sequences that facilitate secretion of the recombinant product from cells, including, but not limited to, bacteria, yeast, and animal cells, such as secretory signal sequences and/or prohormone pro region sequences, may also be included. These sequences are well described in the art.

Nucleic acids encoding wild-type or variant *S. epidermidis*-derived polypeptides may also be introduced into cells by recombination events. For example, such a sequence can be introduced into a cell, and thereby effect homologous recombination at the site of an endogenous gene or a sequence with substantial identity to the gene. Other recombination-based methods such as nonhomologous recombinations or deletion of endogenous genes by homologous recombination may also be used.

The nucleic acids of the present invention find use as templates for the recombinant production of *S. epidermidis*-derived peptides or polypeptides.

Identification and Use of *S. epidermidis* Nucleic Acid Sequences

The disclosed *S. epidermidis* polypeptide and nucleic acid sequences, or other sequences that are contained within ORFs, including complete protein-coding sequences, of which any of the disclosed *S. epidermidis*-specific sequences forms a part, are useful as target components for diagnosis and/or treatment of *S. epidermidis*-caused infection It will be understood that the sequence of an entire protein-coding sequence of which each disclosed nucleic acid sequence forms a part can be isolated and identified based on each disclosed sequence. This can be achieved, for example, by using an isolated nucleic acid encoding the disclosed sequence, or fragments thereof, to prime a sequencing reaction with genomic *S. epidermidis* DNA as template; this is followed by sequencing the amplified product. The isolated nucleic acid encoding the disclosed sequence, or fragments thereof, can also be hybridized to *S. epidermidis* genomic libraries to identify clones containing additional complete segments of the protein-coding sequence of which the shorter sequence forms a part. Then, the entire protein-coding sequence, or fragments thereof, or nucleic acids encoding all or part of the sequence, or sequence-conservative or function-conservative variants thereof, may be employed in practicing the present invention.

Preferred sequences are those that are useful in diagnostic and/or therapeutic applications. Diagnostic applications include without limitation nucleic-acid-based and antibody-based-methods for detecting bacterial infection. Therapeutic applications include without limitation vaccines, passive immunotherapy, and drug treatments directed against gene products that are both unique to bacteria and essential for growth and/or replication of bacteria.

Identification of Nucleic Acids Encoding Vaccine Components and Targets for Agents Effective Against *S. epidermidis*

The disclosed *S. epidermidis* genome sequence includes segments that direct the synthesis of ribonucleic acids and polypeptides, as well as origins of replication, promoters, other types of regulatory sequences, and intergenic nucleic acids. The invention encompasses nucleic acids encoding immunogenic components of vaccines and targets for agents effective against *S. epidermidis*. Identification of said immunogenic components involved in the determination of the function of the disclosed sequences, which can be achieved using a variety of approaches. Non-limiting examples of these approaches are described briefly below.

Homology to Known Sequences:

Computer-assisted comparison of the disclosed *S. epidermidis* sequences with previously reported sequences present in publicly available databases is useful for identifying functional *S. epidermidis* nucleic acid and polypeptide sequences. It will be understood that protein-coding sequences, for example, may be compared as a whole, and that a high degree of sequence homology between two proteins (such as, for example, >80-90%) at the amino acid level indicates that the two proteins also possess some degree of functional homology, such as, for example, among enzymes involved in metabolism, DNA synthesis, or cell wall synthesis, and proteins involved in transport, cell division, etc. In addition, many structural features of particular protein classes have been identified and correlate with specific consensus sequences, such as, for example, binding domains for nucleotides, DNA, metal ions, and other small molecules; sites for covalent modifications such as phosphorylation, acylation, and the like; sites of protein:protein interactions, etc. These consensus sequences may be quite short and thus may represent only a fraction of the entire protein-coding sequence. Identification of such a feature in a *S. epidermidis* sequence is therefore useful in determining the function of the encoded protein and identifying useful targets of antibacterial drugs.

Of particular relevance to the present invention are structural features that are common to secretory, transmembrane, and surface proteins, including secretion signal peptides and hydrophobic transmembrane domains. *S. epidermidis* proteins identified as containing putative signal sequences and/or transmembrane domains are useful as immunogenic components of vaccines.

Targets for therapeutic drugs according to the invention include, but are not limited to, polypeptides of the invention, whether unique to *S. epidermidis* or not, that are essential for growth and/or viability of *S. epidermidis* under at least one growth condition. Polypeptides essential for growth and/or viability can be determined by examining the effect of deleting and/or disrupting the genes, i.e., by so-called gene "knockout". Alternatively, genetic footprinting can be used (Smith et al., 1995, *Proc. Natl. Acad. Sci. USA* 92:5479-6433; Published International Application WO 94/26933; U.S. Pat. No. 5,612,180). Still other methods for assessing essentiality includes the ability to isolate conditional lethal mutations in the specific gene (e.g., temperature sensitive mutations). Other useful targets for therapeutic drugs, which include polypeptides that are not essential for growth or viability per se but lead to loss of viability of the cell, can be used to target therapeutic agents to cells.

Strain-Specific Sequences:

Because of the evolutionary relationship between different *S. epidermidis* strains, it is believed that the presently disclosed *S. epidermidis* sequences are useful for identifying, and/or discriminating between, previously known and new *S. epidermidis* strains. It is believed that other *S. epidermidis* strains will exhibit at least 70% sequence homology with the presently disclosed sequence. Systematic and routine analyses of DNA sequences derived from samples containing *S. epidermidis* strains, and comparison with the present sequence allows for the identification of sequences that can be used to discriminate between strains, as well as those that are common to all *S. epidermidis* strains. In one embodiment, the invention provides nucleic acids, including probes, and peptide and polypeptide sequences that discriminate between different strains of *S. epidermidis*. Strain-specific components can also be identified functionally by their ability to elicit or react with antibodies that selectively recognize one or more *S. epidermidis* strains.

In another embodiment, the invention provides nucleic acids, including probes, and peptide and polypeptide sequences that are common to all *S. epidermidis* strains but are not found in other bacterial species.

*S. epidermidis* Polypeptides

This invention encompasses isolated *S. epidermidis* polypeptides encoded by the disclosed *S. epidermidis* genomic sequences, including the polypeptides of the invention contained in the Sequence Listing. Polypeptides of the invention are preferably at least 5 amino acid residues in length. Using the DNA sequence information provided herein, the amino acid sequences of the polypeptides encompassed by the invention can be deduced using methods well-known in the art. It will be understood that the sequence of an entire nucleic acid encoding a *S. epidermidis* polypeptide can be isolated and identified based on an ORF that encodes only a fragment of the cognate protein-coding region. This can be achieved, for example, by using the isolated nucleic acid encoding the ORF, or fragments thereof, to prime a polymerase chain reaction with genomic *S. epidermidis* DNA as template; this is followed by sequencing the amplified product.

The polypeptides of the present invention, including function-conservative variants of the disclosed ORFs, may be isolated from wild-type or mutant *S. epidermidis* cells, or from heterologous organisms or cells (including, but not limited to, bacteria, fungi, insect, plant, and mammalian cells) including *S. epidermidis* into which a *S. epidermidis*-derived protein-coding sequence has been introduced and expressed. Furthermore, the polypeptides may be part of recombinant fusion proteins.

*S. epidermidis* polypeptides of the invention can be chemically synthesized using commercially automated procedures such as those referenced herein, including, without limitation, exclusive solid phase synthesis, partial solid phase methods, fragment condensation or classical solution synthesis. The polypeptides are preferably prepared by solid phase peptide synthesis as described by Merrifield, 1963, *J. Am. Chem. Soc.* 85:2149. The synthesis is carried out with amino acids that are protected at the alpha-amino terminus. Trifunctional amino acids with labile side-chains are also protected with suitable groups to prevent undesired chemical reactions from occurring during the assembly of the polypeptides. The alpha-amino protecting group is selectively removed to allow subsequent reaction to take place at the amino-terminus. The conditions for the removal of the alpha-amino protecting group do not remove the side-chain protecting groups.

Methods for polypeptide purification are well-known in the art, including, without limitation, preparative disc-gel electrophoresis, isoelectric focusing, HPLC, reversed-phase HPLC, gel filtration, ion exchange and partition chromatography, and countercurrent distribution. For some purposes, it is preferable to produce the polypeptide in a recombinant system in which the *S. epidermidis* protein contains an additional sequence tag that facilitates purification, such as, but not limited to, a polyhistidine sequence. The polypeptide can then be purified from a crude lysate of the host cell by chromatography on an appropriate solid-phase matrix. Alternatively, antibodies produced against a *S. epidermidis* protein or against peptides derived therefrom can be used as purification reagents. Other purification methods are possible.

The present invention also encompasses derivatives and homologues of *S. epidermidis*-encoded polypeptides. For some purposes, nucleic acid sequences encoding the peptides may be altered by substitutions, additions, or deletions that provide for functionally equivalent molecules, i.e., function-conservative variants. For example, one or more amino acid residues within the sequence can be substituted by another amino acid of similar properties, such as, for example, positively charged amino acids (arginine, lysine, and histidine); negatively charged amino acids (aspartate and glutamate); polar neutral amino acids; and non-polar amino acids.

The isolated polypeptides may be modified by, for example, phosphorylation, sulfation, acylation, or other protein modifications. They may also be modified with a label capable of providing a detectable signal, either directly or indirectly, including, but not limited to, radioisotopes and fluorescent compounds.

To identify *S. epidermidis*-derived polypeptides for use in the present invention, essentially the complete genomic sequence of a *Staphyolococcus epidermidis* isolate was analyzed. While, in very rare instances, a nucleic acid sequencing error may be revealed, resolving a rare sequencing error is well within the art, and such an occurrence will not prevent one skilled in the art from practicing the invention.

Also encompassed are any *S. epidermidis* polypeptide sequences that are contained within the open reading frames (ORFs), including complete protein-coding sequences, of which any of SEQ ID NO: 2838-SEQ ID NO: 5674 forms a part. Table 2, which is appended herewith and which forms part of the present specification, provides a putative identification of the particular function of a polypeptide which is encoded by each ORF, based on the homology match (determined by the BLAST algorithm) of the predicted polypeptide with known proteins encoded by ORFs in other organisms. As a result, one skilled in the art can use the polypeptides of the present invention for commercial and industrial purposes consistent with the type of putative identification of the polypeptide.

The present invention provides a library of *S. epidermidis*-derived polypeptide sequences, and a corresponding library of nucleic acid sequences encoding the polypeptides, wherein the polypeptides themselves, or polypeptides contained within ORFs of which they form a part, comprise sequences that are contemplated for use as components of vaccines. Non-limiting examples of such sequences are listed by SEQ ID NO in Table 2, which is appended herewith and which forms part of the present specification.

The present invention also provides a library of *S. epidermidis*-derived polypeptide sequences, and a corresponding library of nucleic acid sequences encoding the polypeptides, wherein the polypeptides themselves, or polypeptides contained within ORFs of which they form a part, comprise sequences lacking homology to any known prokaryotic or eukaryotic sequences. Such libraries provide probes, primers, and markers which can be used to diagnose *S. epidermidis* infection, including use as markers in epidemiological studies. Non-limiting examples of such sequences are listed by SEQ ID NO in Table 2, which is appended The present invention also provides a library of *S. epidermidis*-derived polypeptide sequences, and a corresponding library of nucleic acid sequences encoding the polypeptides, wherein the polypeptides themselves, or polypeptides contained within ORFs of which they form a part, comprise targets for therapeutic drugs.

SPECIFIC EXAMPLE

Determination of Staphylococcus Protein Antigens for Antibody and Vaccine Development The selection of *Staphylococcus* protein antigens for vaccine development can be derived from the nucleic acids encoding *S. epidermidis* polypeptides. First, the ORF's can be analyzed for homology to other known exported or membrane proteins and analyzed using the discriminant analysis described by Klein, et al. (Klein, P., Kanehsia, M., and DeLisi, C. (1985) *Biochimica et Biophysica Acta* 815, 468-476) for predicting exported and membrane proteins.

Homology searches can be performed using the BLAST algorithm contained in the Wisconsin Sequence Analysis Package (Genetics Computer Group, University Research Park, 575 Science Drive, Madison, Wis. 53711) to compare each predicted ORF amino acid sequence with all sequences found in the current GenBank, SWISS-PROT and PIR databases. BLAST searches for local alignments between the ORF and the databank sequences and reports a probability score which indicates the probability of finding this sequence by chance in the database. ORF's with significant homology (e.g. probabilities lower than $1 \times 10^{-6}$ that the homology is only due to random chance) to membrane or exported proteins represent protein antigens for vaccine development. Possible functions can be provided to *S. epidermidis* genes based on sequence homology to genes cloned in other organisms.

Discriminant analysis (Klein, et al. supra) can be used to examine the ORF amino acid sequences. This algorithm uses the intrinsic information contained in the ORF amino acid sequence and compares it to information derived from the properties of known membrane and exported proteins. This comparison predicts which proteins will be exported, membrane associated or cytoplasmic. ORF amino acid sequences identified as exported or membrane associated by this algorithm are likely protein antigens for vaccine development.

Production of Fragments and Analogs of *S. epidermidis* Nucleic Acids and Polypeptides Based on the discovery of the *S. epidermidis* gene products of the invention provided in the Sequence Listing, one skilled in the art can alter the disclosed structure of *S. epidermidis* genes, e.g., by producing fragments or analogs, and test the newly produced structures for activity. Examples of techniques known to those skilled in the relevant art which allow the production and testing of fragments and analogs are discussed below. These, or analogous methods can be used to make and screen libraries of polypeptides, e.g., libraries of random peptides or libraries of fragments or analogs of cellular proteins for the ability to bind *S. epidermidis* polypeptides. Such screens are useful for the identification of inhibitors of *S. epidermidis*.

Generation of Fragments

Fragments of a protein can be produced in several ways, e.g., recombinantly, by proteolytic digestion, or by chemical synthesis. Internal or terminal fragments of a polypeptide can be generated by removing one or more nucleotides from one end (for a terminal fragment) or both ends (for an internal fragment) of a nucleic acid which encodes the polypeptide. Expression of the mutagenized DNA produces polypeptide fragments. Digestion with "end-nibbling" endonucleases can thus generate DNAs which encode an array of fragments. DNAs which encode fragments of a protein can also be generated by random shearing, restriction digestion or a combination of the above-discussed methods.

Fragments can also be chemically synthesized using techniques known in the art such as conventional Merrifield solid phase f-Moc or t-Boc chemistry. For example, peptides of the present invention may be arbitrarily divided into fragments of desired length with no overlap of the fragments, or divided into overlapping fragments of a desired length.

Alteration of Nucleic Acids and Polypeptides: Random Methods

Amino acid sequence variants of a protein can be prepared by random mutagenesis of DNA which encodes a protein or a particular domain or region of a protein. Useful methods include PCR mutagenesis and saturation mutagenesis. A library of random amino acid sequence variants can also be generated by the synthesis of a set of degenerate oligonucleotide sequences. (Methods for screening proteins in a library of variants are elsewhere herein).

PCR Mutagenesis

In PCR mutagenesis, reduced Taq polymerase fidelity is used to introduce random mutations into a cloned fragment of DNA (Leung et al., 1989, *Technique* 1:11-15). The DNA region to be mutagenized is amplified using the polymerase chain reaction (PCR) under conditions that reduce the fidelity of DNA synthesis by Taq DNA polymerase, e.g., by using a dGTP/dATP ratio of five and adding $Mn^{2+}$ to the PCR reaction. The pool of amplified DNA fragments are inserted into appropriate cloning vectors to provide random mutant libraries.

Saturation Mutagenesis

Saturation mutagenesis allows for the rapid introduction of a large number of single base substitutions into cloned DNA fragments (Mayers et al., 1985, *Science* 229:242). This technique includes generation of mutations, e.g., by chemical treatment or irradiation of single-stranded DNA in vitro, and synthesis of a complimentary DNA strand. The mutation frequency can be modulated by modulating the severity of the treatment, and essentially all possible base substitutions can be obtained. Because this procedure does not involve a genetic selection for mutant fragments both neutral substitutions, as well as those that alter function, are obtained. The distribution of point mutations is not biased toward conserved sequence elements.

Degenerate Oligonucleotides

A library of homologs can also be generated from a set of degenerate oligonucleotide sequences. Chemical synthesis of a degenerate sequences can be carried out in an automatic DNA synthesizer, and the synthetic genes then ligated into an appropriate expression vector. The synthesis of degenerate oligonucleotides is known in the art (see for example, Narang, S A (1983) *Tetrahedron* 39:3; Itakura et al. (1981) *Recombinant DNA, Proc 3rd Cleveland Sympos. Macromolecules*, ed. A G Walton, Amsterdam: Elsevier pp273-289; Itakura et al. (1984) *Annu. Rev. Biochem.* 53:323; Itakura et al. (1984) *Science* 198:1056; Ike et al. (1983) *Nucleic Acid Res.* 11:477. Such techniques have been employed in the directed evolution of other proteins (see, for example, Scott et al. (1990) *Science* 249:386-390; Roberts et al. (1992) *PNAS* 89:2429-2433; Devlin et al. (1990) *Science* 249:404-406; Cwirla et al. (1990) *PNAS* 87: 6378-6382; as well as U.S. Pat. Nos. 5,223,409, 5,198,346, and 5,096,815).

Alteration of Nucleic Acids and Polypeptides: Methods for Directed Mutagenesis

Non-random or directed, mutagenesis techniques can be used to provide specific sequences or mutations in specific regions. These techniques can be used to create variants which include, e.g., deletions, insertions, or substitutions, of residues of the known amino acid sequence of a protein. The sites for mutation can be modified individually or in series, e.g., by (1) substituting first with conserved amino acids and then with more radical choices depending upon results achieved, (2) deleting the target residue, or (3) inserting residues of the same or a different class adjacent to the located site, or combinations of options 1-3.

Alanine Scanning Mutagenesis

Alanine scanning mutagenesis is a useful method for identification of certain residues or regions of the desired protein that are preferred locations or domains for mutagenesis, Cunningham and Wells (*Science* 244:1081-1085, 1989). In alanine scanning, a residue or group of target residues are identified (e.g., charged residues such as Arg, Asp, His, Lys, and Glu) and replaced by a neutral or negatively charged amino acid (most preferably alanine or polyalanine). Replacement of an amino acid can affect the interaction of the amino acids with the surrounding aqueous environment in or outside the cell. Those domains demonstrating functional sensitivity to the substitutions are then refined by introducing further or other variants at or for the sites of substitution. Thus, while the site for introducing an amino acid sequence variation is predetermined, the nature of the mutation per se need not be predetermined. For example, to optimize the performance of a mutation at a given site, alanine scanning or random mutagenesis may be conducted at the target codon or region and the expressed desired protein subunit variants are screened for the optimal combination of desired activity.

Oligonucleotide-Mediated Mutagenesis

Oligonucleotide-mediated mutagenesis is a useful method for preparing substitution, deletion, and insertion variants of DNA, see, e.g., Adelman et al., (*DNA* 2:183, 1983). Briefly, the desired DNA is altered by hybridizing an oligonucleotide encoding a mutation to a DNA template, where the template is the single-stranded form of a plasmid or bacteriophage containing the unaltered or native DNA sequence of the desired protein. After hybridization, a DNA polymerase is used to synthesize an entire second complementary strand of the template that will thus incorporate the oligonucleotide primer, and will code for the selected alteration in the desired protein DNA. Generally, oligonucleotides of at least 25 nucleotides in length are used. An optimal oligonucleotide will have 12 to 15 nucleotides that are completely complementary to the template on either side of the nucleotide(s) coding for the mutation. This ensures that the oligonucleotide will hybridize properly to the single-stranded DNA template molecule. The oligonucleotides are readily synthesized using techniques known in the art such as that described by Crea et al; (*Proc. Natl. Acad. Sci.* USA, 75: 5765[1978]).

Cassette Mutagenesis

Another method for preparing variants, cassette mutagenesis, is based on the technique described by Wells et al. (*Gene*, 34:315[1985]). The starting material is a plasmid (or other vector) which includes the protein subunit DNA to be mutated. The codon(s) in the protein subunit DNA to be mutated are identified. There must be a unique restriction endonuclease site on each side of the identified mutation site(s). If no such restriction sites exist, they may be generated using the above-described oligonucleotide-mediated mutagenesis method to introduce them at appropriate locations in the desired protein subunit DNA. After the restriction sites have been introduced into the plasmid, the plasmid is cut at these sites to linearize it. A double-stranded oligonucleotide encoding the sequence of the DNA between the restriction sites but containing the desired mutation(s) is synthesized using standard procedures. The two strands are synthesized separately and then hybridized together using standard techniques. This double-stranded oligonucleotide is referred to as the cassette. This cassette is designed to have 3' and 5' ends that are comparable with the ends of the linearized plasmid, such that it can be directly ligated to the plasmid. This plasmid now contains the mutated desired protein subunit DNA sequence.

Combinatorial Mutagenesis

Combinatorial mutagenesis can also be used to generate mutants (Ladner et al., WO 88/06630). In this method, the amino acid sequences for a group of homologs or other related proteins are aligned, preferably to promote the highest homology possible. All of the amino acids which appear at a given position of the aligned sequences can be selected to create a degenerate set of combinatorial sequences. The variegated library of variants is generated by combinatorial mutagenesis at the nucleic acid level, and is encoded by a variegated gene library. For example, a mixture of synthetic oligonucleotides can be enzymatically ligated into gene-sequences such that the degenerate set of potential sequences are expressible as individual peptides, or alternatively, as a set of larger fusion proteins containing the set of degenerate sequences.

Other Modifications of *S. epidermidis* Nucleic Acids and Polypeptides

It is possible to modify the structure of a *S. epidermidis* polypeptide for such purposes as increasing solubility, enhancing stability (e.g., shelf life ex vivo and resistance to proteolytic degradation in vivo). A modified *S. epidermidis* protein or peptide can be produced in which the amino acid sequence has been altered, such as by amino acid substitution, deletion, or addition as described herein.

An *S. epidermidis* peptide can also be modified by substitution of cysteine residues preferably with alanine, serine, threonine, leucine or glutamic acid residues to minimize dimerization via disulfide linkages. In addition, amino acid side chains of fragments of the protein of the invention can be chemically modified. Another modification is cyclization of the peptide.

In order to enhance stability and/or reactivity, a *S. epidermidis* polypeptide can be modified to incorporate one or more polymorphisms in the amino acid sequence of the protein resulting from any natural allelic variation. Additionally, D-amino acids, non-natural amino acids, or non-amino acid analogs can be substituted or added to produce a modified protein within the scope of this invention. Furthermore, an *S. epidermidis* polypeptide can be modified using polyethylene glycol (PEG) according to the method of A. Sehon and co-workers (Wie et al., supra) to produce a protein conjugated with PEG. In addition, PEG can be added during chemical synthesis of the protein. Other modifications of *S. epidermidis* proteins include reduction/alkylation (Tarr, *Methods of Protein Microcharacterization*, J. E. Silver ed., Humana Press, Clifton N.J. 155-194 (1986)); acylation (Tarr, supra); chemical coupling to an appropriate carrier (Mishell and Shiigi, eds, *Selected Methods in Cellular Immunology*, WH Freeman, San Francisco, Calif. (1980), U.S. Pat. No. 4,939, 239; or mild formalin treatment (Marsh, (1971) *Int. Arch. of Allergy and Appl. Immunol.*, 41: 199-215).

To facilitate purification and potentially increase solubility of a *S. epidermidis* protein or peptide, it is possible to add an amino acid fusion moiety to the peptide backbone. For example, hexa-histidine can be added to the protein for purification by immobilized metal ion affinity chromatography (Hochuli, E. et al., (1988) *Bio/Technology*, 6: 1321-1325). In addition, to facilitate isolation of peptides free of irrelevant sequences, specific endoprotease cleavage sites can be introduced between the sequences of the fusion moiety and the peptide.

To potentially aid proper antigen processing of epitopes within an *S. epidermidis* polypeptide, canonical protease sensitive sites can be engineered between regions, each comprising at least one epitope via recombinant or synthetic methods. For example, charged amino acid pairs, such as KK or RR, can be introduced between regions within a protein or fragment during recombinant construction thereof. The resulting peptide can be rendered sensitive to cleavage by cathepsin and/or other trypsin-like enzymes which would generate portions of the protein containing one or more epitopes. In addition, such charged amino acid residues can result in an increase in the solubility of the peptide.

Primary Methods for Screening Polypeptides and Analogs

Various techniques are known in the art for screening generated mutant gene products. Techniques for screening large gene libraries often include cloning the gene library into replicable expression vectors, transforming appropriate cells with the resulting library of vectors, and expressing the genes under conditions in which detection of a desired activity, e.g., in this case, binding to *S. epidermidis* polypeptide or an interacting protein, facilitates relatively easy isolation of the vector encoding the gene whose product was detected. Each of the techniques described below is amenable to high through-put analysis for screening large numbers of sequences created, e.g., by random mutagenesis techniques.

Two Hybrid Systems

Two hybrid assays such as the system described below (as with the other screening methods described herein), can be used to identify polypeptides, e.g., fragments or analogs of a naturally-occurring *S. epidermidis* polypeptide, e.g., of cellular proteins, or of randomly generated polypeptides which bind to an *S. epidermidis* protein. (The *S. epidermidis* domain is used as the bait protein and the library of variants are expressed as prey fusion proteins.) In an analogous fashion, a two hybrid assay (as with the other screening methods described herein), can be used to find polypeptides which bind a *S. epidermidis* polypeptide.

Display Libraries

In one approach to screening assays, the *Staphylococcus* peptides are displayed on the surface of a cell or viral particle, and the ability of particular cells or viral particles to bind an appropriate receptor protein via the displayed product is detected in a "panning assay". For example, the gene library can be cloned into the gene for a surface membrane protein of a bacterial cell, and the resulting fusion protein detected by panning (Ladner et al., WO 88/06630; Fuchs et al. (1991) *Bio/Technology* 9:1370-1371; and Goward et al. (1992) *TIBS* 18:136-140). In a similar fashion, a detectably labeled ligand can be used to score for potentially functional peptide homologs. Fluorescently labeled ligands, e.g., receptors, can be used to detect homologs which retain ligand-binding activity. The use of fluorescently labeled ligands, allows cells to be visually inspected and separated under a fluorescence microscope, or, where the morphology of the cell permits, to be separated by a fluorescence-activated cell sorter.

A gene library can be expressed as a fusion protein on the surface of a viral particle. For instance, in the filamentous phage system, foreign peptide sequences can be expressed on the surface of infectious phage, thereby conferring two significant benefits. First, since these phage can be applied to affinity matrices at concentrations well over $10^{13}$ phage per milliliter, a large number of phage can be screened at one time. Second, since each infectious phage displays a gene product on its surface, if a particular phage is recovered from an affinity matrix in low yield, the phage can be amplified by another round of infection. The group of almost identical *E. coli* filamentous phages, M13, fd., and f1, are most often used in phage display libraries. Either of the phage gIII or gVIII coat proteins can be used to generate fusion proteins without disrupting the ultimate packaging of the viral particle. Foreign epitopes can be expressed at the $NH_2$-terminal end of pIII and phage bearing such epitopes recovered from a large excess of phage lacking this epitope (Ladner et al. PCT publication WO 90/02909; Garrard et al., PCT publication WO 92/09690; Marks et al. (1992) *J. Biol. Chem.* 267:16007-16010; Griffiths et al. (1993) *EMBO J* 12:725-734; Clackson et al. (1991) *Nature* 352:624-628; and Barbas et al. (1992) *PNAS* 89:4457-4461).

A common approach uses the maltose receptor of *E. coli* (the outer membrane protein, LamB) as a peptide fusion partner (Charbit et al. (1986) *EMBO* 5, 3029-3037). Oligonucleotides have been inserted into plasmids encoding the LamB gene to produce peptides fused into one of the extracellular loops of the protein. These peptides are available for binding to ligands, e.g., to antibodies, and can elicit an immune response when the cells are administered to animals. Other cell surface proteins, e.g., OmpA (Schorr et al. (1991) *Vaccines* 91, pp. 387-392), PhoE (Agterberg, et al. (1990) *Gene* 88, 37-45), and PAL (Fuchs et al. (1991) *Bio/Tech* 9, 1369-1372), as well as large bacterial surface structures have served as vehicles for peptide display. Peptides can be fused to pilin, a protein which polymerizes to form the pilus-a conduit for interbacterial exchange of genetic information (Thiry et al. (1989) *Appl. Environ. Microbiol.* 55, 984-993). Because of its role in interacting with other cells, the pilus provides a useful support for the presentation of peptides to the extracellular environment. Another large surface structure used for peptide display is the bacterial motive organ, the flagellum. Fusion of peptides to the subunit protein flagellin offers a dense array of many peptide copies on the host cells (Kuwajima et al. (1988) *Bio/Tech.* 6, 1080-1083). Surface proteins of other bacterial species have also served as peptide fusion partners. Examples include the *Staphylococcus* protein A and the outer membrane IgA protease of *Neisseria* (Hansson et al. (1992) *J. Bacteriol.* 174, 4239-4245 and Klauser et al. (1990) *EMBO J.* 9, 1991-1999).

In the filamentous phage systems and the LamB system described above, the physical link between the peptide and its encoding DNA occurs by the containment of the DNA within a particle (cell or phage) that carries the peptide on its surface. Capturing the peptide captures the particle and the DNA within. An alternative scheme uses the DNA-binding protein LacI to form a link between peptide and DNA (Cull et al. (1992) *PNAS USA* 89:1865-1869). This system uses a plasmid containing the LacI gene with an oligonucleotide cloning site at its 3'-end. Under the controlled induction by arabinose, a LacI-peptide fusion protein is produced. This fusion retains the natural ability of LacI to bind to a short DNA sequence known as LacO operator (LacO). By installing two copies of LacO on the expression plasmid, the LacI-peptide fusion binds tightly to the plasmid that encoded it. Because the plasmids in each cell contain only a single oligonucleotide sequence and each cell expresses only a single peptide sequence, the peptides become specifically and stablely associated with the DNA sequence that directed its synthesis. The cells of the library are gently lysed and the peptide-DNA complexes are exposed to a matrix of immobilized receptor to recover the complexes containing active peptides. The associated plasmid DNA is then reintroduced into cells for amplification and DNA sequencing to determine the identity of the peptide ligands. As a demonstration of the practical utility of the method, a large random library of dodecapeptides was made and selected on a monoclonal antibody raised against the opioid peptide dynorphin B. A cohort of peptides was recovered, all related by a consensus sequence corresponding to a six-residue portion of dynorphin B. (Cull et al. (1992) *Proc. Natl. Acad. Sci. U.S.A.* 89-1869)

This scheme, sometimes referred to as peptides-on-plasmids, differs in two important ways from the phage display methods. First, the peptides are attached to the C-terminus of the fusion protein, resulting in the display of the library members as peptides having free carboxy termini. Both of the filamentous phage coat proteins, pIII and pVIII, are anchored to the phage through their C-termini, and the guest peptides are placed into the outward-extending N-terminal domains. In some designs, the phage-displayed peptides are presented right at the amino terminus of the fusion protein. (Cwirla, et al. (1990) *Proc. Natl. Acad. Sci. U.S.A.* 87, 6378-6382) A second difference is the set of biological biases affecting the population of peptides actually present in the libraries. The LacI fusion molecules are confined to the cytoplasm of the host cells. The phage coat fusions are exposed briefly to the cytoplasm during translation but are rapidly secreted through the inner membrane into the periplasmic compartment, remaining anchored in the membrane by their C-terminal hydrophobic domains, with the N-termini, containing the peptides, protruding into the periplasm while awaiting assembly into phage particles. The peptides in the LacI and phage libraries may differ significantly as a result of their exposure to different proteolytic activities. The phage coat proteins require transport across the inner membrane and signal peptidase processing as a prelude to incorporation into phage. Certain peptides exert a deleterious effect on these processes and are underrepresented in the libraries (Gallop et al. (1994) *J. Med. Chem.* 37(9):1233-1251). These particular biases are not a factor in the LacI display system.

The number of small peptides available in recombinant random libraries is enormous. Libraries of $10^7$-$10^9$ independent clones are routinely prepared. Libraries as large as $10^{11}$ recombinants have been created, but this size approaches the practical limit for clone libraries. This limitation in library size occurs at the step of transforming the DNA containing randomized segments into the host bacterial cells. To circumvent this limitation, an in vitro system based on the display of nascent peptides in polysome complexes has recently been developed. This display library method has the potential of producing libraries 3-6 orders of magnitude larger than the currently available phage/phagemid or plasmid libraries. Furthermore, the construction of the libraries, expression of the peptides, and screening, is done in an entirely cell-free format.

In one application of this method (Gallop et al. (1994) *J. Med. Chem.* 37(9):1233-1251), a molecular DNA library encoding $10^{12}$ decapeptides was constructed and the library expressed in an *E. coli* S30 in vitro coupled transcription/translation system. Conditions were chosen to stall the ribosomes on the mRNA, causing the accumulation of a substantial proportion of the RNA in polysomes and yielding complexes containing nascent peptides still linked to their encoding RNA. The polysomes are sufficiently robust to be affinity purified on immobilized receptors in much the same way as the more conventional recombinant peptide display libraries are screened. RNA from the bound complexes is recovered, converted to cDNA, and amplified by PCR to produce a template for the next round of synthesis and screening. The polysome display method can be coupled to the phage display system. Following several rounds of screening, cDNA from the enriched pool of polysomes was cloned into a phagemid vector. This vector serves as both a peptide expression vector, displaying peptides fused to the coat proteins, and as a DNA sequencing vector for peptide identification. By expressing the polysome-derived peptides on phage, one can either continue the affinity selection procedure in this format or assay the peptides on individual clones for binding activity in a phage ELISA, or for binding specificity in a completion phage ELISA (Barret, et al. (1992) *Anal. Biochem* 204,357-364). To identify the sequences of the active peptides one sequences the DNA produced by the phagemid host.

Secondary Screening of Polypeptides and Analogs

The high through-put assays described above can be followed by secondary screens in order to identify further biological activities which will, e.g., allow one skilled in the art to differentiate agonists from antagonists. The type of a secondary screen used will depend on the desired activity that needs to be tested. For example, an assay can be developed in which the ability to inhibit an interaction between a protein of interest and its respective ligand can be used to identify antagonists from a group of peptide fragments isolated though one of the primary screens described above.

Therefore, methods for generating fragments and analogs and testing them for activity are known in the art. Once the core sequence of interest is identified, it is routine for one skilled in the art to obtain analogs and fragments.

Peptide Mimetics of *S. epidermidis* Polypeptides

The invention also provides for reduction of the protein binding domains of the subject *S. epidermidis* polypeptides to generate mimetics, e.g. peptide or non-peptide agents. The peptide mimetics are able to disrupt binding of a polypeptide to its counter ligand, e.g., in the case of a *S. epidermidis* polypeptide binding to a naturally occurring ligand. The critical residues of a subject *S. epidermidis* polypeptide which are involved in molecular recognition of a polypeptide can be determined and used to generate *S. epidermidis*-derived peptidomimetics which competitively or noncompetitively inhibit binding of the *S. epidermidis* polypeptide with an interacting polypeptide (see, for example, European patent applications EP-412,762A and EP-B31,080A).

For example, scanning mutagenesis can be used to map the amino acid residues of a particular *S. epidermidis* polypeptide involved in binding an interacting polypeptide, peptidomimetic compounds (e.g. diazepine or isoquinoline derivatives) can be generated which mimic those residues in binding to an interacting polypeptide, and which therefore can inhibit binding of a *S. epidermidis* polypeptide to an interacting polypeptide and thereby interfere with the function of *S. epidermidis* polypeptide. For instance, non-hydrolyzable peptide analogs of such residues can be generated using benzodiazepine (e.g., see Freidinger et al. in *Peptides: Chemistry and Biology*, G. R. Marshall ed., ESCOM Publisher: Leiden, Netherlands, 1988), azepine (e.g., see Huffman et al. in *Peptides: Chemistry and Biology*, G. R. Marshall ed., ESCOM Publisher: Leiden, Netherlands, 1988), substituted gama lactam rings (Garvey et al. in *Peptides: Chemistry and Biology*, G. R. Marshall ed., ESCOM Publisher: Leiden, Netherlands, 1988), keto-methylene pseudopeptides (Ewenson et al. (1986) *J Med Chem* 29:295; and Ewenson et al. in *Peptides: Structure and Function* (Proceedings of the 9th American Peptide Symposium) Pierce Chemical Co. Rockland, Ill., 1985), b-turn dipeptide cores (Nagai et al. (1985) *Tetrahedron Lett* 26; 647; and Sato et al. (1986) *J Chem Soc Perkin Trans* 1:1231), and b-aminoalcohols (Gordon et al. (1985) *Biochem Biophys Res Commun* 126:419; and et al. (1986) *Biochem Biophys Res Commun* 134:71).

Vaccine Formulations for *S. epidermidis* Nucleic Acids and Polypeptides

This invention also features vaccine compositions for protection against infection by *S. epidermidis* or for treatment of *S. epidermidis* infection, a gram-positive spiral bacterium. In one embodiment, the vaccine compositions contain one or more immunogenic components such as a surface protein from *S. epidermidis*, or portion thereof, and a pharmaceutically acceptable carrier. Nucleic acids within the scope of the invention are exemplified by the nucleic acids of the invention contained in the Sequence Listing which encode *S. epidermidis* surface proteins. Any nucleic acid encoding an immunogenic *S. epidermidis* protein, or portion thereof, which is capable of expression in a cell, can be used in the present invention. These vaccines have therapeutic and prophylactic utilities.

One aspect of the invention provides a vaccine composition for protection against infection by *S. epidermidis* which contains at least one immunogenic fragment of an *S. epidermidis* protein and a pharmaceutically acceptable carrier. Preferred fragments include peptides of at least about 10 amino acid residues in length, preferably about 10-20 amino acid residues in length, and more preferably about 12-16 amino acid residues in length.

Immunogenic components of the invention can be obtained, for example, by screening polypeptides recombinantly produced from the corresponding fragment of the nucleic acid encoding the full-length *S. epidermidis* protein. In addition, fragments can be chemically synthesized using techniques known in the art such as conventional Merrifield solid phase f-Moc or t-Boc chemistry.

In one embodiment, immunogenic components are identified by the ability of the peptide to stimulate T cells. Peptides which stimulate T cells, as determined by, for example, T cell proliferation or cytokine secretion are defined herein as comprising at least one T cell epitope. T cell epitopes are believed to be involved in initiation and perpetuation of the immune response to the protein allergen which is responsible for the clinical symptoms of allergy. These T cell epitopes are thought to trigger early events at the level of the T helper cell by binding to an appropriate HLA molecule on the surface of an antigen presenting cell, thereby stimulating the T cell subpopulation with the relevant T cell receptor for the epitope. These events lead to T cell proliferation, lymphokine secretion, local inflammatory reactions, recruitment of additional immune cells to the site of antigen/T cell interaction, and activation of the B cell cascade, leading to the production of antibodies. A T cell epitope is the basic element, or smallest unit of recognition by a T cell receptor, where the epitope comprises amino acids essential to receptor recognition (e.g., approximately 6 or 7 amino acid residues). Amino acid sequences which mimic those of the T cell epitopes are within the scope of this invention.

Screening immunogenic components can be accomplished using one or more of several different assays. For example, in vitro, peptide T cell stimulatory activity is assayed by contacting a peptide known or suspected of being immunogenic with an antigen presenting cell which presents appropriate MHC molecules in a T cell culture. Presentation of an immunogenic *S. epidermidis* peptide in association with appropriate MHC molecules to T cells in conjunction with the necessary co-stimulation has the effect of transmitting a signal to the T cell that induces the production of increased levels of cytokines, particularly of interleukin-2 and interleukin-4. The culture supernatant can be obtained and assayed for interleukin-2 or other known cytokines. For example, any one of several conventional assays for interleukin-2 can be employed, such as the assay described in *Proc. Natl. Acad. Sci USA*, 86: 1333(1989) the pertinent portions of which are incorporated herein by reference. A kit for an assay for the production of interferon is also available from Genzyme Corporation (Cambridge, Mass.).

Alternatively, a common assay for T cell proliferation entails measuring tritiated thymidine incorporation. The proliferation of T cells can be measured in vitro by determining the amount of $^3$H-labeled thymidine incorporated into the replicating DNA of cultured cells. Therefore, the rate of DNA synthesis and, in turn, the rate of cell division can be quantified.

Vaccine compositions of the invention containing immunogenic components (e.g., *S. epidermidis* polypeptide or fragment thereof or nucleic acid encoding an *S. epidermidis* polypeptide or fragment thereof) preferably include a pharmaceutically acceptable carrier. The term "pharmaceutically acceptable carrier" refers to a carrier that does not cause an allergic reaction or other untoward effect in patients to whom it is administered. Suitable pharmaceutically acceptable carriers include, for example, one or more of water, saline, phosphate buffered saline, dextrose, glycerol, ethanol and the like, as well as combinations thereof. Pharmaceutically acceptable carriers may further comprise min or amounts of auxiliary substances such as wetting or emulsifying agents, preservatives or buffers, which enhance the shelf life or effectiveness of the antibody. For vaccines of the invention containing *S. epidermidis* polypeptides, the polypeptide is co-administered with a suitable adjuvant.

It will be apparent to those of skill in the art that the therapeutically effective amount of DNA or protein of this invention will depend, inter alia, upon the administration schedule, the unit dose of antibody administered, whether the protein or DNA is administered in combination with other therapeutic agents, the immune status and health of the patient, and the therapeutic activity of the particular protein or DNA.

Vaccine compositions are conventionally administered parenterally, e.g., by injection, either subcutaneously or intramuscularly. Methods for intramuscular immunization are described by Wolff et al. (1990) *Science* 247: 1465-1468 and by Sedegah et al. (1994) *Immunology* 91: 9866-9870. Other modes of administration include oral and pulmonary formulations, suppositories, and transdermal applications. Oral immunization is preferred over parenteral methods for inducing protection against infection by *S. epidermidis*. Cain et. al. (1993) *Vaccine* 11: 637-642. Oral formulations include such normally employed excipients as, for example, pharmaceutical grades of mannitol, lactose, starch, magnesium stearate, sodium saccharine, cellulose, magnesium carbonate, and the like.

The vaccine compositions of the invention can include an adjuvant, including, but not limited to aluminum hydroxide; N-acetyl-muramyl-L-threonyl-D-isoglutamine (thr-MDP); N-acetyl-nor-muramyl-L-alanyl-D-isoglutamine (CGP 11637, referred to as nor-MDP); N-acetylmuramyl-L-alanyl-D-isoglutaminyl-L-alanine-2-(1'-2'-dipalmitoyl-sn-glycero-3-hydroxyphos-phoryloxy)-ethylamine (CGP 19835A, referred to a MTP-PE); RIBI, which contains three components from bacteria; monophosphoryl lipid A; trehalose dimycoloate; cell wall skeleton (MPL+TDM+CWS) in a 2% squalene/Tween 80 emulsion; and cholera toxin. Others which may be used are non-toxic derivatives of cholera toxin, including its B subunit, and/or conjugates or genetically engineered fusions of the *S. epidermidis* polypeptide with cholera toxin or its B subunit, procholeragenoid, fungal polysaccharides, including schizophyllan, muramyl dipeptide, muramyl dipeptide derivatives, phorbol esters, labile toxin of *E. coli*, non-*S. epidermidis* bacterial lysates, block polymers or saponins.

Other suitable delivery methods include biodegradable microcapsules or immuno-stimulating complexes (IS-COMs), cochleates, or liposomes, genetically engineered attenuated live vectors such as viruses or bacteria, and recombinant (chimeric) virus-like particles, e.g., bluetongue. The amount of adjuvant employed will depend on the type of adjuvant used. For example, when the mucosal adjuvant is cholera toxin, it is suitably used in an amount of 5 mg to 50 mg, for example 10 mg to 35 mg. When used in the form of microcapsules, the amount used will depend on the amount employed in the matrix of the microcapsule to achieve the desired dosage. The determination of this amount is within the skill of a person of ordinary skill in the art.

Carrier systems in humans may include enteric release capsules protecting the antigen from the acidic environment of the stomach, and including *S. epidermidis* polypeptide in an insoluble form as fusion proteins. Suitable carriers for the vaccines of the invention are enteric coated capsules and polylactide-glycolide microspheres. Suitable diluents are 0.2 N NaHCO3 and/or saline.

Vaccines of the invention can be administered as a primary prophylactic agent in adults or in children, as a secondary prevention, after successful eradication of *S. epidermidis* in an infected host, or as a therapeutic agent in the aim to induce an immune response in a susceptible host to prevent infection by *S. epidermidis*. The vaccines of the invention are administered in amounts readily determined by persons of ordinary skill in the art. Thus, for adults a suitable dosage will be in the range of 10 mg to 10 g, preferably 10 mg to 100 mg. A suitable dosage for adults will also be in the range of 5 mg to 500 mg. Similar dosage ranges will be applicable for children. Those skilled in the art will recognize that the optimal dose may be more or less depending upon the patient's body weight, disease, the route of administration, and other factors. Those skilled in the art will also recognize that appropriate dosage levels can be obtained based on results with known oral vaccines such as, for example, a vaccine based on an *E. coli* lysate (6 mg dose daily up to total of 540 mg) and with an enterotoxigenic *E. coli* purified antigen (4 doses of 1 mg) (Schulman et al. *J. Urol.* 150:917-921 (1993); Boedecker et al., *American Gastroenterological Assoc.* 999:A-222 (1993)). The number of doses will depend upon the disease, the formulation, and efficacy data from clinical trials. Without intending any limitation as to the course of treatment, the treatment can be administered over 3 to 8 doses for a primary immunization schedule over 1 month (Boedeker, *American Gastroenterological Assoc.* 888:A-222 (1993)).

In a preferred embodiment, a vaccine composition of the invention can be based on a killed whole *E. coli* preparation with an immunogenic fragment of a *S. epidermidis* protein of the invention expressed on its surface or it can be based on an *E. coli* lysate, wherein the killed *E. coli* acts as a carrier or an adjuvant.

It will be apparent to those skilled in the art that some of the vaccine compositions of the invention are useful only for preventing *S. epidermidis* infection, some are useful only for treating *S. epidermidis* infection, and some are useful for both preventing and treating *S. epidermidis* infection. In a preferred embodiment, the vaccine composition of the invention provides protection against *S. epidermidis* infection by stimulating humoral and/or cell-mediated immunity against *S. epidermidis*. It should be understood that amelioration of any of the symptoms of *S. epidermidis* infection is a desirable clinical goal, including a lessening of the dosage of medication used to treat *S. epidermidis*-caused disease, or an increase in the production of antibodies in the serum or mucous of patients.

Antibodies Reactive with *S. epidermidis* Polypeptides

The invention also includes antibodies specifically reactive with the subject *S. epidermidis* polypeptide. Anti-protein/anti-peptide antisera or monoclonal antibodies can be made by standard protocols (See, for example, *Antibodies: A Laboratory Manual* ed. by Harlow and Lane (Cold Spring Harbor Press: 1988)). A mammal such as a mouse, a hamster or rabbit can be immunized with an immunogenic form of the peptide. Techniques for conferring immunogenicity on a protein or peptide include conjugation to carriers or other techniques well known in the art. An immunogenic portion of the subject *S. epidermidis* polypeptide can be administered in the presence of adjuvant. The progress of immunization can be monitored by detection of antibody titers in plasma or serum. Standard ELISA or other immunoassays can be used with the immunogen as antigen to assess the levels of antibodies.

In a preferred embodiment, the subject antibodies are immunospecific for antigenic determinants of the *S. epidermidis* polypeptides of the invention, e.g. antigenic determinants of a polypeptide of the invention contained in the Sequence Listing, or a closely related human or non-human mammalian homolog (e.g., 90% homologous, more preferably at least 95% homologous). In yet a further preferred embodiment of the invention, the anti-*S. epidermidis* antibodies do not substantially cross react (i.e., react specifically) with a protein which is for example, less than 80% percent homologous to a sequence of the invention contained in the Sequence Listing. By "not substantially cross react", it is meant that the antibody has a binding affinity for a non-homologous protein which is less than 10 percent, more preferably less than 5 percent, and even more preferably less than 1 percent, of the binding affinity for a protein of the invention contained in the Sequence Listing. In a most preferred embodiment, there is no cross-reactivity between bacterial and mammalian antigens.

The term antibody as used herein is intended to include fragments thereof which are also specifically reactive with *S. epidermidis* polypeptides. Antibodies can be fragmented using conventional techniques and the fragments screened for utility in the same manner as described above for whole antibodies. For example, F(ab')$_2$ fragments can be generated by treating antibody with pepsin. The resulting F(ab')$_2$ fragment can be treated to reduce disulfide bridges to produce Fab' fragments. The antibody of the invention is further intended to include bispecific and chimeric molecules having an anti-*S. epidermidis* portion.

Both monoclonal and polyclonal antibodies (Ab) directed against *S. epidermidis* polypeptides or *S. epidermidis* polypeptide variants, and antibody fragments such as Fab' and F(ab')$_2$, can be used to block the action of *S. epidermidis* polypeptide and allow the study of the role of a particular *S. epidermidis* polypeptide of the invention in aberrant or unwanted intracellular signaling, as well as the normal cellular function of the *S. epidermidis* and by microinjection of anti-*S. epidermidis* polypeptide antibodies of the present invention.

Antibodies which specifically bind *S. epidermidis* epitopes can also be used in immunohistochemical staining of tissue samples in order to evaluate the abundance and pattern of expression of *S. epidermidis* antigens. Anti-*S. epidermidis* polypeptide antibodies can be used diagnostically in immuno-precipitation and immuno-blotting to detect and evaluate *S. epidermidis* levels in tissue or bodily fluid as part of a clinical testing procedure. Likewise, the ability to monitor S. epidermidis polypeptide levels in an individual can allow determination of the efficacy of a given treatment regimen for an individual afflicted with such a disorder. The level of a S. epidermidis polypeptide can be measured in cells found in bodily fluid, such as in urine samples or can be measured in tissue, such as produced by gastric biopsy. Diagnostic assays using anti-S. epidermidis antibodies can include, for example, immunoassays designed to aid in early diagnosis of S. epidermidis infections. The present invention can also be used as a method of detecting antibodies contained in samples from individuals infected by this bacterium using specific S. epidermidis antigens.

Another application of anti-S. epidermidis polypeptide antibodies of the invention is in the immunological screening of cDNA libraries constructed in expression vectors such as λgt11, λgt18-23, λZAP, and λORF8. Messenger libraries of this type, having coding sequences inserted in the correct reading frame and orientation, can produce fusion proteins. For instance, λgt11 will produce fusion proteins whose amino termini consist of β-galactosidase amino acid sequences and whose carboxy termini consist of a foreign polypeptide. Antigenic epitopes of a subject. S. epidermidis polypeptide can then be detected with antibodies, as, for example, reacting nitrocellulose filters lifted from infected plates with anti-S. epidermidis polypeptide antibodies. Phage, scored by this assay, can then be isolated from the infected plate. Thus, the presence of S. epidermidis gene homologs can be detected and cloned from other species, and alternate isoforms (including splicing variants) can be detected and cloned.

Kits Containing Nucleic Acids, Polypeptides or Antibodies of the Invention

The nucleic acid, polypeptides and antibodies of the invention can be combined with other reagents and articles to form kits. Kits for diagnostic purposes typically comprise the nucleic acid, polypeptides or antibodies in vials or other suitable vessels. Kits typically comprise other reagents for performing hybridization reactions, polymerase chain reactions (PCR), or for reconstitution of lyophilized components, such as aqueous media, salts, buffers, and the like. Kits may also comprise reagents for sample processing such as detergents, chaotropic salts and the like. Kits may also comprise immobilization means such as particles, supports, wells, dipsticks and the like. Kits may also comprise labeling means such as dyes, developing reagents, radioisotopes, fluorescent agents, luminescent or chemiluminescent agents, enzymes, intercalating agents and the like. With the nucleic acid and amino acid sequence information provided herein, individuals skilled in art can readily assemble kits to serve their particular purpose. Kits further can include instructions for use.

Drug Screening Assays Using S. epidermidis Polypeptides

By making available purified and recombinant S. epidermidis polypeptides, the present invention provides assays which can be used to screen for drugs which are either agonists or antagonists of the normal cellular function, in this case, of the subject S. epidermidis polypeptides, or of their role in intracellular signaling. Such inhibitors or potentiators may be useful as new therapeutic agents to combat S. epidermidis infections in humans. A variety of assay formats will suffice and, in light of the present inventions, will be comprehended by the person skilled in the art.

In many drug screening programs which test libraries of compounds and natural extracts, high throughput assays are desirable in order to maximize the number of compounds surveyed in a given period of time. Assays which are performed in cell-free systems, such as may be derived with purified or semi-purified proteins, are often preferred as "primary" screens in that they can be generated to permit rapid development and relatively easy detection of an alteration in a molecular target which is mediated by a test compound. Moreover, the effects of cellular toxicity and/or bioavailability of the test compound can be generally ignored in the in vitro system, the assay instead being focused primarily on the effect of the drug on the molecular target as may be manifest in an alteration of binding affinity with other proteins or change in enzymatic properties of the molecular target. Accordingly, in an exemplary screening assay of the present invention, the compound of interest is contacted with an isolated and purified S. epidermidis polypeptide.

Screening assays can be constructed in vitro with a purified S. epidermidis polypeptide or fragment thereof, such as a S. epidermidis polypeptide having enzymatic activity, such that the activity of the polypeptide produces a detectable reaction product. The efficacy of the compound can be assessed by generating dose response curves from data obtained using various concentrations of the test compound. Moreover, a control assay can also be performed to provide a baseline for comparison. Suitable products include those with distinctive absorption, fluorescence, or chemi-luminescence properties, for example, because detection may be easily automated. A variety of synthetic or naturally occurring compounds can be tested in the assay to identify those which inhibit or potentiate the activity of the S. epidermidis polypeptide. Some of these active compounds may directly, or with chemical alterations to promote membrane permeability or solubility, also inhibit or potentiate the same activity (e.g., enzymatic activity) in whole, live S. epidermidis cells.

Overexpression Assays

Overexpression assays are based on the premise that overproduction of a protein would lead to a higher level of resistance to compounds that selectively interfere with the function of that protein. Overexpression assays may be used to identify compounds that interfere with the function of virtually any type of protein, including without limitation enzymes, receptors, DNA- or RNA-binding proteins, or any proteins that are directly or indirectly involved in regulating cell growth.

Typically, two bacterial strains are constructed. One contains a single copy of the gene of interest, and a second contains several copies of the same gene. Identification of useful inhibitory compounds of this type of assay is based on a comparison of the activity of a test compound in inhibiting growth and/or viability of the two strains. The method involves constructing a nucleic acid vector that directs high level expression of a particular target nucleic acid. The vectors are then transformed into host cells in single or multiple copies to produce strains that express low to moderate and high levels of protein encoding by the target sequence (strain A and B, respectively). Nucleic acid comprising sequences encoding the target gene can, of course, be directly integrated into the host cell.

Large numbers of compounds (or crude substances which may contain active compounds) are screened for their effect on the growth of the two strains. Agents which interfere with an unrelated target equally inhibit the growth of both strains. Agents which interfere with the function of the target at high concentration should inhibit the growth of both strains. It should be possible, however, to titrate out the inhibitory effect of the compound in the overexpressing strain. That is, if the compound is affecting the particular target that is being tested, it should be possible to inhibit the growth of strain A at a concentration of the compound that allows strain B to grow.

Alternatively, a bacterial strain is constructed that contains the gene of interest under the control of an inducible promoter. Identification of useful inhibitory agents using this type of assay is based on a comparison of the activity of a test compound in inhibiting growth and/or viability of this strain under both inducing and non-inducing conditions. The method involves constructing a nucleic acid vector that directs high-level expression of a particular target nucleic acid. The vector is then transformed into host cells that are grown under both non-inducing and inducing conditions (conditions A and B, respectively).

Large numbers of compounds (or crude substances which may contain active compounds) are screened for their effect on growth under these two conditions. Agents that interfere with the function of the target should inhibit growth under both conditions. It should be possible, however, to titrate out the inhibitory effect of the compound in the overexpressing strain. That is, if the compound is affecting the particular target that is being tested, it should be possible to inhibit growth under condition A at a concentration that allows the strain to grow under condition B.

Ligand-Binding Assays

Many of the targets according to the invention have functions that have not yet been identified. Ligand-binding assays are useful to identify inhibitor compounds that interfere with the function of a particular target, even when that function is unknown. These assays are designed to detect binding of test compounds to particular targets. The detection may involve direct measurement of binding. Alternatively, indirect indications of binding may involve stabilization of protein structure or disruption of a biological function. Non-limiting examples of useful ligand-binding assays are detailed below.

A useful method for the detection and isolation of binding proteins is the Biomolecular Interaction Assay (BIAcore) system developed by Pharmacia Biosensor and described in the manufacturer's protocol (LKB Pharmacia, Sweden). The BIAcore system uses an affinity purified anti-GST antibody to immobilize GST-fusion proteins onto a sensor chip. The sensor utilizes surface plasmon resonance which is an optical phenomenon that detects changes in refractive indices. In accordance with the practice of the invention, a protein of interest is coated onto a chip and test compounds are passed over the chip. Binding is detected by a change in the refractive index (surface plasmon resonance).

A different type of ligand-binding assay involves scintillation proximity assays (SPA, described in U.S. Pat. No. 4,568,649).

Another type of ligand binding assay, also undergoing development, is based on the fact that proteins containing mitochondrial targeting signals are imported into isolated mitochondria in vitro (Hurt et al., 1985, *Embo J* 4:2061-2068; Eilers and Schatz, *Nature,* 1986, 322:228-231). In a mitochondrial import assay, expression vectors are constructed in which nucleic acids encoding particular target proteins are inserted downstream of sequences encoding mitochondrial import signals. The chimeric proteins are synthesized and tested for their ability to be imported into isolated mitochondria in the absence and presence of test compounds. A test compound that binds to the target protein should inhibit its uptake into isolated mitochondria in vitro.

Another ligand-binding assay is the yeast two-hybrid system (Fields and Song, 1989, *Nature* 340:245-246). The yeast two-hybrid system takes advantage of the properties of the GAL4 protein of the yeast *Saccharomyces cerevisiae*. The GAL4 protein is a transcriptional activator required for the expression of genes encoding enzymes of galactose utilization. This protein consists of two separable and functionally essential domains: an N-terminal domain which binds to specific DNA sequences ($UAS_G$); and a C-terminal domain containing acidic regions, which is necessary to activate transcription. The native GAL4 protein, containing both domains, is a potent activator of transcription when yeast are grown on galactose media. The N-terminal domain binds to DNA in a sequence-specific manner but is unable to activate transcription. The C-terminal domain contains the activating regions but cannot activate transcription because it fails to be localized to $UAS_G$. In the two-hybrid system, a system of two hybrid proteins containing parts of GAL4: (1) a GAL4 DNA-binding domain fused to a protein 'X' and (2) a GAL4 activation region fused to a protein 'Y'. If X and Y can form a protein-protein complex and reconstitute proximity of the GAL4 domains, transcription of a gene regulated by $UAS_G$ occurs. Creation of two hybrid proteins, each containing one of the interacting proteins X and Y, allows the activation region of $UAS_G$ to be brought to its normal site of action.

The binding assay described in Fodor et al., 1991, *Science* 251:767-773, which involves testing the binding affinity of test compounds for a plurality of defined polymers synthesized on a solid substrate, may also be useful.

Compounds which bind to the polypeptides of the invention are potentially useful as antibacterial agents for use in therapeutic compositions.

Pharmaceutical formulations suitable for antibacterial therapy comprise the antibacterial agent in conjunction with one or more biologically acceptable carriers. Suitable biologically acceptable carriers include, but are not limited to, phosphate-buffered saline, saline, deionized water, or the like. Preferred biologically acceptable carriers are physiologically or pharmaceutically acceptable carriers.

The antibacterial compositions include an antibacterial effective amount of active agent. Antibacterial effective amounts are those quantities of the antibacterial agents of the present invention that afford prophylactic protection against bacterial infections or which result in amelioration or cure of an existing bacterial infection. This antibacterial effective amount will depend upon the agent, the location and nature of the infection, and the particular host. The amount can be determined by experimentation known in the art, such as by establishing a matrix of dosages and frequencies and comparing a group of experimental units or subjects to each point in the matrix.

The antibacterial active agents or compositions can be formed into dosage unit forms, such as for example, creams, ointments, lotions, powders, liquids, tablets, capsules, suppositories, sprays, aerosols or the like. If the antibacterial composition is formulated into a dosage unit form, the dosage unit form may contain an antibacterial effective amount of active agent. Alternatively, the dosage unit form may include less than such an amount if multiple dosage unit forms or multiple dosages are to be used to administer a total dosage of the active agent. Dosage unit forms can include, in addition, one or more excipient(s), diluent(s), disintegrant(s), lubricant(s), plasticizer(s), colorant(s), dosage vehicle(s), absorption enhancer(s), stabilizer(s), bactericide(s), or the like.

For general information concerning formulations, see, e.g., Gilman et al. (eds.), 1990, *Goodman and Gilman's: The Pharmacological Basis of Therapeutics,* 8th ed., Pergamon Press; and *Remington's Pharmaceutical Sciences,* 17th ed., 1990, Mack Publishing Co., Easton, Pa.; Avis et al. (eds.), 1993, *Pharmaceutical Dosage Forms: Parenteral Medications,* Dekker, New York; Lieberman et al (eds.), 1990, *Pharmaceutical Dosage Forms: Disperse Systems,* Dekker, New York.

The antibacterial agents and compositions of the present invention are useful for preventing or treating *S. epidermidis* infections. Infection prevention methods incorporate a prophylactically effective amount of an antibacterial agent or composition. A prophylactically effective amount is an amount effective to prevent *S. epidermidis* infection and will depend upon the specific bacterial strain, the agent, and the host. These amounts can be determined experimentally by methods known in the art and as described above.

*S. epidermidis* infection treatment methods incorporate a therapeutically effective amount of an antibacterial agent or composition. A therapeutically effective amount is an amount sufficient to ameliorate or eliminate the infection. The prophylactically and/or therapeutically effective amounts can be administered in one administration or over repeated administrations. Therapeutic administration can be followed by prophylactic administration, once the initial bacterial infection has been resolved.

The antibacterial agents and compositions can be administered topically or systemically. Topical application is typically achieved by administration of creams, ointments, lotions, or sprays as described above. Systemic administration includes both oral and parental routes. Parental routes include, without limitation, subcutaneous, intramuscular, intraperitoneal, intravenous, transdermal, inhalation and intranasal administration.

Exemplification

Cloning and Sequencing *S. epidermidis* Genomic Sequence

This invention provides nucleotide sequences of the genome of *S. epidermidis* which thus comprises a DNA sequence library of *S. epidermidis* genomic DNA. The detailed description that follows provides nucleotide sequences of *S. epidermidis*, and also describes how the sequences were obtained and how ORFs (Open Reading Frames) and protein-coding sequences can be identified. Also described are methods of using the disclosed *S. epidermidis* sequences in methods including diagnostic and therapeutic applications. Furthermore, the library can be used as a database for identification and comparison of medically important sequences in this and other strains of *S. epidermidis* as well as other species of *Staphylococcus*.

Chromosomal DNA from strain 19804 of *S. epidermidis* was isolated after Zymolyase digestion, sodium dodecyl sulfate lysis, potassium acetate precipitation, phenol:chloroform extraction and ethanol precipitation (Soll, D. R., T. Srikantha and S. R. Lockhart: Characterizing Developmentally Regulated Genes in *S. epidermidis*. In Microbial Genome Methods. K. W. Adolph, editor. CRC Press. New York. p 17-37.). Genomic *S. epidermidis* DNA was hydrodynamically sheared in an HPLC and then separated on a standard 1% agarose gel. Fractions corresponding to 2500-3000 bp in length were excised from the gel and purified by the GeneClean procedure (Bio101, Inc.).

The purified DNA fragments were then blunt-ended using T4 DNA polymerase. The healed DNA was then ligated to unique BstXI-linker adapters (5'-GTCTTCACCACGGGG-3' (SEQ ID NO: 5675) and 5'-GTGGTGAAGAC-3' (SEQ ID NO: 5676) in 100-1000 fold molar excess). These linkers are complimentary to the BstXI-cut pGTC vector, while the overhang is not self-complimentary. Therefore, the linkers will not concatermerize nor will the cut-vector religate itself easily. The linker-adapted inserts were separated from the unincorporated linkers on a 1% agarose gel and purified using GeneClean. The linker-adapted inserts were then ligated to BstXI-cut vector to construct a "shotgun" sublclone libraries.

Only major modifications to the protocols are highlighted. Briefly, the library was then transformed into DH5á competent cells (Gibco/BRL, DH5á transformation protocol). It was assessed by plating onto antibiotic plates containing ampicillin and IPTG/Xgal. The plates were incubated overnight at 37° C. Transformants were then used for plating of clones and picking for sequencing. The cultures were grown overnight at 37° C. DNA was purified using a silica bead DNA preparation (Engelstein, 1996) method. In this manner, 25 µg of DNA was obtained per clone.

These purified DNA samples were then sequenced using primarily ABI dye-terminator chemistry. All subsequent steps were based on sequencing by ABI377 automated DNA sequencing methods. The ABI dye terminator sequence reads were run on ABI377 machines and the data was transferred to UNIX machines following lane tracking of the gels. Base calls and quality scores were determined using the program PHRED (Ewing et al., 1998, Genome Res. 8: 175-185; Ewing and Green, 1998, Genome Res. 8: 685-734). Reads were assembled using PHRAP (P. Green, Abstracts of DOE Human Genome Program Contractor-Grantee Workshop V, January 1996, p. 157) with default program parameters and quality scores. The initial assembly was done at 2.3-fold coverage and yielded 5821 contigs.

Finishing can follow the initial assembly. Missing mates (sequences from clones that only gave reads from one end of the *Staphylococcus* DNA inserted in the plasmid) can be identified and sequenced with ABI technology to allow the identification of additional overlapping contigs.

End-sequencing of randomly picked genomic lambda was also performed. Sequencing on a both sides was done for all lambda sequences. The lambda library backbone helped to verify the integrity of the assembly and allowed closure of some of the physical gaps. Primers for walking off the ends of contigs would be selected using pick_primer (a GTC program) near the ends of the clones to facilitate gap closure. These walks can be sequenced using the selected clones and primers. These data are then reassembled with PHRAP. Additional sequencing using PCR-generated templates and screened and/or unscreened lambda templates can be done in addition.

To identify *S. epidermidis* polypeptides the complete genomic sequence of *S. epidermidis* were analyzed essentially as follows: First, all possible stop-to-stop open reading frames (ORFs) greater than 180 nucleotides in all six reading frames were translated into amino acid sequences. Second, the identified ORFs were analyzed for homology to known (archeabacter, prokaryotic and eukaryotic) protein sequences. Third, the coding potential of non-homologous sequences were evaluated with the program GENEMARK™ (Borodovsky and McIninch, 1993, Comp. Chem. 17:123).

EE341901427US Identification, Cloning and Expression of *S. epidermidis* Nucleic Acids Expression and purification of the *S. epidermidis* polypeptides of the invention can be performed essentially as outlined below.

To facilitate the cloning, expression and purification of membrane and secreted proteins from *S. epidermidis*, a gene expression system, such as the pET System (Novagen), for cloning and expression of recombinant proteins in *E. coli*, is selected. Also, a DNA sequence encoding a peptide tag, the His-Tag, is fused to the 3' end of DNA sequences of interest in order to facilitate purification of the recombinant protein products. The 3' end is selected for fusion in order to avoid alteration of any 5' terminal signal sequence.

PCR Amplification and Cloning of Nucleic Acids Containing ORF's Encoding Enzymes Nucleic acids chosen (for example, from the nucleic acids set forth in SEQ ID NO: 1-SEQ ID NO: 2837) for cloning from the 18972 strain of S. epidermidis are prepared for amplification cloning by polymerase chain reaction (PCR). Synthetic oligonucleotide primers specific for the 5' and 3' ends of open reading frames (ORFs) are designed and purchased from GibcoBRL Life Technologies (Gaithersburg, Md., USA). All forward primers (specific for the 5' end of the sequence) are designed to include an NcoI cloning site at the extreme 5' terminus. These primers are designed to permit initiation of protein translation at a methionine residue followed by a valine residue and the coding sequence for the remainder of the native S. epidermidis DNA sequence. All reverse primers (specific for the 3' end of any S. epidermidis ORF) include a EcoRI site at the extreme 5' terminus to permit cloning of each S. epidermidis sequence into the reading frame of the pET-28b. The pET-28b vector provides sequence encoding an additional 20 carboxy-terminal amino acids including six histidine residues (at the extreme C-terminus), which comprise the His-Tag.

Genomic DNA prepared from the 18972 strain of S. epidermidis is used as the source of template DNA for PCR amplification reactions (Current Protocols in Molecular Biology, John Wiley and Sons, Inc., F. Ausubel et al., eds., 1994). To amplify a DNA sequence containing a S. epidermidis ORF, genomic DNA (50 nanograms) is introduced into a reaction vial containing 2 mM $MgCl_2$, 1 micromolar synthetic oligonucleotide primers (forward and reverse primers) complementary to and flanking a defined S. epidermidis ORF, 0.2 mM of each deoxynucleotide triphosphate; dATP, dGTP, dCTP, dTTP and 2.5 units of heat stable DNA polymerase (Amplitaq, Roche Molecular Systems, Inc., Branchburg, N.J., USA) in a final volume of 100 microliters.

Upon completion of thermal cycling reactions, each sample of amplified DNA is washed and purified using the Qiaquick Spin PCR purification kit (Qiagen, Gaithersburg, Md., USA). All amplified DNA samples are subjected to digestion with the restriction endonucleases, e.g., NcoI and EcoRI (New England BioLabs, Beverly, Mass., USA) (Current Protocols in Molecular Biology, John Wiley and Sons, Inc., F. Ausubel et al., eds., 1994). DNA samples are then subjected to electrophoresis on 1.0% NuSeive (FMC BioProducts, Rockland, Me. USA) agarose gels. DNA is visualized by exposure to ethidium bromide and long wave uv irradiation. DNA contained in slices isolated from the agarose gel is purified using the Bio 101 GeneClean Kit protocol (Bio 101 Vista, Calif., USA).

Cloning of S. epidermidis Nucleic Acids into an Expression Vector

The pET-28b vector is prepared for cloning by digestion with restriction endonucleases, e.g., NcoI and EcoRI (Current Protocols in Molecular Biology, John Wiley and Sons, Inc., F. Ausubel et al., eds., 1994). The pET-28a vector, which encodes a His-Tag that can be fused to the 5' end of an inserted gene, is prepared by digestion with appropriate restriction endonucleases.

Following digestion, DNA inserts are cloned (Current Protocols in Molecular Biology, John Wiley and Sons, Inc., F. Ausubel et al., eds., 1994) into the previously digested pET-28b expression vector. Products of the ligation reaction are then used to transform the BL21 strain of E. coli (Current Protocols in Molecular Biology, John Wiley and Sons, Inc., F. Ausubel et al., eds., 1994) as described below.

Transformation of Competent Bacteria with Recombinant Plasmids

Competent bacteria, E coli strain BL21 or E. coli strain BL21 (DE3), are transformed with recombinant pET expression plasmids carrying the cloned S. epidermidis sequences according to standard methods (Current Protocols in Molecular, John Wiley and Sons, Inc., F. Ausubel et al., eds., 1994). Briefly, 1 microliter of ligation reaction is mixed with 50 microliters of electrocompetent cells and subjected to a high voltage pulse, after which, samples are incubated in 0.45 milliliters SOC medium (0.5% yeast extract, 2.0% tryptone, 10 mM NaCl, 2.5 mM KCl, 10 mM MgCl2, 10 mM MgSO4 and 20, mM glucose) at 37° C. with shaking for 1 hour. Samples are then spread on LB agar plates containing 25 microgram/ml kanamycin sulfate for growth overnight. Transformed colonies of BL21 are then picked and analyzed to evaluate cloned inserts as described below.

Identification of Recombinant Expression Vectors with S. epidermidis Nucleic Acids Individual BL21 clones transformed with recombinant pET-28b S. epidermidis ORFs are analyzed by PCR amplification of the cloned inserts using the same forward and reverse primers, specific for each S. epidermidis sequence, that were used in the original PCR amplification cloning reactions. Successful amplification verifies the integration of the S. epidermidis sequences in the expression vector (Current Protocols in Molecular Biology, John Wiley and Sons, Inc., F. Ausubel et al., eds., 1994).

Isolation and Preparation of Nucleic Acids from Transformants

Individual clones of recombinant pET-28b vectors carrying properly cloned S. epidermidis ORFs are picked and incubated in 5 mls of LB broth plus 25 microgram/ml kanamycin sulfate overnight. The following day plasmid DNA is isolated and purified using the Qiagen plasmid purification protocol (Qiagen Inc., Chatsworth, Calif., USA).

Expression of Recombinant S. epidermidis Sequences in E. coli

The pET vector can be propagated in any E. coli K-12 strain e.g. HMS174, HB101, JM109, DH5, etc. for the purpose of cloning or plasmid preparation. Hosts for expression include E. coli strains containing a chromosomal copy of the gene for T7 RNA polymerase. These hosts are lysogens of bacteriophage DE3, a lambda derivative that carries the lacI gene, the lacUV5 promoter and the gene for T7 RNA polymerase. T7 RNA polymerase is induced by addition of isopropyl-B-D-thiogalactoside (IPTG), and the T7 RNA polymerase transcribes any target plasmid, such as pET-28b, carrying its gene of interest. Strains used include: BL21(DE3) (Studier, F. W., Rosenberg, A. H., Dunn, J. J., and Dubendorff, J. W. (1990) Meth. Enzymol. 185, 60-89).

To express recombinant S. epidermidis sequences, 50 nanograms of plasmid DNA isolated as described above is used to transform competent BL21 (DE3) bacteria as described above (provided by Novagen as part of the pET expression system kit). The lacZ gene. (beta-galactosidase) is expressed in the pET-System as described for the S. epidermidis recombinant constructions. Transformed cells are cultured in SOC medium for 1 hour, and the culture is then plated on LB plates containing 25 micrograms/ml kanamycin sulfate. The following day, bacterial colonies are pooled and grown in LB medium containing kanamycin sulfate (25 micrograms/ml) to an optical density at 600 nM of 0.5 to 1.0 O.D. units, at which point, 1 millimolar IPTG was added to the culture for 3 hours to induce gene expression of the *S. epidermidis* recombinant DNA constructions.

After induction of gene expression with IPTG, bacteria are pelleted by centrifugation in a Sorvall RC-3B centrifuge at 3500×g for 15 minutes at 4° C. Pellets are resuspended in 50 milliliters of cold 10 mM Tris-HCl, pH 8.0, 0.1 M NaCl and 0.1 mM EDTA (STE buffer). Cells are then centrifuged at 2000×g for 20 min at 4° C. Wet pellets are weighed and frozen at −80° C. until ready for protein purification.

A variety of methodologies known in the art can be utilized to purify the isolated proteins. (Current Protocols in Protein Science, John Wiley and Sons, Inc., J. E. Coligan et al., eds., 1995). For example, the frozen cells may be thawed, resuspended in buffer and ruptured by several passages through a small volume microfluidizer (Model M-110S, Microfluidics International Corporation, Newton, Mass.). The resultant homogenate may be centrifuged to yield a clear supernatant (crude extract) and following filtration the crude extract may be fractionated over columns. Fractions may be monitored by absorbance at $OD_{280}$ nm. and peak fractions may analyzed by SDS-PAGE The concentrations of purified protein preparations may be quantified spectrophotometrically using absorbance coefficients calculated from amino acid content (Perkins, S. J. 1986 Eur. J. Biochem. 157, 169-180). Protein concentrations are also measured by the method of Bradford, M. M. (1976) Anal. Biochem. 72, 248-254, and Lowy, O. H., Rosebrough, N., Farr, A. L. & Randall, R. J. (1951) J. Biol. Chem. 193, pages 265-275, using bovine serum albumin as a standard.

SDS-polyacrylamide gels of various concentrations may be purchased from BioRad (Hercules, Calif., USA), and stained with Coomassie blue. Molecular weight markers may include rabbit skeletal muscle myosin (200 kDa), *E. coli* (-galactosidase (116 kDa), rabbit muscle phosphorylase B (97.4 kDa), bovine serum albumin (66.2 kDa), ovalbumin (45 kDa), bovine carbonic anhydrase (31 kDa), soybean trypsin inhibitor (21.5 kDa), egg white lysozyme (14.4 kDa) and bovine aprotinin (6.5 kDa).

Equivalents

Those skilled in the art will recognize, or be able to ascertain using no more than routine experimentation, many equivalents to the specific embodiments and methods described herein. The specific embodiments described herein are offered by way of example only, and the invention is to limited only by the terms of the appended claims, along with the full scope of equivalents to which such claims are entitled.

Lengthy table referenced here

US07416862-20080826-T00001

Please refer to the end of the specification for access instructions.

LENGTHY TABLES

The patent contains a lengthy table section. A copy of the table is available in electronic form from the USPTO web site (http://seqdata.uspto.gov/?pageRequest=docDetail&DocID=US07416862B2). An electronic copy of the table will also be available from the USPTO upon request and payment of the fee set forth in 37 CFR 1.19(b)(3).

SEQUENCE LISTING (5676 sequences)

SEQ ID NO: 1 - DNA, 204 bp, Staphylococcus epidermidis
ttgttgcaaactcatatttatgtgaaagtccgttttgaattaaccaaattgcatagttataacaataaacacaatttccatcataataaattattggcatgtgtatacactcctttttcattgcttaattatttatattcccatttaggtataataaataaacctatttttctcaattttaactcttttagaattacgcattga

SEQ ID NO: 2 - DNA, 342 bp, Staphylococcus epidermidis
tttttattaaacataaaagaggtgaaatcaatgctagaatttagaaatgtgtataaatcttttaaaaaaaaagaaatattatgtgatgttaattacaaattatctgctggagaaaaggttggtcttataggttctaatgggtctggaaaatcaacattaatgaaacttatagctaaaactcaattaccatctaaaggaaatgtttatttgaacaatatagatatacataaatctcacaatatgataaaagatttttctttcatgataggacaaatatattatcctgagttaaatgcaagaacaaatattgaaaattacctaaaaattaataataagaattag

SEQ ID NO: 3 - DNA, 381 bp, Staphylococcus epidermidis
ataaacctatttttctcaattttaactcttttagaattacgcattgatgtttacttggcaaatttattaattattttagtcccatctattacatcagctatcttaattattttcacttcaaaaatgaaattatatttatggttaaatgtaatttcaaacctaattttttacattatttatagtaaatatatcatgcatctagatggttatctatcctatatcgagagggcgcaaatcaataatagtgatatagaaattaaaatatctccaaatatgcttgaattatctcagattatctttttattttttgtttatttaatacctcaaatgattgtagtttttattaaacataaaagaggtgaaatcaatgctagaatttag

SEQ ID NO: 4 - DNA, 198 bp, Staphylococcus epidermidis
  unsure (38),(46),(66),(147),(161): Identity of nucleotide at the above locations are unknown.
gcgcatcaacgcggtggcgcacggcgcggggtggccantgtggtantggccgcaacaggcatccancaagttgccgctgccgcaaaggcaaatggatgtactcatggttaccaccaatacttctcgaaattttccgggttggcccanaaacgggcattcanccaatccggcacttgtttgtattcaagcagatcgtag

SEQ ID NO: 5 - DNA, 549 bp, Staphylococcus epidermidis
  unsure (23),(37),(118),(138),(146),(189),(233): Identity of nucleotide at the above locations are unknown.
atacaaacaagtgccggattggntgaatgcccgtttntgggccaacccggaaaatttcgagaagtattggtggtaaccatgagtacatccatttgcctttgcggcagcggcaacttgntggatgcctgttgcggccantaccacantggccaccccgcgccgtgcgccaccgcgttgatgcgctcacgntacagcgcctatgtgctggggctggtggattatctggtggccantacgctaccggcacaacagaacggcctcgaccgtgatgccatcggggcctggagcgcgcaaagcacctggctcggcctggaagtggaaagctccgaggtgtttggtgggcagccggaacatgcctttgtcacttttaccgcacgctggcatgacagcaccggcgaacacagccaccgcgaacagttgtctttcgtacagaacgatgggcgttggtactttattgatcctacggtggaggtgaaggccgggcgtaatgatgcctgcctgtgcggcagtgggcagaagttcaagaagtgctgttccagttacctgtaa

SEQ ID NO: 6 - DNA, 243 bp, Staphylococcus epidermidis
  unsure (11),(92),(112),(120),(163),(207): Identity of nucleotide at the above locations are unknown.
atgcccgtttntgggccaacccggaaaatttcgagaagtattggtggtaaccatgagtacatccatttgcctttgcggcagcggcaacttgntggatgcctgttgcggccantaccacantggccaccccgcgccgtgcgccaccgcgttgatgcgctcacgntacagcgcctatgtgctggggctggtggattatctggtggccantacgctaccggcacaacagaacggcctcgaccgtga

SEQ ID NO: 7 - DNA, 240 bp, Staphylococcus epidermidis
tcgatccaggcgttgagcggcgacggtgtggcgttgcattacctgctggaggcgtacaagcatttgaaggcgattgccttggcgggtgaggcgaagcagttgctgcaggtgctcaagctggacgcggatgcggggttgattgtcggcggggatgccaaggcgttgaaggcgtttattgcggcgattgcccagcatcgggtctgggaacgggagcctatggccaaggcggttccggcttaa

SEQ ID NO: 8 - DNA, 249 bp, Staphylococcus epidermidis
  unsure (2),(147): Identity of nucleotide at the above locations are unknown.
gntggccaccgccgaggaccaactcgccgcgttgcaggcccaatcgcccgacgacccggcactcgagccgtatcagcgccaactggccgaggcctatttgcagcgcagccagatcgtcctgcaaaaaggcgatgtcaacgccgccgntacggccttgagccgcgcccgggcgttgatgcccaaggctcccgcgctgaccggtggggtcaacaacgccatcgcccacgcgcgcaaggccgagctggataa

SEQ ID NO: 9 - DNA, 735 bp, Staphylococcus epidermidis
  unsure (341),(486),(501),(513),(709): Identity of nucleotide at the above locations are unknown.
atcaatccgcttcacccgtttagtcagcagcgtgttcagccacgggtaatcctcggtgcgcggcacctggatgctcacatcacactggtaattcaccacatcggtggcgatggcatccagttgatggcgcaattcctggatatccgtgaggttcagcgccaccgtggtgctttcggcggtggggtcgatgaccttggctggcggcttggcttcggcagctttcagggcggcttcggctttatccagctcggccttgcgcgcgtgggcgatggcgttgttgaccccaccggtcagcgcgggagccttgggcatcaacgcccgggcgcggctcaaggccgtancggcggcgttgacatcgcctttttgcaggacgatctggctgcgctgcaaataggcctcggccagttggcgctgatacggctcgagtgccgggtcgtcgggcgattgggcctgcaacgcggcgagttggtcctcggcggtggccanctcactgctggccangttttgttccanctgtgcaatggccacagcgcgcgcatcccgcacctccggggccaacgggcggggtgcttttgcaggcgcccaccaccagggaaaatgccggcaggaacaaataaacggaggttaacggcttcattcctgccactctctaattgcgccaaaagcgagcaagtctacccccctccgacgggggcagggacaaactcanccataaacaattgcgggggccggtga

SEQ ID NO: 10 - DNA, 267 bp, Staphylococcus epidermidis
ggcgaagcagttgctgcaggtgctcaagctggacgcggatgcggggttgattgtcggcggggatgccaaggcgttgaaggcgtttattgcggcgattgcccagcatcgggtctgggaacgggagcctatggccaaggcggttccggcttaagtcattggttgtttgatagggcgccatcgcgggcaagtcgaatcgtcgcactgcccgcgattggcttcagtcggctttacgcggaatcaacacaacctgcgccggaatatgcctga

SEQ ID NO: 11 - DNA, 237 bp, Staphylococcus epidermidis
agacggatttgcaaatcgcaggtttggaaaaaaccaggcgtcggtgatgaaaagccgtacatcagcgtcgcaatttcagaacgcacagtggggacaaaaagcacctctggctctgatgaacagcctgcacaatcgtcgtcatcgccttcaagcgaatcccattcgtcacaacaggcacatcagcctcaaccccaacaggatcaacacccaagcggagtagcaggcttcaatttttga

SEQ ID NO: 12 - DNA, 324 bp, Staphylococcus epidermidis
aaaatgaatttagaaaacttaacaactgaacgtaaaaatgaaaatacaatgggcttaaatgagatgagtgtcaaagaagctttacaaaaaatgaatcaagaagaccaaaaagttgcaatggcagtgggtcaagaattagcagccattgaaccagtggtagaagccatcatcaaaagcttcaatcaaggcggccgcttgatctacatgggcgctggtacaagtggtcggttaggtgtcttaaatgcagccgaatgcgtaccaacttttggcgtcaagccaaagatggttcaaggccccatccgctggtgggccaaaaaccattga

SEQ ID NO: 13 - DNA, 888 bp, Staphylococcus epidermidis
  unsure (505): Identity of nucleotide at the above locations are unknown.
cctcggtttagattcgggtcgagtcgacctttaatcgagttgggcgtaactggccttcggatggactacggcattacgatagaacaaatggctcatgcttcacataagattgatataggattgaatgctagtaccattacactggaagaagtggctgagttaaaggctcatcaagcggacttttctcgcttagaagcttggcataattattatccaagacctgaaaccggcattggaacaacattttttaatgaaaagaaccgctggcttaaagaattaggcttacaagtttttacttttgtgccaggagatgggcaaacaagaggcccaatttttgctggtttaccaacattagaaaaacatcgggggcaaaatcctttcgccgctgccgttggtttgatggctgatccttatgtcgatgctgtttatattggtgatcctacaattagtgagcgaaccatggctcaatttggttattatcaccaaaccaatcaatttctgttanaagtagcacctagcgagagccgctatttgaagcgaatacttgggactcataccaatcgtttagatgctgcaagagatgttttgcgaagtgaattatcaaaaacgagtgaaatgttcagaaaagatgaaattgcaacgattgagtcagagcagactgaagcacgtccagtgggaaccgtaacgattgataatgaaaaatatggtcgctatatgggagaaattcaagtcacacttgtggacttgccgaaagatgaaaaagtcaatacgattacacgaattattgaaaaagatcaaacgatattgccgttaatcaaggcaggcaatcaatttacgctagtcacggaaggaacgatagaaaatgaatttagaaaacttaacaactga

SEQ ID NO: 14 - DNA, 228 bp, Staphylococcus epidermidis
cttgccacaacggcagcaatggcgcgccgtgacacagtgcttccagttgggcgaagaaccgtgccatgtcttctaggttgctcgggccgtgatcttcacgcagcagcccggccaggccctgttgcagcatttgccgccagtgctgcagttgctcggcaaagtcggccggtgcccgctgggccagatcgtcatcgggcagcggggcgatcaccagcagttgcgggctga

SEQ ID NO: 15 - DNA, 186 bp, Staphylococcus epidermidis
cccggcattgcgcagcctgctcaagagctgcgacaaggtgttcaagcgcctgcaaacccagggcatcgaagggatcaacagcccggcaccggaccagttgctcaagagcctgctgttttatatcgccaaagtcacccggccgacgccgcgcatgcaaagcctcaaggaacgctacggcctggatga

SEQ ID NO: 16 - DNA, 1368 bp, Staphylococcus epidermidis
gaagaaaaagcaagagagacgaagagagaaaaggaaagggagaggaaccagccagaaagagaaccagaaaaaaggacaagaaagaagagaggaaaccgagaagaacagatgacgaaaacggaaagaagaaccgggcagagcgaccaagagcgagacaagggaaccagagaagaggagagaagagaaaaaacaagaaggaaaaaagcggggaagagaaagagggcgaagaaagcaaaagaggaaaaaagaacgaaaggccaaaaaagagaagaggggagagagcaggcagggggggaggcccccaaaatgggattctcacttttcaacccattcagaaggggagtcgtattggttgacgggcacgaaaacgtcgccctagaatgggtcaagggcgagatcgcggacaccgtgaagcaggcccgtgcggcaatggacgcctttgcggacgacgccagcgagcaagccctcgcgcagtgcgtggagggcattcatcaggtccacggcgccctgcagatggtcgagttctacggcgcggcactgctcgccgaagaaatggagcacctggcccaggccatgcaagccgggcacgtcagccagcgcgaagaaggcatccgcctgctgcaacaggccctcgggcaactgccgttgtacctggaccgtgtgcacagcgcccggcgcgacctgcccctggtagtgttgccgctgctcaacgacctgcgcagcgtgcacggcaaaagcctgctctcggaaaccagcctgttcagcccgcaactgctggtgatcgccccgctgcccgatgacgatctggcccagcgggcaccggccgactttgccgagcaactgcagcactggcggcaaatgctgcaacagggcctggccgggctgctgcgtgaagatcacggcccgagcaacctagaagacatggcacggttcttcgcccaactggaagcactgtgtcacggcgcgccattgctgccgttgtggcaagtcacctcggcgctggccgaaggcatgctcactggcgtgatcgccaatagcccggcattgcgcagcctgctcaagagctgcgacaaggtgttcaagcgcctgcaaacccagggcatcgaagggatcaacagcccggcaccggaccagttgctcaagagcctgctgttttatatcgccaaagtcacccggccgacgccgcgcatgcaaagcctcaaggaacgctacggcctggatgaagccttgcccgacagcaccgtggtcgatgccgagcgcgcgcgcctggccgggccggaccgcaatgccatgggctcggtgctcggcgcgttgtgtgaggagttggtgcgggtcaaggaacgcctggacctgtttgtgcgcgactct

SEQ ID NO: 17 - DNA, 444 bp, Staphylococcus epidermidis
cgggcacgaaaacgtcgccctagaatgggtcaagggcgagatcgcggacaccgtgaagcaggcccgtgcggcaatggacgcctttgcggacgacgccagcgagcaagccctcgcgcagtgcgtggagggcattcatcaggtccacggcgccctgcagatggtcgagttctacggcgcggcactgctcgccgaagaaatggagcacctggcccaggccatgcaagccgggcacgtcagccagcgcgaagaaggcatccgcctgctgcaacaggccctcgggcaactgccgttgtacctggaccgtgtgcacagcgcccggcgcgacctgcccctggtagtgttgccgctgctcaacgacctgcgcagcgtgcacggcaaaagcctgctctcggaaaccagcctgttcagcccgcaactgctggtgatcgccccgctgcccgatga

SEQ ID NO: 18 - DNA, 267 bp, Staphylococcus epidermidis
cgaaaacggaaagaagaaccgggcagagcgaccaagagcgagacaagggaaccagagaagaggagagaagagaaaaaacaagaaggaaaaaagcggggaagagaaagagggcgaagaaagcaaaagaggaaaaaagaacgaaaggccaaaaaagagaagaggggagagagcaggcagggggggaggcccccaaaatgggattctcacttttcaacccattcagaaggggagtcgtattggttgacgggcacgaaaacgtcgccctag

SEQ ID NO: 19 - DNA, 357 bp, Staphylococcus epidermidis
agaagaaaaagcaagagagacgaagagagaaaaggaaagggagaggaaccagccagaaagagaaccagaaaaaaggacaagaaagaagagaggaaaccgagaagaacagatgacgaaaacggaaagaagaaccgggcagagcgaccaagagcgagacaagggaaccagagaagaggagagaagagaaaaaacaagaaggaaaaaagcggggaagagaaagagggcgaagaaagcaaaagaggaaaaaagaacgaaaggccaaaaaagagaagaggggagagagcaggcagggggggaggcccccaaaatgggattctcacttttcaacccattcagaaggggagtcgtattggttga

SEQ ID NO: 20 - DNA, 195 bp, Staphylococcus epidermidis
ggaatatttctcaggttatcaccccttgggagatcacattttgaggaacaccaatttggccaccgaacagttttttcacgctatattaaacttctccccggcgttttttgggggggagcccaaaaacgggaaggccaaaatgccgcccaaaagaggggattaagggggaaacacgggaaaatggcggaaaattcc

SEQ ID NO: 21 - DNA, 207 bp, Staphylococcus epidermidis
cgtcagatactgcaccccctgaacccccatgctccaacagcaaaaaggaaactttttgctgcttttccgacgcttattcgcttcgctcatatttatatagaaaagaagcgaatgcgcaaaagacataatcgattcacaaaaaataggtacacgaaaaacaagttaagggatgcagtttatgcatcccttaacttacttattaaataa

SEQ ID NO: 22 - DNA, 396 bp, Staphylococcus epidermidis
gcaaaattcattataaccaaattaaagagggttataatgaacgagaaaaatataaaacacagtcataactttattacttcaaaacataatatagataaaataatgacaaatataagattaaatgaacatgataatatctttgaaatcggctcaggaaaaggccattttacccttgaattagtacagaggtgtaatttcgtaactgccattgaaatagaccataaattatgcaaaactacagaaaataaacttgttgatcacgataatttccaagttttaaacaaggatatattgcagtttaaatttcctaaaaaccaatcctataaaatatttggtaatataccttataacataagtaccagatataatacgcaaaatttgtttttgatagtatag

SEQ ID NO: 23 - DNA, 405 bp, Staphylococcus epidermidis
tacgcaaaatttgtttttgatagtatagctgatgagatttatttaatggtggaatacgggtttgctaaaagattattaaatacaaaacgctcatgggcattacttttaatggcagaagttgatatttctatattaagtatggttccaagagaatattttcatcctaaacctaaagtgaatagctcacttatcagattaaatagaaaaaaatcaagaatatcacacaaagataaacagaagtataattatttcgttatgaaatgggttaacaaagaatacaagaaaatatttacgaaaaatcaatttaacaattccttaaaacatgcaggaattgacgatttaaacaatattagctttgaacaattcttatctcttttcaatagctataaattatttaataagtaa

SEQ ID NO: 24 - DNA, 321 bp, Staphylococcus epidermidis
  unsure (311): Identity of nucleotide at the above locations are unknown.
cgaggcttcctatatcaccggcgtgaccttgccgataggaggtggcgacctcggctgattcaccgttacctgcagacattgactcacaacaacaataaagagagcactgccatgcgtacccatgacgttcattcgattatcgacaatgcccctttcaatcgcttccattggctggttgtcagcctgtgtgccttgctgttgatctttgatggctatgacttgtttatctatggcgtggtcttgccatcgatcatgcgcgagtcggggctgacgcccctgcagaccggcgccctgagcatatatgattgttncgcccccccc

SEQ ID NO: 25 - DNA, 735 bp, Staphylococcus epidermidis
aatcgcgcccgcttgctcgtcgatgctgccgtagcgtttcatcgggctgctgtcgagggtctggtcgacgatctgctggtaccacacgcgctcctgctcgctttgcggctggctgttgcgcgggatgcgccgcggtggggcctcggtgccgcccggtgcggtggcattgacacggatgccgctgccggcggtctccagggccaggcacgcggtcagggcattgaccccgcccttggccgcgccatagggcacccgattgaccccgcgtgtggcgaccgaagacacattgacgatggccccactgccctgctccagcatgtagggcagcacgcaatggcaacaccacaacgtggggaacagcgagcggcgcacttcggcttcgatttgcgctaccgcgtagaactcaaagggcttggcccagatagtcccgccgacgttgttgatcagaatgtggatgcgcccaaaccgcaccttggcggcggccatgacctcggcacacgcggcatgttgctcaaggtcggcgatcagggtcagcagccgcgcatgctgcaactcatgcaccagctccgagcgatcgaccgcgaccacccaggcgccctccgccagcaaccgctcggccacgcgccggccgatgccctgggcggcgccggtaaccagcgctaccttggtgtcaaaacgtggattcatgctgatctcctcacgcggcgtcagaacttgcgacggcattggcggtga

SEQ ID NO: 26 - DNA, 312 bp, Staphylococcus epidermidis
  unsure (11): Identity of nucleotide at the above locations are unknown.
ggggggggcgnaacaatcatatatgctcagggcgccggtctgcaggggcgtcagccccgactcgcgcatgatcgatggcaagaccacgccatagataaacaagtcatagccatcaaagatcaacagcaaggcacacaggctgacaaccagccaatggaagcgattgaaaggggcattgtcgataatcgaatgaacgtcatgggtacgcatggcagtgctctctttattgttgttgtgagtcaatgtctgcaggtaacggtgaatcagccgaggtcgccacctcctatcggcaaggtcacgccggtgatatag

SEQ ID NO: 27 - DNA, 819 bp, Staphylococcus epidermidis
cgaagaaattcaccgccaatgccgtcgcaagttctgacgccgcgtgaggagatcagcatgaatccacgttttgacaccaaggtagcgctggttaccggcgccgcccagggcatcggccggcgcgtggccgagcggttgctggcggagggcgcctgggtggtcgcggtcgatcgctcggagctggtgcatgagttgcagcatgcgcggctgctgaccctgatcgccgaccttgagcaacatgccgcgtgtgccgaggtcatggccgccgccaaggtgcggtttgggcgcatccacattctgatcaacaacgtcggcgggactatctgggccaagccctttgagttctacgcggtagcgcaaatcgaagccgaagtgcgccgctcgctgttccccacgttgtggtgttgccattgcgtgctgccctacatgctggagcagggcagtggggccatcgtcaatgtgtcttcggtcgccacacgcggggtcaatcgggtgccctatggcgcggccaagggcggggtcaatgccctgaccgcgtgcctggccctggagaccgccggcagcggcatccgtgtcaatgccaccgcaccgggcggcaccgaggccccaccgcggcgcatcccgcgcaacagccagccgcaaagcgagcaggagcgcgtgtggtaccagcagatcgtcgaccagaccctcgacagcagcccgatgaaacgctacggcagcatcgacgagcaagcgggcgcgattctattcctggcctctgacgaggcttcctatatcaccggcgtgaccttgccgataggaggtggcgacctcggctga

SEQ ID NO: 28 - DNA, 189 bp, Staphylococcus epidermidis
  unsure (45),(128): Identity of nucleotide at the above locations are unknown.
tcaaggatgtcggtggcgtgttggaagcgcggcgtagctgacgcnatgaactaccggggtcagacccccaatgccgctaacgtaaagccctgcgctaacgtggccgagggtctgaccccagtgctggntaatgcgtcttgtcacccgcatgcagtcccgccatcgtggcggtttcaggctgcaatgtga

SEQ ID NO: 29 - DNA, 564 bp, Staphylococcus epidermidis
  unsure (6),(287),(366),(399): Identity of nucleotide at the above locations are unknown.
ttcatngcgtcagctacgccgcgcttccaacacgccaccgacatccttgatcacattcagcgccttcaacagttgcgccgtcgaactgatctcggccgtaaacgtcatgcgggcctggcccttggcgctttgggtattgacgccgatcacgttgatcttttcacgcgaaaagatttcggagatgtcgcgcagcaagccctggcggtcgccggccagaatgaaaatatcgaccggatacacggtgtcgtggccacccgtgctgccccattccgtgaagatcacgcgtncgggcgacttggcgcgcatttcctcgaaattcttgcacgtggcgcggtggataaaacacccttgccgcgcgtgacgaanccgacgatgctgtccggcggcgccggcttgcancacttgggcagcaccgtcatcaaaccctccgtccccaccaccaaaaagccggacttggggccctgctctacactggaagcgcggctcttgcccaacacaacgggtcttccggcaccacaacttccccaatgtcgtgcaacgcctgctccacctggggcaggctga

SEQ ID NO: 30 - DNA, 504 bp, Staphylococcus epidermidis
  unsure (471): Identity of nucleotide at the above locations are unknown.
caaggcctcagcacgcgcgctgccctcgtgcatgtgatgggagacttgctcggctcggtcgccggcatcatcgccggcgccgtgatttactgtacaggctggatgcagatcgacccgctgctgtcggtgctggtgtccctgctgattttaaagtcgacgtttggcgtactgcgcgagtcctatcacttcctgatggaaggcgtgcccttgcacatcgactacatcgtcgtgggcacggacgtggatcaggtggacggcgtgattgccgtgcacgatttgcatgtgtgggatatgtcgccgggccaaccagccctgatcggccacgtggaaatcgaacacctcgaccattggccgaacgtcttgcgggcgatcaagaagatgctgttggacaagcatgggattgatcacatcacattgcagcctgaaaccgccacgatggcgggactgcatgcgggtgacaagacgcattanccagcactggggtcagaccctcggccacgttag

SEQ ID NO: 31 - DNA, 729 bp, Staphylococcus epidermidis
  unsure (46),(340),(373),(452): Identity of nucleotide at the above locations are unknown.
gcccttggaataatgcggggaaacccttgcccccaaggccccgggngttggtggaaggaattccttgccagggggggaggcaaggccgccgttcaatttggaaaccgttggcccaaaaggttgggcttttcccaagttggacgagtttttccttttccttcggcaagggtgaattcagcctgccccaggtggagcaggcgttgcacgacattggggaagttgtggtgccggaagacccgttgtgttgggcaagagccgcgcttccagtgtagagcagggccccaagtccggctttttggtggtggggacggagggtttgatgacggtgctgcccaagtgntgcaagccggcgccgccggacagcatcgtcggnttcgtcacgcgcggcaagggtgttttatccaccgcgccacgtgcaagaatttcgaggaaatgcgcgccaagtcgcccgnacgcgtgatcttcacggaatggggcagcacgggtggccacgacaccgtgtatccggtcgatattttcattctggccggcgaccgccagggcttgctgcgcgacatctccgaaatcttttcgcgtgaaaagatcaacgtgatcggcgtcaatacccaaagcgccaagggccaggcccgcatgacgtttacggccgagatcagttcgacggcgcaactgttgaaggcgctgaatgtgatcaaggatgtcggtggcgtgttggaagcgcggcgtagctga

SEQ ID NO: 32 - DNA, 750 bp, Staphylococcus epidermidis
cgtggctttcctccgcgcgctggtggcgcggctggcccaggaataccgcgtcgatccgcagcgggtatatgtcgccggctactccaatggcggccagatggctttccgcctggccgccgaagcaccggggttgccggcggcgatcgcaacggtggcggcgagcctgccgaccacggagaacgatgcctgtcggccggtcgagcggccgaccgctgcgttgctgatcaacggcacgcgcgatccgatcaatccctatctcggcggcaaggtcagcctgttcggcttcggcgaccggggcgcggtacgctcgacactggactcggcacgctggtgggccggcctgaacggcatcgcagcgccgccggacgtggcgccgctgacccgtcccggcccggtgtggaccgagcgccagcgctggcaggaagacggccatccgccggtggagctgctcagcgtgcatggcgccggccacgtgctggcgcagccggactatcgcttcccgcggattctcggcaagagcgacccggaactggacgcgccagtggaaatctggcgcttcttcagccagttgccgcgctgaggctcagacctcgaagacgaattccggacggaacccgcctctctcgtggggatagccgcccggattggccagcacccgtgcccggccgatgcggtagtcgagggcatcgtggacgtgaccgtgcagccagtagtcggcctgcgccaccagttcgtcgaggttggaagcga

SEQ ID NO: 33 - DNA, 357 bp, Staphylococcus epidermidis
tcagcaacgcagcggtcggccgctcgaccggccgacaggcatcgttctccgtggtcggcaggctcgccgccaccgttgcgatcgccgccggcaaccccggtgcttcggcggccaggcggaaagccatctggccgccattggagtagccggcgacatatacccgctgcggatcgacgcggtattcctgggccagccgcgccaccagcgcgcggaggaaagccacgtcatcgacgtcacgcagccgcgccgaatagctggcggccttgcggcaatcgttccagtggccctcgaagccgtccgggtaggccaccaggaaaccttcttgcgccgccagccggtcgaagccgtagccgctga

SEQ ID NO: 34 - DNA, 852 bp, Staphylococcus epidermidis
cacagcgaggactcgagcctgaaggtcgcgggcctgcgccggcattacctgctctacgtgccgccgggcgtgaccgagggagcgccgttgctggtggtgctgcacggctcacggggcgacggcgcgcatatgcgccgcatcagcggctacggcttcgaccggctggcggcgcaagaaggtttcctggtggcctacccggacggcttcgagggccactggaacgattgccgcaaggccgccagctattcggcgcggctgcgtgacgtcgatgacgtggctttcctccgcgcgctggtggcgcggctggcccaggaataccgcgtcgatccgcagcgggtatatgtcgccggctactccaatggcggccagatggctttccgcctggccgccgaagcaccggggttgccggcggcgatcgcaacggtggcggcgagcctgccgaccacggagaacgatgcctgtcggccggtcgagcggccgaccgctgcgttgctgatcaacggcacgcgcgatccgatcaatccctatctcggcggcaaggtcagcctgttcggcttcggcgaccggggcgcggtacgctcgacactggactcggcacgctggtgggccggcctgaacggcatcgcagcgccgccggacgtggcgccgctgacccgtcccggcccggtgtggaccgagcgccagcgctggcaggaagacggccatccgccggtggagctgctcagcgtgcatggcgccggccacgtgctggcgcagccggactatcgcttcccgcggattctcggcaagagcgacccggaactggacgcgccagtggaaatctggcgcttcttcagccagttgccgcgctga

SEQ ID NO: 35 - DNA, 699 bp, Staphylococcus epidermidis
gtgaagataccggcggttttatcaaatgactataggatgggttacgattttattcaaagcattcaagaattaagcgggatacctacttattttgttccgggaaaccatgatttatggtctgaccaagcagataaaacttcaacagaaatactatcattctttcgctcaaaagaggaatgcttgatcggcaatccaatcattattaatgatcaatatgcaattgtaggccatgtcggttggtatgattatagctatgcagatcatcgtttttctcagcaaaaaatagcaagtggtaaacattatggtgcaacttggcaagataaagtgagaacagattggtcattatcagacccgaaactatcccttttagctgctcaagaggtggaaaaagacattaacaatgtaagcccacgtcaaattattttagttacgcacgttgtaacacatcctcaattcgtagtaccaacgcctcatcgtatttttgacttttttaatgcatttattggtactcatgattttgatactatttatagaaattatcctattcgatttagtataatggggcatgttcattttagaaaaaaacttgttgaaaataacatattatatatatgtccgtgcttaggatatcaaagacaatggatgacagatgatatagcatatgaaataaatcatgctttagtcgattttgatatttag

SEQ ID NO: 36 - DNA, 627 bp, Staphylococcus epidermidis
  unsure (367): Identity of nucleotide at the above locations are unknown.
aatacctgcgcaaaaggacctgaaaaaaaattgctccacccgcaaactgccgcatccaccccccgggcgatttattatttcgacatggtgcggcgctgccattcgatccgcgaagccgcgcggcgcttgaacgtggcgtcgtcggcagtgaaccggcagatcctcaagctggaagatgagatgggggcgacgctgtttgatcgcttgccgggcggcctgcgtgtcacggcggccggcgaaatccttacacgccacatcacgctgctgttgcaggatgtggaacgggtacgcggtgaactggatgggttgcacggggtgcagaccggccatgtggaaatcgccacggtggaaggggctgccgtcgagntactgcccgccgccctcaagcgcatgcgcgagcgctatccgaaggtgacgattggcgtcacggtgcaaggctcgcagtcgattcccagcgcagtggtcaatggccaggcggatttgggactggcttttgccctacctcgcggtggcgaaatcacccaactgtgtgtcggccatttccgcctcggcgcgttgatgacaccgagccatgtgttggccggcgaaagtcatgtcagctacgcacagtgttgcgaacacgggtga

SEQ ID NO: 37 - DNA, 1044 bp, Staphylococcus epidermidis
ttgcacaacaaaaacagagatctccccaccatgactatcccgaaggcgtcaccgcagcggcccgaagatgaaaatctaggcgtcgccgccaacatggcttacggcctgcagcatgtcctcaccatgtacggtggcatcgtcgccgtaccgctgatcgtcggccaggcggccgggttgtcgccggcggatatcggcctgttgatcgccgcgtcgctgtttgccggtggcctggccaccttgttgcaaaccttgggtttaccgttctttggctgtcagttgccgctggtgcagggcgtgtcgtttgccggtgtggctaccatggtggcgatcgtcggcagtgatggcgccggcggggtgccggcgattctcggggcggtgatggccgcgtcgtttatcgggctgttgattaccccggtgttctcacgaataaccaaattcttcccgcccttggtgaccggtatcgtcatcaccaccatcggcctgacactgatgcccgttgcggcacgctgggcgatgggcggcaacacccgcgcggcggattttggcagcatgtccaacatcggcttggccgcgttgaccctgatgctggtgttgctgttgagcaagatcggcagcgcaaccatctcccgtctgtcgatcctgctggcgatggtgatcggcaccgtgattgccgtgttcctgggcatggctgacttctccggggtgacccaggggccgatgttcggtttccccacaccattccatttcggcatgccaaccttccatgtggccgcgatcatctccatgtgcatcgtggtgatggtaacgctggtggaaacctcggcggatatcctcgcggtgggcgagatcatcgacaccaaggtcgattccaagcgcttgggtaacggcttgcgcgccgacatgctgtcgagcatgttcgcgccgatctctggttcgttcacccagagtgcctttgcccagaacgtcggcctggtggcggttaccggggtgaagagccgttctgtcgtggcgaccggcgggtatccgccggatctcttcaccatg

SEQ ID NO: 38 - DNA, 624 bp, Staphylococcus epidermidis
catggtgaagagatccggcggatacccgccggtcgccacgacagaacggctcttcaccccggtaaccgccaccaggccgacgttctgggcaaaggcactctgggtgaacgaaccagagatcggcgcgaacatgctcgacagcatgtcggcgcgcaagccgttacccaagcgcttggaatcgaccttggtgtcgatgatctcgcccaccgcgaggatatccgccgaggtttccaccagcgttaccatcaccacgatgcacatggagatgatcgcggccacatggaaggttggcatgccgaaatggaatggtgtggggaaaccgaacatcggcccctgggtcaccccggagaagtcagccatgcccaggaacacggcaatcacggtgccgatcaccatcgccagcaggatcgacagacgggagatggttgcgctgccgatcttgctcaacagcaacaccagcatcagggtcaacgcggccaagccgatgttggacatgctgccaaaatccgccgcgcgggtgttgccgcccatcgcccagcgtgccgcaacgggcatcagtgtcaggccgatggtggtgatgacgataccggtcaccaagggcgggaagaatttggttattcgtga

SEQ ID NO: 39 - DNA, 192 bp, Staphylococcus epidermidis
cttctccggggtgacccaggggccgatgttcggtttccccacaccattccatttcggcatgccaaccttccatgtggccgcgatcatctccatgtgcatcgtggtgatggtaacgctggtggaaacctcggcggatatcctcgcggtgggcgagatcatcgacaccaaggtcgattccaagcgcttgggtaa

SEQ ID NO: 40 - DNA, 741 bp, Staphylococcus epidermidis
gactttgtcaccaaagttcactgcacgaaaggatcaacatgtctgaccctgcccattccggcgcaaccgtcgcaggttggggggagagccactcgaaagccccagcggcgtgagagtttcgccggccgaggcgcctttctcatcgctgcgatcggttctgcggtcggcttgggcaatatctggaggttcccttatgtcgcctatagcaatggtggtggagccttcatcgtgccttatctggtagcgctgctcaccgctggtattccgttgctcttcctcgactacgccgtcgggcataagttccggggctctccgccgatggctttacgccgtctccacaggcgcatggaggccatcgggtggtggcagaccctcatctgttgggtgatcgtcatctactatgcggtcatcattgcctgggccattcgctatgtcgggttctctgtgacgaaaacgtggggacacgacccggaggggttccttacgggcagcttcctgcacgtggctagcaacgttgacgtcgagttccacttcgtgtctggagtgttctggccattgttgttgctatggctttttgtgcttgccatcatggctaccggcgtcgagaagggcattacccgggcatcgtggatctttatgccgctgctcgcggtgatgttcattactctggttatcgtcgctcttacccttgacggggcctcgcctggacttaagcgacgttcacccgacaatcaccacgga

SEQ ID NO: 41 - DNA, 183 bp, Staphylococcus epidermidis
gacgtgggagagatctacttcgctcacgagcccggcgaggcataccccggtggcgtgaacggggcagtaaccgaaggggttgtcttcgagatactgctggtgctcggcctccgccaggtaaaactcgacgccgttggccatggagatcgcggtcgtgatggctccatagcccgcgttgagtag

SEQ ID NO: 42 - DNA, 279 bp, Staphylococcus epidermidis
ctagagagctggcctgcgaggagacagcacatgaataaaaccgagatggtctcatcggataacgcactaccagggggtcataccccagtgctggcgatgccgtacttccaccgagtgaccggagaccggctcgatcgtcccttcccaagctcagagacgatctacctagccatgggctgtttttggggagccgaaaagctgttttggaacactgacggagtactgcagaccgccgtcgggtacatgggcggtctcacccctaaccccacctaccgctag

SEQ ID NO: 43 - DNA, 240 bp, Staphylococcus epidermidis
caacaacaatggccagaacactccagacacgaagtggaactcgacgtcaacgttgctagccacgtgcaggaagctgcccgtaaggaacccctccgggtcgtgtccccacgttttcgtcacagagaacccgacatagcgaatggcccaggcaatgatgaccgcatagtagatgacgatcacccaacagatgagggtctgccaccacccgatggcctccatgcgcctgtggagacggcgtaa

SEQ ID NO: 44 - DNA, 387 bp, Staphylococcus epidermidis
ccctactcagggaatgcgccagggcaacgacgtgggcacacagtaccgttcggagatctggtgcaccaccaccgaacagttcatgacggccaccactgtcaagggctcttaccaagccaacctactcaacgcgggctatggagccatcacgaccgcgatctccatggccaacggcgtcgagttttacctggcggaggccgagcaccagcagtatctcgaagacaaccccttcggttactgccccgttcacgccaccggggtatgcctcgccgggctcgtgagcgaagtagatctctcccacgtcctacgatcaatgcacttggtcgcgactcagggcacgatgtagttgccacaccaccggagcatcatggatacgaccactactaa

SEQ ID NO: 45 - DNA, 450 bp, Staphylococcus epidermidis
gtgtacacgggatgcaccggacacgccgaaaccgttcgagtaacctacgaccccactcaggtctcgaccgaggcgatcctcactatcttcctggaaaaccatgaccctactcagggaatgcgccagggcaacgacgtgggcacacagtaccgttcggagatctggtgcaccaccaccgaacagttcatgacggccaccactgtcaagggctcttaccaagccaacctactcaacgcgggctatggagccatcacgaccgcgatctccatggccaacggcgtcgagttttacctggcggaggccgagcaccagcagtatctcgaagacaaccccttcggttactgccccgttcacgccaccggggtatgcctcgccgggctcgtgagcgaagtagatctctcccacgtcctacgatcaatgcacttggtcgcgactcagggcacgatgtag

SEQ ID NO: 46 - DNA, 339 bp, Staphylococcus epidermidis
gttggcttggtaagagcccttgacagtggtggccgtcatgaactgttcggtggtggtgcaccagatctccgaacggtactgtgtgcccacgtcgttgccctggcgcattccctgagtagggtcatggttttccaggaagatagtgaggatcgcctcggtcgagacctgagtggggtcgtaggttactcgaacggtttcggcgtgtccggtgcatcccgtgtacacctagcggtaggtggggttaggggtgagaccgcccatgtacccgacggcggtctgcagtactccgtcagtgttccaaaacagcttttcggctccccaaaaacagcccatggctag

SEQ ID NO: 47 - DNA, 186 bp, Staphylococcus epidermidis
caacaaccagccaacaatgaacaccttattcatactgattgcaggcttcattctggccggatgcattcaggccttagtaaaccctgcgcaaatattcctattatccaagctaatccaacaaatcgtaagagatgcttcgatcaattggattgggcaattactgcacaaagactttcatcactttag

SEQ ID NO: 48 - DNA, 1287 bp, Staphylococcus epidermidis
  unsure (1284): Identity of nucleotide at the above locations are unknown.
ttgttgggggagcctttttgtatatgggtggtagggggagtgttcctcgctgtgatcggcctgagtgctatctatctttttacagcccacaaaatcataagatggcggagaaagcacattgacaggatcaacgaacaagaagatgagctgggtgccattctgttcaacactttaaaatcggggaagtctataaaactggaaggagcagaacatactgccacacaccctttgaatgaagctttcacccaatacgccaatgccgcggtaacagttacaagctccggcggttttttaaacggtataaagatcctattcatcagccttgccaccggagggctacttggctggggggtattggatcagctttcaggacaacccgttattagtcttgggcaattagttgcgacattctcaatcgctggcagcttcttaatcaacattactgcgcttacagaaggctaccgggtactggatcaatttctcgcagaccagcgccgactcctgcacctactgtcgttaccaaattttggcgacgacaacggccaactcgaaataccgctaaagcccaaatcaacgttaatacttaatccctgcatcgtgactgacaccagctccatccgcttgaccatcaagacagccatcgaatttacccaaattcagtcagttgccatcactgggccaagtggagcggggaaatctaccttgctggaagtgctggcaggcttgaacccctcactgacaagcaggttgcttatcgacgacaagcccatttgcgaactgagtgcccaagcgcatttgaggtacctgaggtattgcccccagtcgccccagttcctggaaggctactttgatcactccgtactgtttggaatccccccctccccacacttgaaccacgcaattgagcaactgaacctggaagaaatcgttttaaaccgcagcctcagcgaaaacgcgtccaatatttcaggaggcgaagcaaagcgtctgtccctgctgcgcttcgtcaacaggcccggggaattcaatttattcgatgaacccagcgcgtccattgaacaaaaactggccacgcctgtgtgggatctgctgttcgatatcttcggcaaacgcggattgatatgcgtcacacatgatgtccgccacctgcaccgttttgatcaggttattgtcatgtcaaacggagcaatcattgatcaaggcccttggagcgagttggctaacaaaacgtcgatcttgacgctgttaagtgactttgatctggaaaaccaaaccggcaacagntag

SEQ ID NO: 49 - DNA, 192 bp, Staphylococcus epidermidis
ggctgcggtttaaaacgatttcttccaggttcagttgctcaattgcgtggttcaagtgtggggagggggggattccaaacagtacggagtgatcaaagtagccttccaggaactggggcgactgggggcaatacctcaggtacctcaaatgcgcttgggcactcagttcgcaaatgggcttgtcgtcgataa

SEQ ID NO: 50 - DNA, 324 bp, Staphylococcus epidermidis
aacaatacatacataattcaggccctgaggcaaggtgggataaacttattaaagaataatttaaataatttgaagtttaggaaatctaataaggatagtctaaagttaaagtggattagcttggagaaaagaaagctaaggggatgcatattagcatacgacagaaggttgaatgggaaattcttagagccgcttcatctttgtactgaaattgctatatttggggatggtttagatacagtcttgtctgagaccaagaaaggattaaatgaattcttaatgttccttcaatcctatgattctatttgttcagaaaggagataa

SEQ ID NO: 51 - DNA, 195 bp, Staphylococcus epidermidis
gcttgtctggaactcctggcctcaagcattcctcctgcctcagtctcccaaaatgctgggattatgggcatgggccatcacgcccagcctaattcagtatttttagtctcatacagaattaaagcaatgattaactacaactccaatttcaatataaagtctatacaacatgaaaaaaacaaaaaagatgaataa

SEQ ID NO: 52 - DNA, 990 bp, Staphylococcus epidermidis
aaggtgttatcatcttttttaatgttaagtataatcagttcattgctcacgatatgtgtaatttttttagtgagaatgctctatataaaatatactcaaaatattatgtcacataagatttggttattagtgctcgtctccacgttaattccattaataccattttacaaaatatcgaattttacattttcaaaagatatgatgaatcgaaatgtatctgacacgacttcttcggttagtcatatgttagatggtcaacaatcatctgttacgaaagacttagcaattaatgttaatcagtttgagacctcaaatataacgtatatgattcttttgatatgggtatttggtagtttgttgtgcttattttatatgattaaggcattccgacaaattgatgttattaaaagttcgtcattggaatcgtcatatcttaatgaacgacttaaagtatgtcaaagtaagatgcagttctacaaaaagcatataacaattagttatagttcaaacattgataatccgatggtatttggtttagtgaaatcccaaattgtactaccaactgtcgtagtcgaaaccatgaatgacaaagaaattgaatatattattctacatgaactatcacatgtgaaaagtcatgacttaatattcaaccagctttatgttgtttttaaaatgatattctggtttaatcctgcactatatataagtaaaacaatgatggacaatgactgtgaaaaagtatgtgatagaaacgttttaaaaattttgaatcgccatgaacatatacgttatggtgaatcgatattaaaatgctctattttaaaatctcagcacataaataatgtggcagcacaatatttactaggttttaattcaaatattaaagaacgtgttaagtatattgcactttatgattcaatgcctaaacctaatcgaaacaagcgtattgttgcgtatattgtatgtagtatatcgagcttcacatga

SEQ ID NO: 53 - DNA, 966 bp, Staphylococcus epidermidis
ttagtgtcatctattgacactaaaaggagaataataatgaaaaaatctgttagattatataatatgattgaatattgtaatgaaaataggaacttcaaattaaatgatttaatgtcagaatttaatatttctcgtagtaccgctttaagggatataaaagaaattgaagcattaggagtacctttatatagtaatccagggaaaaatggtggttatacgatcataggtaatcgagaccaaacgaaaatagcaatcacagatgaagagttgaaagctttagtatttacactttcgagtatttcaaatgtgagtaatctaccttttcaaacagaatatcaagaaatattaaaaaaattatataataactcgaataaaaaagagttaataaaccaatataatgatctatttcaatattttaatgaagataagtatcagttcaaaagttataagttatttaatgaaatcattagattgataattgagaataagtcttttgaaacctgttattcacaaaactatattaaagaacaatataaaggtattggcattatgtataaaaatcatcaatggtattttgttgtagctaatatagaatcaaagttagtgaatctattaaatatttcgaaaataaaagaactatatgaaatgggagagactcaagagtgtaatgatataactatgcagaattttcaacagttcatggttaaaaatgaaactgctattgatattcttattagaagcaatgttatgggattgaatatcttgaaaggctacctgtggagtgactatatgattgaaaatattgacgaagagacatatttatttaaatcaaaagtgaacgcgaaagatatagattttatagctaagttaattgtcacaggtggtgtcaatgtaaaagtagagacccctaatagtttgaaaaatgctgttaaagttgaattaactaaaataataaacatgtattaa

SEQ ID NO: 54 - DNA, 1242 bp, Staphylococcus epidermidis
gtaaagtttttagcttctcaactattcaaaggaggtttttttatcgattacttaggtgttgatattagtaaaaggagtagtgtagttgcacattataaaaatggaaaattccaaaaagagtttttcatccaaaataataaaaatggctacaattatttactcaagtatttgaatgacttagaccacccacaactcatttttgaatctacaggtatctattcaagaggtatggaacgattttgttgtgtaaatcaaattaactatattcaaatgaatccgttagaagccaaatttaaaacgagcgctctaagatcatggaaaactgatcaggcagatgctcataagcttgcttgtttaggaccgacgctcaaacaaacaggcagcttacctatacatgagttaatattctttgaattaagagaacgtgcccgttttcatctagaaatcgagaatgaacaaaatcgacttaaatttcagattcttgaattactccatcaaacattccctggtttagaaagattatttagtagtcgatattcaatcattgcactcaacatcgcagaaatttttactcatccagacgtggttcttgatatcgacaaggatgtacttattacacatatattcaattctacagataagggaatgtcaatggataaagctacaaaatatgcacttcaattaagagtgattgctcaagaaagctatcctaatgtcgatagacattcctttctagtcgaaaaattacgcttacttattcaacaattaaaacaatctattcatcatctcaaacaattagatgatgccatgattcaattagcacaacaactcgattattttgaaaatattcattcgatacctggtattggtaagctaagcacagctatgattattggggagattggtgatattaagcgatttaaatcaaataaacaactcaacgcttttgtaggcattgatatcaaacgatatcaatcaggtcatacacactgtagagataccatcaacaagcgtggtaataaaaaagcgagaaaacttttattttgggtgattatgaatataataagagggcagcatcattatgacaatcatgtcgtcgattattactacaaactaagaaagcagcctaatgagaaacctcataagactgccatcattgcttgtataaatcgattattaaaaacaattcattatcttgtaatgaatcataaattgtacgattatcaaatgtcaccacattag

SEQ ID NO: 55 - DNA, 546 bp, Staphylococcus epidermidis
tttagtacttttaacttttttttactatccgcttgtacaattaatattgagcgtgatgaggaaaatagtgagaaaaataaacagaaagaaaacactcatactgattcaaacaatacaagttcgaatgaatcaaatacttctaaacaatcatctcaagaaaatactataaatcaaacagaacaaaatcaaccgactgagaataattcaagttcacaacaagatttgcaactaataacagaaaatgaagctattcaaaaagtaaaagatgagtttccacctatacgaacaggaaatgactatcgtatagatactactagaactgataataatgtgtacgctatcaaatttacttctcaagatgcagaaggttatcctatgaaagctgctgtcactattgataagcgaacaggagaatttattgattatattgatgatagaagcgatgaagataaagagcgtcatgtccaacatgctaaagaaagtactctttataaaggtccatacgatgctttcagaaaagattttagtcataaaataaatgaatga

SEQ ID NO: 56 - DNA, 564 bp, Staphylococcus epidermidis
actgccgagttacctaaaaagacgacaagaataggtaaaccgtattataaaacggacaatttattacaaagacaatttaaagcgagttgtccaatggaagtattaacaaccgatattacttatttaccatttggtcattctatgttgtatttatcttcgataatggatatttataacggagaaattgtggcgtataaaatagatgataaacaagaccaaagtttagttaatgatacattaaatcaaatcgatatacctgagggttgtatattacatagtgatcaaggcagcgtttatacatcttatgcttattatcaattgtacgaagaaaaaggcattatcagaagtatgtcccgaaagggaacacccgccgataacgccccgatagaaagtttccattcctcgctaaagtctgaaactttttacatcaataatgagcttaatcgctctaatcatattgtaatagatattgtcgaaaagtacattaaaaactataataataatcgaattcaacaaaaactaggctacttatcccctgtgaaatacagagaattaatagcctag

SEQ ID NO: 57 - DNA, 444 bp, Staphylococcus epidermidis
ttggtttatacgttacacttattgtattttaaaaaagaggtgtcaatgatgacaaagaaaataatttattttatatgtacaggtaattcatgccgtagccaaatggctgaaggctggggtaaaaaaatcttaggagatgaatggcaagtatattctggaggtattgaggcacacggtgtaaatccaaaagcaatcgaagctatgaaagaagttggaattgatatatcaaatcatacttctaatttaattgacaaaaatatactaaaccaatccgatttagtagtaactttatgtagtgatgctgacaataattgtcctatattgccgccgaatgtaaaaaaagaacactggggatttgatgatccagcaggcaaaccttggtcagagttccaacgtgttagagatgaaatcaaaaccgccattgaatcatttaaaactagataa

SEQ ID NO: 58 - DNA, 1278 bp, Staphylococcus epidermidis
gttatggagtttaatggaattttagaagattatgctacttatatttacagaggaaagcaacccaagtattcgactaatggaataccagttatcaatcaaaaagcaattcaatggagtggattaaataaagaatttttaaaatttcataataatgaaataaaagttgattcaagacactttgttaaaaaaaatgacttactaattaattcgactggtactggcaccgttggacgagtttatcatttcaaatttcaacccgaaaagatgtttgttgactctcatataactattataagaactgatgaaaataaattaagaagtcgttttttatattatcaaatgagaacaaataaatttcaaaatatgatcttaaatgagtttttagctgggtctactggacaagtagaatttaataaatcgatggtaaaaaaattaccaatctctattccagaagttaactatcaagatgtagttatcaaagttttagatgaactagaagataaaatagaaataaataaaaaaatcatagcaaacctagaggaactatcacaaacattgtttaaacgttggtttgtagattttgaatttccaaatgaagagggtaatccctataaatctagtggtggagaaatgattgatagtgagttaggtaagataccaagtaattggaaaatctataaattaaaagatatagcaagtcataaaaaggaaacttttaatcctaaaaagagtgaagaagtaacagttaaacattttagtttacctgcttatgataatgaagaacaagctatagaggaagaagtcaataaaataaaaagtaataaatggattattaataacaattgcgtattattttcaaaaatgaatcctgatactaaaaggatttggttacctgtaatagataataaaaaattaaatgttgcttcatcagaatttgttgtaatggaatctcctaataataaaattaattcattcatatataatatatgtcttaattctcaatttatagattatttaaaagctaatactaccggttcaacaaatagtagacaaagagtaaaaccaacaatagctgttaattataaattagcaattgaagatagtattgtaaaaaaatattctgaaataatcactccatatatggaagaaatgaaaatattaagatcagaaattggtaaattaactcaattacgagatactcttcttcctaaactaatgtctggagaactagaaatatctgatgatattgaggtgaatagtgatgaactttcaatttaa

SEQ ID NO: 59 - DNA, 384 bp, Staphylococcus epidermidis
tcaagcaatacaagaactcaaacaaaaatagaaataactatatataagagaggtgattattcaatggaatttattaagtccagctctaatggaacagaggaagaacaattagaattttatgaacagatatttaatgcgctcgctgataaaattagacttaaaatcttgcattctatacgtcaaagcaatacaaagtctttgtgtgtatgtgatttggaagaattgctagaattaaaacagtctaaactttcttatcatttaaaaaaattagtagatgcaaatatcctcattgcagaaaaacatggcacatggaattattataaaattaatgaacaacaaatacaggtagtattaaatgaagatacttgttgtaagatactgtaa

SEQ ID NO: 60 - DNA, 1695 bp, Staphylococcus epidermidis
ctattatgtacaagatgtagcatcgttagatgcgtttggaggcgtattatcatgaatcatatattacaaatgttatctaagctattaagtgtggctaaggaggcaatcgaccgtcaaggtctgattgctatcctaactattcctgttaataatgacgatgaaatagaagaaacggctcaaggtgaaaccgtgtataacgaacttatcgatcagttacgacttaatatcccaaaagatacggattatcgacctaacatctatagttattttggtattaagaagaatcctaatgacaccgtactcatggaaatgatgataaaggtttttcatatcaaacgctttaattcagaactgtttgttttcaaagctaacgggtggcaaaagataaatggagatgaattacaagggttgatatctaaaatgatacaagtattgcttgtagattataagccttcactaagcactctaaaaaatgtcgtagatggattgcaaaaatcaacagatgtagaagaacttgttgaaaatgagcactatattggttgtggtgaaaatatgttcgatcttaatacgtttcaagtcgttaaaaattcaatcgatatctttcctaaaacacgattgaatttatcattaagtacaaatgatgtaattactgataagataccgccttattttaagcaatatatgttacaacttgcgaattatgacgatgatttacaatactttcttttccaacatacagcagtattacttacagctgatactaaataccgtagaggtctcattttgtatggtggagctaagaatggtaaatctgtatatattgaactagttaaatcatttttctatagtaaagatattgtgtctaagccacttaatgagcttgaaggtcgttttgacaaagaaagtttaattgacaaaagtctaatggcaagtcatgaaattgggcaatctaagattcaagaaaagattgtaaatgacttcaaaaagttattatctgtagaatcaatgcatgttgatcgtaaaggaaaaactcaagtggaagtcattttggatttgaaacttatttttagtacaaatgcgatacttaattttcctcctgaacatgcgaaagctttggagcgtcgaattaatattattccatgtgagtattatgttgaaaaagcggacacttcattaattgataagctccagagtgagaagaaagaaatctttctttacttgatgtatgtgtatcaacagattgtaaaagcagatatcgagtaccttgaaaatagccgtgtcactgaaattactcacgattggttaaattttggatatgaatttgtttctagcaggtccgtaagtattgcaaatcagaaagcatgtattaatttactcagaaaacttatagaaatcaaatcaggatcacgaatcaaagtatccgagttaaataaagttattaatgaagaaataaaggtgagttctcaggttattaatcagttaattcaagcaaactttgatactcaaaccaaactatacaatggctacgattattggattgatttaggttggaaagaagccaataaaaaagagattcatgatatttcggaaaaagataatattatttcattagataaaaatgaaaatataacagacgatgaggcattagatgaagagaatttggactttgattgggaggactgtgacgatgaataa

SEQ ID NO: 61 - DNA, 225 bp, Staphylococcus epidermidis
aaaggtgtcaccggaaatggtaaaagttacatcgcttttactttagtaaatcatgcgattgataatcggtatagtgtattattctatagattgacagatttattaagtaagctacaacaagctgattataatagcatagataaactattaaaagtgattagcagaacggatattttagtaaatgatgattttttattgccgtatacaactgaacaagaacaatag

SEQ ID NO: 62 - DNA, 435 bp, Staphylococcus epidermidis
actaaattaacgaggtgccttatgtataaagattataacatgactcaacttactctaccaatggaaacttcagttcttatccccacaaatgatatttcacgacatgtaaatgatattgtagaaacaattcccgagactgaattcgatgaattcagacatcatcgaggtgcaacatcataccatccaaaaatgatgttaaaagtagttttatatgcctacacccaatctgtgttttcaggacgtaagatagaaaaattactcaatgatagtatccgaatgatgtggctatcacaaaatcaaaagccttcttataaaacgattaatcgatttagagtaaatcccaaagtagacgctttattagaatcattatttattcaatttcatagtcagtgtttgaaacaaaatcttattgatgatcaggccattttccattga

SEQ ID NO: 63 - DNA, 273 bp, Staphylococcus epidermidis
gcaccttcaacgaaggtcgcaatggctaaagtcattaaagcttttaaacttaaacctgactgtcattgtacatcgaaatatctgaataacctcattgagcaagatcaccgtcatattaaagtaagaaagacaagatatcaaagtatcaatacggcaaagaatactttaaaaggtattgaatgtatttacggtctatataaaaagaaccgcaagtctcttcagatctgcggattttcgccatgccatgaaattagcatcatgctaacaagttaa

SEQ ID NO: 64 - DNA, 192 bp, Staphylococcus epidermidis
actattgcaactttccagcccaataaaacccatagcataaacaccattaatggattcattaatggtgaagcaattaagaaactcaccgctggaccaaaaggtactttagaatttaatagacctgcaagtattggaattgttgaacaagaacaaaagggagtaatcgcaccaaatatcatcccaaaaaaataa

SEQ ID NO: 65 - DNA, 330 bp, Staphylococcus epidermidis
atggctagaacgtataatgtgattaaatatgtcattaagaaaaataaggatgatcttaaaatacatggattaagattatatgaatttaatataaaagatgaaaaagctataaatattagccaacccatttttgtgaacagagcaactttgattgagaaaatacaaaatgatgaagcatttacgcacgcctttagagtaaatcacaatacttattatgcaggccaattaatttctttatcattgaataaaaatggttatattaataacaactttgaggcctcacgagatattattagaaacgttgaagtaagtattttagactatgaataa

SEQ ID NO: 66 - DNA, 489 bp, Staphylococcus epidermidis
atggaatttgcatattatgaagcgaaatctttaaatgattttgaaaatgaactaaaaacacttgctttaaataaaaaatatacatttagtaaagaaaccgaagtccttaaagaagaagaaattcttgaaaaatcgaatagccatgagcgcgaactattaaaagtatttaaagataatgcgcagataacaacgtatcattttaagagtcataaaagtaattatttaattattattggagagacaaaaacacctaatatcattggtctaacagtgatatttgataaaaaaccttttaaacaaatagggaaagttgcgttaggatggctaattgctttgacttcaggtggaagtatattagccattggagcagtatttggaatacttacctcagttgcaagacgtacacttgtaatcaaaggaccattaggaaaagaaatttcacaaattatagaaaatgaattaggagaaccgatagaaattaaaaaataa

SEQ ID NO: 67 - DNA, 198 bp, Staphylococcus epidermidis
ctcccatatgcaaatacaacagcaactcccaatattgcaactaataaaataacacctaagcttgcaaaaattttcttcacattgctaaccccattctatatttattttaattttatattaatctattttgctacgcttttctatatttattctaaaataattgaaaaagaacacattttgaaatcaatgtgtctttga

SEQ ID NO: 68 - DNA, 510 bp, Staphylococcus epidermidis
aataaaaaagcactaactacaattgcgataattataatttttggcatattagcacctgttgtttttttgttacaacaaatatcaagaagtagaattagaaaaaataaattacaggctaagcaaaaagaaaataatggaagtaactctcaaattattagtgaaacatctaataatatgaatccagagaatgaaagttcaagtaataatcaagaaaaaacacaaactacaacccacgaagctacaatgaatcaacaaaaggtaactagagataacatatttgattatgctattgctgctataaataaagtaggaaatgcagatttattaaaatttcaacaacctgaacacaatggttcagaatggacaattaatgcaaataataaatcaggtactggggctaacaccatcgtagttaaagatgatgaaacagttcaaatatggatggacctaaaacatctatggatcatgaaactaaacaatcagattggcgaacggttgctagttgtttag

SEQ ID NO: 69 - DNA, 216 bp, Staphylococcus epidermidis
gaagctcttttcatagaaaaaaaacacctccgtatgattcattttaatatgaattcaacgaaagtgtttttatataattcccactattggggtcagtctaaaattaaaattgataacttttttaataaaatagatacactaattttaaaacaaggtaaaaaaatagaattattaaaacaacgcaaacaaggcttactacaaaaaatgtttgtgtaa

SEQ ID NO: 70 - DNA, 693 bp, Staphylococcus epidermidis
caaaaaggagccttctgtatgaactatttcagatataaacaatttaacaaggatgttatcactgtagccgttggctactatctaagatatgcattgagttatcgtgatatatctgaaatattaagggaacgtggtgtaaacgttcatcattcaacggtctaccgttgggttcaagaatatgcaccaattttatatcgaatttggaagaaaaagcataaaaaagcttattacaaatggcgtattgatgagacgtacatcaaaataaaaggaaaatggagctatttatatcgtgccattgatgcagagggacatacattagatatttggttgcgtaagcaacgagataatcattcagcatatgcgtttatcaaacgtctcattaaacaatttggtaaacctcaaaaggtaattacagatcaggcaccttcaacgaaggtagcaatggctaaagtaattaaagcttttaaacttaaacctggctgtcattgtacatcgaaatatctgaataacctcattgagcaagatcaccgtcatattaaagtaagaaagacaaggtatcaaagtatcaatacagcaaagaatactttaaaaggtattgaatgtatttacgctctatataaaaagaaccgcaggtctcttcagatctacggattttcgccatgccacgaaattagcatcatgctagcaagttaa

SEQ ID NO: 71 - DNA, 693 bp, Staphylococcus epidermidis
caaaaaggagccttctgtatgaactatttcagatataaacaatttaacaaggatgttatcactgtagccgttggctactatctaagatatgcattgagttatcgtgatatatctgaaatattaagggaacgtggtgtaaacgttcatcattcaacggtctaccgttgggttcaagaatatgcaccaattttatatcgaatttggaagaaaaagcataaaaaagcttattacaaatggcgtattgatgagacgtacatcaaaataaaaggaaaatggagctatttatatcgtgccattgatgcagagggacatacattagatatttggttgcgtaagcaacgagataatcattcagcatatgcgtttatcaaacgtctcattaaacaatttggtaaacctcaaaaggtaattacagatcaggcaccttcaacgaaggtagcaatggctaaagtaattaaagcttttaaacttaaacctgactgtcattgtacatcgaaatatctgaataacctcattgagcaagatcaccgtcatattaaagtaagaaagacaaggtatcaaagtatcaatacagcaaagaatactttaaaaggtattgaatgtatttacgctctatataaaaagaaccgcaggtctcttcagatctacggattttcgccatgccacgaaattagcatcatgctagcaagttaa

SEQ ID NO: 72 - DNA, 306 bp, Staphylococcus epidermidis
acgttacaggcaataaaagaagatatgcacctcatcctttttgacggtaccattacccttgaaggtgaacatgctgtccgtattgatgaacacaaaattcggggggatcgtatggtcgtaccatttgatacgtttaaacaaataggaaaacctagaaaccaaaacgacatccattttaaaaacgatccttttcaaagagttacgaatgatttatggatcacgaatccctcattgtcagaagtggatcaagaacaaatatggcagactggagactatttttcaaaacaccttcagaacattgaataa

SEQ ID NO: 73 - DNA, 342 bp, Staphylococcus epidermidis
gagataacttacattatgattagtaaacaaataaaggatttacgaaagcaacataattatactcaagaagagctagctgaaaaattaaatacttcaagacaaacaatttctaaatgggaacaaggtatttcagaaccagacttaattatgcttatgcaattgtcacaattattttctgttagtacagactatctcattacaggaagtgacaatattattaaaaaagataataaaagctattatgaaatgaatttttgggcatttatgtctgaaaaatggtgggtaattattattatagtaatcataatttgtggaacaataggacaaattttttcaaactaa

SEQ ID NO: 74 - DNA, 474 bp, Staphylococcus epidermidis
aaagctaattacaaatggcgtattgatgagacgtacatcaaaataaaaggaaaatggagctatttatatcgtgccattgatgcagagggatatacattagatatttggttgcgtaagcaacgagataatcattcagcatatgcgtttatcaaacgtctcattaaacaatttggtaaacctcaaaaggtaattacagatcaggcaccttcaacgaaggtagcaatggctaaagtaattaaagcttttaaacttaaacctgactgttattgtacatcgaaatatctgaataacctcattgagcaagatcactgtcatattaaaataagaaagacaaggtatcaaaatatcaatacagcaaagaatactttaaaaggtattgaatgtatttacgctctatataaaaagaaccgcaggtctcttcagatctacggattttcgccatgccacgaaattagcatcatgctagcaagttaa

SEQ ID NO: 75 - DNA, 1203 bp, Staphylococcus epidermidis
aaggataattatatgaaaaaacatgcatataaacaacttttattaggtatgatagcaatgttaatcgttatgtctatcagtaggtttgcttatacacctatattaccatttatgcaacaagatacatctatggacaatcaagaagcggggtttttagctacatggaattatttagggtatttagttggcgctgttattccaatattttatatttataaaactaaagtaatagatttgaaaatttaccttgctttaaatattatttctactatcttaatgggatttacagaacaatatttaatttggtcaatttttcgattgatttccgggataacaagcgggacggtatttgtattaacttcaaacatagtactagattcattaaagaaaatacaaagagaggggatatcaggtgtattatatagtgctgttggattaggtatttttttaagtagtatttatctttatttttttgccagtgtggattcatggaaaatggtttggtttgttttaggaatagtttcactggttttgggcttaattgtattggtttttatgaaagaaaatacaaatacaataataaattttaaagaagaaaaaatgaaaattaataatagactaaacaaaaagtttgttatctttttttctattgcttacttctttgaaggggcaggttatattattactggtacttttctagttgctatagttaaatcaattccttctgttgctgaatatgcgactttaagctggatgtttgttggattaggtgcaattccttctacattaatttggtcacttatagctgaaaaaatcagttataaaaaagccatttatggtgcatttattttacaaattataagcgtttgtctacctgtttttactcatgaaatttttagtttagttattagttcagttctatttggagggacttttttaggtttaactacattatttatttctaaagggcaaagtttaatgtacaaaacagatgaccccttaaatttagtctcattactgactgtaatatacagtttaggacaaatgttagctcctatgtttgcgggaatcttaattggtaaatcgaataattataacattgctttaatatttgcaactgttttattaatactgggtcttatttctacaatatttagctataaacaaaacgaaagtattggtgaaaaatatgaacttaaatga

SEQ ID NO: 76 - DNA, 252 bp, Staphylococcus epidermidis
gttcaagaatatgccccgattttatatcaaatttggaagaaaaagcataaaaaagcttattacaaatggcgtattgatgagacgtacatcaaaataaaaggaaaatggaactatttatatcgtgccattgatgcagagggacatacattagatatttggttgcgtaagcaacgagataatcattcagcatatgtatttatcaaacgtctcattaaacaatttggtaaacctcaaaaggtaattacagattag

SEQ ID NO: 77 - DNA, 348 bp, Staphylococcus epidermidis
gagaaaagatatagaattggatattttaaaaaagtacaaggcattggagaggaagtggtaccaacagtagtcgtagatttagtggatcaattaaaagtaaaatattcaatcaaattgatactagaagtattaaacatacctaaatcaacatattaccgatggaaaaacaaaacccataaaaatgataccgtaacacaaaaagttattgaattatgtaaagctaaccactatacctacggttatcgtaagattacagcattgattaatcaatgttatacatcaccaattaatcataagagagtacagagaatgatgcagaagcatcatttgaactgccgagttacctaa

SEQ ID NO: 78 - DNA, 906 bp, Staphylococcus epidermidis
gagaaaagatatagaattggatattttaaaaaagtacaaggtattggaaaggaagtggtaccaacagtagtcatagatttagtggatcaattaaaagtaaaatattcaatcaaattgctactaaaagtattaaacatacctaaatcaacatattaccgatggaaaaacaaaacccataaaaatgataccgtaacacaaaaagttattgaattatgtaaagctaaccactatacctacggttatcgtaagattacagcattgattaatcaatgttatacatcaccaattaatcataagagagtacagagaatgatgcagaagcatcatttgaactgccgagttagacctaaaaagatgacaaaaataggtaaaccgtattataaaacggacaatttattacaaagacaatttaaagcgagttgtccaatggaagtattaacaaccgatattacttatttaccatttggtcattctatgttgtatttatcttcgataatggatatttataacggagaaattgtggcgtataaaatagatgataaacaagaccaaagtttagttaatgatacattaaatcaaatcgatatacctgagggttgtatattacatagtgatcaaggcagcgtttatacatcttatgcttattatcaattgtgcgaagaaaaaggcattatcagaagtatgtcccgaaagggaacacctgccgataacgccccgatagaaagtttccattcctcgctaaagtctgaaactttttacatcaataatgagcttaatcactctaatcacattgtaatagatattgtcgaaaagtacattaaaaacaataataataataataataatcgaattcaacaaaaactaggctacttatcccctgtaaaatacagagaattaatagcctag

SEQ ID NO: 79 - DNA, 1692 bp, Staphylococcus epidermidis
aaggagcggtatgatatgaagggtaaaattgcactttattcacgtgttagtacgtctgagcagtcagaacatggttattctgtaaaggagcaggaacaagtactcatcaaagaagttgtgaaaaatttcccgggttatgactatgagacatatactgactcaggcatttcaggtaaaaatattgaagatcgaccagcaatgaaacgtctattacaagatgttaaggataataaaatcgaaatggtgttaagttggaaattgaatcgtatctcacgatcaatgagagacgtgtttaatattattcatgaattcaaagaacatgacgtagggtataaatcgatttctgagaatattgatacatccaatgcttctggagaagtactcgttacaatgtttgggttaataggatctatagaacgccagactttgatttcgaatgtgaaactttctatgaatgctaaggcaaggagcggagaggcaatcaccggtcgtgttttaggctacaaattatcacttaatccattgacacagaaaaatgatttagttattgatgaaaatgaagctcatattgtacgtgaaattttcgatttatatttgaatcataataaaggcctcaaagccattacaaccgtacttaatcaaaaggggtatcgtactattaatcaaaagccattttcagtgtatggtgttaaatacattttgaataatccagtctataaaggctatgtcagattcaataaccatcaaaattgggctgttcagcgaagaagtggtaaaagtgataaaaatgatgtgatattggtcaaaggtaagcatgaagccattataagtgaagatgtatttgatcaagttcatgagaaactagcttctaaaagttttaaaccgggtagacctattggtggagatttctacttacgtggccttattaaatgcccagaatgcggaaataatatggtatgtcgacggacgtattataaaacgaaaaagtccaaagaacggacaatcaagcggtattacatttgttccttattcaatcgttcagggagttctgcatgtcacagtaattccatcaatgctgaagtcgtcgagcgtgtaattaatgttcatttgaatcgtattctgtctcaaccagatattatcaagcagattgcgtcaaatgtgatcgaagaactgaaacaaaagcatagtaaccaaacagaaattaaatatgacattgatagtttagaaaaacaaaaagctaagcttaaaagacaacaagaacgattgttagaattgttcttagatgatcaaatggatagcggaatgttaaaagctaaacaaagtgaaatgaatcaacagttggaagtattagaccaacaaattaaagaagcaaaacaagcaaatcaatcacaggatgaaatacctaattttgataaattaaaaggacgactcattttgatgataacacgattcagcgtgtacttaagaaaggctacacccgaagctaaaaatcaactcatgaaaatgttaattgattcaattgaaattacgacagataaacaagtaaaacttgtaaggtataaaattgacgaaagtcttatccctcaatctttgaaaaaagattgggggtctttttttatgcccaaatttcaatttgaaatatatggtcaaaatgattatttcatcgaccaaattaccacttttaccacttag

SEQ ID NO: 80 - DNA, 870 bp, Staphylococcus epidermidis
tgtaagtatctctcaaatattttgggaggttttattatgaaaatcaaaaaattattaaagacattattaattattttattatgttttgtattgtctgttattgtgcaaaatatttcaatgctatggcatattgtgagcatttggagtgttgaatatattttacatgcattaacttatatagtactttcatacttttcagtaaaatggttcattgaaattgtgcttaaaagcaatatgaaagattatagaataataccggtgaaatttttcaagtcttgttttcttataggattaattttgatattagtaattgatttaatatatctattatttattcctggtaaattgataatacctcattattcaacaagcgttggatttatggagatgttctttagcgcatttttaattactggtattgctgcgcctatatttgaagagatggtatttcgaggaatactaatgagatactttgaaaaacaatatggaattttatttggaattataataccctcgattttattttctcttgttcatctatttaatggagagttaaagggagaaaatttattattactacttataggtggctcaattgctggaataatgtatgcagtgactgcatggacgtttaatagtatatgggcctctgctatattacatatgctttggaatataaatggtttattaaatatcacaactcaagatgatcattggggagtatatcagtacatattagaaacaaaaaatgtactgattacaggtggggattatggtatggatacatcattactttcaatatgtagttatattgcagttattatagttatgattgttactaaaagacactttaactttttactaaagtaa

SEQ ID NO: 81 - DNA, 354 bp, Staphylococcus epidermidis
gttttaattcaaatattaaagaacgtgttaagtatattgcactttatgattcaatgcctaaacctaatcgaaacaagcgtattgttgcgtatattgtatgtagtatatcgagcttcacatgaaacagctaaagaagctttgggcgataaagagttaagagccattgcacatgagttaactaaaacagttaaggataacatgagtgttgattggtctaaacgagacagtgctaaagctaaaatgagagttcaagttagacgcctattaaagaaatatggctatccaccagatcttcaaaaaatggctgtggaacaagttgtggagcaagcagaattaatggcaagtccccaataa

SEQ ID NO: 82 - DNA, 255 bp, Staphylococcus epidermidis
atagagtatcaactttatgtccatcacaacatcacttactttttacactccattcagattgtacatatcaatgcttgtatcttaaaaatggtagctttctttatggttttaataacaacaactattaagatatatcaagaaaagtttcttcttaagttttttaagtcccttccctttaatcgaataaaagataatcgttttatttcctcatatagtttgcttgcctgctcttcttcaagttcgaaagctttataa

SEQ ID NO: 83 - DNA, 1470 bp, Staphylococcus epidermidis
ttaatacgtctgtcttttattaaaaatataattgaaggagagagtatggaaatggaattcaatgagaacaatatcgacttagagacgattatcagagatgaagttaataaatatttatctagagatattggagacttacctgcgacacaacaggcaccgctcgagttgagagagaaatatgaaaagatggaagtgccgaataaagggcgagatatctatgaagtactcaaagatttaaataatgaagtgctgaattatttatatcgtccgaaccatccacgttcattctcatttataccaggtccagcatcacgtctatcatggcttggagacattttaacaacagcaaataatatccatgcctctaattttgccaatgcgacgctgccaattaatattgagcgtaatttaattaactacttggtaggaaaaatcggttatgagatcaaaccggccggtggtgtctttgtatctggcggttcaatggccaatttaacagctatcgttgcggctagagatgcacaggtagaaatggaagatattaaaaaagcaaccgtttatcttacatctcaaacgcatcattctgtaggcaaagccttgcatgttgcaggcttccttaaaaataatatccgcagaattgagtacaacgatgactttacaatgaatacagatagcttaaaagccgcaattgataaagatattgaagaaggttacaaacctgctatggtgattgcgactgcaggcacgactaatacaggttctgtcgatgatttcaccacacttggagatatttgtgatcactacaatctatggctccatgtagacggtgcttatggactatcacatatcttatccgataaagcacaacacttatttaaaggcattgaacgttcagatagtgccagttgggatgctcacaaattactgttccaaacatatagttgcgctatggtaatcgtgaaagaaaagaatcatctgctgcaaagctttggcgaagatgctgagtacttggatgatattgcttcagatgatgatgtgattgatccagaaatgttaggcattgaacttacacgccctgcacgtgctttaaaattatggattactctgcaagtcattggtgaagatgaaattatcgagcgcattaaatacggcgaaggtttagcagaatatgcagaagaatacgtgtcaagtctcgataactggcgtattatctcacacgctaatctttccattgtgaacttcagatatgaaaacagtgatttaactgaagcacaaaataatcaactcaatagcatggctgcgcaaaaaattgcagattctggttatgccattgcttataccacagtattgaataaccaacgtgtcattcgtttatgtacaacgaatccattaacgacacatgatgatatcagagaaacaataaatcgccttgatcagtatattggtgattacgatatgaaagatgcttaa

SEQ ID NO: 84 - DNA, 231 bp, Staphylococcus epidermidis
gaattaagacatatattatatatgaatgaattaattttattattaggagattccattacaacaaattctgatgaagcaacatttaattttttattatctattacaggtaaccaaatccttttagtatcaggattcatttttgaaaataatacgcaattgttattaataatccatttattactttttattttattgacttcttcctctatagcttgttcttcattatcataa

SEQ ID NO: 85 - DNA, 714 bp, Staphylococcus epidermidis
gtaatttttaaggggtttatagttatgtatgaagaaaatatttatattaaaaattcagaatatgaatttgataataatcttaaacaattagcatcatacttaaatattcctgttagtattgttagaccttataaagaggatttaacactttatcaatataaaaaaggacaagtcatatatcattcaactgatcaaataaaatttgtatactttttagtaaatggttgtattttacatgaatcttctaatattactggtgacaattatttaagattaagtaaagacgaaaatatatttccaatgaacttcatatttaatgaaacccctgcaccatatgaaatatgtacagctttgacagattgtaaaatattaactttaccgaaagatttacttgagtatttatgtagaaagcataatgaaatatttgaaagtctcttcaagaaacttaatgagactattcaatttcaagtagaatatattatggcgttaagagctaattcagctaaagaaagaattgaaagaatactacaaattttatgcctttcaattggggatgataatggagaattctatgaattaaaacaaattatgactgttcaattaataagtaatttatctggacttaacagaaaaactactggtgaaataatcagagaattaaaaatagaaaatattatatatcaagataaaagaaattggattataaaaaaataa

SEQ ID NO: 86 - DNA, 258 bp, Staphylococcus epidermidis
cttcattttaaagggattaatgctatcaatctgtcctcaaattgtagcattcttgaactatattgttgcaatttgattgtaattatttacattttagtttacaaagctatagttcagcattatcgtaagttaactacattttattggagatactatatacttaaccaatttcaaaataagttatatacaacttattttttagttttatttgtgatacgcttctgcgtatcggttaagagtgcggttttttataattaa

SEQ ID NO: 87 - DNA, 495 bp, Staphylococcus epidermidis
ggagattttaatatggtgaaaaaagataaagacactaatgaccaaaaaagtgagagccatatgaagcataatgatgaaagtaaagttcctgaagatatgacatcgactaatgagggtgaatttaaagtaggagataaagtaacgattacagcagggcatatgccaggtatgaaaggtgcagaagctactgtaaaaggtgcgtataaaacatatgcctatgttgtaagttataaacccacaaatggaaatgaaaaagtaaacaatcataaatgggtcgtaaacgaagaaatcaaagatgcacctaaagatggatttagtaagggcgatactgttaaattagaagcaaatcatatgtctggtatgaaaggtgctacagccattatagataacgtgaaaaagactactgtttacgtagttgattacaaatccaaagataatggtaaaatcattaaaaatcataaatggatgacaggaaatgagctgaaagcacgataa

SEQ ID NO: 88 - DNA, 324 bp, Staphylococcus epidermidis
atgatgactaatgtacaaaggatgatccaaatgaataaaaagagtctccactttttattgttaaaacgcaaggttttaggtattgcattcaatttacctgaaggagaagaatttacatttcatgacttgaacagtcgtgcaaatgtaacgtgttctaaagaagtacaacaaaatgttggacgttggttcgcatattttgtaaaacatgcgccacgtgttccatttattattatcggtaaggatactcacggtcatttagtttatcttaaaacaggtcctaatccacaccataacagcaacccttcgaaaggaggtgttcgctaa

SEQ ID NO: 89 - DNA, 216 bp, Staphylococcus epidermidis
gtatattgtttaccaacttgttgtgaaaatctatatgctagttttggtaaaactgaggaaggacgctggatagctaagaatgcccataattatggatttattataagatatcctaaaaacaaagaaagcatcacaggatatcaatatgaaccttggcatttacgttatttaggaaaaagaaggcgacaaaagtgtacaaatctggtgaaacattag

SEQ ID NO: 90 - DNA, 855 bp, Staphylococcus epidermidis
atgaatcataattttatcaagctgattggagaggttaaaatgcattatataaaatttattgagtcaaaagataatacaaaactttatatgaaagtgaatgatattcaagatgcaaaagcgaatatcattatagctcatggtgtggcagaacatttagatcgttatgatgagataacagcatatttaaatgaagcgggttttagtgttattagatatgatcaaagagggcatggtcgttctgaaggcaagcgtgccttttatagcaatagtaatgaaattgtcgaagatttagatgcgataataaattatgtgaagtcaaactttgaaggtaaagtttacttaatcggtcatagtatgggtggttatacagtcactttatatggaacgaaacatccaaatacagtgaatggtattataacttctggagcattaacacgttataataataaactatttggcaatcctgatagaaacatatcacctgatacttatatagaaaacaatttaagtgagggggtatgttctgatttagaggtaatggaaaaatataaacttgatgatttgaatgcgaaacaaatctctatggggctcgtcttttcaataatggatggtgttaggtatttgaaagacaatgctcaacaatttacagataatattttgatattgcatggcaaggaagatgggctagtaagctatgtagattctttacagctttatcaagaaataggatcagcacataaatcattacacatctatgatcgtttggagcatgaaatatttaatgaaagttcttataatagaactatttttaacgaagttattgaatggcttgaaacggaattaacttataactaa

SEQ ID NO: 91 - DNA, 183 bp, Staphylococcus epidermidis
gctgaaaataatacgaaaatttataaaaaaaaagacaatttctatattatatcaatagaaattgtcttttttcatttatttagaaatgttatatctacagaattttttagtaaaatcactggtagggagaaggtagacgtatcacaccagcaaaacctgctaaagatgctaagttacacttag

SEQ ID NO: 92 - DNA, 375 bp, Staphylococcus epidermidis
acaatgaataatgatagaggaaaaagtcttcaaattccccaaagtacatcgttaaaagaaggatctatatacgttgctacattacattctgtgactgagacagattactcaggcgacataaaacatcaatttacgtatgaaatagagatagatcaacaaatattctatgtgaaccgtagtgttgtggtcaatgtgacacatcaacaattatcaattaatgactggctcgaacgtcatagtaactatagcgcaagtcatgaaaactatgagccttatattgatcagaaacatttaattctattaggtcaatataacggtaactattatgtacaagatgtagcatcgttagatgcgtttggaggcgtattatcatga

SEQ ID NO: 93 - DNA, 375 bp, Staphylococcus epidermidis
ccaaagaataaaatttttttagaaagagtggtgagaatgatggatgagaatcgctcgaaaggtaaccgctggggtgtttgggcctttttcggaatattattggttcctttattggttcctttactttgttgcgcaggaccgattctccttgttgcattagggagcacaggtattggtgccctctttgctggtgcgacaggaaattggtggttgaccggcatttttgcagcattggccattgttatgattgctctgatcctcagcaagttgttgaagaacaaatacaattctcctgaaggcaatggaaaaacaaaaaataaaacggattgctgtacgcctccagagagcgtggatcggaaacatgagacaagataa

SEQ ID NO: 94 - DNA, 1269 bp, Staphylococcus epidermidis
tgtgaatgtaataaagcaaaggaggaatttgaaatggtacaaggacccattcaagtaaatagtgaaataggcaaattgaaaactgtgttgttaaaaagaccaggaaaagaattagaaaatttagtacctgatcatttaagtggtttattattcgatgatattccctacttaaaagttgcacaagaagagcatgacaaatttgctcaaactttgagagatgaaggaatcgaagtagtttatttagaaaaacttgcagcagaatctattactgagccagaagtacgcgagaacttcataaacgacatattaacagaatctaaaaagacaatattaggtcatgaaactgaaattaaagaattcttttcaaagttatctgaccaagaacttgtaaataaaatcatggctggcgtacgtaaagaagaaattcaacttgaaacaacccatttagtagaatatatggatgatagatatccattttacttagatccaatgcccaacctttattttacaagagatccccaagcttcaattggtagaggaatgacaattaacagaatgtattggagagcacgacgtagagaatctatttttatgacatatatactgaaacatcatccaagatttaaagataaagatgtaccagtatggttagatcgtaactcaccatttaatattgaaggtggagatgaattagtattatcgaaagatgttttagctattggtatatcagaacgtacatcagctcaagcaatagaaaagttagcacgtaatattttcaaagatgcaaacacaagttttaaaaaaatcgtagctattgaaatacctaatacacgtacatttatgcacctagatacagtactaactatgattgactacgataagtttacagtacatgcagcaatatttaaagaagaaaataatatgaatatatttaccatagaacaaaatgatggtaaggacgatataaaaattactcgttctagcaagttacgtgaaacacttgctgaagttttagaagtagaaaaagtggactttattccaacaggtaatggcgacgttattgatggtgcacgtgaacaatggaatgatggctcaaacacattatgtattcgaccaggggttgtggtgacatacgatcgcaactatgtatcaaaccaacttttacgcgacaaaggaattaaagtgattgaaattactggtagtgaacttgtacgtggacgcggaggcccaagatgtatgagtcagccgttatttagagaagatatttaa

SEQ ID NO: 95 - DNA, 210 bp, Staphylococcus epidermidis
atagtagccaacggctacagtgataacatccttgttaaattgtttatatctgaaatagttcatacaaaagactcctttttattaaaattatactataaattcaactttgcaacagaaccacttaaagacatgtttgtcatacatatttgtaaaaatcaaaaaatcatggttatatacatcattatttttgataataattatcttaaataa

SEQ ID NO: 96 - DNA, 339 bp, Staphylococcus epidermidis
aagaaaagcaaaatggaggaaaatagtatgaaaatcaatcgatacatcacaagaggcattagtgaacaactatctctagaccttcaaatcttactttggaacatggtaaaagatcgagacaatcaacttaatacagattacctacacattttcaaactacaagaagatgataatatgttgtcaattacacatgaacaagaacaacccgcatacaaattggaatatcactatacaaactatataaaaaatcaaaatgcattacctaagaaagtctacgtcatccgagaagatgatgtagacgctttttattatgtgatgcttttgccagaagaatactaa

SEQ ID NO: 97 - DNA, 225 bp, Staphylococcus epidermidis
tattttataaaggagttcgattttatgaaaataaatcatgcaggtacattatctgttgattattttgttagctacttaaatctaattatgatatcaagagaagtttctttaaaagaagctgtatcatatatgaaaaatgagttctttaaaggaaaaactgacttgtatggtaaagtaacagaaactcattttaatcaagcaatacaagaactcaaacaaaaatag

SEQ ID NO: 98 - DNA, 258 bp, Staphylococcus epidermidis
ttaataataaaaaagcgtctcaatgatattgagacgcttaaagtttatctagttttaaatgattcaatggcggttttgatttcatctctaacacgttggaactctgaccaaggtttgcctgctggatcatcaaatccccagtgttctttttttacattcggcggcaatataggacaattattgtcagcatcactacataaagttactactaaatcggattggtttagtatatttttgtcaattaaattagaagtatga

SEQ ID NO: 99 - DNA, 384 bp, Staphylococcus epidermidis
agaaaagtaaagaaggtgaaaaaagtggaaaatacaaatagtaatatgcataaaaatgacaatagttacgttttatcagcattgagttatttaagtatctttttcgcacctgtcattttacctttatttgtatggatacttgctgatgagccaacatcaggacatggtaaaaaagcattagggaatcatattatgacatggattagtttttgtgtaggcagaggaatttttattttttcaaaaggagtctttgataaaccgtttgatcatcaattattaatatttgttattgctttaatcattgctattgtattctttttaattgctttaatattatatattctcaacattatcagaggaattaaaattttattaaaaaaataa

SEQ ID NO: 100 - DNA, 384 bp, Staphylococcus epidermidis
agaaaagtaaagaaggtgaaaaaagtggaaaatacaaatagtaatatgcataaaaatgacaatagttacgttttatcagcattgagttatttaagtatctttttcgcacctgtcattttacctttatttgtatggatacttgctgatgaaccaacatcagaacatggcaaaaaagcattcattaatcatattatgacttgggttagtttttttataggtagattggcatttattttttctaaagaagtctttgataaacctttggatcatcaattattaatatttagcattcttttaattattactattatattctttttaattgctttaatattatatatcttgaacattaacagaggaattaaaattctattaaaaaaataa

SEQ ID NO: 101 - DNA, 255 bp, Staphylococcus epidermidis
aacagttcaaatatggatggacctaaaacatctatggatcatgaaactaaacaatcagattggcgaacggttgctagttgtttagcatcgcaaaattatatatcgctcgtaaaaggattagtacattatttcacagcgattgaagatgaagaaatacttgataaaatctatgatgattttatgaatgatgactctataacaacggtacttaacaatgatttacagacaatcattaaccattatctatcaaaataa

SEQ ID NO: 102 - DNA, 1125 bp, Staphylococcus epidermidis
aaggagcaaaacactatgtatcaaacaaatacacgtgatttaattacaaaattgcctcaaagcaataaaacagaacactttttaatgaacaaattttcaaatcaagataaagttcagcagctacaaagacaaattagccaacagctagatcaacaatataatgagcttttgtctaatgaaaaagctaagctagaccaatatgtggaagtacaccataatttagaaccattaaagaaagagattgaatcagaatctattaaccttgataccgataaattacctgatatcaaagcgacaatgcttgaaaaggctaagaacgatgaacattctgataaaatcgaacacctatttgatagattagatcagtcattaaatggtacgaatcgattatatacgcaattatcgttgattggcacacgaacacatcggataacaacgaaaagatttaatgttcaaggcttacctaaattagtccaacaaacgattttaccttcgcaatttaaaaaggtttatacaatagattttaaatcattcgaaccatcagttgctgcgtatatgacacaagacgaacaactgattgactacttgaatcttgaagaagggttatacgatgcattactgagagacttatctttgtcaaaagagaagcgcgtgagtgtgaaacgtgcatttatagggtcatttctttttggcggtcgttatagtagctctaaattcaaaatcaatcaagaggttagtgaaattaactggctacaagtaatgagcaaattcaagaagatcattgaatttaaagagcaagtcgaaaaatataaaacaatgcctacgccttacggcattgaacatgatatgagcgcatttcaaggtagtagtattatggcaatttacgtacaaacggtagcgagctatattttcaagcacattttgttggaagtgtacaaagcacagtgcgaacaaaaaacgttcaagattatagtgccgatacacgatgcgattatgattgaatgtaatgataaggagattgcacaaagtgtagcacagctcatgaaagatacagctaatcgactgtttaatggtgaatttgcacatgtgacagtggaagctttaggaggtatagacaatgaataa

SEQ ID NO: 103 - DNA, 2013 bp, Staphylococcus epidermidis
gtgaataaaaatattacagctctaaaatctactgaaaatactacatatatgcagtatacggttcatatcgatgatcaaattataaataatataaaagagtgtaccaaaaagtttaaaattttgcctatggaagataaaattccattatcaccgttgttacaaccagaatatgcaggagaggtacaagattttattagtacatatgagcagtttatgattaattttggtaaagtaatattggatagtcaaggcataaaaatacaatttgaaagtgaatcattaagtagtattcaacgaggcattcaagaacattgttacttaaataagcgaacaaatgacattgatgtgactaaagaatggtatttatgcaaattttcaaatcgaacattagaagaggataaaaatcaattgtataatgctttaaagcaactcatgaatgattctaaaaataaaaagcaagcttttcaagaggtgtttaaggttcatattgatatttatctctacaataaagaaaaatctgaatataagtatcaagcatctagttatttctatcttgtaaaagaaaatcctaaaataatttataaaaaaagacatttacaagagaaacaagggatcaagggtacaactttcacgaacaaattaaaattattgaacaaaatgtatggtgtagatgttgcaaaatatcagccattttataattctaataatcctgaatatgaaagaggtcaatttggtgaaagatacatttctcaaagatctaactatgaatttaatagacttcaatatcaaattatatatatattatcgaaaatacttgataagcatccattaccaaagtcagataataattataaacatattccaactattgaaaaagcaatattaagagatgattcccataatttttatgagtattttgaagatataatgaaagaaattatgaatatggataattctcccttacaggaaaaattattgactgattttacatatcaatcccaatgtagatggtactctgaaaataaaaaattaaaattgcaacttgaaagatttatgcataaagttttagagagtaattattatgagggcaacaaattattgagaatgatgtctaacgcaattgaagaaacaatcaatgaggctaaagaagataaggttcatttcaattattttaaagattattttttgacagacggtggggtgaagaattgggagcaaattagcgagaaaattactgaattcaatggtaaagttattaacgatatccaacatgaatataataagatacagtccaagaatacaaatcaaaatcagaaactaaactttgtttatttatatcattgctttgagtttagtaataacatagtaaaagcaaaagataatgaaagtaaaaattatatcttgttttttatagataaatataaaataaagacaccatttttggatcaattattaataaattgtttgaatcaagaaatagatcaggaaagtattaactacaatatgcaaacaatgtttgaaaaagaaagatatgatagaagtagtatcattgaaaaattagtagcaacaagaaaatttaagtatgaaaaagatgattcagatttattcaaacaacttttcaatgatgttgaaaattcaatagacagattaggtatttacttactaaataatggtataaattcgaatgatgaaaatgcaagatactatagatcgtttttaaaggaacttagtagaataaaaagtaaattaacgccattttctcttgaaataagtaagtctagcggaagagagcaacattatcctgatgatgctgttgatgataaagatgagagaagaaaaaataaagaagaaacatatcatgcttttgatgataaaagcgatattgactacaaattaaagaataaaataagtgattatatcgataatttattgtcagttaaaattaggaataatttgtatgatattagtccaaatacaaaaagcaataattataatgagccaactcaaaaatga

SEQ ID NO: 104 - DNA, 432 bp, Staphylococcus epidermidis
atgttcaaaaatatattattaccctatgatttcgaaaatgattttagtgctatccctgactatttagaaaaagtcaccgatgaagattcagttgttgtaatttatcacgttgtaacagaaaatgatcttgcaattagtgtcaagtattataataagcataaagaagatattattagagaaaaagagaaaaaactcactccatttttacgtgaattagaaaaaagagatattcaatataaaatagatgtagattttgggcatattaaagatacaatcttagaaaaaattacttctggagatataaataatggtgaatttgatttagtaattatgagtaatcatagagtcgatttgaatattaaacatgttttaggagatgttacacataagattgctaaaagaagttctgtcccagtactaattgttaaataa

SEQ ID NO: 105 - DNA, 1287 bp, Staphylococcus epidermidis
tcaagaaaaaagcttactcatttcaaaaataagtgtcttaaatcacttaagagaggattttatgtaatgcttagtaaaaaacaaattaaaaaaactttaaacagcgataaaatgccgtcattaattgttaatgaattagatagagaattgcggaataaatggaaacaacaatatccaagtaaagaagaattaattaaagaattgaagtatgacgcagttaatgagaattctgcagtattaaaaaatgaattgacgagtaaactaaaattcaaacttaaggattatcaagattcaaatgaatttttattttacttaaaaaatagtcaaaagatgattgaaatacatgattataaaatggagcaattttttgaagatatacctcttgaagatagtgatgtttataaatctattgcgaataatgaagatacagaaacatatataataatgaaagctccagaatttaatgaagaagataaactaaatatatcaattaaagttgatgggaaatttaaagaattagattttcacagaatagcatatgatagtaaaaaagaaatgaaatatttatatcagaaccgatatataaagatattcatgttaatagaaaaaaatttagaatatattagttggggatttcatcatctttttaatgaaagtataggggaagtaaatacaattaatataattgatacttataaaatgttaatagcgctagctagtggcgaaatgtatacagcaaataagataaaatttaataacgattcagcaagtaaaaataaagaaatcttagaatctttaaacagagatttaaaattatttgaaattattcatgaatttcaaaattcgttggataaagaatttaagatatccaccccgtttaattctaaagaaattatagaaggagtaaaaacctactttttattatataaacaaaaactaatattggaagaaaagcgtttagaaagtttactaatcaaaacatcttccttcgatttagaagatataaaaggaaaaaaattcaccttaattcaagaggaaaaagtaacaaaaactatttttactcaaaaaatctcttacacacaatatcaatgttattatcaagtaaaatcctcagactatgaaaaattacaagatgatgaatttaaactaaaatttaatcctgaagatgtaattactattattttaaaagcttcattcaacacaaccgaacctatcggattagaaaatattgcttttgaagaagcggaaactttagatacctttattagtaactataaatcaaattaa

SEQ ID NO: 106 - DNA, 441 bp, Staphylococcus epidermidis
ggaggaaaaaacatgaaatttcaagtaagtccatattttttaatcactcaaaatgcagagggtttaaaaaagttgtatgaagagctgtttggcgctaaaacactgtatattcaacgtattaaagatagacctatagataagcaacttaatattgacgaaaatgatttaaataaaattgatcaatgtgtacttcaatttggagatataaaaattatgatcgcagatgacactgaaggtttgcccataacacaaggtaataatatatctctttgtctcacttttgaccaagtagaagaaactaaacatgtatatgaccagttaatagaaaaaggcagtgaggtattgaaaacatttagtccagaattctatactgaaggttatggttatgtaagagatccttatggtatctctttgcatttatttacaaagagaaaaaattag

SEQ ID NO: 107 - DNA, 522 bp, Staphylococcus epidermidis
aggagtgaaaatttcatgaaaacaatcaaaagtacattagaaaccgaagccattttcagtgatgaccaacaacatcgctatctacttaagaaaacatggaatagtgaaaaacaaaagatcacaatcatcacaatgtatccaaattatacaggccttcttcgtatagatttaactacccaattgataatgaacaaagtttcagaaatggatacatttggttccatcaattttgtgaatctatactctaatattacaacccctatcaatctcaaacatttagaaaacgcctatgataatcatacagatattcaaattatgaaagccgtgaaagagtcagatgaagtgatactagcttggggtgcttacgctaaaaagcccgttgttgaatcacgcgtcaatgaagtattagagatgttgaaaccacataagaaaaaagtgaaacgactcatgaaccccgcaaccaatgaaatcatgcatccccttaatccgaaagcgagacagaaatggactttgaaagcataa

SEQ ID NO: 108 - DNA, 681 bp, Staphylococcus epidermidis
agtggagaaaatataaggaggaataagcttatgaaaaatatttcagaattctcagcccaacttaatcaaacttttgatcaaggggaagccgtctctatggagtggttattccgtccgttgctaaaaatgctggcggagggcgatccagtccccgttgaggacatcgcggcggagaccgggaagcccgtcgaggaagttaagcaagtcctacagactctacctagtgtggaacttgatgagcagggccgtgtcgtcggttatggcctcacactggtccctaccccccatcgcttcgaggttgatgggaagcaactatatgcatggtgcgcccttgacacacttatgttcccagcactcatcggccggacggtccacatcgcttcgccttgtcacggcaccggtaagtccgtacggttgacggtggaaccggaccgcgttgtaagcgtcgagccttcaacagccgttgtctcgattgttacaccagatgaaatggcctcggttcggtcggccttctgtaacaacgttcactttttcagttcaccgagtgcagcccaagactggcttaaccaacaccctgagtcgagcgttttgcccgttgaagatgcctttgaactgggtcgccatttgggagcgcgttatgaggagtcaggacctactaatgggtcctgttgtaacatttaa

SEQ ID NO: 109 - DNA, 969 bp, Staphylococcus epidermidis
aaccaggaaaagaaaaaaactataaaatttgaggttaatcaagattctgctacgttatggtatcacccccacccctctccaaatacagctagacaagtttataatggcttatcaggattattatatatagaagatagtaaaaagaataattatcctagtaattatggaaaaaatgatttgcctataataatccaagataaaacatttgtatctaaaaaattaaattattcaaaaacgaaagacgaagatggcactcaaggtgatactgttcttgtgaacggaatagtaaaccccaaactgacagcaaaagaagagaaaatacgtttgagacttttaaatggttctaatgctcgagatttaaatcttaagctaagtaataatcaaagttttgagtatattgcttcagatggcggtcaattaaaaaacgctaaaaaattaaaagaaattaatttagctccttcagaaagaaaagaaatagtaatagatttatctaaaatgaaaggcgagaaaatcagtctggttgataatgataaaactgtaattttaccgattagtaacaaagagaaaagttctaacaaaggtaatacaccaaaagtaagtaaaaaaataaaattagaaggtatgaatgatcatgttaccattaatggtaataaattcgatcctaacagaatagattttacacaaaagttaaaccagaaagaagtatgggaaattgaaaatgtcaaagataaaatgggtggtatgaaacatcctttccacatccatggaacgcaatttaaagttttatctgtggatggtgagaaacctccaaaagatatgaggggtaaaaaggatgttatatctttggaacctggacaaaaagctaaaatagaggttgtatttaaaaatactggaacatacatgtttcactgtcatatacttgagcatgaagataatggaatgatgggtcaaataaaagtaacaaactaa

SEQ ID NO: 110 - DNA, 978 bp, Staphylococcus epidermidis
gctgatagaaagatgagtataagcgaatataaaaatagatacttagagtcactatataacacctttaaaactgagttagaaaacgaacgcactcgctattttatattagataccaactatacaaatagtgatgatactgaaaaggagtttacttgggatgtaaaacagaataataagatcagagaaggcgatttgttcatttttagacggccaactaatttatctcaaattgctcaacaattttatttctttggagctgggaaaatagaaaaaattgagcgaaaaaataatgtagcaaccgcttacatttcaaaacccttactttttgtggatcgtgttttaaaagataatattgaaaatttaaaatgggagttcaaagaaagaattaaagaagagtgggagcagtttttctttaaaaataaaatcagtaatattacaaaaaatgattttttaaaactactaagtttgagtagaaatgtagtggaaatagaaagtaattatattaataatgatatttcgctaacttttaaacaaatggctgatatggcaactcgaataaagaaaaatatttactacgtagggaatcatgaagcatttgttcaagctaagggaagtgctcattttgagttttcaaaaaggattaaacaaaattatagttatagatgtgcaattaccgggattaaaactaaagactttttagtcgttacacatattattccttggcatgaaaatgagtttattagactagatccttcaaatggtatttgtttgtctttatttttagcaaaagcatttaagaaaggctttatcactttttctaacagttatagagttgttttatctaaagaagcagagaaagatgctgctttatatgaagaattaaagatttatgaaaatcaaaaaatcgaactaccagattgtcagaaacctaatttgaaatatttagattggcatagagaacatatttttaaaaattaa

SEQ ID NO: 111 - DNA, 510 bp, Staphylococcus epidermidis
cgatatatgaatacaatcaaaagtacgatacacacagaagcgatatttagcgatgatgaacaacatcgctacttactcaaaaagatatgggatgacaagaaaccggcttgtactgtgataacgatgtatcttcatttagatggtgtattatcactcgatcttactacggttctcatcctcaatcaattagctaattctgagcaatatggcgctgtttatctcgttaatcttttctctaatattaaaacaccagagaaccttaaacatatcaaagagccttatgatgagcacacagatatacacttaatgaaagcaattagtgaaagtgacacagtcattcttgcttatggtgcctatgcgaagcgaccagttgttatcgaccgtgtcgaacaagtgatggaaatgttaaaacctcataaaaagaaagtaaaaaagctcataaatccagtaacgaacgaagttatgcatccactcaaccctaaagcacgtcaaaaatggacactaaagtaa

SEQ ID NO: 112 - DNA, 3126 bp, Staphylococcus epidermidis
atagtgatgaactttcaatttaatgaagatgatttagaacaagtcgcattagaatggttacaatcactaggctatgactataaaaaaggtaatgagattagtatgacaggtctaacgccagaacgtaaaagtgataaagacgttgtccttcatgaacgattagaaaaggcgttaagaaaaattaattcagatattcatcctcgttttattgaaaaagcgatacatgaactaactttagagaagtcgcccaatcttttagaaaataaccttacttttcatgaaaatttgatcaatggtattgaaatcgaagactatgatgacgaaggacaatcggtagtagaaattgttaaaatcgttgattttgaatatccacaaaacaatgattttttagcagtcaatcaattcacggtcgttaatggagactatacaaaacgtcccgatattgtactctttatcaatggcttgcctatcgttgtgattgaacttaaaaattcaaccattgaaaccgtaggcgtcgaagacggctatcgtcaattagaaacatataaaatgcgtattccacaattatttacatttaatgaagttcttgttacaagtgatggtattaatacaaaggcgggctccctaaccgcaaattatgatcgttttatgacttggcgttctaaagatggagaaacggaatcatcatcaagtttagctagtttagatgtgctgattcatgggatgctaaatccagaaaccttacttgatttaattcgatattttgtcttattccaagatgatggtaaaggacatatcagtaaaattctagcagcgtatcatcaatactatgctgttaataaagctgttgatagagctttattagcttcatctgggcagggtgatggtaaaggcggcgttatttggcatactcaagggtctggtaaaagtttaaccatggtctttttctctggaaaattaattcaaatgcttaataatcctaccttagttgtcgtaacagatcgtaatgatttagataaccaactatacagtacgtttgttaaatcgaaaggacggtctggtaaaggtttattaagacaaacaccaaaacaagctgaaacacgtaaagaattaaaatcgttattatctgttgagtcgggcggtattgtatttacaacgatgcaaaaatttgaacctgaacaaaacgaaacgaccatgtctgctctaacagaacgtaaaaatgtgattgttatggcagatgaagcgcatcgtacacaatatggttttaatgcaaaatacgatgataaaggggaaggcattaaatatggttatgcgaagtatttaagagatgctttaccgaatgcgacgtttgtaggatttacgggcacgcccgtagcttcaacggataaaaatacgcaaatggtctttgggaactatatcgatgtttatgatatgacacaagccgtagctgatggaagtacggtgaaaatttactatgaaagtcgcataattccattaaatttacctcaaaatttagacttagacgaagcatataatgacattacagaggatcaagaagaggatgtaaaacagcgtttaaaatcaaaatggtcacgaattgaagccttagcaggcgcaaaacctcgtgtagaagctttagccaaagacatcatccaacattttgaaacacgtcagcaagcgatgaaaggtaaaggaatgatcgtaacgatgagtcgtcgaattgctgttgatttatacgatgaaatcattcgtctaaaaccagaatggcattcagatgatgatgataaaggggtcattaaagtggtgatgactggctcatctatgcacccaatttctttccaaagacatattggtcctaaaaaacgtcgtaatttattagaaaaacgtatgaaagatatgaatgatgaattacaactcgtgattgttcgagatatgtggctcacaggatttgatgtaccttccatgcataccatgtatatcgataaaccgatgaaaggtcataatttaatgcaagcgattgctcgtgtcaatcgagtgtttaaagataaaccgggtggattgattgtcgattatgtgggtatcgctgaaagtttaaaagaggcacttaaagaatatacagaatctgatcaagcacaaacggcgatagatacagataaagcggttgaattgatgttattgaaatatgatgtgattcaagatatgttatataatcttgactattctaagtttaattcagagaaaaagtctgaacgttattatgcgatttcagatacgatggattatgtgattggtttaggcgaagatgaacgccagcgttttattaaaacggtcacagagttagggaaagcttttgcgctttgtgcgactgaacctacagcccaagaactcaatgatgaaattgccttctttaaagcagttaaagcaggacttgttaaattgttacaaccgccaaaagaaggaaaaacacgtaaaacacctgcagaagttgaagcagagattaatcaacttgtgtcacaatctgttgtgacagaagatgtgattgatgtttaccaaacactaggtcttgaacaacccgatttatcaatcctatcagatgacttcctaaaagatgtcgaaggattgaaacaaaaaaatgttgcggtagaattattaaatcgattactcaaagggcaagtaaaatcattaatgaaaacgaacgcgacagtatctaagcgtttctctgaaatgttaggaaattcgattaataaatataatagccgttctattgaaacatcaaaagtgattgaagaactcattcaactcgctaaagatattaaacaagaacaacaacgaggaaatgaattaggcctgaattcagatgagattgcgttttacgatgctttagcttcacatgaaacagcaaaagaagccatgggagataaagaactacgtgcgattgctcatgagctaactaaaacagtgaaagaaaacatgggtgttgattggtctaaacgcgatagcgcaaaagctaaaatgcgcgtagctgttagacgattgcttaaaaaatatggctatccaccagatttacaaaaaatggctgtagagcaggttgtagagcaagcagaacttatggcgagtaatcagtaa

SEQ ID NO: 113 - DNA, 339 bp, Staphylococcus epidermidis
aagagtcagaacgaaaggaagtctcttatgaatagatatattactcaaggtattgccaataacttacctatcatcttacaacaacaattatggaaaatagtagcacaacgtgaaaacgaacagtccaaggaactagaagcaatagattactttcatatcttccagttcaacatgcataatgatcaattatatatcaaacacaaacaagaacgtcctgagtacatcaaaacacataaagctaattattcaaaagctatcaatataaataaggtctatattatccgagaagatgatgtagacctttcttattacgtcatgttactaccggaagaatactag

SEQ ID NO: 114 - DNA, 249 bp, Staphylococcus epidermidis
cttattaagaagatggatgaagataaaggtaccggaaaaatattatcttcattgtatataaaagacgatgaattaaaaaaacaatattctacatgtagagaatttctagatgattatttatatacagcatggattattcctgttttgctgaatgaacatgcaacaagtcaattagaggaatatttaggtagatatttaattaaccaaaacgtaccaatccttaatttactttcacatactttcaaataa

SEQ ID NO: 115 - DNA, 183 bp, Staphylococcus epidermidis
atagttgagaagctaaaaactttacttaacctttctcatttcattttcctatacacggtttcaagaacccaacatactacaaacgaatttcaaaaggtgagagtaaagctgacttgttttttttacggatttaaaatcctagagtctggacagtctactcctctctataactataaaaaatag

SEQ ID NO: 116 - DNA, 186 bp, Staphylococcus epidermidis
atccaccgtttagttaagatgatggattttttcaaactgtggatgaggtacagagtttcattagataaaaacagggaaaacttattaaagagtgatttctgtgaggaggataatgatgacaaagaaatacgatcttattgtgattggtacaggttctgcggggtcaatcacagcagcaaaatgtaa

SEQ ID NO: 117 - DNA, 363 bp, Staphylococcus epidermidis
ggaggcaatgatatgaaaacaactactcaagaactcaaacaatatatgactcgcttattccaattatctaacaatgaaacatgggaatgtgaaacactggaggaagcggcagaaaatattctacccaaacgttttattaatgattccccacttgcacatcttatacttgaaacttatacctactataataatgagctacatgaactaagtatctatccatttctaatgtattctaataaccaactcatcagtattggttatctggatcattttgatatggactttctatacctcacagatactaaaaatacgattatcgatgaacgtcatttactaaaagaaggagggaataaccatgaataa

SEQ ID NO: 118 - DNA, 777 bp, Staphylococcus epidermidis
ataatgaatgatttgttaaaaatttatgaaaaattgaaaaaagatattgaaaacaggtggttaataccatttcattatgtggtttttggattagcattagttgtatattttctggaaattcctatttataaattggtgaataacttagataaagagcttgttgataaggttttatatgctttttcattagtgtatgatcacattgtattgatatttatattaattataattatcattttgatagtttatttattctttgatgtgtttaatatgaatcgttttgttccatcgcctacaacttatgtagatggtagtgaaagttctataaactatgtaagtgctattaaaagattgataaactttatgatattaattatcacaaagtactggataacttactttattgtaaacttaatatttcataatgataaattactgtatttaaacaatgattcaaaacatttgtataagtgtctcttgtttttaaatatctgtatctttatagtgcatatattaaaatcaatttttataataaaaattatggcagatgattcgctaagacttattaatgaaaatgatttaactgatttttacataacattaaataaaaatgatgaatatcgtatggtaaaacctaaatatagaaaaatagataattttattattattaaaaaaagtgaagatttcactaattcaaatgagtataaagttattaataaaagtaaaaattttgaggaaataatttatcattttgacaatcttacttcaaatcattga

SEQ ID NO: 119 - DNA, 186 bp, Staphylococcus epidermidis
tatctcatggaggtattcgaaataagaagccgtgaaaaatcattaatactttgttctcaaatgacttccgtagaatggcataagaaattaagtggaaaagtcatcgcttatgcgattttaattcgtgctgtatcaaagtcatttaaaatatttttagaagtagagtcgttgagaaaaattaaataa

SEQ ID NO: 120 - DNA, 450 bp, Staphylococcus epidermidis
acgatgaaggaaatcaatattgtttcactacaaatgataaaaacagatacattaagttatctaaaaaatcatatttcaaaccctgaggatgcggcagaaatcttgcgttcattcattggaaacagtgaccgagaacatctcattctcatatgtatgaacagtaaaaatgaacctacacatattcaaacactatcgattggatctattaaccaaacagtgattcaccctagagaaatattcaaaacagcgatactcagtaacgcaaatagtataatgctcggtcataatcatccaagtggggatataaccccctctcctgaagatatcaatgtaaccaaacggttaatgctcatcagtgaaatgatgggcattttattttatgatcatattattttttcagatagtaacacctattccattagacaacatgatttagaagtagaggtatag

SEQ ID NO: 121 - DNA, 387 bp, Staphylococcus epidermidis
actacatcactattacactatctaggaggcaataatatgaaaaccatcactcaagaactcaaacaatatataacccacctattccaactatctaataacgaagcttgggaatgtgaagcgctggaggaagcagcagaaaatattctaccggaacgttttattaatgattctccactggtacatctcacactcgagacttatacctactataatgatgaactacatgagctaagtatctatccatttctaatgtatgccaataaccaactcatcagtgtcggatacttagaccattttgacatggactttctgtaccttacagatactcaaaatatcattattgatgaacgtcatttactaaaacaaggaggtcaggaccatgaataa

SEQ ID NO: 122 - DNA, 213 bp, Staphylococcus epidermidis
aaaagagcacttgaaacagataatttgtattatttagcctatgtaacaactttagataattgttttaaatattaccaattaattacacaaaatgaacatttttgctattctcaacaagaagaaagagaaagttatcagcaaaaatttcaaagtatgattaatggtttaaaaattaaaattggcatacaaagttcaaatgatgatgcgcaataa

SEQ ID NO: 123 - DNA, 435 bp, Staphylococcus epidermidis
aggggagaacttatgcactggaaagaaaatagaataaaatcagccaaaaatgacacgaatccgatggtaatcaaagaattaaaaggtagttatgtggtttttggagatgttcagtttcttccaggttattgtgtattacttcctaaaagagaggtaagattattgaatgatcttactttagaagaacgacaagattacttattagatatgagctttgttggtgatgctatgatgaaagcattgaaacctacaagagtaaattatgaaatactaggtaataaaaatcactttcttcatgcacatttattccaaagatatgaatgggaagatgaatctgttaggtatatgccagtgtggtgtatgatgcttctaattggtctaatgaagaaacgtcttacgattctgataaacatgatgaaattagaaataagataa

SEQ ID NO: 124 - DNA, 732 bp, Staphylococcus epidermidis
acaggattatggcggggattggccccatgttttaaagataggagtggaattatgagtttttcgtttctcttcattctgaccgctggaatggttgcggcctttaatccttgtggtatcgccttgcttccttcttatatctcctatttaattggaggcgaaacaaaggatcattcgttccgctatgcaatttttaaaggattagggcttggtggagcgatgaccacggggtttttaacgatttttgtattggctggtttgttgataggaggattgggaagcgcactaacagggatttttccgattctttcattggttatgggtatactcattgctttattggggttgggcatgctatttgggaagcatttgccgattaaaataggatcttttcaagtcaagccagggaaatggtctatctatttttacggaatagcctatgccgtgacatcacttggttgtaccttgccagcctttatgttggtggtctctgcatcgctgaatgacaatagcgtaacggccgtgatcatcaagttcatcatctactcccttggtatgggaattgtggtgacagcgatcacgatggtctcattgatttcacgacaattggtacagaagtttctgcacaactatatgggttctatccaaaaaatagcagctgttgtgattttcctctccggtttgtacatggcttattactggtatttcggttctggtggcatttgtacattttaa

SEQ ID NO: 125 - DNA, 2124 bp, Staphylococcus epidermidis
gggggtatatgttatattataagtagctttactataacattttcattaggaggggttaatttgaataataatagtgaagagcataatcatcaaaatcacatgaatcattccaatcacatgcatcatgataaccatgaatcacataatcatcatagtggccatgcacatcatcatggaaattttaaagttaagttttttgtttcattaatttttggaatacctatcattcttttatcgccactgatgggtgttaacttaccttttcaattcacatttccaggttctgaatgggtagtgttaatattaagtacaattttattcttttatggtggtaaaccgttcttgtctggtggtaaagatgaaattgctgaaaaaaaaccaggcatgatgaccttagttgccctaggtatttcagtagcttatatttatagcttgtatgctttttatatgaataactttagtaatgcaactggtcatacaatggactttttttgggaattagcaaccttaattttaattatgctattaggacattggatagaaatgaatgctgtcggaaatgctggagatgctttaaagaaaatggcagaactgttacctaatagtgctattaaagttatggataatggccaacgcgaagaagttaaaatatcagacatcatgactgatgatatcgtcgaagtaaaagccggagaaagcattccaacagatggtattatcgttcaaggacaaacatctatagatgaatccctagtcactggagaatctaaaaaagtacaaaaaaatcaaaatgacaacgtcatcgggggttctattaatgggtctggaacaatacaagtcaaggttacagctgttggagaagatggatatctttctcaagttatgggacttgttaatcaagcacaaaatgataaatctagtgctgaattgttatctgataaagtagcgggttatttattctactttgctgtaattgttggcgtgatttcttttattgtctggatgctcattcaaaatgatgttgattttgcactcgaacgtcttgtaactgtgttagtcattgcttgtccacatgctttaggattggcaatacctttagtcactgcacgttctacttcaattggtgcacataatggtttaattattaaaaatagagagtctgtagaaatagctcaacatatcgattatgtaatgatggataaaactggtactttaactgagggtaacttttctgtgaatcattatgagagctttaaaaatgatttgagtaatgataccatattaagccttttcgcctcattagaaagtcaatctaatcacccattagctataagtattgttgattttgcgaaaagtaaaaatatttcatttactaatccacaagacgtgaataatattccgggtgtcggattagaaggtctagttgataataaaacatataaaataacaaatgtctcttatcttgataaacataaacttaattatgacgatgacttgtttactaaattagctcaacaaggtaattcaatcagttatttaatcgaggatcaacaagtcattggcatgattgctcaaggagatcaaattaaagaaagctcaaaacaaatggtagctgatttactatcaagaaatattacaccagtcatgcttacaggtgacaataatgaagtggcacacgctgtcgcaaaagaattaggtattagtgatgtccacgcacaactcatgccagaagataaggaaagcattataaaagattatcaaagtgacggtaataaagtcatgatggtcggagacggtatcaacgatgcgccgagtcttataagagccgatattggtatagcaattggtgcaggcacagatgttgcagtggattcaggtgatatcatacttgttaaaagtaatccatcagatattattcatttcttgaccctttcaaataatactatgagaaaaatggtgcaaaacttatggtggggtgcaggttataatattgttgctgtacctttagcagctggcgcattagcttttatcgggttaatattatcaccagctgtaggagcaatattaatgtctttaagtacagttatagtagcgattaatgcttttacattaaaattaaaataa

SEQ ID NO: 126 - DNA, 198 bp, Staphylococcus epidermidis
cctaaaacacgaccggtgattgcctctccgctccttgccttagcattcatagaaagtttcacattcgaaatcaaagtctggcgttctatagatcctattaacccaaacattgtaacgagtacttctccagaagcattggatgtatcaatattctcagaaatcgatttataccctacgtcatgttctttgaattcatga

SEQ ID NO: 127 - DNA, 354 bp, Staphylococcus epidermidis
atgaaaaaacgcatttccttcaccgctataatgacggtgttgttaatcggtttaacagcttgtggagcagaatctgataccgcgaatgaatcaaaggttcaagacattcaaggaaatccagtcagcctacctaatgagaaacccacactcatttattttatggcaacctggtgtccatcttgtatatacaatgaggaaatctttaaggaaattcatcaactaaacccgaacgatgttcaattgatcacagttagtttagaccctaacacagatacaaaagaaagctttgcgaaatttaaacaggattatggcggggattggccccatgttttaaagataggagtggaattatga

SEQ ID NO: 128 - DNA, 690 bp, Staphylococcus epidermidis
gagagggttagtatggctagttatttattttttcatcctaaaccagcgtgtgatacttatggggatatgaatatttatcacgacaaatttggaaataatgaggacccatacgtatggagtgaacggtttttgcatagcttttgtaaaataacggattatgcatatagtaaatctactcaaaaggacattattttttggatatcaataaataaagaaggcaataatttaaaatatttatgtgatttagtatttaaaatagaaaagtgggatttttggtataaaacttttagtgaacaaaaagatgccatagctacaaataaagaattaacgataaatgacgcagtagtagaaggcgatgaagaagcatatgaatatcattattcttggatcaacagaggggaacacaagtgggaaccaacttatcgaaggcgaagactcacattaaaagcagatcccgtcttgagttttcagcctcaaaatcgacaaggtaatttactagatgtcacggaattactaaaaacaattgtgaattttaatgttgaaaaatcacctgcaaaaagtgggacttcttataaagctttcgaacttgaagaagagcaggcaagcaaactatatgaggaaataaaacgattatcttttattcgattaaagggaagggacttaaaaaacttaagaagaaacttttcttga

SEQ ID NO: 129 - DNA, 543 bp, Staphylococcus epidermidis
aatggggttagcaatgtgaagaaaatttttgcaagcttaggtgttattttattagttgcaatattgggagttgctgttgtatttgcatatgggagttacaaagatttagaactaaaaaaagaagaagctaaactaaaggataagaagaataagaaaatcgataaaaacaaaactacagaaaatgaaaatcaagaccagattaataatcaaacaattacagcaccaaatgaaaaagcacaatatggcaataacctaggagttcaagaaaaaagtacggataaaaatgatcctaatggtgtgcttagatttgatacaaacggagatggacttatctccactagtgaagtaacaccagaagctcaaaaattagttgatgaaggtaaactacagccatcttcagatagaatggttgaagagtggactaagaataaaaataatgtagataatacatatgactatgatgaatcatataaaaaacaacaagaaatgtacaaaaaagctgctcgtggcgaagttcctgaacctggagaaacaataaaataa

SEQ ID NO: 130 - DNA, 228 bp, Staphylococcus epidermidis
ctcaacgagctgaaaataatcaaaaaatttataaaaaaagacaatgtctatattatctcaatagaaattgtttttttttcacttattccaagaactttatgtcccggactcattatgatttatttttttattggggacttgccattaattctgcttgctccacaacttgttccacagccattttttgaagatctggtggatagccatatttctttaataggcgtctaa

SEQ ID NO: 131 - DNA, 339 bp, Staphylococcus epidermidis
aagaaaagcagaagggagggaaatagcatgaaaatcaatcgatacatcacaagaggaattaatgaaagtattccactagaccttcaaatcttactttggcacatggtagaaaaaaaagataaccagcctcatacagattacctacacatttttaaattacaagaagatgagaatatactctcaatcacacatgaacaagaacaacccacatacaaattggaatatcactatacaaactatgaaaaaaatcaaaatgcattacctaagaaagtctacgtcattcgtgaagatgacgtggacgctttttattatgtgatgcttttaccagaagaatactaa

SEQ ID NO: 132 - DNA, 273 bp, Staphylococcus epidermidis
tcttatataaggagtatattgatgaaaaagataaaaattgttccacttattttaatagttgtagttgtcgggtttggtatatatttttatgcttcaaaagataaagaaattaataatactattgatgcaattgaagataaaaatttcaaacaagtttataaagatagcagttatatttctaaaagcgataatggtgaagtagaaatgactgaacgtccgataaaaatatataatagtttaggcgttaaagatataaacattcaggatcgtaaa

SEQ ID NO: 133 - DNA, 834 bp, Staphylococcus epidermidis
atcatacggaggtgttttttttctatgaaaagagcttcttattcagtagaaacaaagtataaagcagttgaaatgaaagcagcaggatttccaacaaaagaaattatgaaagaattaaatattagaaatagaacacaagtgaaaaattggtggcgatggtatcgaaatggggaaagttatagattttcacaacatgttggtaaacaatatacctacggttatcgtaagattacagcattgattaatcaatgttatacatcaccaattaatcataagagagtacagagagtgatgcagaagcatcatttgaactgccgagttagacctaaaaagacgacaagaataggtaaaccgtattataaaacggacaatttattacaaagacaatttaaagcgagttgtcccatggaagtattaacaaccgatattacttatttaccatttggtcattctatgttgtatttatcttcgataatggacatttataacggagaaattgtggcgtataaaatagatgataaacaagaccaacgtttagttaatgatacattaaatcaaatcgatatacctgaggggtgtatattacatagtgatcaaggcagcgtttatacatcttatgcttattatcaattatgcgaagaaaaaggcattatcagaagtatgtcccgaaagggaacacctgccgataacgccccgatagaaagtttccattcctcgctaaagtctgaaactttttacatcaataatcagcttaataactctaatcatattgtaatagatattgtcgaaaatacattaaaaactataataataatcgaattcaacaaaaactag

SEQ ID NO: 134 - DNA, 519 bp, Staphylococcus epidermidis
gaaaattttgggagtgggattatgaaactaagagcattagagtatagtgatttactttttgttcatgaattaaataatgaatattctattatgtcttattggtttgaagagccttatgaatccttaacggaacttcaacatttatttgataagcatttattagatgaatcggaaagacgttttattgttgaagatgaaaatcaagtcgtaggtattgttgaattagtagaaattaattacatccatcgtaattgtgaaatacaaataattattaaacctgagttcagtggtaaaggttatgcaaaattcgcattcgaaaaagcgataatttatgcattcaatattttaaatatgcacaagatctatctatatgttgatgcagataacaaaaaagctattcatatatacgagtcacaaggatttaaaacagaaggattacttaaagagcaattctacactaaaggtaaatataaagatgcctattttatgtcattattgaaatctgaatatattttgtag

SEQ ID NO: 135 - DNA, 1713 bp, Staphylococcus epidermidis
caaatacatggaggtcaatatggaaacaaaacaaatcaacatcgttttactgtaaatgatattgttgaaacaattcctgacaatgaattcgacgaattcagacatcaccgtggtgcaacttcgtaccatcctaaaatgatgttaaaagtgattctatatgcctacacacaatctgtattctcaggtcgtaaaatagaaaaaatgcttaatgatagcatccgaatgatgtggctatcacaaaatcaaaaaccttcttataaaacaattaatcaatttagagtaaatccaaaagtagatgctttattagaatctttatttattcaattttacagtcagtgtgtaaaacaaaatcttatagatgataaagctatttttattgatggtacaaaaattgaagcaaatgccaatcgatatacatttgtatggaaaaagagtattcaaaaccatgaatcaaagatgaatgaggattctaaagccctctaccatgaattggtaaccaataaaatcataccggaaattaaagaagatcatgataatgaattaacaaaagaagaaatagatttgattggtagtcacttagataaagaaatcgaagatttaaaccaacatatcaacaatgaaaaatgtactaaaacaagaaaacaaatacgtctcaaaagaactaaaatcaaaaaatacaaaaagcaaatcaatgattattttgagcgaaagtatcgatacgaatttcaaaaatctattttaaaggatagaaatagttattctaagacagattatgatgcgacatttatgagaatgaaagaagatcacatgaaaaatggacaacttaagccagggtataatttacaaatagcaacaaattcccaatttgttttatcttataatgtgtatcaaaatccaacggatactagaacgatgattccatttttaaattcaattcaagagacctacggtcatttacctgaatatattgtagctgatgcaggttatggtagtgaatcaaattataaggcaattatagatgactttaatcgaacgccactcataacatatggaatgtttataaaagataaaactaaaaaatataaaagtgacatctttaatactcaaaattggaactatgacgaaattaatgacgaattcatttgtccgaataataaacggctaggttttaaaagatatgcctatcgtcatgataagtatggttataagcgagacttcaaattatatgaatgtgatgattgttcagaatgtcctctgaaaaatcaatgtatgaacttcaattcaaaaacaaacaaaaaaataatgaagaattataactgggaatattttaaatcccaaattaacaaaaagctttcagaaccagaaacaaaaaatatctacagtcaaagaaaaattgatgtggaacctgtttttggatttatgaaggctattttgggtttcactcggatgtctgtccgacgactcaataaagtcaaaagagaactgggttttgtattaatggcacttaatataagaaaagtagtagctcaacgagctgaaaataatcaaaaaatttataaaaaaagacaatgtctatattatctcaatagaaattgtttttttttcacttattccaagaactttatgtcccggactcattatgatttatttttttattggggacttgccattaattctgcttgctccacaacttgttccacagccattttttga

SEQ ID NO: 136 - DNA, 1650 bp, Staphylococcus epidermidis
atgaagaaaggatgtaacataatgcaacaacttaaaacaaaacgtgtcggtatctatgtacgtgtatcaacagaaatgcaaagcacagaaggttatagtatcgacggacaaatcaatcaaatcaaagaatactgtgacttccatcattttgaagttaaagatatatacgctgaccgtggtatttcaggtaaatctatgaacagacctgagctccaacgtatgttgaaagatgcaaaagaaggcaatatcgactgtgttatggtatacaaaacaaaccgattagctcgtaatacatctgatcttctcaaaattgtcgaagatttacacaaacaaaatgtcgaatttttcagtttgtcagagcgtatggaagtcaatacttcttctggtaaactcatgttacagatacttgcgagtttctcagaattcgaacgtaataacattgtcgagaacgtatttatgggtcaaacgagacgtgcccaagaaggctattatcaaggcaatttaccactaggttatgacaaaataccagatagtaaacacgagctaatgattaaccaacatgaagctaatattgtaaaatatatattcgagtgctatgccaaaggacatggctatcgtaaaattgccaatgcattgaatcacaaaggatatgtcactaaaaaggggaaacctttcagtattagttcaatcacatacatcttagctaaccctttctatatcggcaaaattcaatttgcgaaatacaaagattggagtgaaaaacgtcgtaaagggctgaatgataaaccagtgatagctgaaggtaagcattcccccattattaatcaagatttatgggataaagtacaaatgcgtaagaaacaagtcagtcaaaaaccccaagtccatggcaaaggaacgaatctgcttacaggcattattcactgtccccaatgtggcgcacctatggcagcaagcaataccacgaatactcttaaagacgggactaagaaacgtattcgttactattcatgtagtaattttcggaacaagggttccaaagtatgttcggcaaacagtgtaagagctgatgtgattgaagattatgtgatgaagcaaatacttgaaatagtcaaaagtgataaagtcattcaacgcgtagtaacacacgtcaatcaagaaaatcaagttgatggcgctgcacttcatcacgatattgcttataagcaacaacaatatgatgaagtacaaatcaaaataaataacttgattaaaaccatcgaggataatccggacttaacatcagtaatcagaccaagtattcaaaaatatgaaaagcaactcaatgacattacgaatcaaatcaaccaactcaaaaatcaacaaaatgaagataagactttatttgatgccaaagaaatcagtaaactattacaacacatctttcatgatattaagcacatagaaaaatctcgactcaaagcattgtatctatcagtgattgatcgcattgatattaaaaaagatggtaatcataaaaaacaattctatgtcacactcaaacttaataacgaaatcattaaacaacttttcaataataaacaactcgacgaagtgcatctcagcacttcgtctttatttttgccccaaacactatatcttactatttag

SEQ ID NO: 137 - DNA, 1662 bp, Staphylococcus epidermidis
atagaaagagggattcaaatgactcaaaattcatataaaatacccattcaaggcatgacatgcacaggctgtgaagaacatgtaaccgaagcattggaacaagccggagctaaagatgtttcggccgatttccgacgcggtgaggccatttttgaactcagcgatgatcagatcgaaaaggctaagcaaaatatttcggcagccggctatcaacccggagaggaagaaagccagccctctgaaaacagtgtagatttcaatcgggatggcgattacgatcttctgattattggttccggcggtgcggcgttttctgcagctatcaaggccaatgaaaacggggcgaaagtggccatggtagaacggggaaccgtcggggggacctgcgttaacatcggttgtgtaccgtcaaaaaccatgcttcgtgccggtgaaataaacggtctcgcccaaaacaatccgtttaccggacttcaaacgagtaccggtgctgcggaccttgcccaattgaccgaacaaaaagatggattagtcagtcaaatgcgtcaagaaaaatatatagacttgatcgaagaatatggatttgatctcattcgtggcgaggcctcgtttatcgacgataagacgatacaagtgaatggacaaaacatcacgtctaaaagctttttaatcgcaacgggggcttctccggctgttccggaaatcccgggaatgaatgaggttgattatttaacaagtacatccgcactcgaattaaaagaggttccacaacgattggcagtgatcggttctggctatatcgcagcggaattaggtcaaatgtttcacaacctcggaacagaagtgactctcatgcaaagaagcgagcgtctgtttaaaacctacgatcctgaaatttccgaagccatcgatgaatccttaactgagcaaggacttaacctgatcactggggtcacttatcaaaaggttgagcaaaacggtaagtcgacaagcatttatattgaagtgaacggtcaagaacaagtcatcgaagccgatcaagtcctcgtggcaacaggaagaaagccgaacacagagactttaaaccttgaatcagcaggtgtgaaaacagggaaaaaaggcgaagtgctgaccaatgaatatttgcaaacgtcgaataaccgaatatatgccgcgggcgatgtgaccctcggtccgcaattcgtttatgttgcagcttatgaaggcgggattgtggcaaataatgcgttgggtctagcgaaacgcaaaatcgatcttcgctttgttcccggcgtaaccttcaccaatccatcgatcgccacagtcggcttgactgaacaacaggcaaaagaaaaaggttacgatgtcaaaacatcggtccttccgttggacgctgtaccgcgggccttagtcaatcacgaaacaacaggggtctataaacttgtagtcaacgcccaaacccagaaattgatcggggcgcacattgtgagtgaaaatgctggagatgtgatttatgcggcaacgttagcggttcaatttggattgaccattgaagaccttacggatagctttgcgccttatttaacgatggctgaaggattaaagcttgcagccttgacgtttgataaagacgtatcgaaattatcttgttgtgcaggctaa

SEQ ID NO: 138 - DNA, 615 bp, Staphylococcus epidermidis
atagtaggaggtataattaacgtgttcaatacaacatataaagaaatatatagcatgtttcctaataaaccatacccagtacatgatatctatgaagactgtagaactattcttgctgacttgcaaatagaaatgtttaatagaattaataaacagctttataaaacctgtcattacaataagcctagaaaacatcacgaaatgattaagaaattactaatcgaatttattatagacaacaaagatagcaaaatcgttagcgcggaaccatttgaattaaacctagaagctttttatgctatcaaacaaaattgtaatattagtaataacaataaacccttagatgaatatattattacatattttgaggatttattgtctaatataagtaacacattaacaaataataatagagctaatggaaataacccaataataaattacatctatgttactcaaagaaaagatggcatggtttgcgtagttggaaaatcacatttcaaatatgaatttaagggtaatgaatataaattagttaaaaatcaagaaggtgacttattaagaagatggatgaagataaaggtaccggaaaaatattatcttcattgtatataa

SEQ ID NO: 139 - DNA, 891 bp, Staphylococcus epidermidis
cttaaaggaggtgacatattggatcgtgcatttcgaatacttacgatatacaatcgtttactacaaaataaatccgtcaacaagcaatcactcacattagaactcgatacaagtcctcggacgatacaaagagatatcgacgatataagaaacttcttatatgaaagtaaatcatggataagcgcacctaaagaaattacgtacgattataaatcagaaagttataagctcgaacaaaataaaagtgaaaatatgtattttatgtatgatattttgactgctttatacctaacaacaccaaaattaagccattacttttatcaatatcttaaattattaatcgtcaaacatcattcaaattatcgaactacattattaaaatatcttgagcgttttgaaattgataagaatcaaacaggtatttcgacatcatcattagttgttcaagcaatgaacgaaaatcaatatcttcaatacaatcaaaatctattattacctttatcgatgtactatcaaatgcatgcttttcacttggtatatcgaatgaacgatgaaattcatatcgatgatattaatcaaatgaatctgagtttgtctgaaaaatctgtggacacacatgaaaaatcaaaggtacaaacctatatcacgtttgaaatttctaaagatgtgtggtcaaaaatgcatcgatattatcaaattcatgtgatagaaaaatatgatgcgcattatcttatcgtcacttttaagatgacaaggattgaagcgattcaactctgttttatgtatcgatccaatatacgtatcatttcaccccctgatttgaaggaacaagtgattgatgaattacttttattacaaacaacctatttaaaacaacaggttcaaaagtag

SEQ ID NO: 140 - DNA, 339 bp, Staphylococcus epidermidis
atcatacggggggtgtttttttctatgaaaagagtttcttattcagtagaaacaaagtataaagcagttgaaatgaaagcagcaggattttcaacaaaagaaattatgaaagaattaaatattagaaatagaacacaagtgaaaacttggtggcgatggtatcgaaatggggaaagttatagattttcacaacacgttggtaaacaatatacctacggtaaaggattagaagagctgttagaagtagaacaattaaaattagaaaataagagaaaagatatagaattggatattttaaaaaagtacaaggcattggagaggaagtggtaccaacagtag

SEQ ID NO: 141 - DNA, 570 bp, Staphylococcus epidermidis
aattcatttattgggcatacaatgcttttaggcaaatgtttaggaggtatggcaatggatagtcatttaaatcacattttgtcctattggcagggaccaccgttggaaggggcaaaaaccataattagtaagtatggatatccccaggaagcaacaatgagacgattaatttggtacaatagcgggccatggaaacgcacgatagtatataaggatccagtccctcataacttccctacccctcaccttgatttccttaagcagaccatcgattataaagtgcccgtacacttatatgatgcgattgccgcttttgatggaagtgtctacttagatcgaactacaggtgaggcatcagcaaagtgtcatgaggaagcgatgaattttttatctttaaacttgttaaatgacattgtaactggcaaacgtgatgttcaaggagcaaaagctttctacgcccaaactgccgaacagtttaccaaatatcatataacatctccttatacagaaggttttctttttccaatgcaatataatacggcagaccttggcgttacatattttaaataa

SEQ ID NO: 142 - DNA, 1383 bp, Staphylococcus epidermidis
atatatattatcactgtgaaaggaggagccgatatgaaacaagtcataggctatttacgtcaaagtacgatgaaacaacaatctcttgcagcacagaaacaagctatcgaagcaatagccgaaaaacatcatattcaacatatcaacttttatagcgacaaacaatcaggtcgcaaagataatcgtagtgggtatcgacaaataacacaattaattcaacaaggacagtgtgacatattatgctgttatcgtcttaataggttgcatcgtaatctgaaaaatgcattaaaactcatcaaattatgtcaaacgtaccatgttcatatcttaagcgtacatgatggttactttgatatggatcaagctttcgaccgactcaagcttaatatcttcatcagtttagccgaacttgaatcggataacattggagaacaagtcagaaatgggcttcaagaaaaagcaaagcaaggtcgattgattacaacacatgcaccttttggttacgaatatcacaacggaacattcatcatcaatcaaaatgagtcaccaacggtaaaggctgtattcaattattacattaaaggtcatggttataagaaaattgcacagttattagaagaagataacacgtatatcaatcgacaaccctatcaagttcgtaacattatcatcaatcctaattattgtggtcgtgtcaacaatcaatatggccaattcgacaatatgtttccttctattgtttccacaagtatatatgagcaagcgcagagacttcgattgcaaaaacaaaccaaacagacaccttcggataatcaactcaaacaaaaaatcaaatgcccatgttgtaatgcaacacttacaaatatgaccattagaaaaaagaatcatacattacgttactacgtctgtcctaaaaacatgaatgcttcacgctttgtctgtgattttaaaggcatcaatgcacaaacacttgaagataaagtattagaagtgtgccgagacttttatcaaaatcaacgcatctacacaaaaattaaaagtgcgattgacaaacgcatcaaaagacaaagaaacatagaaaaacatcacacattgactcaagaacaactgatagaaaagttggcacaaggcatcattgatgcagaaacgttcagagagcaaacacaatcattacgtcaacaaccgcaacgcactacatctatcaatgggcatcaaatacaacacatcattcaaaatattattcaaaaacgtttcacgttaaacatattgtacccctatattgaaaccattcacattacgaaagataaaaatcttataggaatctatttcaaaaatgaaccactcaatattgtcaatcaaaccatgcaatcatcgattgcataa

SEQ ID NO: 143 - DNA, 1515 bp, Staphylococcus epidermidis
atggcaactattggatttgaagaaaaactatggcaagctgcagataaattgagaggaagtatggatgctgctgaatataagaacgtagcattaggtttaatatttttaaaatatgtatcagattcttttgaagaaaagtatgaagaattgaagcaagatccttatgctgacgaagaagatcaagatgaatacttagcggaaaatattttctgggtgccaaaagaagcaagatggcaatatatcaatgataatgcgaaaaaaccagaaattggacaaataattgataaagccatgattgcaattgaaaatgaaaatgaatcattaaaaggtgtgttaccaaaagaatatgcgcgtcctgcattagataaagaaaaattaggcgatattattgatttatttacatttaaggttggagatactgaaagtcgcaagcaagatgtattaggccgagtgtatgagtattttattgctaaatttgcgagtgctgaaggtaaaaatgctggagaattctatacgccatcatcaattgtaaaattattagttgagatgattgagccttataaaggccgtatttacgatccatgttgcggttcaggtgggatgtttgtacaaagtgaacgcttcgttgagaaacatcaaggtcgattagacgatattgcgatttatggacaagaatctaaccctacgacttggaaattagcaaaaatgaacttagctatccgtggtattgataatgatttaggtgaacgaaattctgatacattccataacgatttacataaaggactaaaagcagattacatattagccaatcctccttttaatgcaagtgattggggtcaagaacgattacttgatgattaccgttggcaatttggtattccgccaaaaggtaatgccaactatgcatggattgaacatatgatttcaaaattagcacctaatggtacagcaggttttgtattagctaacggatcaatgtctacaagtggaaaagatgaattagaaattcgcaaaaatcttattgaacaagatttagtagaatgtattgtcactttacctggacaactcttttactcaacccaaatacctgtctgtctttggttcattagtaataataaaggtcaaaatggtaaaaaagaacgtaaaaatgaaattttatttatcgatgctcgtgaaatcggtcatatggtatctagaacattaaaagaattttcagatgaagatattcaaaaagtagcacaaacatatcatgcgtggagaggtacaaacgataaaccttatgaagatatagctggtttttgtaaagtagctaatttagaagaagttaagaataatgaatacattttaacacctggacgatatgttggtttagctgacgttgaagaagaggaagaaccttttgaacaaaaaatggaacgtattacttctgaattaagtgaacaattcgcaaaatcaaaagaacttgaagaccaaatccgtaaatcattggagggactaggttatggagtttaa

SEQ ID NO: 144 - DNA, 1293 bp, Staphylococcus epidermidis
ataatgactattctagcgattattatttttcttttaactcttatgtttgttatttggcaacctaagggtttagatattggtattacagcattgattggtgctatcatcgccattattacaggcgttgttagtctctcggatgttattgaagttacagggattgtttggaacgctactttaacttttgtcgctgttatactcatttcattaattttagatgaaattggatttttcgaatgggcagctatacatatggttagagcttcaaatggtcatgggtttaaaatgtttgtctacattatgttattaggcgctattgtagcagctttctttgcgaacgatggagctgcattaattctcactccaatcgtgctagctatggtaagaaaccttgggtttaatcaaaaagtcatttttccttttatcattgcaagtggattcattgcagatactacatctctcccattaattgtaagtaatttagtaaatattgtttctgctgactacttcaatattggatttatcgaatatgtaagtcgtatgattattccaaatatattctctttaatagcaagtattgttgtattatggttatatttcagaaaagttattcctaacaattttgaaattaaaaatcttaaaacacctaatcaagcaattaaagatccaaaattatttaagttttcgtggattgttttgtcaattttactcattggttatatagttagtgaatttattcaaattccagtatcgttaattgcttgtttgattgcacttatatttactgtactggcctataaatcgagagtagtaaacacgaaacaagttatcaaaggcgcaccttggaatattgttctcttttctataggcatgtatttagttgtatttggtctgaaaaatgtgggtattactgcactattagctaatattctatcaagcatatcaaactatggactgtttagtagtgttataggtatgggcttcatatccgcatttctttcagcaattatgaataatatgcctaccgtattaattgatgcaattgctattggacaatctgcaactactggtttaatcaaagaaggcatgatttatgccaatatcattggcgcagatttaggacctaaaatcacacctatcggctccttagcaacactgctatggctacacgttttaacacaaaagggagtaaaaatttcatggggcacatattttaaaacgggtattgttattacgattcctgttctttttatcacattagttggtttatacgttacacttattgtattttaa

SEQ ID NO: 145 - DNA, 417 bp, Staphylococcus epidermidis
ggtgacaatatggagatgaaaatcagtgaattggctaaagcgtgtgatgtgaataaagaaaccgttcggtattacgagcggaaaggattgatagccgggcctcccagaaacgaatcagggtatcgaatatattcagaggaaacagcagatcgggtacggtttattaaacgaatgaaggaattggatttctcgctaaaggaaatccacctgttgtttggtgtggttgatcaagatggggagagatgtaaagatatgtacgcctttaccgttcaaaaaaccaaagaaatcgagcggaaagtgcaggatttgttacgaatccaacggttattagaggaattaaaagaaaagtgtccagatgaaaaggcgatatatacctgtcctattattgaaacgttaatgggagggcctgataaataa

SEQ ID NO: 146 - DNA, 945 bp, Staphylococcus epidermidis
aaggaggatataaatatgtctaaaatcgtcgtagctttgggtggtaacgctttaggacaatcgcctaaagaacaattagatttattaaaaagtacatctaaatctctagtaagtttaatcgataaaggatacgaaattgtaattagtcatggtaatggtccacaagttggaagtattaacttaggtttaaattatgcggcggaacacaaacaaggtcctccttttcctttccctgaatgtggtgctatgagtcaagcttatattggctatcagatgcaagaaagtttacaaaacgaacttcattcaatgggcatagataaacaagttgttacgctagtaacacaagttcaagttgcaagcgatgattctgctttcaataaccctactaaaccaattggattattttatacaaaagagcaggctgataaatttacgaaagaaaaaggttatacttttgtagaagattctggacgcggctatcgtcgcgttgtcccttccccacaacctataagtatagttgagttagatagtatagaaacattaatcactcatggaacactagttatcgctgccggcggtggtggaattccagtaattaaggaaaatgaagtttatacaggtgttgatgcagttattgataaagataaaacgagtgctttattagcagcacatttacaatctgatcaattaatcatattaactgctgtggaccatgtttacattaactatggaaaagaaaaccaaagaggtctcgatgaagtgtctgtggatgaaatgaaaaaacatatctctgatggtcaatttgctaaaggaagtatgcttccaaaagttgaagctgcacttcaatttcttgaaaaaaatactaaaggcagtgttttgattacatctctagcaggattaggggacgctttagacggtaaaataggaacattaattaagaattga

SEQ ID NO: 147 - DNA, 333 bp, Staphylococcus epidermidis
ctaggaggtatatttatgtcttataaagaattatcagcaatattaaaagttttatcagatccaagtcgattagaaatattagacttattatcttgcggtgaactatgtgcttgtgatttattagcgtattttcaattttcacaacctacattaagccatcatatgaaaattttagtggataatgaattagtatctacacgaaaagacggtactaagcgcatgtaccgacttaatcatacgttcttagattcaatcaacaaagaattaacttatattagttctcctactcaacaatgtatgtgtaaaaagataaagacaggtgaatgtaaataa

SEQ ID NO: 148 - DNA, 537 bp, Staphylococcus epidermidis
tgcttttacattaaaattaaaataaaagaggtaaaccttatgtataataaagtttttgcaattttaattataattttttccataataattattgcgtctaatgatactttcgcagaaagtaagaatgacatgatgaacatgaaagaagataagaaaagtacaatggacatgacaaatatgaaacatcatgacgaaagaaagaaattaaattcttcacaaggaaaaaatgaaataatatttcctgaagttgcagagtcaaaaaaagataacaatggttataaaaattatacattaaaagctcagaaaggaaagacagagttttacaaaaataatttttctaatactctaggctacaatggaaatttacttggaccaactttaaaattaaaaaaaggagataaagttaaaattaagttaataaataacttagatgaaaatacaacatttcattggcatggattagaagtaaatggaaaagtggatggagggccttctcacgttataaaaccaggaaaagaaaaaaactataaaatttga

SEQ ID NO: 149 - DNA, 1044 bp, Staphylococcus epidermidis
aaaaataacatgaataaaatattaattgaaaaggagatattcaaaatgaaaaatttaagaaatagaaactttttaactttgttagacttcacacaaaaagaaatggaatttttacttaatttatctgaagatcttaaacgcgcaaaatatgcaggaatagaacaacaaaaaatgaaaggtaaaaatatcgctctactttttgaaaaagattcaacacgcactcgatgtgcatttgaaacagcggcttatgatcaaggtgcacatgtaacataccttgggccaacaggttctcaaatgggtaaaaaagagtctaccaaagatactgctcgtgttttaggtggaatgtatgatggcatagaatatcgtggattctcacaaagagtagttgaggatttggcaaaatattctggcgttcccgtatggaatggtttaacagatgaagatcatcctacacaagtacttgctgattttttaacagctaaagaagtattgaaaaaaccatataatgaaattaacttcacatatgttggagatggacgtaataacgttgcaaatgccttaatgcaaggagcagcaatcatgggcatgactttccatcttgtatgtcctaaagaactaaatccaactgatgaattattaaatcggtgtaatgatatagctgacaaaaacggtggtgaaatccttataactgatgatattgatgaaggtgtcaaaggatctgatgtaatttacacagatgtttgggtatctatgggtgaacctgatgaagtttgggaaaaacgtatcaaattattagaaccataccgtgtaactaaagaattaatgaaaaaaacaggtaatccacatacaatttttgaacattgcttaccatcattccatgatactgaaacaataatcggtaaacaaattcaagaaaaatatggtctaactgaaatggaagtaacaaatgaagtatttgaaagtgaacaatcagttgttttccaagaagcagaaaatagagcacatacaataaaagcagtcatggtagcaacattaggagagtaa

SEQ ID NO: 150 - DNA, 927 bp, Staphylococcus epidermidis
tactgggtcttatttctacaatatttagctataaacaaaacgaaagtattggtgaaaaatatgaacttaaatgacttagaagctttttataaagtctgcgaaaatcgtagctttactaaagcagcgcaagaactgaattatgttcaatcaaatgtaacagctaaaattcaaagattagagtcttattatcaagtgaaattactatatagagataaaaaaggaattaaaccgacaccagaaggtattgaattactaaaatatattaagagaatattcacaattttacatgaagcagaacataatgtaagcaacaataaaaaattaaatattaacatagggacaattgaaacaatagctgcagttcatttacctaaattattgaatgaatataagaggaaaaatccaaaaattcaaattaatttaaaaacagataatagtattaaattaattgaacatgtaaagaatagagaaatggattgtgcttttatatctgggaatattaacgataaagatcttatttgcacaaatatctttaatgaaaaattagtgattttatctcaaaagagcaactttaaacagaatataaacgaaaataagtctattataatgtttggcgaaggttgtttttatagaaaaatttttgaagattggcttaattatcatgatattaatatagaaaataaaatgacattaaatactttagatggcattttggggtgtgttgaagctggattaggtatagcatttttacctatgtcagtattaaataaaggaaatagcgatggtatagaaataaccaaagtagaggaatcatttcaaacaatatcactaaatatcatttatcgacaagataataaaaataataatgtgataaatcaattgaaacaagttgcttttgagaaaatgaaatcaaatataataaaatag

SEQ ID NO: 151 - DNA, 324 bp, Staphylococcus epidermidis
ataacattaataataatgaaaggaatgggaattatgagtaacatcataaaaacaataggcaaaggtattggaaaaggtgtcggtgcagcagcatattattcagttgcgactgttggtgctgccatcggtgcgatttgggaaacaacaggcgatagaggtttgatgagagacgctttaagtgatagctctaaccaagacttaatagaaatatatgagatacaaaagaaagatgatggggattatgatacttatattgcggctaaatccttattacaagagagaggattcacttataatcatgaaacgaataaatgggaaaaataa

SEQ ID NO: 152 - DNA, 549 bp, Staphylococcus epidermidis
aaggtgttaattatgaatttaactactcaaatcacaaaaatgttaggtattaaatatcctattatacaagctggaatggcaggaagtactacgccagaactagtttctactgttagtaaacaaggaggcttaggtatgataggagcaggttattttgattcacatcaactttcgaaagagattttagaagttcaaaaactgacacaagctccttttgcagtaaatctatttacacccaatgatattaagtacgataaaaaacaaattgagcagatgaatacaaaactcaaaccatatagagaagcgcttggattatctactcccaaaaatagtacggttaaagaaaaagaaaagtttgaagatgcaatagaagttattgaatcattaaaagtacctatcattgcttttacttttggtattccaaatcaaaatattattaaacgacttcataatgcaggaaaaattttaattggaactgcaacatcagtcgaagaagcagttgaaaatggaaaatgctggtatggatatagttgtagcccagggctatga

SEQ ID NO: 153 - DNA, 234 bp, Staphylococcus epidermidis
gaggtcataatgatgacattagaacaacaactcaaacactatataactaacttattcaatctgccaaaggatgaaaaatgggaatgtgaatccatcgaagaagccgctgatgatattctacctgaacaacacgtaagacttggtccacttagtaataaaatacttcagactaatacctactactcatacacacttcacaaaagtaatatctatcccttcatcctctactattag

SEQ ID NO: 154 - DNA, 474 bp, Staphylococcus epidermidis
tcaaaaataataaagggggtaataaaaatgaaaaaagaaaaacgtttaaatcttatcttaactgttatacaacagaatcagtttaataaaaaacaacaaatagtggattacatggcaagacattttggagtttactatagcttgacaactatttctcgtgacttacaagaattagaaatttacaaaatccctgttgaaaataaaaagtatatttacaagaaaataaatcaaacaaatcaattaagtgcaaaaaaacaattagaaatatttagtgatgagattattgaatttataacgctaaataactatgtcttaataaaaacatctcctggctttgctcaaagtataagttattacatagatcaattacaaatgaaagaaatattaggaattattggaggtaacgatactttgatgattttgacttcttcaaatgaaatagcagaatttgtttgttatcaattattcccttaa

SEQ ID NO: 155 - DNA, 465 bp, Staphylococcus epidermidis
ttaccacaaattgttgatgatgtgtctataccagtaattgcagctggtggtattatggatggaagaggtttagtagctagtttagctttgggggctggagcagcgcaattaggtactgcttatttaacaacgaatgaaagtggcgctgatgacaaaatcaaaaatgaaattattgaaagctctgaaacagatacaatactgacaaatgtatttagtggcaaattggctcgcggaattatgaatgaatttgtacacaatatgaatttatattcaaaacaggtgcctccttatcctttacaaaatcaattaacaacgcaaatacgaaaatctgctttggagaaaggatatactgagtggacccatatttggagtggacaaagtactagattagctgacacagtcgatgcagctcaattaacaaaaaatattattaatgatgcagtcaaaattatcaataataagtga

SEQ ID NO: 156 - DNA, 2739 bp, Staphylococcus epidermidis
ggggaacaaatgaaaaatatagatatcgcaatttatgatatagataaagttatttgtaaaagtattgagaataactcatcagatttaggttatttatcacaaagtatcttatcacatttaagaaactacgtagaacatattggtatgaaatattatttcgaaagtgtaaatgaagatatgactaatagttcttcaaatatctataatgaaatacaaatgggaataggttattttaggaagcattacaaattgaattggcttaaaaattttcatgaattacttcagcaatctgtttctcattatacatttgatgaagatagatccgaacggttatttataaagtattatgacttaatgttagaattaaaagaaaagttaaagaaagattttgaaatggatttattgcaaaatttatataaagtaccgctgaatattgatagtgatttaaaaggatattatcatacaatatctcaattaataggtaataaatacactgataatgaatatgaagtagataattcaaggtattatattgaaaaaacaaaaccatttgttattgaaaataaagtatattatgaaattacatttagaaatgcaaatgataaaactagtaaatacgaaaggctgattggttattcaaaacatagaataaacacaaattatgctgtaaaattcgcattagaaatgcaaacaataagttatttagggattaaagctaacgtaataataataaatgattacgaaatatctataagaccttgtgaatttaataattttgctaaaatattagattacgatttaaaattacaatcaaatcataatgaatataaaaaattaatgaaattgttaaaagaatttaatttacatttacttgatattgttttgttagatgacgatgaatttaatgaattggagtgttcagtgaatagcgaatcagcagttattaatatttttaatgtgttgagactagcaagaagatatattttaacaaataaatcaggcgcaaatgttcttaggtatttattatttgtttttaacaataggataattcgtttacagttaccttataataggaataaatgttataaattatctaaccttatattggattataaatgtgttccatttgatcaaatgccatttacagcctctttaaaaggccataatcctaatatctatactttgttacaatgtatagaatacaaagggagagaatatgaattattagtcaggaagattcaaaagaatactttgaagaataagaaagtttatacaagcaaagaagaaattgagcagtatggtgttgtaaacgaactaatcgataaatataataataatttgtattataagcatcgaccgaatagggaaatacattcatttggtgataaatattatttatatgaaaatgagcagagtattatgagtataataaagtcaattaaactattgtcaaatgaaagcgtagagggctattcaaattcagtagagttttggctaaataatgaatatacatcgttggattgtaaagaaaagaaggaaatactcttaagaatgttttcaaatagcaaaatatcgatggtatacggagctgctggaacagggaaatcaactttaataaaccatatttgcaattttttctatgataaagatgttatcgtcatagcaaatactaatactgcagtagacaatattaaaagaaaaatcaaattatctaacattaaaacgtctactatttctaaatttttatataatgataaagaaaagtatgacttgttaataatcgatgaggcaggtacagttagtaataaggacatgaatcgaattcttgaaaacaagcaatttgaattattattaattgtcggtgataattatcaaatcgaatcgatagattttggaaattggttcgaaattgccaaagatgttttgtcaaaaaatataatcaacgaactaactgatatgtatcgaactaaaaatgatgatttactttacttttggaaatctgttagagaaaaaaagagtaatttaaatgaaattattaatatgaataaatattctacaagattagatgaaagtatatttaatgaattcaataaagatgaaattattctttgtttaaattacgatggtatatatggtatcaataacattaatagattattacaagcaaataataaaaatgattctgtaatttggggtgtgaaagaatataaagttggtgatcctattctatttaatgaaactaataagtactcaccaatactttttaataatttaaaagggtcaataattgaaatacatgtttttgaagaatatatattgtttgatttagaaataaataaagttataaatgaacttgatattatttcgttagaaattgatttaataagttcttctgaaaatagttcggtgattaggattagagtagaaaaaagtgatgggttgaatgatgatgataatgattcatctgatagtatagttccttttcaagtgagttatgcaatttcaatacataaagctcaagggttagagtttaattcagtaaaaattgttatatctgatgatttagacgaacaaatcactaacaatattttttatactgcaattacacgagctagagaaaatttaaagatttattggtcaccacgaactgaaaagaaaattattgataatataatttctaaaagaaacttgaaggatctttctatattaaaatctcgaataaaaaaacaaaatacttag

SEQ ID NO: 157 - DNA, 1824 bp, Staphylococcus epidermidis
cagcaacccttcgaaaggaggtgttcgctaatgactcaaactaacccttcatttaatccttcaccacgatacaaatcaaaaaaaggttggtataaagacaagcctcccaaagaaaaaggaggaatgcctactgaagttgaaatcgcaggtcctatcgttatcgaaaataagtttattgaccctaaaactaacactgaaaaagtaattattacagacgaggatcaaaaagtaattgttgaatctagtgatattttaacaacacaaaaactgccctctttaatgaaatatggatttagtattaatgaaaaatatacaaaagatttaggttatgcgttgcaacaaatgcgcaaccaattacccatttcctacttatatgaaggggtaggtatactggaaacaccgtttggtcctattgtatcgttaaatgaaatctatactactacggaatttgataataaatctccatctgacgccatttgtgagaatacttatgacttagcacctaggggaacatttgataattggtttaacatgtatattgacgaggttaaagatcatcttcttttagaattgacagtcatatttgggatttctgccttagtgacaagttttctgaagcataaacatgaaatcgaatttgcaggaattctctttagttttacaggtcaatcctcaaccggtaagtcaaccgcagctgctttagctgtatcagtcgctggtaaccctaccaaaggtaatgaaactctttttagaagttggaatgccacacgtaacgcacttgaaggttatttgagtaacaattatggcgttcctatagtatttgatgaactttcatctacgacacttaaagataccacaggtttgttatattccatcgctgaaggtcaaggtcgtcaacgttccaatgtacacggagaagttaaagcgcctaagaattggggtacatctgtgatttcaacctcagaatacagtatatttaatgattctgctcaaaatgatggtttacgtgtgagaaccatcgagattaatgaacaattcactacaaatgcgaccaatgctgacaatattaaaaaagctgtagcactaaactatggtcatgttttaccgttagtagctaaatatcttataaatcgtgaagatgaagttattcaatggttttacaaggaagtagattggtttgaagctaaattgaaagatgaaacaaacaatacaggtattcgtatgtttaagcgttatgcagtcattacaacatctgcgaaaatattaggtcgtgttttatctacagatattgatatcgctaatataagagactactttattgattatcatactcatacagtctctgaacgctcattagctgataaagctattgatgtcatcattcaatttgtggcacaaaacagaggtaagttttcagatgaaggtgctttgaaaaatatgtttgagaactatggattaatctcattaaaagatgaccatatcgaagtaaaaataattgcgaacgtttttaaacagatgctaaacaatcatcaatttcaagatgttaataatgttgtcaacgccttaagagataaaggtttcatattagctgaccgtggacgccaaacaactaaaagaagtgtcaaagataatagcggtaaaaaacaatcacttgtattttaccatctaaaattagatgtagagtttgcatctatcctcggattaactaaagataagtcgttacttcaaaattggacaccgtcaaatgataacaaagctgcgaaagaactttttaaatccgctaatgaagggataggcccttcaggagttcacgaagatttctaa

SEQ ID NO: 158 - DNA, 825 bp, Staphylococcus epidermidis
ctaggtggaattatgaaaaattttaaagttcaagaagctaaagaaactccattaagtgctcaaaatgcaaatgtattcattaaatgtgttaaaaaatataattggcttaaagacataataataaatggttatttccaatataggtatgtaactgaagaagtagaatatttaaatatagagactactgacttaagtggaaagagaattcctatcgaagacattacgtttccaatgttatgtttttgtgatataccattaaatcaattaaaagatcataataaatggtatggagactatgcgatatgtatgaaaaaatcttggggagtaaacaaaaacctacagccattgcattatgtatcgaatactagtgagtatattaaaatgtatcaagaagtgtttaataatatagttaataaaccagacactgatgaaaaagtatatgaatttatattcgcttcattatttttcttaaaacattttaaaggaagtcaatattgtgaaaaaactgataaaatagaagagaaaatattcatggatgaacaagaatggagaagtataaaattagttgatgaagatttagatcctttttacatcaatgaaaatagtgactctaaaagaaattattataatgaagctttaacaaaattatcaagtaataaattagaatttaattgtgaagatattaggtacattattgttgaaaaagaagaggacgttattcagctaataaatgatattaattgctctaattacgatgatcaagaaaaaagcttactcatttcaaaaataagtgtcttaaatcacttaagagaggattttatgtaa

SEQ ID NO: 159 - DNA, 1530 bp, Staphylococcus epidermidis
aagagagtgattatcatgattaaaaataagtggaaaatagagctgtggtttcaattcttcagttattttatacacaaaattgattccgaatttatactaaaagaatatgcacaacatattttacctgaagaaatgagaacaaattatgtagtgggagaagcacaacctaatgaaactatatatataagctactttgtaaatacctctaatcaaaatattgaacaacacactgtgaaatgtagtgaagagggtatatttatcgataaaattcctagtggctttactaaagataatctgacgtattctattgatagtcaaagtatggtggacatagatgaactttcaaatgaaatcattgaccaaggtgtagatgctctagatgtgttagaatcaacaactctagatacatatttcaccgagttcttaaccacaatcaataaaacaacagattttgctaaaaagatagctaacaatacaataaaacagattcgagaaaatattgaattaaaaaaagctaactatagaatagattatgaaaaagctattgacgatgtatcttctttggaatcatttataaatctgaaagatacaatattagaaactcatcaagatttatctaaagaaaattttgacgatgtattaataagtgattttttaacgaaatatctcatttataaagaaaaacaagactcttatgttaagaaaaatatctcaaacttaaataagtctaactactttaaacaattagtgacggaaggtttaatcaaagaacgaacaagtaattctcaatactttgaaattgctaatagtatcaaaccttcgattcataacaagtatagcttaaatcaatctgatgagttagaccaatttaggcaagctgttatcggcatttctctcaacttatatgatcaaaatgatacatactttaaattcatccgtagtattctgacagaaaagtcacgtaaagttaatttaacaatagatggacttattgagtctcaaaacactataaatgaatttatgaaaaaacaagatctaattagcgacaatgaattatattatttaacaactattgaagatacgttccactttgcattattcactgccatttccgatttaatggatgaattagttttagtaacaagtaaaatcattcaaagtgcgacacaatacgatgtattagtcgctttatatagtatttctaatttaaaaaatgatttgaataaattagcacacaaacacgaacgatcattaacccgttttaaaagtcttattgatggttatgtaagaaatactagattaaaagatttaattcataatattattatgaatgatataaaaatgacagaaaaagtagaaaggtctttactcaccgatctaaaaaaatataatattagcaacttttataaaagagacaactttaataataatcctaatgattttctcgataaactaatgattcaaataatcagtaagttttacaagacacgtttagaagatattaacgatggaccaaatttatattattaa

SEQ ID NO: 160 - DNA, 342 bp, Staphylococcus epidermidis
ttagaggagatcgattcatttaatgaattattttatttaatagaattatatttgaaggcatttaaaggacaaaagaaaacaggctatgaatttgaagaaagattgaacacatttattcaatcatatgtcattattttacttatagatataaggttaccgactgttaggttatatattattaggcatattgtggatacatgcgaaaaagaagtggacaatcaaaaaagaattatactaatagagaaatctattaaaaagtacagatatgtaaaagaacagattaaaagatttggaaatgcgttgaaagaagaattatctaacgcgactttgtctattgaatag

SEQ ID NO: 161 - DNA, 567 bp, Staphylococcus epidermidis
cgtggacgctttttattatgtgatgcttttaccagaagaatactaaaggaagtgacgatgatgaatacaatcaaaagtacgatacacacagaagccatatttagcgatgatgaacagcaccgctatttactcaagaaaacatgggatgaaaagaaagctgcatgcacagtgataacgatgtatcctcatttagacggtgtattatcactcgatctcacaactgttcttatcctcaaccaattagccaattcagaacgatacggtgctgtatatcttgtaaatctattctctaatattagaacacccgaaaacctcaaacatatcaaaaatccatacgatgagcacactgatattcatttgatgaaagcgattagtgaaagtgacacagtgattcttgcttatggtgcctatgcgaagcgaccagttgttatcgaccgtgtcgaacaagtgatggaaatgttaaaacctcataaaaagaaagtaaaaaagctcatcaatccagtaacaaatgaaattatgcatccactcaaccctaaggcacgtcaaaaatggattttgaaatcatag

SEQ ID NO: 162 - DNA, 195 bp, Staphylococcus epidermidis
actttaagcgtctcaatatcattgagacgcttttttattattaattattttatactttttgatttatctccaggattagtcatttttcttatctttttaatttacacactaaaaaatatcctccttaacaataataagttatttaaattattgattaaggaggatatttttatatctatttatttctcaatctag

SEQ ID NO: 163 - DNA, 270 bp, Staphylococcus epidermidis
cttttcttagtgatgataggatatgttgaccaaattggccgtgagattggaggggtggtttttatggttagttgttgttcaatcgatccatacactgaattcgaagtcattattattggtgccggggtgccggaggtttctcttgcctttcatttgacttcatacggcataaggacggcacttgcggatgaacagaacgtggataacagattaaaggactttttaagaacttttcaagaattgattgagcgcgattcgggtatgccgtga

SEQ ID NO: 164 - DNA, 1491 bp, Staphylococcus epidermidis
aagtcacaagtaattcattcattaaatcaaataacaagatttttaccacctttattaggggagattaatatggatgaaaataaattaggtaaaacttccttaattggtttagtcataggctctatgataggcggtggtgcattcaatatcatctcagatatgggtggccaagctggtggacttgcaataattatcggttggataataactgctattggtatgatttctcttgctttcgtatttcaaaatttaacaaatgagcgaccagatcttgatggaggaatttatagttatgctcaaacagggtttggagattttattggtttttcaagtgcttggggatattggtttgcagcatttctaggtaatgtggcttatgcaaccctattaatgtcagctgtgggtaactttttccctatatttaaaggaggtaacacacttccaagtattatcatagcatcaattttattatggggtgtacattttttaatacttagaggtgtagaaactgcagcgtttataaatagtattgttacagtagctaaattaatacctatatttctagttattatatgcatgatagttgtattcaacttcagtacttttaaatccggtttttatggtatgactagtggaagtgttggcgtttttagttggggagatacaatggcacaagtaaaaagtactatgttagtaactgtatgggtattcacagggattgaaggagccgttgtcttttctggacgtgcaaagtctaaaaaggatgtaggaactgctaccgttattggtttgatttctgtgctagtcatttatttcttaatgactgtactagcccaaggtgtcattcaccagaaccaaatttcaaaacttgctaatccatcaatggcacaagtattagaacatattgtaggtcattggggttcagtgttagttaatataggcttaattatctctgttttaggagcttggttaggatggacattactagctggtgaattaccattcattgtagctaaagatggacttttcccgaaatggtttgctaaagaaaataagaataaagctccggtcaacgctttaattattactaatatattagttcagttatttttaattagtatgttgtttacagatagtgcctatcagtttgcgttttcacttgcatcaagtgcaatcttaattccatatacactcagtgctttttaccaggttaaatatactattcaaaataaatctaaagctaatttaaaacaatggataataggaattattgcatctatttacacaatttggttggtttatgcagctggattagattatttactattaacgatgttgttatatatacctggattactcgtatacagctacgtacaaagggataataacaaacatttgacaaaattggattatacgttattcatattcatcattgtacttgcaataataggaatagttcgtttgattacaggtaatatttctgtattttaa

SEQ ID NO: 165 - DNA, 231 bp, Staphylococcus epidermidis
cttctaaaagttttaaaccgggtagacctattggtggagatttctacttacgtggccttattaaatgcccagaatgcggaaataatatggtatgtcgacggacgtattataaaacgaaaaagtccaaagaacggacaatcaagcggtattacatttgttccttattcaatcgttcagggagttctgcatgtcacagtaattccatcaatgctgaagtcgtcgagcgtgtaa

SEQ ID NO: 166 - DNA, 1146 bp, Staphylococcus epidermidis
attaaaggagtgttggaagtgaaaactagagcagcagttttacatgaaatgggggctaaaaagccctataaagaatctaaacctttaaaaattgaatacttagaacttgataatcctagcgaacacgaagtattaattaaaattcatgcagctggattatgtcactctgatttgtcagtaattaatggtaacagacctagacctttacctatggcacttggtcatgaagcttccggtgaagtaattaaagttggaaaagctgttacaagagttagcgaaggagatcatgtggtatgcacatttattcccagttgtggaaaatgtatcccatgtaaagaaggacgtcctgcattatgtgaaaacggagcaatatctaatgaaaaaggcgaaatgttagagggagggatgcgtttatctaatgatgaaggaaaagtatatcatcacttggggatatcaggttttgctgaatattctgttgtctctgaaaactctatagttaaaattgataaaaaaataccttttgaacgtgcagctgcatttggttgtgctattatcacaggtatcggtgctgtggtgaatacagcccaaattcgttctggtagtaatgtagcggttgttggtttaggaggtattggattgaatgctattattggagctaaactagcgggagccaatgaaattattgctttagatattaacgaagataaatttgaattagcaaagcaatttggggctacagcaacatttaattcaagcgataaagatatcgatgagcaaattaaagaatatattcctggcggagtagaatatgcttttgaaacagcgggtgtagtgccagctatgaaagttgcttatcagattactaaacgaggggggacaactgtaacaacaggactgcctaatcctaaagataatttttctttccctcaagttactttagcggctgaagaacgtaccattaaaggatcatatgtaggaagttgtgtacctgacagagatataccaaggttcgttaatctatacaaccaaggacgtttaaatattgattcactcatcagtgaggttatcactttagatgaaattaatgagggatttgatcgtttgtctaatggtgaagtaggtagaattataatgaagatgcattga

SEQ ID NO: 167 - DNA, 243 bp, Staphylococcus epidermidis
agtaaaggagtattatctatgaaccatgacaacactatacaatccaattggcgaacggttgctagttgtttagcatcacaaaattacatttcaatagtaaaaggtctggtgcatcatttcacagccatcgatgacgaggaaatacttgataaaatctatgaagagtttataaatgatgactctattacaacggtacttaacaatgatttacaaacaattattaatcattatctatcaaaatga

SEQ ID NO: 168 - DNA, 264 bp, Staphylococcus epidermidis
caaaaaggagtcttctgtatgaactatttcagatataaacaatttaacaaggatgttatcactgtagccgttggctactatctaagatatgcattgagttatcgtgatatatctgaaatattaagggaacgtggtgtaaacgttcatcattcaacggtctaccgttgggttcaagaatatgccccaattttatatcaaatttggaagaaaaagcataaaaagctaattacaaatggcgtattgatgagacgtacatcaaaataa

SEQ ID NO: 169 - DNA, 195 bp, Staphylococcus epidermidis
atagtctcattaagtttcttgaagagactttcaaatatttcattatgctttctacataaatactcaagtaaatctttcggtaaagttaatattttacaatctgtcaaagctgtacatatttcatatggtgcaggggtttcattaaatatgaagttcattggaaatatattttcgtctttacttaatcttaaataa

SEQ ID NO: 170 - DNA, 198 bp, Staphylococcus epidermidis
agtaatacattacataggagtgataaaatgccaagtcgttgggtaaaagttaaaacctttaagtcattatctacttccaaattagagaaaaagttacaaaatttcaaatcatataatagctttgatattatagaaattaaaagacattcatatttatttttaaatatagtcgaagtttattacaaagataaaacttag

SEQ ID NO: 171 - DNA, 216 bp, Staphylococcus epidermidis
ttatgggcattcttagctatccagcgtccttcctcagttttaccaaaactagcatatagattttcacaacaagttggtaaacaatatacctacggtaaaggattagaagagctgtcagaagtagaacaattaaaattagaaaataagagaaaagatatagaattggatattttaaaaaagtacaaggtattggaaaggaagtggtaccaacagtag

SEQ ID NO: 172 - DNA, 912 bp, Staphylococcus epidermidis
tttaataaatttggaggcgttatactaatgatagattcgattatagaatttataaaaacatttctaatgctattttttgaattattaatactgttcataatcgtaagttttattgtaagtctaatccaacaagtagtttcggaagataaaatcaaaagcatgttaagtaaacctaaccaaggaatcaattatttttttgggatgatatttggtgcgattactcccttttgttcttgttcaacaattccaatacttgcaggtctattaaattctaaagtaccttttggtccagcggtgagtttcttaattgcttcaccattaatgaatccattaatggtgtttatgctatgggttttattgggctggaaagttgcaatagtttattttattgtactagcaatatttagtatctttacaggtcttgtgttttcaaaaatgaatttggctgaaagttataagggcgtaaatgttaaaggagatggattttttgccaataaagaaggatctcgttttaaacaagcattaaatgatgcgtgggcatttttatatccaatgcttccttacctatttattggtgtatttattggagcattcatatatggatttgtacccgaaacatttattacaaaatacgcaagtggagatggcgttatatccgtattcattggatctgttataggcattccaatgtatattagacctgaaacaatgttacctatagctgaggcattagtatcaaaagggatgtctttaggaacagtagttgcgttgataataggtggtgctggtgcaagtattccagaagttgtattgttaacgaaattattcaagaaaaaatttgtagtctcattcgtaatcgcaattttagttgtagctattgctacaggtttgattgtgaacatcgttatttaa

SEQ ID NO: 173 - DNA, 333 bp, Staphylococcus epidermidis
catgataaattagtggttagctatatttttttactttgcaacagaaccctattctttggcgcaacatgggggccaattatgtgggtaatgttgccagaaatgttccctacacgcgctcgaggtgcagctactggtatcgctattgtagtattacaaataggaacacttattatttctcaagtatttcctatccttgttaatatgttagaagtacaatatgtattcttgatttttgcagttataggggcattagcactcatttttgtagttaaattcttaccggaaacgcgtggtaaaagtttagaagaaatcgaattacaattacaaaactaa

SEQ ID NO: 174 - DNA, 243 bp, Staphylococcus epidermidis
gtagcgaaatttattggaaaaggtacttatattgaagatattgttaatggttcatttttaaaaagccaagacgatttgaagttaaaagcttctgacttcactgtcgaagataactataactacggtgtacttatatttccagagaatctttctcttacagataataataagaaattggaatctttaataaaaactatactatttacaggtaaacgatatcaatatacttattttaaaatttga

SEQ ID NO: 175 - DNA, 450 bp, Staphylococcus epidermidis
acgttgatttctcaagaactgttaatacaaaaaattcaagatgcagatgcattaatcactttattgtctacccaggtaagccgacaagttattgaatcggcgccaaaattaaaaatcattgcaaattatggtgctggttttaataacattgatatccaagcagctcgcgaacaccatattaatgttacgaatacacctatagcttctacaaatgcaacagctgagttaacaatgggaatcttattggctgtcgctcgtcgtattcctgaagacgatcaactttgccataatgaagggttcaatttgaaaatcacagatgataatctgcaagtcgattaccctcgtcaatttctgaaaggcgcacatgcaccgagtgttaaagcacagcacgttattcattggggcgacaccttctgggtttcgtcgttatggttagcgtggttttattaa

SEQ ID NO: 176 - DNA, 1374 bp, Staphylococcus epidermidis
agagtgatttctgtgaggaggataatgatgacaaagaaatacgatcttattgtgattggtacaggttctgcggggtcaatcacagcagcaaaatgtaataaagccggctggaatgtagctatggtagatgacaggccgtttggaggcacgtgtgcactacgtggatgtgacccaaaaaaggttctacatggtgctgccgagcttattgattggaacaaacggatggttaagaatggagtaccgtctgaagtctccatcaactggaaagatcttatgaattttaaaagaacctttacagatgatgtcccggaaaaaaaagaggaagcattgaataaacagggaatcgatacgtatcatggcaatgcatctttcgtgagtgaggacaaacttgaagtgaataaagaagtgctcgaggggagtcatttcttgatcgctagtggtgcgaaacctacccctttacccataaaaggagaagaacatcttacttatagtgatgagtttttggagttggatgaattaccacaaagaatcgtctttgttggtggtgggtatatttcgtttgaatttgctcatatcgcggcacgtgctggatcagaagttcatattatccatcgaggtcaaagacctttggagaattttgatatagatcttgtagatatccttttagaaaagtcgaaagagattggcatacaggtacatcttcaacattccgttgaatccattgaaaaagaacaaggaaagtttcatgtgtacgctcgaaaaaaagaggatataacgcggtttgaagcagacattgttattcatggtgctggacgggtccctgccttagatatgaatcttgaaaaagggaatatagaaaggaaaaaacatggtgtccatgttaatgagtatttgcaaagtgtaagtaacccgaatgtctatgcagctggagatgctgcagcaacggatggcttgcccctcacacctgtagccagtgcagattctcatgtcgtagcatctaatttattgaaagggaacagcaaaaaaattgaatatcccgtgattccatctgctgtatttaccgtacctaaaatggcatcggtaggtatgagcgaggaggaagccaaaaactctggccggaatattaaagtaaagcagaaaaacatctccgactggtttacgtataaacggacaaatgaggactttgctgcgtttaaagtgctaattgacgaggatagtgatcaagttgtcggtgctcatttgattagtaatgaagccgatgaactaattaaccactttgcaacagccattcgctttggaatttcaaccaaagaattgaaacaaatgatatttgcctatccaacggcagcttcggacattgcacacatgttgtaa

SEQ ID NO: 177 - DNA, 369 bp, Staphylococcus epidermidis
ataaaggagttttcaataatgaaaaataaaaaaggattaggcataggtcttatcacaattatgattatcgtttgtattgtactagtaatcatgatgttcgtgggtggtaagaaagaatcatactacggtattatgaaagatagcacgactattgataaaatgataaatactaaaaatgaaaaaattgaaaaaaacgtagaattacctaaagatgctaatgtatcagttaaaaaagaagattttgtgatgctctttaaagatgaaaaaactggaaaaattactaaagttaagaaagttaatcacgatgacgtacctcatggtttaatgtcaaaaatccatgatatgggtaatatgaaacacggaatgtag

SEQ ID NO: 178 - DNA, 2112 bp, Staphylococcus epidermidis
tatacaatgacatgttttttaaatatatataaagaatatcattctccccctgaacgcaatattaatagaattattctgatgttttcacttacaaatgacttaaaaatcactattaatggtgaaacaaaagatttaggtaatcatatagctatcattaatcaatctgacatctattttattaatagtgcttcaaatctcgtattactctctattccagttatttatttttatagtaaagataataaattttttaaatgttattttgacagacatttattacaatcaagcagttttgttaaaacaattattttacaagctattcaacatttaataaaaggagaaaatcaagatgagcaatccatctctaaaataatacaaacgctactaaaagaagcagtcattcgatataagaaaaaatatattcctcaaattgcagttaatcattcagtgtttactgaaggattaacatttattcattcaaaagtatcacagtcactttcactacgagaagtagctcaacattgtaatatatctgaatcttattgttctaacctatttgcaagatatcttaatatgaattttaaagattattttacaagcttaaaagtgattgactctataaaaaggctactttcatctgaggactcaattaacgctatttcagaacaatctggatttagtagtcataccaattttacaaatcaatttaaaaattatttaggttgtagcccaaaacaataccgaacgattatctctaagttagactccttaccttcgataagttttagtgatactgacttttcacaatatattgatttaattaatcaatttgagtttagtgatcatttggctactgaaacgactgaaagagatatcaatgaattttatcctcaagatcagactaaaaactctaaagcgtttatacgttttcaaaatttcaacgaattatttcaatttgtttttaatgaatattacaacattgattttacctccctgccacaagctgtaatttttatcaatgatatcactgatatttcgacgcgagaggtgaactttaatttattaaatcgatgctttgaaaaattattcgaaaaaaatataggtttagccatgagattaacatctacaaatgaatttgaatctatcaaagaaataattttattatttcttaatagccaccaagattataaaatgaacaaaaaaatggttaaatttatgttagtctttgaaactaagaatatgtcagtgaacgatatacatttatgccatttaaaaattaaaaataaaaataaagctatccgttatagtataactgttgaaggattactacaccaaaattcttctattgatcgaacttatgatatgatgaagcgattaaatttcgattactattttatagacattgaaaatctagaaaccaaaaactcattaattaccaaacgtaaatcgtacttacattcgtccacacactttgaaaattataaacaatttatattagattccggtataccttcaactaaatttgtttacaataatttatctttaaagtgttttaaatatacaaacaatggtacttatccacttcaattatctgaccttgtttgtcatttagtcgcattaatgcgttacgggggtggtgtaagttatcaactgatagaagatgagagtccttttattgccttatttaatcgttatggtagtcccctacctctcatgcacctctataaattaatcgaaccatttttaaatgaacctttagagatagctaacaattttttaatgagtcgcaaagatggtaactatcactttttattatttaataaaataaatgatcgttatctatctgatagtcaacagcgctacgtttttaaaaatacattatcaaccaactcattaattattattaaaacgttaaatcatgagcatggcgcaattcaaaaccttctaccacaaactaaacaacaattttatattgaacgtagtattcttgatgaacttgataaatcaaatcaaccaaaaacagaattagctatacaacatgaccatcatcttcctttccaagtcaccttaaaacacgatgaagtcaaatatatttgttttaaaccttcttaa

SEQ ID NO: 179 - DNA, 822 bp, Staphylococcus epidermidis
atctatggcaaaggtgagttattaccgattatctttttcgcagtattttttggattaggattagctgcgataggagaaaaagcagaacccgttaaaggattcttaaatggtactttagaagctgtattttggatgatcaataaaattttaaaattagctccaattggagtatttgcatttatctgtacgacagtaatgacttttggtgcttctgcattaattccattatttaaattattagttgttgtagtatttgctatggttttctttgttattgtagtattaggaattgttgcaagaatggttggaataagtattttttcaatcatgaagatacttaaaagtgaattgttacttgccttttctacttcaagttcagaagcagtattgccgattatgatgaagaaaatggaacgctttggttcgccaaaagatgttacttcatttgttattcctatcggttattcatttaatttagatggctcagctttatatcaatctatagctgctttatttgttgctcaaatgtatgatatacatttatcattaactgaacaacttgtattaatggccacacttatgattgcttcaaaaggtatggctggggtgccaggcgtatctattgtagttttattaacaacattaacttctatgaacataacagcacaaggtcttgctttaattattggtattgatcgtttattagatatggttcgtacatgtgttaatgttattggtaatgcactatcaacagttgttattgctaagtgggaaaacgtctatgataaagagaaaggtcaaaactacttaaattcaatttaa

SEQ ID NO: 180 - DNA, 468 bp, Staphylococcus epidermidis
attatgtgtgataaggatatatacaataataaggagatgataattttgaataaacaacaagtgacaaaagcaatagaaaaagtattaaattcttcaaaaattggtgtcctatcaacagcacatcataataaacctaatagcagatatatggtcttttacaacgatgacttaaacttatatacaaaaacgaatatcaattcactaaaagtcgaagaaatagaaaataatcctgatgctcatattttattaggctataacgaaacaacaaacaatagctttgttgaaatagatgccactatagaagttgtcaaaaatcaaaaagttattgattggttatgggaaactcaagacaaaacatttttcaattcaaaagaagatcctgaattatgtgtactcaaagttatacctcgttcaattaaattaatgaatgatgatgaactagatacgccagctacaattgagttataa

SEQ ID NO: 181 - DNA, 531 bp, Staphylococcus epidermidis
aggggagtttgcataatggctctattcaagaaaaaaataagtgtaccaacgcaagtaattattgctttggtactcggtgtcatcgctggtctattactatatggacaagatgatgttgcaaattatattaagccatttggtgatgtgttcttaaatttaattaagatgatcatcattccgattgtattttgttcattagccttatctatttcaaatttaggggattctaaaaaggtaggaagctatggatggaaagcaatcctttattttgagattattacaactatcgctataggtttaggtcttatcattggtaatctattcaaaccaggttcaggtctagatccagataaattacctaaaggcgatattactaaatatcaatcatctgcacattcagcagaacaagcgactacttatggtaatcatcttatagatacattagttcatattgtgccaacgaatttatttgaatctatggcaaaggtgagttattaccgattatctttttcgcagtattttttggattag

SEQ ID NO: 182 - DNA, 378 bp, Staphylococcus epidermidis
ttgaaagaacgcggaaaaatagaaaaattgtggcgtgaagaaaaatatcgtgtgctatttcatgatcagaatgcatatcattcgataagaacgttattaaaatcgcctaccacattgggtgaagtgaaagaacatataacgcacgctttaaccattacacctacaaaaggctcagttatcaatgcttttgaacatatgtgggggtatttcaaaaaacaatgtacacaatatgaaaagcaacatagccgagaattaaaagcgttgtatattgaaaatcaaattgactattttgagctgttgtcttttttaaaaaatttagcagataaatatgctgtcgagtacttacaacaaagtaccatactcaatattacaaaatga

SEQ ID NO: 183 - DNA, 1401 bp, Staphylococcus epidermidis
  unsure (157): Identity of nucleotide at the above locations are unknown.
aaaaagtaccagattgctgcaagccttaggttagtagacctgtgggggacgagagaagctggatttgagttgcccagtttaggtttggctggggggctccatacaattacaagaaaggaaagcattatggttaatcgtcaacccccccagggggtgntattcggtttacccatatctctgatttgggggtttgtggccattgccgtgttcatgaccggggatggaattgaactagcgtttctctcccgatatgtagttgatctgggtttctcccctactcaggcaactcttttatttacggtctatggttttttggcagccatttcaagttggggttccggtgtgctggcggaaaccttcggtcctcggcggatcatgctgattggcgtcgcggcctggattgtctttcatgtgttgttcctgattttcggcctggagcagcagaaatacacattaatggtggttttttacggtatccgtgggttggcctacccattgttcatttatgccttcatggtttggatcgcacaggtgacgccaggcgcacgtatggcctcggccatgggctggttttggtcgatgtattgcatcggtattggccttttaggcaactggattccaagcctgagcatttcacgtatcgggtttatcaacacgttgtgggtcggtgtattttgggttgccgttgccgggctgatgatcatgtatttagtcaaggagcgtggggccggcaaacccgacgatgcagtgacattggttgagcgtctgaaaaccttgagttcgggcgtcaccatcattgctgagcgacggggcatgttcctgattgtattggtgcgaattatctgcaacctgagcctgttcggtctgccggtgatcctgccgctgtacctaacctcggtcgaggtcggtttcagcatggagcaatggttgcatttgtggggtgtgatgtttgtggtgagcatcttcaccaacgtgatttgggggcaaattggtgatcgcctggggtggctgatacaaatgcgctggttcggctgcataggctgtgcgctgtcgtcactggcgttctattacctgccgcagttctacggtgcccattttgaaatcgctttgattgccgccatcggctttggcatcagcgtgaccgctttcgtgcccatgggcgcggtattcctggccctggcgccggagcagaaaggcgcggcgatttctgcacataacctggcggctggcctgtcgaatttcatggggccggggattgccaccctgtttatcgccactctgggcatcaagggcgtggtgtggatctacgcagggctctacgtggccggtgcggttttgaccttcttcattcctgtccctcaacctcgactctgtcaactgcgtcattgcccacgatacgcc

SEQ ID NO: 184 - DNA, 192 bp, Staphylococcus epidermidis
gcgacggggcatgttcctgattgtattggtgcgaattatctgcaacctgagcctgttcggtctgccggtgatcctgccgctgtacctaacctcggtcgaggtcggtttcagcatggagcaatggttgcatttgtggggtgtgatgtttgtggtgagcatcttcaccaacgtgatttgggggcaaattggtga

SEQ ID NO: 185 - DNA, 521 bp, Staphylococcus epidermidis
cgggttgccgaatcccgtggtcgaaggtcttatcgtcagcgggtgttacggggggcatggacctggcgttggcgctggtcgaagaagattacggcagagaattggcgctcagcgtggcccgtgaaatggtgatgttcttcaagcggcctggcgggcaatcgcagttcagcgcgcaactggcagcgcaaaccgccgaacgcagcgtgatccgggacgtgcaggaatatgtggtggagcacctgaaggccgacttgagcgtccctgccttggccgcccgcgccggtatgagtgagcgaaacttcgcccgtaccttcaaggctgaagccggctcgaccccggccgaatttgtcgaattggcccgcattgatgcggccagacggctgattgaagatgccgatgtttcacttaaacgcttggccgatacagtcggttatgccaatgcggacgggttcagaagggcatttatgcggcgtctcggcgttgggccaagtgattatcgaaagcggttttcattgatgtga

SEQ ID NO: 186 - DNA, 453 bp, Staphylococcus epidermidis
  unsure (7): Identity of nucleotide at the above locations are unknown.
cgatatngagttcaccctgttgcgagacgaattttcggagttccggaaccgcttggcgatcttgatatgtacaccgcgaaggccggagtgctcacttttctccccgtgggtcaaagcccaggattagacattcagcaggtgtggtgtttcgaccctgttgctcaagcctggcgggtggacatgatgattgaatcaggaagccctgaagtatgggtatacaaacgggatgggtctatccggtttccccgtaccgaaatgttgtatctgagcagtgagggcattccatatttaaggccagcggcgatcctcttgttcaaagccctgcacgtgcggccaaaggatgaggaggattttcacaagaccttgccgacgctgcccgatgaggaggtggcgtggctgaagcggcatttgctgaagcttcatccggggcatcactggataaccccgtcatga

SEQ ID NO: 187 - DNA, 444 bp, Staphylococcus epidermidis
agaagcatgaagggccttttgcaacgggtgcgtggcgcccgggtcgaggtggcggggcaagtggtgggcgcgatagaccagggtttgctggtactggtggccgttgaaccttcagataccgccgccagtgccgacaagttgttgcataagctgcttaactaccgggtgttcagtgacgacgagggcaagatgaacctgtcgttgaaggacattggcggtggtttgctgctggtgtcccagttcaccctggcagccgataccaaaagcggcctgcgtcccagcttctccaccgcggcgccaccggcgttgggcgaggcgctttttgagcacttgttgtcacaagcgcaacaattgcatggcacggtggcgtcggggcgttttggcgcggatatgcaggtgcatttggtcaatgacgggccggtcaccttccttttacagacctga

SEQ ID NO: 188 - DNA, 228 bp, Staphylococcus epidermidis
cccgcgccgaacaggcaaaacagggcggagcccgtcaccagtgcgtttcgtaaccgtttggcagacaattttggtgcattacagggactaacaatcacgagcaaccctcgccgaaaacagatcaaaaaaccaacggccagctatctatatgccaggttggcgagcattgttccgactccgatggggctaaatgattccccaagggcgaccggacaagtctctacctaa

SEQ ID NO: 189 - DNA, 711 bp, Staphylococcus epidermidis
tttggtgaagaccttgagcgcattcgcgagcacctggggattgaaaaatgggtgctgttcggtggttcctggggctcgaccctggccctggcctatgcacaaacccaccctgatcgcgtgcttggcctgattgtgcgcggcatcttcctggcccgcccccaggatatccagtggttctaccaggccggcgcgagccgcctgttcccggactactggcaggactacatcgcgccaatcccggtggaagagcgccacgacatgatcagcgcctaccacaagcgcctgactggcaatgaccagatcgcccagatgcatgccgccaaggcctggtccacctgggaaggccgcatgctcggcctgtgccccagcccgcagttgatcgagcgcttctccgagccccagcgcgcgttgtcgattgcgcgcatcgagtgccactacttcaccaataactcgttcctggagcccaaccagctgattcgcgatatgcacaagatcgcccatctgccggggatcatcgtgcatggccgctacgatatgatctgcccgctggataatgcctgggagctgcaccaggcctggccgaacagtgagttgcaggtgatccgcgaggcgggccacgcggcgtccgagccgggcatcaccgatgcgctggtgcgtgcggcgggcgagatggcacgacgcctgcttgatctgccccctgaagaagcatga

SEQ ID NO: 190 - DNA, 183 bp, Staphylococcus epidermidis
tcgcgtgcttggcctgattgtgcgcggcatcttcctggcccgcccccaggatatccagtggttctaccaggccggcgcgagccgcctgttcccggactactggcaggactacatcgcgccaatcccggtggaagagcgccacgacatgatcagcgcctaccacaagcgcctgactggcaatga

SEQ ID NO: 191 - DNA, 225 bp, Staphylococcus epidermidis
caacaagtgctcaaaaagcgcctcgcccaacgccggtggcgccgcggtggagaagctgggacgcaggccgcttttggtatcggctgccagggtgaactgggacaccagcagcaaaccaccgccaatgtccttcaacgacaggttcatcttgccctcgtcgtcactgaacacccggtagttaagcagcttatgcaacaacttgtcggcactggcggcggtatctga

SEQ ID NO: 192 - DNA, 207 bp, Staphylococcus epidermidis
tccgcgaggcgggccacgcggcgtccgagccgggcatcaccgatgcgctggtgcgtgcggcgggcgagatggcacgacgcctgcttgatctgccccctgaagaagcatgaagggccttttgcaacgggtgcgtggcgcccgggtcgaggtggcggggcaagtggtgggcgcgatagaccagggtttgctggtactggtggccgttga

SEQ ID NO: 193 - DNA, 1191 bp, Staphylococcus epidermidis
  unsure (1071): Identity of nucleotide at the above locations are unknown.
ctggccgttggttttttgatctgttttcggcgagggttgctcgtgattgttagtccctgtaatgcaccaaaattgtctgccaaacggttacgaaacgcactggtgacgggctccgccctgttttgcctgttcggcgcgggtcaactgtgggcattcagcctggacgatgtgtcggccaaggcaaaagagctggccgggcagaaatacgaagccccgcgcagcaatctgccgaacgaattccgcgaaatgaagttcgctgactaccagaaaattcgtttccgcaatgaaaaagccgagtgggccgagcagaaaactccgttcaagctgtccttctatcaccagggcatgcacttcgacacgccggtgaagatcaacgaaatcaccgcgaccgacgtccaggaaatcaagtacgacccgactcgtttcgatttcggcgacgtcaagtttgatcctaaagccaccgatcagctgggttatgccggctttcgcgtgctgtacccgatcaacaaggacgacaagcaagacgaaatcatgaccatgctcggcgccagctatttccgcgtcgtgggcaaggaccaggtctatggcctgtccgcccgtggcatggcgattgataccgcgctgccgtccggcgaagagttcccgcgtttcaccgagttctggatcgagcgtccaaagccgggcgacaagcacctggtgatcttcgccttgctggattcgccgcgggccactggcgcctaccgcctgatcctgcgcccgggcaccgacaccattgtcgacgtcaagtcgcagatgttcctgcgtgacaaggtcagcaagctgggcgttgccccgctgaccagcatgttcctgttcggcgccaaccagccgtccaaagtgctcaactaccgtcgtgaactgcacgactccagcggcctgtcgatccatgccggtaacggcgagtggatctggcgcccgctgaacaacccaaaacacctgtcggtcagcaacttctcggtagaaaacccacgtggtttcggcctgttgcagcgtggtcgcaacttcagccagtacgaagacctcgacgacaantacgacaagcgcccaagcgcctggatcgagcctgaaggcgactggggcaagggttccgtggatctggtagagattccgaccgccgatgaaaccaagtgctcaccagcgggaagggcggag

SEQ ID NO: 194 - DNA, 261 bp, Staphylococcus epidermidis
tcatgtcgtggcgctcttccaccgggattggcgcgatgtagtcctgccagtagtccgggaacaggcggctcgcgccggcctggtagaaccactggatatcctgggggcgggccaggaagatgccgcgcacaatcaggccaagcacgcgatcagggtgggtttgtgcataggccagggccagggtcgagccccaggaaccaccgaacagcacccatttttcaatccccaggtgctcgcgaatgcgctcaaggtcttcaccaa

SEQ ID NO: 195 - DNA, 2667 bp, Staphylococcus epidermidis
gatggatgttctttttattttttaggaggtagacatatggaaatgaaaccaaaatatgatccaagagaagttgaaaagggtcgttatgaggaatgggtaagtaatggttactttaaaccatctgaagataaatctaaagaggcatatacaattgtaattccgccccctaatgtaacaggtaaattacatttaggtcatgcatgggatactactttacaagatataataactagaatgaaaagaatgcaaggatacgatactttatatctgcctggtatggatcatgctggtatagcaactcaagcaaaggttgaagcaaaacttaatgaacaaggtatatctagacacgacttaggaagagaaaaatttttacagcaagcatgggattggaaagaagagtatgcaacatttattagacaacaatgggctaaacttggcttagggttagattatagtagagaacgctttacgttagatgatggtttaagtaaagctgtaagaaaagtatttgttgatttatataataaaggtattatttatcgtggtgaaagaattattaactgggaccctatagctagaacagctttatcagatattgaagtcattcatgaagatgtccaaggtgctttttatcattttaaatatccttatggtgatgggaatggatatatagaaatagctactacacgtcctgagactatgttaggtgacactgctattgttgtaaatccaaatgacgaaaggtataaagatgtgattggtaaaacagttatattacctattgtaggaagagagttacctattttagctgatgaatacgttgatattgaatttggttcaggagcaatgaaagttactccggcacatgatcctaatgactttgaaattggtcaaagacatcaattagaaaatattatagtcatggatgaatatggtaagatgaacgataaagctgataaatacaaagggatggatagatttgattgtagaaatcagcttgttaaagacttaaaagaacaagatcttgttataaaaattgaagaacatacacattcagtaggacattctgaacgttctggtgcaatagtagaaccttatttgtctacacaatggtttgtaaaaatgaaacctttggcacaaagagctttggataatcaaaatacaaaagatagaattgactttttcccaggtagatttgaaaatacattcaatcgctggatggaagaaattagagattggacgatttcgcgtcaactatggtggggccaccaaatacctgcttggtatcataaagatacaggtgaagtctttgttggtgaagaagcacctgaagacatcgagaattggatacaagatgaggatgtattagatacatggttctcaagtgcactttggccgttttcaacattaggatggcctgatacaaatgctgatgattttaaacgttattatccgacaaatgcattagttactggttatgatatcattttcttctgggtagcccgtatgattttccaaggattagaatttactgatagaagaccatttaatgatgtattactccacggtttagtcagagctgaagatgggcgtaaaatgagtaaatcattaggtaatggcgttgatcctatggatgttattgacgagtatggcgctgatagtctacgttactttttagcaacaggatcttcaccaggtcatgacttgagatattctactgaaaaagttgaatcagtttggaattttattaataaaatatggaatgctgcccgctttagtttaatgaatattggtgaagattttaaagtcgaagatatagacctaagtggtaatttgtcattagcagatcaatggatattgactagattaaatgaaacgatatctacagtaaccgaattaagtgataaatacgaatttggtgaagtaggtcgtgcgctttataatttcatttgggatgagttctgcgattggtatattgaaatgagcaagatacctatgaatggcgaggacgaatctcaaaagcaaacgacgcgatcagtacttagttatgttttagataaaataatgaaaatgttacatccatttatgccttttgtgacagaaacaatttggcaaagtcttccacatcatggagaaacaattgtaaaagctaactggccaactgttgatcaagcattaatctttaatgaaagtaaacaaacaatggaacaattagttgaaattattaaatctgtccgtcaatcaagagttgaagttaacacaccgttatctaaggcaataccgattttaattcaaactaaagatgaaaagattaaacatacacttatggataacataagttacctacacaaattctgtaatccaagtcaattgactattgatactgagattgaaattccagaaaaagctatgacaactgtagtagttgctggtaaggtagttttgccattagaaggtcttattgatatggacaaagaaattgctcgacttgaaaaagaattagataaattacaaagcgagttagatagagtagataaaaagttatccaacgagaattttgtaaataaagcaccagaaaaaataattaatgaagaaaaagaaaaacaacaacattatcaagaaaaatataatggtgttaaatctagaattgaacaattaaaggcatag

SEQ ID NO: 196 - DNA, 1329 bp, Staphylococcus epidermidis
attagtcaatcatggaggtatttatacatgacagcaacttgggaaaaaaaggaaggtaatgaaggcgttttaactgttactgttcctgcagagaaagtaaataaagcattagatcaagcatttaaaaaagtggtcaaacaaattaatgtgcctggattccgtaaaggtaaagtgcctcgtccaatttttgagcaacgttttggtgtagaagcactttatcaagatgcagtggatattttattacctgaagcttatggtgaagcaattgaagatacagaaattaatccagttgcacaaccagaagttaatgtaactcaaatcgaaaaaggtaaagatttcatttttgaagctacagttacagttgaacctgaagttaaattaggtgattacaaaggattagaaattgaaaagcaagaaactgacctttctgatgaagaattacaagaatcaatcgaccatagcttaagtcaccttgctgaaatggttgttaaagaagatggtgctgttgaaaacggtgacacagtaaacattgatttctcaggttcagttgatggtgaagaatttgatggtggacaagctgaaggttatgacctagaaattggttctggatcattcattcctggctttgaagaacaaatagaaggaatgaaaactggcgatgaaaaagatgtagttgtaacattcccagaagaataccacgctgaagaattagctggtaaagaagctacatttaaaacaaaagtcaacgaaattaaattcaaagatgtaccagaattaaatgatgagattgctaacgaattagattctgatgctgaaaacgtggacgaatataaagaaaatcttcgcaaacgtttaagtgaacagaaagcaactgaagctgaaaatactgaaaaagaagaagctattaataaagcaacagaaaatgcttcaattgatattcctgaagcaatgattaatactgaattagatcgtatgattcaagaatttggtcaaagaatccaacaacaaggcttagatttgcaaacatattatcaaatctctggtcaaaacgaagagcaactaagagaccaaatgaaagacgatgcagaacaacgcgttaaaacaaacttaacgttaactgcgattgctgatgaagaaaatattgaagtatctgatgaagatattgataaagaattagaaaaaatgagcgagcaatttaacatttctgtagaagatattaaatctactttaggtaatacagatattgttaaaaatgatgtacgcattcaaaaagttattgatttattaagagataatgcgaaatatgttgaagctactaaagaagactag

SEQ ID NO: 197 - DNA, 1269 bp, Staphylococcus epidermidis
aaaagaatgttcaaattcaatgaagatgaagaaaatttaaaatgttctttctgtggtaaagatcaagatcaagtaaaaaaattagtcgcaggaagtggcgtttatatttgtaatgaatgtattgaattgtgctcagaaatcgttgaagaagaattagcacaaaatacatctgaaggatttacggagttaccaactcctaaagaaattatggatcacctcaatgaatatgtcattggtcaggaaaaagccaaaaaatcattagcagttgctgtatataatcactataagcgtattcaacaattgggtccgaatgaagatgatgttgaattacaaaaaagtaatatcgcattaattgggccaactggtagcggtaaaacattattagctcaaacactagctaaaacactaaatgtaccatttgcaattgctgatgctacaagtttaacagaagcaggttatgtaggtgatgacgtagaaaacatcttattacgtcttattcaagctgctgatttcgacattgataaagctgaaaaaggtattatatatgtcgatgaaattgataaaattgcgcgtaaatctgaaaacacttcaatcacgcgtgacgtgtctggtgaaggtgtacaacaagcattgcttaaaattttagaaggtacaactgctagtgtaccgcctcaaggtggtcgaaagcatccaaaccaagaattaatccaaattgatacgacaaacatcttatttatcttaggtggagcttttgatggtatcgatgaagtcattaagagacgcttaggagaaaaagtgataggatttgctagtaatgaagcagataaatatgatgaagaagctttactggaacaaattcgtccagaggatctccaatcatatggcttaattccagaatttattggtcgtgtacctatagttgctaatcttgaaactttagatgttgctgcacttaaaaatattttaactcaacctaaaaatgcgctagttaaacaatacactaaaatgctagagttagataatgtagaattagagttttctgaagaggctctatctgctataagtgaaaaagcaatcgaacgtaaaacaggagcgcgtggattacgttcaattatagaagaagcattaattgacatcatgtatgatgtaccttcttctgaaaatgtaagtaaagtagtcattactgaacaaacaattaatgaagaaattgagcctgaattatatgatgatgaaggaaatctaattaataagaacaagacatctgcttaa

SEQ ID NO: 198 - DNA, 333 bp, Staphylococcus epidermidis
gatactaattttagtcatatagaggtgttctgggtgcttaagttttttagaaataacaagctcattgtcgttttatgtgcaatgattatttttattgcattaatagggttatcgatacgttctcagacccaatctccagctgaacaatacgtaggagactctgtatcatttggacaaagagtaatcagttatccaattcaatttgttactggatctattggtgatttatttgaaaaaggaagctcaaaaaaggataaaaataaaatcaaacaacttgaagctaaaaatgaagagttagaatcagcaaataagaaatataacaacagaacttga

SEQ ID NO: 199 - DNA, 324 bp, Staphylococcus epidermidis
agtaaccattacttacccattcctcataacgacccttttcaacttctcttggatcatattttggtttcatttccatatgtctacctcctaaaaaataaaaagaacatccatcctataaaaaataggacggatgttctgttccgtggtaccacctatattcaagaagaaataattcattcttttcttcaagcacttaagtctctgattaacgctcatacacggcttctacctacttgtcgtctatgtttcaatagaagttataaaatagggctaccttcagacttaatcatttacatattcacagccaccatatgctctctttaa

SEQ ID NO: 200 - DNA, 222 bp, Staphylococcus epidermidis
tactacatatacaatataagtgatttaaggaggttcaacataatgagcattttgacgattattttaattgttttgctagtcatcctcttatttaaagttggattatctatattacgctttttgatttcagtaggcattgttttgttatgtatctatttaggttatcaaggtgtattatggttatttgaacattttcaaaacttttcaggttttattcgataa

SEQ ID NO: 201 - DNA, 381 bp, Staphylococcus epidermidis
agatcatctaaggaggaatttattatgccacgagttaaaggtggaacagtaacaagagcacgtcgtaaaaaaacgattaaattagctaaaggttactttggttcaaaacatacattatataaagtagctaaacaacaagtaatgaaatcaggtcaatatgctttccgtgaccgtcgtcaacgcaaacgtgatttccgtaaattatggattacacgtattaatgcggctgcacgtcaacatgacattagctactcacgtttaatgaacggcttgaaaaaagctgagattgatatcaatcgtaaaatgttatcagaaattgcaatctcagatgacaaagctttcgctgaattagtatcaaaagctaaagaagctttaaaataa

SEQ ID NO: 202 - DNA, 930 bp, Staphylococcus epidermidis
cgtatgcgtaaattaattgttgggtcgcgaagaagtaaattagcgctaacacaaagtcaacaatttatagataaattaaaatttatcgatccgtctttggatattgaaataaaagaaattgtaactaaaggcgacaaaattgtagataaacaattatccaaagttggaggtaaaggactttttgttaaggaaatccaaaatgaattatttaataaagagatagatatggcgattcattctctaaaagatgtaccaagtatgattcctgacggtcttaccttaggatgtattcctgacagagaaattccttttgatgcctatatagcaaaaaatcatataccattacaagaattgtctgagggcagcattgtaggtacaagttctttacgtcgtggcgctcaaattttatcaaaatacccacatttaaaaattaagtggattcgtggaaacattgatactcgattaaaaaaattagagactgaagattatgatgctattatattagctgctgctggattaaaacgcatgggttggtcagataatattgttacgacttatcttgatcgagatatattactgccagctatagggcagggtgcacttggtattgagtgtaggagtgatgacaaagaacttttagatttactatctaaagtacacaatcatgatgtagcacaatgtgtgactgctgaacgtacttttctatcagaaatggatggcagttgtcaggttcctataggtggatatgcaacaattgctcaagataaccaaattgaatttacaggactgattatgtctccagatggtaaggaaagatatgagcatacagcattgggtactgatcctgtaaaattgggtatagaagtgagtcaagtacttaaaaaacaaggtgcttatgacataattaaaaaattaaacgaagcagaataa

SEQ ID NO: 203 - DNA, 522 bp, Staphylococcus epidermidis
attatactaaatttgatttgtaaaaggagggcttatatgagatatatctttagtgttattaaaaatattattgcagtattagcgataatattgattatatatatagctcttcaacatgcaccatttctcaaaaatcaagaatggaacccacttaatgatatgaacaatcatcatcaaaatatcacacagaaagtgagtcaaaaaaataatacactctattcacaacctagtaacgataaaagttacattttaaaagaaaatgatatcatcaataatgttccagcaggtcaaattaagacagtttttaatatgattgataaggcagaatttatgtctgtttcaggtttagaacgtatgggattcaatgacgaatatcttgctggccaacaaggtgacgaatttattatttataaattcggtgatgattatatccgagtttataatactgaattcgaaatgaacgaagacctaaatcaattaaaacaacctattaatttgaagccaattgaagcctatcaataa

SEQ ID NO: 204 - DNA, 234 bp, Staphylococcus epidermidis
atcctggtgaagaggcctataggaaatgaatcatgcctaggaatgaaaactcaccgtggagcagctaaacgtgttaaaagaactggttcaggtcaattaaaacgttctagagctttcacatctcacttattcgcaaataaaaatactaaacaaaaacgtcaattacgtaaagctaagttagtttctaaaagtgatatgaaacgtgttaaacaattattagcatacaaaaaataa

SEQ ID NO: 205 - DNA, 186 bp, Staphylococcus epidermidis
aaagtagggaacaaaatgaaatttgatagacatagaagattgcgttcatctaagacaatgcgtgatttagtaagagaaactcatgttagaaaagaagatttaatatatccaatatttgtagttgagcaagatgatataaaaagtgaaattaaatcactaccaggcatataccaaattagtttttaa

SEQ ID NO: 206 - DNA, 486 bp, Staphylococcus epidermidis
agtaaatatgaagtgaaaagacgtggtgatatggaagatgatccatcgtttaaacaattaatatcatattgcctactagaaaatgagaagggtgaaatccttatttacgaacgtctttctggtggtggagaagaacggttacatggtcagtcatcaatcggtgttggtggtcatatgaacgatgttgttggagctgattctattaatgaagttttaagagttaatgctcaaagagaattagaagaagaagtaggattaagtaataataaatctcaaaatatggaatatttaggttttataaatgatgatgacaatgatgtgggtaaagttcatatgggcgtcgtatttaaaatcactgtgcattcaaacgatgttgaagctaaagaaactgatacgctaaaaattaaatggatagaacaaggcgacattcaatcctatgaggattttgaaacatggagtgcattaattcttcaagatatatcatga

SEQ ID NO: 207 - DNA, 825 bp, Staphylococcus epidermidis
tttggtgatgatatgcaagaaaccctgttaattcgatttcatgaaatcatattaatgatttatctgtttagtattatatgttactttgttgatttcattaataaaaattataagactagaactgtaggtttttattcattagggattgtttgggttttacaaacaatctctttgtctattttttttattcatactaaacaagtgccactaggttctatatttgacgtttttttctctttaacttggattattatatcaatttcgttgatattgaatttgattaaagtaatgaatttttctgtttttttccttaatttgattggatttatcctaatgagtttaaatacttttcagcctgaacattatcaaacgcaaattcaacaaattgcagtaattaatgaattattacttgttcatatagcacttgcagtattaagttatgcattttttgcaatcgcatttgtaaattcattactctacattattcaatatcgaaatttaaaggagaaaaatttcgatcaaaattactttagaattggtagtgttgctactttagaaaccatcgttttctattcaacacttgttgcatggattatccttatattaagtacgattttaggtgcacaatggggtatctttgcagtcggtaaacaaatatttatagatccaaaagtaatattttcaacaattattactttattatatggtgtttatattttcattagaataaaaaaatggatatcacaaagaaatcttatctactttaacattatattattttgtttgtgtatgattaatttattctttttaactcattttagataa

SEQ ID NO: 208 - DNA, 264 bp, Staphylococcus epidermidis
tcttcagcacttgtagaactaattactatgtccgttgtttctaataaagatggtaatgctgaaagtgaatcatatgaaacattgtgtttttcggctaaaattttagctttagataatgtccgattaacaattgttacatttgaaattccagaacctaaaagatttaagagtgataattcacccatttcccctgctccaataacgacagcatgtttactttttaattttccaaatacctttttagctaattcaacagcagcataa

SEQ ID NO: 209 - DNA, 627 bp, Staphylococcus epidermidis
tatattattttactcatttatattataatggatattaaaataagtcaatgtattggagatgaaattatgaatgaatgtgcttttaacacaactgatcctatctatatagagtatcatgattattattggggacaaccaatctatgatagcaaagaattatttaagctaatggctcttgaatcacaacatgcaggattatcatggttgacaatattaaagaaaaaagaatcgtatgaacaggcattttacaactttgaacctcaatttatcgcacatatgactgaacaggatattgattatttaatgaaattcccaaacattattcataatcgtaaaaagttagaagcaattgtgagccaagcgaagggatatttaaaaattgaaaaagactatggtagttttagtaaatttttatggtcttatgtaaatcatcaacccataaatatgggttataaaaaacctagagatcgtaaaaaagttgatcaaagagctactcaattatcaaaagatttaaaagcatatggttttaaatttttaggtccagtaaccgtgttctcattcttagaagctgctggattgtatgactcacatcttgaaggatgtcctttcaaaccaaatcatgagtga

SEQ ID NO: 210 - DNA, 618 bp, Staphylococcus epidermidis
ttatacaatagtataagaaagaggaagtctatgaatataaattttaataatattaacttaattataagtgctgtaaaaaaagcacagtatcctgacactggattaacagaagtagcgttaagtggacgctcaaatgtagggaaatctacatttattaatagtatgattgggcgtaaaaatatggcgagaacgtcacaacaacctggtaagacacagacattgaatttctataatatagatgaacaacttatttttgttgatgtaccaggatatggatacgctaaagtaagtaaagttcaacgagaaaaatttggtaaaatgattgaagaatatattacacaacgagagaatttaaaacttgttattcaacttgtcgatttaagacatcaacctactgaagatgatgtgcttatgtacaattatcttaaacattttgatataccaacacttgtaatatgtactaaggaagataaaattgccaaaggaaaagtacaaaagcatatcaaaagaataaaagacaaattagaattagaatctggagataatattataagttattcttcaattaaaaatagtaaacagcaagaaatttggaactttattgaaacatatatataa

SEQ ID NO: 211 - DNA, 1077 bp, Staphylococcus epidermidis
agtggtattttgaagcggaattttattaataatttaatcatattattaattgctattatgttaagtctgttattaaaaatgttacatgtgattttgccatttatgtttggaccaatattagcggcgttattatgtgtaaaagtattaaaattaaaaatacgatggccattttggttgagtcaaattggtttaatactacttggagttcaaattggctctaccttcacacaacaagtgattaaagacataagtaaaaattggctaactatcgtttttgtcactatcctactaattttattagctttgataattgcattcttttttaagaaaattgcacaagtaaatttagaaactgcaattttaagtgttataccaggtgcgctaagccaaatgttagtgatggcagaagaaaataagaaagcaaatatattagttgtgagtttaacacagacatcacgtgtaatatttgttgttattttagtaccacttatttcgtatttttttcaggataaccatcatgaaatgaatcatactacaatggaagtacccacactttctcagactttaaatatatggcaaataatcatcttattctcaatggtgggaatcatctatataggaatgtcaaaaattaacttccccactaaacaattattagcacctataatagttttaattatatggaatatgacaacacatttaacattttcactagatcattggttgttagccacagcgcaacttatttatatgatacgtattggattacagattgccaacttaatgagtgatttaaagggaagaattgcaatagcaatagcctttcaaaatataatgctcatagtcacaacgtttataatgataataggaatacatttgattactaatgaatccatcaatgaattgtttttaggagcagcaccaggaggtatgagtcaaatagttttagtggctatggctactggagctgatgtagcgatgatttcaagctatcacatttttagaatattttttatattatttgtcattgcgccactaattggttattttattaatgttaaattaaataataaatga

SEQ ID NO: 212 - DNA, 1284 bp, Staphylococcus epidermidis
aggcataggagcatgatcatgaattacctagacagcttgtattggatacacgaaagatctaaatttggtatcaaacctggcgtcaaacgtatggaatggatgctagaacaattaaataatccccaacataaaattagaggtattcatgtgggtggaacaaatggtaaaggttcaactgttgcatacttgagaaccgcattaattgagaacgattactcagttggaacatttacctcaccatttattgaaagtttcaatgaacgtattagtttaaacggtgtaccaattatgaacgatgaaattgttcaattagttgaacgagttaaacctgttagtgaagccttagagatagaaacagatttaggtggggctactgaatttgagattataacaacaatgatgttcctttattttggtgagataaatcctgttgattttgtgataattgaagcaggtttaggaattaaaaatgattcgacgaatgtttttaaacctgtgctatccatactcacaagtataggacttgaccatacagatatcttaggaacaacttatttagatattgcaaaagataaggcagctataattaaaccacatataccgattgtttatgctgtaaaaaatgacgatgctttaaagtatgtgagagattatgcgcttgaacagaacgcaaaaccaattgaattggatcgggagattaccgttgtctcccaagatgatgagttcacatatcggtataaagattatgaattagaaactatcattcttaatatgttaggggaacatcaaaaggaaaatgcagcacttgctattactgctctcattgaattaaatgaaagacaaatcatagaattagattttaataaaatgatagacggtatagaatctgtgaattggacaggtagaatagaacaagtaaaagaacaaccattaatggttattgatggtgctcataataatcgaagtattgatgcgttagtagacacaataagacattattatggaagagataaaattgatattttattttctgcaattaaaggaaagccaattcatagtatgattaacaaattaaatgatattgcatcaaaattctatatagcagattttgagtttccaaaagcattagctaaagaagaaattgccgaagaattgaaattagataatttacatttaattgatgattatgttgattttattgaaaattacgaaggtgatgggctgattattactggaagtttatacttcatcagcgaggtaaaagcaaaaattaattttaattaa

SEQ ID NO: 213 - DNA, 690 bp, Staphylococcus epidermidis
aataaatttatgaaaccagttatagttatgacgcagacgaatgaagttcatagtcatttagttgatattatccataagccttttatccaactaaaacaacttcattttaatgaaaaattgcttgatcatagctacgactggcttattttttcgtctaaaaacgcagtaaaatacttttatccttatttaaaaaacgttaaagttaaaaaggtagctgttataggtgataagacagctcagtattgtaatgaattaggtattagtgtcgactttgtgccacgtgatttttctcaagaaggctttttggacgagtttaagattagcgaacaacatttattgttgccctcaagtgaaaaagcacgttctaaattagttcaacaattgagcaaatataatgaagtcgttaaaattgatttatatagaccagtaccgaattttaaaaatataagtcaagttaagtctcttgttagaaaacatcaaatagacgcagtgactttttctagttcctctgcagttgaattttatttcaaagaggacaatgtgcctgaatttgatcattattttgctatcggtaagcaaactgctaggaccattttaaaattcaatacatctgtaaaagtggcaaataaacaaacattagattcacttattgataaaataatagaaagtagggaacaaaatgaaatttga

SEQ ID NO: 214 - DNA, 1296 bp, Staphylococcus epidermidis
ggaggtcatatgatgagttttgaaaaatctattaaagcaatggagcaagctgagaaattaatgcctggcggtgttaacagtcccgtaagagcatttaaatcagtagacacaccagctatttttatggatcatggtgaaggatctaaaatatatgatattgatggaaatgaatacattgattatgtgctaagttggggcccattaattctgggacataaaaatcaacaagttatatccaaattacatgaagcagtagataaaggtacaagcttcggcgcttcaacacttcaagaaaataaacttgctgaacttgtgattgaccgtgtaccttcaattgaaaaagtaagaatggtttcctcaggaactgaagctactttagacacacttcgtttagctaggggttatacaggacgtaataaaattataaaatttgaagggtgttatcatggacacagtgattctttattgattaaagcaggatcaggtgttgcaacactaggtttacctgattcaccaggcgtccctgaaggtattgctaaaaacactatcacggtgccatataatgatttagattcacttaaattagcgttcgaaaaatatggcgatgatattgctggtgttattgttgaaccggttgctggaaatatgggtgtagtgcctccagtgaatggatttctacaaggtttaagagatattactaatgaatatggagcattacttatatttgatgaagtgatgactggtttccgtgtaggttataattgtgcgcaaggatactttggtgtaacacctgatttaacttgcttaggaaaagtgataggtggaggtttacccgttggagcttttggtggtaaaaaagaaattatggattacattgctcctgttgggactatttatcaagctggcacactttcaggtaatcctttagcaatgactagtggttatgaaacattgagtcaacttactcctgaatcttatgagtattttaattctctaggagatatacttgaaaaaggattaaaagaggtatttgctaagcataatgttccaatcacagtaaatcgcgctggttcaatgattggttacttcttaaatgaggggcctgtaacaaattttgaggaagcaaataaaagtgatttaaaattatttagtaatatgtatagagaaatggctaaggaaggtgttttcctaccaccttcacaatttgaaggaacatttttatcaactgcacatactaaagatgatattgagaaaactatccaagcatttgataatgcattaagtcgtattgtgtga

SEQ ID NO: 215 - DNA, 297 bp, Staphylococcus epidermidis
gcagatgtcttgttcttattaattagatttccttcatcatcatataattcaggctcaatttcttcattaattgtttgttcagtaatgactactttacttacattttcagaagaaggtacatcatacatgatgtcaattaatgcttcttctataattgaacgtaatccacgcgctcctgttttacgttcgattgctttttcacttatagcagatagagcctcttcagaaaactctaattctacattatctaactctagcattttagtgtattgtttaactagcgcatttttaggttga

SEQ ID NO: 216 - DNA, 669 bp, Staphylococcus epidermidis
atatttacctttaataccatttatattcttatcattcgtagtaacttcatcagtttatcaccaacttttatttcttttaaggggagaattttattgagaataaatgaaatggcactgcatgaaaaacctagagaacgtttaattacatatggcgctaaaagtctatccaatgttgaacttttagcaattctcttaaacactggtagaaaaggattttctagtattgacattgcaaacgaattactgaagcaacaatccactattagagatttaaaaaaattgtctataaatgatctactgaaaataaagggcattggactttataaagctgtaatattacaggctgcatttgaactaggtgaacgtattaattctacaagcacttttgacaaagtacagattacacatcctagtgatgttgctagtctgatgatgtcgacaatgaaagatttagagcaagaacattttgttgtacttttacttaactcaaaaaatatagtcacaaaacaagcttgggtatataaaggcacattgaatagttcgattattcatccaagagaagtatttaatattgcaataagagagtcttctaattcaataatagttgtacataatcatccttcaggtgatgtaacaccttctgaaagaggatatgaatacaacgtatag

SEQ ID NO: 217 - DNA, 960 bp, Staphylococcus epidermidis
ttcttcaagatatatcatgattggagtgctaaattaatggctgatattataccttttccacagtttaaaagtaaaatgattaagcaaataaatgatgcagaaagaaatgcagattttgaaaagatgtatcaattgtttaatgtatatgaacagcatttcgaccccaacgaggagattgcactaaagaaatgccagatgcttttacaattgaatgcttatttagagttacgagaagaggcaattattttgttaaaacgtggattcaactgttatgacgaattgatgatatattatattaaaagtctgaatggcttaggtcaatttaatgaagcagttgaagtaattaatcaaattatcgatgaagttaaaaatcataaaaccagaatggaactttttccacttaaagaatatgcgatatcgagacttgatgaagatagaaaggcattgtcctcatctttatcagatttcggttcgcttaacacacgtgaacaaacttctttaatattacaacttattgataatggacattataattttaaagaatcagtagcgaatatactaatttctatggatttaccaaaaaatttagtgagcttaatgttggaatatttaagatttgctgaatattctcatacaattacaatccataaatatggtgaaactatcaatgtaaaccctaatcatttaagtggcattgagcatacgacgataaaagacaaggtcattcctgtcgtaatgaatagattagaagatggagcgttgcatattttaaaagaagcacaacatattatgaataatcattctatactcatgtatcctatagatatagagtcgttatacactattgataattggatagatgcatatgatgtttacttcaaacaattaattggtatagatataaatggctgtaacaatgatactttacaattcattaaatcattagataatgaaatgtaa

SEQ ID NO: 218 - DNA, 1347 bp, Staphylococcus epidermidis
atgcattttgttgcaattagcataaatcatcgaacagctgatgtaacattaagagagcaagttgcttttagagatgatgccttacgattagcacatgaagatttatatgaaactaaagcaattttagaaaatgtcattttatctacatgtaatcgtactgaagtatacgctattgttgatcaagttcatacaggacgttattatatacaaagatttttagcgcgctcttttggatttgaggtagatgatattaaagatatgtcggaagttaaagtgggggacgatgcagttgaacatttattgcgtgtcacttctggcttagattcaattgtgcttggtgaaacacaaattttaggacaaatgcgcgatgcatttttcttagcgcaaaatactggtacaactggaacgatttttaatcatttatttaaacaagcgattacttttgctaaaaaagcacacagtgaaacagacattgcagataatgctgtgagtgtttcttatgctgctgttgaattagctaaaaaggtatttggaaaattaaaaagtaaacatgctgtcgttattggagcaggggaaatgggtgaattatcactcttaaatcttttaggttctggaatttcaaatgtaacaattgttaatcggacattatctaaagctaaaattttagccgaaaaacacaatgtttcatatgattcactttcagcattaccatctttattagaaacaacggacatagtaattagttctacaagtgctgaagactatatcatcactaattctatggtgaaaacaatttcagaaactagaaaactggattcattagttctgattgatattgcggttccacgagacattgaaccagggattgatgcaattacaaatatttttaattatgatgttgatgatttgaaagatttggtagatgccaatttaagagaacgtcaattagctgctgaaactattgcaggacaaatacctgaggagattgattcacacaacgaatgggttaatatgcttggtgttgtacctgtaatcagagctttacgtgaaaaagctatgaatatccaagcagaaactatggaaagtattgatcgtaaattgccagatctctctgaaagagaacgtaaagtcatttcgaaacatacaaaaagtattatcaatcaaatgttaaaagatcctatcaaacaggctaaggaattaagtactgataaaaaaagtaatgaaaaattagagctatttcaaaacatatttgatattgaagccgaagatcctcgtgaaaaagcaaagttagaaaaagagagtagagcaaaggaaatcttagcgcatcgaatatttagttttgaataa

SEQ ID NO: 219 - DNA, 219 bp, Staphylococcus epidermidis
actgatgaagttactacgaatgataagaatataaatggtattaaaggtaaatatttaatatctttaaaagaaaaaatttttaaaattatggcaaaaatccccccaatgataaacgtaaatacaacaataaaaaagaaaaaatttaacggaaatataagtcccaatatattaaaaagcaatatgtctccataccctataaatttagatgcgaatagataa

SEQ ID NO: 220 - DNA, 714 bp, Staphylococcus epidermidis
tatatgctattacttgcctatacttgtagcattatatttagttttctttatcaattttgcaatcaaaatatattaaaacttcaatatctttattctaggtctcactgtgatttttgtcatactatcataaaacccttagatttactgcctattataagttttttaaaacttcgtggacaatctcgttgttgtaatcaaccattacaacgtttatatttaatcggagaactcgtttcgtttggtgctattttcctctattatcctactcattttaatatacacttcacattatttttaataactttcctgtttctactgacgatgtgtctttacgatattcactcaatgcatattgatatgagactcttatttgtatacacagtcgtatctgtttttacaacccaaacctattttggtaattttataatgatatttttgatttcacatgttatttatctattcgcatctaaatttatagggtatggagacatattgctttttaatatattgggacttatatttccgttaaattttttcttttttattgttgtatttacgtttatcattggggggatttttgccataattttaaaaattttttcttttaaagatattaaatatttacctttaataccatttatattcttatcattcgtagtaacttcatcagtttatcaccaacttttatttcttttaaggggagaattttattga

SEQ ID NO: 221 - DNA, 297 bp, Staphylococcus epidermidis
gttaaaatatttttaagtgcagcaacatctaaagtttcaagattagcaactataggtacacgaccaataaattctggaattaagccatatgattggagatcctctggacgaatttgttccagtaaagcttcttcatcatatttatctgcttcattactagcaaatcctatcactttttctcctaagcgtctcttaatgacttcatcgataccatcaaaagctccacctaagataaataagatgtttgtcgtatcaatttggattaattcttggtttggatgctttcgaccaccttga

SEQ ID NO: 222 - DNA, 861 bp, Staphylococcus epidermidis
aaagtgaaattaaatcactaccaggcatataccaaattagtttttaaaaaaaaaattttattgcatgaagagattaaagaggcatatgatttaggtattagagcaatcatgttcttcggtgtgccaaatgacaaagacgacattggatctggtgcatatgatcataatggagttgttcaagaagcgacacgaatatctaagaatttatataaggatttacttattgttgcagatacttgtctttgtgaatacacagaccacggacactgtggcgttattgacgatcatacgcatgatgtagacaatgataaatcacttccattacttgtaaaaacagctatttctcaagttgaagctggagctgacatcattgctccaagtaatatgatggatggttttgttgctgaaattcgtgaaggccttgatcaagcgggatatcaaaatattcctatcatgagttatggtattaaatatgcatcaagctttttcggtccattcagagatgctgcagattcagcaccttcttttggggatagaaaaacctatcaaatggatcctgcaaaccgattagaggcattaagagaattggaaagtgatcttaaagaaggttgcgatatgatgatagttaaaccatctttaagttatctagatattattagagatgtaaaaaataatacgaacgtgccagtcgtagcaaacaacgttagtggagaatatagtatgacaaaagcagcagcgttaaatggttggatagatgaagagaaaattgttatggaacaaatgatatctatgaaacgtgcaggtgctgatttaataattacttattttgcaaaagatatctgtcgttatttagataaatag

SEQ ID NO: 223 - DNA, 351 bp, Staphylococcus epidermidis
ctgccggtgacaaaccggaggaaggtggggatgacgtcaaatcatcatgccccttatgatttgggctacacacgtgctacaatggacaatacaaagggtagcgaaaccgcgaggtcaagcaaatcccataaagttgttctcagttcggattgtagtctgcaactcgactatatgaagctggaatcgctagtaatcgtagatcagcatgctacggtgaatacgttcccgggtcttgtacacaccgcccgtcacaccacgagagtttgtaacacccgaagccggtggagtaaccatttggagctagccgtcgaaggtgggacaaatgattggggtgaagtcgtaacaaggtag

SEQ ID NO: 224 - DNA, 1845 bp, Staphylococcus epidermidis
agggagcgtcttatgaagtggcttaaacaactacaatcccttcacacgaaactcgttattgtttatgtactactcattattattggtatgcaaatcatcggtttgtattttacgaatagtttagaaaaggaattactcgataacttcaagaagaacataacacaatatgcgaagcaattagacgtcaatattgaaaaggtttataaggataaagataaaggttcagtcaacgctcaaaaggatatccaagaccttttgaatgaatatgcgaatcgtcaagaaataggagaaatacgctttattgataaagaccaaatcatcatggcaacaaccaagcagtctaaccgtggtcttatcaatcaaaaggttaacgacgggtcagttcaaaaggcgctctccttagggcaaacgaatgatcatatggttcttaaggattacggaagtggtaaagagcgtgtttgggtatacaatataccggttaaagtcgataaacagacaatcggtgatatatacatagaatcgaaaattaatgatgtatacaatcagctgaacaacattaatcagatattcatcgtagggacagcgatatcactattcattacagtgatactaggattcttcattgcacgaacgattactaagccgataaccgatatgcgtaaccaaaccgtcgagatgtctaaaggtaactacacgcaacgagtgaagatatacggtaacgatgaaatcggtgagctcgcacttgccttcaataacttatcgaaacgtgtccaagaagcacaagcgaatacagaaagtgagaaacgtcgtctagattccgttatcacgcatatgagcgatggtattcttgcgacagatcgccgtggacgtgtacgtattgcaaacgacatggcgctgaaaatgctcggtctcgcgaaagaagatgtcatcggctactacatgcttggtgtccttaacttagaaaatgaattctcattagaggaaattcaagaaaatagtgattccttcttgttagatattaacgaagaagaaggcattattgcacgcgtaaactttagtacgattgtacaagaaacaggtttcgtgacaggttacattgccgtattacatgatgtcactgaacaacaacaagtcgaacgtgaacgtcgcgaattcgttgcgaatgtttcacacgaattacgtacaccgctgacatctatgaatagttatatcgaagcacttgaagaaggtgcttggcaagataaagaattggcaccatcattcctatctgtcacacgcgaagagactgaacgtatgattcgtttagtgaatgatttacttcaattatctaaaatggataatgaatcagatcaaattacgaaagaaattatcgacttcaatatgtttatcaacaaaattattaaccgtcatgaaatggcagcgaaagatacgacattcgtgcgcgaaattccgcaacaaaccatctttgctgaaatcgatccagacaagatgacacaagtatttgataatgtcattaccaatgcaatgaaatattcacgtggcgagaaacgtgttgagtttcatgtgaaacaaaatgcactttacaatagaatgacgattcgtattaaagataatggtattggaataccgattaacaaggtagataaaatatttgatagattctatcgtgtagataaagcacgtacacgtaagatgggtggtacaggacttggtctagctatttccaaagagattgtcgaagcacataacggtcgaatttgggctaacagtgtagaaggacaaggtacgtcaatctttattacgcttccttgcgaaatcattgaagacggtgattgggatgaataa

SEQ ID NO: 225 - DNA, 792 bp, Staphylococcus epidermidis
atgaactggaaacttacgaagacacttttcattttcgtttttattcttgtgaacatctttttagtcatcgtttatattgataaagtgaataaatcacaagttaatgactcggaaaaggtaaacgaggtcaattttcaacaagaagaaattgacgttcccaaggatgtcttgaatcaaagcgtgaaagatactgaacttgaacaaattactgcccgttcaaaaaatttctcaagttatgcgaaagatcattcaagcctgcaaacgtctgattccgataaaacacttgaaggagatattgataaaggcgttcaagtgagtgataagaacttacaagatatcaaagagtacattgcaaagaaaatctttaacggtaaagagtatcaattaagtgatttaactaaagacaaagtcacttacgaacaaacgtataaagattatccaattatgaataatagtaaagcacgcctaacgtttaatttgagcgatggcaaggcgacaagctataagcagacagcgatggatgatatacaagtagctaaaggttcaaatagcacgaagaaacaagtcatcacaccgcgtaaagctattgaagccctttattacaacagatatctaaaacaaaatgatcaagtgctagacgcacgcttaggctattattcagtggtaaaggaaacaaatgttcaattactccaacctaactgggaaattaaagtaaaacataaaggcaaggatgaagttcaaacctattatgtagaagctacaaatcataatccgaaagtgattgattattag

SEQ ID NO: 226 - DNA, 705 bp, Staphylococcus epidermidis
tatatggctagaaaagttgttgtagttgacgatgaaaaaccaattgctgatattttagaatttaatttaaaaaaagaaggttacgacgtatattgcgcttatgacggtaatgacgcagtagatttaatctatgaagaagaaccagatatcgtcttacttgatatcatgttacctggtagagatggtatggaagtatgtcgtgaagtgcgtaaaaagtatgaaatgccgattatcatgctgacagcgaaagattctgaaattgataaagtattaggccttgaattaggtgcagatgattacgtaactaaaccatttagtactcgtgaactcatcgcacgtgtgaaagcgaacttacgccgtcattattcacaaccagctcaagaagtaagtggtgcgacaaatgaaattacaattaaagatattgtgatttatccagatgcatattcaattaaaaaacgtggagaagacattgaattaacgcatcgtgaattcgagctattccattatctttctaaacatatgggtcaagtcatgacacgtgaacacttactacaaacagtgtggggttacgattattttggtgatgttcgtactgtggacgtaacaattcgccgtttaagagaaaaaattgaagatgatccatctcatccagaatacattgtgacacgtagaggcgttggatacttcctccaacaacatgattag

SEQ ID NO: 227 - DNA, 807 bp, Staphylococcus epidermidis
gaaaggatgagtcgcttgatacgtatgagtgtattagcaagtggtagtacaggtaacgccacttacgtagaaagtgagaaaggtagcctactcgtcgatgtaggtttaactggcaagaagatggaagaacttttcagccaaattgacagaaacattaaggatttaaatggaatattagtgacacatgaacacatcgatcatattaaaggtcttggtgtcttagcacgtaaatataaacttccaatttacgcgaatgagaatacatggaaagcgatagagaagaaagatagtcgcattccaatggatcagaaatttatctttaatccatatgaaacgaaatctcttgcaggattcgatatagaatcatttaacgtgtcacatgacgcgattgatccacagttctacatcttccacaataactataagaaattcacgatgattactgacacaggttacgtttcagatcgtatgaaaggtatgattcaaggtagtgatgtctttatgtttgaaagtaatcacgacgtcgatatgttacgcatgtgtcgttatccatggaagacgaaacaacgtattttgagtgatatgggtcacgtatccaatgaagacgcgggccttgcgatgagtgatgtcattacaggtaatacgaaacgtatatacctctctcatttatcacaagacaataatatgaaagacctcgcacgcatgagtgttgggcaagtgctcaacgaacatgatatcgatacagagaaagaagtattgctctgcgataccgataaagcacaagccacaccgatttatacactataa

SEQ ID NO: 228 - DNA, 192 bp, Staphylococcus epidermidis
aaacttaatattcctatacatgcttatatttctataattaaaaatactgtcattacggcacttttgacatatacgaaaacgataaaatatgatgataaacctaaacaaaagcgtcaagcatattgcaaaagtctaacttattttgcggaactgtatttcaatggtaaaattataaataatattattctataa

SEQ ID NO: 229 - DNA, 1401 bp, Staphylococcus epidermidis
aaggacaaggtacgtcaatctttattacgcttccttgcgaaatcattgaagacggtgattgggatgaataacaaagaacatactaaatcaattattttagtcctactcgtcttgatgagtatcgttttgacatacatggtctggaacttttctccagacctttcaaatattgataacacggataatagtaaaagtgataagcctaaaccacttactaaaccaatgactgcagaaatggaaggaacaatcacaccatttcaaatcgtgcattctagagatgataaatctcaaggaacagtagcatcaggtgcagtcttagataagatgattcaacctttaaagaatcaagaagttaaatctgtatcacatctgaaaagggaacataaccttgttatccctgaactaagtaacgactttattgtcctagatttcacttatgatttgccactttcaacgtacttaagtcaagtactcgatatcgatgcgaaagtgccgaataactttaattttgatcgtctccttatcgatcaagatcataataaccacgtcgtactatttgcgattagcaaagaccgtcatgaagtagttaaacttaagacaacgatgaaagggaataatgttgataaagcttttaaaagtatcgaacctgacatgcagccctatacggaaatcatcacgaataaagatacaatcgacaaagcaacacacgtgtttgcaccaagcaaaccgaaagacttaaagacgtatcgcatggtcttcaatacgatcagtgttgaacgcatgaactcaatactatttgatgattcaacgattgttcgtagctctcaaagtggtacgacaacatacaacaacaatactggcgtcgccaactacaatgataaagatgaaatgtatcattataagaatttatctgaagacgcgaaaagttcaagcaacatgcaagaaaccatcccaggcacatacgagtttataaatagtcatggtggcttcttaaatgaagattatcgcttatttaaaacagataatagaacagggaaactcacatatcaacgattcctcaacggttacccaacgtttaataaacagaacttcaatgaaatccaagtcacatggggggataaaggcgtttacgattatcaacgttcgctacttaagacggacgtcacactgaacagtgaagaatctaaatccgtccctaccgttgagtccgtgcgttctgcattagccaaccatcctgatattgattttgaaaaggtaacgaacattgcgattggttatgatatggacgacaaggcaaataacgaagatattgaagttcaacgtaactgtgaattaataccacgttggtttgtagaatacgatggcaattggtatgcctataaagatgggaggcttgaataa

SEQ ID NO: 230 - DNA, 2541 bp, Staphylococcus epidermidis
ttcataccgtggggcacgtccaatggaagaaatccgtgtgagaaaaaacgcgaatttgatccaaacttagcgccaggtacagagaaagtcgttcaaaaaggtgaaccaggaacaaaaacaattacaacgccaacaactaagaacccattaacaggagaaaaagttggcgaaggtgaaccaacagaaaaaataacaaaacaaccagtggatgagattgttcattatggtggtgaacaaataccacaaggtcataaagatgaatttgatccaaacgcaccgaaaggtagccaagaggacgttccaggtaaaccaggagttaaaaatcctgatacaggcgaagtagtcacaccaccagtggatgatgtgacaaaatatggtccagttgatggagattcgattacgtcaacggaagaaattccgtttgataaaaaacgcgaatttgatccaaacttagcgccaggtacagagaaagtcgttcaaaaaggtgaaccaggaacaaaaacaattacaacgccaacaactaagaacccattaacaggggaaaaagttggtgaaggtgaaccaacagaaaaaataacaaaacaaccagtggatgagatcgttcattatggtggcgaagaaatcaagccaggccataaggatgaatttgatccaaacgcaccgaaaggtagccaagaggacgttccaggtaaaccaggagttaaaaatcctgatacaggcgaagtagtcacaccaccagtggatgatgtgacaaaatatggtccagttgatggagattcgattacgtcaacggaagaaattccgtttgataaaaaacgcgaatttgatccaaacttagcgccaggtacagagaaagtcgttcaaaaaggtgaaccaggaacaaaaacaattacaacgccaacaactaagaacccattaacaggagaaaaagttggcgaaggtgaaccaacagaaaaaataacaaaacaaccagtggatgagattgttcattatggtggtgaacaaataccacaaggtcataaagatgaatttgatccaaacgcaccgaaaggtagccaagaggacgttccaggtaaaccaggagttaaaaatcctgatacaggcgaagtagtcacaccaccagtggatgatgtgacaaaatatggtccagttgatggagattcgattacgtcaacggaagaaattccgtttgataaaaaacgcgaatttgatccaaacttagcgccaggtacagagaaagtcgttcaaaaaggtgaaccaggaacaaaaacaattacaacgccaacaactaagaacccattaacaggggaaaaagttggcgaaggtgaaccaacagaaaaagtaacaaaacaaccagtggatgaaatcgttcattatggtggcgaagaaatcaagccaggccataaggatgaatttgatccaaatgcaccgaaaggtagccaagaggacgttccaggtaaaccaggagttaaaaaccctgatacaggcgaagtagttactccaccagtggatgatgtgacaaaatatggtccagttgatggagatccgatcacgtcaacggaagaaattccgtttgataaaaaacgcgaatttgatccaaacttagcgccaggtacagagaaagtcgttcaaaaaggtgaaccaggaacaaaaacaattacaacgccaacaactaagaacccattaacaggggaaaaagttggtgaaggtgaaccaacagaaaaaataacaaaacaaccagtggatgagatcgttcattatggtggcgaagaaatcaagccaggccataaagatgaatttgatccaaatgcaccgaaaggtagtcaaacaacgcaaccaggtaagccaggagttaaaaatcctgatacaggcgaagtagtcacaccaccagtggatgatgtgacaaaatatggtccagttgatggagatccgattacgtcaacggaagaaattccattcgacaagaaacgtgaattcaatcctgatttaaaaccaggtgaagagcgtgttaaacaaaaaggtgaaccaggaacaaaaacaattacaacaccaacaactaagaacccattaacaggggaaaaagttggcgaaggtgaaccaacagaaaaaataacaaaacaaccagtagatgaaatcacagaatatggtggcgaagaaatcaagccaggccataaggatgaatttgatccgaacgcaccgaaaggtagtcaaacaacgcaaccaggtaagccaggagttaaaaatcctgatacaggcgaagtagtcacaccaccagtggatgatgtgacaaaatatggtccagttgatggagatccgattacgtcaacggaagaaattccgtttgataaaaaacgcgaatttgatccaaacttagcgccaggtacagagaaagtcgttcaaaaaggtgaaccaggaacaaaaacaattacaacgccaacaactaagaacccattaacaggggaaaaagttggtgaaggtgaaccaacagaaaaaataacaaaacaaccagtggatgagatcgttcattatggtggcgaataa

SEQ ID NO: 231 - DNA, 1152 bp, Staphylococcus epidermidis
atcaagccaggccataaggatgaatttgatccaaacgcaccgaaaggtagccaagaggacgttccaggtaaaccaggagttaaaaaccctgatacaggcgaagtagtcacaccaccagtggatgatgtgacaaaatatggtccagttgatggagatccgatcacgtcaacggaagaaattccattcgacaagaaacgtgaattcaatcctgatttaaaaccaggtgaagagcgtgttaaacaaaaaggtgaaccaggaacaaaaacaattacaacaccaacaactaagaacccattaacaggggaaaaagttggcgaaggtgaaccaacagaaaaagtaacaaaacaaccagtagatgaaatcacagaatatggtggcgaagaaatcaagccaggccataaggatgaatttgatccaaatgcaccgaaaggtagccaagaggacgttccaggtaaaccaggagttaaaaaccctgatacaggcgaagtagttactccaccagtggatgatgtgacaaaatatggtccagttgatggagatccgattacgtcaacggaagaaattccgtttgataaaaaacgcgaatttgatccaaacttagcgccaggtacagagaaagtcgttcaaaaaggtgaaccaggaacaaaaacaattacaacaccaacaactaagaacccattaacaggggaaaaagttggcgaaggtgaaccaacagaaaaagtaacaaaacaaccagtggatgaaatcgttcattatggtggcgaagaaatcaagccaggccataaggatgaatttgatccaaatgcaccgaaaggtagccaagaggacgttccaggtaaaccaggagttaaaaaccctgatacaggcgaagtagttactccaccagtggatgatgtgacaaaatatggtccagttgatggagatccgattacgtcaacggaagaaattccgtttgataaaaaacgcgaatttgatccaaacttagcgccaggtacagagaaagtcgttcaaaaaggtgaaccaggaacaaaaacaattacaacaccaacaactaagaacccattaacaggggaaaaagttggcgaaggtgaaccaacagaaaaaataacaaaacaaccagtagatgaaatcacagaatatggtggcgaataa

SEQ ID NO: 232 - DNA, 408 bp, Staphylococcus epidermidis
atcaagccaggccataaggatgaatttgatccaaatgcaccgaaaggtagccaagaggacgttccaggtaaaccaggagttaaaaaccctgatacaggcgaagtagtcacaccaccagtggatgatgtgacaaaatatggtccagttgatggagatccgatcacgtcaacggaagaaattccattcgacaagaaacgtgaattcaatcctgatttaaaaccaggtgaagagcgcgttaaacagaaaggtgaaccaggaacaaaaacaattacaacaccaacaactaagaacccattaacaggggaaaaagttggcgaaggtgaaccaacagaaaaagttacaaaacaaccagtagatgaaatcacagaatatggtggcgaaaaaattcagcacggccctaaggtatga

SEQ ID NO: 233 - DNA, 300 bp, Staphylococcus epidermidis
ggtagtatcccaccaacgcctccacgtaagctagcgctcacgtttcaaaggctcctacctatcctgtacaagctgtgccgaatttcaatatcaggctacagtaaagctccacggggtctttccgtcctgtcgcgggtaacctgcatcttcacaggtactatgatttcaccgagtctctcgttgagacagtgcccaaatcgttacgcctttcgtgcgggtcggaacttacccgacaaggaatttcgctaccttaggaccgttatagttacggccgccgtttactggggcttcgattcgtag

SEQ ID NO: 234 - DNA, 303 bp, Staphylococcus epidermidis
cgcttgccacctacgtattaccgcggctgctggcacgtagttagccgtggctttctgattaggtaccgtcaagacgtgcatagttacttacacatttgttcttccctaataacagagttttacgatccgaagaccttcatcactcacgcggcgttgctccgtcaggctttcgcccattgcggaagattccctactgctgcctcccgtaggagtctggaccgtgtctcagttccagtgtggccgatcaccctctcaggtcggctacgcatcgttgccttggtaagccgttaccttaccaactag

SEQ ID NO: 235 - DNA, 294 bp, Staphylococcus epidermidis
gggagcttgactgcgagacctacaagtcgagcagggtcgaaagacggacttagtgatccggtggttccgcatggaagggccatcgctcaacggataaaagctaccccggggataacaggcttatctcccccaagagttcacatcgacggggaggtttggcacctcgatgtcggctcatcgcatcctggggctgtagtcggtcccaagggttgggctgttcgcccattaaagcggtacgcgagctgggttcagaacgtcgtgagacagttcggtccctatccgtcgtgggcgtag

SEQ ID NO: 236 - DNA, 351 bp, Staphylococcus epidermidis; identical to SEQ ID NO: 223

SEQ ID NO: 237 - DNA, 225 bp, Staphylococcus epidermidis
gccaacatcctagttgtctgggcaacgccacatccttttccacttaacatatattttgggaccttagctggtggtctgggctgtttccctttcgaacacggaccttatcacccatgttctgactcccaagttaaattaattggcattcggagtttgtctgaattcggtaacccgagaggggcccctcgtccaaacagtgctctacctccaataatcatcacttga

SEQ ID NO: 238 - DNA, 225 bp, Staphylococcus epidermidis
gcacacggtttcaagttctctttcactccccttccggggtacttttcacctttccctcacggtactggttcactatcggtcactagagagtatttagccttaggagatggtcctcccagattccgacggaatttcacgtgctccgtcgtactcaggatccactcaagagagaatatgtttccgactacaggattattaccttctttgattcatctttccagatga

SEQ ID NO: 239 - DNA, 207 bp, Staphylococcus epidermidis
ctgtgttggctttctaacccgcaccacttatcgtggtgggagacagtgtcaggcgggcagtttgactggggcggtcgcctcctaaaaggtaacggaggcgctcaaaggttccctcagaatggttggaaatcattcatagagtgtaaaggcataagggagcttgactgcgagacctacaagtcgagcagggtcgaaagacggacttag

SEQ ID NO: 240 - DNA, 366 bp, Staphylococcus epidermidis
ataatatccactgagaaatattcaaaagaaaaacacactttatttttaatatctagtcaccagttaaaagaattagaagatctttgtgatagatttctattactcgaaaaccatcaaattagagaaattgacttacataatagaatattcactcaaaagttaatattcaaaaatactttaaacaatgctccagaactaaaggctaatttcaatttcattaaaaaaattgatagcaattcaataacaattataaataaagatgaagaagtagatcttacaaatttacttaatttagtaggtaaaaatcccttaataaaaattgaaagtaatgataatctattatcttcatatttctataaagagtag

SEQ ID NO: 241 - DNA, 411 bp, Staphylococcus epidermidis
agagtaggtaatattatgtttaaatttaacttcttttatatttcaaagattcgtgcaacttggatgctttacctcattgggatttatcctctcttgatattcctagctgaattacttaatagtaattttctttcattatcagcaactcataagaatagtgtaagctttttagaattatttatcgcaatatatgatactcaacaaaaagtaatgctatcacttataattattggatatttatcttctttattattttatagcgaaattagcacaggaagactattgttttataaggatcaaagtcgctacaaaatttttaattctaaattaacatctattatttctagttactttatattcttcttcattttattattatcaacgtggctcttaaccgccgaatgcccccac

SEQ ID NO: 242 - DNA, 255 bp, Staphylococcus epidermidis
atggtaaattttaaaattgaaaaattaaaactaaataatttattcatatcactaagtattgttattattactactattgtactaaatataagcattggaataatatcataccttaaattatctgaatattgtgaatttttatcgatgattctttctcttataataagttttataataatacctacttttctctcttcaatatttaattataaaactaatccatttaaattgttaactataaaaaatttactttaa

SEQ ID NO: 243 - DNA, 630 bp, Staphylococcus epidermidis
cacttgagatataacatttcacgtatatttggagtgttagtgggtataccagtggcctttattgtttggcttattactgtttttgcgttggatttatcattcattatagacatgcttatcagttttggtagtttcattgcatcatacttccctacgcaaaggctcacttcacgaaagtatcttaatgaaattggtttatcaagaagagattacagatatgttcaatcacagcttcatcatgcacatactaaaattagaaatatcttaaagtcatttattaatattcgttcaatcaaagattttagacaagtaaatgatatatatcgaatttctcgttctattcatacaagcattaagcaaagacccgcgatgttttttaaagttgaaagctttttctattctcatttggataatgcacttaacttagtagactcgtatacacgtcttgcaagaatgccacgtaagtcgcaagatgaaaagctaaaattagaacaaacacgtattactctagatgaaataaagagaacgctcattgctgaccttaaaaggcttaatgaggaagattatgagcgactagatgttgaaatagaattaaataaattagaacagcaacgtcgacataataattaa

SEQ ID NO: 244 - DNA, 240 bp, Staphylococcus epidermidis
tgcatattgaaagaatttagtcttggaggtttcagaattatgaaacaaggtacagttaaatggtttaatgccgaaaaaggttttggtttcatcgaagttgaaggagaaaacgacgtattcgtacacttctcagcaattaaccaagaaggatacaaatcattagaagaaggtcaatcagttgaatttgaagtagttgaaggcgatcgcggtcctcaagctgcaaacgttgttaaactataa

SEQ ID NO: 245 - DNA, 210 bp, Staphylococcus epidermidis
ttaaatattgaagagagaaaagtaggtattattataaaacttattataagagaaagaatcatcgataaaaattcacaatattcagataatttaaggtatgatattattccaatgcttatatttagtacaatagtagtaataataacaatacttagtgatatgaataaattatttagttttaatttttcaattttaaaatttaccatttaa

SEQ ID NO: 246 - DNA, 228 bp, Staphylococcus epidermidis
gttataattgaaaaactaagtttgaatttatatcttataacatacaaaattatacttgagggaaatcttattaatagattagattctaatgactcattgagatgtaagattaaagcaaatagtaaagaaccaatagaaatagaagttaataaactgaagttatttagcaaaatgttaaatactacttccctaaataaaatttcttcccctaaagctataaagaaataa

SEQ ID NO: 247 - DNA, 336 bp, Staphylococcus epidermidis
ctttatagtagggaaggggaaattaatatgtggacagtagtcaagatcagggctgactacgaaggttggtggctatttgaggattggccacaaaaaattgtggaacaatcagaatttactacatacgaccaaatgttggattattacataaatgtattaaaccatagtaagaaatgttacgacaattatgtagtaggcaagtataatatacatgctttttacaacaattgtgatttaaacttttgtgaagactgtgaggaagatttacaaatattttatagttttattattttaaaaaataatgaggtttattttaatcttccaaaaatagattga

SEQ ID NO: 248 - DNA, 1302 bp, Staphylococcus epidermidis
atgttctttggcgcaggtaaccttatatttccaacacaacttggactcgaaagtggtcatttcttttggccagccatactagcctttgcacttacgggtattggattaccgcttcttggcgttgtggtaggcgcacttgataaacatggttatattgggtcttttaataaaatatcaccacgattttcgttaatctttttaattatcatatatctcactataggaccattatttgcgataccacgtacagcttcaacttcatttgaaatgactgtgactcctattgcacataatagtgggaatttagcattatttatttttacagtaatctattttttaatcgttctttatttatgcttgaatcctaataagatgatagatcgaattggttcattacttacacctttattacttattaccattgtcgctatgattattaaaggttttgtagattttagtggacattcttcaaattacggaatgacaaatgcttatcattccaatttaagtggattttcacaaggatttacacaaggttaccttacaatggatgctatcgcttcaattgcattttcaatgattgttgttaatgcgattaaaacaacaggaatacagcatgctgataaaatctttaaacagaccattattgctggtctcatcgctgcaatcgcattagtatttatatatatttcgctagggtacataggcaatcatattaatattccttcagacactctaaaggaattgaaagctaaagatcaaaatatagggacgtatttactcacaacaatggcaacgaagggctttggaactttcggaaaatacttacttggtattatcgtatcattagcatgtttaactactgcttgtggattaattgtatcagtaagtgaatatttccacagaatactacctaagataccttataaagtatttgtgatatttttcattttagttagtttcattctagctaaccaaggacttaattccgtaattaaaatgtcagtccctgtactcagtgtaatctatccagtggctattacagttattttgttaatactcattgctcgcttcatacctacaaaacgtattgcacaacaaataccgctaattattgtagcaattgaatcaatcttaagcttaataacgacacaagggtggatacgtatttcatttatagatggtttacctttaaaagaatattcacttgaatggttcccaattgctgttgtagcaactcttgttggttatatgattagttattttgttaaacaatctaacattgtatatcaaaaagaataa

SEQ ID NO: 249 - DNA, 327 bp, Staphylococcus epidermidis
tattttataatcttattaattttaatagtttatgttgatgattataagttaatcatattttatttctttatagctttaggggaagaaattttatttagggaagtagtatttaacattttgctaaataacttcagtttattaacttctatttctattggttctttactatttgctttaatcttacatctcaatgagtcattagaatctaatctattaataagatttccctcaagtataattttgtatgttataagatataaattcaaacttagtttttcaattataactcattggatatataatatttttattgtagtaatgagatga

SEQ ID NO: 250 - DNA, 315 bp, Staphylococcus epidermidis
ttttttacaattaaaatacgtataataaagacaagaggtgattttatgcaacgtaaacatattcaagtttttggtacagtacaaggtgtaggatttagattttacacgcaacgtattgctcatcaatttaatattaaaggtacagtccaaaatgttgaggactacgtagatatatatgctcagggcgacgatacagaattagaacagtttattgattctgtaatccaaggtgcttcaccggcttcacaagtgtctaattacaatattgaagaattagaccttgatgaatctttatcagagtttaagacaatttag

SEQ ID NO: 251 - DNA, 1179 bp, Staphylococcus epidermidis
aacagcaacgtcgacataataattaatagaaatggagagatgagtgagatggtaagtgaacgaagtagtaatcagtcacatccacttgattactatatgaataatcaatcaactgatcatcatacaatcgctgaagatcttgaaatccaattaactgaaaatgataaacaaagaattaaatcaataagtgagcaaattgagccacttaatcatgaaggattgttaaaatatggtgctaatcttcaacaaaagatgtctcatttttcgcatcaaattttagatgatgttcaatcaaaagatatgggaccagttggggaaactttaagtcaattaatgggaaaattaaaatctgtaaatccaaatgacataaatccagaaaaacaatctagattaaagcgtttatttaaacgtactaaagcttctattaatgaagtgttttctagaatgcaatctgtaagttctcaaattgatcgtattactattcaattagaaaaacataaagatcagttaactaaagatgttgaatttcttgatcaattatatcagcaaaataaaacttattttgataacgttactttatatatcttagcggctcaaaaaaagaaaaaagagatattgacagaaaccataccacagttacgtgaaaaggcgcatcaaactggtaatcaaatggatattcaggcaactgctgatatggaacagtttgtggatcgtttagataagcgcatttatgatttacaattatctaggcaaattgctattcaaactgcacctcaaatccgtatgatacaaaatgtcaaccaagctttagccgaaaaaattcaaagttcaattttaacaagtattcctttatggaaaaatcaaatggctattgccctaactttgatgagacaaagaaatactgtttcagcacaacgttcggttaccgatactacgaatgagttacttactccaaatgcatcaatgttaaaggaaaatgctattgaaacggcagctgagaatgagcgtggcatcgtggacatcgaaacgttaaagacaacacaaaatgacattattgaaacaattgaacaaacacttcaaattcaagaagatggtagacagaaacgtcaagttgcagagaaagaacttaatgagttagaacaagatttgaaacagcatctattagctatgcgtaaataa

SEQ ID NO: 252 - DNA, 345 bp, Staphylococcus epidermidis
cgttctctatctaaaccgatagaacgatatgagtataaaatgactaatatggtaataataatacttgtgatgatgagtagagcgctaaaaatatcgactacaaatacaatgctgtatggggctttccaagagcccagttcaaccttgattggtccatctcgtagcacattctttaagttaatcaatgcaatgaccaatgttagcaatgtaccgacaagtgcaacatatctttttattattgggcgctttccaataaatatgagtaaaattgcagttaggataggtatgactaaagttaaaacaagcaagttactctctatcatcttctggcgctcctttcattag

SEQ ID NO: 253 - DNA, 387 bp, Staphylococcus epidermidis
tataggatgttatatcgattttctcacaagactggtgtttatggtgtaagtgtcaaagaggaaactggaaatcaaatactcgtacaaattgaacaagtaattaaacatcccaaacaaggtgatttacaccaccccaatgaaacagaaggcgtcttttttcatgaacgtaaagctttaagccattttgagaaacgttacgctacaccttctcaacttcgtgattttaatgtcgaggccatgccttatgaagactcacttcaacatgctattacacatcttgagaatcaactaaaaaaagagaagacagagtattctcgattgtctttaaataatttaaatcgtttaaaagaagattacgctattcaatataaaagacacttcgactaa

SEQ ID NO: 254 - DNA, 294 bp, Staphylococcus epidermidis
acaaaattaacgaggtgccttatgtataaagactataacatgactcaacttactctaccaatggaaacttcagttcttatccccacaaatgatatttcacgacatgtaaatgatattatagaaacaattcccgagactgaattcgatgaattcagacatcatcgaggtgcaacatcatatcatccaaaaatgatgttaaaagtagttttatatgcctacacacaatctgtgttttcaggacgtaagatagaaaaattacttaatgataatatccgaatgatgtggctatcataa

SEQ ID NO: 255 - DNA, 1356 bp, Staphylococcus epidermidis
gtacttataacaggaggcaataagatgactcacattcaattagactatggcaaaactttagaattttttgataagcatgaactagatcagcaaaaggatattgttaaaactatccatcaaactattcataaaggtacaggagcaggtaatgactttttaggttggttagatttaccagttgattatgataaagaagaattttctagaatcgtcgaagcatctaaacgtatcaaatcaaattccgatgtacttgttgttatcggtattggaggttcatacttaggtgcacgtgctgcaatcgagatgcttacatcttcatttagaacaaatacggaataccctgaaattgtatttgtaggtaatcatttatcctcaagttatacaaaagaattacttgattatttacaaggaaaagatttttcagttaacgttatttcaaaatcaggtactacgacagaaccagcagttgcatttagattatttaaacaattggttgaagaaaaatatggaaaagatgaagctaagaaacgtatttatgcaacgacagataaatctaaaggtgcacttaaacaattagcagacaatgagggttatgagacgtttgttgtacctgatgatgtgggaggtcgttattctgttcttacagctgtaggattactaccaattgcaactgcaggtatcaatattgaatcaatcatgattggtgcggctaaggcacgtgaagagttatcttctgatgatttagatcaaaatatcgcatatcaatatgcaactattcgaaatattttatacagcaaaggttatactactgaaatgttaattaattacgaaccctctatgcagtatttcaacgaatggtggaaacaattatacggtgaatcagaagggaaagatttcaaaggtatttatccatcaagtgcgaattacacaactgatttacattccttaggacaatatgttcaagagggccgtcgtttcttattcgagacagtggttaaggtcaaccatccaaaacatgatatcaaaattgaagaggatgcagatgatttagacggactgaactatcttgctggcaaatcaatcgatgaagtgaatactaaagcatttgaaggtacattacttgcacataccgatggtggcgttccaaatatcgttgtaaatattcctcagttagatgaagaaacatttggatatgttgtttatttctttgaattagcttgtgcaatgagtggatatcaattaggtgttaatccatttaatcaacctggagttgaagcctataaacaaaatatgtttgcgctattaggtaaaccaggctttgaagataagaaaaaagaattagaaaatcgtttataa

SEQ ID NO: 256 - DNA, 279 bp, Staphylococcus epidermidis
gtggtgaagacttttgcgaatatacctattatcgcttcattatttataccttttggagcatcaattggtttagacacaatggctcttattgctttaattggtacagcaagtgctttaggtgattcaggttctccagcaagtgattctacacttggaccgacagccggtttgaatattgatggacaacatgatcatattcgtgatacatgcatcccgaatttcttgttttataatgttccccttatgatttttggtacgatagcagctatggtactataa

SEQ ID NO: 257 - DNA, 213 bp, Staphylococcus epidermidis
aaattgtctcaagcgtcgccaaagctatggttcaactggtcaagaatcagtaaaacatcaactaaaagtcgcaaaagcattattaaaagacaacgaatcaaaatagttattaaaaataatagccatctaaaattacaaaaatttaattttgtattaagttatcaaagtttatataaaaaaaatgtaaaattccctttcatcctttcaaattga

SEQ ID NO: 258 - DNA, 201 bp, Staphylococcus epidermidis
tgtggctatcataaaatcaaaagccttcttataaaacgattaatcgattcaaaaacaaataaaaaaataatgaagaattatagttgggaatatttcaatgtccaaattaatcaaaagctttcagaacgaaaagcaaaaaccatctacagtcaaagaaaaattgatgtggagtctgtttttggaattatgaagctattttga

SEQ ID NO: 259 - DNA, 1512 bp, Staphylococcus epidermidis
aaggagcgccagaagatgatagagagtaacttgcttgttttaactttagtcatacctatcctaactgcaattttactcatatttattggaaagcgcccaataataaaaagatatgttgcacttgtcggtacattgctaacattggtcattgcattgattaacttaaagaatgtgctacgagatggaccaatcaaggttgaactgggctcttggaaagccccatacagcattgtatttgtagtcgatatttttagcgctctactcatcatcacaagtattattattaccatattagtcattttatactcatatcgttctatcggtttagatagagaacgtcattattattatttctctatcatgtttatgttgattggtattattggctcatttacaacaggagatattttcaacttgtttgtgttctttgaagtctttttaatgtcttcatattgtttactcgttattggtactactaaaatacaattacaagaaacaattaagtatattttagtcaatgttgtttcatcgtctttctttgtcatgggtgttgcagttttatattcagttgtaggaactttaaatctcgctcatattagtgaaagattgtcacaactttctgtacatgacagtggcttagtcaatattgtttttattttatttatctttgtctttgccactaaagcaggcgtttttcctatgtacgtatggctacctggtgcttattatgcccctccagtagcgatcatcacgttctttggtgcactattgactaaagtgggtgtatacgcaattgcgagaactctaagtttattctttaataatacagtaagcttttctcattatgtcatccttttcttagcattacttacaattatttttggatgtataggtgcgatagcttactatgatacgaagaaaatcatcctttacaatattatgattgcagtaggtgtcatattagttggtattgctatgatgaacgaatcaggcatgactggtgcaatatattacacactacatgatatgttagttaaagcttcattgttcttactcattggcgtcatgtacaaaatcactaaaacgactgacttacgtcattttggtggcttgataaaagggtatcctattctaggttggacattctttattgcagcgctaagcttagcgggtataccaccttttagtggtttctacggtaaattctatattgttcgagcgacctttgaaaaaggattttatctaagtggtatcattgtacttttatcaagtttaatcgtgttatattcagtcatacgtattttcttaaaaggatttttcggtgaagttgaaggatatactttatctaaaaaggtaaatgttaaatatctaacaactatcgctgttgcatctacagttattactgtaatctttggattatctgcagacacgttattcccaatcatcaaagatggcgctgaaacgtttgtcgatccaagtcaatatattcatagtgtgttaggaggtaaatag

SEQ ID NO: 260 - DNA, 261 bp, Staphylococcus epidermidis
aacatgaaacatttgattaaatatttgatttccttcacttttgcaattattattgtaatattcattcaatcatttataatcgtaggcgctgtgatatcaaataatagcatgacacctaccttgcaaacgggagatagagtaatagttaataaaattaaagtcacgtttgaccttattcaacgtggtgatataatcatgtacaggcataataacaaaacgtactttagcagaattgtcggaaacagccataaccacgggatg

SEQ ID NO: 261 - DNA, 243 bp, Staphylococcus epidermidis
gcgagatttaaagttcctacaactgaatataaaactgcaacacccatgacaaagaaagacgatgaaacaacattgactaaaatatacttaattgtttcttgtaattgtattttagtagtaccaataacgagtaaacaatatgaagacattaaaaagacttcaaagaacacaaacaagttgaaaatatctcctgttgtaaatgagccaataataccaatcaacataaacatgatagagaaataa

SEQ ID NO: 262 - DNA, 603 bp, Staphylococcus epidermidis
tacaaccctaagaaaggatttgatgtattgtcgctttctcagttagaagaatggtttgacgcatttcgacaattcggatatattcctgggttcattatgctttatttaagagccattgtacctgtgttgcctctcactttgtacgtcgtgctattaatacatgcgtatggattgtttccaggtataattatcagttggctaggtatcgtctcaggtacttttactgtctttcttatctgtaagaaatttgtgaatacaataagaatgaaaaaattaaaaagtagaaagtctgttcaaaggctaattagcttcatagatagacaagggcttatccctttattcgtattattatgctttccatttacacccaatacattaataaatattattgcgagcttatctcacatcaaaataaaatattatttttttgtattagttatttctaagttgatttcaattactattctaggagtaatgggaaaagaaattttcaccatatttactaatccattaagagcgcttattatgattgtgttactcgtagtattatggtttattagcaaaaaggtagaaaagcattttatgggttctaccaaggagtaa

SEQ ID NO: 263 - DNA, 393 bp, Staphylococcus epidermidis
ggggttatcaagttgaatcatcactacaaagtaggtcaacatatcaaggtacgtgtgactggtattcaaccgtatggcgcatttgttgagacccctgaccatactgaagggcttatccatatctcagaaattatggatgattatgtccataatttaaagaaatttctatctgaaggacaggttgttaaagcaaaaatattatcaattgatgatgaaggtaaattaaatttgtccttaaaagataatgattactttaaaaattatgagcgtaaaaaagaaaaacagtctgtcttagatgaaattagagaaacagaaaagtatgggtttcaaacacttaaagaacgcttaccggtctggatcaaacagtcaaaacgtgcaattcacaatgactaa

SEQ ID NO: 264 - DNA, 378 bp, Staphylococcus epidermidis
actatgaccaatcttttagaaacatttgaaatgaagattgaacaaaaagaagatggtaaagtagtagtgtctatgcctgtgacagataaagtaaagcaaccctttggctatttacatggtggtgcaagtttagctttaggtgaaacagcatgttcgataggtgctgctcatttgattgatacgcagcaatttattccactaggtttagaaatgaatgcaaatcatattcgctcaactcgacaaggacatgtgagagcatttgcttctttaatacatcaaggaaaaacaacacaagtttggaatattgatatcaaagatgaccatgaccaattaatcagtgtcatgcgtggtacgattgctattaaacctattcaataa

SEQ ID NO: 265 - DNA, 435 bp, Staphylococcus epidermidis
atgaccatgaatagacaacaaaataaccttatctttcaatacgctgccgtgattattttcttcatggtcattgtgtttggcttttcattatttttagctggacattatacacctggtggcggtttcgttggtggtttgcttttcgctagtgcattattagttattacaattgcatatgatgtaaaaacgatgcgaaagatttttcctttagattttaaaatcttaattggtattggtttattattttgcgtgggtacaccattaacaagttggttcatgtctaaaaacttttttacacatgtcacttttgacatccctttgcctttacttgaacctatgcacatgacgacagcgatgttttttgatttcggtgttttatgtgcagttgttcgaactattatgactattattatttcgattggagagaacgaatag

SEQ ID NO: 266 - DNA, 1263 bp, Staphylococcus epidermidis
aaagaggcgaataggatcatgactgagaataataatttagtaacttccactcaagggattattaaagaagcattacacaagttgggctttgatgatggtatgtatgaccttataaaagaaccaattagatttttacaagtgcgcattccagtacgaatggacgatgggacagttaaaacatttactggataccgtgcacaacataatgatgcagttggccctactaaaggtggcgttcgtttccatccagaagttgatgaagaagaagtgaaggcattatcaatgtggatgactttaaaatgtggcattgttaatttaccttatggtgggggtaaaggcggtattgtttgtgatccacgtcaaatgagtatacacgaagttgagcgtctatctcgagggtatgtaagagctatatctcaatttgttgggcctaacaaagatattccagcaccagacgtttttacaaactctcaaattatggcttggatgatggatgagtatagtgcattagataaatttaattcgccaggttttataacaggcaaacctattgtattaggtggatctcaaggacgtgatcgctctacagctttaggtgtagtcattgcaattgaacaagcggcaaaacgtcgtggcatggatattaaagatgccaaaattgtgattcaaggtttcggcaatgcaggtagtttcttagctaaattcttatacgatttaggtgctaaagtagttggtataagtgatgcatatggagccttacatgaccctaatggacttgatatagattatttattagatcgacgtgatagcttcggtacagttacaaatctattcgaagatacaatttctaacaaagaattattcgaattggattgtgacatccttgttcctgctgcaatttccaatcaaatcactgaagataatgcgcacgatattaaagcaagcattgtagttgaagctgctaatggccctacgacgcctgaagcaacacgtattttaacagaaagagatatattactagtgccggatgtacttgcaagtgcaggaggtgtgactgtatcttatttcgagtgggtacaaaataatcaaggttattattggactgaagaagaagtcaatgacaaactacgtgagaagttagtaacagcatttgatacgatttatgaattgtcacaaaatagaaaaattgatatgagattagcagcatatatagtaggtattaaacgtactgctgaagcagcaagatatagaggttgggcataa

SEQ ID NO: 267 - DNA, 186 bp, Staphylococcus epidermidis
ttcatattagatggaatatttgtttgttgttgtatcgatttctctgattggtttggtgctggagagtggttcgaagtttcagctatcgaaggggaacttaaactagctaaacccagtgtaacggtagataaagttgaaatgattattttcttagatttaaacataaaaacatcctttcaaaaatag

SEQ ID NO: 268 - DNA, 2427 bp, Staphylococcus epidermidis
attttaaaggaggaaaacatagtgagtttgttacatattgcggtactattaccgttaatatttgcactcattattccattcctataccggttcgttaaacgtatacatttaggatggtttgtattacctgttcctattgtcttatttatatatttcatatcattgatttcaatgacgatgtcaggtaataacgtaatgaaaaacttaaattggatgccacatattggaatgaattttaatttatatgtggatggtctcggattattattcagtttgcttatcactggcataggaagtctagtggttttatattctatcggatatttaagcaaatcagaacaactcgggaatttttactgttatttattactatttatgggtgcaatgttaggagttgtactctctgataattttattattttatatttattttgggagttaacttctttctctagctttttattaatctctttctggagagagaaaaaagcttcaatttatggtgctcaaaaatctttaatcattaccgtattaggtggcttgagcatgctaggtggtatcattttactttccctagctactgatacttttagtattcaggctatgatttcaaaagcaagtgacattcaaaatagtcctttctttatcttagtaatgatactttttatgattggtgcatttacaaaatctgcacaagtgcctttttatatttggttaccagatgctatggaggcgcctacgccagtgagtgcataccttcattctgcaacgatggtaaaagcaggactatatctaatcgcaagaatcacacctatttttgcaatatccgaaggttgggtatggacaattacacttgttggtttaatcaccctattttgggcatcactcaatgcaacaaaacaacatgacttaaaaggtattttagctttctcaactgtgtctcaactagggatgattatgtctatgcttggtattggtgctgtaagttatcattatcaaggcgctaatagtcaactttatgttgctggatttgttgctgccatatttcatttaattaatcatgccacgtttaaaggtgcactatttatgattacaggtggtattgatcattcaactggtacacgtgatgttaaaaagttgggcggtttacttacaatcatgcctatctcattcacgcttacagttattacaacattaagtatggctggtgtgccgccttttaacggctttttatcaaaagagaaattcttagagtcaatgattaatgttacacatttaaatttaatgagtttaaatactttaggtattcttttaccaatcattgccattattggtagtattttcacatttgtatattcaattaaatttatattgcatatattctttggttcttataaacctgaagctctgccaaaacaagcgcatgaatcttcaattttaatgcttatttcacctatcattttaacatcactagttatagtattcggtttattcccaagtatattaacgcaatctattatagagccggcatctgtagcagttagtcaaacatcaaatataactgctgagttccatttattccatggtataactccagcattcctatcaacaataggtatttatattattggtattttattattaatttcatttagttattgggttcgtttattacaagcacatccatatcagttaacgttgaatcattggtatgacacttcaggccaacgtattccaggatattccgaaaatataacaaatagttatgttacaggtttttctagaaataatttggtgattatcttaggtattctcattgctttaacttttgttacagtcatcagtgtacccttcagtattgactttaaaaacgtgagtcatttacgcgtatttgaaggtgcaacagtattgtttttactgattgcttcaactttcattatatttgcaaaatcacgtttgtttagcattatcatgttaagcgctgtgggttacgctatatcagtattatttattttctttaaagcgcccgacttagcattaacacaatttgtagtggaatctatttctacagcattattcttactatgcttttatcacctacctaatttaaatcgctacaatgaaaaaccaacctttaaactgacaaatgctgtgatttcaattggagtgggattatcagtgattattttaggattaattggctatggtaatagacactttgactctattactaaattctatcaagaacatgtttttgatttagcacatggtaaaaatatggtaaatgtcatcctcgtaaatttccgtggtatggatactttattcgagtcatctgtactaagtattgcaggtttaggcgtatatacaatgattaaattacgattaaaacagaaaaatcaatcaagtgaggtgaatgaccatgaatag

SEQ ID NO: 269 - DNA, 189 bp, Staphylococcus epidermidis
tgtggagtctgtttttggaattatgaagctattttgagtttcactcgaaagtccgttcgagggataaataaagacaaaagagaactaggacttgtgctaatgacacttaatataagaaaagtaccagctcaacgagctgaaaattataaaaaaatcataaaaaagacaatttttatattatttcaatag

SEQ ID NO: 270 - DNA, 1221 bp, Staphylococcus epidermidis
gtttttattcgaaaacgaaggggagattttatgactcaatctgaaaaaattattaacttaacaaatcactatggggcgcataactacgttccacttccaattgttatttctgaagcagagggtgtatgggtgaaagatccggaaggtaacacgtatatggatatgctttcggcctactcggcagtgaatcaaggtcatcgacacccaagaattattcaagcattgaaagatcaagcagataaagtcactttagtatcacgtgcttttcatagtgataatttgggtcaatggtatgagaaaatatgtaaactcgcaggtaaagacaaagcattgcctatgaatacgggagcagaggcggttgaaacagctttaaaagctgctcgtcgttgggcttatgatgttaagggtattgagccgaacaaagctgaaattatcgcttttaatggtaatttccatggacgtacgatggcaccagtatcattgtcttcagaagctgagtatcaacgaggctatggtccattgttagatggctttcgaaaagttgagtttggtgacgttaatcaattaaaagcagcaattaataaaaatacagcagcaattttagtagaacctatacagggagaagcagggattaacgtaccaccagaaggatatttgaaaacaattagagaattatgtgatgaacatcaaattttatttattgctgatgaaattcaagcaggattaggacgttcaggaaaattatttgcaacggattgggatcatgtaaaaccggatgtttatattttaggaaaagcgttaggtggaggggtatttcctatctcggtagttcttgcagataatgaggtattagatgtatttactcctggctcacatggttctacatttggtggaaatccactagcgagtgcagtttctattgcagctatagatgtcattattgacgaggatttacctggtcgttcattagaattaggagaatattttaagtctgaattgaaaaaaattgagcatccatctattaaagaagttaggggacgaggattatttatcggtattgaattacatgaaagtgccagaccatattgtgaagctttgaaagaacaaggattattatgtaaagaaactcacgacaccgttattagatttgcacctccattagtgataacgaaagaagagttagacatggctttagagaagattaagagtgtatttgcatag

SEQ ID NO: 271 - DNA, 312 bp, Staphylococcus epidermidis
aaaggtaggcgagaaataatgccttttaaaatatttattattacagccttaattattgttgtcttatcaatgttagcaatgttaatacgtgttattttaggaccctctctagcagaccgtgtcgtcgcacttgatgcaattggtttacagttaatggccgtgatagcgctatttagtattttactgaatattaaatacatgctcgtcgttattttaatggtcggtattcttgcttttctaggaactgcagtcttttctaaatttatggatgaaggtaaggtgatcaagcatgatagcaacgatcgtcactag

SEQ ID NO: 272 - DNA, 492 bp, Staphylococcus epidermidis
gaggtaaatagtttggctatacagtttgtaattaatttacttgtttctgtcatatggttacttgtaacaaatagctataccttaaataactttgtattaggttttatactaggtttgtttctagtttatctcctgcaccgtgtcttgcctggtcagttttatttagtgagaatatatagaattataatgcttatcattacatttttaactgagttaataaaagcaaactttggtgtactaaaaattattctcaaaccacgaattgagaataaacccggattctttgtgtacgagacggaattagaacgtgactggcaacttgttttactttccaacttgattacgttaacacctggcacagtcgttttaggtattagtgatgaccgtaaaaagatttatatccactcaattgatttcagtacaaaggaagaagagattcaaaatatcaaatcttcattagagaaggtcgttagaaaggtaggcgagaaataa

SEQ ID NO: 273 - DNA, 333 bp, Staphylococcus epidermidis
  unsure (174): Identity of nucleotide at the above locations are unknown.
tctttgttgagtggtattctcacatctataagtgtctatctcgtttcgtctaaaagtttgatacgtatcattatggggactacactactaactcatgctgcaaatttatttttaattactatgggaggtttaaagcacggaactgttccaatatttgaaaaaggaacatcaagntatgttgaccctatcccccaagcattgattttaacagctatcgttatcgcctttgctacaacagctttctttttagttcttgcatttagaacatataaagaactaggcactgataacgttgagctaatgaaaggagcgccagaagatgatagagagtaa

SEQ ID NO: 274 - DNA, 612 bp, Staphylococcus epidermidis
cacgaatggagaattgaaatgacgaactatcctcagttaaataaagagattcaagataacgaaattaaagtagttatgcatacaaataaaggtgacatgacatttaaattatttcccgacattgctccaaagacagttgaaaactttgtgacgcattcaaaaaatggatactacgatggtgtaacattccaccgtgttatcaatgattttatggtacaaggtggggacccaactgcaactggtatgggcggagaaagtatttatggtagtgcttttgaagatgaattttctctagaagcttttaacctttacggtgcattatcaatggctaatgcaggtcctaatacaaatggatctcaattctttattgtccaaatgaaggaagtgcctgaaaatatgttaagtcaattagcagatggtggatggcctcaacctattgtagaagcatacggtgaaaaaggtggtacgccttggttagatcaaaaacatacagtatttggtcaacttattgagggtgaatcaactttagaagatattgcaaatactaaagttggtgctcaagacaaacctgtttatgatgtagtcattgaatcgatagatgtagaagaataa

SEQ ID NO: 275 - DNA, 1173 bp, Staphylococcus epidermidis
aagcagaggggcgattcaatgcactggacaattattggtggtggcttacaaggaaccaccattgcacttaaattaaaaaatgaaggactaaaaaatgaggcgcttactatcatagatccttactcctcattatgtgagcgatttaatatttatacacaacgtattagtatgccatacttaagatcgcctttcgttcatcatattcatcctaaaccttttcatctcaaacaatatgctagatatcatcagtatacttcagcttattacggcccgtataaacgtcctcaaagagatatgtttatgcatcatgttcatgatttgatacatcaatttaaacttaatgattgtcatatacaaggtaaagtcgaagctattaataaatcaagaggtaaatggtgtataaaactatcaactggcgataaaatgattaccgattgtgttgtgatagcaaatggctatacgcaaacgccattcatacctgaaattttcagaaataaagcgaatgtaaaacacatattcgctgataattatcatgcctctttagataaagatactcaacatgttgttggttcaggtatatctgctgcccacctcactttaaaattattaaatgaacacaatcaccaacttgttcatttatggatgaataaagatattgagatacataattttgatgctgaccctggttggttaggacctaagaaattgaactatcttgcatctatatcctcatcagatgcaagaatgaagttaattgaagacgaacgtcatagtggttcaatgcctatggaattatttttaaggttaaagaaatatgtgcaaagtggtcgactcgtcatacatacgagtcaaattgatgatgtaactgaatcctatattatctccgctggaaaatattttgaatataagcatattttgttagctactggattttataatcaattgttaacacaaccactcataaaaaatcttattcaaaacgaacaagcaccacttaatcaatcaggttatccttctttgtcaaacgaactagaatggttaaatcaattattcgtagctggtggactcgcagatttagaactaggtccttttgcaagaaatataatgggcggtaaagaaagcgctgaacgcataagtaaagcatataaacgtttaaataagaaaatctcttaa

SEQ ID NO: 276 - DNA, 186 bp, Staphylococcus epidermidis
ggtaattctatatctgaaattgttccatcatcatttgatgaagtatgtgtaagaggagctaaaacaaaacgatttcttacttcaacaccattaggtagtgttaaagatttaaataaaggttcatatttattattcatatttttaatactctccttgtttaatgatgttatgactatagcatgctag

SEQ ID NO: 277 - DNA, 1215 bp, Staphylococcus epidermidis
ggtgtaaatatgaaagataaaatcgttttagcatattcaggtggtttagatacaagcgttgcagttcaatggcttattgataaaggatatgatgtagttgcttgttgtcttgacgtaggcgaaggcaaagatttagacgttgtatatcaaaaagctttagatatgggtgcagtcgaatgtcatattattgatgcaactaaagaatttagtgatgattatgtaagttatgctattaaaggaaatttaatgtatgaaaatgcatatcctctagtttcagcattatcacgtccactcatcgcgaaaaaactggttgaaattgctgaaaaaacaaattctattggtattgcgcatggatgtactggtaaaggtaatgatcaagtacgtttcgaagtggcaatcaaagctttaaatcctaagttaaaagcatttgcacctgttcgtgaatgggcttggagcagagaagaagaaattgattacgcaatcaaacataatattcctgtttcaatcaattatgactcgccatactcaattgaccaaaacttatgggggagagctaatgaatgtggtattttagaagatccgtatgccgcacctccggaagatgcatttgatttaactacacctttagaagaaactccagacaatgcagacgaaattatccttacatttaaacaaggtattccagtacaagttgatggcaaagattatcaattagatgaccttattctttacttgaatcaacttgctggcaaacacggtattggtagaatcgatcatgttgaaaacagaatggtcgggataaaatcgagagagatttatgaaacacctggtgcggaagttattttaaaagcacacaaagcactagaaacaattacattaactaaagacgtagcgcactttaagcctgtcattgaaaaacaattttcagaacaaatatacaatggtttgtggttctcgccattaacagatagtttaaaactctttatcgatagtactcaacaatatgttgagggagatgtgagaattaaattatttaaagggaacgctattgtcaatggcagacaatctccttacactttatacgatgaaaaattagctacttatacaaaagaagatgccttcaatcaagaatcagcagtaggtttcattgatatttatggtttacctacacaagttaatgcattacttcacggggggtatagtaatgagcaataa

SEQ ID NO: 278 - DNA, 1062 bp, Staphylococcus epidermidis
aaggatgtttttatgtttaaatctaagaaaataatcatttcaactttatctaccgttacactgggtttagctagtttaagttccccttcgatagctgaaacttcgaaccactctccagcaccaaaccaatcagagaaatcgatacaacaacaaacaaatattccatctaatatgaatcaatcatcagctaaaacatttaaacgacaagctgaatcagactcagtaagtggtaaaacaaacgatactcataatcattggactaaaaatttaactggagagaaatttacaaccattgcacatcgtggcgcaagtggttacgccccagaacatacttttgaagcatatgataaaagtcataatgaattaggagcatcttacatagaaatcgatttacaacgtactaaagatggtcacttggttgctatgcatgacgaaaaggtcaatcgtacaactaatggccatggacgtgtcgaccaacttactttaaaagagttaaaacaacttgatgcaggaagctggtttaatcgaaagcaccctgaatatgccaaaaataaatataaaaatgctaaagttcctactttagacgaaattttaaatcgctatggcaaaaatgcaaactattatattgaaactaaatcgccagatgtttatcctggcatggaaaaacaattattagatacattagataaacatgacttgttaacacaaaaatcacttaaacatggacatgtgatgatccaatcattttcagggagtagtttagaaaaggtacatcacatgaacgccaatataccacttattagactaatgaataaatttgaacttaaaaaagctactaatcaagatttaaaaaatattaaatcttatgccattggagtaggtcctgaatacacagatttaaatattaagaacacaagacatttaaaaaatttaggatttttagttcatccttatacagttgatgatgaaaatcaaatgagaaacttaaatcaatatggtgttgatggtgtattcactaattttgctgatagatataaaaaagtttcagaaacacaacaataa

SEQ ID NO: 279 - DNA, 1455 bp, Staphylococcus epidermidis
gtttcattgatatttatggtttacctacacaagttaatgcattacttcacggggggtatagtaatgagcaataaagcttggggtggcagatttgaaactcaacccgaagaatgggttgatgatttcaatgcgtcaattgattttgataaaaatttaattaaacaagatgttcaaggtagtattgcacatgcaactatgctcgctaaacaacatattattacagatgatgaagctcaatccatcattaatgagcttaaaaatattcaaagtgactttgaagaaggtaaacttaaatttaaagcttctctcgaagatattcatcttaatattgagcacgagcttattcaacgtattggcgaagctggtggaaaactgcatactggtcgtacccgtaatgatcaagttgccacagatatgcatttgtatactaaagaacaagttcaatacattattgaacttatagcgtcgtttcaagaaacaattgttcaattagcagaccagcacgttgacacaattatgcctggatacacgcatttacaacgtgcacaacccatctcgttcgcacatcatattatgacttacttttggatgttagaaagagacaaaggtagattcatggatagtcttaaacgtatagatatctcaccattaggtgctgcagctttaagtggaactacacaccctatagatagacatctgactcaagaacttctaggatttgcaaatctgtatgaaaatagtttagatgctgtcagtgatcgtgactatatcgttgaaacattgcatcatatttcactcactatggtacatctatcacgttttgcagaagaaatcattttttggtcgactgatgaggcaaaatttatcactttatcagatgcgttttctactggctcatctattatgccacaaaagaaaaaccctgatatggctgaactaataagaggaaaagtcggacgtactacaggacacttgatgagtatgttagtaacacttaaaggcttacccttagcttataataaagacatgcaagaagataaagaaggtttatttgatgctgtacacacacttaaaggctctcttcgaatcttcgaaggtatggttgcatctatgaaagttaattcaaaccgtttaagtcaaacagtaaaaaatgatttttcaaatgcaacagaattagcagactatttagtcagtaaaagtgtaccttttagaaccgctcatgaaatcgttggtaaaatcgtattaaattgtattcataaaggtatatacctattagacgtacctttaagcgaatatcaagaacatcatgagaatattgaggaagatatatatgattatttaacacctgaaaattgtctcaagcgtcgccaaagctatggttcaactggtcaagaatcagtaaaacatcaactaaaagtcgcaaaagcattattaaaagacaacgaatcaaaatag

SEQ ID NO: 280 - DNA, 363 bp, Staphylococcus epidermidis
tcaagcatgatagcaacgatcgtcactagtgtctctatcatatttgttgttcttggagctttgattagtgcctttgctgcaacgggtctcattcgattaagggatgtttactcaagagcacatgcagctggtaaagcagccacgttgggtgcgatgtttttactatttggagcatttttatactttattggcactgaaggatatgtaaatatgcaattaattatcggaattattttcgtatttattactggccctctttcaagtcatttaatcatgaaagctgcctacaacattaaaacaccatataccaaagatactaaaattgatgaaattaaagaggatatgaagcatacaaaactataa

SEQ ID NO: 281 - DNA, 1173 bp, Staphylococcus epidermidis
  unsure (620): Identity of nucleotide at the above locations are unknown.
catgctatagtcataacatcattaaacaaggagagtattaaaaatatgaataataaatatgaacctttatttaaatctttaacactacctaatggtgttgaagtaagaaatcgttttgttttagctcctcttacacatacttcatcaaatgatgatggaacaatttcagatatagaattaccttacattgagaaacgttctaaagatgttgggattgcaattaatgcagcaagtaatgttaatgatgtaggcaaagcatttcctggtcaaccttctgttgcacatgactcagatatcgaagggttaaaagaacttgctcaagttatgaagaaaaatggtgcgaaagcaatagtccaaattcatcatggaggtgctcaagctttaccagagttaacacctgatggagatgttgttgcaccaagtgccatttctcttaaaagttttggtcagcaaaaagaacatgatactcgtgagatgactgctgaagaaattgaacaaactattagagactttggtgaagcaactagaagagcaattgaagcaggttttgatggcgttgatattcatggggcaaaccaatgtcttattccccaatttgtttctccttactataatataanaaatgatgtttgggctgataactataaattccctgttgctgttatagatgaagttgttaaagctaaaaaagctcatgcaaatgatgattttattattggttacagattgtcacctgaagaagcggaatcaccaggtatttcaatggagataactgaagaattaattcaccaaatcgcaaataaaccacttgattatattcatgtgtcattaatggatgttaactcagttacgcgagaaggtaaatataaaggtgaaaatcgcttggaacttattcatcaatggataaatggacgtatgccgcttattggtataggttctgtctttacagctgaagatgcactaaatgctgttgaaaacattggagttgaatttgttgcattaggtcgtgaaattctacttgattatgattttgttgctaaaataaaagaaggtcgagaagacgaaattataaatgcttttgatcctaatcgtgaagaccaacattatctaacaccaaatctttgggaacagtttaatcaaggattctatccattacctcgaaaagacaaataa

SEQ ID NO: 282 - DNA, 183 bp, Staphylococcus epidermidis
ttttgtttattggtatttattaaattatacgaaagaccttatttttttaagtatttcattgtgaaattacatataaacacaaagtattttggcgagactcttgagggagcaggacaagttgaagactacaggctgaagctgtccctaagaaagcgagccaacaatacgaggtattgtaaataa

SEQ ID NO: 283 - DNA, 990 bp, Staphylococcus epidermidis
aaggttagttccatgcttaagttaaatccctataaaataggatttagaactgtcaaaactgctgtgggaatgactttaggagtaatcatatgtaaacttctaggcttagataattatgcatccagtgctattttagttgtattgtgcataaagcacactaagatgcattcagtacaagcaattttatctcgactagtttcatgtttactcatattatttttaggttcagcaatttttagtcttttaggacaacatgcatttgttttaggtttaattgttttgttgtttattcctttgacagttgttctaaatgtgcaagaaggtgttatcactagttgtgtcatattattacatgtctttaacgccaaagctattaatgggcaccttattttaaatgaaataatgctattaatagtgggcttaggtatagcatttctaatgaacttaatgatgcctagtttagataagaaattgaatcattttaagcaggatatagaaaatcaaataactgaaatatttaatatttttagtcaagcctgctcaatgcataatgatcatttaaatattaaatttgattcattacttttaaatattaaaaaagcaaaatcacttgcttttagagatgttaaaaatcactttgtacgaaacgaaaattcattttatcattattttgatatgagagaagaacaagttgaattattaaaacgtatgacatcgttattagaaagaataaatacagatgatcctatactcgaaaagatttcacaattaatgtatgaaattggaagtaacgtaaatagcaatgattatacggctctaagactacattcactttatgaaatacgtttatctctcgatgatttaccattaccgactactcataagactttaaattcccgagcacatattattcaaattctaaatgaactagaagaatacttaaatattaaatctcaatttggttctttaaaattgcatagtgaaatataa

SEQ ID NO: 284 - DNA, 1236 bp, Staphylococcus epidermidis
caattttactcgtttataagatgttataattatgtagtgtataaggaggcatacaagatgactgaagaattcaatgaatcaatgattaatgatattaaagaaggtgacaaagtcactggtgaagttcaacaagtagaggataaacaagttgttgtgcatattaatggtggcaaatttaatggaattattcctattagccagctttcaacacatcatatcgaaaaccctagtgaagttgtaaaagtcggtgatgaagtcgaagcatatgtcactaaaatcgagttcgacgaagaaaatgatactggggcatacattttatcaaaaagacaacttgaaactgaaaaatcttatgaatatttacaagaaaaactagataacgatgaagtgattgaagctgaagttactgaagtagttaaaggtggtttagtcgttgacgttggtcaaagagggtttgtacctgcttctctaatttcaactgatttcattgaagatttttctgtattcgatggtcaaacaatccgtattaaagtggaagaacttgatcctgaaaacaatagagtcattttaagccgtaaagctgtggaacagttagaaaacgacgctaaaaaagcttcaatattagattctttaaatgaaggcgatgttattgatggtaaagttgctcgattaactaactttggtgctttcattgatattggtggcgtagatggtttagttcacgtttctgaattatctcatgaacatgttcaaacaccagaagaagttgtgtcagtaggtgaagcagtcaaagttaaagttaaatctgtagaaaaagattctgaacgtatttctttatctattaaagacactttaccaacaccatttgaaaacattaaagggaaatttcacgaagatgatgttattgaaggtactgtagtacgtttggcgaactttggcgcattcgtagaaattgctccatccgtccaaggtttagtgcatatttctgaaatcgatcataaacatatcggttctcctaacgaagtattagaacctggacaacaagttaatgtaaaaatattaggtatcgatgaagataatgaaagaatttcattatcaatcaaagcaacgttacctaaagaaaatgtcattgaaagtgacgcatccacaactcaatcatatcttgaagatgataatgatgaagataaaccaacattaggcgatgtttttggtgataaatttaaagaccttaagttttaa

SEQ ID NO: 285 - DNA, 192 bp, Staphylococcus epidermidis
attgtacactctgtatatcaactcgatattttagataagttaccatttataaatcaaatgatttcagttaatatttctatacctttttctaattgttttttagtgatggtcaatggcggtaataacctaatcacatttttaccagctgttaaaatgattaaccccatacgtttagcttctcgcactacttga

SEQ ID NO: 286 - DNA, 186 bp, Staphylococcus epidermidis
tcaaatccatcgacatctatcattataaataaagattccagtcactacagtaagatgctgactagaatagctatatcatgtcatactaatgagaggacatcttcttcacaaagattctcttactatagaatcgacgagctaaacttgatagacggagatagcaattatacgggagcgagactatga

SEQ ID NO: 287 - DNA, 894 bp, Staphylococcus epidermidis
aaagaaggattaaaaatgcctcaaagagtattgctcgttgatggaatggctttattatttagacatttttatgcaacaagcttacacaatcaatttatgtacaattctaaaggaattcctacaaatggtattcaaggttttgtaagacatatttttagcgctatcaaggaaatcgaacctactcacgtagcagtttgttgggatatggggcaagaaacattcagaaatgaaatgtatgatggctataaacaaaatcgcccagcacctcctgatgaacttattcctcaattcgattatgttaaagaaatatcccatcagtttggttttgtaaatgttggtaagcgtaattatgaagctgatgatattattggcagtttagcggaaacatattcacaagaacatgaagtttatatcattaccggagaccgagacttactccaatgcattaatcataatgtagaagtttggcttataaaaaaaggttttacaatctatcaacgttacacgcttgatcgtttcattgatgaatacgggcttaatcctcaacaattaatagatgttaaagcttttatgggtgatacagcagatggctattctggtgtaaaagggataggtgaaaaaacagcaattaaattaattcaaaatcatggaactgtcgaaaatgtagtgaacaatttatcatcattaactcccgctcaacagaaaaaaataacaaataatttaaatcatctgcatttatcaaaatcactcgcagaaatatataccaaagttccaattgaaacagacaaactttttaaagagatgacatatgctcatacactaaatgagattttatccatttgtaatgaacatgaactatacgtttcaagtaaatatattgcaactcacctctaa

SEQ ID NO: 288 - DNA, 468 bp, Staphylococcus epidermidis
tttgaggtgttaattgtgccaaaaaagtcagtgagacatataaaaataagagagataatttcaaatgaacaaatagaaacacaagatgaactagttaaacgtttgaatgagtatgatttaaatgttactcaagctactgtttcacgagatattaaagaattgcaattaattaaagttcctgcacctacagggcaatatgtttatagtttaccaaatgatcgtagatatcatccattagagaagttgggtagatatttaatggattcatttgtaaacattgagggtactggtaatctactagttcttaaaacgcttcctggtaatgctcaatccattggtgctatacttgatcaaattgattgggatgaggtacttggtacaatttgtggtgatgatacatgcttacttatttgtcgagacgaagaagcgagtgaagaaatcaaaactcgaattttcaatttattataa

SEQ ID NO: 289 - DNA, 945 bp, Staphylococcus epidermidis
attcgtcagttaaagtgtatcgaaaggagactggacatgcaaaaaaatattctaaaaagtggcatcgaaatttctgaacttgggttaggttgcatgagtttaggcacagattataaaaaagcgcaaccaattattgaaagtgcaattgataatggtattacgtattttgatactgcagatatttacgatcaaggagttaatgaagaaattgttggtaaagccttaaaaaaatatcaaaatcgtgatgacatcgttatcggaactaaagttggaaatcgattaactgacgatggacatatgacgtgggatccttcgaaaaaacatattaaagaaagtgttaagggatcattgaaacgattaggattaaaccatttagacttatatcaattacatggcggaacaatagatgatcctctagacgaaactattagtgcatttgatgaattaaagcaagaaggatatattcgtgcatatggaatttcatctatacggcctaacgtgatagactattatcttaaaaatagtcaaattgaaacacttatgtcccagtttaatttaatagataatcgccctgaaagtcttattaatgacgttcatgataagcaagttaaaattctagcacgtggccctgtatttaaaggtttattaacttcaaaaagtgttgatgttatagatgaaaaatttaaaaacggtgtgttagattacactcaagacgaattaggtagcacgattgcttctattaaagaattggaaagtaatttaaccgcgttatcatttaaatatttaacttctcatgatgctatggggtcaattattgtaggagctagtagcgttgaacaacttgaagagaatgtccgcaattattataaagaaatcagtttagatcaaatcaaatctgcacgtaatagagttaaagatattgaatatacacaacatttgaaataa

SEQ ID NO: 290 - DNA, 246 bp, Staphylococcus epidermidis
tttgtgcatacctgttcgtatgttggattttctacatgtcctccactatatccggaaacgactgattttattccaggatatgaggtgaagggtttaaccatgcaccaaaaacaacctccagctagtgtcgcatatgccatgttatattccctccttaagttatctgtttgtttaaatttacgctatattgtcgggaatttaaagtatttaactcagaatcattcatgtgattttgtgacaacttag

SEQ ID NO: 291 - DNA, 1488 bp, Staphylococcus epidermidis
ggatgtgataccatgaatgatcatcaaaaaaatcatgcaacatctcaagatgataacacaaagtcaacaccatctaagaatagcaagcatataaaaattaaattatggcatttcatactcgttattttgggtattattcttttaacatccatcattactgtagtatcaacaattttaattagccatcaaaaaagtggtttaaataaagaacaacgtgcaaatttaaaaaaaattgaatatgtctatcaaacacttaataaagattattacaaaaagcaaagttctgataaattaactcaatctgccatagatggtatggttaaagaacttaaagatccatattcagaatatatgactgctgaagaaacaaaacaatttaatgaaggtgtatcaggtgatttcgttggcataggtgctgaaatgcaaaagaaaaatgaacagataagtgttactagtccaatgaaggattcaccagcagaaaaagctggtattcaacctaaagatatcgtcacacaagtgaatcatcattcggtagtcggtaaaccacttgatcaagttgttaaaatggtccgcggtaaaaaaggaacatatgttactttaactataaaacgtggttcgcaagaaaaggatattaagattaaacgcgataccattcacgttaagagtgtagagtatgagaagaaaggcaatgtaggcgtactaacaatcaataaattccaaagcaatacttctggtgaactcaaatctgcaatcatcaaagcgcataagcaaggcatccgtcatatcattttagatttgagaaataatccgggggggttattagatgaggcagtcaagatggctaacatctttattgataagggaaatactgtcgttcaattagaaaaaggtaaggataaggaagaattaaaaacttctaatcaagcactaaaacaagcaaaagatatgaaagtatccatcttagttaatgagggatcagctagtgcttcagaagtgtttacaggtgctatgaaagactatcataaagctaaagtttacggttctaaaacatttggtaaaggtatcgttcagaccactcgtgaatttagtgatggttcattaattaaatatacagagatgaaatggctaacgcctgatggccattatattcatggtaaaggaattagaccagatgttagtatctcaacaccaaaataccaatcactcaatgtcattccagataacaaaacttatcatcaaggtgaaaaagataaaaatgttaaaacgatgaaaataggtctaaaagctttaggttatccaattgataacgaaacaaacatatttgacgaacaattagaatctgctattaaaacatttcaacaagacaataatttaaaagttaatggcaattttgataaaaaaacaaatgataaatttactgaaaaactagttgaaaaagcgaataaaaaagatactgttttaaacgatttactaaacaaactaaaataa

SEQ ID NO: 292 - DNA, 612 bp, Staphylococcus epidermidis
catctcatcacaaacattacaacaggtttaaaagatgtggttgaagttacattcaatcaaatcactgtagatggtgacacttcaacaaatgatatggtgcttgtgatgtcaaatggatgtacaaataataacgaaattaaaaaagacagcgaagactactataaatttaagcagatgcttctatatattatgaccgatttagcaaaaagtattgcaagggatggcgaaggtgcttctaaattaatagaagtcacggttaaaggtgcaaaagaatctagtgctgcaagaatgattgctaaaagtgtggtgggttcaagtttagtaaaaaccgcaatttttggcgaagatcctaattggggtagaattattgctgctgcaggttatgctaaaacatattttgatattaatcaggtagacatttttataggtaggatacctgtattaataagatcctcaccagtaaagtacgataaagaagaaattcaagaaataatgagtgctgaagaaatatcaattcagcttgaccttcatcaagggaattgtgaaggtcaagcatggggatgtgatttatcgtatgactacgttaaaatcaacgcactatacaccacttag

SEQ ID NO: 293 - DNA, 393 bp, Staphylococcus epidermidis
gagtctgaagccgacagtatagtctggatgggagaaaatggaggttttttgttgttcaaatttcctccttttctaagtaagatgaatggaaggagaaaattatatatgcaacaaaacaaacgtttgattacaattagtatgttaagtgcggtagcgtttgtgttaactttcatcaagtttccattgccatttataccaccgtatctaactctcgattttagtgatgtaccgacgttattagcaacattcctcttaagtcctattgctgggattatcgttgcactcatcaaaaatattttaaattttctattcaatataggggatcctgttggaccagtagctaactttttagccaggcgtcagctttttgctatcatcatactatgtttatag

SEQ ID NO: 294 - DNA, 339 bp, Staphylococcus epidermidis
gctaatgcggcacattacggtgcatcgaaagcagggtttagcgccgttcttaatgcattgagattagaacaaccggaattaaaagtgctcaatgtacagcccggtccaatagatacaccattccaaaaaaacgcagatcctactctaaagtattttaaaaattatagacacatgatgatacaacctcaacaacttgccaagcaaatagtggaaggaataatactaaataaaattgaaattaatcaaccatcatggatgcaaataatgcttaaattttatcaattatgtccacgtacactagaaaaattatgtccaaatctatttaaaaataaagtttaa

SEQ ID NO: 295 - DNA, 465 bp, Staphylococcus epidermidis
aggagtgaggcttccgtggaagaacgattaaatcgcgtgaagcaacaattacaacaatcttcatataaattgactccacaaagagaggcaactgttagagtattaattgaaaatgaaaaagatcatcttagcgcagaagatgtgtacttaaaagtcaaagataaggctccagaaataggattagctaccgtttatagaactttagaattgctagctgaaataaaagtgctagataaaataaattttggtgatggtgtagctcgttttgatttaagaaaagaaggagccaagcatttccatcatcatcttgtttgtatggaatgtggtaaagttgaagaaattgaagaagatttattacctgaggttgaaaatcgtgttgaaaatgagtttaatttcaagattttagatcaccgtttaacgtttcacggtgtatgttttgaatgccaagccaaaaataagcaataa

SEQ ID NO: 296 - DNA, 972 bp, Staphylococcus epidermidis
gggtttaatttgtacaatatactatcatacgctatgagtcatgcatttaactacaaaaccaataaaagtatctataatattttaacaggcaagaagtcacaccaaacgtttttcgatgcgtcaagccaacaacttttgtcattatatcatagtttacctaacttaaagtattcaacttttgagcaatttatactccaaaaggatgattttaaaaaatcaattcaagtaaaaatacatccacaatacacttatgatagtctcactcaaacctttagttgcatacaattacttatccaaacgttatctcatacacgcaaggagtcaaatacatttattccaatcgttcaaaatacctatatccaacaaagggttaaacaactttatcatcaggtcattgaatcaaatcaagtatcaaatactatagacgaaatatatttattatttgagaatttaaataataaatataaccatacatttcttcattattatttacaaggatatgaggaatccatgtatactagacaacaaataagtttaattgagggtataccacaatcagaattatttgaacgagaaatgaatgaactgattgacatattgaatcaattaaaagattcaacgaaatatccaatactttctcaagctatcattctttcaccattactaacaaatacatacttaagctatcaaaagttaaaatctggtctcaatttaaaagaaattgctcaattacaaaatgtaaaacttaacacaattgaagatcatattctagaaatgtatattaaaggttatttgatagactatacattatttataaataaaaaagatattctcgaatttataaactactatcaaaaacatcgcggtgaacgattaaaattttataaagaacattttactgattggacttactttcaaattaagttagttatagtaggaatagaaagaggtgatttaattgctgaaagataa

SEQ ID NO: 297 - DNA, 513 bp, Staphylococcus epidermidis
gagtgcatttacatgtttaaaaagttatttggaaaagctaaagaagttgacaaaaacattaaaatctacgcacctttgacaggtgagtatgtcaaaattgaagatattcctgatccagtttttgcgcaaaaaatgatgggagaaggctttggtattaatcctacagagggtgaagttgtttcaccgattgaaggcaaagtcgataatgtttttccaacgaaacatgccgtagggttaaaagccgaaaatggattagagttattagttcatatcggattagataccgttcaattggatggaaaagggtttgaagtacttgttgaaagtggagatgacattaaaataggtgacccacttatacgttttgacttagaatatattaataataatgcaaaatctattatttctcctattattattacaaactctgatcaaactgaatcaattcatattgaagacgtacaagcagtagttaaaggggaaacacaagttattgatgtgacagtaagctaa

SEQ ID NO: 298 - DNA, 465 bp, Staphylococcus epidermidis
aaaagcatttatcgaatcacactggggaggctcaaaatgattaaaaaaaacaaagaagaactgaatgacatggagtatctagtcactcaagaaaatggtactgaacctccgtttcaaaacgagtattggaatcactttgaaaaaggaatttacgttgataaattgtccggcaaaccattatttacttcagaggataaatttgaatctaattgcggttggccaagtttctccaaagcattaaatgatgatgaaatcgtagaacttgttgataaatcatttggtatgattagaactgaagttcgatcagaaaaagcaaatagtcacttggggcatgtttttaatgacggacctaaagaaaaaggtggtttaagatactgtattaactctgctgcgattcagtttataccttatgataaactagaagagttaggatatggagatttaattaaacattttaaaaaatag

SEQ ID NO: 299 - DNA, 717 bp, Staphylococcus epidermidis
gaggaaagttatatgtataatgaaatatttggtattgcgtcatttattgttacattcgctttaatggtactgatgtatcgctgttttggtaaacaaggactaattgcttgggtagcaataggaacgattatcgctaatatacaggtcataaaagcggttcatatttttggtattacggctacacttggaaatgtcatgtttgcttctatatatttagctactgatatattaaatgacatctatggtcgtaaagttgctaaaagagcggtgtggcttggtttctcttctaccttagtaatgattatagtcatgcaaatgtcattgcattttattcctgctccagtagacaatgcgcaaaactcattaaaaatgatttttgatttagttcctagaattgctataggttccattattgcttatatcataggccaacatattgatgtatttatattcagtatgattaaaaagatatttagctctgataagaccttttttattagagcatatggtagtaccattttaagttctatcattgataccggtttatttgtttcaattgcttttattggtactatgcctggtactgctgtttttgaaatatttattaccacttacttgttaaaactagtgtcaactatttttaatgtaccatttggatatatcgctaagtcactatatcgaaaaggaaagatagaacaactagataatgggtattga

SEQ ID NO: 300 - DNA, 1059 bp, Staphylococcus epidermidis
aggaacacctattcatattattccaagaaaaagaaattaaaaacaaaggggaattcaataatgagaaaaattacagtttttggtatgggtagttttggtactgcattagctaatgtattagctcaaaatggtcatgatgttttaatgtggggcaaaaatgtagagaatgtagatgaacttaacacacatcatatgaacaaaaattatcttaaagatgctaaattagattcatctataaaagcaactgtagatttaaataaggcagtgcaattttcagatatctatcttatggcactacctacaaaagcaattagagaagtatcaaaagatatcgatcaattactcacatctaaaaagacttttattcatgttgctaaaggcattgaaaacgatacatttaagcgcgtatctgaaatgattgaggactctatctcttcagaacataatggaggaatcggcgtcttatcaggtccaagtcatgctgaagaagttgttataaaacaacctacaactgtagctgcatcatctaaagataataatgtgagcaaacttattcaagatttatttatgaacgactatttacgtgtttacacaaataatgatttagtaggtgtagaattaggtggtgctttaaaaaatattatagctatagctagtggtatcgttgccggcatgggttacggtgataatgcaaaagcagctttaatgacacgaggtttagccgaaatcagtcgacttggtgagaaacttggtgcagatccaatgactttcttaggtctaggtggcataggtgacttgatcgtaacttgtacgtccacacattcacgaaattacacacttgggtttaaattagggcaaggcaaaacagcagaagaagctttaaaagagatgaaaatggtggttgaaggtatgtatacaactaaatcagtatatcatcttgctcaacaagaaggagtagagatgcctatcactaacgcattatatgaagttttatttgaagatgtccctgtaagtaaaagtgttagaacacttatggaaagagacaaaaaagcagaataa

SEQ ID NO: 301 - DNA, 573 bp, Staphylococcus epidermidis
aagtatcaatatgatttaaatttattgttaccactcgttaaaattctaaaaaagaggtgttttagtaagatgattagattagcaactaaaaatgatttacttagtattactcaattagtcaaagatgctaaacagattatggaagaattcaacaacaaccaatgggatgatgaatatcccgcgaaagaacatgttgaagaagacatcgaatataaaacactatatgtgttagacgtggatcatacaatttatggtttgattgtgatcgaccaaaatcaatcggagtggtatgatgacattgattggcctgttaatccaaatggggcatacgttattcacagattacctggatcaaaacaatataaaggtgctgccactgaacttttccaatttgccattgacttagcaaatgaacatgatattcatgtcattttaacagatacatttgccctcaataaacctgctcaaggattatttgaaaagtttggttttactaaagttgatgagatagagatagattatcatccttttgatagaggggcacctttttatgcatattataaaaacatataa

SEQ ID NO: 302 - DNA, 1317 bp, Staphylococcus epidermidis
aaagaaaaatataggagtttggttatgaaaactacgattaaacaagcgaaaaaacatcttaaccaagaagtaacaattggtgcttggttaactaataaacgttcaagtggtaaaatagcgtttttacaattacgcgatggtacaggatttatgcaaggagtagtagtaaaatctgaagtagatgaagaaacatttcaactagcaaaagatataactcaagaatcatctttatacatcacaggaacgattacagaagataatcgttctgatttaggctacgaaatgcaagttaaatcaatcgaaattgtacatgaagcacacgattatcctattacaccaaagaatcatggaacagaatttttaatggatcatcgtcacttatggttacgttcaaaaaaacaacatgctgtcatgaaaataagaaatgaaattatccgtgcaacatatgagtttttcaatgaaaatggcttcactaaaattgatccacctattttaacagcaagtgcaccagagggaacaagtgagttattccatacaaaatatttcgatgaagatgcattcttatcacaaagtgggcagttgtatatggaagcagccgcaatggctcacggacgtgttttttcatttggcccaacttttcgtgcagaaaaatctaaaacacgccgtcatttaattgaattctggatgattgaaccagaaatggcctttacaaatcatgcagaaagcttagaaatacaagaacagtatgtgtctcacattgttcaatctgttttaaatcattgccaattagaactcaaagctttagatagagatacaactaaactagaaaaagttgctacacctttccctagaatttcttatgatgatgctatcgaattcttgaaaaaagagggattcgatgatattgaatggggtgaagactttggtgcacctcatgaaacagccatcgctaatcactatgatttaccagtattcattacaaattatccaactaaaattaaaccattctatatgcaaccaaatccagacaatgaagatacagtattatgtgctgatttaattgcgcctgaaggttacggtgaaattattggtggttccgaacgtattaatgatttagaattattagaacaacgcattaatgagcacgaattggatgaggaaagttatagctattatttagatttacgtcgctatggtagcgtaccacatagtggttttggcttaggcttagagcgaacagtagcttggatttctggagttgaacatgttcgtgaaacatccccattcccacgtttacttaatcgcttatatccataa

SEQ ID NO: 303 - DNA, 315 bp, Staphylococcus epidermidis
tataatgaatatcattataaaacctcaggaggtgaattcataatgaataaaactgatttaattaatgcagttgcagaacaagctgacttaactaaaaaagaagctggttcagcagtagatgctgtatttgaatctatccaaaactcacttgctaaaggtgaaaaagtacaattaatcggtttcggtaactttgaagtacgtgaacgcgctgctcgtaaaggtcgtaaccctcaaacaggtaaagaaattgacatccctgcaagtaaagtaccagcatttaaagctggtaaagcattaaaagatgctgtaaaataa

SEQ ID NO: 304 - DNA, 1725 bp, Staphylococcus epidermidis
gaaactggatacatcactatattaaggagaatgtacatgtttagaaagtctatgctcatcttaatgattgctgtcattttgttcgtaacagcatgtagcaaagataaaacgcaagatgaagcgaaaagaaaagcagatgctaaaggtaaaccagatacatggattgcagatagaaagcttaaaggacttgtgtttcaaagtgataacgatgcctcccctaaaatgaataaagaagtcgctcaagaacttaagaaaaagactggcatcacgttagaacttcaaaccgtttctaatgaagattccacagaagcattaacttcaggactcgcttcaggagatttacccgacttcatcgtttattacttagacgatagtggaagacctgaaatgaaagtactaaataaagcagcgaaacaaggtcgactcacagacttaacgaaaatgcttaaaaacacaaaaatttatagtaagtatttcaaaaaaggatatttaccaaaagatacgaaagataacatcatgtttaataaagaacaagatggaacgtaccttgtacatatggggattaaccgtcatccaggacaagaagaacgtcgcactgtaggtggtccttacgtcagaaaagatatcatggataaacttcatatcgaccctacttctatcaagacgtccaaagatgtagaaaaacttgctgaaaagatgaaagaacaccacttcaaagatgataatggtaaagaaatcacacctattggcccaacagcgtggggcggtgacgatcgtactaaattctataatgaccttgtgtggactggtcagtctgatgagaaatttttaaataaaggtaagaaaattatacatgaatcacaaaccgaatatccacttaaacgtgtacattacgttaaagaccttatgaagaaaggcttaatgacaaaagagttctatacaatggaagaaaataaagcaaaagaaggactcgttaatggctcatggggcattgtttcagatttacataactatgttactgaaaatcaaagtatgaaatacgttcctcttgggccactcaatacagtcaaaggtaaatttagagttgaaaagccatataaatcaggcgcaaacggttgggctgtaccaagtacgactgaacatcctgaagacgtcgttaaactcgctgatttccttgcaagtcgcagaggtaaattactcggtcagtacggtattaaaggacgtgactatacgttagataagaaaggtaaccctcatgttaaacctgaagtgttaaaagaagttgaaaataatccagacgaagctaaaaaacgtggttttagaggtgcgggttcttattgggcagatcatcttggttatactgatatagataataaagctgatttcggtgaaactgaatacggagataatacaaaaacgaaaaagacgactcctgaaaagattgctgatatgtggcattatgatcaaagacagaaacacgccaaaatcgtaaacggactcacagtaaagtcattcttatctaaatatgaatatggcgaagatttagaagttgcactcgatgattatagtgacgctattaaacgtgcttattattctcaatcagacaaggaaacgaaacaaattattgatagtgctaagcaacgtttagaagaggcaggcttaaatcaatttgaaagatacgttgaaaatcaaagagataaaaaaggaactcaaattatttattaa

SEQ ID NO: 305 - DNA, 774 bp, Staphylococcus epidermidis
ataattatgtataaaagaaatgaacgtttgaatcttattcgtaaacgtgttgatcagtacggacaggtggcagtaaaagatttagctatattcttacaagttacgcctgaaaccgtgagaaaagatttagaaaccttagaaaacgataaactgattacacgtacacatggaggtgcgatacaatacaatcatattaataaagagaaatcatatgcgaataagtggcagaaacaatcacaagtaaaagagcgtattgctaagaaagctgctttgcaaataaagtctggagaaattattgtcatcgatggtggaaccacaacagggcgaattcctcaatatctcaatgatattactcagaccacgattgtgacgaattctctgaagattgcggatgaattgaatcgtgctatagaggagcaacgaattcaagcagaagtgattatgcttgctggaaagacgaatactgaacaagatgttgtgcgcgggcatatgacgaatgagttattacaacgttttaaatttgataaagcttttatttcatgtggttcgtttgatacgagtgattgttatgaatttgatctggaagaagcgcatgcaagtcacattatgattcaaaaaagtcaactgagttatctcttagcggatagtagtaagcgagatgcgcatgcgtcgtatcgtattgatggttttagcgaaattgattatatgatttctgattatgctaaacctcagaatatagaatattttaatcagaagcattggttacagatttaa

SEQ ID NO: 306 - DNA, 1278 bp, Staphylococcus epidermidis
aataaaaatctccttgtttgtctaactgacttatgttgtgtgattgaatatgataatatattaaacatattacaatttaatgtattgaagaatagaaaggggcgtgcgatcatgagataccttacatccggtgaatcacatggaccacaacttacagtcatcatagaaggtgtaccagctaatttagaaattaaggctgaagatattaataaggaaatgtttaaacgtcaagggggatatggtcgggggcgtcgtatgaaaattgaaaaagatactatagaaattgtgtcaggcgtcagaaatggctttactttaggaagtccaataactttagtagttactaacgacgatttcactcattggagaaaaataatgggcgtcgcaccaattagtgatgaagaaagagaaaatatgaaacgtaccattacaaaacctagaccgggccatgctgatcttataggtggcatgaaatataatcatcgtgatttaagaaatgtgcttgagcgttcatctgctagagaaacagcagcaagagttgctgtgggtgctgtttcaaaaattcttttagaacaattagatatccacttatatagccgtgtagtcgaaattggtggtattaaagacaaaggtttatatgatgtagatatgttcaaaaataatgtagataaaaatgatgtacgtgtaattgacgaaaatattgcgcaacaaatgagagataaaatagatgaagcgaaaaaagacggagattcaatcgggggcgtagttcaagtaatggctgaaaacatgcctattggagtgggaagttatgtacactatgaccgtaaattagatggacgcattgcacagggtgttgtgagtatcaacgccttcaaaggtgtaagttttggtgagggatttaaagcagctgaaaaacctggtagcgaaattcaagatgaaattcattataatcaagattcaggctattttagagctacaaatcacttaggtggatttgaaggaggcatgagtaatgggatgcctataattgttaatggtgtcatgaagcctattcctactttatataaaccactaaactcagttgatattaatactaaagaagacttcaaagctactatagaacgctcagatagttgtgcagtgcccgcagctagcgtagtatgtgaacacgttgtcgcttttgagttagcaaaagcagtactcgaagagtttcaatctaaccacatggaccaactcgtagcacaaattaaagagcgtcgacaactcaacatagaattttaa

SEQ ID NO: 307 - DNA, 1116 bp, Staphylococcus epidermidis
ttaaatcttcaaaggagcaaagacatgatacaaatcaaggatttaaacaaagtttacgacaatggtagttacgcagttaaagatttcaatttagatattgaggacaatgaatttgtagtatttgtaggaccttcgggatgtgggaaatcaacaacgttacgtatgattgcaggacttgaagatgtgagcaaagggacaattagtatcaacgataaagtaatcaacgatttacaacctaaagatcgtaagattgctatggtctttcaaaactatgcattatatccacatatgacagtttataaaaatttagctttcggcttaaaaatgcgaggaatcaagaagaaaatttatgacgaaaaaattcaacatgcagctcaaatattagaaattgaaaacctcctcgaccgtaaacctaaagccttatctggaggacaacgtcaacgtgtggcacttggtcgagctatcgttagagaagctcaaatctttctcatggatgaaccactttctaatttagatgctaaattacgaagtaacatgagaagcgaaattataaaaatacataaacaaatgaaagcaacaacgatttacgtgacacacgaccaaactgaagctatgacaatggcatcacgtatcgtcatattaaaacaaggcgaaatacaacaaattggtacgcctgaagaaatttatcgtcatcctgtcaatgaatttgttgccactttcattggtagcccatcaatgaatatggttccaatgacctacaacatggatgcttggtacttcgatggacaaaaagtggctgatgctacattacttcaacttgcatcgcatgcacaatacagacttggtatacgacctgaagacttacatcttgttaatgataacgaaataagtaattatccaatccaactttctcaattcactgtagacttagttgagttaactggttcatacaaattacttcactgtcatcacaatgagcataaaatcatagcagctgtagatagtaatttggattttgaattaggacaaacagtttccttcggtataaaaacggaagatgcacactttttcgattctgattcaggcgaaagagtacaagaggaggttttatcatga

SEQ ID NO: 308 - DNA, 612 bp, Staphylococcus epidermidis
aaggtagttcatactaagatgtatcaatggctttgggaaacttcactttatcaaaaatggttgatttcttttattttaatttgcaatatatttggtacgatatacggttatcattggtatagtagtcaattagctaacacaccaaattattttaaattatttgttccagatagtcccactgctacattatttttatgtttatcattattattcatactatttaataagcgttatgccctgattgacgctttagcttttataactctatttaaatatggtagttgggctgtaattatgaatattttgatgtttataaaaatgaatgatattgccataaacggacttatgttgctcatttctcacgcaattatgatattagaagctatctatttttatcctcgttttaaaatatctaaattggctggattgatgagtttcatatgggtgacgatcaatgacgtaatagattacatatacggacaatatccctactatgattttatcgccaaacatttaattgaagtaggggtattggcttatagtctcactatcatttcgtatattttatttttaaaattacaaaagtggttgaaagttaaaacatttgattaa

SEQ ID NO: 309 - DNA, 198 bp, Staphylococcus epidermidis
agaagtaatcaaggaggcatgagtatgtctaatttatggattatatttgcagttactgtactaatagcagtttattccgcaattgaagtatttacaaatttaaatcataaacaacaaccaagatttaaatattttactatcgcatttgttgtgtttattatcttagcgattatagaagttatatttcttgctcaatga

SEQ ID NO: 310 - DNA, 240 bp, Staphylococcus epidermidis
aaattaaatcaaaaacaaacagaacctaagataacatatatacttcaggttctgctaacaaatagggcattgatgtctaaatttagcccttttattaagatttatttaactttggtcgtaggtcctatcattgagaatttcgctcgaaaattctacggacaaaccaaattgaatttcgaagctagttcagcacatggaactctgattcgcttttgtataactatatttctgatacaataa

SEQ ID NO: 311 - DNA, 1332 bp, Staphylococcus epidermidis
ggagggtgtcaattggatataaaaatgcctaagcttggtgaaagtgtgcatgaaggtacgattgaacaatggttagtatcagtaggagatcatgtagatgagtatgaaccattatgtgaagttattacagataaagtaacagctgaagtgccttcaacaatttctggaacaataacagaattagtggttgaagaaggacaaactgtcaatattaacacggtgatttgtaaaatcgattcggaaaatggtcaaaatcaaacagaatcggcaaatgagtttaaggaagaacaaaatcagcattctcaatcaaatataaacgtgtcacaattcgaaaataatcctaaaactcatgaaagtgaggtgcatacagcctctagtcgcgcaaataacaatggacgattttcaccagttgtctttaaattagcttctgaacatgatattgatttaacacaagtcaaaggaactggttttgaaggtcgtgttactaagaaagatattcaaaatattattaacaatccaaacgatcaagaaaaagagaaagaatttaaacaaacagataaaaaagatcattcaacgaaccatggtgactttttacatcaatcctcaactaaaaacgaacactcaccatcatcaaatgaacgtgtcgtaccagttaaaggtattagaaaagctatcgcacaaaatatggttactagtgtcagcgaaataccacacggttggatgatggttgaagctgatgcaacgaatttggttcagactagaaactatcataaagctcaatttaaacagaatgagggttacaatttaactttctttgcgttttttgtaaaagctgttgcagaggctttaaaagtaaatccattactcaatagtacatggcaaggagatgaaattgttatccacaaagatattaatatctctattgctgttgcagacgatgataagttgtatgtgccagtcattaaaaatgcagatgaaaaatcaattaaaggtatcgcgcgtgaaatcaatgatttagctactaaagcaagattaggaaaattagcacaaagtgatatgcaaaacggtacatttacggttaataatactggttcttttggttctgtttcttcaatgggaatcattaatcatccacaagctgccattttacaagtagaatcagtcgttaagaaacctgtagttatagatgatatgattgcaattagaaatatggttaatttgtgtatttcaatcgatcatcgtattctcgatggtgttcaaacgggaaaatttatgaatcttgttaagaaaaaaatagaacaatattctattgaaaacacttctatttattaa

SEQ ID NO: 312 - DNA, 696 bp, Staphylococcus epidermidis
aaaataagtcatatactaaaaatgtatcatattttaattagaaaggggcttttaaatatgaagactgttttgattgtaggcgcaaatggtagagtatctatcgaagcgacaaaaattttcctagagaactcaagatttaatgttgatttatttttgagaaatgcgcatcgtatacctgattacgcctctaatagaattaaagtttatgagggagacgctaaaaatattgaggatttagaaagtgctttaaacaatgttgatgttgtttttgcaagtttatcgggatcacttgataaacaagctgaaactatcgtaaaagccatggataacaaaaatgttaagagactgatttttgtagcagctcctggtatttatgatgaactaccagaaccattcaatcaatggaataaagaacaatttggcgaaaaattgaatcgctaccgcaaagcatctgatattatagaaaattcagatttagattacacaataatacgtccaggctggcttacagataaaaatgaaaatgtatatgagatcacagcaaagaacgaaacatttaaaggtactgaagtatcacgtaaaagtgtagcatctttagcagtacaaattgccaaaaacccagaactacactctaaagaaaatattggtgtgaataaacctaatacagaaggtaataaacctgcttggttcaattag

SEQ ID NO: 313 - DNA, 1416 bp, Staphylococcus epidermidis
agaaaaatccatagaaacagtacgtggcgtagggtatgtgattcgatgattaagcgccaaaaattaaaatataaatggatgcttattacgacgctcattaccttcacgacaatattacttttctgcttaattattattttctttttaaaagatactttacgaagtagtgaaattgacgaagctgaaagaagttcaaatgatatcgccaatctgttccattctaaatctttaagtgatatatctgcattggatttaaatgcatccttagaaaattttcaagaaatattgatttatgatgataagggtaggaagttaattcaaacatcaaatgataatacacttgcttatgataacaaaattgatttcaaacatcctgaacgtatacatattcaaagaagccacggtattaattacttagtaataactgaacctatacgttcgaaagatttttctggatacagtgtattagtccattctcttcaaaattatgataatctcgttaaatcactttatatagttgcacttgcttttggattaattgcaaccattattactgccggcgtgagttatatcttttcttcacaaattactaaaccgatagttacaatgtccaataaaatgaatcaaattagaagagatggttttcaaaataaacttgaattaactacaaattatgaagaaacagataatttaattgatacttttaatgaaatgatgtatcaaatagaagaatcttttaatcagcaacgtcaatttgtcgaggatgcttcacacgaattaagaacgccactgcagattattcaaggtcatctaaatttaatccaacgttgggggaaaaaagatccagcagttttggaagaatctttgaatatttcaattgaagaagtgaatcgaataacaaaacttgtcgaagaactacttttacttaccaaagatagagtcaatcataatgttttggaatgtgaaaatgtagacgtaaatagcgagattcaatcacgtgtgaagtcactgcaacacctacatccagattatacttttgaaacacatcttgctactaagcctatccaattaaaaattaaccgtcatcagtttgaacaactcttactcatatttattgataatgcaatgaaatacgacactgaacataagcacattaaaattgttactcaactaaaaaataaaatgattatgattgatattactgatcatggtatgggtataccaaaagctgacttagaatttatctttgatagattttatcgtgtagataaatcacgtgctcgtagtcaaggaggcaatggattaggactatcaatagcggaaaaaattgtgcaacttaacggtggtatgattcaggtagaaagtgaactacaaaagtacacgactttcaaaatcagttttccagtactaaactaa

SEQ ID NO: 314 - DNA, 732 bp, Staphylococcus epidermidis
aatatgtcccaaatgatgtttgacaatttcctctcaagttctcgcgcaaaatggggtgagcgttcaggtttaacacttttcttaccacatgtttttgaaggacagggaccagagcattcatcggcacgcttagaaagatttctacaattagccgctgaaaataattcaactgtagttaatctatctagtgcaagtaattacttccatttactacgtgcacaagccgctagtttagataccttagaaatgagaccattaattgtcatgtcacctaagagtcttttaagaaataaaacagtagctaaacctattgatgagtttacatctggcggttttaaacctatcatcacagaagatatcgatgaacaaaaagtcaaaaaagtgattttagcatcaggaaagatgtatattgacctaaaagaatatttagctaaaaatcctaacgattctattcttctcatagcagtagaaagattatatccgttcccagaagaagaaattaaagaagtattaaaatcgttacctcatcttgaaaatgtgtcatgggttcaagaagaacctaaaaatcaaggtgcatggttattcgtgtatccttatctaaaagcacttgttgctaataaatatgatttaacttatcacggtagaatacaaagagctgcacctgctgaaggcgatggagaaattcataaacttgtacaaactaaaattattgaaagtagcattaacaattaa

SEQ ID NO: 315 - DNA, 567 bp, Staphylococcus epidermidis
cgtaaatttaaacaaacagataacttaaggagggaatataacatggcatatgcgacactagctggaggttgtttttggtgcatggttaaacccttcacctcatatcctggaataaaatcagtcgtttccggatatagtggaggacatgtagaaaatccaacatacgaacaggtatgcacaaatcaaacaggacatgtggaagctgtacaaattgaatatgaccctaatattacaacatttgaaaatatcttagacgtttactttaaaacatttgacccaactgatgacggagggcagttctttgatagaggtgaaagctatcaacctgtcattttttatcatgatgagaatcaactcaaagctgccgagttaaagaaacaacaaattgacgaagagggtatctttaaaaaacctgttatcacaccgataaaaccatataaaaatttctatcctgcagaagaatatcatcaagattactacaaaaagaatcctacgcattatgaacaataccaacgtggatctggtagaaaagcatttatcgaatcacactggggaggctcaaaatga

SEQ ID NO: 316 - DNA, 1683 bp, Staphylococcus epidermidis
ttttttaataacataggaggagatattatgaaaagaaattggtggaaagaagcagttgcatatcaagtatatccacgaagttttaatgatagtaatggagatggaataggtgatctacctggattaattgaaaaattagattatctagaaaatttaggaatagatgtcatttggttaagcccaatgtatccatcaccaaacgatgataatggatatgatattagtgactacaaaggcattatgagtgaatttggtacaatgaacgattttgatcaattgttatcaagcatacatcaaagagggatgaaattaatattagacttagtggttaatcacacatcagatgaacacccttggtttattgaatcaaaatctagtaaaacaaatgcaaaaagagattggtatatttgggcagatcctaaaccggatggatctgaacctaataactgggaaagtatctttaatggttcaacttgggagtttgacgaatcgactaagcaatactatttccatttatttagcaaaaagcagccagatttaaattgggaaaatccagatgtaagacaagctgtgtttgaaatgatgaattggtggtttgaaaaaggtattgacggatttagagttgatgccattactcatattaaaaagaattttgaagcaggagatttacctgtacctgatggcaaaaaatttgctccagcatttgatgtagatatgaatcagccaggaatacaagaatggctccaagaaatgaaagataaatcgttaagtcggtatgacattatgactgtaggcgaggctaatggtgttactcctaatgatgctgaagaatgggtaggagaagaaaatgggaaatttaatatgatattccagtttgaacatcttggtttatggagtactggcgatacgaaattcgatgttaaatcctataaacaagtcttaaatcgttggcaaaagcaactagaaaatgtaggttggaatgctttatttatcgaaaaccatgatcaaccacgtcgtgtttcaacctggggtgatgataaaaattattggtatgaatcagcaactagtcacgctactgcctactttttacaacagggcacaccttttatttaccaaggtcaagaaataggtatgactaattatccatttgaaagcattgaaagtttcaacgatgtcgcagtgaaaactgaatatcaaatagtcaaaaaagaaggtggagatgtcaatcaattactagataaatataaaatggaaaaccgagacaatgcaaggactccaatgcaatggaataattctatcaatgctggattcactactggtaagccatggtttcatgtaaaccctaactatacagaaattaatgttaaacaacaactaaatgataagttttcgatactttcttattataaagcgttaattcaactaaaaaaatctgatttgatttacacctacggtaagtttaatatggtcgatgctgaaaataagcaggtttttgcatatacacgcacatttaaaaacaatactgtattaattgtagccaatctcacaaatgaagtatcagaactaaacctaccttttgaattagatatttcatctgtagatataaaattgcataattatcacttaaatgatataaatttagaccatattaaaccttatgaatcattcgtcgttgaaatataa

SEQ ID NO: 317 - DNA, 240 bp, Staphylococcus epidermidis
tgtgacagtaagctaatggttaagaattattcattttatcaatttattatgaccgtgcgcggaagaaaagacgataaaggtgtttttgctgagcaaatttttgaagaccttgcctttccaaaacacgaagatgattttaatacattatctgaatatattgagacacatagcgaattcaccctaccaatgtctgtatttgatgacttatatgatgactatacagaatggttgaagttttaa

SEQ ID NO: 318 - DNA, 849 bp, Staphylococcus epidermidis
atagaattcaaaattgaaggagttgagttgaatatgaaacttgtattttatggtgctggtaatatggcgcaggcaatttttactggaattattaattccaacaatttaaatgcaaatgatatttatttaactaataaatccaatgaacaagcattaaaaagctttgcagaaaaattaggggttaattatagttatgatgatgaagcattactcaaagatgccgattatgtatttttaggtacaaagccccatgattttgaaaatttagctaatcgtattagagaacacattactaatgataataggtttatttctataatggcaggtttatctattgattatattcgtcagcagcttaataccaataatccattagctcgtattatgccaaatacaaatgctcaagttggacattcggttactggaataagtttttcaaataattttgatcctaaatctaaaaatgaagtggatgaattaatcaatgcatttggatcagttatagaagtctccgaagaacatctacatcaagttactgcaattacaggaagtgggtctgcatttttatatcatgtatttgaacaatatgtaaaagcaggtacagaattaggtttagaacgaaatcaagtcgaagaatctatacgcaatttaattattggaacaagtaaaatgattgagcgttcagacttaagtatgtctcaattaaggaaaaatattacatctaaaggtggtactacacaagctggacttgatgcactatctcaatatgatattgtatcgatgtttgaagattgtttaggtgcagctgtgaatagaagtatggaattatcacataaagaagatgaataa

SEQ ID NO: 319 - DNA, 366 bp, Staphylococcus epidermidis
agaatggtcaatgtagcagattattctcaatctaatttaggaaaaattgaaatagcaccagaagtattatctgttatcgcatccattgcgacatcagaagtagaaggtattacaggccattttgctgaactaaaaaaaacaaatctagagaagattagtcgaaaaaatttaaacagagatttaaaaatcgaagctaaagaagacggaatatacattgatgtattttgttctttaaaacatggcgtaaatatttctaaaactgcaaatcaaattcaatcagcaattttcaattcaattacgacaatgacagctattgaaccacagcaaattaatattcacatcagaagtatcgtcgcagaaaaataa

SEQ ID NO: 320 - DNA, 195 bp, Staphylococcus epidermidis
cataaggccaagatttgcgccgaagtttacaggagcctctgtaaattctttcttgttcttagtcatttaacaccctccacaaaaatgatgaaacgcttacatggttatcatagcattatttcatatattgttaaagtacatttacctattattatacaaaataggagcaagacagaatttactccaaattcatag

SEQ ID NO: 321 - DNA, 1035 bp, Staphylococcus epidermidis
tggtcaagcaattcatgtatagttggaggtaaaaaaatgatagattacaagtcagcaggccttacagaagaagacctcaaaaaaatatataaatggatggacttaggaagaaaaacagacgaaaggctatggttactcaatcgtgcaggtaaaattccatttgttgtcagtggtcaagggcaggaagcaactcaaattggtatggcatatgcaatgcaaaaaggtgatatctcatcaccttattatcgtgatttagcatttgtcacttatatgggaatttctccattggatactatgttatcagcttttggaaaacgtgatgacattaactcaggaggtaaacaaatgccttctcattttagtcacaaagaaaaaggcattttatctcaaagttctccagtagccactcaaataccacattctgtcggtgctgcattagcacttaaaatggataacaagccaaatattgctaccgcaacagttggagaaggcagttcaaatcaaggtgactttcacgaaggtatgaactttgctgcagttcacaaattacctttcgtctgtgtaataattaacaataaatatgcgatatctgtaccagattcactacaatatgctgctgaaaagttatcagatcgtgcattaggttacggtatgcatggaatacaggtagatggaaatgacccaattgcagtatacaaagcgatgaaagaagcaagagaacgagcgctagcaggtgaaggtccaacattgatagaagctgtcacttcacgtatgacaccacattcatctgatgatgatgatacatatcgtacaaaagaagaaagagacctattgaaacaagaggattgtaatataaaatttaaaacggccttactcgatcaaggcatcataaacgaaaattggttgagtcaattggaaaaagagcataaagaactcattaatgaagctactaaatctgctgaagcagcaccatatccttcagaagaagaagctttgacatatgtttatgaagagggaggtcaacgaaatgactaa

SEQ ID NO: 322 - DNA, 30549 bp, Staphylococcus epidermidis
atgaagagcaaaccgaaattaaacggtcggaacatctgctcttttttattgagcaaatgtatgagttattcattgtcaaaattatcaacattaaaaacgtataattttcaaatcacatcaaacaacaaagaaaaaacatcaagaataggagtggcaatagctttgaataatcgtgataaattacaaaaatttagtattcgaaaatacgcaattggaacattttctactgtgattgcaacacttgtgttcatgggtatcaatacaaaccatgcaagtgccgacgagttgaatcaaaatcaaaagttaattaaacaattaaatcaaacagatgatgatgattcgaatacgcatagtcaagaaatcgaaaataacaaacaaaattctagtgggaagactgaatcattacgttcatcaactagtcaaaatcaagcaaatgcacgactgtcggatcaattcaaagacactaatgaaacatcgcaacaattacctacaaatgtttcggatgatagtatcaatcaatcgcatagtgaagcaaatatgaataacgaaccattgaaagttgataatagtactatgcaagcacatagtaaaatagtaagcgatagcgatgggaatgcttctgaaaataaacatcataaactaacagaaaatgtacttgcagaaagccgagcaagtaaaaatgacaaagagaaagagaatctacaagagaaagataaatcgcagcaagtacatccaccattagataaaaatgcattacaagctttttttgacgcatcatatcacaattacagaatgattgatagagatcgtgcggatgcaacagaatatcaaaaagtcaaatctacttttgactacgtcaatgacttactaggtaataatcaaaatattccttcagaacagcttgtttcggcatatcaacaattagagaaagcattagaacttgcacgtacgttaccacaacaatctactacagaaaaacgtggtagaagaagtacgagaagtgttgttgagaatcgttcatcaagaagcgattacttagatgctagaactgaatattatgtttcaaaagacgatgatgattctggtttccctcctggtactttcttccatgcttcaaatagaagatggccttataatttaccaagatctaggaacatcttacgtgcttctgatgtacaaggtaatgcttatatcactacaaaacgacttaaagatggatatcaatgggatattttatttaatagtaatcataaagggcatgaatatatgtactattggtttggacttccaagtgatcaaacaccaactggtccagtaactttcactattatcaaccgtgatggttcaagtacatctactggtggcgttggatttggatcaggtgcaccactacctcaattttggagatcagcaggtgctattaattctagcgtagcgaatgattttaaacatggctccgctacaaattatgcattttatgatggtgttaataatttttctgactttgctagagggggagaattatacttcgacagagaaggcgctacacaaactaataaatattatggcgatgaaaacttcgcattgctaaatagtgagaaaccagatcaaataagaggattagatacaatatatagttttaaaggtagtggtgatgtaagttatcgtatttcatttaaaactcaaggagctccaactgcaagattgtattatgctgctggcgcgcgttctggtgaatataaacaagcaacgaactataaccaactctatgtcgaaccttataagaattatcgaaatcgagtacagtcaaatgtccaagttaaaaatcgtacacttcatttaaaaagaacaatcagacaattcgatcctacattacagagaactactgatgttcctattttggatagtgacggttccggaagtattgattcggtatacgacccattaagttatgtaaagaatgtgactggtacagtcctaggtatttatccatcttatcttccttataatcaggaaagatggcagggagctaatgcaatgaatgcctatcaaattgaagaacttttttcacaagaaaatcttcaaaatgcagcacgttcaggccgtccaattcaatttcttgtaggttttgatgttgaagatagccatcataaccctgaaactcttttaccagtaaatttatatgtaaaacctgagttaaaacatacaattgagttatatcacgataatgaaaaacaagatagaaaggaattttcagtatcgaaacgagcgggccatggtgttttccaagtaatgagtggaacgcttcataacactgtaggatcaggaatattaccttatcaacaagagatacgtatcaaacttactagtaatgaaccaattaaagatagtgaatggtctattacaggatatcctaacacgcttacattacaaaacgctgtgggtagaacaaataatgctactgaaaaaaacttagctcttgttggtcatattgatccaggaaattatttcatcactgttaagtttggtgataaagtagaacaatttgaaattagatcaaaaccaactccaccaagaatcattacaactgctaatgaattacgtggaaatcctaaccataagcctgaaataagagtaacagatataccaaatgatactactgctaaaatcaaacttgtgatgggcggaaccgatggcgatcatgatccagaaataaatccatatactgtccctgaaaactacacagtagttgcagaagcataccatgataatgatccaagtaaaaatggggtcttaacattccgttcatcagactaccttaaagatctaccattaagcggtgaattaaaggcaattgtttattacaatcaatatgtacaatcaaactttagtaatagcgttccgtttagtagcgatacaacaccacctacaattaatgaaccggcaggactagttcataagtattacaggggagatcatgtagaaattactcttccagtcactgataatactggcggttcaggtttaagagatgtaaacgtcaatttacctcaaggttggacaaaaacctttacaatcaatcctaataataatactgagggtacgcttaagttaattggtaatatacctagtaatgaagcatataatacgacatatcatttcaatattactgcaaccgataattctggaaatacaacaaatccagctaaaacctttattttaaatgttggtaagttggctgatgatttaaatccagtcggattatctagagatcaactacaattagtgacagacccttcttcattatctaattccgaacgagaagaggtaaaaagaaaaataagtgaagcaaatgctaatataagatcatatttattacaaaataacccaatactcgctggagtaaacggcgatgttacattttattatagagatggttctgtagatgttattgatgctgaaaatgtaatcacatatgagcccgaaagaaaatccattttcagtgaaaatggtaatacaaataaaaaagaagcagtaatcactattgctagaggacaaaactataccattggtccaaacttaagaaaatatttctcattaagtaatggttcggatttacctaatagagatttcacctctatatcagctattggatctttaccttcatcgagtgaaattagtcgactcaatgttggaaattataactatagagttaatgctaaaaatgcttatcataagactcaacaagaacttaatttaaaacttaaaatagtagaggttaatgcacctactggtaataatcgtgtatatagagttagtacttataatttaactaatgatgaaatcaataaaatcaaacaagcatttaaagcagctaattctggacttaatttaaacgataacgatatcactgtttcgaataactttgaccatagaaatgttagtagtgtgacagtaactatacgtaagggcgatttgataaaagagttttcatcaaatctcaataatatgaatttcttacgttgggttaatataagggatgattataccatttcgtggacttctagtaagattcaaggtagaaatacagatggtggattagaatggtcaccagatcataaatcacttatttataaatatgatgcaacattaggtagacaaataaatactaatgacgtgttaactttacttcaagcaacagctaaaaactcaaatttacgttcaaatatcaatagtaatgaaaaacagttagcagaacgagggtctaatgggtattctaaatctataattagagatgatggcgagaaatcttatttacttaactcaaatcctattcaagtattagacttagtagaaccagataatggttacggtggacgtcaagtcagtcattctaacgttatatataatgaaaaaaattcttctatcgtaaatggtcaagttccagaagctaatggggcatccgcttttaatattgataaagttgttaaagctaatgcggcaaataatggtattatgggtgttatctataaggcacaattatacttagcaccatacagtccaaaaggttacattgaaaaattaggccaaaatttaagcaataccaataacgtgattaatgtttattttgtgccttctgataaagtaaatcctagtataactgtaggtaattacgaccatcatacggtatattctggtgaaacatttaaaaatactatcaatgtaaatgataattatggattaaatacagtagcttctacaagtgatagtgcaattactatgaccagaaacaacaacgagttagtaggtcaggctcctaatgttactaatagcataaataaaattgtaaaagttaaagccacagataaaagtggaaatgaaagtattgtttctttcacagtaaatataaaaccattaaacgagaaatatagaataacaacttcatcaagtaatcaaacaccagtgagaattagtaatattcaaaacaatgctaacctttcaattgaagatcaaaatagagtaaaatcttcactcagcatgactaaaattttaggtacaagaaattatgtcaatgagtcaaataatgacgttcgtagtcaagttgtaagtaaagtaaatagaagtgggaacaatgctacagttaatgttacaactacattttctgatggtacaactaatacaataaccgttccagttaaacatgtgttattagaagttgtacctactactagaacaacagtaagaggacaacaatttccaaccggcaaaggaacttccccaaatgatttctttagtttaagaacgggaggtccagttgatgcgagaatagtttgggttaataatcagggacccgatataaatagtaatcaaattggtagagatttaacattacacgctgaaatattctttgatggtgaaacaacaccaattagaaaagatactacttacaaacttagtcaatctattccaaagcaaatatatgaaacaactatcaatggtcgatttaattcatcaggtgatgcatatccaggaaattttgttcaagcagtaaatcaatattggccagaacatatggacttcagatgggcccaaggatcaggcacaccaagttctcgtaatgcaggttcatttactaaaacagttacggtagtttatcaaaacggccaaactgaaaacgttaatgtactattcaaagtcaaaccaaataaacctgttattgatagtaatagtgtgatttcaaaaggacaattaaatggtcaacaaattttagttcgaaatgttccacaaaatgcacaagtcactctatatcaatcaaatggaactgttattcctaatacaaatacaactatagattctaatggtatagctactgtaacaattcaaggcactctaccaaccggaaatattactgctaaaacctcaatgacaaataatgtaacgtacactaaacaaaatagtagtggaattgcttcaaatacaactgaagatataagtgttttttcagaaaacagtgatcaagtaaatgttaccgctggcatgcaagctaaaaatgatggtattaaaataattaaaggtacaaactataattttaatgacttcaatagtttcataagtaatataccagcccattctactcttacatggaacgaggagcctaatagttggaaaaacaacatcggtactacaacaaaaactgttacagttactctacctaatcatcaaggtacgagaactgtagatattccaataacaatctatccaacagttacagctaagaatccagtaagagatcaaaaaggacgaaacttaaccaatggtactgacgtttataattatattatttttgaaaataataaccgtcttggaggaacagcttcttggaaagacaatcgtcaacctgataaaaacatagccggtgtacaaaatttaattgcacttgttaattatcctggcatatctacaccattagaagttcctgttaaagtgtgggtatataattttgatttcactcaacctatctacaaaattcaagtaggagatacattccctaaaggaacatgggcaggctattacaaacatcttgaaaatggagagggattaccaatagatggttggaaattttattggaaccagcaaagtacaggaactactagtgatcaatggcaatcattagcatatactagaactccttttgttaaaactggtacttatgatgtcgttaatcctagcaactggggtgtttggcaaacatcacaatcagctaaatttatagttacaaatgctaaacctaatcaaccaaccataactcagtctaaaactggtgatgtaacagtaacacctggtgctgtgcgtaatatactaataagtgggacaaatgattatatccaagcatctgcagataagattgttattaataaaaatggaaataaattaactacatttgttaaaaataatgatggtcgttggactgttgaaactgggtcacctgacataaatggtatcggaccaacaaataacggaactgctatatctttaagtcgattagcagttagacctggggattcaatagaagcaatagcgactgaaggttccggagaaactataagtacttcagcaactagtgaaatttatattgtcaaagctccacaacctgaacaagtagcaactcatacttatgataatggaacattcgatatattacctgacaattcacgtaattctttaaatccaactgaacgtgtcgaaattaattacactgaaaaattaaatggcaatgaaacacaaaaatcattcactattactaaaaataacaacggcaaatggacgataaataataaaccaaattatgtcgagttcaatcaggataatggtaaagttgtattttcggccaatacaattaaacctaattctcaaattacaataactcctaaagcaggtcagggtaacactgaaaacacaaatcctactgtaattcaagcacctgcgcaacatactttaacaatcaatgaaattgttaaagaacagggtcaaaatgtgactaatgatgatattaataatgcggttcaagtgccaaataaaaatagagttgcgattaaacaaggaaacgctcttccaacaaatttagctggtggtagtacatcacatattccagtagttatttattacagtgatggaagttctgaagaagctactgagactgttagaactaaagttaataaaaccgaattaatcaatgctcgtcgtcgactagatgaagaaattagtaaagagaacaaaacaccatcaagtatcagaaactttgatcaagctatgaatcgtgctcaatcacaaattaatacagctaaaagtgatgctgaccaagttataggcacagaatttgcaacacctcaacaagtaaattcagctttatctaaagttcaagcggcacaaaataaaataaatgaagctaaagcattattacaaaacaaggctgataatagtcaacttgtgagagcaaaagaacaattacaacaatcgattcaaccagccgcttcaactgatggtatgactcaagatagcacaaggaactacaaaaataaacgccaagcagctgaacaagcaatacaacatgcaaatagcgttataaataatggagatgcaacatcccaacaaattaatgatgctaaaaacacagttgaacaggcacagagagattatgttgaagctaaaagcaacttacgtgctgataagtcacagttacaaagcgcttatgatacgttaaatagagatgttttaacaaatgataaaaagccagcatctgtaagacgctataatgaagccatttcaaatattagaaaagaattagatacagctaaagcggatgcaagtagtactttgcgaaacaccaatccttccgttgaacaagttagagacgctttaaataaaataaatactgttcaacctaaagtgaatcaagcaattgctttacttcaaccaaaagaaaataattcagaacttgtacaagctaaaaaacgtttacaagacgctgtaaatgacatacctcaaacacaaggtatgacacaacaaacaattaataattataatgacaaacaacgtgaagctgaaagagcacttacatctgcacaaagagtgattgataatggggatgctacaactcaagaaattacttctgaaaaatctaaagtagagcaagcaatgcaagctttaactaatgctaaaagtaatctgagagctgataagaatgagttacagactgcatataacaaattaattgagaacgtatctaccaatggtaaaaaaccggcgagtatacgtcaatacgaaacagccaaagccagaatacaaaatcaaattaatgatgctaaaaatgaagcggagcgaattttaggtaatgataatccacaagtatcacaagtaactcaagcattgaacaaaatcaaagctattcaaccaaaattaacagaagctatcaacatgcttcaaaacaaagaaaataatacagaattagtcaatgctaaaaacagacttgaaaatgcagtaaatgatacagatccaacacacggtatgactcaagaaacaattaataattacaacgctaaaaagcgagaagctcaaaatgaaatacaaaaagcgaacatgattattaataatggagatgctactgctcaagatatttcttctgaaaaatctaaagtagagcaagtattacaagcattacaaaatgctaagaatgacttaagagctgataaaagagaattacagactgcatacaataaacttatacaaaatgttaataccaatggtaaaaaaccatctagtattcaaaactataagtctgcaagacgaaatatcgaaaaccaatataataccgctaaaaatgaagcacataatgttcttgaaaatacaaaccctactgtaaatgcagtagaagatgctttacgtaagataaatgcaattcaaccagaggttacaaaagctattaatatacttcaagataaagaagataatagcgaacttgttagagcaaaagaaaaattagatcaagcgattaatagtcaaccatcactaaatggtatgactcaagaatctattaataattacacaacaaaacgtagagaagcacaaaatatagcaagttctgctgacactattattaataatggggatgcatctattgaacaaataacagaaaataaaattcgagttgaagaggcaactaatgcacttaacgaagcaaaacaacatttaacggcagatacaacttctttaaaaactgaagtacggaaattaagtaggagaggcgacacaaacaacaaaaagcctagcagtgttagtgcttataacaatactattcattcgctacaatctgaaattacacagactgaaaatagagcaaatactatcatcaataagcctattcgttctgttgaagaagtaaataatgcattgcatgaagtaaaccaattgaaccaacgcttaacagatacaattaacttattacaacctttagcgaataaagaaagcttaaaagaagctcgtaatcgacttgaaagtaaaattaatgaaaccgttcaaacagacggtatgactcaacaatctgttgagaattataagcaagctaaaataaaagctcaaaatgaatctagtattgcacaaactcttattaataatggtgatgcatctgatcaagaagtttctacagaaatagaaaaattaaatcaaaagctgtctgaattaacaaattcaatcaatcacttaacagttaataaagaacctttagaaactgccaaaaatcagttacaagcaaatattgaccaaaaacctagcactgatggtatgacgcaacaatctgtacaaagctatgaacgtaaactacaagaagccaaagataaaataaactcaattaataatgtcttagctaacaatccagatgttaatgctatcagaacaaacaaagttgagacggaacaaatcaataatgaattaacacaggcgaaacaaggtcttactgttgataaacaaccattgattaatgcaaaaactgctttgcaacaaagtctagataatcaaccaagtactactggtatgactgaagcaacaattcaaaattataacgctaaacgtcaaaaagcagagcaagttatacaaaatgcaaataaaattattgaaaacgctcaacctagtgtacaacaagtgtctgatgagaaatctaaggtagagcaagcactcagtgaattgaacaacgccaaatcagcgcttagagctgataaacaagaattacagcaagcatataatcagttgattcaaccaacggatttaaataataagaaaccagcttctatcactgcgtacaatcaaagatatcaacaatttagtaacgaattgaacagcactaaaacaaatacagatcgcattttaaaagagcaaaatccaagtgtagctgatgtcaacaatgcactaaataaagtaagagaagtacaacaaaaattaaacgaagccagagcacttttacaaaataaagaagataatagtgcactagttcgagccaaagaacaacttcaacaggcagttgaccaagtcccttcaacagaaggtatgacgcaacaaactaaagatgattacaattcaaaacaacaagctgctcaacaagaaatatcaaaagcacaacaagttatcgataatggcgatgcgactacacaacaaatttctaacgccaaaacaaatgttgaacgcgctttagaagcattaaataatgcaaaaactggtttaagagcagataaagaggaacttcaaaatgcatataatcaattaactcaaaatattgatacgagcggtaaaacgcctgcaagtatcaggaaatacaatgaagctaagtcacgtattcaaactcaaattgattcagctaaaaatgaagcaaacagtattttaacaaatgacaatcctcaagtatcacaagtgactgctgcgttaaacaaaataaaagctgttcaacctgaattagataaagcgatagcaatgcttaaaaataaagagaataataatgcattggttcaagcgaaacaacaacttcaacaaattgttaatgaagtagatccaacacaaggcatgacaacagatactgctaataactataaatcaaaaaaacgtgaagctgaagatgaaatacaaaaagctcaacaaatcattaacaatggcgatgccactgagcaacaaattactaacgaaacaaatagagtaaatcaagcgattaatgcaataaacaaagccaaaaacgatttacgtgctgataagtctcaattggaaaatgcttataaccaattaatacaaaatgttgatacaaatggtaaaaaacctgctagtattcaacaataccaagctgctcgacaagctattgagacgcaatacaataacgctaaatcagaagcacatcaaattcttgaaaatagtaacccttcagttaatgaagtagcacaagcattacaaaaagttgaagctgtacaacttaaagttaatgacgcgattcatatacttcaaaataaagagaataatagtgcacttgtcacagctaaaaatcaacttcagcaatcagttaatgatcaaccattaacaacaggtatgactcaagattctattaataactatgaagctaagagaaatgaggctcaaagtgctatcagaaatgcagaagctgtcatcaacaatggcgatgcaactgcaaaacaaatttcagacgagaaatctaaagttgaacaagcactagcacatttgaatgatgctaaacagcaattaactgcagatactactgaattacaaacagcagttcaacaattaaacagaagaggcgatacaaataataaaaagccaagaagtatcaatgcatataataaagcaattcaatcattagaaacacaaattacttctgctaaagataatgccaacgctgtgatacaaaaacctatacgtactgttcaagaggtaaataatgcattacaacaagtaaatcagttgaatcaacaattaactgaagcaattaatcaacttcaaccgctatcaaataatgatgcattaaaagctgcaagattaaatttagaaaataaaattaatcaaactgtacaaactgatggtatgacacaacaatctatagaggcttatcaaaacgctaaacgcgtagcccaaaatgaatctaacactgctttagcattaattaataacggcgatgccgatgaacaacaaattacaactgaaacagaccgagtcaatcagcaaactacaaacttaactcaagcaattaacgggttaacagttaataaagaaccattagaaaccgctaaaacagcgttacaaaataacatcgaccaggtacctagtacagatggtatgactcagcaatctgttgcaaattataatcaaaaactacaaatagctaaaaacgaaattaacacaattaataacgttttagcgaacaatccagatgttaatgcaatcaaaacgaataaagcagaagcggaacgaatcagtaacgatttaacacaagctaagaataacttacaagttgatactcaacctttagaaaaaataaaaagacaacttcaagatgaaattgatcaaggtactaacacagatggaatgactcaagattcagtggataattacaatgatagcttaagtgcagcaattatagaaaaaggcaaagtaaataaattacttaaacgtaatccgacagtagaacaagttaaagagagcgttgctaatgcacaacaagtcatacaagatttacaaaatgctcgaacttcacttgttccagacaaaactcaacttcaagaagctaaaaatagattagaaaacagtattaaccaacaaacagatactgacggcatgactcaagattcgcttaacaattataatgataaattagcaaaagctagacaaaaccttgaaaaaatatctaaagttttaggtggtcaacctactgtagctgaaattagacaaaatacagatgaagcaaatgcacataaacaagcattagacactgcacgttctcaacttacattaaatagagagccatatatcaatcatattaataatgaaagtcatttaaataacgcgcaaaaagataattttaaagctcaagttaactcagcacctaatcataatactttagaaacgattaaaaataaggctgatactttaaatcaatctatgacagcattaagtgaaagtattgcagattacgaaaatcaaaaacaacaagaaaattatttagatgcatctaacaataaacgtcaagactatgacaatgcagtcaatgcggctaaaggtattttaaaccaaactcaaagtccgacaatgagtgctgatgtgattgatcaaaaagctgaagatgttaaacgtacgaaaactgcgttagatggaaatcaaagattagaagttgctaaacaacaagcacttaatcatttaaataccttaaatgatttaaacgatgctcagcgacaaactttaactgatactataaatcactctccaaacatcaattcagtgaatcaagctaaagaaaaagctaatactgttaacacagcaatgactcaactgaaacaaactattgctaactatgacgatgaattgcatgacggcaattacattaatgcagataaagacaaaaaagatgcttataataacgctgttaacaatgctaaacaactgattaatcaatctgatgctaatcaagcacaacttgatccagctgaaattaataaagttacacaaagagtcaatacgactaaaaatgatctaaatggtaatgacaaattggctgaagctaaaagagatgctaatacaaccattgatggtttaacttatctaaatgaagctcaacgtaacaaagctaaagaaaatgtaggcaaagcttctacaaaaacaaatattacgagtcagttacaagattacaatcaattgaatattgctatgcaagcattacgtaacagtgtgaacgacgttaacaatgttaaagcaaatagcaattatataaatgaagataatggtccaaaagaagcttacaatcaagccgttactcatgctcaaacattgataaatgcacaatctaaccctgaaatgagccgtgacgtagtaaatcaaaaaacacaagcagtaaatactgcccatcagaatttacatggacaacaaaagttagaacaagcacaaagtagtgctaatacagaaatcggtaacttaccaaacttaactaatactcaaaaagctaaagaaaaggaactggtaaatagtaaacaaactcgtacggaagtacaagaacaacttaaccaagctaagtcactagatagttctatgggcacgttaaaatcattagttgctaaacaacctacagtacaaaaaacaagtgtttatattaacgaagatcaacctgagcaatctgcctacaatgattccattacaatgggacaaactataattaataaaacagctgatccagtacttgataaaactttagttgataacgcaatcagtaacatttcaactaaagagaatgcactgcatggtgaacaaaaattaacaactgctaaaacggaagcaattaatgcacttaatacattagctgatttaaacacacctcagaaagaggctattaaaacagctattaacactgctcatacaagaactgatgtaactgcagagcaaagtaaggctaatcaaataaatagtgcaatgcacacgttgagacaaaacatttctgacaacgaatcagtaacaaacgaaagtaattatattaacgctgaacccgaaaaacaacatgcctttactgaggctctaaataatgctaaagaaatagttaatgaacaacaagccactcttgatgccaattcaattaaccaaaaagcacaagcgattcttactactaaaaatgctttagatggtgaagaacaattacgtcgtgctaaagaaaatgccgatcaagaaatcaatacgttaaatcaattgactgatgcgcaaagaaatagtgaaaaaggtttaatcaacagttctcaaactagaacagaagttgcttctcaattagcaaaagctaaagaactaaataaggtgatggaacaactgaatcaccttatcaatggtaaaaaccaaatgataaatagcagtaaatttatcaatgaagatgcgaaccaacaacaagcatattcaaatgcgattgcaagtgcagaagcgcttaaaaacaaatcacaaaaccctgaattagataaagtaacaattgaacaagcaattaataatattaattctgcaattaacaatctaaacggtgaagctaaactgactaaagctaaagaagatgctgttgcttcaataaacaacctaagcggattaacaaacgagcaaaaaacaaaagaaaatcaagccgttaatggcgctcaaactagagaccaagttgctaataaattacgtgatgctgaagcattagatcaatcaatgcaaacattacgtgacttagttaacaatcaaaatgcaatacattcaacaagtaattattttaacgaggattcaactcaaaagaatacttatgataatgcaattgataatggctcgacatatataactggtcaacacaatccagaattaaataaatctactattgatcaaacgattagccgaattaacacagctaaaaatgatttacatggtgtagaaaagttacaaagagataagggaactgctaatcaagaaattggacaattaggttatttaaatgaccctcaaaaatctggtgaggaatccttagtcaacggttcaaatacacgttctgaagtagaagagcatcttaatgaagctaaatcattaaataatgcaatgaaacaattaagagataaagtagctgaaaagactaatgtcaaacaaagtagcgattacattaatgattcaactgaacatcaacgtgggtatgatcaagcacttcaagaagcagaaaatattattaatgaaatcggtaatccaacattaaataaatcggaaattgaacaaaagttacaacaattgactgacgctcaaaatgcgttacaaggttcacatctattagaagaagctaaaaataatgcgattactggaatcaataaacttacagcattaaatgatgcacaacgtcaaaaagcaattgaaaatgttcaagcacagcagacaatcccagcagttaatcaacaattaactttggatagagaaataaatactgcaatgcaagctttacgagataaagtaggccaacaaaataacgttcaccaacaaagtaattatttcaatgaagatgaacaaccaaaacataactatgataattctgtacaagccggtcaaactattattgataaacttcaagatccaatcatgaacaaaaatgaaattgagcaggctattaatcaaatcaatacgactcaaacagcgttaagtggagaaaataaattacacactgaccaagaaagcacaaatagacaaatagaaggtttatctagtttgaacacagctcaaatcaacgccgaaaaagatttagtcaatcaagctaaaacaagaacagatgttgctcaaaagttagctgcagctaaagaaataaattctgctatgagtaatttaagagatggcattcaaaataaagaggacatcaaacgtagcagtgcatatatcaacgcagatccgactaaagttacagcttacgatcaagcactacagaacgcagaaaatatcatcaatgccacaccaaacgtagagcttaataaagctacaattgaacaagcgctatcacgcgttcaacaagcacaacaagatcttgatggtgttcaacaattagctaatgctaaacaacaagctacacaaactgtcaatgggttaaatagcttaaatgacggtcaaaagcgtgaattaaatctattaattaattcagctaatacccgtacaaaagtacaagaagaattaaacaaagcaactgaattgaaccatgcgatggaagctttaagaaacagtgttcaaaacgttgatcaagtaaaacaaagtagcaattatgtcaatgaagatcaacctgaacagcacaattatgataatgctgtcaatgaagctcaagctacaatcaacaacaatgctcaacctgttctagacaaattagctatagaacgtttaactcaaactgttaacactacaaaagatgcattacatggtgctcaaaaactgacacaagaccaacaagctgctgaaactggaatacgtggtttaacgagtctcaatgaacctcagaaaaatgctgaagtagctaaagtaactgcagcaacaacacgtgatgaagtgagaaatattcgtcaagaagcaacaacattagatactgcaatgcttggtttacgtaaaagcattaaagataaaaacgatactaaaaatagtagtaaatatattaatgaggatcatgaccaacaacaagcttatgacaatgctgtaaataatgctcaacaagttatcgatgaaactcaagcaacgttaagctcagatacaatcaatcaattggcaaatgccgtaactcaagctaaatctaatcttcatggagatactaaactacaacacgataaagatagtgctaaacaaacgattgctcaattacagaatttgaattcagctcaaaaacatatggaagattctttaattgataatgaatctacacgtacgcaagtccaacacgatttaacagaagctcaagctttagatggtttaatgggtgccttaaaagaaagtattaaagattatactaatattgtttcaaacggtaattacatcaatgcggaaccatctaagaaacaagcatatgatgcagctgtacaaaatgctcaaaatataataaatggaacgaatcaaccaacaattaataaaggtaatgtcactacagcaacacaaaccgtgaaaaatactaaagatgccttagacggtgatcatagattagaggaagctaaaaataatgccaatcaaacaatcagaaatctatctaatttgaacaatgcccaaaaagatgcagagaaaaatctagttaatagcgcatcaacattagaacaagttcaacaaaacttacaaaccgctcaacaattagataatgctatgggtgagttacgacaaagtattgctaaaaaagatcaagtgaaagcagatagtaaatatctaaatgaagatcctcaaattaagcaaaactatgatgatgcagttcaacgtgttgaaactattattaacgaaactcaaaaccctgaattacttaaagcaaacattgaccaagcaactcaatccgttcaaaatgcagaacaagctttacatggtgctgaaaaattaaatcaagacaaacaaacgtcttcgacagaactagatggattaacagatttaacagatgcacaacgtgaaaaactcagagaacaaattaacacttctaatagtagagatgatattaagcaaaaaattgagcaagcaaaagcactaaatgacgcaatgaaaaaacttaaagaacaagttgcgcaaaaagatggtgttcatgctaacagtgattatacaaatgaagattctgcacaaaaagatgcgtataataatgcacttaaacaagcggaagacattattaataacagctcaaatcctaacttaaatgcacaagacattactaatgctttaaataatattaaacaagcacaagataaccttcatggagctcaaaaattacagcaagacaaaaatacaactaatcaagccattggtaacttaaatcatcttaatcaacctcaaaaagatgcgcttatacaagctattaatggagctacatctagggaccaagttgcagaaaaacttaaagaggccgaagcgcttgatgaagctatgaaacaacttgaagatcaagtgaatcaagatgatcaaatttcaaatagcagcccattcataaatgaagactcagacaaacaaaaaacttataatgataaaatccaagctgcaaaagaaataattaatcaaacatctaatccaaccttagataaacaaaaaattgctgatacacttcaaaatattaaagatgcagtgaataatttacatggtgatcaaaaattagctcaatctaaacaagatgctaataatcaattaaatcatttagatgacttaaccgaagaacaaaaaaaccattttaaaccgttaattaataatgctgatactcgagatgaggtaaataaacaactagagattgctaaacaattaaatggtgatatgagtacacttcataaagtcataaatgataaagatcaaattcaacatttaagcaattacattaatgctgataatgataaaaaacaaaattatgataatgctattaaagaagctgaggatttaattcataatcatccagatacattagatcataaagcattacaagatttattaaacaagatagaccaagcgcataacgaattaaatggagaatccagatttaaacaggctttagacaatgctttaaacgacatagatagcttaaacagtctcaatgttccacaacgccaaactgttaaggataacatcaaccatgtgacaactctagaaagtttagctcaagaattgcagaaagcaaaagagcttaatgatgctatgaaagcaatgagagatagcattatgaatcaagagcaaattcgtaaaaatagcaattatactaatgaagacttagctcaacaaaatgcctataatcatgcagtagataaaataaatcacattattggtgaagacaatgcgacgatggatcctcaaataatcaaacaagcaactcaagatataaatacagctataaatggattaaatggagatcaaaaacttcaagatgcaaagacagatgctaaacaacaaattactaactttactggtttaactgaaccacaaaaacaagcattggaaaacatcattaaccaacaaacaagcagagcaaatgttgctaaacagttaagtcatgctaaattcttaaatggaaaaatggaagaattaaaagttgcagtagccaaagcgtcattagtaagacaaaatagtaactatattaatgaagatgtctctgaaaaagaagcatatgaacaagctatcgcaaaaggtcaggaaataattaattcagaaaataatccaacaataagtagtactgatatcaatcgtaccattcaagaaattaatgatgctgaacaaaatcttcatggtgataataaattaagacaagcacaggaaattgcaaagaatgaaatacaaaatctagacggattaaattcagctcaaataacaaaattaatccaagatataggcagaacaacaactaaacctgcagtaactcagaaactagaagaagcaaaagcaataaaccaagctatgcaacaacttaaacaaagtatagccgataaggatgctactctaaattctagtaactatctcaatgaagattctgagaaaaagttagcgtacgataatgctgtaagccaagctgaacaactcataaatcaacttaacgacccaactatggatataagtaatattcaagctattactcaaaaggtcattcaagcaaaagattcattgcacggtgcgaataaacttgcacaaaatcaagcagattcaaatttaataataaatcaatcaacaaatttaaatgataaacaaaagcaagcattaaatgacttaattaatcatgctcaaactaaacagcaagtggcagaaataattgcacaagctaataagttaaataacgaaatgggcacactaaaaacactcgtagaagaacagtcaaacgttcatcaacaaagtaaatatattaatgaagatccgcaagttcaaaatatttataatgactccattcaaaaaggtcgagaaatattaaacggcactacagatgatgttttaaacaacaataaaatagcagatgccattcaaaacattcatttaactaaaaacgatttacatggtgatcaaaaattacaaaaagcacaacaagatgcaaccaatgaattaaactatttaacaaatctaaacaattctcaaagacaaagcgagcatgatgagattaactctgctccttcaagaactgaagtttctaatgatttaaatcatgctaaagcacttaatgaagctatgcgtcaacttgagaatgaagttgctcttgaaaacagtgttaaaaaattaagcgactttatcaatgaagatgaagcggcacaaaatgaatatagtaatgcacttcaaaaagctaaagacattatcaacggcgttccaagtagcactttagataaagctacaattgaagatgctttattagaattgcaaaatgctagagaaagtttacatggtgagcaaaaacttcaagaggctaaaaatcaagctgttgctgaaattgataatttacaagcattaaatcctggacaggttcttgctgaaaaaacattagttaaccaagcatcaaccaaaccagaagttcaagaagccttacaaaaagcaaaagaacttaatgaagctatgaaagcactgaaaactgaaataaataaaaaagaacaaatcaaggctgatagtagatatgtaaatgctgacagtggtcttcaagcaaattacaattctgcgttaaattatggttctcaaattattgcaactacccaaccaccagagcttaataaagatgtaataaatagagcaactcaaacgattaaaactgctgaaaataatttaaatgggcaatctaaattagcagaggctaagtcagacggaaatcaaagcatcgaacatttgcaaggattaacacaatcacaaaaagataaacaacatgatttaattaatcaagctcaaactaaacaacaggtagatgatatcgtaaataactctaaacaattagataactctatgaatcaactacaacaaattgttaacaatgacaatacagtaaaacaaaatagtgatttcattaatgaagattccagccaacaggatgcttataatcatgcaattcaagcagcaaaagatttgataactgctcatccaactatcatggataaaaatcaaatagatcaagctattgaaaatatcaaacaagcacttaatgatttacacggtagtaataaactatcagaagataaaaaagaagcttcagaacaactacaaaaccttaatagcttgacgaacgggcaaaaagatacgattttaaatcatattttcagtgcaccaacaagaagccaagtaggagaaaaaattgcaagtgctaaacaattaaataatacaatgaaagcacttagagattctattgctgataataatgaaattttacaaagtagtaagtacttcaatgaagattctgaacaacaaaatgcttataatcaagccgtaaataaagctaaaaatataattaatgatcaaccaacaccagtaatggcaaatgatgagattcaaagtgtcctaaatgaagttaaacaaactaaagataatttacatggtgatcaaaaacttgctaacgacaagacagatgctcaagcaacattaaatgcgttaaattacttaaatcaagcgcaaagaggtaatcttgaaactaaagttcaaaactctaattctagaccagaagtacaaaaagtagttcaattagcaaatcaacttaatgatgcgatgaaaaaattagatgatgctttaactggtaatgacgcaataaaacaaacgagtaattatattaatgaagatacttctcaacaagttaactttgatgagtatacagatagaggtaaaaacatagttgctgaacaaacaaatccaaatatgtctccaactaatattaacactattgctgataaaattactgaagctaaaaacgatttacatggcgtacaaaaactaaaacaagctcaacaacagtccatcaatactattaatcaaatgactggtctaaaccaagctcaaaaagaacaattaaatcaagaaattcaacaaactcaaacccgttctgaagtacatcaagtaattaataaagcacaagctttaaatgattcaatgaatactttacgtcaaagtattactgatgaacatgaagttaaacaaacaagtaactacatcaatgaaactgttggtaatcaaactgcatataacaatgccgttgatcgtgtaaaacaaataatcaatcaaacatctaatccaactatgaatcctttagaggtggaacgtgcaacatcaaatgtaaaaatttctaaagatgcacttcatggtgaacgtgaattgaatgacaataaaaattcaaaaacttttgcagtcaatcacttagataacctcaatcaagctcaaaaagaagcattaactcatgaaattgaacaagcaactatagtttcacaagtaaataatatctataacaaagcgaaagctttaaataatgatatgaaaaaacttaaagatatcgttgctcaacaagataatgtgagacaatcaaacaattatataaacgaggatagtacacctcaaaatatgtacaacgatacaattaatcatgcacaatcaatcattgatcaagtagcaaaccctacgatgtctcatgacgaaatagagaatgcaatcaataacataaagcatgccatcaatgcactcgatggagaacataaattacaacaagcaaaagaaaatgcaaacttattgattaatagtttaaacgatttaaatgcaccacaaagagatgccataaatagattggttaatgaagctcaaacaagagaaaaagtagctgaacaacttcaaagtgctcaagctttaaatgacgctatgaagcatttaagaaacagcattcaaaatcaatcatccgtaagacaagagagcaaatatattaatgcaagtgatgctaaaaaagagcaatataatcacgcagttagagaagtcgaaaatattatcaatgaacaacatccaacattggataaagaaataattaagcaactaacggatggtgtaaatcaagcgaataatgacttaaatggcgttgaattattagatgctgataagcaaaacgcacatcaatcgatacctacattgatgcacttaaatcaagcacaacaaaacgcattaaatgaaaaaattaataacgcagttaccagaactgaagttgcggctattattggccaagcaaaactactcgatcatgctatggagaatttagaagaaagtatcaaagataaagagcaagtcaaacagtcaagtaactatattaatgaagattctgatgttcaagaaacatacgataacgccgttgatcatgtgacagaaatacttaatcaaacagtaaatccaactttatctattgaagatatagagcatgctatcaacgaagttaatcaagcgaaaaaacaactcagaggtaaacaaaaactttatcaaactatcgatttagctgataaagaattaagtaaattggatgatttaacatcacaacaaagcagttcaatatctaatcaaatatatactgctaaaacgagaacagaagttgcccaagcaattgaaaaagcaaaatcattaaatcatgcaatgaaagcacttaacaaagtatataaaaatgcagataaagtgttagatagtagtcgattcattaacgaagatcaacctgaaaaaaaggcgtatcaacaagctataaatcatgttgattcaatcattcatagacaaacaaatcctgaaatggatccaacagtaatcaatagcataactcatgaactcgaaacagctcaaaataacttacatggtgatcagaaacttgctcatgcacaacaagatgccgctaatgtaattaatggtctaattcatcttaatgttgctcaacgtgaggtaatgataaatacgaatacaaatgctacaacacgcgaaaaagttgcaaagaacttagataatgctcaagctcttgataaagctatggaaacactacaacaagtagttgctcataaaaataatatattgaacgatagtaaatatttaaatgaagattcaaaatatcaacaacaatacgatcgagttattgctgatgccgaacaactacttaatcagacaacaaatccaacattagaaccttataaagtcgatattgttaaggataatgtcctagctaacgaaaaaatactatttggcgcagaaaaactatcatatgacaaatcaaatgcaaatgatgaaattaaacatatgaattatcttaataatgcacaaaagcaatctataaaagatatgatttctcacgcagcattaagaactgaagttaaacaacttctgcaacaagctaaaatccttgatgaagccatgaaatcacttgaagataaaactcaagtagtgattacagatactactttgcctaattacactgaagcttcagaggataaaaaggaaaaagtagaccaaactgtatcacatgctcaagcgattattgataaaataaatggctcaaatgtaagtttagatcaagtacgacaagcactagaacaattaactcaagcatcagaaaacctcgatggtgatcagcgagttgaagaagctaaagttcatgctaatcaaacaattgatcaattaacacatcttaattcattacaacaacaaactgcgaaagaaagtgttaaaaacgcaacaaaactagaagaaatcgctactgttagtaacaatgctcaggcattaaacaaagtaatgggtaaattagaacaattcattaatcatgctgattctgttgaaaatagtgataattatagacaagccgacgacgacaaaatcatcgcttatgatgaagcacttgaacatggacaagatatacaaaaaactaacgcaacccaaaatgaaacaaaacaagcgttacaacaattaatatatgcagaaacatcgttaaatggtttcgaaagattaaatcatgctagaccacgagctttagaatatatcaaatcactagaaaaaataaacaatgctcaaaagtctgctttagaggataaagtaacgcaatcgcatgatttattagaattagaacatattgtcaacgagggcacaaacctcaatgacattatgggtgaattagctaacgcaatcgttaataactatgctccaaccaaagcaagtataaattatattaacgccgataacctacgcaaagataactttactcaagctatcaacaatgcacgtgatgcactcaacaaaactcaaggtcagaacttagatttcaatgcaattgatacatttaaagatgatatattcaaaactaaagatgcacttaacggtattgaacgtttaacagctgcaaaatcaaaagcagaaaaactaattgatagtttaaaatttattaataaagctcaattcacacatgcaaatgatgaaattatgaatactaattctattgcacaattgtctagaatcgtgaatcaagcatttgatttaaatgatgcaatgaaatctttaagagatgaacttaataatcaagcttttcctgtccaagcaagctcaaattatataaattcagatgaagatttaaaacaacaatttgaccatgctttaagtaatgctcgaaaagttcttgcaaaagaaaatggtaaaaatttagatgaaaaacaaattcagggactcaaacaagtgattgaggatactaaagatgctttaaatggtatccaacgtttatcaaaagctaaagctaaagcaattcaatacgtacaatctttatcttatatcaatgatgcacagcgtcatattgctgaaaataatattcacaactctgatgatttatcatctttagcaaatacattatctaaagctagtgatttagataatgcaatgaaagacttacgagatactatagaaagtaattcaacttctgttccaaatagtgtgaattatattaatgctgataagaatttacaaattgaatttgatgaggcgctacaacaagcaagtgcaacaagttctaaaacttcagaaaatccagcaacgattgaagaagtattaggtcttagtcaagccatttacgatacaaaaaatgcattaaatggtgaacaacgacttgcaactgagaagagcaaagatctaaaattaataaaaggattaaaagatttaaataaagcacaacttgaagatgtcacaaacaaggtaaattcagcaaatactttaacagagttatctcagctcactcaatcaacgttagaattaaacgataaaatgaaattattgagagataagcttaaaactttagtaaatcctgttaaagcaagtttaaattatagaaacgctgattataatttaaaacgtcaatttaacaaagctttaaaagaagctaaaggcgtattaaataaaaatagcggtacaaatgtcaatatcaatgacattcaacatcttttaacacaaatagataatgctaaagaccaattaaatggtgaacgacgtctaaaagaacatcaacaaaaatctgaagtatttattattaaagaattagatatacttaataatgctcaaaaagctgcaataattaatcagattagagcgtctaaagacattaaaataattaatcaaatcgttgataatgcaatagaattaaatgatgctatgcaaggtttaaaagaacatgtagctcaattaacagcaactacaaaagacaacattgaatatttaaatgctgatgaagaccataaattacaatatgattacgctatcaacttagcgaataatgttcttgacaaagaaaacggtacaaataaagacgctaatatcataattggaatgattcaaaacatggatgatgctagagcacttctaaatggaattgaaagacttaaagatgctcaaacaaaagcacataatgacattaaagatacgctcaaacgtcaacttgatgaaattgaacacgctaatgcaacatcaaattctaaagctcaagctaaacaaatggtaaatgaggaagctagaaaagcgctttctaatattaatgacgcaacatcaaatgatttagttaatcaagcaaaagatgaagggcaatctgcaattgaacacatacatgcagatgaattacctaaagcaaaactagatgctaatcaaatgattgaccaaaaagttgaagatataaatcacttaattagtcaaaatccaaacttatcaaatgaagaaaaaaataaactaatatctcaaattaataagttagtaaatggaattaagaatgaaattcaacaagctataaacaaacaacaaatagaaaatgctacaacaaaactagatgaagtcattgaaactactaaaaaattaattatcgccaaagcagaagctaaacaaatgataaaagagttatcacaaaagaaacgagatgcaataaataacaacactgatttaacaccttctcaaaaggcacatgctttagcagatattgataaaacagaaaaagatgcacttcaacatatcgaaaattctaattcaattgatgatatcaataacaataaagagcatgcatttaatactttagctcatatcattatttgggatactgatcagcaaccattagtttttgaagtacctgaattgagccttcaaaatgctctagtaacaagtgaggtggttgttcacagagatgaaactatttcattagaatctataaaaaaaaaaatgactttaactgatgaacttaaagtcaatattgtttcattaccgaacactgataaagtagctgatcacctaaccgctaaagttaaggttattttagctgatggctcatatgtcactgtaaatgttccagtcaaagttgtagaaaaagaattacaaatagctaaaaaggatgctataaaaacaattgatgttctggtaaaacaaaaaatcaaagatatagattctaataacgaattaacgtctactcaacgtgaagatgcaaaagctgaaattgaaagattgaaaaagcaagccatcgataaagtgaatcattcaaaatcgattaaagatattgaaacagtaaaacgaactgattttgaagaaatagatcagtttgatcctaaacgctttacgctaaataaagctaaaaaggatatcattactgatgttaatactcaaatccaaaatggtttcaaagaaattgaaacaataaaaggtttaacttctaatgaaaaaactcagtttgataaacaattaactgcactacaaaaagaatttttagaaaaagtcgagcatgctcataatttagtagaattaaatcaattacaacaagagtttaataatagatataaacatattttaaaccaagcacatttactaggtgaaaaacatatagcagaacataaattaggatatgttgtagtaaacaaaactcagcaaatactaaataatcaatctgcttcttactttataaaacaatgggcacttgatagaattaaacaaattcaactagaaacgatgaattcaattcgtggtgcgcataccgtacaagatgtacacaaagcattattacaaggtatagagcaaatcttgaaagtaaatgtaagtattataaatcaatctttcaacgattccttgcataactttaattatcttcattcaaaatttgatgctagattaagagaaaaggatgttgcaaaccatatcgtacaaactgaaacattcaaagaagttctaaaaggaacgggtgttgaaccaggtaaaatcaacaaagaaacacagcaaccaaaacttcataagaatgataatgatagcctattcaaacatttagttgataatttcggcaaaactgtaggtgttattacattaactggtttactttctagtttctggttagttttggctaaaagacgtaaaaaagaagaagaagaaaaacaatcgataaaaaatcatcacaaagatattcgtctttcagatactgataaaatagatccaattgtaataactaagcgtaaaatagataaagaagaacaaattcaaaacgatgacaaacattcaattccagttgctaaacataagaaatctaaagaaaagcaattgagtgaagaggatattcattcaatccccgtcgttaagcgtaaacaaaacagtgataaccaaagatacaaaacagaagaaagttacttctaa

SEQ ID NO: 323 - DNA, 570 bp, Staphylococcus epidermidis
aaccaattaaaaggaacgtgtttaaatatgagattaaacgaaaaaacaatcgatagaacagttatatataatggtagtattattgatttagaagtacatgatgttgaattacccgatggtagcacatctaaacgtgaacttgtatttcatcatggtgcggtggcagtgtgtgcaataactcctgaaaatgaagttttattagttaaacaatttcgtaagcctgcagatcaaccacttttggaaattcccgcaggcaaattagaaaagggtgaagatcgtaaagaagcggctattagagaactacaagaagaaacaggatatattgcttcagatttgcaatttgtcactaatatgtatgggtctcctggattttcaagtgaaaaactttctatatacttcacagaccaattaacggttggagaaaccaatttagatgatgatgaatttgtggagcttcacaaagtacctttaagtcaaatcgattcattgttaaaagataataaaattgaggatgccaaaacaatcattgcattgcaacatctattattaaattataatcattctaaataa

SEQ ID NO: 324 - DNA, 1170 bp, Staphylococcus epidermidis
tgtcagttaaaatatatttatacaagtaaaaagggggtaccatatatgattaatcaaaaacgtttattagattgttttctagaattagtgcaaattgattcggaaacagggcacgaagaaacaattcaaccttatcttaaagatacgtttgaaaaaatggggctccatgttattgaagatgaagcttcaaaaaataatagattaggtgctaacaatcttatttgtacgttaaaaagtaatataagtcatcagaatgtgccgaaaatttattttacaagccacatggatactgtcgttccaggaaaaaacatccaacctgtagtaaaagaagatggatacgtttatagcgatggaactacgatactcggggcggacgataaagccggtcttgcggcaataattgaagcgattaaacaaattaaggaatcaaatttgccacacggacagattcaaataattattaccgtgggagaggaatctggattagtaggtgctaaagcaatagatactcgccttcttgatgcagatttcggctatgctgtagatgcaagtaaagatgttggaactactgttatcggtgctccaactcaagtaaagatttatacaactataaaagggaaaaccgcccatgcaagcacacctaaaaaaggtattagcgcaataaatattgcatcaaaagcaatcagtcgaatgaaattgggacaagtcgatgcattaacaacagccaatataggtaaatttcacggaggttctgccactaatattatagctgatgaagtcactttagaggcagaagcacggtcacatgatgatcaaagcattaataaacaagtgaaacatatgaaagagactttcgaaacgacagcaaatgaattaggcggtcaagctgaagtgttagttgaaaaaagttatccgggatttgaagttagtgaagctgacaaagtaacacaatatgctatatctagtgcattagccctcggtctaaaaggtgatacttgtattgctggtggtggttcagacggcaacatcatgaatcaatatggcattccttctgtgattttaggagtaggatatgaaaacatacatactacttcggaaagaatagcaataaaggatatgtatatgctcacaagacaaataataaaaattattgagctagtagctgaataa

SEQ ID NO: 325 - DNA, 1902 bp, Staphylococcus epidermidis
agagggataaaaatgagtgatcgttttataaaattcaacgatgaacaattagatgcaaaacaagtaatgatgttacaagacttagcacgtttacttttaaaaaatgagcaaacgcaagttaaaatacaaaaattcccttactataatccttatagtaatacactcattgcgagttggttttggtctcatagaccgaaacatattgaacaagctggactaaaaacagatgtcttactcgcaacgtatggatatctgaatatggatctttcaatcatcaatcaagttttacacaacaacgattttgaacaccctaagttctttcatcaattatttaaacttttagaggacgtacgtatatttgaacatattagacaacaaagacctagtactacaaaaatgattgatttacgcatagaaacacgattatcttttacagaatctcaaattaatttctacaaaactaaaactgtatatactgatttactttttctttatttagaacatgcatttttaagtcaaaacttttttaatattccatccatacatccagcatttgatgatattttagttcatatgtatcagtacttaccaaatatttttcagaatcaaacatcagaagataatatgtatttagcagaacgtattatgtatcaagtggatgatttattaaaggaagatatgctaaatgaatattactacttacctcaaaaattatatgaagatatttatgcagatagttttgaagacttaaagcgtacagatgcgagcaatactgatggtaaagataatcaacagacagacgaagatgtagaaacagctgaagctgaaacaaaagccgcagacagtgagtctaaaggcggggcatatttagaaatggagctacatgagggtgaaaacagtgaagttatggctgataatgatacggctcgagaaggcgacagcactgatgatatgactgatatgatgaccaaaaaaggaaaagggtcagaaaatacacttgatcatgatgaaggtggatttataggacaaaaccaagcttttgctttaaaaggcattaataaagacgtaagtattgaatggaatatccctgatattacacctcaaaatgtgatagattatcaatattcaaaaaatgatgtacagtttgaaattaaagatttaatacaaattatcaaaaagaccatcgacagagaacatgaagatgaaagacataatttaacaaagggccgtttacaaaaagaccttattaattggtttattgatgatcaatttaagttattttacaaaaaacaggatttaagtaagacattcgatgcaacatttaccttactcattgatgcatcagcgagtatgcacgataaaatggatgaaacgattaaaggtgtcgtcttgttccatgaaacattaaaatctttgaatattaaacatgaaatactagcatttaatgaagatgcttttgaagctgaccaacgtcaacaaccaaatatcattgatgaaatcattaattataattactctatctttgaaaaagaaggcccacgtatcatgacattagaacctcaagatgataatcgtgacggcgtagctatcagaattgcgagcgagcgtttattacaaagaagtcatgaacaacgctttttaatcgtattctcagatggtgaaccgtctgcatttaattacagtcaagatggtattttagatacgtatgaagctgttgaacgtgcgcgtaaatttggtatagaagtatttaatgtctttcttagccaagagccaattactgaagacattgaacaaaccattcataacatatatggccaatttgctttatttgtagaaggtgtggaacatttaccgagtcacttatcaccattactaaaaaaattgttacttaaatctttataa

SEQ ID NO: 326 - DNA, 417 bp, Staphylococcus epidermidis
agaggagtaaaagtaatggctaaaatatattttgatgctgcgactaaaggaaatcccggccgaagtgcttgtgcgattattattaaagaaaattcacaaagatatacatttacccatgatttaggtaaaatggataatcatagtgcagaatgggcagcaatgttacacgctttggaacatgcacgcgaattaaaagtatctaacgcgttactttatactgattcaaaattaattgaagatagtatgatgcaaggtaaagttaaaaatgctaagtttaaagtttattttgaaaacatagaaatcttagagcaaagttttgatttgatgtttgtgagatggattccacgaaagcaattttttttttgtttatcaacttgctcaacaaacactataccaacttacatcacaataatctaa

SEQ ID NO: 327 - DNA, 759 bp, Staphylococcus epidermidis
ttaaccaaaaaggagagtcaaatgagtaaagaacaagagagattacaaaaaagaatcgctaatagcggatatacatctcgtcgaaaagcagaagtacttatcactgaaggacgagttaaagtcaatggacaaactgtaacagaattaggttccaaagtgatgccatcagatttagttgaagttgatggtattaaaatcgaacaagaagacaaaatttatattttattttataaaccaactcaagtcattacaagtgtctctgatgatcgtggacgtagggtggttacggattactttgatgatctagaatcacgtatttatccggttggacgattagattatgacacatctggagttttattattaactaatgatggagaatttactaatttgatgacacatcctcgatatcacattaaaaagaaatacgttgctaaattaaaaggttatttaatgagagaggaaattaagcaacttgaaaaaggaatagaattagaagatggttacacacaaccagcacaagttaaaataaaaaagcaagataaagaaaaaaatacgactttagttgaaattacaattagtgaagggcgaaatagacaagttagacgtatgtttgagtatttcggtcatcaagttaataagttaacaagaattcaatttggccctatagatttaaaaggtttgaacgccggtgaaggaagagttcttacaccacatgaagtaaaaatattaagacatttggcagaaaacggtaaataa

SEQ ID NO: 328 - DNA, 990 bp, Staphylococcus epidermidis
ttcaggcgaaagagtacaagaggaggttttatcatgagtaaaaacaaaaaacaaagccttcaatccgctcatcaaaaacctttgttaaaaagaatgtgggaacacaaagtactttacttaatgattttaccttgtttactctttttcttgattttcaactatattccaatgacaagtcttgttctggcattcaaagatttccgcttcgatactggtatcatcggcggtgattggaaagggctatactattttaaacgctttttctctgaccctcgatgtattcaaattattatgaatacgctaattataagtggcatgaaattgattttagctctaccatttccaattattttagccattatgtttaacgaaattaaagattctaaattaggtaagatcagaggtttatttcaaggcgtactttacatccctcattttttatcttgggttgtagttatcagtattttcaagaaattactcgctccagatgatggacttatgaatcaactgatccatcaatttggtggcgacgggtcgacttactttatgatgaaccctgagtatttccacaccatcatgttttctagttatatatggaagaatgtagggtgggattccattatttattttgcagcaattatgagtattaatcctgaaatttatgaatcagctgcgattgatggcgcgaatcgtttcaaacaaattatacatattaccttacctatgttaacaccaacaattgttattttattcatcatttctctaggcgatattttaaaagcagggttcgatcaaatttacctactcaaaacaccaggtaacgctaacgtttcagaaatactggatacatttgtgattcgtactggtattgagcaaggcgatttcagttacgcaattgcgattagtctattacagggtgtgataggacttatcgctgtcgtcattattaataaattcgcagataagaaactggatacatcactatattaa

SEQ ID NO: 329 - DNA, 246 bp, Staphylococcus epidermidis
ctagggggaaaaataagtatggcagaggtaaaagttccagaattagcagaatcaatcacagagggtaccattgcagaatggttaaaaaatgtaggcgataatgtagataaaggtgaagctatcttagaactagaaacagataaagttaacgtcgaagtagtttctgaagaagctggggtattatcagaacaattagccgaggaaggcgatacagttgaagtatgtcaagctgtagctgtagtatga

SEQ ID NO: 330 - DNA, 417 bp, Staphylococcus epidermidis
cgtttgatgaactcactgacttcatcaacgacttgcagtggtctcaagatcaaagtttcgaatgaggtggaaaaaaagatgtcagatgtttcattaaaattatcagcgaaagatatttatgaaaaagatttcgaaaaaactatggcaagaggctatagaagagaagaagtagacgcttttttagatgatatcattacagattatcaaaaaatggcggatatgaacaatgaagtagtaaagctttctgaagaaaatcacaaattaaaaaaagaacttgaggaattaagattacgtgttgctacatcaagaccacaagacaataaaaacttttcttcaaataattcaagcagtgcttcaaataatgtagatattttaaaacgtatttcaaaccttgaaaaagcagtattcggcaaataa

SEQ ID NO: 331 - DNA, 633 bp, Staphylococcus epidermidis
attatgatgaattatccaaatggtaaaccatactctaaaaataagcctttggacggacgtaagagttcgccattttcaagtaatattgaatatggtggacgaggtatgacactagagaaagatattgaacaatcgaatactttctatcttaaaagtggcatagcagttattcataaaaagccgactccggttcaaatagttaatgttcactatccgaaacgtagtaaggctgtaataaatgaggcttattttcgcactccttcaacaactgattataatggtgtctataatggatattacattgattttgaagctaaagaaactaagaacaaaacttcatttccactcaataatattcatgcacatcaagtagaacatatgaaaaatacatatcatcaaaaaggaattgtctttttaatgatacgttttaaatcacttgatgaagtgtatcttttaccctattcaaaatttgaaaaatattggcaaagatacattaataatattaaaaagtcgataactgttgaagaaattcggaaaaatggttaccatattccttatcaatatcaaccaagattgaattacctcaaggcagttgataagttgatattagatgaaagtgaggaccgcgtatga

SEQ ID NO: 332 - DNA, 1857 bp, Staphylococcus epidermidis
atgactaagaacaagaaagaatttacagaggctcctgtaaacttcggcgcaaatcttggccttatgctagatttgtatgatgattatctacaagatccatcatccgtacctgaagatttacaagtcttgttcagtacaattaaaacaggtgaagctcatatcgaagctaaacctaccactgatgggggtggttcacaagcgggagatagcacaattaaacgtgttatgcgcttaatcgataatattcgtcaatacggacatttaaaagcagatatttatccagtaaatcctccagagcgtcaaaatgttcctaaattggaaatcgaagattttgatttagataaagaaactttggaaaaaatatcatctggaattgtctctgaacattttaaagacatttatgacaatgcctatgatgcaattgttcgtatggaaagacgttacaaaggaccgatagcttttgaatacactcacattaataataataaagaacgtgtgtggttaaaaagaagaattgaaacgccttataaagcaagtttaaacgataatcaaaaaaaagaacttttcaaaaaactcgcacacgtagaaggttttgaaaaatatttgcacaaaaattttgttggggctaaacgtttttcaattgaaggcgtcgacacattagttccaatgcttcaacacacaatcacattagcaggtaacgaggggattaaaaacattcaaatcggtatggctcaccgtggacgtttaaatgtattaacgcatgtcttggaaaaaccttatgagatgatgatttcagaatttatgcatacagatccaatgaagtttttacctgaagatggtagtttagaattaacctcaggttggacttcagatgtgaagtatcacctaggtggcgttaaaacgactaactcatacggaatagaacagcgtatttctttagcgaataatccaagtcatttagaaatcgttgcacccgttgttgctggtaaaacaagagcagcccaagataatacacatcaagtaggagctccatctaccgacttccataaagcaatgccgattattatacatggtgatgcggcatatccaggtcaaggtattaattttgaaacgatgaacttaggtagtttaaaaggatattctacaggtggttcacttcatattattacaaataatagaatcggttttacaactgaacctattgatggacgttcaacaacgtactcttccgacgtagctaaaggttacgatgttccaatactacatgtaaatgccgatgatgtagaagcaacaattgaagctattgaaattgcaatggaattccgtaaagaatttcataaagatgtcgttattgacttagtaggttatcgtcgctatgggcacaatgaaatggatgaaccttctattactaatccagttccataccaaaacattagaaaacatgattcagttgaaattttatatggtaaaaagttagttgatgaaggaattatttccgaagacgaaatgaatgaagtcattgacggtgttcaaaaagaaatgcgaacagcacatgataaaattgataaaaatgacaaaatgaataatccagatatggaaaaaccagaatcacttcaactacctttacaaagtgatacgaaagatttctcatttgatcatttaaaagaaatcaatgatgcaatgcttgattacccaaaagattttcatgtgctaaaaaagctcaataaagtactagaaaaacgtagagaaccttttgaaaaagaggaggggctcgtcgattgggctcaagcagagcaacttgcatttgcaaccatattacaagatggaacttcaattcgtttaacaggtcaagaatag

SEQ ID NO: 333 - DNA, 231 bp, Staphylococcus epidermidis
caggtcaagaatagtgaaaggggaacatttagccatagacatgctgtgcttcatgatgaagacaatggtaatacattcacaccattgcatcatgtacctcaacaacaggctacttttgatattcataattcgccattatctgaagcagctgtagttggatttgagtatgtttataacgtcgaaaataaaggtaactttaacatatgggaagctcaatatggcgacttttag

SEQ ID NO: 334 - DNA, 909 bp, Staphylococcus epidermidis
tgcaagaagaagttggtgataaaggaaatgaagaaactacagatgaataaattaataaatataattaatacatcactgaataagtcaatacaatcatcaccattaaaaactaatttagaagaaagtatgaaatattcattaaatgctggtggtaaaagaatcagaccagtcatattattattaacactaaaaatgcttaacaaagattatcaacaaggactaaatagtgctttagcattggaaatgattcatacttattctttaattcatgatgatttaccagcaatggataatgacgattaccgtagaggaaaattaacaaatcataaagtttatggtgaatggaaagccattcttgctggtgatgcattattaacaaaagcttttgaattagtttctaatgatactaccattgaagatagtgtgaaagtaagtattataaaaagactttcaaaagcaagtggacatttgggaatggtgggtggccaagcgcttgatatggaaagtgaagggaagtcaattcgtttagaaactttagaatcaattcatgaaactaagacaggcgctttactaaatttttcagttatggctgcggtagacattgctcaagtagaacaaaatattgctaagaatttagatgaatttagtcatcatttaggaatgatgtttcaaattaaagatgatttactggatgtgtatggtgatgaatcaaaacttggcaaaaaagtaggcagtgatatagtaaatcataaaagtacttatgtttctttacttggaaaagaaggagcagaagaaaagttaaacaatcatcaatatcttgctatgaactgcttaaatcaaatttctgatcaatatgatacttctgaattaagtgatattgtagatttattctataacagagaccattaa

SEQ ID NO: 335 - DNA, 1692 bp, Staphylococcus epidermidis
ggatgcgatgaatttatgttacaaaccttatcaataaaacaatttgccattattgacgaacttgatataaacttttctgacggtctaacagttatgagtggtgaaactggctcaggaaaatctatcattattgatgccattggacagttaatcggtatgagagcttcttctgattacgtcagacatggtgaaaagaaagcaattatcgaaggtatctttgatatagacgagagtaaagatgcaattaatatactagaatcattagctatagatgttgatgaagattttttattagttaaaagagaaattttcagttctggtaagagtatttgtcgtattaataaccaaattgtcactctacaggacttaagaaaagtgatgcaagaactgcttgatattcatggtcaacatgaaacgcaatctttacttaagcaaaaatatcatcttcaactattagatgattatgcagacaatcagtattcagatttacttaatcaatatcaactttcttataaccaatataaaaataaacgtaaagaattagaggaattagaatccgcggaccaagctttattacaacgattagacttaatgaaatttcaattagaggaactaaccgaagcttcactgaaagaaggcgaagtggaccaacttgaatccgatattaaaagaattcaaaactccgaaaaattaaatctagctttaaacaatgcacatcaagttctaactgatgaaagtgcaatacccgataggttgtacgaattaagcaactacttgcaaacgattaatgatatcgttccagaaaaattcgtaagattaaaagaggacattaatcaattttactatttgctagaagatgcaaagcatgaaatttacgacgaaatggctaacactgaattcgatgagcaagttttaaatgagtatgaatccagaatgaatttacttaataatttaaaacgtaaatatggtaaggatattactgaacttattgcttatcagagtaaacttgcaaatgaaattgataaaatagaaaactatgaacaaagtacatcacaattaagggaagaaattaaaacgctttataacgaagtgatagatataggaaaaaaactttctcaagaacgtaggcgtgtagcgagagagttaagggaccatattgtttctgaaatacaaaatttacaaatgaaagatgctaaccttgaaatttcgtttaaaccattagatgaacctacaattgaaggtattgaatttgtggaatttttaattagtccaaatcgtggtgaaccacttaaaagtcttaataaaatcgcttcaggcggtgaactttcaagaattatgctagctctaaaaagtatatttgttaaatcacgcggccaaaccgcgattctttttgatgaagttgactcgggtgtatctggtcaagcagcacaaaaaatggctgaaaaaatgcgagatattgctcaatatatacaagtcatttgtatttcacacttacctcaggtagcttcaatgagtgaccatcatcttctaataagcaaggcatccaatgccgatagaactacaactcaagtcaaagaattgaaagatgaaaacaaaatagatgaaatagcacgtatgatttcaggagcaagtgtgactgagctcacgagagaaaatgcaaaagaaatgattaagcaaaatcacaatatttaa

SEQ ID NO: 336 - DNA, 348 bp, Staphylococcus epidermidis
aggaggcgtgatgatatgattgaaaaacaggatttcaatcatatagaggaccaacttgatcaactagcaagtaataaacaactcaaaacaccagaagctagggaacttttagatagttatttcgatttaattattaattattttaaacaaataaataacatagatgaaattcattttaatcaactcgatacatatccagtagttccaatgaattttgatgaacgctatcattatatggttgcacgtaaacaccattttatgggctatcgtcaaatgaaaacattgaaatcagaattaataaaaatgaatgcatcttatctaattagaaagcaacgtcaacaaaaataa

SEQ ID NO: 337 - DNA, 213 bp, Staphylococcus epidermidis
aggaggagcgacgtgataggcaaacactttattataactggagcaacgagtgggttaggttttgcaataaccaatgaattacttcaaagaggggcccatgttactatacttgcaagaaatatagataagttcaatcgaatcaaagaaaactattttaaacctgaacatatcaatgtgattaaatgtgatttaatgcaacgaaaagaatattga

SEQ ID NO: 338 - DNA, 741 bp, Staphylococcus epidermidis
gaggtagtagaaagtatgactaacgaaattttaatcgttgatgatgaagatagaattagaagattacttaaattatatttagaaagagaatcttttgaaattcatgaagcaagagatggtaaagaagcctacgagcttgctcttgaaaacaactatgcgtgcatcctcttagatttaatgcttcctgaaatggatggaattgaagttgcctctaaacttagagaacataaagatacacctatcatcatgcttactgcaaaaggtgaagaaacaaatcgtgttgaaggatttgaatcgggagcagatgattatattgttaagcctttctcacctagagaagtagtattgagagtaaaggcgttattaagacgtacacaaactgcaaacactgagcaaagcgaaccgcatgcacgcgatattattgaatttagtcatctagtgattgataatgacgctcatcgagtccttgcggatgatcaacaagtgaatctaacacctaaagagtatgaattactcatctatttagctaaaactccaaataaagtatttgatcgagaacagttacttaaagaggtttggcattacgaattttatggggacttgcgtacagtagacactcacgtcaaaagacttagagaaaagttaaatcgagtatcaagtgatgctgcacaaatgatacaaactgtgtggggtgtcggttataaatttgaggtaaaacctagtgatgaaccgactaaatag

SEQ ID NO: 339 - DNA, 1425 bp, Staphylococcus epidermidis
accatgtcagaaaaacaatacgatttagtcgtgttaggtggtggtacggcaggatatgtagccgccatcagagcttctcaattaggaaaaaaagtagcgatagtagaaaaatcactcttaggtggtacgtgtttacataaaggatgtatacctactaaagcacttttaaaatcggctgaagtcaatcatactattaaaaacgcgcatacatttggaattgatgtcaatcattttaaaattaatttccctaaaattttagaacgtaaagatgctattgttaagcaattgcatgaaggcgtcaatcaactgatgaaacatcatcatatagatatttataacggtattggacgaattatgggaacatctatattttctcctcaaagcggtacaatttctgtggaatatgaagacggcgaatcagatatactccctaataaaaatgtgcttatagctactgggtcgtcaccacagtctcttccgttcattaaatttgaccataaacaaatactatcgagtgatgatatcctaaggttaaatacactaccacaaagattagcaatcataggtggaggtgttattggtttagaatttgcatctctgatgaatgatttaggtgctgatgtagtagtaatcgaagcgaatgacagagttcttcctaccgagagcacacaagttgcgtcattactaaaagaagaattaactaatcgaggcgttacattctacgaaaatattcaattgaccaaagatcattttaaccaaactgataagggtgtaactattaatatttcagatgagcccgtccaattcgataaagtacttgttgcaattggtagaaagcctaatacaaatgatattggtttaaataacactcaaattaagacttctgatgctggtcatattattacaaatgcttatcagcaaactgaagataaacatatatacgcagcaggagattgtatagggcaattacaattggcacacgtcggttcaaaagaagctatagttgcagttgaacatatgtttgattgttctcctatacctatcaattatgacctgataccaaaatgtgtttatacaaacccagaaattgcttcaattggtaaaaatttagaacaagcaaaaaaagcaggcatcaaagcaaaaagtatcaaagttccttttaaagctataggaaaggcaataattgaggatgtaacccaatcaaaaggattttgcgagatggtagttaacaaagatgacgatgaaatcataggtcttaatatgatagggccacatgttacagaattaataaatgaaatgtcattgttacaatttatgaatggctcatctttagaacttggtttaacaacacatgcacatccttcattatccgaggtagtcatggaattaggtttaaaagctaatggtcaagcaattcatgtatag

SEQ ID NO: 340 - DNA, 912 bp, Staphylococcus epidermidis
gaggtggcagagacaatgaaagtttcacaagataaaagtgcgcttgtcattcgtattatctcattaatcattattattggcttagtaatcacaattatcctcccgatgattaatatctttgccttagcatttaactctggggtagatgctcaaaaaggtggcatcactttctacccgcgtaaattttcactagataattttaaggagatatttaaacaaggcacgttattaaatgcattatttattagtatcgcaaagacagtcataggaacgatactaagcgtcatattaacagctatggctgcatacgttctaacaatcaaaagtttaccgtttcgaagaatcatctcattcttcctagtctttacgatgttattcagtgtcggtgttgtaccactttatatcctattaaatcaacttcatttaactgatacattctgggtatacattttaccgtcactttatagcgtttataacattttaattatgcgtacattcttcaatcaattacctagtagtgtgattgaagccgctagagtagatggttgtaatgactttcaaatcttttggaaaattgtcttacccatgagtaaacccgtggtggcatcaattacattatttaacgccgtgagtcagtggaatgattggtttacaggtgcattcttcgtacgtaatccaaacctcaaaccgttagctactgttttacaagatatgttaacgaaacaagctgccattgcagatgctttaaaacaaaagtcaggttcatatgcgatgttagacaagttgacaattacaggggactcaatgcagatggcaatgattgtactattaacaattccagtattattcctcttcccatttgttcagaagcattttgtaaaaggtataactatcggttcgacaaaagagtaa

SEQ ID NO: 341 - DNA, 1380 bp, Staphylococcus epidermidis
ttgctgaaagataatttaaagagatggtttggttttgatgaatttaaagaggggcaagaagaaattattgatagtgtccttcatggaaggcatacacttggaattttaccaactggtagcggtaaaagcttatgttatcaactccctacatatatattagaaaaaccgacattaattatatcaccactcatttcgcttatggatgatcaagttatgcaaatgaagttaaaaggtgaaacacatgttgcatgtgtacattccggcatggacgaagtagaaaaaagagacaatattaaacgactaagtaaaagtcgatttatttatttaagtccagaatatatactgcaacctcataattttaagtacatcgctcatatcaactttggattaatagtattagatgaagcgcactgtttatcagagtgggggtatgattttagacctcactatgctttagttggtaaaattattcatcattttaattcagcaacagtgttagcactaacagctacagcaccacctcaattagaaactgatttatctcacattttatcactcaaattaaatgtagttcaaaaaagtatgaatcgagaaaatattagcttacaacactataattttaatgatgatgaggggaagattgaatggctgttaccatttttatctaattctgggcctacaattatatatgtttcttctaaaaaaagatgtttagaactagctcaaatgatttatgactcaggatatctaacaggtatatatcatggagatttaagttatcaggaacgccaaacagttcaacaacagttttttaataatgacatccccgttatagtagcaacaagtgcttttggaatgggaataaataaaaaagatattcgtacagtcatacattttcatttatcatcttcaccatctaactatttacaagaaattggtcgtgctggtagggatggtaaacaaagtcaagccattagtttatttcaacctgatgatagttttattctagaaacactactattcactgatattatcacagatgacgatattacaatgtttgagacgggaaaccacttaccagatgaaaaggaaaaaattttaagtactttaaatatacaattcacatttagccaacttaaagatatatttcatcaatcatatcaacgtaagcgactaggttatatgagaatgatgggctatactaatttagatcaatgtcgacgtaaatacttactagaattttttggcgaacatcctcaaagtccaaaacaatgttgtgatcaagattcaagattagagcctattcagatattgaatcgtaaaaaggtgaaaagaaaactaagttttaatgaaaaattatataatttgttcgaaacctag

SEQ ID NO: 342 - DNA, 1248 bp, Staphylococcus epidermidis
acaatggaagatatctacaaacttatagacgatatcaatctacaaaaaatagaaaacttagattctcgagtaaatgaggcattgagttcaaacaatgatgatgcattatttatacttggtgaaactttatataatttcggtcttacacctcaagggttagaagtttttagaacgttgtatcataaatacccagatgaaagtgaattactcatttactttatcgaaggtctcatgtctgaaaaccaaactgacgaagcacttgaatatttagcacaagtagaaccatctaccgaaaagttgatgctagaagccgatttataccaacaaataaatatgttagaagtagcaattgacaaattgcaagaagcattagatcttgaacctaatgatccaattattcacttcgccttagcagagctattatactacgatgggcaatacttacgagctacaagagagtatgaaacagtattagaaactggtgaatatgaagttaatggagtaaatattttttcgcgaatggcagattgtagtttacaaagtggtaattattcagatgctattagcttatttgatgaaattaatgaagaagagatgaattctgaagattactttaaaaaatcaattgcttatgaaaaaaacgatttaactcaagaagcaattaaaattatgcaaacattactttcaaaagatcctgattttatacaaggatatttttatcttcaatctctatttgaaaatgaaaaaaattatcctgatgctatagaaactggtaaggaaggattacgtttaagtcaattttacaaagaattaatggtttctacaggtagcttagaaattgagcatggagatgcaaatgaaggtgtagaattgctaaaacaagccttagaagtcgataatgcatatcatgaaccattgttgattttaagtgatttatatcgtaatgaagaagactatgaatcaattatacaattgttgacttatgtagatgaagaagatttagaccctattttcatgtggcatttagcatatgcatacggtcaagaagaacgagataaagaagcgcaacatttctttgaattagcatatccaacattacaaacccaagttgaatttttaagcgattattatttctatttattagaaattggacaaaaagaaaaagcaattttgattttaaatcaattattagaaattgatccaagcaatgaaaattggcatgacgagtcaatgagattgcaaatataa

SEQ ID NO: 343 - DNA, 444 bp, Staphylococcus epidermidis
caaatcatggatttaaactttgatttatatatgaatgatgttgttgaacaagcacgaaacgaaattgagcatgctggttatcaacaattaacttctgctgaggatgttgatcaagttttacaacaaaaggggacatctttagtcatggtaaattccgtatgcggatgcgcaggtgggattgcacgtcctgcagcgacacatgcattacattatgataaattacctcaacgattagttacagtatttgcaggacaagataaagaggcaacacaacaagctagagaatattttgaaggatatgcaccctcaagtccatcttttgctttgattaaagatggtaaaatcaccgagatgattgaacgacatcagattgaaggtcatgatgtaatggacgtaatcaatcagttgcaagcattgtttgataaatattgtgaagaaagataa

SEQ ID NO: 344 - DNA, 531 bp, Staphylococcus epidermidis
aatctaatggatcaatcattaatggattattattatcaatttcataagcatcaacattacttcctatgtcatgatattttagaagatgcttggaaatcacaaaatactttttcaaaacatgatgcagtagtaagtctcattttgtttgcaacagctaattatcactatcgtcgtgggaatttaaaaggcgcattaaaatcttttgaaaaagctttattaactattaaccacgctaaagatgacactcaattacaccttaatatcaatgaatttaaacaacttattgtgaaaatgattgaagcagtaaaattacaaaaacaatttactccgttacaattacctattgaaccagagtttcagacacttattaaacgtaaatatccggattatttgtttacctctcaaataattaaggaaccttatattgttgatcatcatattaaacgtgacagaactgaagtgataaaaaatagagaacgtgctttattccatagacagtatcgaaacaaaagcaataaaaaagaccagtaa

SEQ ID NO: 345 - DNA, 672 bp, Staphylococcus epidermidis
aacaacaaggaaggttatcaaataatgagttcaattaatattgcactagatggcccagctgctgcaggtaagagtacaattgctaaacgtgtagccagtcgtctatcaatgatatatgttgatacaggagcaatgtatcgtgccattacatataaatatttacaaaatggcaaacccgaaaattttgattatctgattaataacactaaacttgagcttacttatgatgaagtaaaagggcaaagaatcttactagataatcaagacgtcactgattatttaagagaaaatgatgtaacacatcacgtatcttatgttgcttctaaagaaccagtgcgttcatttgcagtgaaaatacaaaaagaattagctgctaaaaaaggtatcgttatggatggccgagatattggtacagttgtattaccagatgccgaattaaaagtttatatgattgcatctgttgctgaacgtgctgaacgtcgacaaaaagagaatgagcaacgtggcattgaatcaaatttagaacaattaaaggacgaaattgaagcacgagatcactatgatatgaatcgtgaaatttcgccattacaaaaagccgaagatgctattacacttgatacaactggcaaatctatagaagaggtaacaaatgaaatattgtctctactttaa

SEQ ID NO: 346 - DNA, 1332 bp, Staphylococcus epidermidis
aaaagagaggaagtttatcctatgactaaaccgatagtagcaattgtaggaaaaccaaatgtaggaaaatctacaatttttaatagagttgtcggcgaacgtgtatctatcgtagaagatacgccaggcgttactcgtgatcgtatttattcatctggcgagtggttaactcatgaatttaacatcattgatacaggtggtattgaaattggagatgctccttttcaaactcaaatccgtgcacaggcagaaatagcaattgaagaagcagatgtcatcatttttatggtcaatgttagagaaggacttacacaaagtgacgaaatggtcgcacaaatgctttataaatctaagaaacctgttgtattagctgtgaataaagttgataatcttgaaatgcgtaatgatatctatgatttctattctttaggctttggagatccatatcctatttctggttcacatggattaggacttggagatttgctagatgcagttgttgaaaactttaataaagaatcagaagatccttatgacgaagatacgatacgtctttccatcatcggtagacctaatgttggtaaatctagcttggtcaatgctattttaggcgaagaacgtgttattgtgtctaatgttgctggtacaactcgagatgccattgataccgagtactcttatgatggacaagattatgtattgattgatactgctggaatgagaaaaaaaggtaaggtgtatgaatcgactgaaaaatattctgtattacgtgcattaaaagcgattgagcgttcagaagtagtattagtagttatcgatgctgaacaaggtataattgaacaagataaacgtgtagctggctatgcacatgaggaaggtaaagctattgtcattgtagtaaataaatgggatacaattgaaaaagatagtaagacaatgaaaaaattcactgatgatgttagaaatgaatttcaatttttagattatgctcaaatcgcgttcgtatcagcaaaagaagggctaagattaaaaacattattcccttatatcaatcaagccagtgaaaatcataaaaagcgtgtccaaagttctacactaaatgaagttgttactgatgccatctctatgaatccaacacctactgacaaaggtagaagacttaatgtattctatacaactcaggttgcaattgaaccaccgacatttgtagtatttgtcaatgatgttgaattaatgcatttttcttataggagatatttagaaaatcaaatacgtaatgcttttggttttgaaggaacacctattcatattattccaagaaaaagaaattaa

SEQ ID NO: 347 - DNA, 183 bp, Staphylococcus epidermidis
gacttactactgcatcatgttttgaaaaagtattttgtgatttccaagcatcttctaaaatatcatgacataggaagtaatgttgatgcttatgaaattgataataataatccattaatgattgatccattagatttcacccataatttaaaagttgtatgtattcatgctataataatttag

SEQ ID NO: 348 - DNA, 546 bp, Staphylococcus epidermidis
agcacctattgcggtataaaaagatgcattaatatttcgcatacagaaaggaggtataccatgacattatcaataattgtcgctcacgataaacaaagagtcattgggtaccaaaatcaattaccttggcacttaccaaatgatttaaagcatgttaaacaactgaccactgggaatacacttgtaatgggacggaaaacttttaattctatagggaaaccattgccaaatagacgtaacgtcgtactcactaaccaagcttcatttcaccatgaaggggtagatgttataaactctcttgatgaaattaaagagttatctggtcatgtttttatatttggaggacaaacgttattcgaggcaatgattgaccaggtagatgatatgtatatcacagtaatagatggaaagtttcaaggagacacattctttccaccatacacattcgaaaactgggaagtcgaatcttcagtagaaggtcaactagatgaaaaaaatactataccgcatacattcttacatttagtgcgtagaaaagggaaatag

SEQ ID NO: 349 - DNA, 195 bp, Staphylococcus epidermidis
attgcttgttgttctgtattagtgagtatagctttcacttcccttagctatagactatttatatttatacccatttcacatgtttgtattatagcatttataagttgggaatttgaaataatcaattttagttttgagaaaactgataacttagacgttggtttaagttattatttatttactcttcttttttag

SEQ ID NO: 350 - DNA, 813 bp, Staphylococcus epidermidis
tttaaaagttgtatgtattcatgctataataatttagtgaaatatgcattaacgatgcaatttgatatagaggtagatgtaatgtatgaagtaaaactcgatgcatttaatggtccattagacttattattgcatctaattcaaaaatatgaaattgatatttatgatatccctatgaaagccttaactgaacagtacatgcaatatgttcatgcgatgaatcagctagaaattaatgttgctagtgaatatttagttatggcatcagaattactaatgattaaaagtaaattactattgcctcaaacgagcatcgaagaagatatagaagaggatcctcgtgaggatttagtaggaagacttattgagtatcaaaactataaagaatatactgaaatattaaatactatgaaagaagaacgcgatctttattttactaaacatccgacggaccttactcatttagagacaaatgaatcgtgggatcctaatcaaacgattgatttaactgaattgattgtagcttatcaaagagtaaaaaatcgagttgaacttaacactcctaaatctgtagaaattaaaaaagaaacctttacgattcaacaagctacagcacaggttaccgaacgattaaaacaacatgaatcgtttaactttttcagtttatttacatttcatgaaccggtcgaacaagttgttactcattttttggcaattttagaaatgtcaaaatcaggaatagttaatatcaaacaaactaaacaatttgatgacattgacataattagaggagtgaactatagcattggataa

SEQ ID NO: 351 - DNA, 1554 bp, Staphylococcus epidermidis
ctaaaattatgtttaatcataaagaatatcatcttttattatatttatttaagaattgaggttttaatcttgagtactaaacaaaaacacattccttgtttgattacaatattcggtgccacaggagatttgagtcatagaaagctatttccttctatattccatttatatcaacaagacaatttagatgaacatattgctattattggtataggacgtcgcgattataataacgaacaatttcgcgaccaagttaaagcgtcaattcaaacttatgttaaagatacagatagaattgatgagtttatgacgcatgttttttatcataaaactgacgtgagtgataaagaaagttatcagtcattacttcaatttagtgagcgactagattcagaatttgctttaggtgggaatcgtctgttttacttagcgatggcaccacaattttttggagtgatctcagattaccttaaatcttctggtcttactcaaactacaggatttaaacgcttagttatagagaaaccatttggcagtgatcttaaatctgctgaatcattaaataatcaaataagacgttcgtttaaagaagaagaaatttatcggatagatcactatcttggcaaagatatggtgcaaaatatagaagttttgcgattcgcaaacgcgatgtttgaacctttatggaataataaatacatttcaaatattcaagttacatcatcagaagtattaggtgtcgaagatcgtggtggctactatgaatctagtggtgcacttaaagacatggtacaaaatcacatgctacagatggttgctttacttgcaatggaagcaccgataagtttgaatagtgaagatatacgtgcagaaaaagtcaaagtacttaaatctcttagacaattaaaaccagaagaagttaaaaagaatttcgtgcgtggtcaatatgatcaaggcaatatagatggtaaacaggttaagtcatatcgagaagaagatcgcgtagcaaaggattcggttacaccgacatttgtatcgggtaaattaacaattgataactttagatgggctggagttcctttctacattagaacgggtaaacgtatgaaatcaaaaacgatacaagtcgtagtagaatttaaagaagtacctatgaatttatattatgaaactgacaatttactagattctaatttgctagtcattaatattcaaccaaatgaaggaatttcattgcatttaaatgctaaaaagaacattcaaggaattgatactgagccagtgcaattatcatacgcaatgagtgctcaagataaaatgaatacagttgatgcatatgaaaacttattgtttgattgtcttaaaggtgatgcgactaattttacacattgggaagaattaaaatctacttggaaatttgtagatgcaatccaagatcaatggacaatggttgaaccatgtttccctaactatgaagcgggtacaaatggacctcttgaaagtgatcttttattaagtcgtgatggaaatcattggtgggatgatatccactaa

SEQ ID NO: 352 - DNA, 828 bp, Staphylococcus epidermidis
atagaggagtgtcagttaatgagtggacttagaagtgtcactttaggaacaaacgatttatctaaaacgaaagaattatttaaccacatcattggtttacaacattcaactaaaaatgaacatgccataagatttggtgacgctaatttaagtcctggaacgcgtgttcactttgttgaagttccagaggaagattataaaaatctacacatagatagcgttggacttagaacaccttctgattctggattagtagaatatcaaaatatttttgacaagtttaatatatcctatagttcaatcactgaacttaatggtcttaaacattttacttttgaagatcataatcaacaaaaatttgatatttattctaacgagttaaatacgggtataggattaggtatgcctgcttttgatagtcctgttaaccctttacatcaagttcaaggcttaggtccagtcattattaaggtgaacgagttatctgtcaccacttcaattctcacacaagtatttcaattagatttatttgctgagtatcttccacatgaagatgcccaacaacctattcaagtgtttcgtataggtgagggtggtcttggtggtgaaatccacttatttgaaagcgatgaagatattcaaatgaatacacacgggccaattgagcaagtggaattctctacaaatgatacccaattgtatcttcaagcaaaaaatcgtttagatgagattggtgttccatatcaaactctcgaacaggatacttcagaatctcttagaatcactgaaaatagtggcatttcatttatttatacacttgaaaagtaa

SEQ ID NO: 353 - DNA, 891 bp, Staphylococcus epidermidis
ctatcggttcgacaaaagagtaaaggagacgaaacaatgactacaattctacaattaagcgatttacatattgggccccccaatgatgaaaaagatctaaaaactgacgatttaattcatcatatgatgacacactatcaacctgacatcacagtattaacaggtgaccaaatttggtctgaaggcgtcattgattcaggtcgcgtttataaaaaattaatggagtatttaaatcgatatgatacgcaaattgcaacgacatttggtaatcacgatacagaggggcatctcaaacgttcagatttacgcgctattgaggaccaatattctaccaactatgtacagaaaaatcatagcctcattgttgatgataaagaagcttatacaatagaagttgtaaacaacgatacagtcacacatgtgctttatgttattgatggaggagattataatccatttggcataggtgattatgattttataagacctgaacatgtgaattggcttagggaaacacatcaagcatatcaaactcaatttcaacacaactttcaacataacttattatttacacatattccattacaagaatatagagaagttgagaatattggtgaatatcatggcattttcaatgaacctattgcgtgctcaaaaattaattccggattatttagtcagatgttactaaacggtgatattgaaggtatgttctgcggtcatgaccatgacaatgattttacgattaatttatatgggattcgccttagctttggtcgtattggtggttacaatacttatggtgatttacaacgtggggctagattaattgagttgcaacctgacgctatatataaatcgaaagtgttagaatttgatgatcgtttctaa

SEQ ID NO: 354 - DNA, 393 bp, Staphylococcus epidermidis
aatatgagtcgtaaagatgcaagagtacaagcttttcaaactttatttcaacttgaaataaaagagacagatttaacaattcaagaagcaattgaatttattaaagatgatcattctgatttagactttgattttatatactggttagttactggagtcaaagatcatcaaatcgttttagacgaaacaattaaaccccatttaaaagactggtctatcgatcgtttactgaaatcagatcgtattattttaagaatggcaacttttgaaatattgcacagcgacacacctaaaaaagtagttgttaatgaagctgtagaactcacaaaacagtttagtgatgatgatcattataaatttgttaatggtgttttaagtaatataaatgattaa

SEQ ID NO: 355 - DNA, 918 bp, Staphylococcus epidermidis
acaagttaccgcttcaataggggtgccaacatgaatactatcattgaagaatatttaaatttcattcaaattgaaaaaggattaagtaacaatactataggagcgtatcgaagagatttaaaaaaatataaagattatcttgaagataacaagatttcacatatcgattttattgatagacaaattatccaagagtgtcttggacaccttatagatatggggcaatcttcaaaatctctcgcaaggtttatttctacaataagaagctttcatcagtttgcattacgcgaaaaatatgctgctaaagacccaactgttttaattgaaacacccaaatatgaaaagaaattaccagatgtgcttgaaatagacgaagtaatagcattactggaaacgcctgatttaactaagaataatggatatcgtgatcgtacgatgttggagcttttatacgccacaggtatgcgtgtaactgaaattattcaattaaatgttgaagacgtaaacttaatgatgggatttgtaagagttttcgggaaagggaataaggaaagaatcgttcccttaggagataccgtcatcgaatatttaactacatatattgaaaccgtaagacctcaattactcaaacaaaccacaactcaagcgctatttcttaacatgcatggaaagtctttatcaagacaaggcatttggaaaatcattaaacaatatggtttgaaagctaatatcaataaaacgcttacaccacatacattacggcattcatttgcaacacatctcttaaaaaatggtgctgatttaagagccgtacaagaaatgttaggtcactctgatatttctacaactcaactttatacacatgtatctaaatcacaaattagaaaaatgtatacgcagtttcatccaagagcttag

SEQ ID NO: 356 - DNA, 210 bp, Staphylococcus epidermidis
catgcggtgcttgcggtgcagctgctccagatatatatgattacgatgatgaaaggtattgcatacgtaatccttgacgataaccaaggtactactgaagtgcctgaagagttatatgaagatatggaagatccgctaggaggttgtcctactgactcaatcaaaattgaagacgaaccatttgatggtgacgcactgaaatttgaataa

SEQ ID NO: 357 - DNA, 969 bp, Staphylococcus epidermidis
ggagttgtacgcatgtataatccattcgacgaagcttatcatggcttatgcgaagagatattagaaatagggaatagacgcgatgatcgcacacataccgggacaatttccaaatttgggcatcaattgcgtttcgatttaaccaaagggtttcctttacttacaaccaaaaaggtttcttttaaattagtagcaactgaattattatggtttattaaaggagatacaaacattcaatacctacttaaatataataacaatatatggaatgaatgggcatttgaaaattatgttcagtctgatgattatcatggaccagacatgacagattttggacatcgttcccagcaagaccctgaatttaacgagcagtataaagaagaaatgaaaaaatttaaagaacgtattctaaacgatgatgcatttgctaaaaaatatggcaacttagggaatgtttatggtaaacaatggagagattgggaagataaaaatgggaatcattacgatcaattaaaatcagttatacaacaaattaaaaccaatccaaactctcgacgtcacattgtttcagcatggaatcctactgaaatcgattcaatggcattaccaccttgccacacaatgtttcaattttacgtacaagagggtaaattaaattgtcaattatatcaaagaagtgctgatatatttttaggtgttcctttcaatattgcaagttatgctttactgacacatcttgttgcaaaagaatgtggacttgaggtgggtgaattcattcatacatttggagatgcacatatttattccaatcatatggatgcaatacatacacaattatcaagagatagttatctaccacctcaattaaaaattaatacagataaatcaatttttgatattaattatgaagatttagaattgataaattatgaatcacaccctgctattaaagcacctattgcggtataa

SEQ ID NO: 358 - DNA, 705 bp, Staphylococcus epidermidis
ataggaggtagtaatattatggatctaattcaattaaaaacaagacctgttgttataagacgagaattgtttgatcattattcagagttaggtttggatgaacaagatttagttattttgataaaacttttatatgcatctgaaacttctaataagcaaccttctattgaatttcttcaaaaaggatcaactatggaacctcgtcaaattacttccgtaatacaaaacttaattcaaagagaattattagaactcaatgttagtaaagacgaagaaggtaaattcactgaatacatgaatttggatcccttctatcacaaattaaatcaattattaaaacatcaatacttaaaacatgaggaacaagataaaaaagagcagtttaagcaattgtttcagatagttgagcaatcgttcggcagaccactatcgccgtatgaaattgaaacattaaatcagtggattgatgtcgatcaccatgacttatcagttatacaagccgctcttgatgaggcacttagccaaaataaacttagttttaaatatattgatcgtattttattaaattggaaaaagaataatgtgaaaacagttgacgattcaaagaaaataagagaacagtttaacaaaccaaaaatgaaacatgttgttaaaaaggtgcctaaatttgactggttgaatggagagaatcctaatgataagtaa

SEQ ID NO: 359 - DNA, 246 bp, Staphylococcus epidermidis
ggcggtattttttggctcaatgatgagtacccgattataaatggtaatcaagcagctatcttaggtatgcattcaattattacacgcccaattgcagttgataaagatacaattgaaaatcgtccaatgatgtatatcgcattaagctatgatcatagaatcatcgatgggaaagaggctgtaggattcttaaaaacaatcaaagaactcattgaaaaccctgaagatttattacttgaatcataa

SEQ ID NO: 360 - DNA, 294 bp, Staphylococcus epidermidis
ccaggcgtcagctttttgctatcatcatactatgtttatagaaaaagaaaaaataatcgttctttaatttatggattaattacaggtacaatcgttatgactattgttttgagcatcttaaattattttgtgttacttccattatatggaatgatatttaatttaggtgatgtgcttaataacgtaaaaattgttattgtgtctggagtcataccttttaatttaattaaaggcataatcatttccattatatttgtgctgttatttagaagattaagacatatcatcaaataa

SEQ ID NO: 361 - DNA, 1101 bp, Staphylococcus epidermidis
aaacatataagaatagaggttgtaattatgacaaaaattgcatatacaggtggaggaacagtaggacacgtttcagtgaatttaagtttaattcctacttcgattgaaaaaggacacgaagcattttatattggttcaaaacatggtattgaaagggaaatgatagagtcacaactccctgatattcaatattatccaatatcaagcggtaaattacgtcgttatctatcttttgaaaatgcaaaagatgtctttaaagttttgaaaggaattttagatgcacgtaaaatacttaaaaaacaaaaaccagacttacttttttcaaaaggtggttttgttagtgttccggtagttatagccgcacgttctttaaaaattccaactatcatacacgaatcagatttaactcctggattagctaataaaatttctttaaaatttgctaagaaaatatacacaacctttgaagatacacttacatatcttccaaaagataaagctgattttgttggggctactgtacgtgaggacttaaaacaagggaataaagaaagaggatatcaactcactgattttgataaaaataaaaaagtgttattagtcatgggaggaagtttaggtagtaaaaaacttaataatatcattcgtcaaaatattgaggcacttctccatgattatcaaattatacacttaactggaaaaggacttgttgatgactcaatcaataaaaaagggtatgttcaatttgaatttgttaaagacgacttaactgatttattagcaatcactgatactgttgtaagtcgtgcaggttctaacgcaatttatgaatttttatcgctacgtataccgatgttactcatccccttaggacttgatcaatcaagaggagatcaaattgataatgctaaaaactttgaatctaagggttatggtcgtcatattcctgaagatcaacttacagaagttaacttattgcaagaattaaatgatattgaattacatcgtgaatctattattaaacaaatggaaacatatcaagagagttacacgaaagaagatttatttgataaaattattcatgatgcattaaacaagtag

SEQ ID NO: 362 - DNA, 999 bp, Staphylococcus epidermidis
aggaggataagtatgcaaactattgaaagcatcattataggtggcggtccatgcggattaagcgcggcaattgaacaaaagaaaaaaggtattgaaacattagtaattgaaaaaggtaatgttgttgaatcaatctataattatccaacacatcagacttttttctcatcaagtgataaattaagtatcggcgatattccttttattgttgaagatagtaagccaagacgtaatcaagcgcttgtatattatagggaagtcgttaaacatcatcaacttaacatacatccattcgaagaagttttaacagttaaaaaaataaacaataaatttgcaattacaactacaaaaggtgtatatgaatgtaaatatttaactgttgctacgggttattatggtcaacataacactttagaagcggaaggggcagaattaccaaaagtattccattactttaaagaagcacatccgtattttaatcaaaatgttgttattattggaggcaaaaactctgctgttgatgctgccttagaattagaaaaagctggtgctaatgtaactgttttatatcgtggcgaacagtaccctaaagcaattaaaccatggatattacccaatttcgaatcattagtcaatcacgaaaaaattacgatggaatttaatgcgacagtaaccaaaattaccgatcattcagtgacttatgaaaaagatggtcaacttatagaaattgataatgactacgtttttgctatgattggttatcatccagattacgatttcttaaaaacaataggtattgatatccataccaatgaatatggaactgctcctgtttataatcgagaaacattcgaaacaaacgtcgaaaattgttatatagctggtgttattgctgcgggtaatgatgcaaatactatttttatcgaaaatggtaaatatcatggtggtgtcattacacaaagcattttgacaaaaaaacaaacacctcttgaaacatag

SEQ ID NO: 363 - DNA, 1134 bp, Staphylococcus epidermidis
ttaatgatgagttatctttttaataattacaagcgtgacaatatagagtttgttgatgctaatcaaaatgaattaattgataaagataataatgtctacctagatttttcgtcaggtataggtgtgacaaatctgggttttaatatggaaatttaccaagcagtttataatcaactgaatttaatatggcattcacccaatttatacctaagtagtatccaagaggaagtggctcaaaaattaattggtcaacgagattatttagctttcttttgtaatagcggaacagaagcgaatgaggcagctatcaaactcgcacgtaaagctactggtaagtcggaaattattgcttttaaaaagtcttttcacggcagaacgtacggcgcaatgtctgcaacaggacagaagaaaattacagatcaatttggtccggttgttcctggattcaaatttgctatttttaatgattttaattcatttaaatcattaacttcaaataatactgctgctgtaattatagaaataattcaaggtgaatcaggagtactacctgctgatcctttatttatgaagcaattaaatgagtattgtaaacaaaaagatatccttataattgtagacgaggttcaaacgggcataggtagaaccggtaagttatatgctcatgaacattatcaattgtctccagatatcatcacattagctaaaggattaggtaatggccttcctattggaacaatgttaggcaaaaagaatttaggtcatgcatttggctacggttctcatggtacaactttcggtggaaatagattatcattggttgctgcaaaccaaacgctttctatcattaatgatgctgatttgctgaatgatgttcaatcaaaggggcaatttcttattgaaaacttaagaaaaagtttagtaaataaaagaaatgtaattgaagtacgtggtgtaggtttaatggtaggaatagaggtcactaatgatcctagtcaagtagtgcgagaagctaaacgtatggggttaatcattttaacagctggtaaaaatgtgattaggttattaccgccattgaccatcactaaaaaacaattagaaaaaggtatagaaatattaactgaaatcatttga

SEQ ID NO: 364 - DNA, 711 bp, Staphylococcus epidermidis
aggagagtgagtttaatgtctttaatatcaatgattatatatttcgtaatattaatggtcattccaatgtgggctcaacacaaagttaaatctaattatgaaaaatactcacaagtgagatccacaagcggtaaaactggtcgtgaagttgctgaagaaattttacatgctaatggcatttacgatgttgacgtcgttaaaggcgaaggtttcttaactgatcactatgacccaaataaaaaagttgtttgtttatctcctgcaaactacgatagaccatcagttgctggtactgcaattgcagcccatgaagtaggacatgcaattcaacatcagcaaggatacgcaccattaagatttagaacagcattagtaccattagctaatattggtagttctttaagctacattattattatggtaggtattgttttaacagctctcggtagtgtctttggctctacagttctatgggttggtgctggtttaatgtcacttgcagttttattctctatcgtgacattacctgttgagtttaacgctagttcaagagcgatgaaacaaataacagctttaaatatcgttaatgagaaagaatacaaacacgcgaaaaaagttttatctgcagcagcaatgacatatgtggcatctactgcagttgcgttagctgaacttgctcgtattatattaattgcaagatcaagtgattaa

SEQ ID NO: 365 - DNA, 1221 bp, Staphylococcus epidermidis
aacaaggtgagaacaacaatgagtcatgagatatttgaacaagcaaaacctattttaaaaaagattcaaaataaaggttttaaggcttatttcgttggcggatcagtacgtgattacatcatgcaacgacctatacatgatgttgatattaccaccagtgcaacgcctgacgaaatagaatctatattcgataaaaccataccagtggggaaagaacacggtacgatcaacgtggtctttcaaaatgacaattatgaaattactacattcagatctgaagatgaatacatcgatcatcgtaggccaagtgaagtgtattttgtaagagacttatatcaagatgttcaacgtagagattttacaatgaatgctatagcaatggatttaaattaccggttgtatgattattttaatggtcaacaagatataaacaatcgagtaattcgtactgttggtgtaccaagtgaaaggttttcagaagacgcgcttcgtatcattagaggattacgttttcaatcacaacttaattttcaaattgattcagacacattacatgcaatgtcttctcagatttcagatatacaatatttatccgttgaacgtgtagtagtagagcttaaaaaacttatcatgggaaacaatgttaaacaaagttttgaagtcatgcaaaacatgaaagcatttaattatataccttttttcaaatcatttgagatgtctcatcttcatatagatgagcccatcacatttgaactttggattgcaatcttaatcgtccaacaaccaaaagatatacaattaagcaccttgaaaatcagcaatcaagaaaaagcaactatcaaaaaatgggttacactcatccaaacattgcctaagatacagtcaaagcaatctttaataacattagtatatgattacaatttaaatgatattgaaatcctattatcattacatcatttgcttaaacaaaatgggcttacaacagccaatcatttaatcattaatgaaataagtattcgcgaagcaaatgaaaaattacctatccattgcagaaaagaattggcaataaatggtaaagatatactcaatcatacgaataaaaattcaggaccatggctaaaagatacacttagagaaatagaaatcgcagtcatatcaaatcaaatagtcaacactaaagaagaaatattagaatgggtggatgcacatgtcaaaatatag

SEQ ID NO: 366 - DNA, 210 bp, Staphylococcus epidermidis
ttatccattttacctaaatcatgggtaaatgtatatctttgtgaattttctttaataataatcgcacaagcacttcggccgggatttcctttagtcgcagcatcaaaatatattttagccattacttttactcctcttcagaattgtctactcactaaaatgtatctattctattgtatcaaactaaaaagacaaagcactaaaaattaa

SEQ ID NO: 367 - DNA, 222 bp, Staphylococcus epidermidis
tttaaggatggttattacatgttacatgaaacttggaaagaacgtacaccaattaaaaaagtagaagtgacaaatactgatgccaaaaaatttacagttgcagatatgctaactatcggcaaacagtatgatgttattaacgaaactgaagaatattatcaaattatagataattctggtttagtaggtggctattacaaagactactttaaagagatataa

SEQ ID NO: 368 - DNA, 282 bp, Staphylococcus epidermidis
gttacaataggaggatgtcacatggagattatagcaatttcagaaacacctaatcataatacaatgaaagtttcgttgagtgaaccacgtcaagataactcatctacaacatatactgccgctcaagaaggtcaacctgaatttattaatcgattatttgaaatagaaggtgttaaatcaatattctatgttttggattttatatcaattgataaagaagataacgctaactggaatgaattattaccacaaattgaaaacacgttcgctaaaagcaattaa

SEQ ID NO: 369 - DNA, 1164 bp, Staphylococcus epidermidis
tttaagaaaggatgggcacaaatgaaaatcggtataacgtgttacccgtccatgggtggttctggcattattgctacagaactcggtattaaaatggcagaacgtggccatgaagttcactttattacctcaaacataccctttagaatacgcaaacctttacctaacatgacgttccaccaagttgaagtcaatcaatatgccgtattccaatatccaccatacgatattacattaagtacaaaaatttctgacgttatacaagaatatgatttagacatattgcatatgcattatgctgtacctcacgctgtatgtggtatattagcgaaacaaatgtcaggtaaaaacgtcaaaattatgacaacactacatggcactgatataactgtgttaggttatgaccatactttacaaaacgcgataaaatttggcatagaacaaagtgatattgtaacaagtgttagccattctctagcacagcaaacttatgaaattatcaatactaaaaaggaaatcatccctatatataattttgtaagggaaaatgaattcccaactcggcataatgaagaattaaaagattgttatggtatttcacctgaagaaaaggtattgatacatgtttctaatttcagaaaagtaaaacgtattgatacagtgattgagacatttgcaaaagttcatgagagtataccatccaagttgatacttttaggagatggtccagaattaatcgatatgcgacataaagcacgagaacttgatgttgaaacacacgtactctttttaggcaaacaaaatgacgtaagcgcattctaccaactatctgatttagtactactcttaagtgagaaagaaagttttggattaactctcttagaagcaatgaaaacaggcgtcttacctatagggagtcatgcaggtggtattaaagaggtcatcagacatgaagaaactggatttatagtagatataggggatagtacacaagctgcaaaatatgctattaaacttttatcaaatccagagttatatcaaaaaatgcaatcacaaatgctgaaagatattgaagcaagatttagttcagatttaattactgaccaatatgaaaactattatcgaaagatgctagaacaaggtgagaacaacaatgagtcatga

SEQ ID NO: 370 - DNA, 1014 bp, Staphylococcus epidermidis
catatgtttatgaagagggaggtcaacgaaatgactaaattatcatacttagaagctatacaaaatgcacaagacttagcactaaatcattttagtaatgcatttatacttggcgaagatgtaggaaaaaagggtggcgttttcggcacaaccaaaggattacaaagtaagtatggtgatgaacgtgtaattgatacacctcttgcggaatcgaatattattggtactgctattggtgcagcaatgctaggtaagagacctattgccgaaatacaatttgcagatttcattttgcctgctacaaatcaaattataagtgaagcagctaaaatgagataccgttcaaataatgactggaattgcccactgactatcagagcaccttttggtggtggagttcatggtggattatatcattcacaaagtgttgaaagcatttttgcttcaactcctggattaactattgttattccttcatcaccttatgatgctaaaggtcttctattgtcctctatagagtctaacgatccagtcttatactttgaacataaaaaagcatatcgttttctaaaagaggaagttcccgaaacatattatactgtacctctaggtaaagcagatgttaaaaggccaggcgaggacatcactgtattttgttacggattgatggtgaattactgtttacaagctgcagatattttggcaaatgacggcatcgatgttgaagtagtcgacttaagaacagtttatccactagataaagcaactatcattgaacgctctcaacgtactggtaaagttcttcttgttactgaagataatctagagggaagcattatgtctgaagtatctgcaattatagctgaaaactgtctgttcgatttagatgcgccaatcatgcgattagctgcaccggatgtcccatctatgccattttcaccaacattagaaaatgaaattatgatgaacccagaaaagatacaggacaaaatgcgtgaactcgcacaattttaa

SEQ ID NO: 371 - DNA, 858 bp, Staphylococcus epidermidis
gaggcaattatggctaaacaaattatcgtcacagattcaacctctgatttatcacatgaatatttaaaacaacataacattcatgttataccattaagcctgacaatcgacgggaaatcttacactgatcaagttgatatctcttcaagtgagtatatcgatcatattgaaaatgatgcagacgtcaaaacaagtcaaccacctattggtcgatttattgaaacatatgagcaattagctcaagatgacgttgaaattataagtattcatctttcgtcaggcttaagtggtacttataatactgctgttcaagcgagccatatggtagatggcaatatcacagtgattgattctaaatctatttcgtttgggttaggttatcaaattaagcaaattgttgaattaataagtcaaggtacatcaacagaagaaatagtgaaggaaatgacacagttacgtgataacttgcaactgtttgtggttatcggtcagcttaatcaactcattaaaggtggaaggataagtaaaacaaaaggtttaattggaaacattatgaaaattaagccaatcggaactttaagagatggtaaacttgaactagtgcataattctagaactcaaaactctagtgtgcaatatttaaaaaaagaaattacagattttgttaaagatcataaaattaaatcaataggtattgctcacgccaacgttaaagatttcgttgataaaatcataaaatcatttacagagtcatttgattttagccaatttgatattaatgtaacaactccagtgatttctacacacactggacaaggtgcaattggacttgtggtattgagagatacgttgaactaa

SEQ ID NO: 372 - DNA, 627 bp, Staphylococcus epidermidis
ggggcacctataatgaatcgatggaaacgcatttcattgcttattgtttttacacttatttttggtataatagctttttttcatgaatcaaggcttggaaaatggatagataacgaagtatatgaatttatttattcatctgaaagtttcattaccacatctattatgttaggtgtaacaaaaattggtgaagtttgggcaatggttgcgctatccttattattagttgcttaccttatgctaaaacgtttcaagattgagacattattctttgtaatagtaatgagcttatctagtacactcaatccactattaaagaatatctttgatagggaacgtccaacattattgcgtttaattgacatttcaggctttagttttccaagcggtcatgctatgggctcaacttcattctttggaagcgctatatatgtaataaaccgtcatgattcgggtatctctaaaggcgtgttaatcggtttatgcgcacttttcattttattaatatcaacttctagagtgtatctaggcgttcattaccctacagatattattgccggcattattggtggtgtattctgcattgttttatcaacgttaatattgaaaaaacaactcgctgtataa

SEQ ID NO: 373 - DNA, 1347 bp, Staphylococcus epidermidis
gtgataactatgactgaatatttaagtgtttctgcactaactaaatatataaaatataaatttgaccaagatcctcatctacagtcagttcttattaaaggagaattatctaactttaaaaagcattcaagcggacatttatattttaatgtcaaggacaaagaaagtgtcatcagtgcaatgatgtttaaaggaaatgcttctaagttaggctttgagcctaaagaaggtgatgaggttttaattgaagctcgcgtttctgtttatgaaagacgaggaaattatcaaatatatgttaataagatgcaactcgatggtattggtaatttataccaaaagcttgaactactaaaaaagaaattgaaaaaagaaggctattttgatcaaagtaacaaaaaactcataccaaagtatccaaagaaaatagcggttttaacagcgagcacaggtgcagccattagagacatacatagtacgattaacaatcgctaccctttggtcgaacaaattcaaatcagtacccttgttcaaggcacgcaagctagacaagatataatagaaaagattcaatatgctgattcattagatgttgatacaataatagttggacgtggtggtggttcaattgaagatttgtggaactttaatgaagaagatgttgttaaaaccatctttaattgtcaaacacctattatatcagctgtaggtcatgagactgattttacattgagcgattttgtagcagatgttagagctgcgacacctactcaagctgctgttatagcaacacctgatcaatatgagttattacaacaaattaaacagtatgaatatacattatcaagatatataaaacaatatatcgaacatcagaagaaacaacttaatcacatatcatcatattacaaatttaagcaaccgagtttattgtacgatcaacaaattcagaaacgagatgaattagaaagacaattaaatcatctattaaatactaaagttgaaaagtcaaaacatcacctcaagttacttcaacaaagttttaattttaaaaatttaaatcagcagattactcaggaaaagcaatctatttatcaattgcattctagattgtccaaaataatgtccaataacattactaatttaaaaacagtgctaaaaaacaaattagaaagtcttaataatttaagccccaccaatacgatgcttagagggtacgcaattgtcaataaagacaatgaagtggttacaagcacacataaattgaatgaaaacgaccaaatatctttaacaatgaaagacggaagtgtcgatgcaacggttaagaaagtaaggtgtaatgatgagtaa

SEQ ID NO: 374 - DNA, 747 bp, Staphylococcus epidermidis
gaggaacatatgaaaaacatcatcgtaattaagctcggtggtatagctatagaaaatttaaacgacgcatttatacaacaaattaatgcttggcaccttgaaaacaaaaaaataattattgttcacggtggcggccaagtcatcagtaatttattaactaaaaacaatcattcaactattaaaattgatggcatgagagtaactgctaaaaatgatttacctatcatatatgatgctttaattaacatagttggccatcaacttttagaaagacttaaagaatctaatttagaattttttcaatttaaagaaaagataaaagaacttgtaagcgccgaatttttaaataaaaatatctatggttacgttggtaaagttaaagaaatcaacacgatgctattagaaaaaatgttatcacgcgacataataccaattatcactagtttgggtgtaaatgagcaaggggagtatcttaatgttaatgctgatcatctcgccaccgcaattgctaagaaactaaaagtcgaaaaattagtatatatgactgatgtccctggtgtaattgaaaaagataaaacgcttgctactcttacaattaatgaagcaaaaacaaaaattgaaaataaaataattacaggcggaatgatacctaaaattgagagtgcaatccaaacattagaatctggtgttgaatcgattttaattgcaaataatttacaaaaaggaacaatcataaggggtgattaa

SEQ ID NO: 375 - DNA, 669 bp, Staphylococcus epidermidis
ggtgcaaatatgacaaatattttaattgtagaagatgagcaaaatcttgctagatttatagagcttgagttaactcatgaaaattatactgttgatatagagaatgatggaaaggtgggtttggataaagcattatctaagccctatgatttatatatattagacttaatgcttccaaacataaatggtctagaaatttgtagacaaattcgtcaaaaaacaactactccaattatcatcattactgcgaaaagcgagacatatgataaagtagctggattggactatggggcagatgactacattgtaaaaccctttgatatagaagaattgcttgcaagaataagagcggtattgcgcagacagccagataaagatgttttagatatcaatggtattatcattgataaagatgcctttaaagttactgttaatggccatcaattagaattaactaaaacagaatacgatttactatatgttttagctgaaaatcgtaaccacgtcatgcaacgtgaacaaattctcgatcacgtatgggggtataatagtgaagtagaaacgaatgtcgttgatgtttatattcgttatttacgtaataaactcaaaccttttaataaagaaaaatccatagaaacagtacgtggcgtagggtatgtgattcgatga

SEQ ID NO: 376 - DNA, 615 bp, Staphylococcus epidermidis
attatgaatataattaagggaaatattgcaagtcctcttggattttcagctgatggtctgcacgctggctttaaaaagaaaaaattagactttggttggattgtttcagaagtacctgcaaatgtagctggtgtatttacaactaataaggtcattgctgcaccattaaaattaacaaaaaacagcatcgaaaaaagtggtaaaatgcaagctattgttgttaattcaggtattgctaattcttgtactggtaaacaaggagaaaaagatgcttttaaaatgcaacaactggccgcaaataaattacaaattcaaccagaatatgttggtgtcgcatctactggtgttattggaaaggtgatgccaatgtctattctaaagaatggcttttccaaactagttaaaaacggtaatgctgatgactttgcaaaagcgatattaacaacggatactcatacaaaaacatgcgttgtaaacgaagaatttggtagcgatacagtaacgatggcaggtgtagcaaaagggtcaggaatgatacatcctaatttggctacaatgctagcatttataacctgtgacgctaacatctcatcacaaacattacaacaggtttaa

SEQ ID NO: 377 - DNA, 2241 bp, Staphylococcus epidermidis
ggaccgcgtatgacggaaaataaagggtcttcccaacctaaaaagaacaacaatgggaagtccaatggaaaaaagaataggaatgtaaagagaacgattattaagattataggttttatgattattgcctttttcgttctattgctactcggtatcttgttgtttgcttattatgcgtggaaagctccagcatttagcgaatcaaaattagatgatccaattccagcaaagatttacgataaaaacggagaacttgtaaaaacacttgataacggacagcgacatgaacatgtgaatatcaaagatgttcctaaagacatgaaaaacgctgttttagctactgaagataaccgtttctaccaacatggagcattagattacaaacgtttatttggtgccattggtaaaaacttaacaggtggatttggttcgcaaggtgcgtctacacttacacaacaagttgtaaaagactcattcttgacacaacaaaaatctatcggtcgtaaagcacaagaagcttatctttcttatagattagaacaagagtacagcaaagatgaaatattccaagtttacatgaataagatttattattcggatggcgttactggaattaaggccgccgctaaatattacttcaacaaagatatgaaggatttaaatttagctgaagaagcttatctagctggtttacctcaagttcctaacctttacaacatttacaacaatcctaaggaagctaataatcgtaaagatactgtgctttatcttatgcataaacataaccgtattaatgataaacaatatgcggatgcgaagaagattgatcttaaagctaacttagttgaacgtactaaaaaagaacgtcaagtcactggaaatgaaaaaaatcctgagtatgattcttacgttaatttcgttcaatctgaattaatgaataacaagtactttaaggataaaaatttaggttcagttcttcaaagtggtataaaaatttatactaatatggataaagatgttcaacaaacgttacaagatcgaattaacaatggttctttctacaagaatgaagaccaacaagttggtgcaacaattctagatagtaaaactggtggattagttgcgatctcaggtggacgtaattataaaaatgttgttgaaagaaaccaagctactgaccctcaccctactggttcatcattaaaacctttcttagcttatggacctgcaatagaaaatatgaagtggtcaacaaatcatgcgattcaagacgaatcatcatattgggtagatggttctcaattcaagaactatgatacgaaaggccatggaacagtttctatctatgatgcattgcgtcaaagtttcaatattccagctttaaaaacttggcaacaagttaaaagtcaagctggtaatgatgcacctcagaaatttgcatctaaattaggattggattatagtggcaaaattggaccttctgaagtattaggtggatcttcatcagaattctcacctactcaactagcttccgcttttgcagcaatagcaaatggtggtacttataataacgcgcattcaatacaaaaagttgttactcatgaaggagatacaattgagtatgaacatacgagtcacaaagctatgaaagactatacatcatatatgttagctgaaattcttaaaggtacatttaaagcatatggttcggcttatggacatggtgtgtcaggcgtaaacatgggtgcgaaaactggtactggtacgtatggacaagaaatatacgaaaagtataatttacctgataatgctgccaaagatgtttggattaatggtttcagtccagaatatactatgtcggtatggatgggcttcaataaggttaaacaatatggaacaaattcatttatcggtcattcagaacaagattatccacaatacttgtatgaagatgtgatgtctagtatctcatctaaagatggtgaagatttcaaaaagcctaatgatgtacaaggaagttcaccggacagtctatctgtatcaggtcattctgataataatactactaaccgtagtgttcatggaagtagcgatacatcttcttcatcaaatggtggctctaactcagcatcaagtggaaacaactcgaatagttcgaatggtaccagtcaaggtaactcaggcaatgcatttacacgtctgttcaatttaaactctatattcgattataaagtttcataa

SEQ ID NO: 378 - DNA, 678 bp, Staphylococcus epidermidis
aaaggaatcataaacatgttagagttcaaacaagtgagcaaatctttcagagatggcaatcaaatgattcaggcagtaaaacctaccgatttaaaaataattcagggggaactgattgctatcgtgggaccctcaggttcagggaaaagtacatttttaactatggctggcgccttacaaagacctacgtcaggaaatatttacatcaataacaaaaatatatcaatattatctgaaaaacagttatctcaaataagaattaacgaaataggttttatattacaatcgacgaatctcgtgccttttttaacaatcgaacaacaattcaaacttcttggtaaatataaaaaagatacattaagtgaagatgaataccaaaagttggttaaacagctaaatttatcggatattaccaatcaattaccaaatcaaatatctggcggtcaaaaacagcgcgtggcaatagctaaagctatttacacaaatccatcaatcatactagcagatgaacctaccgcttcactagatacgaataatgcaatggctgtaatgaaaatacttcaaaaacaaacgaaagaaagaaataaaacatgtgtgattgttactcatgatgaacgtttaactcatttttgtgataaaacatatttcatggaggatggagttctttcactccaatag

SEQ ID NO: 379 - DNA, 480 bp, Staphylococcus epidermidis
atgaaacacatgcacagggggacacacgaagtggaacgcacatttttgatgattaaaccggacgctgtccaaagaaatttaattggtgagattatatctcgcattgaaaagaaaggtcttaagcttgttggcggtaagtttatgcaagtgcctatggaactagctgaaaaacattatagtgaacatgaaggaaaaccgttctacgacaagttaatttcattcattacttctgcacccgtttttgctatggtagtagaaggtgaaaatgctgtagctgtatctcgtaaaattattggaagcacaaatccaagcgaagcagctcctggtacaatccgaggcgactatggtttaaatctaggtcgtaatattatacatggttcagattcaacagaatcagcacaacgtgaagttaaattatggtttacaagtagcgaaattgctgattataaagaaccaagagaagattggctatacgaataa

SEQ ID NO: 380 - DNA, 588 bp, Staphylococcus epidermidis
ggtgtgaacatggaaacgacaataagcaaactaaacaaacatgtagaacaactgcttaagggcattaatgagtatgagcctattgaaatcaatagctctttaagtcatttattagatatgtactctatcccagatgaagctaagattgcttgcctcactattgatacatcaatgcgtcatttggacgctattggtgataatcatctatctaagaaagcaatattaataggggacctattaagcgctcatttctatactctattagcaaatattcaagattccgcttttcaacttgcaatgagcaaggccattgttaaaatcaatgaagataaatcatcaattaatcaaaatgatctcactgataaagagttgaaagatgcgattctagatatagaaacactatttccatatcttacaattaaccattttggaagttctgttgataaaatcaaattattcgctgaattgacttctaaatataaagattaccatcctgagtatctgggtaagtttaacagatatgaaatagataaatatattcaagaaattagcaaaagttataaaaaaagaggtaatgaaaatggctga

SEQ ID NO: 381 - DNA, 2721 bp, Staphylococcus epidermidis
ggagcggacattatgggaatagcaacatttgcagttgttgatttagaaacaactggaaatcaactggattatgatgaaatcattcaaattggtattacgtttgtgcgtcagaatcaagtaattgatacataccattcaatgatacgtaccgatttagaaattccaccgtttatccaagccttaacttctatagaagaagaaatgttagtacaggcaccttattttaatgaggtcgcagatgacatttatcaacttatcaaagactgtgtttttgttgcacataatatctcatttgatcttaattttataaaaaaagcttttgaaaaatgtaatattcaatttaaacctaaaagagtaatggatactttagaattgtttaaaatcgcattccctacagacaaaagctaccagttaagtgcattggctgaatctcatcatataccattaaataatgcacatagagcagatgaagatgcaacaacaactgctaaattgatgattaaagcttttgagaagttcgagcaattgcatttagatacacaaaaacaactgtactatttaagtaaaaatctcaagtatgatctttatcatattttgtttgaaatggttagaaattatcaaactaaaccgcctaacaaccaatttgaacaatttgaacaaattatttaccgtaaacaaattgatttaaaaaaaccggctgtcaattttgatggtaccttaaaagatttatataaaaatgtcactcaatcattaaatcttacatatcggccacaacagttatacctagccgaaattatacttgatcagttgatgcatagtgataaggcaatgattgaagctcctttgggtagtggaaagtctcttgcttacctgcttgcagcaacaatgtataatattgagaccggtcgtcatgtaatgatttcaacaaatacaaaattattacaaagtcagctattagagaaagacataccattactcaatgatgttttagattttaaaattaacgcgtcattaatcaaaagtaaaaatgattatatatctcttggtcttatcagccaaattcttaaagacgatacaaataattatgaagtaagtattcttaaaatgcagttacttatttggataactgaaacaaatactggggacatacaggaattaaatcttaaaggtggacaaaaaatgtatgttgaccaaaaaattgaaacatacgttccagttcgtcatgatatccattattataattatataaaaagaaatgctcaaaacatacaaattggtatcactaatcatgcgcacttaattcattcagacagtgaaaacactatatatcaactatttgatgattgcatcatcgatgaagcacatagattgcctgactatgcgctaaatcaagttactaatgatttaaattattcagatgttaaatatcaattaggacttattggcaaaaatgaaaatgaaaaactacttaaagcagtagacaaacttgagcaacgacgtattttagagaaactagatattgcacctatagacgtttttggactgaaaataaatatcaatgagttacatgatttaaatgagcaactattcactacaatttataatattattcaaacatcagacgtttatgatgatgacattcataagtatcattacgtttatgactttgaaacgggtgagattttaaaagatttacgtgcaatcatagataaattaaataaaacgatagaaatttttaacggaatgaatcacaaaacaatcaagtctgtacggaaacaattattatacttacatgacaaatttaaacttatcgaacaaagtataaaagatcatcatacaagctttatttcaattaaaaatttagcacaaaaatcaacaatccgactcttagtcaaggattatgatgttaaagatatcttgacgaaacaagtactcgaaaaatttaagtctcttacatttatatctggcacattaactttcaatcactcatttaaagcatttcaaaattggtttaatgaagatatagactttaatacatttgaaatttcaacacctttaacatcatccaaccatacaaatgtttttgtgcccaatgatgttgaaacgtacaattataaaaatttagacgattatgtagcttcaattgtagactatattgttgaatacatcacagtgacacagtcgaaatgtcttgtcttatttacaagctataaaatgatgcatatggttcaagatttgttaaatgaattacctgagttagaagattatgtcattttaacccaacaacaaaaccaaaattataaaattgttcaacaatttaataactttgataaatctatacttcttggaacatcaacattttttgaaggttttgattttcaagccaatggccttaaatgtgtaatgatagctaaattaccatttatgaataaacataatattaaatactggcttatggattctgaattcacatcaacttttaaagattatgtattacctgatgctgtaacaaggtttagacaaggtcttggacgtcttattcgacacgaagacgacaaaggacttattgtgtcatttgatgatcgactagtaaatagcacatataaaagcttttttgctcaatcactagaacattttaaacaacgaaaaggtaatattaaacagtttaataaattactgaatcaaatacagaggtctatcgataatgagagtaaaagctaa

SEQ ID NO: 382 - DNA, 1074 bp, Staphylococcus epidermidis
ggtgaaagcatggaacttaaaacatcatatgcaagtgataattatcccatcatcgttaaacatcacgcaattaactctttagaaagatacattaaaaatgaagaacaacgatttttcattatagataagcaagtctataatttatttgtagataaacttgaagctttggctcaaaaatttgatgctaaatgtatcgtaatcccttctggggaaacgtcaaaatcattcgaacattatcatcgtactattgaatatttactaagccatcaattaacacgtcaaacatgtattgttgccattggtggtggtgcaacaggagatttcgcagggtttattgctgcaactttacttagaggagtatcatttgttcaagtaccgacaactattttagcccacgattcaagtgtaggtggtaaagttggaattaattctgagcatggtaaaaatttaattggtgctttttatcgacccaaagctgtcatttatgatttagattttttagaaactctaccatattctgaaatactaagtggctatgctgaggtctataaacacgctttattaaacggtgagaaatcaacaaaaaatatcgaatctaattttacctcaaataaagttttacaagcgttaaaaaatctagattattatttatttgagggtataaaaacaaaactaaatattgttgttgaagatgaaaaagaaaaaggtaaaagaaagtttcttaatcttggtcatacattcggtcatgcaattgaatatgagcataaaatacctcatggtcatgcagttatgattggtattctttatcaatttattgttgcgaaccatttgttcgagacaaattataacattcaacactatattaattatatgaaaaaacttaaatatccattatctatcatcaaacaacttcattttgaagatacttaccattttatgcttctagataaaaaaaatgattacaatggtattcaaatggtcttacttaaaaatttagggaaaccagttgtcactcatgttgataaggatacacttttatcagctttcgaggaattacaatcttattttaagtag

SEQ ID NO: 383 - DNA, 906 bp, Staphylococcus epidermidis
ttgaatttaattggagtgaaagttttggacgttatcaagcaaatacaacaggcaattgtatatattgaggatcgtttgttagagccttttaatttgcaagaattaagtgattacgttggtctttctccgtatcatttggatcaatcttttaagatgatagttggtcagtccccagaggaatatgcgcgtgcacgtaaaatgacaatagcagcaaacgatgtagttaatggagctagtcgattaatggatgttgctaagaaatatcgttatgcgaattctaatgatttcgcaaatgattttagcgattttcatggtatctcacctattcaagctacaacaaaaaaagatgaactaaaaatacagcaacgactgtatataaaattatcaacgactgaaaatgcaccctatacatacagacttcaagagactgatgatatttctttagttggctattcaagatttattcctactgagcaattatcaaatccatttaatattccagactttttagaggatctattagtagatggttatattaaagaacttaaacgttataatgatacgagtccgtatgaattatttgtagtcagctgtcctctggaacaaggtttagaaatatttgttggtgttccgagtgaacgttacccttcacatcttgaaagcagatttttacctggtcgccattatgcattgtttaatttacaaggtgaaattgattatgctacaaacgaggcttggtattatattgagtctagcttgcaacttactttaccttatgagcgaaatagtttatatgttgagatttatccacttgatatttcatttaatgacccattcactaagattcaattatggttgcctattaaacaagaaatctatgatttagatgaaggttatcaaaattaa

SEQ ID NO: 384 - DNA, 1236 bp, Staphylococcus epidermidis
ggtgaaataatgaaaaagattttaatcgctaatcgtggtgaaatcgcagtaagaataataagagcggcacacgatttaggtattcaaacagtagctatatactcagaaggtgacaaagatgcattacatactcaaattgctgatgaagcatactgcgtcggtcctactttatcaaaagattcttatttaaatataccaaatattttatctatcgctacttctacaggatgtgatggtgttcatcctggatacggctttttggctgaaaatggtgattttgctgaattgtgtgaagcatgccaattaaaatttattgggccaagctatcaatcaattcagaaaatgggaataaaagatattgctaaagctgaaatgattaaagccaatgtacctgtagtaccaggaagtgaaggacttattcaaagtatagatgacgctaaaaaaatagctaaaaaaatcggctatccagttatcatcaaagccacagcaggtggtggtggaaaaggtattcgggttgctcgtgatgagaaagaacttgaaactggttaccgtatgacacaacaagaagctgaaaccgcgttcggaaatggtggtttatacttagaaaaatttatagaaaactttagacatatagagattcaaattattggcgatacttatggaaacgttatacatttaggtgaacgtgattgtacaattcaaagaagaatgcaaaagctcgttgaagaagcaccctcaccagtattaagtgaagataaacgccaagaaatgggtaatgctgcaattagagctgcaaaagctgtaaattatgaaaacgcaggtacaattgaatttatatatgatttagatgataaccaattttatttcatggaaatgaatacacgtattcaagttgaacacccagtaactgaaatggtaacaggagtagatttagtaaaattacaactcaaagttgctatgggtgaggcgttaccttttaaacaagaagatatttccattaacggtcacgctattgaatttcgaatcaatgctgaaaatccttacaaaaactttatgccatcaccaggcaagattacccaatatcttgctccaggcggttttggagtgagaattgaatcagcatgttatactaattatacgataccaccttactatgactccatggtggcaaaacttatagttcacgaacctacacgtgaagaatcaattatgacaggcattgcgtgctttaagtga

SEQ ID NO: 385 - DNA, 333 bp, Staphylococcus epidermidis
atgtatcaaatcattaaacaattgttagaggatattgatgaaatgaattataggtatcaacatgtaaaaattaatggcggttcattcgatttttataaagatgttgaaccctatgtcaaaaatattgataatcatttagaggcactcaactgttactcaaaaagcattacagaaacacaatatatgagccaacaaaagttagatatattgatattaaatatacaaaagctttctgtagattgtcattttcctagaacgagccgtaaattatttgtcgaaaaacttaaaagtgcccagtacgatttaaaaaatattttatcgaattatgtttag

SEQ ID NO: 386 - DNA, 1311 bp, Staphylococcus epidermidis
gtgaatcaaatgaataacagtgaaataattaatattaatggaccattcaaaggtgaaatagaagtacccggtgataaatcgatgacacaccgcgctattatgttagcttcattagctaaaggcatatcaaccatttatgaacccttaatgggcgaagattgtcgacgtactatggatatctttaaactattaggtgtaacaattgaagagcaggacaattctatcataatcaattcaccaggatatcaaaatttcataacgccacaccaagtgctctatactggtaattctggtactactacacggttacttgcaggtcttttaagcggattaggcattgaaagtgtgttatctggtgatgtatctataggcaaaagacccatggatagagtgatgaaacctctgttaaaaatgaatgctaatatatctggaattgataataattacacaccacttataattaagccttcaactattaaaggtataaattatcaaatggaagttgcaagtgcacaagttaaaagtgctattttacttgctagcctattttcaaaagaagccacgacacttacagaatttgatgtaagtagaaatcatacagaaacattgtttgcacactttaacattcctatatcaattcaaggtaaaacaatccaaaccataccttatgcaattgaacatatacagcctagagattttcatgttccaggagatatctcatctgctgcatttttcatagtcgcagccctaattacgcccggtagtgacattacaattcataatgttggcattaatcccactcgttcaggtatcatagatatcgttaaacaaatgggaggaaacattgaattaagtaatgtaagcaagggtgcagaaccaactgcatcaatacatgtaaaatatacaccgaacttgaatgctgttacaattaaaggcgacttagttccaagggctatcgatgaattaccagttattgcactactttgcacacaagcttcaaattcttgtattatcaaaaacgcggaagaattaaaagtgaaggaaacaaatcgtatagatactactgcagacatgctaaatttacttggttttaatttacaacccacacatgatggacttattatacatccatcagagtttagatcaaatgcaactgtagatagtcaaacagatcatcgtataggaatgatgttagctgtagcttcactacttagttcagaaccactcaaaatagagcaatttgacgctgttaatgtttccttcccaggttttttacctaaactaaagcttttagaaaatgagggaaaataa

SEQ ID NO: 387 - DNA, 804 bp, Staphylococcus epidermidis
aggatggaaattatggtacaaacagtttacaaaaattcagatcaaacagtttttgaagatgctaaagctttatttcaattaaataagaatatactactaaaagggccaacaggctcaggaaaaaccaagcttgccgaaacgttaagtcatgttatgaaattgcctatgcaccaagttaattgttcagtagatctagatactgaaagcttattaggttttaaaacaattcaaactaatgaagaaggtcaccaagaaattgtcttcatagacggtcctgtaataaaagcaatgaaagaaggtcacattttatatatagatgaaattaatatggcaaaaccggaaacattacctatacttaacggtgtattagattatcgacgtcaattgacaaatccttatactggtgaagtgattaaagcagcacctggatttaatgtaattgctgctataaacgaaggttatgtaggaacattaccaatgaacgaggctttaaaaaatagatttatcgtcatagaaatagattatatcgatggtgacattcttaaaacagtcattaaagagcaaagtaaattacaagatgaacaattgattcaagatattgttaaatttaatgaagatttacgtactatgaccaaacaaggtcaaatttctgaagaggctgcaagtattcgagctttaatcgaccttagtgatttagcaactgtcatgcctattgaacgtgctgtacaacgtacaattattgataaattagaggatgagcgagaacaacaagcgatacttaacgctatcgagctcaatttttaa

SEQ ID NO: 388 - DNA, 675 bp, Staphylococcus epidermidis
atggagagaatcctaatgataagtaagaaaaaagcattacaaatgattgacgttatagcagatatgtttcctaatgcagaatgcgaattaaaccatagaaatgcattcgatcttacaatagctgtattattatcagcacagtgtactgataatctagtcaatcgtgtcactcaatcattatttagaaaatatcgaacacctgaagattatttaaatgtgagtgatgaagaattacaaaatgatatacgctctattggattatatcgcaataaagccaaaaatataaaaaaattatgccactctttaattgaacaatttaatggtcaaatcccacaaacacataaagaattagagagtctagctggagtggggcgtaaaacagcaaatgttgtaatgagtgtcgcatttggagaaccttctttagctgtcgatactcatgttgagagagtttctaaacgtttgggaattaatcgttggaaagatagtgtaagacaagtagaagatcgattatgtgatattatcccaagagatagatggaataaaagccatcatcaattaatattttttgggagatatcattgttttgctagaaaacctaaatgtgagatatgtccgctgttaaatgattgtagagaaggacaaaaacgacataaagcaaagataaaggaggcgtga

SEQ ID NO: 389 - DNA, 240 bp, Staphylococcus epidermidis
ggtgtaatgatgagtaaagaaaagcaaagtttcgaagaaatgatgaaagaacttgaaaatatcgttcaaaaattggataatgaagcagtttctttagaagaatccctcgatttataccaacgtggtatgaaactatctgctaattgtgattcaactttaaaagaagcagagaaaaaagtgaatgaattaatgcaagaagaagttggtgataaaggaaatgaagaaactacagatgaataa

SEQ ID NO: 390 - DNA, 1332 bp, Staphylococcus epidermidis
aatttgatgatcgtttctaaaagaacgtttcggtcattatacattcctattttgatagaacaacttttcatactcatcatgggtcaagctgatacattgatgttaaacagctatagcactgatgccgttgctgcttcgggaatgataagccaaatactcatgctcatcacgtttctgattacaatcattcatgtgggtacaaatatacgtattgttcatttgaaggaacatcaaccttcaagtatttcacaagagatttatcataatttgttattcaatagcatagtatctatcgtatttacgattgtgattgggatcgcattcgaacttatcttacgactttttcaggtacctcaagatatattcaaactgacctatcaatttggaatgattatattgagtgtactcactttaacgacctgtcacatgtatattggtactgtattacgtgtcatgaatcatgcatcatcagctacacgcattactatcattagtaatgtgactaatatcattttgaacggtatcgtactctttattattccagaatatgtaggtaaccctgtattaggtgtcgcggtggtaacagcgttcagtcgtttattgggatgtactttagctttaattgcgctgatacaaattttccgtccattcaagcattacttcaagctgagctggaagaaaatatatcaggtttcgacattaggtatcccaacagcaggtgaacaaatttcttataattttgcacagacatttacaactgcatttattgcgatgttaggcactcaagtcatcgctgcgaaatctgtttctactgttttaagcggcctgtcttttagttgtgctatggcatttagtgctgctagccaaatttatttaggaaaatttatatcccgtcgacgttaccgtactttaaagaaagttgttataaaaagtatttggtttaatatcacacaatctttcatgattatgacgtgtgtatttataggatttatagtgtgtggacgttggataacacacgacatacaaacctatcatttaatcatttactatcttgttatactttttggattagaaccgatacgtgcaattaataatctaattgtagatttattaaacgtgacaggggatgtacgttatccagtcaccgtgagtgttgtgaccacatggttgttattattacctggaagttatctattagggattcattggagattaggttatacaggaattattttagtgagtattgctgatgaagcgctgagatttatcattatgtatcttagatggcgaaatgatcgttggcaagcacgaatgaagcagattggagtatag

SEQ ID NO: 391 - DNA, 1776 bp, Staphylococcus epidermidis
aacctagtgatgaaccgactaaatagtgttgttataaaactgtggttaactattattttaatagtagcgacagttttaattttattaagtgtttcattaatcacttttatacaatattactttacgcaagaaacagaaaatgcaattaaagaagatgccaaaagaattagttcacttgttgagaagtctcataacaaaacattagctatccaaaatagccaaacactcattgatggtgatggaccgggtggcctcattattatgaaagacatgagcgagaaaccagactcatcgtataaagacactaaaaaacaaatgtttaatgaaataaaaaagagtactaaatttaaaaaagtgtttaaagaaggtgagtatgaaactcaaaatattacaataaaaaataaaggtaattctcaatcttatcttttgctaggatacccaatgaaagctcaaaaaggtgctcaaagtcattatagtggtgtttttatatataaagatttgaaatctatcgaagatacaaataatgctattacaattattatattaataactgctattatatttactatagcaagcacaatatttgcattctttttatctaatagaataacgaaacccttacgtcaattaaaaacacaagcacaaaaagtttctgaaggggattatagtcaaatttcaactgtcgctactaaagatgaaataggtgatttatcacgtgcatttaacaacatgaacgtagaaattcaagaacatatcaaagcaatttcttcatctaagaatataagagatacattattaaactctatggtagaaggcgttctaggcattaataatcaacgtgaaatcatattgtcgaacaagatggctgatgatattatgcgtcacattgatgatttttcaaaagaatctattgaacagcaaattgaagcaacatttgaatcacaacagaatgagtatttagaattagaaattaatacaaggtactatgtatttatctccagttatatagatagaattcaaacaaatggtagaagtggtattgtcatggtcatccgtgatatgacaaatgaacataatcttgatcaaatgaaaaaagattttatagcaaatgtatcacatgaattacgtacgccaatctctttattacagggttacactgagtccatagtagacggtatagttaccgaaccagatgaaatacgtgactcattagcaatcgttttagatgaatctaagcgacttaatcgtttagtcaatgaattactaaatgtagctcgtatggatgctgaaggattatcagttgagaaggaattacaacctattcaacaccttcttgataaaatggagtctaaatatcgcatgcaaagtgaagaattaggtttaacaatgacgtttgattctaataatgacgaacaattatggaactatgatatggatagaatggaccaagtgttaactaatttaattgataacgcaacaagatatacacaagctggtgattctataaagatttctattgatgaagattcagatttcaatattttaacaataactgatacaggcactggtatagcgccggaacatctgaaacaagtatttgaccgtttttataaagtggacgctgctcgaaaaagaggtaagcaaggcaccggattaggacttttcatttgtaaaatgattattgaagaacatgggggacgtattgatgttgagagcgaattaggcaaaggtacttcatttattattagactacctaaatcaaaacaaattagttag

SEQ ID NO: 392 - DNA, 987 bp, Staphylococcus epidermidis
aatgggtggatgcacatgtcaaaatatagtcaagacgtcattagaatgttgtatgaacatcaatcaaattacatatcagggcaatatattgccgatcaactcaatatttctagagcaggtgtcaaaaaagttattgacctattaaaagaagatggttgtgatatcaagtcaataaaccacaaaggccatcaactgaattcattacctgatcagtggtatagcggtattgtaaaacctattctcgatgaacttggcctttttaatcatctagaagtttatcacactgtagattcaacacaattaaaagcaaagagagcactcgttggaaataaagatacttttttaattttgagcgatgaacaaaccgaaggtagaggtagattcaatcgtaattgggaatcatctaaaggaaaaggcttatggatgtcactagtgctaagacctgacgtacctttttctatgatacctaaatttaatttatttattgctttaggtattagagatgctattcaacaattttcgaacgaacgtgtaacaattaaatggccaaatgatatatatattggtaataaaaaaatttgcggatttttaactgaaatggttgcaaattatgatgaaatagaagcaataatttgtggtataggtataaatatgaatcatgttgaaagtgattttgacgaggatattaaagataaagcaacaagtatacgcatgcattccgatagtataattaatagatatacttttttaactgcattattaactcaaattatacatcgctttgatcaatttttacatcaaacttttgagtcaattcgagaagaatatattcacgctacaaatatatggcatcgtcaacttaaattcactgaaaataatcatcaatttttgggggaagccatagatattgattcagatggattccttattgttaaagatgaaaaaggtcaattacatcgacttatgagtgcagatatagatttataa

SEQ ID NO: 393 - DNA, 186 bp, Staphylococcus epidermidis
tgtaaagggattcaaactgtacactttttaattataacttctgctagatgcacacaaaataattacgctgttttctcaatgaaacattcgtttaatatattaattttttgcatgtactactcaagcctcatgcgattttcacttacatacatcataattaaaaatattcgaatacatacagaatga

SEQ ID NO: 394 - DNA, 393 bp, Staphylococcus epidermidis
acattgcacttgaaatgcaagtcactttattttgtaatatactatataagaatagcgataaaggagtacttctatatgaaatctatggagcaaatgcaacaagaagttgatgactatatcagtcagtttaaagctggttatttttctccacttgctaatctagcaagaatgacagaagaagttggagaattagcacgcgaaattaaccatcgttttggagagaaaaaaaagaaagatacagaagaagataatacaattaaagctgaattgggagacaatttatttgttttactgtgtattgcaaactctctaaacatagatatgacagaaagctttaatgacacgatgaataagtttaatacaagagataaaaatcgctttgaaagaaaataa

SEQ ID NO: 395 - DNA, 471 bp, Staphylococcus epidermidis
gaaatgaactttaaagaaataaaagaattaatcgaaattcttgatcaatctagtttaactgaaataaatattgaagataataaaggtagcgtagttaatttaaaaaaagaaaaagagactgaaatagttacaccgcaagttactcaacaaccaactcaaccgataaatcatacgcataatgaaacacaacaaaagccatcacatagctctaaagatgaacaaagtagtgataatgaatacaataccattaatgcaccaatggttggtacattttataaatcaccttcaccagatgaaaaagcatacgttcaagttggagataaagttacgaatgaaagtactgtttgtatattagaagctatgaaattatttaatgagattcaagccgaaacaacaggtgaaatcatagaaattttagtagaagacggacaaatggtagagtatggccagccgttatttaaggtgaaataa

SEQ ID NO: 396 - DNA, 186 bp, Staphylococcus epidermidis
ataaatattgtttgtaagctcaatgttaataatatttatcttatattaatttctttgttttcatttttgttaataaaagacttaaaatgttgtcttataaatgttttaagtcttttgttttttgaaaaattacaaacaaaaaattttgatttacgaaaacttaaatttgaaaaaagtttactttaa

SEQ ID NO: 397 - DNA, 981 bp, Staphylococcus epidermidis
gaggaatacgtaatgaaacgtctacttatcatacatactggtggcacaataagtatgtcacaagatcaaactaataaagtgataacgaatgaagaaaatccaatatcacaacatcaaaatatcattagtcaatatgcagaggttgacgaaatcaatcttttaaatataccctcgccgcatatgacaatttcgaatgttgtgcgattaagagacgaaatcattacatattctaaagaaaatatatatgatggatttgtcattactcatggaacagatacacttgaggaaacagcttttttaatagatttattaattgatattcaagagcctatagtaattactggagcaatgagatcatccaatgaaattggttccgatggtctctataattttatttctgctataagggttgcttcttcatctgaggctaatcataaaggtgttatggtcgtatttaatgatgagattcacactgctcgtaatgtgacaaagacacatacttcgaatattaatacatttcaaagtcctaatcaggggcctctaggtgtacttaccaagaatcgagtacaattttatcatcatccttacagacaaactacctaccaatatatcgatgtaaatttacgtgttccacttgtaaaagcatacatgggtatggaagatgatgtactatcattttattcacaacaacacgttgatggtatagtcatcgaagcactaggacaaggtaaccttccaaaaagttgtcttaatggactacagcaatgtctaaagaaaaacattcctctagttctcgtatctagatcattcaatggtattgttagtcctgtatatgcttatgaaggtggtggcgcagatttgaaaaataatggtgttattttttcgaacggtttaaatggaccaaaggcaaggctaaaattactagttggtttgagtcaagacatgactcaaaatcaattagagcgatatttcgaagagtaa

SEQ ID NO: 398 - DNA, 1404 bp, Staphylococcus epidermidis
agttataacgtgattgaattaattaaaatggaagggatgatagttgtgtctaataataattttaaagatgatttcgaaaagaatcgtcaatctattaatccagacgaacatcaaacagaattaaaagaagatgataaaacaaatgaaaataaaaaagaagctgactctcaaaacagtttatctaataactcaaatcaacaatttcctccgagaaatgcccaacgacgaaaaagacgcagagagacagcaactaatcaaagcaaacaacaagacgacaaacatcaaaaaaatagtgacgctaaaactacagaaggttcattagatgaccgttatgacgaagcacagttacagcaacaacatgataaatcgcaacaacaaaataaaactgaaaaacaatcacaagataatagaatgaaagatggaaaagatgcagctattgtaaatggaacatctgagtcaccagaacataaatcaaaatcaacacaaaatagacccggccctaaagctcaacaacaaaagcgtaaatcagaaagtacgcaatcaaaaccgtcaacaaacaaagataaaaaagcagctacaggtgctggaatagctggtgcagctggtgttgctggtgcagcagaaacatccaaacatcatcataataaaaaagataaacaagattctaaacactcaaaccatgagaatgacgaaaaatctgttaaaaatgatgaccaaaagcaatctaaaaaaggcaaaaaagcagcagtcggtgctggcgcagctgcaggagttggtgcggctggtgttgcgcatcataataatcaaaataaacatcataatgaggaaaaaaattctaatcaaaacaatcagtacaatgaccaatcagaaggtaagaaaaaaggtggtttcatgaaaatcttgttaccacttatagcagccattcttattctaggtgcaatagcaatattcggtggtatggctctaaataatcacaacgatagtaaaagtgatgaccaaaaaatagcgaatcaaagtaagaaagactcagataaaaaagatggtgcgcaatccgaagataacaaagacaaaaaatctgattctgataagaacgcagatgatgactctgataatagttcctcaaatcctaacgctacttcaactaataataacgataatgtagccaataataactcaaattatacaaaccaaaatcaacaagataatgcaaaccaaaatagcaataatcaacaggcaactcaaggtcaacaatcacatacagtatacggtcaagaaaacttatatcgtatcgccatacaatattatggagaaggaactcaagctaacgtagataaaattaaacgtgcgaatggattaagcagtaataatattcataatggtcaaacattagttattcctcaataa

SEQ ID NO: 399 - DNA, 624 bp, Staphylococcus epidermidis
aagtgcccagtacgatttaaaaaatattttatcgaattatgtttagtgaggaaaaaaatggttaaaactgtttatattactggttataaatcttttgaactgaatatctataaagacgatgcgccagaagtatattatttaaagcaatttatagctcataaattaaaacatcttttagatgaaggtttagagtgggtattgatacaaggacaaatgggtatagaattatggtctgctgaagtagtgattgaactaaaaaaagacttcccagatattaaactaggtataattacgccatttataggtcatacacaacgatggaatgataagaatcaagctaagtatacaaatattatacaacaagccgattttactgaaagcattcatcacactgagtatatgggtgcctatcaatttaaacaagcagatcaattcatgcttgatcataccgattacactattttaatttatgatgatgaacaagaggcaagccctaaatactttaaggctatgttagttgaatttatggaaaaaacaaactatacttgtgatattgtgacgtttgatgaactcactgacttcatcaacgacttgcagtggtctcaagatcaaagtttcgaatga

SEQ ID NO: 400 - DNA, 789 bp, Staphylococcus epidermidis
gaaggacaagtaaacacatctaacgatagttctaacgaatcttcacaaaaagatgaagctaaagagaaagaaacgccaaaacaatctactccgaattctagtgaaagtgaaaatacacaagataatagccagcaacgtatcaatgcaacaccatctgcacgtcgacatgcgcgtaaaaatggcgttgatttaagcgaagtatccggaaaaggcaatgatgttctaagaaaagatgatgttgaaaatagtcaaaaatcttcaagtcaaacagctaaaagtgaaagcaaatcacaaaacagtggttctaaacaatctaataacaatccatcaaaacctgttattcgtgaaaaaatgtctcgacgcaaaaaaactgctgcaaaaaaattattagaagtatcaaatcaaacagctatgcttactacatttaatgaagttgatatgacaaacgttatggatttacgtaaacgtaaaaaagaacaatttatcaaagatcatgatggtactaaattaggatttatgtccttctttactaaagctgccgttgcagctctcaaaaaatatcctgaagtaaatgctgagatagatggcgatgatatgattactaaacaattttacgatattggcattgcagtatccactgacgatggattactcgtaccatttgttagagattgtgataagaaaaattttgcagaaattgaacaagaaatcgctaatttagccgtaaaagctcgtgataaaaaattaggccttgatgacatggttaacgtttcgtttaccatcaattaa

SEQ ID NO: 401 - DNA, 924 bp, Staphylococcus epidermidis
agcatggaagttacatttttcggtacaagtgctgggttaccgacgaaagagagaaacacacaatccattgctttaaatctagaaccatattcaaattcgatatggttatttgatgtgggcgagggaacacaacatcaaattttaagacactctattaagttagggaagatagatcatatttttataacacacatgcatggtgatcatatttttggtctccctggacttttaacaagtcgttcgtttcaaggtggagaaaataaaccccttactattatagggcctaaaggtattcaaaattacatagaaacatctttacaactttctgaatcgcatttgaattatccgattacctatatcgaaatcaatcaacaattagcgtatcaccacaatggttttactgtacaagctgaaatgcttaaccatggcataccttcattcggatatcgtattgaagccccaatcacgcctggtacaatcaatgtagaggccttgagaggtattggactagagcctggtccaaaatatcaggaagtcaaattacaagaaacgttcgaatataaaggattaatttacaattcggatgattttaaaggtaaagctaaacctggtccaattatcagtatatttggtgatacaaaaccgtgtgaaaatgaatatgaattagcaaagaactcagatttaatgattcatgaagcaacttacattgaaggagataagaaacttgctaataattaccatcatagtcatatagacgatgtatttaatctaattaagcaagctaatgtaaataaaagtcttatcactcatatcagtaacagatataacattgatgaagttacatcaatatacaatgagttatcccttgatcaaacttctccacatttttatttcgttaaagattttgatactttcaaaatataa

SEQ ID NO: 402 - DNA, 204 bp, Staphylococcus epidermidis
ctaagggaagtgaaagctatactcactaatacagaacaacaagcaattcaacacatcgaccaattgatgaatatttattgtcaccaatgtccattaaaaaagcacaatagaaaaactcacggtaaaacacaagcacatcatttttgtataaatgaatgtacggtcggtaaacaaattaaacaaattggtaatgagttacaatag

SEQ ID NO: 403 - DNA, 195 bp, Staphylococcus epidermidis
ataaaaaaggttttaaatgttttttatttgatgatatgtcttaatcttctaaataacagcacaaatataatggaaatgattatgcctttaattaaattaaaaggtatgactccagacacaataacaatttttacgttattaagcacatcacctaaattaaatatcattccatataatggaagtaacacaaaataa

SEQ ID NO: 404 - DNA, 1425 bp, Staphylococcus epidermidis
acaagagaggtaagtaatatgacacaacaaattggagtagtgggtttagcagtaatggggaaaaacctagcttggaatattgaatcacgtggttatagtgtttctgtttataaccgatcaagacaaaaaactgatgaaatggttaaagaatcgcctggaagagaaatttacccaacatactcattagaagaatttgtagaatctttagagaaacctcgtaagattttattaatggtaaaagctggacctgcaacagatgccactatagatggtttattacctttattagacgatgatgatattttaattgatggtggtaatactaattaccaagatacgattcgtcgaaataaagctttagctgaaagtagtattaactttattggtatgggagtttctggtggagaaatcggcgcactcacgggcccttctttaatgccaggtggtcaaaaagatgcttataacaaagtcagcgatatcttggacgcaattgctgctaaggcacaagatggtgcttcatgtgtaacttacattggccctaatggtgcaggacattatgttaagatggtacacaatggtatcgaatatgcagatatgcaattaattgctgaaagttatgcaatgatgaaagatttattaggcatgtcacataaagaaatttctcaaacttttaaagaatggaatgctggagaacttgaaagttatttaatagaaattacaggtgatattttcaataaattagatgatgacaatgaagcacttgtagaaaaaatattagatactgcaggtcaaaaaggcacaggtaaatggacttcaattaacgcactagaattaggtgttcctttaacaatcattacagaatctgtatttgcgagattcatctcatcaattaaagaagaacgtgttactgcttctaaatctttaaaaggacctaaagcacattttgaaggcgataaaaaaacattcttagaaaaaatacgtaaggcactttatatgagtaaaatatgctcatatgcacaaggtttcgctcaaatgagaaaagccagtgaagataatgagtggaatttgaaattaggcgaattagcaatgatttggcgtgaaggttgtattattcgtgcacaattcctacaaaaaattaaagatgcctacgataataatgaaaacttacaaaacttattattagacccttacttcaaaaacattgttatggaatatcaagatgcactacgtgaagtagtagctactagcgtgtacaatggcgtgccaacacctggtttttcagcaagtataaattattatgatagttatcgctcagaggatttacctgcaaacttaattcaagcacaacgtgattactttggcgcacatacttatgaacgtaaagaccgtgaaggtattttccatacacaatgggtagaagaataa

SEQ ID NO: 405 - DNA, 3456 bp, Staphylococcus epidermidis
actaaaggggtaatacttatggcaataaatgaacaattagatactttatataaattaaaaaaagaattggaaaaatctaataacagacctttaattaataccattaatcaagtaataaaaaaagtttatttaaatcaatacaccgcaacatttgtaggacatttctcagctggaaaatcaacgttaattaatttgttattagaacaagatatactaccaagttctccagtaccaacaacgagcaatacagctatcgtttcagtagccaaggaagacgaaatcattgccaatcttacgcaacaacaatatacaaaattaaaaacgtacaacgatgttaaacaaatgaatcgacaaaatgtcgatgtagaatcgatagaaattaattttccatcaaacaaatttaatctagggtttacatttcaagatacaccgggtgttgactctaacgttgcaacgcatcagtcgagtacagagcaatttatgtatacaagtaacttgttgttttatacagtagactataatcatgtccaatcagcgttgaactttaaatttatgaaacgtattaatgaagttggtataccaattatttttgtgattaatcagattgataaacataatgaagaagaaattacatttgaaacttttaaatcaagagtcgaaaaatcaatcaaagactgggatatcaaacttcaagatacttattacgtttcaaagtttgatcatccacagaatgaaattgacaaactttcaaattttctagtatttatggatcaacatcgtgaatcaacagaagactatgttaatagaacaattcaattcattaccgacgcacaatacatatacattcaaaatgaaatgcaatctattcttgacacccttcaaattaatgaagaacaattcgaggaagcatatattcaatttcaacaaaatcaagaagtcagcgcagaagcacaattgctcaatgactctaatcaattatttaattatttaaaacagaagcgtaaagatatattagataatgcttatatcatgacgtacgatatgcgtgaatctttacggaattatttagaaagcatggcaactgattttaaagtgaatggattttttaataaaaggaagaaaaaagaagaagaacaaatcaaacgacttaatgaggcgaccactcaattgcaagagaaagttaatcaacaagtacgacaaccacttcgtgaagatatgtcatttttaactagattcataaataaacatgctgtgaatgaaaaaatactaaatcaagaatatgacgtcgttccgtcacttatatcagagctatatcaaactcaaacgagcattagcaacacatacgttttaacattttcagatgaagttataaaagctttgaataaaaaaatagaaaatgagtcaacaccactatttgaagaagctgtcaatcatgtacaagttaatgaattatcgagtgatgaaaatgaagataggtatgaatatgatagatacattgaacttaacacattaaaggattcgcttacatcccacaactacaaacattactatatccatttagacgattctttagataaattaattggaagaacagagactcattttgaacttaaacaagaaaattcaactgcttatcatcgtaaacatgagacacaacatcgtaacgagtttgttacatctaatcaagatattaagcgtgcattagatatcgttaaagatgtaccattatttgatcgcactaaacaagatatcaccgataccattctgagactcgataatcaaataacaaaagtaggtgtttttggtacatttagcgcaggtaaaagcagcttaatcaacgctctactaggtgataactatttagttagttctcctaatccaacaacagcggcaacgacggaattatcatatggtaaagagagtcaaatcacattaaaatctaaagagcaattactagaggaagttaatcatgtactagaattttatgaaatatcgtttaacaccttagacaactttattaagagcgatttagagaagttaaaatcgaaactagaaaagaaccaacttgcatttattagtgcaattgagaaacattatgaaatgtacacgtcaatgctagaacattcacttatacacacagtatcgcttgaagaaattaaaaagtggagtgccgaggatgagtatgccactttcgtgaaaactgtacaccttaagctacctttagattggcttaagggtaaaatcattattgattcactgggtttacattccaataatcaaagacacacgaatgaaactgaacaaattctcacttcttctgaccttattttgtatgtaacttacttcaatcattcatttacagataacgacaaagcctttatcgaacatatgaaagatatgaatcaattaaatgaaaatcaagcttttaaaatgataattaatgcggttgacctagctgaagataaacaggatatacaagccgttgaggattatgttgcagatgcactggggcaagttaacttacactctgatatatatagtgtttcaagtcgtcaaagtttaaatgggaataacattggcataaatgaattaagagaaagtatacaatactttgcaaaggttgaatctagaacaattttagagcagcagatgacttatcaattgcaacaaatgaataactcctttaaaaaaatgattaaagattttcacgatgacaacgcaaaattatcagctagacaacataaattaaatcactataaaaaccaaaccctattaaatcaagagttgattgatacaactgcacaacgtactttcaatgaagtagaagaacaagtatatcatctaaatgaacggttaaaactacaacttttagatgaggttaaatctgtgtttaatagtcagatgacacaaaataacgactttaatgaggaaaagaaaatttcaactaaaatatatttagatcaaattcatcaacgcttattcttagagcaatcacttatcacagaaaggattaaaaaatattttaattcacaactagaagaacaaatcctaccagtcatgaaaaagttaaatcagattcatgttattataaatgcaaaatttaatgttgagccatcactggttgatacggcgttacttcaaattgaacttaattcaatgttgcaatcactaccaaaacagttaactaaacgtaaaatagttaatccaaagtcacaaaaggatatacaagtacacatagctaatcaaactcttgaattattacaagatgatttgaactcattgcgccgacaattaaatgattatatccatgagatgactcaacttgccgaacatcaatttcaaatgttggagacatccattcaacaacaaattgatgagttactttcattcactatcgatgatacattaatacaacaactagaattgaaaacgacacaattagacaatattttatag

SEQ ID NO: 406 - DNA, 468 bp, Staphylococcus epidermidis
aaacaattattagtagaggagcattttatgatgaatggatacgaagcttatatgaaagaacttgcacaacaaatgagagctgaattaacagacaatggattcacaagtcttgaaacgagtgatgacgtcaatcagtatatgcaaaatatagataatgatgatacaacatttgttgtaatcaactcaacatgcggttgtgctgcaggattagcacgtccagcagctgttgcagttgcagagcagaatgaagtaaaaccagatcataaagtaactgtatttgctggtcaagataaagaagcaacacaaacaatgagagattacatccaacaagttccttcaagtccctcatacgcattatttaaaggtcaacatttagttcattttatacctcgcgaacatattgaagggcgcgacatcaatgatatagctatggatttaaaagatgcttttgatgataattgtcaataa

SEQ ID NO: 407 - DNA, 777 bp, Staphylococcus epidermidis
ataaatatattcaagaaattagcaaaagttataaaaaaagaggtaatgaaaatggctgaaaatcaagctaaaaaagaacaagttcatacagtattccaaaatatttctcaaaaatacgatcgactcaacaacatcataagtttcgaacagcataaagtatggagaaaacatgttatgagtactatgaatgtacaaaaaggcagtaaagctttagatgtgtgttgtggtactgcagattggactattgcattaagcgaagcagtaggctcaaaaggccaagtaactggtcttgattttagtgaaaatatgcttgaggtaggtaaacagaaaactgcttcattggaaaatatccagcttgttcatggtgatgctatgaatttaccttttgatgataactcatttgattatgttactattggttttggcttacgcaatgttccggattatttgtcagcactcaaagaaatgcatcgagttttaaaaccaggaggcatggtggtatgtcttgaaacaagccaaccgacattgccattattcaaacaaatctatagtttatactttaaatttgtgatgccaatttttggtaaaatgtttgctaagtccaaagaagaatatgaatggttgcaacaatcaacatttaattttcctgacaaacaaacattgaaaggcttattcttcgaagcaggatttaacgatatcattgtacgtagctttacaggtggcgttgctgcaatgcaccttggctataaagaaaacagttctagcaaaggtgattaa

SEQ ID NO: 408 - DNA, 186 bp, Staphylococcus epidermidis
gtccactcattaactgacactcctctatttatctttacagataacattataacgtattttgtaacacttgaatatgatgaacactcatataaagatagatatttatttgttgttgatttattatttattagaaaaataaaacatacagattggctaaatattttgtatgtattaaaatgtaattaa

SEQ ID NO: 409 - DNA, 1062 bp, Staphylococcus epidermidis
ggtgcatcattcatgtttttagcttggaatgaaataaaaagaaataaaattaaattcagtttagtcattggcatattagtacttataagttatttattattcctactgtcaggacttgcaaacggccttattaaaatgaatactgaaggtatagaaaagtggaatgcagacgctatcatattaaaaaaagaagctaatcaaaccgtagagcaatccttattcaatatatccaaagtacaaaatacttatgaaaaatcaaccacattaaaacaacaaggagttattatctcaaaccatcatcgggaagaaaacgcgttactttttggcgttacacacaaatcatttttaattccgcctataattaaaggtcatcaagttgaaagttcaaatgaaatagtcattgatcaaacattagctgataaggggttcaaaataggtgacatcttatctttatctcaatcagacgaaaagctaaaagtggtaggtattgtagaaagtgctaaatataatgcttcacccgtgctattctctaataatcaaaccattgagaaacttaatcccaaattatcaaaagataaaacaaatgctatagtaatcaaagactcaaattggaaaaatcataaacttaacaaagatttagaaagcatttcaatatcgcagtttattaaaaatcttcctggctataaagctcaaaatttaactttgaactttatgatcgttttcttatttataatttcagcaacagtaattggcgtattcttatatgttataacactccaaaaaacacacttatttggtgtacttaaagcacaaggctttaccaactgctatttagcaaaaatggtttttgctcaaactttcatattatctttaattggaacaatcataggatttctcttaacactattaacaggtacatttttaccgcctgtcgttccaattcattttaatttattaacgatgttgatatatggaattgttcttatcattatttctttattaggcagtctattttctgtgttgtctataataaaaataaatccacttaaagcaattggatag

SEQ ID NO: 410 - DNA, 552 bp, Staphylococcus epidermidis
actatagcattggataatattgcaatacttgaggcattactatatacttctggcgatgaaggattagaacaaaaacaaattattgacatattagacatcaacctcaatcaattagaagatttagttagtaaatatcattcacatggcttaacaattcaaagatacggctcaacttatgtacttacaacaaaaaaagaaacttttacatacatagaacaattagtcaaagaaaagtctaaaatgaaattatcccaagcagcaatggaaacactctctattattgcatataatcaaccgctgactcgtggagatatagaaatgattagaggaattaattcggatggagctgtaaagactttaatcgctaggggattagtagaagccaaagatgttgatcattctagaagccatcatttaataaccacagatttatttctaaatgtatttggaatcgaaaacttagatgcattacctactacagaagaagatgaagcagaaatggatgaattctttagtaatttagttaaccaaaaaggagagtcaaatgagtaa

SEQ ID NO: 411 - DNA, 1164 bp, Staphylococcus epidermidis
ttcaataaattaaaaggagactcggtcatgtttcaattattagcagtatgtccaatgggattagaagcagttgtagctaaagaaatacaagaattaggttacgatacacaagtagaaaacggtcgtatcttttttgaaggtgatgaaagtgctattgttagatgtaacttatggttacgtaccgcagaccgaataaaaattgtaatgggtcgattcaatgctactactttcgacgaattatttgagcaaacaaagtcattaccatgggagaccgtaattgacaaagaaggtaatttcccggttcaagggcggagtgtaaaatcaacattatatagtgtacctgactgccaagcaattactaaaaaggctatagtagaacgacttaagcatgctcatcaagaaaaaggatggctaagtgaaacaggcgccaaatatcctgtagaagtagcaatattaaaagataatgtattattgaccattgatactgctggttctggactcaacaagcgaggttatcgcattgctcaaggtgaagcacccattaaagaaacattggcagcaagcctcattcgtttagcaaattggaatggtaacacacctttaattgatcctttctgtggttcaggcaccattgctattgaagcatgtcttattgcacaaaatattgcacctggttttaatagggattttgtatctgaacaatggaatatgatgccacctaatatttatgacaaatttcgtgatgaagctgatcaattggctgactatgataaagacatacaagtatatgcttctgatattgatccagaaatgattgaaattgcaaaacgtaatgcagaagaagttggtctcggagatatcatacagttcaatgttaaagatgtgaatactttgtctattgataccgacaagcctgtagcacttgttggcaatccaccgtatggtgaaagaattggagatcgtgaagaagttgaagaaatgtatcgttatataggtacacttttgaaacaacatcctcatttatcggcctacatattaacaagtaacaaagaatttgaatacttagttaatcgaaaagcgactaaaagacgtaagttgttcaacgggtatattgaatgtacgtactatcagtattggggtaaaaagcaaagtaataaaaattaa

SEQ ID NO: 412 - DNA, 648 bp, Staphylococcus epidermidis
tatggtctttcagaagtaatgaatattagtcatcgcaatagatttattgctaaccctggttgttatgcaactgcaactgaattagcgctatatcccttaatcagcaatcatttaatccgtgttgattctataattgttgatgctaaaagtggtcttactggagctggtaaaaaattaaatcagtcatcgcattacgtaaatgtaaacaataattatgtgacgtataaacttaataaacatcaacatattcctgaaattgtacaaacgttgcagttttttaacaaaagtttacagaatattcagttttcgacatcgcttattccggttaatagaggtattgttgcaactatatacacacggcttgaaaacggagttaaaataaatcaaatagaatctacctacaaggatgtatataaaaataagcctttcataagaattaaagatggattaccacagttaaatgaagtaataggaacaaattacactgatattggttttgtttataacgaaaccacgggtgttttaacaatttcatcagttattgataatttaattaaaggtgccgctggacaagcaattcaaaacatgaatctgatgtttaatttcgacgaaactgatggtttaattttggcgcctttatatatctaa

SEQ ID NO: 413 - DNA, 1074 bp, Staphylococcus epidermidis
aaggcttattcttcgaagcaggatttaacgatatcattgtacgtagctttacaggtggcgttgctgcaatgcaccttggctataaagaaaacagttctagcaaaggtgattaacgtggcaaagttaaacattaacaacgaaataaagaaagtagaaaagcgacttgaagaagcaattataagttctgatcaaacattacaagaagcctcattccatttactatcttcagggggaaaaagagttagacccgcttttgttattttaagtggtcaatttggctctaacaacaaaccttcagaagacacgtatcgtgtagcagtagctttagaactaattcacatggctaccttagtccacgatgatgtgatagataaaagtgataaacgtagaggccgactcactatttcaaaaaaatgggaccaaagtacagctattttaacaggaaatttcttacttgctatggggctcaagcatttatctgaaatcagtgatactcgtgtccattcgaccatttctaaatcaattgttgatgtgtgtagaggagaactattccaatttcaagatcaatttaatagcaatcaaacaattactaattacttacgtcgtatcaaccgtaaaacagcacttcttattcaactgtctacacaagttggtgcgattacttccaatgcgtcaaatgacgttattcgtaaattaaaaatgatcggacattatataggtatgagtttccaaataatagatgatgtgctagattttactagttctgaaaagaaacttggtaagccggttggtagtgaccttatgaatggtcatattacattacctgtactattagaaatgcgaaaaaataagacttttaaagataaaatttcacaacttaatcctgacagtcctcaacatgcctttgaaacttgtataacaataattagacagtccgaaagcatagaacaatcaaaacaaataagtgaaaagtatttaaataaagcaatcaatttaatcgatgaattagaggatggtcctaataaagaactatttagaaagcttattaaaaaaatgggaagtcgaaataagtaa

SEQ ID NO: 414 - DNA, 564 bp, Staphylococcus epidermidis
atgaatgattctcttattcgtatcaaacaaaattttatagaatatattctgtttaactatcgttttaaatcaagaatcactgtgtgggtattaaattatttaaaggcaaatcaagataagctaaataatgtacatttcgtaaatagtaaaatcaataatcattataccttagaaattgcagaagtggatgcaactgcttctgcaattcaattgagcaaggataataaatcttatattaatacaaatcaaatttttaattatattgcaaatcatacattaagattagatatacaaatacattttgctaattgtcacatccgagaatctcgcttagatgatttaatattaatgcagctcatacattcacctagttattcatcttatgtacaagacttatattcaatttctatggataaaagaaaacaaacatttattattcaaaccttacaaaacaatattgatttaagtttacaaatgaatgaacctgattatttttatcaactcacacaaatacttaatgtattaaaatcaaaagatattcaatcaactttacatgaaaggtag

SEQ ID NO: 415 - DNA, 945 bp, Staphylococcus epidermidis
ggaagatgtccaatgattttaacattaactttaaatccctcagttgatatatcttatcctttagatcagtttaatttagatactgttaatagggtatctcaaacaagcaaaacagcaggcggtaaaggattaaatgttactagagtattgtctgaatttggtgaagacgtaatagcaagtggttttttaggtggagcattaggtcaatatattgaagaacaaatagaaactactcgtattaaacaagcatttttcaaaatcaaaggcgaaacacgaaattgtattgcaatactacatgaaggacaacaaactgaaatccttgaaaagggtcccacgattgaacttaaggaatcagaggaattcaagtcacatctattaaaacttttcaaagaaactgatgtggctgttatgtctggtagtctgcccaaaggacttaatactgattattatgcggatattgtgagattagcaaaagaacaaggaattttgaccattttagatagctctggtcaatcacttgaggaagttcttattagtaatgtgaaacctacagtaattaaacccaatatagatgaattatcacaacttttaaattacaaagtaaccaatgatattaaagaattgaaagcggcagtaagtcagccaatatttaatgatattgaatggattattgtttcattgggcagtgaaggtgcttttgcaaaacataatcaaaaattttataaggtgaatattcccaacattaaagtagttaatcctgttgggtcaggagattccactgtagcaggaattgcttctggactcattcatcaacaaaccgatgaagagttattaaaaaaagcaaatgcattcggaatgctaaatgcaatggaacaacaaacaggtcatattaatacagataaatttgacgaaatattcaaacaaatagaagttatagaggtgtaa

SEQ ID NO: 416 - DNA, 666 bp, Staphylococcus epidermidis
ggagggaatactgtgggtcaaaaaattaatccaatcggacttcgtgtcggtgttatccgtgattgggaagcaaaatggtatgctgaaaaagactttgcttcacttttacatgaagacttaaaaatccgtaaatttattgataatgaattaaaagaagcgtcagtttctcacgtagatattgaacgtgcagcaaatcgcatcaatattgcaatccatactggtaagccaggaatggttattggtaaaggcggttcagaaattgaaaaacttcgtaacaaattaaataccttaactgataaaaaagtacacatcaacgtaattgaaattaagaaaattgatattgatgcacgtttagttgcagaaaatattgcacgtcaattagaaaatcgtgcttcattccgtcgtgtacaaaaacaagctattacaagagctatgaaaaatggtgctaaaggtatcaaaactcaagtatcaggtcgtttaggcggagctgacatcgctcgtgctgaacaatactcagaaggaactgttccacttcatacattacgtgctgacattgattatgcacacgctgaagccgatacaacatatggtaaattaggcgttaaagtatggatatatcgtggagaagttcttcctactaagaacactagtgaaggaggaaaataa

SEQ ID NO: 417 - DNA, 252 bp, Staphylococcus epidermidis
gggagggataccatggctgataataacaatcaaaacggacaagacgctactcaacaatttataaatattttaaaatcgtttaaatggcgtattattggatttttagcatttttaattatagctatattattcctaactctcggattttggaagacaattttaattatagtgttatgtttaataggaatcggtatcgggtatattaaagaccgtacacaagatttcttaaacttcctaaatagatggagttag

SEQ ID NO: 418 - DNA, 564 bp, Staphylococcus epidermidis
ttgagttggtttttggtgtttttttacaacgttaacaccttccacaacgacacggtctttttttggttcagtagctactactttaccttctttacctttgtctttacctgcgataacttttacgttgtcaccttttttgatatgcatgtgggcacctccttaaattatgtgaatttatttgattggtattatagtacttctggagctagtgatacaattttcatgaagtttccttcacgtaattcacgagcaacaggaccaaagatacgagtaccacgtgggcctttgtcatcacggatgataacacatgcattttcgtcaaatttaatatatgaaccgtcttcacgacgaacacctgattttgtacgaactacaacagcttttacaacgtcaccttttttgacaacgccacctggtgttgcatttttaacagtacatacaataatatcaccaatgttcgctgttttgcgaccagatccacctaatactttaattgtaagaacttcacgagcaccagagttgtctgctacttttaagcgtgtttcttgttggatcattcgttaa

SEQ ID NO: 419 - DNA, 516 bp, Staphylococcus epidermidis
aggagggacacattcatggctcgtagagaagaagaaactaaagaatttgaagaacgcgttgttacgattaaccgtgttgctaaagttgtaaaaggtggtcgtcgtttccgtttcactgcattagtggttgttggagataaaaatggtcgtgtaggtttcggtactggtaaagcgcaagaggtaccagaagctatcaaaaaagctgttgaagcagctaaaaaagatttagtagttgttccacgtgtagaaggtacgactcctcatactataactggtcaatatggatcaggtagcgtatttatgaaaccagccgcacctggtacaggagttatcgctggtggaccagttcgtgccgtattagagttagcaggaattactgatatcttaagtaaatctttaggatcaaatactcctattaatatggttcgtgcgactatcaacggtttacaaaacttaaaaaatgcagaagatgttgctaaattacgtggcaaatctgtagaagaattatacaattaa

SEQ ID NO: 420 - DNA, 492 bp, Staphylococcus epidermidis
tttattcgcactgcaataatgaacgaagcatttatttttaggaggacaattattatgcgtcaaacatttatggcaaatgaatcaaacattgagcgcaaatggtatgttattgatgctgaaggccaaacattaggtcgtttatcatcagaagtagctgctatattacgcggtaaaaataaagtaacttatacaccacacgttgatactggtgattatgtaattatcattaatgcatctaaaattgaattcactggtaacaaagaacaagacaaaatgtactaccgtcattcaaatcacccaggcggtttaaaatcaatctctgctggtgaattaaaaagaacaaatcctgaacgtttattagaaacttcaattaaaggtatgttaccaagtacacgcttaggtgaaaaacaaggtaaaaaattatttgtatatggtggcgctgaacatccacacgctgcacaacaaccagaaaactacgagttacgtggttaa

SEQ ID NO: 421 - DNA, 1023 bp, Staphylococcus epidermidis
agaggtggcactatgaaagcgataggatttaagtcttcattccaattagatgaaggaaattgttttgaggaatttaactttgatatacctcatccatccggccatgaattattagtcaaggttcaaagtattagtgtgaatcctgttgatacaaaacagcgtacaatgccagttgacaaagcgccacgtgtacttggctttgatgctgttggtgtgattgaaaagataggagatcaagtgtcaatgtttcaagaaggggacgtcgttttttattcaggttctcctaaccaaaatggttcgaatgaagaataccaattaatagaggaatatttagtagctaaagcacctacaaatttgaaaagtgaacaagcagctagcctacctttaactgggctaacagcttatgaaacgcttttcgatgtttttggaatttcaaaagaaccatctgaaaataaaggtaaatcattgttaataattaatggagcaggtggtgtaggtagtattgcaacacagatagcgaaattttatgggttgaaggttattacaactgcttcgagagaggatactataaagtggtctgttaatatgggtgctgatgttgtactgaatcataagaaagatttaagtcaacaatttaaagataatcatattgagggtgttgactatatcttttgtacattcgatacagatatgtattatgaaatgatggttaacttagttaaacctagaggacatattgcgacaattgtcgcatttaattcgcaacaagatttaaatttattgaaatctaaaagtgtaacatttacgcatgaatttatgttttcaagaccattacaccatacagatgatgtaatcaaacatcatgaatatcttaaggatataacagaaaaggttgaacagggatattatcaaccaactaccacgaaagttatcgacggattagatgtagatagcctttatgaagcgcatcaaattttagagtctcattctatgattggtaagcttgttatcaatcttaagtaa

SEQ ID NO: 422 - DNA, 372 bp, Staphylococcus epidermidis
attaatatggcacgtattgcaggagtggatattccacgtgaaaaacgcattgttatctcattaacatacgtatatggtattggtacttcaactgctaacaaaattgtagaagaagctaacgtatcagcagatactcgcgttaaagatttaactgacgatgaattaggtcgtatccgtgaagttgtagatggctacaaagtagaaggtgacttacgccgtgaacaaaacttaaacattaaacgtttaatggaaatttcatcataccgtggaattcgtcatcgtcgtggcttaccagttcgtggacaaaaaactaaaaacaatgctcgtacacgtaaaggtccagttaaaacagtagctaataagaaaaaataa

SEQ ID NO: 423 - DNA, 840 bp, Staphylococcus epidermidis
gcgacaatggctcttaaaaaatataagccaattacaaatggtcgtcgtaatatgactactttagatttcgctgaaatcacaaaaacaacacctgaaaagtcattattacaaccgctaccgaaaagagcgggacgcaataaccaaggtaaattgactgttcgccatcatggtggtggacacaaacgtcaataccgtgttatcgattttaaacgtaacaaagatggaatcactgctaaagttgattcaattcaatatgatccaaaccgttcagcaaacattgcattgctagtttatgctgatggtgaaaaaagatatatcatcgcacctaaaggattacaaataggtcaaactgtcgaaagtggtgctgaggcagatatcaaagttggtaatgccttaccattgcaaaacattccagttggtacagtaattcataacatcgagttaaaacctggtaaaggtggacaacttgctcgttctgctggtgctagctctcaagtattaggtaaagaaggtaaatatgtattaatcagattaagatctggtgaagtacgtatgattttatctacatgtcgtgcaacaattggtcaagttggtaacttgcaacatgaattagtaaatgttggtaaagcaggacgctctagatggaaaggtgttcgcccaactgtacgtggttctgtaatgaaccctaatgatcacccacacggtggtggtgaaggtcgtgctccaatcggtagaccatctccaatgtcaccatggggtaaacctacgcttggtaagaaaactcgtcgtggtaaaaaatcttctgacaaacttatcgttcgtggacgtaagaaaaaataa

SEQ ID NO: 424 - DNA, 1965 bp, Staphylococcus epidermidis
attatgaatttcaatcaatttataaataaacaaaatataataatgactgaagatgaacataatgtatatgactttcttaaacatcataatcctaattggtcttctaattatattgatcatttattagatggacgtgataaagtaagtcaacgtttaattacatctttacatagggagaatttagtaaaaagtcgcgatcatagtcgtatacttaatcgacatcagtttgctggatacggagttaatgtgattgccattttagaaatctattttccaacatctaatatttatttgtatgcaccaataactggaatgcatgcattcgatcgcattgatgttgaaggacctttttattttaagaatctaagtaaagaagatgattttgaacgtgtactacatcctaatcaaatattagattggatattaattgaagatgaaaacttaaataacgaggctagcgtacaatttagaaatgatttaaataatagtgcagctaatatgacttttgctttaagtttccagcactatacgatgcgtaatgaaagagcgccattatataaccttattaaaaatgcaaatgatagttacttgcgttccgaacaatctgtcatcgaaggtcatccccttcatcctggtgctaagttaagaaaaggaatgaatgctgaggaaaactttatgtattcatcagaatttggtaatgttattcatctaagagccgtttttattcataaaagtataagtcgtattcaatcatcgaatgtagattacaatgttgccgtaaagcaaatgtttcccgacttaattaaaaccttagaaaaagaatttggcgaagattttaatttacaaaattatcatttaatgatggttcacccttggcaaataaaacatattttacaaagtgattatcgggatgaactaaatgaaaagttaatattgataagtaatcattcggtaccatattatgccggtctatcatttagaacgttagtacctaaacaacctgatttatccccgcacatcaagttatcgacgaatgtacatataaccggtgagattcgaacattgtctgaacaaacgacatataatggaccactagtgacgcaaattttaagagagattatgtcaaaagatgaagatttttcacattatcaatctacttatatcgatgaaaatgcagggattcacttttataatcgaaacgacaatgaggcaattcaaacagatagaagtgaacaattagggactttgtttagaaataatttatatcaatttatatctaatgaaacagtgccagtaattccatcaagtttggttgcgacctatccttataatactgaagcaccaatctgtacgttaatcaaaacgtatcaaaatacgtatcaatataaaaattatgaagaagcagcgaaacaatggattaaagactatagcaaagctcttcttggcttagttatccctctttattcaaaatatggaatttcgctagaggcacatttacaaaattcagtggcaacttttaataaagatggctcactaaatatgatttatatcagggactttgaaggattacgtattgataatgaacaattgaataatgctggatttaccactagacatttccatgaaaaatctagaatccttacaaattctaaaacatcagtatttaataaaatgttctattcaacagttcaaaatcatttaggtgaactcgttattacaatagctaaatattctaatagtaaagtccttgaacaagaaatatggcaaattatttcacaaacagtagaagacatttttaatcacatgactcacatttcaaaacaacatctcaacaacatcaagcgcactattttcgcatccgaaatcgattataagtgtgtcacaacaatgcgtttagaggatcaagcacatgaatatacgtatattaaagtgcataatccacttcatagaaagaatgatttataa

SEQ ID NO: 425 - DNA, 372 bp, Staphylococcus epidermidis
ctcatgggttacagaaaattaggtcgtacttctgatcaacgtaaagcaatgttacgtgacttagcaacttcattaatcgttagtgaacgtatcgagacaactgaagctcgtgctaaagaagttcgtagtgtagtagagaaattgatcacacttggtaaaaaaggtgatttagcatctcgtcgtaatgctgctaaaactttacgtaatgttgaaattttaaatgaagatgactctacacaaactgctcttcaaaaattatttggtgaaatcgctgaacgttatagtgaacgtcaaggtggttacactcgtattcttaaagtaggccctcgtcgtggtgacggcgctgaatcagtaattattgaattagtttaa

SEQ ID NO: 426 - DNA, 579 bp, Staphylococcus epidermidis
gaagctagtcaaaacgttgtattacaaaagaaaactgaagaagtagatggttataatgctatccaagtaggttttgaagataaacaagcatataagaaaggttctaaatctaataaatatgctaataaaccagctgaaggtcatgctaaaaaagctgacacagcacctaagcgcttcattcgtgaattccgcaacgttaacgttgacgaatacgaagtaggtcaagaagtctcagttgatacattcgaaactggtgacatcattgatgttacaggcgtttcaaaaggtaaaggtttccaaggtgctattaaacgtcatggacaaggtcgtggaccaatggctcacggttctcatttccatagagcgccaggttctgtaggtatggcatcagacgcttcaaaagtgtttaaaggacaaaaaatgccaggacgtatgggtggaaacactgttactgttcaaaacttagaagtcgttcaagttgacactgaaaatagtgtgattttagtaaaaggcaatgtacctggacctaaaaaaggtttagtagaaatcacaacttcaataaaaaaaggtaataaataa

SEQ ID NO: 427 - DNA, 372 bp, Staphylococcus epidermidis
cgaatgatccaacaagaaacacgcttaaaagtagcagacaactctggtgctcgtgaagttcttacaattaaagtattaggtggatctggtcgcaaaacagcgaacattggtgatattattgtatgtactgttaaaaatgcaacaccaggtggcgttgtcaaaaaaggtgacgttgtaaaagctgttgtagttcgtacaaaatcaggtgttcgtcgtgaagacggttcatatattaaatttgacgaaaatgcatgtgttatcatccgtgatgacaaaggcccacgtggtactcgtatctttggtcctgttgctcgtgaattacgtgaaggaaacttcatgaaaattgtatcactagctccagaagtactataa

SEQ ID NO: 428 - DNA, 330 bp, Staphylococcus epidermidis
ggaggtgcccacatgcatatcaaaaaaggtgacaacgtaaaagttatcgcaggtaaagacaaaggtaaagaaggtaaagtagtagctactgaaccaaaaaaagaccgtgtcgttgtggaaggtgttaacgttgtaaaaaaacaccaaaaaccaactcaattaaaccctgaaggtggaattttagaaacagaggcagcaatccatgtttctaacgtacaattattagatcctaaaacaaatgaacctacacgtgtaggatataaaacagttgatggtaaaaaagttcgtatcgctaaaaaatcaggcgaagaaattaaagctaataattaa

SEQ ID NO: 429 - DNA, 183 bp, Staphylococcus epidermidis
gttatggctaaattacaaattaccctcactcgtagtgttattggtcgtcctgaaacacaacgtaaaactgttgaagctttaggtcttaaaaagactaatagttcagtagttgttgaagataaccctgcaattcgtgggcaaatcaacaaagttaagcatttattaacaattgaagaaaaataa

SEQ ID NO: 430 - DNA, 222 bp, Staphylococcus epidermidis
tcaatggctaaacaagatgtaattgaattagaaggtacagtactagatactttaccaaacgcaatgtttaaagtagaattagaaaatggtcatgagattttagctcacgtaagtggtaaaatcagaatgaattacattcgtattctacctggcgacaaagtaactgttaagatgtctccgtatgatttatcgcgcggtagaattacttatcgttataaataa

SEQ ID NO: 431 - DNA, 201 bp, Staphylococcus epidermidis
aaggaggctaataaagtggctaaaacttcaatggttgctaagcaacaaaaaaaacaaaaattcgctgtacgtgaatatactcgttgtgaacgctgtggtcgtccacattctgtgtatcgtaaatttaaattatgccgtatttgtttccgtgaattagcttacaaaggtcagattcctggcgtacgtaaagctagctggtaa

SEQ ID NO: 432 - DNA, 585 bp, Staphylococcus epidermidis
ttgatgtataatctaaaattaacttttgctaaggaggtgacgtgcgaggtgaaaagacttaagaattttattctcggcttactcattgtggctatagttggcttcctattatttatgtatatagatgatagtcgcattcaaagttatcaagactacttcttacaatttaattggttccaaccactattgattgggcttgcaggattacttatattaatcggacttatattagtacttagtatttttaaacctacgcatcgcaaacctggactttataaaaactttgatgatggacatatttacgtatcacgtaaagctgttgaaaaaacaatttacgatacaatcgctaaatatgatcaagttagacaaccaaatgttgtaagtaagctttataacaaaaagaataaatcatttattgacatcaaagcagatttcttcgtaccaaaccatgttcaagttaagagtttaacagagagtatccgtgctgatatcaaaagtaatgttgaacactttactgaaattcctgttagaaaattagaagttaacgtacgtgatcagaaaacatctggtccacgtgtattgtaa

SEQ ID NO: 433 - DNA, 525 bp, Staphylococcus epidermidis
tttaaaaataaaggagaatgtattatggcagtagataacaataaagctaaacaagcatatgataatcaaacaggtgttaatgaacaagaaagaaaagagcaacaacaagctcaaaataatcaacctcaatttgaaaacaaattaactttctcagatgaagtagttgaaaaaattgcaggtattgcagcacgtgaagttaaaggaattttagacatgaaaggtggcttcacagatagctttactaacgctttctcaaacggtaacaatgtaactacaggcgtatctgtagaagttggagaaaaacaagctgctgtagatttaaaagttattttagaatatggtgaatctgcacctaaaattttccgtaaagtgacagacttagttaaagaacaagtaaaatatattactggtttagaagttgttgaagttaacatgcaagttgacgacgtaatgacaaaaaaagaatggcaacaaaaaaatgaaaaagataacaaagaaaacaatgaaagagaaggtttaaaataa

SEQ ID NO: 434 - DNA, 771 bp, Staphylococcus epidermidis
gaagtgaataaatcaatgaacaaatatgataggttagatgaaatcacaaaattagtaaataaacgaggttctgtaagaacaaatgaaatcgtcgaagatctaaatgtgtcagatatgactgtgcgccgtgatctcgcagagcttgaagaaaaaggtgttctcactaaaatacatggtggtgctcgtagtaattcagctttccaatataaagaaatgtctcatcaagaaaaacatacacgttttattgaagaaaaacgatttatagcaaagaatgcagtagatttaattgaagatggagatactattttcttaggtccaggtactacagttcaaaaattagctgaagaaataaatcattattcattaacaattattactaattgtttaccagtatttaatatattaataaaaaaacaaacgttacatttcagagtctatttattaggtggggaaatgcgtgatttaactgaagcatttgtaggtgagatgacaaatcagttattaagtcaactaagatttagtaaaatgttttttagtagtaatggtgttaaagatggtctagctatgacatcctcaatagaagaggcttatacgcaacaaattgcacttagccattcgttggaaaaatatttactgattgactcttcaaaaattggtaaggatgatttttcatcattttgtgagcttcgtgaactcaatgcagttttaacagataataatgacttggaaaagaaagaaaaaatagaatcatatgttgaggttattagctaa

SEQ ID NO: 435 - DNA, 507 bp, Staphylococcus epidermidis
tttaggtgtaaagatttgaaagcgctttttcaaaaacacatgtgtttaatcaccttaattcaaaaaaggagacttattatgacgattattattggttcagatgtagatggcaaacgcttaaaagaattaattaaagattatttggaagacaacgattatgatgttttagatgttacagaaggaaaagatttagactttgttgattcaacagtctctgtagctaaagaagttcaaaagtccgacgacaatctaggtattgctatagatgcctatggtgcaggtagttttattgtagcaactaaaattaagggaatgattgcggctgaggtttcagatgagcgttcagcttacatgacacgtagccataataatgcacgcatgattactatgggagctgaaattgttggagatacgcttgctaagaatgtcgcaaaagaatttgtcaatggtcattacgatggtggacgtcatcaaattcgcgtagatatgttaaataaaatgtgttaa

SEQ ID NO: 436 - DNA, 873 bp, Staphylococcus epidermidis
tatacagtcaatttgaattattgtagaatgtttagtgatataaaaatattaggagtggttgatgtgaatgggtcaaatcctatcattgagtttaaagatgtatcatttcaatatcaaagtgacgctgctttcacattaaatcgcgtttcattctcaataccagctggacaatggacttctattgtaggtcacaatggttcaggaaaatctactattgctaaacttatggtaggtatagaagaaccaagtgaaggacaaattctatttcaaaatctaccagtagactctcaaaataagcgagaagtgaggaaacatatcggaattgtttttcaaaacccagataatcaatttgtaggttctatagttaaatttgatgttgcttttggtcttgaaaaccaacttgttccttataaagaaatggtatctaaagttaatcaagttttaactgaagtagatatgataaataaagccgatgatgagccccattcactttcaggagggcagaaacaacgtgttgccattgctggggtacttgcacttaatcctgatgtgctgattttagatgaagcgacaacgatgctagatcctcatggaaagtcatctttacttaaccttgttaatgaagttaaagtaaataatcatgttacaattatttcaatcactcatgatttagatgaagcaatgcatgctgatcaaatcattgtattgaataaaggaactgtttttaaacaaggaacacctcaagatatttttaagtgcgaagatgcactaatatcggttggattggacttaccatttcctttgaaaatgaatcgacttttaggttttgattcaacttatgtaacttatgaagggttgattaaaaaattatga

SEQ ID NO: 437 - DNA, 981 bp, Staphylococcus epidermidis
tttatgacaaaatcacaacaaaaagtgtcatcaattgagaaattaagtaatcaagaaggtattatttcagctttagcatttgatcaacgtggtgcattaaaaagaatgatggcagaacatcaatctgaaacaccaacagttgaacaaatagaacaattaaaagtacttgtttctgaagaattaactaaatatgcgtcttcaattttattagatccagaatatggtttaccagcatcagatgctcgaaataatgactgcggactattacttgcatacgaaaaaactggatatgatgtgaatgcgaaaggtcgtttgccagattgcttggtagaatggtctgcgaaacgtttgaaagagcaaggggccaatgcagttaaatttttactttattatgatgtagatgacacagaagaaattaacatacaaaagaaagcatatattgaacgaattggttcagaatgtgttgccgaagatattcctttcttcttggaagttttaacatatgacgacaatattcctgacaataaaagtgcagaattcgctaaagttaagccacgtaaagttaatgaagcaatgaagttattctctgaagatcgttttaatgtggatgtacttaaagttgaagtacctgtgaatatgaattttgtggaaggattttcagaaggagaagttgtttatactaaagaagaagctgcacaacatttccgtgatcaagatgcagctactcacttaccatatatttatttaagtgcaggtgtatcagcagaattgttccaagatacattaaaatttgcgcatgattctggtgcgcaattcaatggtgttttatgtggacgtgccacatggtcaggagcagttaaggtatacattgaagaaggagagcaagctgccagagaatggttgcgtacggtaggatttaagaatattgatgatttgaatacagtattgaaaacaacagctacatcatggaaaaacaaataa

SEQ ID NO: 438 - DNA, 1776 bp, Staphylococcus epidermidis
attatacaaaaaagggagctgacccctatgaataaattaatagcatggatagaaaaaggaaagccattctttgaaaaaatatcacgaaatatttatttaagagcgattcgtgatggatttattgctgctattccaattatcttattctcaagtatatttattttaattacctatgtaccaaatgtgtttggttttacttggagtaaaactatggaaggtatattgatgaaaccctataactatacaatgggaatagttggtttgcttgtagcaggaaccacagctaaatctttaactgattcttacaatcgaaaactagataaagcgaatcagattaactttatttcgacaatgatggcagctatttgtggatttttattcttagctgctgatcctgttaaagatggtggattttcaagtgcatttatgggaacaaaaggtttattgacagcctttatttctgcgtttattaccgtgattgtttataatttctttgtcaaaagaaatattaccattaaaatgcctaaagaagtaccaccaaatatatctcaagtatttaaagatattttccctttatcagccgtaattttaattttgtatgctttagacttactttctagagcaatagtccacacgaatgtagcaaatgcagtattaaaagtatttgagccactatttactgcggcagatggttggattggggtaacactcatattcggtgcgtttgcgttcttctggtttgtaggtattcatggaccttctattgttgaaccagcgattgcagcaattacttatgcgaaccttgaaacaaatttacacttaatacaagctggagaacatgctgataaagtaattacaccgggtacacagatgttcgtagcaactatgggaggaaccggtgcaacattagttgttccatttatgtttatgtggttaacaaaatcaaaaagaaataaagcgataggtagagcatcagtcgtacctacattctttggtgtcaatgaacccatactttttggtgcaccactagtactaaatccggtattctttataccttttatttttgcacctatagtaaatatatggatttttaaattttttgttgatgttttaaatatgaatagttttagtatctttttaccttggactactcctggtccactcggtattgttatggggactggatttgcattttggtcatttgtgttagcaatattacttattgttgttgatgtgattatttactatccattcttaaaagtatacgatgaacaagtgcttgaagaagaattaggaaataaagaagcaaataatgaattaaaagaaaaagtatcagcaaactttgatacgaaaaaagccgatgctattttagcaactgcaggggcaagtgaagcggatactgatgatacatcttcagttgatgaaacaacttctacatcctctacagatactattagtgaacaaacaaatgttttagttttatgtgcaggtggaggtacaagtggtttactagctaatgctttaaataaagctgctgaagagtatgaagtaccagtaaaagcagcagcaggtggttatggtgcacatatggatattatgaaagattatcaattaattatcttagcaccacaagttgcttcgaattttgaagatattaaacaagatactgatcgcttaggaattaaattagccaaaactgaaggcgctcaatatatcaagttaacaagagacggtgaggcggctttagaatttgtaaaacaacaatttaacaattaa

SEQ ID NO: 439 - DNA, 405 bp, Staphylococcus epidermidis
aggaggcaaaatttaatggcacgtaaacaagtatctcgtaaacgtagagtgaaaaagaatattgaaaatggtgtagctcacatccgttcaacattcaataatactatcgtaactatcactgatgaattcggtaatgcattatcttggtcatcagctggtgcattaggattcaaaggatctaaaaaatcaactccatttgcagctcaaatggcttcagaaacagcttctaaaactgctatggaacatggtttgaaaacagtagaagtaacagtaaaaggacctggtccaggccgtgaatctgctatccgtgcactacaatctgcaggtttagaagtaactgcaatcaaagacgttactccagtaccacacaacggttgtcgtccaccaaaacgtcgtctcgtataa

SEQ ID NO: 440 - DNA, 747 bp, Staphylococcus epidermidis
aaacaaatgaaaaaaccagatattcaacagttaaaagatatcgtaaacaactctaatcaaattgttttctttacaggagctggtgtttcagttgcaagcggaattccagattttcgctcaatgggtggcttgtatgatgaaatatcaaaagatggacagtctccagagtatttgcttagcattgatcatttacatgataataaagaaagttttataaacttttatcatgaaagacttttaattgccgataaaaaacctaatattgttcatcaatggattgcacaactggaaaatcagcaaaaatcacttggcgtcatcactcaaaatatagatggtttacacgaagatgcaggtagtcacaatattgatgagctacatggtacacttaatcgcttttattgtattaactgttatgaggagtactcaaaatcatatgtcatgacacatcatctcaaatattgtgaaaaatgtggtaacgtcatcagacctgatattgttttatacggcgagatgttaaatcaaaaaacagtcttcaaggcattagataaaattcaacatgcagatacactcatcgtattaggttcatcacttgttgtacagcctgctgctggttttgtatcagaatttaaaggtgacaacctagttatcattaatagagatgcaactccatatgatcatacagctagcttagttatacacgatgatatgactaatgttatagaagaaatcttaaatagtaatagttaa

SEQ ID NO: 441 - DNA, 1065 bp, Staphylococcus epidermidis
tgcatggcgaatgttcgtgtcaatttatctaaaattaaatataatgccaaagtacttcaatcgttattagaacgtagacatatccatttcacaccagtaattaaatgtgtcgcaggggataaacgtattgtatcaagtattaagtctttaggaattactcattttgctgaatcaagactagataacattgaacaactcaaagatttagatattacatttacattgttacgacctactgttgaagcagatttggaaaagatgatttcaagagtagaaatgagtatccaaactgaattaaccacaatcaaaaaacttaatacgttagcaaaatcacttgatattaaacatcaaatcatgctaatggttgactggaaagatggtagagaaggggtcttgacctatgatgtggtgcgttatgttcaagaagtacttagattatctcacatacaacttgttggcttggcatttaattttatgtgctttaaatcagaagcacccaatgaaaaagatgttcgtatgataaacaaattcatacataatgtagaaaacgaaactcattttaagtttagaattatttcaggtggaaattcgagtatgttacctcaaacactgtacaatcatttagataaaatcaatgatcttcgtataggggaggcattattaaggggtatagatacgacgacaaatcattcaattaatagcttatatcaaaatgcgatagtattagaagcagaaattatagagataaaaccacgtctatatcaaaaaaataatcaatcttatttacaagctatagtagatatcggttatttagatacgtttattgaggggataaaacctcttgggaatgatataagaatattaggtgcatcaagtgatcatttgatgattgatttaaataaccaagatcattatcaaatcggtgataaacttcaatttagcttgaattatgaagcactgtctcagagcatgtatatgaaaaatttaactaagttatatagtagtgattcaaaaatagaatcccttgttcagaacttcgatatgcatatatattcccagtgctaa

SEQ ID NO: 442 - DNA, 237 bp, Staphylococcus epidermidis
aacgtgaagaattgggtggtgaaacaaatgaaagctaaggaaattagagacttaaccacttcagaaatcgaagaacaaatcaaatcttcaaaagaagagctttttaacctacgctttcagttagctacaggtcaattagaagaaacggcacgtattcgcacagtaagaaaaacgattgcacgtctaaaaactgttgctcgtgaaagagaaattgaacaaagcaaggctaatcaataa

SEQ ID NO: 443 - DNA, 453 bp, Staphylococcus epidermidis
ggaggtgccgaaatgaaattacatgagttaaaagcagctgaaggatcacgtcgtgtacgtaaccgtgtaggtcgtggtgctgcaactggtaacggtaaaacaagtggccgtggtcaaaaaggtcaaaaagcacgttcaggtggtaaagtaagaccaggatttgaaggtggacaattacctttattccgtcgtttgcctaaacgtggtttcactaacattaaccgtaaagaatatgctattgttaacttagaccaactcaataaatttgaagatggtactgaagttactccagctttattagtagaatctggtgttgttaagaatgaaaaatctggtatcaaagtactaggtaacggttcactagacaagaaattaacagtgaaagctcataaattctcagcttcagcagcagaagctattgatgcaaaaggtggagcacacgaggtgatctaa

SEQ ID NO: 444 - DNA, 387 bp, Staphylococcus epidermidis
cactctaaagaaaggagtattgaaatgatcagtaaaattgataaaaacaaagtacgtttgaaaagacgtgctcgtgttcgtactaaattatcaggtacagctgaaaagccacgtttaaatgtgtatcgttcaaacaaacacatctatgcacaaattattgatgacgttaaaggcgtaacacttgctcaagcatcatcacaagataaagatattgcaaacacatcagcttcaaaagttgacttagcaactactgttggtcaagcaattgctaaaaaagctaacgataaaggtattaaagaaatcgtcttcgatcgcggaggatatttataccacggacgtgttaaagctttagctgatgctgcaagagaaaatggattagaattttaa

SEQ ID NO: 445 - DNA, 285 bp, Staphylococcus epidermidis
ttgaaagaggaggttacaaaagtgagcgaaagaaacgatcgtaaagtttatgtaggtagagttgtttcagataaaatggacaaaacaatcactgttctagtggaaacttacaaaacgcacaaattatacggcaaacgagtaaaatactctaaaaaatacaaaactcatgatgaaaacaattcagctaaattaggagacattgttaaaattcaagaaactcgtcctttatcagcaacaaaacgttttcgtttagtagaaattgttgaagagtcagtaattatttaa

SEQ ID NO: 446 - DNA, 372 bp, Staphylococcus epidermidis
gtagaggaggaaatcctgatggaagcaaaagcggttgctagaacaataagaatcgcacctcgtaaagtaagacttgttcttgatttaatcagaggtaaaaatgctggagaagctattgctattttaaaattaactaataaagcttcatcaccagtgattgaaaaagtattaatgtccgctttagcaaatgctgagcacaactatgatatgaatacagatgaattagttgtaaaagaagcatatgctaatgaaggaccaactttaaaacgtttccgcccacgtgcacaaggacgtgcaagtgcaattaataaacgtacaagccacattacaatcgtcgtaagtgacggtaaagaagaagctaaagaagcttaa

SEQ ID NO: 447 - DNA, 1848 bp, Staphylococcus epidermidis
ctacatttactattatgggaattagcactatcagtatttcactcattttttatatcatacaacgtatttcgaatatggaggagagcaataatgaatcataaggaatggcttttagctgacaaaaacatccaatatcgaacgattaacgcaatgattaaggaacatattgtttctgaaggtatgcgtattaaagaaggtacgtgtaaagttgaaatttttctcaataatcaccttttatcgttaaaagtagcgcgaaaaagtgccttaaaaagatacgtttttactggtgacatagtattaaaaaataaaaaattgtctcaatcaattgaaagtttagaagaacttcttcaaatactaacggaaatatttcatatcaacatttcaaaacgattatacgatgaattaatacatagtagggatagtttgtatgaaacgtacaaacatttttataatagacaaacactcattcatcagagtatgaaatttagtaaattacccgattctataaattttattgcttggctgcaacatttacaagatagtggtattacagatgatttaagttactcggaaagtcttgtgatagaagggcatccaacacatcctttaacaaaaactaaattgcctctcagtactaatgaattgaaactttatgcaccagaatttgaaaaagttattccattaaatattatgcttattgaaaaaaatcatgtagtaacaacagcaataaatgatgatcaaaattttattctaaatcaagttattcctgaatatcgagatcgtttaaaatgctacctcgagccacttcgattaaatcttaacgattacagagtgatgttgatacatccttggcagtatgatcatactatcggcgaacaatttgaagaatggatagccaagaaaatcttactacctacaccatttactgttgagtccaaagctactttatcatttagaacaatggatttaattcatacaccatatcatgtgaaattgccagtaaatgttcaagctacaagtgctgttagaacagtttcatcagttacgactgtagatggtcctaagttaagccatgcattacaaggattgcttcaggaatttccagaacttcaagtcgcgatggaaccttatggagcttatgctcacacggcatctgatttatcaaaacaattagcgcttatcatacgtcaaaaacctacgatatatgattatggttgtacagttgtaacagctagtttagttaatcctaatccaattgataatcaggcagttgtagatagttatttaaaatggatagaaaatgaaatcacacttgatcatattaagcattttatagcaatttatacacaaaccttagttacaccgcttattgcgtatattcaaaattatggcatagcacttgaagcacatatgcaaaatacgattgttaatcttggacctaattataaaatgaaattcattgtacgtgatttaggtggttctcgtatagatttaaatacacttaaacagaaagttcctcaaatagatgttacaaatgaaagtcttattgcagatactattgaagaggttattgctaaatttcaacatgcagttattcaaaatcaactagcagaattgattcatcattttaatcagtatgatgaagtaatagaagaagaattatttgaaattgtgcgtgaagaaatcgaaatggcaatcgataatgacaagccacatgctgaaaaattgaaaaaaatattgtttgggtcaactatcacagtcaaagctttattaagtatgagaatggaaaataaagtgaaaaaatatttaaataccaagttagataatccaataaaaaaagaggtgtag

SEQ ID NO: 448 - DNA, 339 bp, Staphylococcus epidermidis
aaacttatttgggtgtgcggcgtaaagctgcacgcacacaataagaagggaggcgcccaaatggctcgtagtattaaaaaaggacctttcgtcgatgatcacttaatgaaaaaagtagaagctcaagacggaagtgaaaagaaacaagtgattaaaacatggtctcgtcgttctacaattttcccaaatttcattggtcatacttttgcagtatacgatggacgtaaacatgtacctgtatatgtcactgaagatatggtaggtcacaaattaggtgaatttgctcctacacgtacttttaaaggacatgcagcagacgacaagaaaacaagaagataa

SEQ ID NO: 449 - DNA, 1323 bp, Staphylococcus epidermidis
tgcaaaaggtggagcacacgaggtgatctaatgtttcaaacgtttgtacgtttctttacaactaaagaagtacgaaacaagattttcttcactctagcaatgttagttatttttaaaataggaacgtatattcctgctccaggagttaatcctgaagccttcaatcatccacagggatctcaaggtgccactgagttattaaatacttttggtggcggtgccttgaaacgtttctcaatatttgcgatgggaatcatgccttatatcactgcatccatcgtcatgcaattactgcaaatggatattgttcctaaatttacagagtgggcaaaacaaggtgaaatgggtagaagaaaaattaataacgtaactcgttattttgctataattttagcttttatccaatctataggtatggctttccaatttaataactatctcaaaggacaacttattatagaaaagtctgttatgagttatttattaattgcagttgtattaacagcgggaacagctttcttaatttggcttggtgaccaaatcacacagtttggtgttggtaacggtatttctcttatcatctttgcaggtatattatcaactttaccttcgagtctagaacaatttgcacaatcagtgtttgtgggtcaagacgatacttcacttgcttggctgaaaatactaggattgatagtagccttgattttactaacagtaggcgcaatatttgttcttgaagctaaacgtaaaatacctattcaatatgcaaagaaacaatctgctcaacgattaggttcacaagcaacttatctacctttgaaagttaactctgccggtgttattccagttatctttgcgatggcgtttttcttgttaccaagaactttgactttattcttcccgaaagcagaatgggcacagaatattgctgatactgccaacccgtcaagtaatattggaatgattatttatgtagttttaattattgcatttgcatatttttatgcttttgtacaagttaatcctgaaaaaatggcagataaccttaaaaagcaaggtagttatgtcccaggaattagacctggtgaacaaacaaaaaaatatattactaaagtactttatagattgacttttgttggttcaattttcttagcagctatagctattttacctattattgcgactaaatttatgggcttaccacaatcaattcaaattggtggtacgagtcttttgatcgttattggtgtagctattgaaactatgaaaactttagaagcacaagtcactcaaaaagaatataaaggctttggtggtagataa

SEQ ID NO: 450 - DNA, 291 bp, Staphylococcus epidermidis
ggaggtgctcgcataatggaagcaagagatgttcttaagcgccccgtaatcactgaaaaatcttctgaagctatggcagaagataaatacacttttgatgtagatactcgtgcaaataaaacacaagttaaaattgctgttgaagaaatcttcgacgttaaagttgatagtgtaaatattatcaactacaaacctaagaaaaaacgtatgggccgttaccaaggctatacaaacaaaagaagaaaagcgattgttaaactaaaagaaggttcaatcgatttatttaactaa

SEQ ID NO: 451 - DNA, 366 bp, Staphylococcus epidermidis
aaacaacagctacatcatggaaaaacaaataatgtaagggaggatattcaaatgaatagagatgaggtacaattactcggatttgaaattgttgcctatgctggggatgcacgttcaaaattattagaagctttaaatgctgctaaagatagtgaatttgataaagcagaacaacttgtagaggaagcgaatgaatgtattgctaatgcacataaagcacaaaccaatcttctagctcaagaggctaaaggcgaggatatcgcatatagtatcactatgattcatggtcaagaccatttaatgacaacattacttttaaaagatttaatgaagcatttaattgaattatacaaaaaagggagctga

SEQ ID NO: 452 - DNA, 669 bp, Staphylococcus epidermidis
ataatttgtaggagggcatttatgaatatcattttaatgggcttacctggtgcaggtaaagggactcaggcgagtgaaattgttaagaaattcccaataccacatatttctactggtgacatgttcagaaaagcgattaaagatgaaacagatttaggaaaagaagctaaatcatatatggatcgtggagaattagttcctgatgaagttactgtaggtatcgttaaagaaagaatttctgaagacgatgcaaaaaaaggattcttgttagatggattcccaagaactatagatcaagctgagtcattaaatcaaattatgtctgagcttgatagagaaattgatgctgtcattaatatcgaagttcctgaggaagaattaatgaatcgtcttacaggtcgtcgtatctgtgagaaatgtggtacaacatatcatcttgtatttaatcctccaaaggttgatggtatatgtgatatcgatggtggaaagttatatcaacgtgaagatgacaatccagaaacagtatctaatcgtttgagcgttaatgttaaacaatctaaacctattttagaatattacaacaacaaaggtgtcttgaaaaacattgatggttcaaaagatattgacgaagtaaccaacgatgtcattgatatcttagatcatttataa

SEQ ID NO: 453 - DNA, 828 bp, Staphylococcus epidermidis
agttgtataaggagtggcatcatgaagaataaattaatcattggacgatatcttcctatgcaatcaattattcatcagcttgatcctagagctaagttaatatttgtctttttctttattattttaatttttttctgtcattcactaggtacatatgcatggttgtttctttttataatattatttattaagttagcacgcattcctttttggtttttaattaaaggattaacacctatctttttcttcttggttttcactttttctatgcatgtgttatttactaatggaggtatcgtattatttcaatggaaatttatcactattgaatcaagtggtgttatggaaggaatttatatatcactaagattgatttttatagttatgattgcaacaatcatgacactttcgactagtccgattgatttaacagatgcttttgaaaaattatttgcacctcttaaagtgattaaagtaccagtacatcaattaagtatgatgatgtctattgctctaaggtttataccaacgttaatggatgaattagaaaaaattatacttgctcaaaaatctagaggatcagaaataagttcaggaagtttaataacacgaattagagcttttatacccatcatgattccattatttatttctgcctttcaaagagcagaagaactagctatagcaatggaagtcagaggttatgatattaacatcaaacgaacaagctataggttattacattggcaatataaagacacattaacagtcttacttttaatacctatcgctactatattatttattttaaaattttcaggagtgtaa

SEQ ID NO: 454 - DNA, 423 bp, Staphylococcus epidermidis
gagtctgaaaggaggcaacaatcaatgacaatgacagatccaatcgcagatatgcttactcgtgtaagaaacgctaacatggtgcgccacgagaaattagaattacctgcgtctaatattaaaaaagaaattgctgaaatcttaaagagtgaaggtttcattaaaaatgttgaatatgtagaagacgataaacaaggtgttattcgtttattcttgaaatatggtcaaaacaatgaacgtgttatcacaggtttaaaacgtatttctaaaccaggtttacgtgtttacgctaaagcaaatgaagtgccaaaagtattaaatggcttaggtattgcattagtttcaacttctgaaggtgttatcactgataaagaagcaagaaaacgtaatgttggtggagaaattatcgcatacgtttggtaa

SEQ ID NO: 455 - DNA, 867 bp, Staphylococcus epidermidis
aaaattatgagtatacaatttaatcaagtgagttatatttatcaacaagggacaccttatgaatttgaagctattaaaaacgtttcactaactcttgaacagggcaagtattatgcaattattggtcaaactggaagtgggaaatccactttgattcaacatttgaatgctttattaaagcccactacaggttcagtcaacattaatggtttagaagttacaaataaaactaaagacaagcacttacgtcacataagaaaagaagtaggtgtagtatttcaatttccagaatcccaattatttgaagatagtgttgaaaaagaaattgagtttggacctaaaaattttaatatgaacctaaaaaatgttaaagataaagcttttcaacttcttcttgaattaggcttttcaagaaatgtgatgtcatcctctccatttcaaatgtcgggaggacaaatgagaaaaatagccattgtttccattttggctatggatccacaagtaattattctagatgaaccgactgctgggttagacccaaatagtaaacaccaagtcatgtctttaataaagaaaatacaaatagaagaaaataaaacgattattcttgtttcacatgatatggatgatgtagcacgttattcagatgaggttgtagtaatgaataaagggacgatagtagaaaaatcaaatcctagaaatttatttaatcaaaaaacgcaattattaaagtggcatatagagttgcctaaagtagtgaaattacagaaagatatcgaaaaaaaatataatatgttatttccaaagcttgccacgaatgaagaagagtttgtgaagttgtataaggagtggcatcatgaagaataa

SEQ ID NO: 456 - DNA, 558 bp, Staphylococcus epidermidis
ataataaggaggtgccataacatgagtcgtgttggtaagaaaattattgacattcctagtgacgtaacagtaacttttgacggaagtcatgtcactgtaaaaggtccaaaaggtgaattagaaagaactttaaatgaaagaatgacatttaaacaagaagaaaacactgttgaagttgtaagaccatctgattctaaagaagacagaacagatcatggtacaactcgtgctttattaaataatatggtactaggtgtttctcaaggttatgaaaaaacacttgagcttgttggtgtaggttaccgtgcacaaatgcaaggtaaagatttagtacttaatgttggatactctcacccagttgaaattaaagcagaagaaggcattactttcgctgttgagaaaaatacaactgttaaagtatctggtgtttctaaagaacaagttggtgcgattgcttctaacattcgttctgtaagacctccagaaccttataaaggtaaaggtattcgctaccaaggtgaatatgtacgccgtaaagaaggtaaaactggtaaataa

SEQ ID NO: 457 - DNA, 1047 bp, Staphylococcus epidermidis
atgaagaggagatgtgtgttcatgagattaagtttacttgattatgtcccgttgttcgaagggcgtaccccaaatgacgccctaaagcatagtattaaattagcccaacacgctgagaaacttgggtacttacgatactgggttgcagaacatcatcaagtttattctgtcgtttctagtgcacctgaaataataatgatgtcgattttagaacacacacaacacatcagagttggtagtggaggtgtgatgttaccacattatagtccttataaagtagctgagcaatttaaaattatggaagcaagacacccccaacgtatcgatatggctatcggacgttcgccaagctttaaaaatgttaatgcagcactaaatgaaaacaaaaatgaaaaattaccattcaatactcagattactgatttgcttaaatacttcaataacgatacaactcaagaccatcgttttaaatcattattagctacacctatggttacttcatttcctcaactatatattttaggtatgagtaatagaagcgcaaaattagctgctcagcgcggactaccttttgttattgcacgaatgggacaatctgagacagaccttcatgaagctataagcacttatagaaaatattttaaagcttatcatggtgaaattaataatgcgaaaccatatgttattttagcaacttttgtggtaacagcttctaatttatctagagttaaacaattgctacatacgcttcaactttggttgatgcgtattaactatttaaatcaacctaagagttatccatcgattgaaacagcacagaacaagcattatagtcaacgagaattagaaaagcttgaaaagatgaaatcgaaaatcatatacggaatgccaaatgatgttgcggaacaacttaccttacttcatcaacaatttaaagtggatgaaatcatcatcttacctcatgtatttggtgaagacgctagaatggaattaattgagttaattgcgaatgaattgattccatcttgttcacgcgatgaattttag

SEQ ID NO: 458 - DNA, 648 bp, Staphylococcus epidermidis
aaagcgaaaggaggaaattgcataatggctaattatgatgttttaaaagtagacggatcaaaatcaggttcagttgaattaaacgatgcagtatttgctattgaacctaataatagcgttctattcgaagctattaacttacaacgtgcgtcattacgccaaggtactcacgctgttaagaatcgttcagcagtacgtggtggtggacgtaaaccatggagacaaaaaggtacaggtcgtgcacgtcaaggtacaatccgtgcgccacaatggcgtggtggtggtgtagtattcggaccaacaccaagaagctatgcatataaaatgccaaagaaaatgcgtcgtttagcattacgttctgcattatcttttaaagttcaagaaaatagctttacaattgtagatacttttggttttgaagcaccaaaaacaaaagaattcaaaaatgtattaactactcttgaacaacctaagaaagtattagttgtaacagaaagcgaagatgtaaatgttgaattatcagcacgtaacattcctggtgttcaagttacaactgctcaaggattaaatgtacttgatctaacaagcgctgacagtgtaatcattacagaagcagctgcgaaaaaagttgaggaggtgctcgcataa

SEQ ID NO: 459 - DNA, 558 bp, Staphylococcus epidermidis
ttgaaaggaggatccactttgaaccgtttaaaagaaaaatttaatacagaagttactgaaaacttagtgaaaaaattcaattatagttcagtaatggaagtaccaaaaattgaaaaaatcgttgtgaatatgggtgtaggtgacgcagttcaaaattctaaagttttagacaacgctgttgaagaattagaattaattactggtcaaaaaccattagtaacaaaagctaaaaaatcagttgcaacattccgtttacgtgaaggtatgccaatcggtgcgaaagtcactcttcgcggagaaagaatgtatgaattcttagacaaactcattgcagtttcattaccacgtgtacgtgacttccaaggtgtttctaaaacagcttttgatggtcgtggaaattacacacttggtgttaaagaacaattaattttcccagaaattgactacgataaagtaacaaaagttagaggaatggatattgttatcgtaacaactgctaacactgacgaggaagctcgtgaattgttaacaaacttcggtatgccatttcgtaaataa

SEQ ID NO: 460 - DNA, 807 bp, Staphylococcus epidermidis
atattgcgtatattagttgaaattgcttatcaaggtaaccaatttttaggttttcaaattcagcaacaaggacgaactgttcaacaacaatttgaaaagattcttaaacgaatgcataaacatcatgtacgaattcatccttcaagcagaacagacaggggtgtacatgcgtatcagcaattctttcatttcgataccgaattgaatattgataacaaacaatggcaatatgcgatgaatcgagctttaccagatgatatttacgttaaaaatgtacgaaatgtcgacgagtattttcattgtcgttatgactgcgtaggcaaacgctatcgttacaaagtttatcaaggtaatcatcgaaatccttttaagagtggtactgaaacatttgtttatgaaacattagactatgataaaatgaacaaagctgcgcaagaatttataggtacacatgattttaccggtttttgttcacagaaaacagaagttgaaagcaaagtaagaacactatatcagagcgaaattgttgctactaaagaagggtttgattacgtcgtaacaggttctggattcctttataatatggtccgtgtattggtagctttcttaattgaagtaggaaaaggaaagcatgaacctaatgacgtccctaagctcttagaggacaaaaatagaaataatgtgcctctcacagctccacctgatggattatatttagaaaagatttatttaagcccagaagaattgatacaagaatatggaaaagatataaaaatacactacaaaaaatcgttggaaaaacactaa

SEQ ID NO: 461 - DNA, 1044 bp, Staphylococcus epidermidis
cacaatagcataaactactattataaggatgatgatgatatgaataatgaacaaatagtatttaataaagtaccagacggaatgccacaagacgatacatttaaatatgaagatatagatgttattgaaccttcagaaaatgaattgcaattgaaaacattatatatatcggttgatccatatatgagaggacgtatgacaaatgctgattcttatatagatccgttcaaacaaggggaaccgttcaatggacatacggtatctaaagttttgaaatccaaggatagtaattttgatgaaggtgatatagtagtgggtatgctaccttggagaaaaataaatacagtaaatagtgagtatgttaacaaagtacctacttctgacgtaccattacatctttatcttagtgtgttggggatgcctggtcagactgcttatcatggattacttgatattggacaacctaaagaaggtgaaacagtagttatttcagcagcttcaggtgcagttggttcagttgtgggccaaattgcgaagcttaaaggttgcagagtcgttggtatagctggtggagataaaaaagtgaactatctaaaaaatgaacttcgttttgatgctggtatcgattacaaaaaagataatttccctgaagcgttaaaagaagcggtgcctaacggtatagatgtctacttcgaaaatgtaggtggatatattggcgatgaagtcttcaaacatctcaatacacatgcaagaattcctgtttgtggtgcgatttcatcctataatcatccagaaaaagatattggaccacgcattcagcaaacattgattaaaaatcaagcaatgatgagaggtttcatagtagcagaattcgctgatggttttaaagaagcgagcaaacaattagctcaatgggttcaagagaataaaattaaaacacaagtttcagtagaagatggttttgataaagtgccgcaagcctttagaaatctgctaactggtgataattttggtaaacaagttattaaagtggcaagtgaataa

SEQ ID NO: 462 - DNA, 1236 bp, Staphylococcus epidermidis
tccatattaatgataatgataattattatcaatgaaaaagacaggtggaatttgatggcaaaatatttcttttccagttcttttctgttatttttaggaaattggattggtcaagtgggtttaaattggttcgtactcacaacatatcataatgctgtatatttgggtttagttaatttctgtcgtcttatacctattttactattaagtgtttgggcaggatccatagctgataaatatgacaaagggcttctgttacggatcactattacttcatcattcataattacagcattattgtgtttacttacttatagtcttaacagtataccgattttcatcattcttttatatgcaacatttaggggcatactaagtgctgtagaaactccagtgagacaagcagttttacctgatttatctagtaaaatttctacaactcaagcagtttcttttcattcgttcattattaatatatgccgatcaataggaccagcaatagcaggtggattaatagctgtataccatacacccactacatttttagctcaagcagtgtgctattttatcgcagcagttttatgtatacctattcattttgaagtcatattaagtcaaaaagaaggaaaagcactaccacttaaagttgtactaaattattttaaaagtaatttagaaggtagtcagatattcattacgtctataattattatggcaacaggcttttcttacactacagttttaccagtattaacaaaccatatttttcctggtcaatcgcaagtgtttggtatagctatgactttttgtgcgattggaggaatagttgcaacaatagtcttaccatcaattttaaaacacttgagtacagtaaaaatgtattatctcagttcaatattatttggtatagctttactaggtattatcatacatcatttagtagttatgtttatctgtattacgttaataggcttgtttagtcaatgggctagaacaactaatagagtttattttcaacatagtgtaaaggactgtgatagagggaaagtattaagtattataatgatggatcgaggtatgattccgttaggtagtttaataatgagctttttcgcggatatgttcggtattttaactacatttactattatgggaattagcactatcagtatttcactcattttttatatcatacaacgtatttcgaatatggaggagagcaataatgaatcataa

SEQ ID NO: 463 - DNA, 540 bp, Staphylococcus epidermidis
aatgtgttaataggaggaataaaaatgaaaattgcaataggttgcgatcatattgttactgatacaaaaatggaagtttcacaacacttaaaatcacagggacatgaagtgatagatgttggaacttatgatttcacacgtacacattatccgatttatggaaaaaaggtaggagaaaaagttgcgagtggtgaagcagatttaggtgtatgtatttgtggtactggtgtaggaattagtaatgctgcaaacaaagtaccaggtgttagaactgctttagttagagatatgacatcagcgctttattctaaagaagagttaaacgccaatgttgtaagttttggcggtaaagtagcaggtgaattatttattttcgacatcgttgatgcattcattgaggcagagtacaaacctactgaagaaaataaaaaattaattgctaaaatcaatcatttagaagcacataacaatgaccaagctgatccacatttcttcgacgagttcttagaaaaatggaataaaggtgaatatcacgattaa

SEQ ID NO: 464 - DNA, 879 bp, Staphylococcus epidermidis
agagggctaatgatgaagtcaaaattcacaattctattatttacaatcttttctacaacagtattagttttggttattatttataacaaaactcaatcccaatcatacatttcgactcactattctaataataaaataaaaacaacagcaacactttttttacatggttatggtggtagcgaacgctcagaaacgtttatggtcaaacaagcgttaaataaaaatgtaaccaatgaggtgataaccgctagagtgagtagtgaaggaaaagtatattttgataaaaaattaagtgaagatgcagcaaaccctattgtcaaagtagaatttaaagataataaaactggaaattttaaagaaaatgcttattggattaaagaagttctatcacaactaaaaagtcaatttggaattcaacaatttaattttgtaggacattcaatggggaacatctcatttgctttttacatgaaaaattatggggacgatcgacatttgccacaacttaaaaaggaagttaatatagcgggagtttataacgggattttgaatatgaatgagaacgtgaatgaaattatcgttgataaacaggggaaaccaagtagaatgaatgccgcatatcggcaattgttatcactgtataagatttattgtggtaaggaaatagaagttttaaatatctacggagatttagaagatggctcacattcagatggacgtgtgtcaaatagctcttctcaatcgcttcaatatttactaagaggtagcactaagtcttatcaagaaatgaaatttaaaggtgcaaaggcacaacatagtcaattacatgagaataaagatgttgcaaatgaaatcatacaattcttatgggaaacttaa

SEQ ID NO: 465 - DNA, 576 bp, Staphylococcus epidermidis
agatacaaaattttagatgaagctaaggatttaaacgatttcttaggtattaattattatatgagtgactggatgcgtggttttgaaggcgaatctgaaataacacataatgccactggtgataaaggtggatctaagtatcaacttaaaggtgtaggacaacgtgaatttgatgttgatgttcctagaaccgattgggattggatgatttatccacaaggtttatatgaccaaattatgcgtgtagtaaaagattatccgaattatcataagatttatattactgaaaatggattaggatataaagatgtattcgacgaaaaagaaaaaacagtacatgacgatgcacgaattgactatattaaacagcatctaagtgtgatagcagatgcgattgcagatggtgccaatgttaagggatacttcttatggtctcttatggatgtattttcatggtcaaatggttatgaaaaaagatacggtttattctacgttgattttgaaacacaagaaagattccctaagaaaagtgcatattggtacaaagaacttgcagaaagtaaagaaattaaataa

SEQ ID NO: 466 - DNA, 450 bp, Staphylococcus epidermidis
aggaggaaaataataatgttactaccaaaacgtgtaaaatatcgtcgtcagcatcgtccaaaaacaactggtcgttctaaaggcggtaactacgtaacatttggtgagtatggattacaagctacaactacatcttggatcacatctcgtcaaatcgaatcagctcgtattgcaatgacacgttacatgaaacgtggcgggaaagtttggattaaaatcttccctcatacaccatatactaaaaaacctttagaagtacgtatgggtgctggtaaaggtgcggttgaaggctggatagcagttgttaaacctggtagaattttattcgaagtagctggtgtacctgaagaagttgctcgtgaagcattacgtttagcaagtcacaaacttccagtaaaatctaagtttgtaaaacgtgaagaattgggtggtgaaacaaatgaaagctaa

SEQ ID NO: 467 - DNA, 768 bp, Staphylococcus epidermidis
atgatagaaattgaaaaacctagaattgagacaattgaagttagtgaagatgctaaattcggtaaattcgttgttgaaccacttgaacgtggctatggtactacactaggaaactccttacgtcgtatcctactatcttcattaccaggtgcagccgtaaagtacatcgagattgaaggagttttacacgaattttcagcagtagataatgtagtagaagatgtttcaacaatcattatgaacattaaaaaacttgcattaaaaatttactctgaagaagataaaactttagaaattgatgttaaagatgaaggcgaagtaactgcaagtgacattactcacgacagtgatgttgagattttaaatccagagcttaaaatcgcaacagtgtctaaaggtggacatcttaaagtgcgtcttgttgctaataagggtagaggttacgcattagctgaacaaaataatactagtgatttaccaattggtgtaattcctgttgattcactatattcacctgttgaacgtgtaaactatacagttgaaaatacacgcgtaggtcaaagtagtgattttgataaattaactttagatgtttggacaaatggttcaatcacaccacaagagtcagtatcattagcagctaaaataatgactgaacacttgaatatctttgtaagtctaactgatgaggctcaaaacgctgaaatcatgattgaaaaagaagaagatcaaaaagaaaaagtaattgaaatttctatggaagaataa

SEQ ID NO: 468 - DNA, 408 bp, Staphylococcus epidermidis
aaggaggaaattacattggcacaagttgaatataaaggcacaggccgtcgtaaaaactcagtagcacgtgtacgtttagtacctggcgaaggtaacattactgttaacgaacgtgatgtacgtgactacttaccattcgaatcattaattttagacttaaatcaaccatttgatgttacagaaactaaaggtaactatgatgttttagttaacgtacacggtggtggatttactggacaagctcaagcaatccgacatggaattgcacgtgctttattagaagcagatcctgaatacagaggttctttaaaacgcgctggattacttactcgtgacccacgtatgaaagaacgtaaaaaaccaggtcttaaaaaagcacgtcgttctccacaattctcaaaacgttaa

SEQ ID NO: 469 - DNA, 867 bp, Staphylococcus epidermidis
aaaggagttttatatatgactaagaaattacctgatgactttatttttggtggagcaaccgctgcttatcaagcagaaggagctactcagactgatggtaaagggcgtgtcgcttgggacacgtatttagaggagaattattggtacacagctgaaccagcaagtgatttttataacagatatcctgttgacttggaattaagtgaacgctttggtgtaaatggtatacgtatctcaattgcttggtctcgtatttttcctaaaggttacggtgaagtgaatcaaaaaggtgtcgagtattatcataatcttttcaaagaatgtcataaacgtcatgttgaaccttttgtaacattacatcactttgacacaccagaggtacttcacaaagatggagatttcttaaatcgtaaaacaatagactattttgtagattatgctgaattttgttttaaagaatttccagaagttaagtattggacaacattcaatgaaattgggccgattggtgatggtcaatatttagttggtaaattccctccaggtatcaaatatgactttgaaaaagtattccaatctcatcataatatgatggttgcacacgcacgtgctgttaaactttttaaagatgaaaattataagggagaaataggtgttgtccatgcattacctacaaaatatccatatgatccatctaatcctgaagatgtgagagcagccgaacttgaagacattattcataataaatttattttagatgcaacataccttggtaagtactcacgtgaaacgatggaaggagtacaacacatcttatctgtgaatggtggtcaattagagatttctgatgaagatacaaaattttag

SEQ ID NO: 470 - DNA, 1521 bp, Staphylococcus epidermidis
attgataaatcaaagttcaaaggagagaaatttatgtcagaagaaatgaacgaccaaatgcaagttcgtcgtcaaaaattacaagaattaattgatttagggattgatccttttggtcatcgattcaatcgctcatctacttcaagtgagttaaaagaacagtgggaccaattctctaaggaagaattgcatgaaaaagaagacgaaagccacgtgtcaattgcaggtcgtcttatgactaaacgtggtaaaggtaaagcgggatttgcacatattcaagacttgaaaggtcagattcaaatttatgtaagaaaagatcaagttggagatgatcaatttaacatttggaaaatggctgacttaggtgacatcataggtgttgaaggtgtcatgtttaaaactaatacgggcgagatttctgtcaaagctaagtcatttactttactatccaaatcattacgacctttacctgataagttccatggtttacaagatatagaacaaagatatcgacaacgttatttagatttaattacaaatgaagatagtacgcaaacgtttattaatcgtagtaaaataattcaagaaatgagaaactatttaaataaacaaggattcttggaagtagaaacaccaatgatgcaccaaattgctggaggtgctgctgcacgtccgtttgttacgcatcataacgcattagatgctactctttatatgcgtatagctatagaactacatttgaaacggttaattgtcggaggtcttgaaaaagtctacgagataggcagagtttttcgtaatgaaggtgtatctacaagacataaccctgaatttacaatgattgaattgtatgaagcttatgctgattatcatgatataatggatttaactgaaaatatggtcagacacattgctcaagaagtgtttgggtcagctaaagtacaatataatgatgaagaaattgacttagaatcttcatggaaacgacttcacattgttgatgctgttaaagaagttaccggtgtagatttttataatgttaattctgatgaagaagctattagattagcaaaagaacatgatattgaaattactgaaaatatgaaatatggccatatattaaatgaattttttgaacagaaagttgaagaaacacttattcaaccaacgtttatttatggtcaccctattgaaatttcaccgttagcaaagaaaaatccaaacgatgaaagatttactgatcgttttgaattatttattgtaggaagagagcatgcaaatgccttcacggaattaaacgatccgattgatcaacgccaacgttttgaagcgcagcttgttgaaaaagaacaaggaaatgatgaagctcatgatatggatgaggattacatcgaagcattagagtatggaatgcctccaactggtggtctaggtatcggtatcgacagattagtaatgctattaactgattctccgtcaattagagacgtattactattcccatacatgagacaaaaatag

SEQ ID NO: 471 - DNA, 195 bp, Staphylococcus epidermidis
cgaacaaggtcgagtgacttcaatggaaatgtggcaaaagcaggtacagatatcaaagaaaacgatgaactcattattcgttttggacaaaaattagtcacagttaaagtaacaggattaagcgaccatgctacaaaagaaaatgcaaaaggtatgtatgatttgattaaagaagaacgtattaatgaagagtga

SEQ ID NO: 472 - DNA, 300 bp, Staphylococcus epidermidis; identical to SEQ ID NO: 233

SEQ ID NO: 473 - DNA, 810 bp, Staphylococcus epidermidis
tttaaaatgcccaatgttgtaggtgttcagtttcaaaaagcagggaaattagaatactacgcgccgaatcaattagatgtaaaggttggtgactgggttgttgtccaatctaaaagaggtatagaaattggccacgtaaagtttccattacgtgaagttgatgtagaagatgtcacattaccgctaaaaaatatcattcgtaaaatgaatgaagatgatcaagaaacatattatcgtaatgaacgcgatgccaatgatgcgttagaattatgtaaaaaagtagttaaagatcagcaattagatatgcgattagttaattgtgaatatacattagataaatctaaagtgatttttaattttaccgcagatgatcgcattgattttcgcaaacttgttaaagttttagctcaaaatctaaagactagaatagaattacgtcaaattggggtaagagatgaagcgaaattattgggtggtatcggtccttgtggacgttctttatgttgttctacatttttaggagatttcgaacctgtatccattaaaatggcgaaagatcagaacctatcattaaatccaactaagatttcaggagcttgtggtagattgatgtgttgtcttaaatatgaaaatgactactatgaagaggctcgaactcaattacctgatgttggagatatgattcaaacaccagatggtcacggaaaagtgataggattaaatattttagatatttctatgcaagttaaaatagagggtctagaacaacctttagaatataaaatggaagagatagaagtattgaattaa

SEQ ID NO: 474 - DNA, 615 bp, Staphylococcus epidermidis
gaaatgtctacatttataacgtttgaaggtccagaaggagcaggaaagacctcagtaattaaaaaagtaagcgaaagattagctaaagaatatgatattgttacaacacgtgaacctggtggagtattaactagtgaagaaatacgtcgtattgtacttgatggagatagtatagacattcgaactgaagctatgctgttcgctgcatctagacgtgaacaccttgttgaaaagattatcccatctttacaggcaggtaaaattgtcctttgtgatagatatattgatagttcattggcttatcaaggttatgcaaggggtataggaattaaagaagtaaaattattaaatgaatttgcaattaatggtttgtatccagacttaacgatttatttagatgttgatgcggaaattggtcgtcaaagaattctaaaaaataacagagaacaaaacagattagataaagaggaaaaagcttttcatgaaaaagtgatcgaaggatatcaaaaagtgattagtgataatcctcatcggtttattaaagtcaatgctaaccatagtttggataaagttgttgaagaaacataccaatctatcatcaaatatttaaaataa

SEQ ID NO: 475 - DNA, 321 bp, Staphylococcus epidermidis
gggagcttgactgcgagacctacaagtcgagcagggtcgaaagacggacttagtgatccggtggttccgcatggaagggccatcgctcaacggataaaagctaccccggggataacaggcttatctcccccaagagttcacatcgacggggaggtttggcacctcgatgtcggctcatcgcatcctggggctgtaatctgtcccaagggttgggctgttcgcccattaaagcggtacgcgagctgggttcagaacgtcgtgagaacagttcggtccctatccgtcgtgggcgtaggaaaatttgagaggagctgtccttag

SEQ ID NO: 476 - DNA, 597 bp, Staphylococcus epidermidis
cgtccaacagcatcaatttcatcaataaaaatgatacatggggcatttttcttagcattttcaaataaatcacgaacacgactcgcaccaacaccaacaaacatctcaacgaagtcagatccactaattgagaagaatggtgcaccagcttcacctgcaaccgcacgtgctaataatgttttacctgtacctggaggcccaacaagtaagacaccttttggaattcttgaacccatttgtttaaatttcttgttatcttttaagaaatctacaatttctattaattcttgtttctcttcgtcagctcctgctacatctgagaaacgaactcgacgtttattactgtcgtacatcttagctttggattttccaaagttcatcatacgaccaccgccgccgccaccttgggcttggctaaggaagaaaataaataataatgcaatgattaatacaggaatcagtgtcgttaaaatactaacgaatacactttgtttttcttcttctttaactgtaaatttaagattatcttgtttcttagctgtatctgtgattttttgtaaatctttttcattgttatataaaattgtcgatgagtaa

SEQ ID NO: 477 - DNA, 480 bp, Staphylococcus epidermidis
atggttaaagcttatttaggattagggagcaatattggaaatagagaactacaactcaatgaggctattaaaatacttcatgactatcaaggtattcaagtaactcaagtttctcatatttatgagactgaaccagtgggatatactaatcaaccgaaattcttaaacttgtgcattgagatagagactgaattgaatccacaatctttgttaaaatgttgtttaacaacggaacaacaacttcatcgtaaaagagaaatacgttgggggcctagaactttagatatagatatactactgtttggtgatcaaattattgaacaagataatttatcagtgccgcaccctagaatgaaagaacgttcgtttgttcttatcccgttaaatgatatagccaccaaacaaatagaaccgatttctaataaaagtatcggacaactagtagtacctgataatagtgtgaaaaaatataaggaataa

SEQ ID NO: 478 - DNA, 210 bp, Staphylococcus epidermidis
tttatcaatttattgttccatgtctttctgttgaaaactttaggagctatatattgtttcctaatcagttttaatttatatttaagccttttattatacccttcttatcttcatatgtattgttattcaatgaaggttgatattgcatctaatcaaagcaaatctactcactttattattctacaagaccatcaaaatgtaataaagtaa

SEQ ID NO: 479 - DNA, 1386 bp, Staphylococcus epidermidis
agtgtaaattttaatggagggttagcattcatgcaaagacatgcgattattctggcagcaggtaagggcacaagaatgaaatcaaagaaatataaagtgctccatgaggttgctggcaaaccaatggttgaacatgtgcttaacaacgtaaaacaagctggcgttgatcaaattgtaactattattggtcatggcgctgagagtgtgaaagatacattgggtaatcaatcattatatagttttcaggataaacaacttggaacagctcatgctgtgaaaatggcacatgaacatttagcagataaagaaggaactactctagtagtatgtggagatacaccacttattacataccaaactttacaatcacttattgaacatcatgaaagtacacaatcacatgttactgtattatctgcttctactatcaatccttatggttatggacgaattattagaaatcataatggaatattagagcgtattgttgaagagaaagacgcaaatgactcagaacgtgcgattaaagaaattagttcaggtatttttgcctttaataatcgagtactatttgagaagttagaacaagttaaaaatgataatgctcaaggagaatattatttacctgatgttttgtctttaattttaaaagacggaggtaaagctgaagtttattgtaccgaagattttgatgaaatcattggtgttaatgatcgtttgatgttaagtgaagctgaaaaggctttgcaacaacgtatcaatcgctatcatatggaaaatggtgtgacaatcattgatcctagttcaacatttattggaacagatgtgaaaattggaatagatacaactattgaaccgggcgtgcgcatcggaggtcatacaacgattgaagaagatgtgtggataggccaatactctgaaattaataatagcacaattcattcgaatgctaacataaaacaatcggttatcaatgactctattgttggagagaacacaacagttggacctttcgctcaactacgcccaggatctaatttaggttctgaagttaaagtaggaaactttgttgaagtgaagaaagcagatattaaagatggtgctaaagtatcacacttgagctacattggagatgctgaaataggtgagcgtacaaatatcggatgtggttctatcactgtaaactatgacggcgctaacaaatttaaaacaatagtaggtaaagatgcttttataggatgtaatacgaaccttatagcacctgtaacagtaggtaatcatactcttattgcagctggatccacaattacagataatatccctgaagatagtttagcattagcgcgtgcaagacaagtaaataaagagggctacctaaaaaaatag

SEQ ID NO: 480 - DNA, 897 bp, Staphylococcus epidermidis
aaaggagatttaacaatgacacatgattatatagtgagaggtttagcatacggtggggaaataagagcatatgctgcaatcacaacagagtcagtacaagaagcacaaacacgtcattatacatggcctactgcttctgccgctatgggaagaactatgacagctactgttatgatgggtgcaatgttaaaaggaaatcaaaagttaacagttactgttgatggcaaaggtccaattggcagaattattgctgacgcagatgctcaaggaaatgttcgtgcatatgtagaccatccacaaacgcattttccactcaacgatcaaggtaaattggatgtacggcgagcagttggtactgatggttccattcaggttgttaaagatgttggaatgaaagactacttttctggtgcgagtccaatagtatcaggtgagctaggagatgatttcacatactactatgccacaagtgaacaaacaccatcatcagtaggattgggtgtattagttaatccagacaactcaatcaaagcagcgggaggatttattattcaagttatgccaggtgctactgatgaaacggtgactaaattagaagaagccattagtcaaatgcaacctgtatcgaaattaattgagcaaggacttacacctgaaggaatattaaatgaaattttgggtgaaggtaatgttcaaattttaaattcaacgtcagcgcaatttgaatgtaattgtagtcatgagaaatttttaaatgctattaaaggtttaggagaggcagaaattcatagcatgattaaagaggatcatggagctgaagctgtatgtcacttctgtggtaataaatatcagtatagtgaaagtgaattagaagatttattagaaacaatgaaatag

SEQ ID NO: 481 - DNA, 546 bp, Staphylococcus epidermidis
attataatgcataaggatttaaagaatgttttgttatcggaagaagacattcaaaatatttgtaaagagatgggagctatcattactgaggattataaagatcgcccactcgtttgtgttggtattttgaagggatcagtcatgtttatggcagacttaattaaacgtattgatacacatttatcaatcgattttatggatgtttcaagttatcatggtggaacggaatcgactggggaagttcaaatattgaaagatttaggtgcttctatagaaaataaagacgtacttataattgaagatatattagaaactggtacaactttaaaatctattacagagttattgcaatcacgtaaagttaactctttagaaatagctacattattagataaacctaaccgtcgcaaagctgatatcgaagcaaaatatgttggtaaaaagattccagatgaatttgtagttggttatggtttagattatcgtgagttatatagaaatctgccatacataggcacactaaaagcagaagtttattctaaatag

SEQ ID NO: 482 - DNA, 417 bp, Staphylococcus epidermidis
tctcaatttaatattcacgtaacagatgaatggataattcaaattgcatatgataaattaataataatggctaaaagtgaaatggatcaatatatattagaccgtatatgtattagaaagccaggtacatatgaatttaatgattatcaaattgatattcatcctgacttaccacaacagttatatccgcttactgtgcgtgtccgacaaaatggagatgtgtataaattaaatggtcaaaaaggtcataaaaaagtgagtcgtttatttatcgataaaaaagtgactcttgctgaacgtcagcgcatcccactcattattaatcaagaaaatgcagtgttagctattggcgatttatatgttaaagaaaattttaaagaatttattttgatttcgaataatggagatgaattataa

SEQ ID NO: 483 - DNA, 891 bp, Staphylococcus epidermidis
atggaatataaagatatagcaacaccatctcgaacacgtgctttgcttgatcaatatgggtttaattttaagaaaagtttaggacaaaattttctaatagatgtaaatatcattaataaaattatcgaagcgagtcatatagattgtacaacgggtgtaattgaagttggaccaggtatgggatcattgactgaacaacttgcaaagaatgctaagaaggtgatggcttttgaaattgatcaaagattaatacctgtgcttaaagatacactttcaccatacgataatgtaacaattatcaatgaagatatacttaaagctgatattgctaaagctgtagatacacatctacaagattgtgacaagattatggttgttgctaatttaccgtattatattaccacacctattttacttaatttgatgcaacaggatgtacctattgatggttttgtcgtaatgatgcaaaaagaggtaggagaacgtttgaacgctcaagtaggtaccaaagcatacggttcgttatcgattgttgctcaatactatacggagacaagtaaagttttaacagttcctaaaactgtatttatgcctcctccaaacgttgattctatcgttgtaaaattgatgcaacgccaagaaccacttgtacaggttgatgatgaggaaggcttttttaagttagcaaaggccgcttttgcacaacgacgtaaaacaattaataataactaccaaaacttctttaaagatggtaagaagaataaagaaactatacgacagtggctagaaagcgctggtattgatcctaaaagacgtggagaaacactcacgattcaagatttcgccacattatatgaacaaaagaaaaaattctccgaattaacaaattaa

SEQ ID NO: 484 - DNA, 966 bp, Staphylococcus epidermidis
atgttaaataatgaatataagaattcatcaatgaagatcttttcgcttaaaggaaatgaacctttggcacaagaagtagcagatcatgtagggattgaattaggtaaatgttctgtaaaacgttttagtgatggagaaattcaaataaatattgaagaaagcattcgtggttgtgatgtttttattgttcaaccaacttcatacccagtcaatcttcatttaatggagttacttattatgattgatgcgtgtaaacgcgcgtcagcagcaaatattaacatcgtagtaccatactatggttacgctcgacaagatagaaaagcccgtagtcgtgaacctattactgctaaattagtagctaatttaatcgaaacagcaggtgccaatcgtatgatcgcattagacttacatgcacctcagatccaaggattcttcgatattcctattgatcatttaatgggtgttcctatccttgcacaacactttgagaatgatcctgatattaatccagaagaatgtgtagttgtgtcccctgaccatggtggggtaacacgagctcgtaaattagccgacattttaaaaactccaattgcaattatcgacaaaagacgtccgaaaccgaatgtggcagaagttatgaacattgtgggtgatattgaaggacgtactgcaattattatagatgacattattgatactgcaggaacaattactttagctgctcaagctttaaaagataaaggtgctaaagaagtctatgcttgctgtacacatccagtgctttctgggccagcgaaagaacgaattgaaaactctgcaatcaagcaacttatagtaacaaactcaattcaattagaagagaatagaaaacctaataatacaaaagaactttctgtagctggtttaattgcgaaagcaattattcgtgtatacgaaagagaatcagtaagtgtattatttgactaa

SEQ ID NO: 485 - DNA, 357 bp, Staphylococcus epidermidis
tataatgataaaaagaggtgtataaaaatgaaaatgattatagcgatcgttcaagatcaagatagtcaagagctttcagaccaactcgtaaaaaacaatttcagagctacaaagttagcaactactggtggatttttaagagcaggcaatacaactttcttatgtggggttaaggatgaccgtgtcgacgaggttctatctgtcattgataatacttgtggtaatagagaccaacttgtttcaccaataacaccaatgggtggtagtgcagattcatatattccttatccagttgaagttgaagtaggtggcgcgacagtatttgtaatgccgattgaagcatttcatcaattctag

SEQ ID NO: 486 - DNA, 882 bp, Staphylococcus epidermidis
atgaatatcaaaacagatggttggtctaaaaaagcacatattgttgtggctgtctcaacaggcattgatagtatgagtttattatatagcttattaaacgactatcaacatacatatcgtaaattaacatgtgttcatgttaaccacggattgcgtgaacagtcatatgaagaagaagcgtttttgagagagtattgccatcaacatcatattgacatttatataaagcgtttagacttaagtgatattgtagcagacggtaatagtattcaacaagaagcgcgtcaacgtcgttatgaatggtttggagatatcatagctcaattaagagcagatgtattgttaacagctcatcatcttgatgatcaacttgaaacgattatatatcgtttgtttacagggagatcaacacgtaattcattaggtatgacatacgagtcgtattttaatcaatacaaagtgtatcgtcctatgttaaatttaaaaaaaactgaaatattagcgtatcagtatgcgaaccaaattccatactatgaggacatgtctaatcaagatagaaaatatgttagaaatgacattagacaacgcatcatacctgcaattaacgagaacccgcatttaaacgcgcatcagctactcaaacttaaggattggcatgatattgaattgcaatcgttaaaagaacaagctgaaacgttcatcaataacgaagtttcaaaaagtaaatatttaacctattccttttctagaactgcttttaatgaattgaatgtgaatatcaaaagcgtagttatggatttgttattccaaaaattagattgtcatttagcaatgccacaacatgcttatgacgagtgttttgaacagattagaaatgaataa

SEQ ID NO: 487 - DNA, 408 bp, Staphylococcus epidermidis
caagcaatgaataaaaaagtagaacatatcggtaaccaatatacgtcacaagaaaataagaaaaaacaacgacaaaaaatgaaaatgcgtgttgtacgtagacgtattgctttattcggaggtattcttttagcgattatcctcattctacttgtattgcttgtcattcaaagacataataacgatcaagatgcagttgaaaggaaagagaaagaaactgagtttcaaaaacaacaagatgaagaaattgctttaaaagagaaacttaataatttaaatgataaagactatatcgagaaaatagcgagagacgattattatttaagtaataaaggtgaagtcatttttagattacctgatgataaaaaatcctctcagtcaaagacttcaaacgaaaaaggcaattag

SEQ ID NO: 488 - DNA, 378 bp, Staphylococcus epidermidis
aggagaatgaatatgaacgacatcatctttcttaatggaatgcgtttttatggttatcatggagtattagctgcagaaaatgatattggacaaatttttgttgttgatattactttaaaggttgatcttagttatgcaggtcaatcagatgatgtaaaagatactgtaaattatggagaggtttataaagatgtaaagtctattgttgaagggccacgttcatgcttaattgagcatctggctgaacgtattgcaaaacatataaattcacactataatcgtgtaatggaaacgaaagttagaatcactaaagaaaacccacctattcctggtcattacgatggtgttgggattgaaatagtgagggagaatgactaa

SEQ ID NO: 489 - DNA, 1881 bp, Staphylococcus epidermidis
agtcaagtgaaatcaatgattgcaaattacattagcgaagataatcgttttcaagaattagatgaagtcttcggccaagagaatattttagttacgggattatccccgtcagcgaaggcaacaattattgctgaaaaatatttaaaagatcataaacaaatgctactcgtaactaataatttataccaagcagataaaatcgaaactgacattttacaatatgtagatgactcagaagtttataaatatcctgttcaagatataatgactgaagagttttctactcaaagtccacaattgatgagtgagcgtgttagaacgttgactgcgttagcccaaggcgaaaaagggttatttattgtgcctttaaacggctttaaaaaatggctaacaccggttgatttatggaaagatcatcaaatgacgcttaaagtaggtcaggatattgatgttgatgcgttcttaaataaattagttaatatgggttatcgtcgagaaagtgtagtgtcacatattggtgagttttcattgcgtggtggaatcatagatatatatccgttgataggaacacctgtgagaatagagctatttgatactgaagttgattccatcagagactttgatgtagaaacacaacgttctaacgataatataaatcaagttgaaatcacaacagctagtgactacattattactgatgaagtgatacaacacttacaaaatgaacttaaaaaagcatatgaatatacacgccctaaaattgaaaagtccgtacgtaatgatttaaaagagacatatgaaagttttaagttgtttgaatctacctttttcgatcatcaattgttacgacgtcttgtttcatttatgtatgaaaaaccatcaacccttattgactattttcaaaaaaacgcgattattgtagttgatgagtttaatcgtattaaggaaacagaagaaacacttacaacagaagttgaagattttatgagtaacttaattgagagtggaaatggatttatcggacaaggatttatgaagtatgaaagttttgacgcattattagagcaacatgccgttgcatatttcacattatttacatcttcgatgcaagtaccattacaacatattattaagttctcttgtaaaccagttcaacaattttatggtcaatatgacattatgcgctcggaatttcaaagatacgtgcatcaagattacactgtcgtagttcttgttgaaactgaaacaaaagttgaacgtattcaatcaatgcttaatgaaatgcatattccaacagtatcaaatattcacgaagatattgatggtggtcaagttgtagtgacggaaggtagtctttctgaaggctttgaattaccttatatgcagttggtagtcatcacagaaagagaattatttaaaacaagacaaaagaaacaacgtaaacgaacaaaaacgatttctaatgctgaaaaaataaaatcatatcaagacctaaatgtgggcgattatatagtgcatgtgcatcatggtgtcggacgatacttaggtgtcgaaacactagaagttggagatacacatcgcgactatattaaattgcaatataaaggaactgatcaattattcgttccagttgatcaaatggatcaagttcaaaagtatgtggcttctgaagataagtcgcctagattaaataaattaggcgggacagaatggaaaaaaacaaaggcgaaagttcaacaaagtgttgaagatatagctgatgaattaattgatttgtataaagcacgtgaaatgtctgtaggttatcaatacgtcctagatactgcagagcaatcagcatttgagcatgattttccatatgaattaacacccgatcaatag

SEQ ID NO: 490 - DNA, 2106 bp, Staphylococcus epidermidis
cgcatgcagaaagcttttcgcaatgtgctagttatcgcaattattggcgttattatatttggcctcttttcatttttaaatggaaatgggaatatgccaaaacaacttacatatactcagtttgttaataagttgaataaaggcgatttaaaaactttagaaattcaaccagagcaaaacgtatatatggtaagtggtaaaacaaaaaaagatgaagattactcatcgacaattttatataacaatgaaaaagatttacaaaaaatcacagatacagctaagaaacaagataatcttaaatttacagttaaagaagaagaaaaacaaagtgtattcgttagtattttaacgacactgattcctgtattaatcattgcattattatttattttcttccttagccaagcccaaggtggcggcggcggtggtcgtatgatgaactttggaaaatccaaagctaagatgtacgacagtaataaacgtcgagttcgtttctcagatgtagcaggagctgacgaagagaaacaagaattaatagaaattgtagatttcttaaaagataacaagaaatttaaacaaatgggttcaagaattccaaaaggtgtcttacttgttgggcctccaggtacaggtaaaacattattagcacgtgcggttgcaggtgaagctggtgcaccattcttctcaattagtggatctgacttcgttgagatgtttgttggtgttggtgcgagtcgtgttcgtgatttatttgaaaatgctaagaaaaatgccccatgtatcatttttattgatgaaattgatgctgttggacgtcaacgtggtgcaggtgtaggtggcggtcatgatgagcgtgaacaaacattaaaccaactattagttgagatggatggttttggagaaaatgaaggtattattatgattgcggctacaaaccgcccagatatcttagaccctgcattgttacgtcctggtcgttttgatagacaaattcaagttggacgaccagatgttaaaggtcgtgaagcaattcttcatgtgcatgcgaaaaataaacctcttgatgaaacagtagatttaaaagctatttctcaaagaacgccaggtttttctggtgcagacttagaaaacttgctaaatgaggcatctttaattgcagcacgtgagggtaaaaataaaattgatatgcgcgatattgaagaagcaactgaccgtgttattgcaggtccagctaaaaaatctcgtgtaatttctgaaaaagaacgtaatattgtagcgcatcacgaagcaggtcatactatcatcggtatggtgcttgatgaagctgaaattgtacacaaggtaacaattgtccctcgtggacaagcaggcggttatgcaatgatgttaccaaaacaagatcgcttcttaatgacagaaccagaattactcgacaaaatatgtggtttattaggtggacgagtatctgaggatattaactttggtgaagtatcaacaggtgcttcgaatgactttgaacgagcaacgcaaattgcaagatctatggttacagaatatggtatgagtaagaaattaggaccattacaattctcaagcaatagtggtggacaagtattccttggtaaagatatgcaaggtgagccgaattattctggtcaaattgcttatgaaattgacaaagaagttcaacgaattgttaaagagcaatatgaacgttgtaaacaaatcttgttagaacatgaagaacaacttaagttaattgctaaaacactactttcagaagaaacattagttgcagaacaaattcaatcattattctatgatggtgttttaccagaagtagattatgactctgcaaaagttgtgaaaaatgaaaatagtgattatagtgatggaaagtatggaaaatcatacaacgacattcgtaaagaacagttagaagatgacgataaagaagatgatgacaaccatgaaaaagatgaagtaaaccaagacaacacagacagagaagctgataatacttcacatacgaatgaaccaggtcatcaacaatctccgaacatcgataaaccatacaatcctaacgatccaaatcatagacaatag

SEQ ID NO: 491 - DNA, 729 bp, Staphylococcus epidermidis
tgggtaagtgaggagcaggttagacgtatccaatgtctaaacctcgaaattcgaaaggtggaaatacgaatggcttcattaaagtcaatcattcgtcaaggtaaacaaacacgttctgacctaaaacaattaagaaactcaggtaaagtacctgcagttgtatatggttacggtacaaaaaatacttcagttaaagttgatgaagttgaatttatcaaagtaatccgtgaagtaggacgtaatggtgttattgatttaggcgtaggttctaaaacaattaaagtaatggtttcagattatcaatttgatccattaaaaaaccaaatcactcatattgactttttagcaatcaacatgagtgaagaacgtactgttgaagtacaagttcaattagttggtgaagctgtaggtgctaaagaaggcggcgtagttgaacaaccattattcaacttagaagttacagctacacctgaaaatattcctgaaactatcgaagtagatatcagtgaattacaagttaatgacagcttagcagtttctgatattaaaatctctggtgatttcacaatcgaaaataatccagaagattctatcgtaacagtagttcctccaacagatgaaccttctgaagaagaagttgaagctatggaaggcgaatcagcaactgaagaaccagaagttgttggtgaagacaaagaagacgatgaagaagaaaataaagaagactaa

SEQ ID NO: 492 - DNA, 855 bp, Staphylococcus epidermidis
tacaggagggataacatgacaactttatatttagtaggaacaccaattggaaatcttggtgatattacatttcgagctatagaaacattaaaaaaagttgatgtgattgcatgtgaagatacacgtgtaacacggaaattgtgtaatcattatgaaatacaaacacctctaaagtcgtatcatgaacataataaagaacaacaaactgactatttaatcaagcagttacaaactggcttaaatatagcgttagtatcagatgctgggttgccattaattagtgatccaggatatgaattggttgtcgaagcacgtaaaaataatataaatatagaaacagtaccaggtcctaatgctgggttgactgcacttatgtcaagtggattaccatctttcacatacacatttttaggttttttgccaagaaaagaaaaagaaaaaattgaagtgcttgaggatagaatgtttcaaaatagtactttaatactttatgaatcgccttatagggttactgatactttgaaagcaatagctaaaatagattcacaaagatggattactgttggtagagagctaacgaagaaatttgaacaagttcttacacttacagttgatgatatgttgaaattgattaatcatgacaaattacctcttaaaggtgagtttgtgatactgattgaaggtgcattacctaagagtggtgaatcatggtttgaaagctatacggttaaagaacatgttgattattatattgaaaccaaacatgttaaacctaaaaaagcaattaaatttgtcgctacagatcgacatatgaagacgggtgacatatataatatttatcataatattgattaa

SEQ ID NO: 493 - DNA, 960 bp, Staphylococcus epidermidis
attgtaaaactaaaaggagtgttttggatggcacaaaaacctgtagattatgttacacaaattattgggaatacacctgtagtcaaattaagaaacgttgttgatgatgatgcagctgatatttatgttaagttagaatatcaaaatccaggtggttcggtaaaagatcgtatcgctttagcgatgattgaaaaagctgagcgtgaagggaaaattaaacctggtgatacaatcgttgagcctacgagtggtaacactggtataggtctagcatttgtatgtgctgccaaggggtacaaagcagtttttacaatgcctgaaacaatgagccaagagcgccgtaacttattaaaagcttatggtgctgaactagtattaacaccaggatctgaagctatgaaaggtgcaataaaaaaagctaaagaattaaaagaagagcacggctattttgaaccacaacaattcgaaaatccagcaaatcctgaaattcatgaacttacaactggaccagaattagttgaacaatttgaaggtcgacaaattgatgcatttttagctggtgtaggaactggtggtacgttatctggtgttggtaaagtattgaagaaagaatatccaaatgtggaaatagtagctattgaacctgaagcttctccagtattaagcggtggtgaaccaggccctcataaattacaaggattgggagcaggtttcgtacctgatactttaaatacagaagtttatgacagcatcatcaaagtaggtaatgatactgctatggatatggcacgtcgtgttgctagagaagaaggtatattagcaggtatttcatctggtgctgcaatatatgctgctattcaaaaagcaaaagaattaggtaaaggtaaaacagttgtaacagtattaccaagtaatggggaacgttacttatcaacaccattatattcatttgataattaa

SEQ ID NO: 494 - DNA, 351 bp, Staphylococcus epidermidis
cctttgaatcgaaacgaattattcgaaagacttatgaaattagaacatcacgttgaacaacttacaaccgacatgtcagaacttaaagatttaacagtcgaacttgttgaggagaatgttgctttgcaagttgaaaatgaaaatttaaaacgattgatgaacaaaactgaagaatcggttgaaactcacttagataaagataattataagcatgtaaaaacaccatctccaagtaaagataatttagcaatgttatatcgtgaaggttttcatatttgtaagggtgaattattcgggaaacatcgtcatggtgaagattgcttattatgccttaatgtgttgagtgattaa

SEQ ID NO: 495 - DNA, 189 bp, Staphylococcus epidermidis
caactaaagcgaatcacttttggatattacaaaaattggacttattcaaatggttattcgtttaatttaaatgaattgtgtattaataataaacgtaagttgcataatctcatgaaaatgggaataaataaagactacaataacaaagagtctgaacatatattcaatgtccagactcaccttaaataa

SEQ ID NO: 496 - DNA, 867 bp, Staphylococcus epidermidis
agtttacttagtaagattattaggatagaagggtttgaaaagatgagatataaaagaagcgaacgtattgtatttatgacacaatacttcatgaaccacccaaataagttgatacccctcacttattttgtaaagaaatttaaacaagcaaaatcgtcaattagtgaagacgttcaaatcattaaaaatacgtttcaaaatgaaaaattaggaactattattactacagcaggtgctagcggtggagtaacctataagcctatgatgagtaaatcagaggccacagaggttgttgatgaggtgatagagcaattacaagagaaagaccgtttgctacctggaggatatttatttttatccgatttagttggtaatccttctctattaaataaagtaggtaagttaattgctagtatatatatgaacgaagaacttgatgctgttgttaccatagcgactaaagggatatcacttgcgaatgcagtcgcaaacgtattaaatttacctgtagtggttataagaaaggacaataaagttacagaaggttctacggtttcaatcaattatgtttcaggatcatctagaaaaatagaaacaatggtgttatcgaaacgaactttagctgagaattctaatgtcctcgtagtagacgattttatgagggctggtggctcaattaatggagtaatgaatttaatgaatgagtttaaagcccatgtaaaaggggtatcagtacttgtagaatcaaaagaagtaaaacaaagattaattgaagattatacttccttagtcagattgtcagatgtcgacgagtacaaccaagaatttaaagtggaaccaggcaacagtttgtctaaattttcttaa

SEQ ID NO: 497 - DNA, 333 bp, Staphylococcus epidermidis
agatatactaggggggctcactacatgaaagtgacagatgtaagacttagaaaaatacaaacagacggcagaatgaaagcactcgtttccattacgctagatgaagcttttgtaattcatgatttacgtgtaattgaaggaaactcaggtcttttcgtcgcaatgccaagtaaacgtacaccagatggtgaattccgtgacatcgcgcatcctatcaattctgatatgagacaagaaatccaagatgcagtgatgaaagtatatgatgaaactgatgaagttattccagacaaaaatgctacttcagataacgaagaatcagacgaagcttaa

SEQ ID NO: 498 - DNA, 207 bp, Staphylococcus epidermidis; identical to SEQ ID NO: 239

SEQ ID NO: 499 - DNA, 798 bp, Staphylococcus epidermidis
tataatctaaggataggagagataatgatgttaatcgatacgcatgtacatttaaatgatgaacaatatgatgaggatttaaatgaagtgatatctcgtgcgagagaagcaggcgtagatagaatgtgtgtagtaggttttgatacacctactattgaacgtactatggagctaatagataagtatgactttatctatggtattatcggttggcatcctgttgatgcaatagattgtactgatgaaagattggaatggatagaaagtctttctaaacatcctaaaattattggtattggtgagatggggttagattatcattgggataaatcaccttctgatgtacaaaaagaggtatttaaaaagcaaattacattagctaaacgtgttcaattacctattattattcataatcgtgaagcgactcaagattgcatagatattttgattgaagaacatgcagaagaagtgggcggaataatgcatagttttagtgcttcacctgaaattgctgatgtcgtgattaataaattgaacttctatgtttcgcttggaggacccgtcactttcaaaaatgcaaaacaaccaaaagaagttgctaaacacgtaccaatggatcgtttgttatgcgagacagatgccccgtatctatccccgcacccttatagaggtaaacgtaatgaaccagaacgtgttactttagtagcacaacaaattgcagatttgcgtggtatgacttatgaagaggtctgtcgccaaacaaccgaaaatgctgaacgtttattcaatttgaattaa

SEQ ID NO: 500 - DNA, 285 bp, Staphylococcus epidermidis
tgtgtagtgaggtggggcaatatgccaaaatcaattttggacatcaaaaattctattgattgtcatttaggaaatcgtattgtacttaaagccaatggtggacgtaaaaagacaattgaacgatcaggggttttaaaagaaacatatccatctgtttttattgtcgaattagatcaagataaacacaactttgaacgcgtatcttatacatacactgatgtgcttacagaaaatgtacaagtttcatttgaagaagataatcatcaagaagcagttgcacactaa

SEQ ID NO: 501 - DNA, 1608 bp, Staphylococcus epidermidis
catggaaagagcaagactatggaccgtcttctttgtggtgatgtgggatatggtaaaactgaagtggctgtccgcgcagcgtttaaagctgtcatggatggtaagcaagttgcgtttttagtaccaacaacgattcttgcacaacaacactacgaaacactacttgaacgtatgcaagattttccggtcgaaattcaattggtaagtcgattccgcacagctaaagaaataagggaaactaaagaagggctcaaatcaggatatgttgacattgtcgtaggtacacataaattattaggtaaagatattcaatataaagatttgggattgcttattgttgatgaagaacaacgttttggagtgcgacataaagaacgcattaaaactttgaaaaaaaacgttgatgtactgacgcttactgcaacaccaataccaagaacattgcatatgagtatgttaggtgtacgtgacttatcagtgattgaaacaccacctgaaaatcgttttcctgtacaaacttatgtcttagaacagaatacgaactttattaaagaggcattagagcgtgaattatctcgcgatggacaagtattttatttgtataacaaagtgcagtctatttatgaaaaaagagaacaacttcaaatgttaatgcctgacgctaacattgctgtagcacatggccaaatgactgaacgtgatttagaggaaacaatgttaagctttattaatcacgagtacgatattttagtaacgactacaattattgaaacaggtgtagatgtaccaaatgctaatactttaatcatagaagaggctgatcgttttggtttaagccagctataccaattaagaggacgtgtaggacgttcaagtagaattggttacgcttatttcttacatccagctaacaaagtgttaaatgagactgctgaagagcgattgcaagctattaaggagtttaccgaactaggttcaggttttaaaatcgctatgcgagatttaaatattcgtggtgcaggcaatttactcggtaagcaacaacatggctttattgattcggttggtttcgatttatactctcaaatgttagaagaagcagtaaacgaaaaacgtggcattaaagaaagatcgccggatgcaccagatattgaagttgaattgcacttagatgcttatttaccagctgaatatatacaaagtgaacaggctaaaattgagatttataaaaaacttcgaaaagtagaaacagaagaacaacttttcgatgtcaaagatgaattaatagatcgttttaatgattatccaattgaagtcgaacgattattagacattgttgaaatcaaagtccacgctctacatgcgggtgtcgaattgataaaagacaaaggcaaatctatacaaatcattttatcacctaaagcgactgaagatattaatggagaagaattgtttaaacagacgcaacctcttggtagagcaatgaaagttggcgtgcaaaataatgcaatgaatgtaacgctaacaaaatcaaaacaatggttagatagtttgaaattcttagttagatgtattgaagaaagtatggcgattaaagatgaagactaa

SEQ ID NO: 502 - DNA, 972 bp, Staphylococcus epidermidis
gtagtctttttacataatgaatatcataaagggagtaagtcgcttatggatgaacaacaacagttagctaacgcatatcattctaacaaattgtcacatgcatatttgtttgagggtgatgatgcacaaacgatgaaacgtgtcgcaatccattttactaaattaattctttgtaataatagtaatcaatgcgaactgaaagttgatacttttaatcatcctgacttttcatatgtgtcttctgatgaaaatacaattaaaaaagaacaaattgaacaacttgttcatcatatgaaccaactacctattgagggtcaatataaagtatatattattgaggattttgaaaaattaactgttcaaggggaaaatagtatactaaaatttttagaagagccccctgataatacaattgcgatacttttatcaacgaaaccggaacaaatattagacactatacattcaagatgtcagcatgtatattttaagcctattgataagcggcagtttatagagcgtttagtagagatgtcaatagcaagaccggtagcagaaatgctaagtacctatacaactcaaatagaagcagcatcgtcgttaaatgaggaatttgatttagttactttaagaaaatcaatcatcagatggtgtcaattaatattatctaataaagctatggctcttataggtgtcattgagttattaaaacaagctaagaatcgtaaattacaattacttactttatcagccgtcaatggctttttcgaagatataatgcatgcaaagatagaaatggataattattatacatttagtgatttaactgaagaaattgaaaattatgcaaatcaattaacttttaatcaattaatcctcatgtatgatcagattactgaagcgcataaaaagttaaatcaaaatgttaatccaacacttgtttttgaacaaatagtaataaaaggtgtgatttaa

SEQ ID NO: 503 - DNA, 261 bp, Staphylococcus epidermidis
aaggtgtttattatggataaacattttgtttatattgttaaatgtaatgacggaagtttatatacaggctatgctaaagatgtaaatgcacgcgtaataaagcataataacggtaagggtgctaaatatacaaaaataagacggccggtagagttagtttatcaagaaacatatacaacgaaatcggaagcattgaaacgtgaatatgaaattaaaacatatactagacaacaaaagttaaaaatgatacaggagggataa

SEQ ID NO: 504 - DNA, 186 bp, Staphylococcus epidermidis
ttggttattatacatctcttattggctaatatgaaatctattgctcatacatgtttattgagtattataaccatgagagatgataacaatatttttaccaaaagtttaaaaatgtattggtataaactatacataaaaaagtcccttttcactcaattcatacgtgagcaaaaagagacttactaa

SEQ ID NO: 505 - DNA, 846 bp, Staphylococcus epidermidis
gagtatattattgaaaaaggtgaaattatgattaaaacaaaaataatggggatattaaatgtgacacctgactcattttctgacggaggacagtaccactcagttgatcaagctgtgaagcgtgctaaagagatgatagatgaaggtgtagacatcatagacgttggaggtgtctcaacacgaccaggtcataaagaagtatcgcataaagaagtatcgcttaaagaagaaatgaatcgtgtattgcctgtggttgagtctatcgttaaatatgatgtgcaaatttcggttgatacatttcgaagtgaagttgcggaagcttgtcttaaacttggtgtttcaatgattaatgatcagtgggcaggcctatttgattcgaatatgtttaatgtggtatctcaatacggtgctgaaattgtacttatgcataatggtgacggtcatagagataaacctgttgttgaagagatgcttgtatcattacttgcgcaagcgaataaggctgaactagccggtataccacataataaaatctggttagatcctggaataggttttgctaaaacacgagaagaagaaaatgaagtaatggcaagattagatgaattagtagcgaccgaatatccagttttacttggaacaagtcgaaaaagatacattaaagaaatgatgaatcaagattcttctccttcagatagagatgaggcaactgcagctacaacggcttatggtataatgaaaggcgttcgtggggttcgagttcataatgtattattaaatacgcgactagcccaaagtatggattttctaaaggagaatgaatatgaacgacatcatctttcttaa

SEQ ID NO: 506 - DNA, 606 bp, Staphylococcus epidermidis
agatacataatattaatagtggaggtaacaataatgaaatgcattgtcggtcttggcaacattggtaaacgttttgaattaacaagacataatattggtttcgaagttgtcgatgatattctagaacgccaccaatttactttagacaaacaaaaatttaaaggtgcatatactattgaacgtttaaacggcgaaaaagtattatttattgagccaatgaccatgatgaacttatctggtcaagctgtagcccctttaatggattattataatgtcgatgttgaagatttgatcgttttatatgatgatttagatttagaacaaggacaagtgcgtctgcgccaaaaggggagtgcaggcggtcataatggtatgaaatcgataattaaaatgcttggtacagatcaatttaaacgtattcgaattggtgttggccgtccaacaaatgggatgtctgttccggactatgttttacaaaaattttcaaaagaagaaatgatcattatggaaaaggtaattgaacattctgcaagagctgtagaatcttttattgaaagttctcgttttgatcatgttatgaatgaatttaatggtgaagtcaagtga

SEQ ID NO: 507 - DNA, 405 bp, Staphylococcus epidermidis
aaaatgtcaatcgaagtaggaaacaagcttaaaggtaaaattacaggtatcaaaaagtttggtgcattcgtagaattacctgaaggaaaaagtggtttagttcatatcagtgaagttgccgacaattatgttgaaaatgttgaagaccacttatcagtaggtgacgaagtagaagttaaagttttatcaatcgcggatgatggtaaaattagtttatcaataaaaaaagctaaagaccgccctcgtaagcctcgtcacagtaaagctaatcacggtaaaccagttcaaaaaactgaagactttgagaaaaaattaagtaacttcttaaaagatagtgaagataaattaacgtcaattaaacgtcaaaccgaatcacgcagaggcggtaaaagttctagacgttaa

SEQ ID NO: 508 - DNA, 549 bp, Staphylococcus epidermidis
tttatgaaaataaacgaatttattgttgttgaaggtaaagatgatactgaacgagtaaaaagtgctgtagattgtgatactattgaaacaaacggtagtgcaattgatacatatactttagaagtgatacaacacgcgcagcaaactagaggtgtgattgtactgacagatccagatttcccaggtgataaaattagaaatactatacgggaacatgtttctggtgttaaacacgcatatgtagatagagaaaaggccaaaagtaaaagaggtaaaataggaatagaacatgcaaacattaaagatattcaagaagcattaatgcatgtaagttcaccacttgaagaagctaaagaaactattgataaaagtgtactcattgatttgggattaattatcggtaaagatgcaagataccgtagaaatatcttaggtcgaaaattacacatcggtcactctaatggaaagcaattattaaagaaacttaatgcttttggctatactgaagacgatgtcagaaaagcgctatttgaagaagaggagaattaa

SEQ ID NO: 509 - DNA, 1281 bp, Staphylococcus epidermidis
tgtattaggatacaaagaaataaagcacttaccttttggagacaaattatatcaaatgaagagaggaagacggtcatgacacatacaattacaatagttggtttaggtaattatggcattgatgagttacctttaggtatctatcgttttttagaaaaagagtctaaagtatatgctagaaccttaaatcatcctgtcatcaatacgctaaagaaagaaattgaattcgagagtttcgatagtatttatgaagcacatgaccgttttgaagatgtttatgaagcgattgtcacatcactaatagaattggcacaatctgaagatattgtttatgcagttcctggtcatcctagagttgctgaaactacgactgtaaaattattagagtatagtcattttaataaggatatctctgtgaaggtacttggaggaaaaagttttattgatgacatttttgaagcggttgatgtagaccccaatgatggttttacactgcttgatggtacgtcattaaaagaatcggccttaaatgttcgtacaaatacagtaattactcaagtttatagcgtaatgatagctgccgatttaaaacttactttaatggaaagatatcctgatgattttaatgtgaaaataattactggttctcatagtgatggagctcacgtaattgaatgcccactttatgaaattgatcgctacgacgattattttaataatcttacaagtttatttattccaaaaatcaatgaggatacattactttatcaagattttgattacgcagttcaaactattgatttactcgttgataatgaaaaagggtgtccgtgggataaagtacaaactcacgactcattaaaacggtatcttttagaagaaacgtttgaattatttgaagccattgataatgaagatgattggcatatgatagaggaattaggagatatacttttacaagtattattacattctagtataggtaaaaaagaaggatatattgatatcaaagaaattatagaaagtctcaacaccaagatgattcatagacatccacatatctttggtaatgcgcatgtaacttcgcaagaggatttaaaagacatttggtcacgtgctaaagaaaaagaaggtaaagtgcctcgtgttaaatttgagaaagtatttgcagaccacttcttgaaattgtatgataaaacaaaaaataggcaatttgacgaagatatctcaaacaatttttacaacaaggagagaaaattcatgagattagataaatattaa

SEQ ID NO: 510 - DNA, 543 bp, Staphylococcus epidermidis
gaaagagggatgactttgattattagggcattggagaagacagatttatcatttatacatcatttgaataatgagtattccattatgtcgtattggtttgaagagccttatcaatcattaagcgaattagaaaatttatatacaaagcatattttagatgaaacagagcgacgtttcattgttgaagagggatcaacatctgtaggcgtggtagagttattagaaattaactttatacatagaacttgtgaagtgttaattattatcgatccgcagtatgcaaataatgggtacgcgaaaaaagcctttaaaatggctattgactatgcttttttagtattaaatatgaataaggtatacttatatgtggatattaagaatgagaaagcagtacatatctatcaaagtaataatttcgaaatagaaggaacgttaaaggaacacttctatacaaggggagaatatagagattgctatgtaatgggcttgttaaaaaggaattgggttaataagaatgatgatgatttgtctcatataagatga

SEQ ID NO: 511 - DNA, 900 bp, Staphylococcus epidermidis
aggctttatgttaaaatcattttaataacaattcaaagcgagggcggaaaaatgatatatgaaactgcgccagctaagataaattttacgctcgacaccctttttaaaagagatgatggttatcatgaaattgaaatggtgatgacaacagttgatttaaatgatcgattatcttttgaaaagcgaactgataataaaattgttgtcgatattgagcataattatgttcctaacgataataaaaaccttgcgtataaagcagctgatttaatgtttgagagatttaatattaatgaaggtgtgacaatttcaatcgataaagatataccagtttcagctggactcgcaggtggttctgcggatgctgccgctacaatgagaggattgaatcgattgtttggtttaggtcaatctttagacgctttagctgcattaggcatacaaataggcacagacatacctttttgtatttataaccaaactgctgtgtgtacggggcgtggcgagcaagtaactttcctaaaaagaccaccttctgcatgggttgttttagctaagcctaacatcggaatttcatcacctgatgtatttaaagcactagatttaactgaagaacatatagttcataatgaaaagtgtaagcaagctttagagaacaatgattatcatttattatgcaatagtctttctaaccggttagagcctgtttctatggctatgcatcctgacattaaaaagattaaagataacatgctacaatgtggtgctgatggtgctttgatgagtggaagcggtcctactgtttacgggctagctcaaaaagaaagacaagctaaaaatatttataatgcagtgaatggttgttgtaatgaagtttacttagtaagattattaggatag

SEQ ID NO: 512 - DNA, 402 bp, Staphylococcus epidermidis
aaaaggagtgtcaaattcatcatgaaaataatcaactcagataaggtacccgaagcactaggcccatattcgcatgcaactgttataaacggttttgtctttacatcaggtcaaattccactcacacttgatggaacaattgttagcgatgatgttcaagaacaaactaagcaagttttagaaaatttaactgtggtattaaaagaagcaggttctgatttgaattctgttgttaaagcgacaatctatatttctgatatgaatgattttcaacaaattaatcaaatctatggaaactatttcgtcgaacaccaaccagctcgtagttgtgttgaagtgtcacggttgcctaaagacgtaaaggtagaaattgaattgataggtaaagtgaaggaattataa

SEQ ID NO: 513 - DNA, 1983 bp, Staphylococcus epidermidis
ggaggaccagtgatggctaaagatacattttatataacaaccccaatatactatccgagcgggaacctacacatcggtcatgcatactctacagtcgcaggcgacgtgatagctcgctataaaagaatgcaaggctatgatgttcgttatttaactggcactgatgagcacggtcaaaaaatccaagaaaaagctcaaaaagctggcaaaacagaactagaatacttagatgaaatgatttcaggtattaaaaacttatggagtaaacttgagatttctaatgatgattttattcgaactacagaagagcgtcataagcaagtcgttgagaaagtgtttgagcgattattaaaacaaggtgacatttatttaggtgaatacgaaggttggtattctgttcctgatgaaacatattatacagagtcacaacttgttgaccctgtttatgaaaacggcaaaattgtaggtggtaaaagtcctgattctggtcacgaagtcgaacttgtaaaagaagaaagctatttcttcaacattaataaatatacagaccgcttattagaattttacgatgaaaatccagactttatacaaccaccatctagaaaaaatgaaatgattaataactttatcaaaccaggtttagaagatttagcagtatcacgtacatcattcgattggggtgtacgtgtaccatctaatcctaaacatgttgtatacgtgtggattgatgcacttgttaattatatttcttcattaggttatctatctgatgatgaaacattatttaataaatattggccagcagacatacacttgatggctaaagaaattgtacgtttccactctattatatggccaatattgttaatggcgttggatttaccacttcctaaaaaagtttttgcacacggttggattttaatgaaagatggtaaaatgagtaaatctaaaggtaatgtcgtagatcctaatgtattaattgatcgttatggtcttgatgcgacacgttattacttaatgcgtgaattaccgtttggttctgatggcgtatttacaccggaagcctttgttgaaagaacaaattacgatcttgcgaatgatttaggtaatctagtgaatcgtactatctctatgataaacaaatatttccacggcgaattacctgcataccaaggtccaaaacatgaattggatgaaaaaatggaagcgatggcgcttgaaactgttaaatcattcaatgataatatggaaagtttacaattttctgttgctttatcaacagtatggaaatttattagtcgtacaaacaaatatattgatgaaactcaaccttgggttcttgcaaaagatgaaaatcaacgtgagatgcttggtaatgtaatggcacatcttgtcgagaacattcgtttcgctacaatcttattacaaccattcttgacgcatgcacctagagagatatttaagcaacttaatattaacaatccggatttacatcaattagatagtctgcaacaatatggtatgttgtcagaggcaattactgtaactgaaaagccaacaccaattttcccaagattagacactgaagcagaaattgcttatatcaaagaatcaatgcaaccacctaaatcaataaaacagtctgatgaacccggtaaagagcaaattgatatcaaagattttgataaagttgaaatcaaagcagcaaccattattgatgcggaaaatgtaaaaaaatcggagaaactattaaaaataaaagttgaattagataatgaacaacgtcaaatagtatctggtatagctaagttttatcgtccggaagacattattggtaaaaaagttgcagttgttactaatttaaaaccagctaaattgatgggacaaaaatccgaaggtatgattttgtcagctgaaaaagatggcgtacttaccttgataagcttgcctagcgcaattccaaatggtgcagtaattaaatag

SEQ ID NO: 514 - DNA, 750 bp, Staphylococcus epidermidis
catcctttttttaggagtaaagatatgttagaagataatgaacgcgttgaccatttaataaaagaaggatatgagattatacaaaatgatgaagtattctctttttctactgatgccctattgttagggtatttaaccgaagttcgcaaaaatgataaagttatggatttatgctccggcaatggtgttattccattattattagctgctaaatcaactcaacctattgaaggaatagaaatacaagagcaactagtgagtatggcacgtcgcagttttaaattgaatgatttgaacgatagactaactatgcaccatatggatttaaaagatgtatatcaaacatttcaacctgctcaatatacattagtgacttgtaatcctccttattttaaaatgaatcaaaatcatcaacatcaaaaagaagcacataaaatagcacgtcacgaaataatgtgtaatcttaaagattgtattgaagctgcaagacatttacttaaagagggtggtcgttttattatggttcatcgagcggaaaggctaatggatgtcttaaccgaattaagacatggtaaaattgagcctaaagcactgacgttagtgtatagtaaacatgataagcctgcacaaacaattgttgtggaaggaagaaaaggtggtaaccaaggtttagatatacgtaatccattatacatatataatgaggatggatcatatagcgatgagatgaaaggtgtttattatggataa

SEQ ID NO: 515 - DNA, 339 bp, Staphylococcus epidermidis
tcttctttattttcttcttcatcgtcttctttgtcttcaccaacaacttctggttcttcagttgctgattcgccttccatagcttcaacttcttcttcagaaggttcatctgttggaggaactactgttacgatagaatcttctggattattttcgattgtgaaatcaccagagattttaatatcagaaactgctaagctgtcattaacttgtaattcactgatatctacttcgatagtttcaggaatattttcaggtgtagctgtaacttctaagttgaataatggttgttcaactacgccgccttctttagcacctacagcttcaccaactaattga

SEQ ID NO: 516 - DNA, 1575 bp, Staphylococcus epidermidis
ttagatgtattgaagaaagtatggcgattaaagatgaagactaagagtgagacggcgtttaacggcgtcgttatacttaccttagcattaattattgtgaagatactaagtgccatttatcgcattccgtatcaaaatgttttaggtgatgacggtttatatgcttatcaacaaatatatcctgtcgtagcactaggggttattttatctatgaatgccattccaagtgctgtgactcaagtgataggtgttaatcgatccgatgaagtctatacaagggttatgtttcgattacaatgcataggttttatcgtctttattttgctttttatgtttgcgaatatgattacccgatggatgggcgattctaatttagcacccatgttaaagatggccagttttagttttattttaataggtgtcttaggagtgttaagaggattttatcaatcaaagcaagtaatgaccataccagcaatttcccaggttatagaacaggtaattagagttagtttaatcattgttgcaattattatgttttcaatgaaacattggtctatttatcaagcaggagcattagctatattggcatcttcgattggttttttaggttcaatgttatatttattacttaaaaaaccacttaaacttaagttatgctatcgctttaataatacttccattcaatggaagcagttgtttatttccatatccatatttgcattgagtcaacttatcgttattttatggcaagttgtggatagttttacaataatacgtttattacaacatagcggtattgcttttaaagaagcaattattcaaaaaggcatttatgatcgtggtgcttcatttatacaaatgggtttgattgtaactacgacttttagtttcgttcttatcccattacttactcaagcaattcgtgaacataatcaaattcatatgaatcgttatgcaaatgcatcaattaaaatcacggtagtaataagtacagcagctagtataggattaattaatctgcttccacttatgaatgttgtattctttaaaagtaatcatttaactctaactttgagtatttatatgtttacagtgatatgtgtttcgttaataatgatgaatatctcattattacaagttcaaaccagtattcgtcccattattatgggtgtgataataggaatactgtccaaaattattttaaatgttatattaatacctttttggggtatcgtgggtgcaagtgtgagtacagtcttatcactactactttttgtcataatattgcaagttgcagtcttaaagtactaccgttttaatcgtatatctttatttatcgttaaacttattttaggtatgataattatgagtatagttgttcaaactgtcatgcttgccttaccttcaaaaagtaggatgttaggattactagaacttatagttagctcaattataggcatagtgattataatgttgtatattgttatatttaatgtattaggatacaaagaaataaagcacttaccttttggagacaaattatatcaaatgaagagaggaagacggtcatga

SEQ ID NO: 517 - DNA, 1371 bp, Staphylococcus epidermidis
gatgaaaaattaaatttagagagagttattaatatgaaaagaccaataattcaaaaattaaatcacttgatagagaaaaaagctatctctatgcatgttcctggacataaaaacatgacaatcggctacttaaataggcttgatttagcaatggatatgacagaaattactggattagatgatatgcattatcctgaaggaattattttagaaagcatggagaattttaggaaacataaaaactatgatgctttcttattagttaacggaacgacttcaggtatattatcggttatccaagcgttttcgacaagaaaaggtaaatatttaattagtagaaatgttcataaatcagtatttcacggtttagacataacacaacaacaagcgacaataactaagacagatgtcagtaagaaaacgaatcaatatgtaaatccaaagataaatcaagataaaaatcaatattataaacttgccatctgtacataccctaattattacggtgaaacttttgatatttctcaatatatcaaacaattacatcacagagggataccgatattagtagatgaagcgcatggtgcacattttggtttagatggatttccagaatcctcaatgaattttaatgctgattacgttgtgcagtcatatcacaaaacactccctgcactaacaatgggatcagttatatatatacataaagatgcaccattaagacaacaagtcatagattatttaacttatttccaaacgtcaagtccttcgtacctcattatgtctagtttagaattagcgaataaattttataaagaatatgattctacattatttgaccaacgaagaaagatgttaattgatttattagtaaatatgggatttacagttatagaaccagaggatcctttaaaattggttgtgagttttgagggtgttgaaggttatgatgtgcaaaaatggtttgaggataaagaaatttatgtagaattagctgatatgtatcaagtgttactcgttctccccctatggcatgaaggagataaatttccttttaagttgttgattgaaaaaattagagaaattaacgtgccaaaaaaatgtacgcgcgacataaaacctcttaattttatgacgggttttagcgaatacaaaactgttcattttcaaaatacgaaagaagtgtctattaaaagggcagaaggtaaagttttagcacaacatatcgttccataccctccaggtataccggtgatgtttaaaggagaagtcgtgacgtctcatatgatagacttattaaataaatatgataaacaaaatattaaagttgaaggtttaaatcataaaaaaatattagttaaggatgaataa

SEQ ID NO: 518 - DNA, 1401 bp, Staphylococcus epidermidis
atgaatacatcacaaaagtttaggggagataatcgcttattattagggattattttaggggttattacattttggttatttgcacaatcacttgtaaatctagtcgtgccattacaatcatcatacaatagtgatattggtactattaatatagcagttagcttatcggcactattttctggtctgtttattgtaggtgcaggagatattgcagataaaattggtagagtaaaagtgacatacataggcttagcacttaatattgttgggtcggttttaatcattattacgccattaccaagtctattgattattggacgtgctattcaaggattgtcagcggcatgtataatgccagcgacactcgcaatcattaatgaatattatatcgggacagcacgacaacgtgcattaagctactggtccatcggttcatggggaggtagtggtgtttgtactttgtttggtggtttaatggcaactaaccttggatggcgctcaatctttattgtttcaattattctgacaatattatccatgtttctcattaaacatacacccgaaacaaaagcagagcctataggagatcaaccgacagagacaaagaaatttgatgttgttggtttaatcatcttagtggttagtatgttaagtattaatgtgataataactcaaacctctcaatttggtttgttctcaccatttattttgggacttattgcaatttttgttatatcgttaattatattcgtgatttacgaaaataaaatcaaacaaccacttgtcgattttgatatctttaaaaacaaaggttatacaggtgcaacgatttcaaactttatgttgaatggtgtagctggtggtacattgattgtagtaaatactttttatcagcaaaaattagattttaactctcaggaaacaggatatatttcacttacatacctaattgcagtattaattatgatacgtgtgggtgaaatgatattacaatcgttaggacctaaaagacctttgttactcggaagtgccttgaccgtcataggattaatattattatctttgacgtttttacctaatgcttggtatatagcgtcaagtgtcattggttatttattatttggtaccggtttaggtgtttatgcaacaccatccacggatacagctgttgcacaagcaccagatgataaagtaggcgtcgcatccggtgtatataagatggcatcatccttaggaaatgcatttggtgtggccatctcaagtacagtttacagcgtacttgcagcccaacttaatctgactttaggtggttttactggagtaatgtttaatgcgcttatagcattattagcattcctttctattttgttcttaataccgaaaaaacagtctaatgtataa

SEQ ID NO: 519 - DNA, 231 bp, Staphylococcus epidermidis
ggcataattccatatatatatgagagtacaacaatacctactaataacactgctaaaattgtacccatagtgactaaagttttgactgcattcttaggtgctggatttttaaaatttgttactgcattggatattgcctctacacctgtaagtgatgatgctccagatgaaaatgcttttaaaagtaaaaataacgtaacaccgggcacagtactacctacagtggaatga

SEQ ID NO: 520 - DNA, 1245 bp, Staphylococcus epidermidis
acttacatgttgataggtatagtgttatttgcttttatgagagctcttggtgaattattattaagtaactctaaatttaattcattcgtagatattgcaaatgaataccttggtccatttggtggatttgtaattgggtggacctattgggtttgttggattgtctctagcatgtcggacctcactgcgatgggacaatattttgcttattggtatccacaagtcccacactggttgacagtactatttattgtactcctacttatatcatttaatttgcttggcgccagattatttggagaacttgaattttggttttctataattaaagtcgttacaattattacgatggttattgtaggtttagttctgatttttttatcatttaaaacagaatatggacatgcttcttttggtaatttgatacatcatggcgggatgtttccacatggtgcagctggatttttaatgtccttccaaattgctgtatattcatttatcggtatagaacttataggagtcacagctggcgaaacaaaaaatccagaaaaaacaattcctaaagcaataaataacgttcctatacgaattttattattttatataggtggtttacttgtaatcatgtctgtcattccatggtttaaagttgatcctgatagtagtccgtttgttaaattattcacactaattggtgttccctttgctgctggcatagttaattttgttgttttaacagcagcagcatctgcaacaaatagcggaatatattctaatagtagaattttatttggtttagcgaaacaaggtttaggtcctaaagtattgacaaaaactaattctaatggtgtaccttatctctcaatgttagtatcttcaataacattgttaatcgcagctttattaaattttattttcccagatgctattaaattatttatttatgtaacgacactatctaccgtcctattccttgtagtgtggggaatgattatcgtttcttacatcgcatacgtaaagaagaatcctgaacaacatcaatcaagtgcatttaaattatggggcggaaaaattattgcctatattgtgttatcttttttcatatttatctttattttgctattctttagcaaagatactagagtagctatttttatttcaccattatggtttatcttcttgttcttttattataagaaatacaagaataatgctgaatctttagccgatagacagcgacattaa

SEQ ID NO: 521 - DNA, 1584 bp, Staphylococcus epidermidis
acaaattatttatgcttatccaaaaggtggggagcgtatattgtttctaaaacaaatcttggtgagaaatggggattgctagctggagggtctttattagtcgactatatattaacggtggcagtgagtatttcttcaggagcagatgcttttgttgctgcatttccccacttatatcattttaaagtgcttattgcatgtttattagtactctttattttaatgatgaatttaagaggtttgactgaatcagcaactgtattatcatatccagtctacttatttattataggtttaattgttttgatagtcgttgggacatttcgcgtagctactggacaaatcgcaccacatattcattccactgtaggtagtactgtgcccggtgttacgttatttttacttttaaaagcattttcatctggagcatcatcacttacaggtgtagaggcaatatccaatgcagtaacaaattttaaaaatccagcacctaagaatgcagtcaaaactttagtcactatgggtacaattttagcagtgttattagtaggtattgttgtactctcatatatatatggaattatgcctcaaactgaaacgaccgtgctttcacaacttgcgtcccaaatatttggtgaaaatgtagcgttttattttatacaagctactacagttatgattttggtattggctgctaatactggttttacagcatttcctatgctagctgcatcaatgtctaaagacaaatatatgccacgtatgtttactgttcgtggtgatcgtctcggttattcaaactcgattattatattaggtgtattagccatcattttaattatcctatttgaaggaatgacagagaacctcattccattatatgcagtaggtgtttttattccatttacgcttgctcagtttggtatggttttaaaatggcttcgggaacgtcctgaacgatggggaataaagcttactatcaatttaattggtggtacgattacgtttatcgtattcatgattttactcattactaaacttaatcaagtatggccaattcttttatttttaccttttattgtatttatttttattagaattcatgtacattatgagaatatagcatgtgaattacgatctgaaattgatatacacgatattcctgttgtagatcgcaatttagctattgtacctattcaaagtattacaactgtagttgataaatctatttattatgccaaattattagctaatgatgatgttattgcagtgcatgtgacatttggtgatgaagatgagcaggcttttatgactaaatggaaaaaacattttcctgatgtaagacttgtgattttacattcagagtatagaagtattattcatccgatttcacgatttatagataaaattcgtaaaaaagcgaatgataaaaattatttaattacagtagtcgttccagaatttatccctaaaaaggcttggcagcacttattgcacaatcaaacgagtttacgtttaaaattgcatttaatttatcaaaaaaacgttactctgtgtactattccattcaaattaataaaataa

SEQ ID NO: 522 - DNA, 261 bp, Staphylococcus epidermidis
gtgtgtatcgcatgtcttaaatgtggctttttaatgcttaggtgttattttaatgttttttctttttatcagaacggtaagttatacttattaaagataaccaaaccagtaacatggttatggctagatagacacttacaactaaatatttcgaatgtaaaggtaaccatgataaaacaaacccccaagttgcatctcctaatattatcaagggaagtagataaaaaagaatattcattgctacaaatcccaacaaaatga

SEQ ID NO: 523 - DNA, 279 bp, Staphylococcus epidermidis
aacaacttagcaccaaatccactacctaatgcgccagaacctgcaattgctattttcatatattccatctccttacaattctatattgtttttaaaatactactttactacataccagtcaatataatacggttaatttgtaagaattttctgttaattaagaataagtattatctctcaaacgtacattgctcattcgacattttattaccaatttgcacagtgaatcgtttctttgttaatttattattctatttcagttgcgtttttaaaatatga

SEQ ID NO: 524 - DNA, 792 bp, Staphylococcus epidermidis
ttccatataaatcttctaaggaggaacactttaatgaaagcgttaatcgttgatgatgaaccacttgcaagaaatgaattacaatatcttttaaatcttaatgatgctatagatgaaattgaagaagcagaaaacatagaagaaacattggagaagttactctacaacacatttgacttaatattcttagatataaatttaatggatgaaagtggtattgatttagctcaaaaaattaataaaatgaagcgatcaccacatattatctttgcaaccgctcacgagaaatttgcagtcaaagcctttgaattaaatgcaaccgattatatattaaaaccttttgaaaaagaacgtattaatcaagctgtaaataaagttgacatggctaaagataaaccaaaaaacaaagataaaactatcacacctaaatatattgattatagtgatgatgagcgcgctcaaacacatgtacttccaattgaagtggatgaacgtattcacatcttaaatttcacagacattatcgcattatctgttaataatgggattacaacgatagatacaacaaaacaaagttatgaaacgaccgaaacacttaatcattacgagaaaaaactaccttcctctctatttattaaaatacatcgcgctactatcgttaataaagaacatatccaaacaatagagcattggtttaattatacgtatcagctgacgttaacacatgaatttaaatatcaagttagtcgttcttatatgaagacttttaaacaacaactcggtcttcaataa

SEQ ID NO: 525 - DNA, 705 bp, Staphylococcus epidermidis
gcaatgattgaacatttaggaattaatacaccttattttgggatattagtatcattaataccatttgtcatagcgacttatttttataaaaaaacgaatggtttctttttactagcacctttattcgtaagtatggttgcaggtattgcttttttgaaattgacaggaattagttatgagaattataaaatcggtggcgacattattaatttcttcctagaaccagctacaatatgctttgcgattcctttatatcgcaagcgcgaagtattaaaaaaatattggttacaaatatttggtggtatagctgttggtacaattattgccttgttattaatttatcttgttgcaataacattccaatttggcaatcaaattatagcatctatgctacctcaagctgcaacgacagcaattgcattacctgtatctgacggtatcggtggtgtcaaagaattaacctcactcgcagttattttaaatgcagttgtcatttctgctttaggtgctaaaatagttaaattatttaaaatatctaaccctattgccagaggacttgcactagggacaagtggacacactttaggtgtcgcggcagctaaagaattgggtgagactgaagaatcaatgggaagtattgcagttgtcatcgttggcgttattgttgtagcagtagttcctatacttgctccaatcttattataa

SEQ ID NO: 526 - DNA, 1791 bp, Staphylococcus epidermidis
atgaggattgacgttatgcttaatttatttattttattacttgaacgcgtgggattaattattttactcgcatatatactcatgaatattaatcattttaaaacaatgatgagcgaacgtgacaaatggcgttcaaaattccaactaatcattatttttggtatattctctatgatttcaaattttacaggaattgaaatagaaaatggccatatcgtatctggtgatatttattaccacttaagcaaagacgcctcaatggccaatacccgtgtattaacaatcggtgtttctggtctaataggtggaccgtgggtagctataattgtaggcattatttcaggattatgtcgtttatatattggcggggctgacgcatatacctatcttatttcatccatagttatcgctatcatatctggttactttggtcatcaaacaataaaacaaaatacatatccgtccattaaaaaaggtgctattatcggtgcaataactgaaattattcaaatgggctgtatattattatttacaaataacttacatcacgcaattacattagtcagttttatagcactaccgatgattatcattaatagtttaggtacagccatatttttaaccatcattttgtcgaccatcaagcaagaagaacaaatgcgtgcagtccagacgcatgatgtattacaactcgctaacgaaacactaccttactttcgatctggacttaatgaaaaatcagcccaacaagctgctgaaattattttaaaattaatgcaagtgtcggcggtcgctattacaaataaaaaagatattttaacacatattggtgcaggcagtgaccatcacgtagcacgtaaagagataattactgatttatctaaagaagtgattcaatctggaaaattaaaagtcgctcatacgagagaaggaattggatgtcaccatcctaattgccctcttgaaggagccattgtcgtccctctttatatacataatgaagtcgcagggactttaaaattttatttcacagataacaatattatttcaacttcagaccaacagctcgcaaaaggtctcgccaatatattttcctcacagctagaactaggtcaagctgaaatgcaaggacaattattgaaagacgctgaaattaaatcattacaagcacaagtcaatccacatttcttttttaatgctattaacactatatcagcactagtaagaattgatagcgaaaaagcacgacgtttactgattcaactcagtcagttcttccgctctaatcttaatggtgcacgtaataatacgattactttacaaaaggaattacaacaagtagcagcatatttatccttagagcaagcgcgctatccaaatagatttaacatacactatcgaattgatgatcagtgtcaagatgcgctcatcccaccttttataattcaaatattagtggaaaattctattaaacatgcatttaaaaatcgtaaaaagaataatcatattgatgtggatgttagcatgaagcaagactacttaagtatatctgttcaagataatggtcaaggcataccagctgatcaattagatactattggatatacgacagtaacgtctaccactggtactggtaatgccttagtcaatcttaataaaagacttactggactatttggaacaacatcggcactgaacattcaatcttctcaatcaggcacgactgtaagttgtttaattccatataaatcttctaaggaggaacactttaatgaaagcgttaatcgttga

SEQ ID NO: 527 - DNA, 276 bp, Staphylococcus epidermidis
acaaaaaatgagcaagttgagcaatttttagctaaagaaagccaatggcaagattgttataaatttttgagaaatttaatttttaatgaaactgaacttgaagaaaattataaatggatgcatccttgttatacgataaacaataaaaatgctgtgctaatacatggatttaaaggttatgtagcgttgctttttcaaaaaggagcaatacttgaagaaaagtatcatacattgattcaacaaactgaaagactacaggctgaagctgtcccctaa

SEQ ID NO: 528 - DNA, 975 bp, Staphylococcus epidermidis
aagtatctagataaatgggaggaattgacattgaagaagtatcttaactatacactgattctgattgcattatctctcatcgtgttatctggatgcagtttaccaggcttaggtgatggaaatgctaaagatgatgtgaaaattacaacgactgaaacaagtgaaactaagattataggtcatatggaaaaattattaattgaacatgaaactgatggaaaaatcaaaccgacgttaattggtaacctagggtctagcattattcaacataatgcgttacaacgtggagatgcaaatatgtcagcggtacgttacacaggtactgaattgacgagtgtattagcagctaaacctactaaagatcctgataaggccatgtctgaaacacaacgcttatttaaaaagaaatatgatgaaaagtattatcattcacttgggtttgcgaatacatacgcattcatggtgacaaaagaaacggctaaaaagtatcacttaaaaaaagtatcagacttagagaaatataaagatgaactacgtcttggaatggatacccaatggatgaaccgtgcaggtgatggatatcctgcttttgttaaagattatggatttaaatttgatagtgcgcgtccaatgcaaattggtttagtatatgatgcattaaaaaataataaattagatgtagcagttgggtattcaacagatggacgtattgcagcttatgatttgaaaatattggaagatgatcgcaaattcttcccgccttatgacggtagtccacttgcaaatgaacaattaataaaggataatccagaaatcgataaggcactaaaaaaattagaaggtaaaatctcaacagaagaaatgcagaagttaaattatgaagcggatggaaaaggtaaggaacctgcagtgatagctgaagaatatttaaagaaacatcattactttgaagaaaagaaaggtggtcataagtaa

SEQ ID NO: 529 - DNA, 954 bp, Staphylococcus epidermidis
aattgtaaggagatggaatatatgaaaatagcaattgcaggttctggcgcattaggtagtggatttggtgctaagttgtttcaacatggttatgacgtcactttaattgataattgggaacctcaagttactacaatacaacaggacggtctacatatcgatattaatggtgaagcgcatcatttcaggctacctatgtatagactaacggaaattcctaaagcaacgtcctatgatattgtttttctatttcctaaatctatgcaattagaagaggtgcttagtcatattcaaccccatcttcatgataatacaattgttgtgtgcactatgaatggtttgaaacatgaacgtcttatacaacaatatgtttctatagatagaattgtacgtggagtaacaacgtggactgccggtattgatcaacctggtcacacgcacttaatggggcaaggtcctgttgaaattgggtgtctcgtgcccgagggaaaagaaagcgtagatatcattgttaatctgctacaaaatgcagaattaaaaggtgtaaaaagtgaacatttacatcaatcaatttggaagaaaatatgtgttaatggaacagctaattcattatgtactatacttgaatgtaatttggcagcactgaataatagtgatgacgctaaaaatttgatatataaaattacacaagaaattgttcatgttgcaacagttgatgatgttcatcttaatgttgatgagatttttgattacttaattgctttaaatgataaagtaggcccacactatccttctatgtaccaagacttaattaaagataatcgaacaactgaaatagattatattaatggagcagttagtaaattagggaaagagaatcatattgctacacctgtaaatgattttgtaacaaatcttgtacatgctaaagaaaatcaacgtggtgcacaatga

SEQ ID NO: 530 - DNA, 195 bp, Staphylococcus epidermidis
ccaatgacacttgacgctatataccaagcattaggtaaaaacgtcaaagataataatattaatcctatgacggtcaaggcacttccgagtaacaaaggtcttttaggtcctaacgattgtaatatcatttcacccacacgtatcataattaatactgcaattaggtatgtaagtgaaatatatcctgtttcctga

SEQ ID NO: 531 - DNA, 1533 bp, Staphylococcus epidermidis
agtagaggatgctcaatgaagataaaactgtttgtcattgttgtcatttttttgatgactattttatcgataatttcaataacaacacgagaaatcgcacatagtaagaatgagacgatattgacacatgcttctcaaaaacatattgataaaatggttgagacagcaatgaagaaaggagatatccccggactagcaatattgatcatcaaagacaataaaatctttttaaataaagggtatggttatgccaatattgaaaaaaaagcaaaggtaaatccacatactcaatttgaaattgcatccaatactaaagcttttacaggttatgcaattctacaactagctcaagaaggaaaaataaatttaaatgacaaagtaagtacatttatacccggatttaaaatgaagtatgaagacaaagaaagagatattactattgaacagctattagctcaaactagtggtatccctggagatatcactgaagaaaatcgttactctaaacagtacgatagtattgaaaatatcgttaattttgcaaaaggaaaacgtctgaaccatgtacctggagaaacttttgaatattcgaatatgaattatgatattttaggtcttattattcaaaatgttacccatcaatcctatacatcatacatccaaaagcatgttttagcccctttaaagatgaaacataccacttttaaagtaaataataccaaatctaataacgaagcattaggttatatatgggaagataatgaaaataaagttgcacaaccagagtttaacattggggatactcctgcggcatatatgatgtcaagtacaagtgatttagcaaaatgggtccaactacagatccaccctacttcaaaatcacaagccaagttaattcgtcaatcgcatcaggtattatctaactcattaaatagtgagcctaacgcagatagctacggttcgggatggtttataaatactgatgaccatctcgtatttcataccggcgttttagataatttctcttcacaaattttattaaatattcgtaaatcttatggcattgtcgtattagccaatacaaattcaaatcaagtgactcgtttagcggaacatttaaatactcaaattatgaataatcgtcattacacaactatagaagaaaaagtgaaccaaacgaaagatatgcaacttatcatttccacattggccgatatattcatggtcatatttagtatcttagtttttagtaaaatcttaaaattacgtgaaggccacatcttcatccgtaaatgtttacgaacttcaatcatgttcagcatcattttgttgggatttgtagcaatgaatattcttttttatctacttcccttgataatattaggagatgcaacttgggggtttgttttatcatggttacctttacattcgaaatatttagttgtaagtgtctatctagccataaccatgttactggtttggttatctttaataagtataacttaccgttctgataaaaagaaaaaacattaa

SEQ ID NO: 532 - DNA, 1383 bp, Staphylococcus epidermidis
aaatatataagcaaaggcctttgtcttttgtttaactttagtcattatttgtttaacaattgcatcagaggtctttttttaggtcatggaacaagacattctttatataggaaggggaaaacaattatgttaagtattaaaaacttaaccaagatttattcagggaataaaaaagcggtagataatatttctttggatattcaatctggtgaatttatcgcttttattgggacgagtggtagtggtaaaacaactgcactacgcatgattaatcgtatgattgaggcgacagatggacagattatgatgaatggaaaagatgtccgtaatatgaatcctgttgaattgcggagaagtatcggttatgtcattcaacaaattggtttgatgccacatatgactattcgagaaaatattgttttagtacctaaacttttaaaatggtctaaagagaagaaagatgaaaaagctaaagaacttattaaactggtagatttacctgaagaatatttggatcgttatccagctgaattgtcaggagggcaacaacaacgaattggtgttgtgcgcgctttagcagctgaacaagatattatattaatggatgaacctttcggtgcattagatcctattacacgcgatacattacaagatttagtaaaggaattacaacaaaaattaggaaaaacatttatttttgtcactcatgatatggatgaggctattaaattagcagacaaaatatgtattatgtctaagggaaaagtcgttcaatacgatacacctgacaatattttacgatatcctgcaaatgactttgttagagattttattgggcaaaatcgcttgattcaggatcgtcctaatatgaaatctgtggaaagtgctatgatcaaacccgtcactgttaaagcagatgattcattgaatgatgcagtaaatattatgagaacacgtcgagtagacactatttttgtagtcaataatcaaaataaattattaggatttttagatattgaagatatcaatcaaggattacgtgcgcgtaaagaattaattgataccatgcaaagggatgtctacaaagtacatatcaattcaaagttacaagactcagtgcgtactattctaaaacgtaatgttagaaatgtacctgtggtcgataatgatgaacatctcattggtttaattacacgtgcaaacttagtcgatattgtgtatgactcaatttggggcgaagaagattctgatagttatgagatcccaaatgaaagcttagatgagaataatcacgatttaccacaaaatcaaactgatacacgaacaaatataaatgaagatgtgaatgattatcatgatgctcaacatagaggtgaggattaa

SEQ ID NO: 533 - DNA, 855 bp, Staphylococcus epidermidis
caaaaaggaagtatcactatgcataaacgacttttcatcactttattaggttttatcattttactagctggatgcgattattctaaagaagagaaccaaactggtatattttataacgtttttgtaaaatctatggatggatttcttcattttcttggcagagtctttcaggataactatggctttgctattatttctattgtactcatagttcgtttcatcctattacctttcatgttaatacaagttaagaatatgcatatgatgcgcgaaaaaacaaaagtcgtccaaccagaattggatgctataagagataaaatgaaacacgcaacatcacaagaagaacgtaatgcagccaatcaattgcttatgaaaaagtatcaatcgtatggaattaatccattaaaaaatatgttagggtgtcttcctgttcttatacaaatgcctatattaatggggctttatatgagtttgaagtacccttcgagtcacggaattactgaatacccacatttcttatggtttgatttaacgcaacctgatttgattatgacaataatcgcagcaatcatgtattttgttcagccacttgtaaactcaatccattatccaaaagatcaaagaaaaacatattactttatgatggtattttcaccgatattcataacatatgcgtctctacattctgctgcagctttgggcttatattggagtataagcgctgcttttctaatagtgcaaatgcattttgctcactctcattataagaaagtggcactacatgaagctaaaaaactcaaacaaaaattagagcaaaataaagacaatagtgagttattaaccgaagagtcataa

SEQ ID NO: 534 - DNA, 474 bp, Staphylococcus epidermidis
agaaaacagaggggaatggttattttggaacaaacgcatctcgttaaaaacaaaacggttgataacaagaagtcaatgaaatacagtatttttcaacaagcattaacgattgcagtgattttacttatatcaaaaattattgaatcatttatgcctattccaatgccagcttcagtaattggacttgtactattatttatcgcattgtgtacaggcattgtgaaattaggtcaagttgagactgtgggaactgcattaaccaataatattggattcctattcgtaccagctggtatttcagtcattaactctttaccaatccttaagcaaagccctattttaattattttacttattattatttcaacacttttattattaatttgtactggctttgcgtcacaattattagtgacgaaatcacttttcccttctaaagagaaaaatgaagaaacaagtcacgtaggagggtaa

SEQ ID NO: 535 - DNA, 699 bp, Staphylococcus epidermidis
gtaatgaaaggtaatttgttacattcaatcatcgaatattactcactgaactgggcctttcttctagaactgttcttcaaacatctattaatgtcggtatatggtgtgttgtttgcatgtataattggaattcctattggtattttcatagccaagtataaacgtttatcgtggccggtaattacaattgcaaatattatacaaactgttccagcaatcgctatgttagccatacttatgttggctatgggattaggaccaacaactgttgttgtaactgtattcctatattcgttattacctattattaaaaatacttatactggtattgtagaagttgatgaaaatattaaagacgctggtaaaggtatgggaatgacggggaatcaaatattaagaatgatagagttaccattatctttatctgttattattggtggtgttagaattgcacttgttgttgctatcggaatagtagcgattgggtcatttatcggtgctccaacactaggtgatattattattcgtggtacaaattcaacagatggaacaacattcatcttagcaggtgccataccaattgctttaatagcaattatcatagatataggattacgttatctagaaaaacgtttagatcctactcgtaaaaacaaaaaagattcaatgcaaaaacatcaagtacaaaaattacattaa

SEQ ID NO: 536 - DNA, 351 bp, Staphylococcus epidermidis
gttttcaggggtattttagatatatttatagttttgggtaattataataagattggagcaagtataggaactactgctacaacaataacgccaacgatgacaactgcaatacttcccattgattcttcagtctcacccaattctttagctgccgcgacacctaaagtgtgtccacttgtccctagtgcaagtcctctggcaatagggttagatattttaaataatttaactattttagcacctaaagcagaaatgacaactgcatttaaaataactgcgagtgaggttaattctttgacaccaccgataccgtcagatacaggtaatgcaattgctgtcgttgcagcttga

SEQ ID NO: 537 - DNA, 1065 bp, Staphylococcus epidermidis
ggggtttttattatgaaagcagcagtatggtatggacaaaaggatgtacgcgttgaagatcgcgaacccaaagcaataaaagacaatgaagtgcaagttaaagtctcttgggccggtatctgtggtactgatttacatgaatatttggaaggacctatctttatttcaactgatcaaccggacccactacttggtcaaactgcacctgtgactttaggtcatgaattttcaggtgtcgtagaaaatgttggtaaaaacgtatcacgttttaaaaaaggggatcgtgtggtagttaatccaacagtgtctaaaagagaaaagccggaaaatgttgacttgtatgatggttattcatttataggactaggttctgatggtgcatttgccgagtttactaatgctcctgaaacaaatgtttatcatctaccagataatgtttcagcacgagaaggtgctcttgtagaaccaacagccgttgctgtccaagcagttaaagaaggcgaattattattcggtgatactgtagcagtatttggcgctgggccaattggtttgttaactattgttgcagcaaaagctgctggtgcaagtaaaatatttgtctttgacttatcagaagaacgtttagcgaaagctaaaagtgtcggtgcgactcacgtgtataactcaggtaacgtcgatccagtacaaacggtttatgaacatactgacaacggtgtagatgtgtcatttgaagttgctggtgtaggtattactttacaacaatctattgaagtaacacgtccacgtggtactgctgtcatcgtatcaatcttcggtcatcccgtagaattcaatccattattacaaatgaataaaggtgtcaagttaacaactacaattgcttatacaccaactacattccaacaaacaatagatttaatcgctaacggtagcttaaatgttaaagacgtcgtaacagatcaaattgaattagataatattgttgaaagtggcttcaatcaacttgtaaacgataaatctcaagctaaaattttagtccgtttaaatggtgaccaaaaataa

SEQ ID NO: 538 - DNA, 645 bp, Staphylococcus epidermidis
ggattaataatgaaagcattcttacaagaatacggtagtcaacttttatcaaaagcagtagaacatttttatatttctatgtttgcattattgttagcgattgtagtagctgtccctttaggtattttattatcaaaaacgcaacgcacagctaatgtggtattaacagttgctggcgtgcttcaaaccattcctactttggctgtgttagctatcatgattccaatatttggggtaggaaaaacaccagctattgttgcattatttatctatgtattattaccaattttaaataatacagtattaggtgttaaaaatatcgataaaaatgtcattcaagctggtcaaagtatgggaatgactaaatttcaattaatgaaagatgtagaaatgcctttagctttaccacttattattagtggtattcgtctatcaagtgtatacgtcattagttgggcaacactcgcaagttatgtaggtgcaggtggacttggggatcttgtatttaatggattaaatctctatcaaccacctatgattattagtgcagcgattgttgttactttattagcattagttattgactttatactttcattagttgaaaaatgggttgtacctaaaggattaaaagtatctagataa

SEQ ID NO: 539 - DNA, 345 bp, Staphylococcus epidermidis
gttaaagaggtaggagtcatgttcattcaatttaaaagacttttgattggtagacctaaaagaaacagagacttaaaaaacgagaaaatttcaaaatttaaaggattagctatcctatcatccgatgcattgtcatcagttgcatatggtcctgagcagatattaattacattatcggtgataggagctgtggcatcttggtatacgctgcctattgccggagcagttttaatattattaacagctctaattttatcttatagacaaattatttatgcttatccaaaaggtggggagcgtatattgtttctaaaacaaatcttggtgagaaatggggattgctag

SEQ ID NO: 540 - DNA, 255 bp, Staphylococcus epidermidis
ggtacaccattagaattagtttttgtcaatactttaggacctaaaccttgtttcgctaaaccaaataaaattctactattagaatatattccgctatttgttgcagatgctgctgctgttaaaacaacaaaattaactatgccagcagcaaagggaacaccaattagtgtgaataatttaacaaacggactactatcaggatcaactttaaaccatggaatgacagacatgattacaagtaaaccacctatataa

SEQ ID NO: 541 - DNA, 663 bp, Staphylococcus epidermidis
aactcatcctcactacaaaccttcaaaatatttaaaagcagtatttgtaacaataaaacattaattttctataaatatgggtataaatcactgttgaagttttatttgaaaggatgtcattatatgggaattagaagtaaactaactaataatattacaaataaagtagggaactcattattgaacatagaggaaattaaagagaaaggtgatttgccaactacacaggaagaacttagacaacgcagagaaagagctgaaactctagttaaaaagaaatcgctactttcctccggtgctagtattgtccctattccaggacttgattttggagtagatcttaaattaatgagagatattatagaggatgtaaataaaatttatggtttagatcacgatcaagttaattcattgagtgatcaagtgaaagaaagaattatgtctgcagcggcaattcaaggaagtcaatttattggacgtaaggtatctgaggcgttgcttaaagttgtgattaaagatgtagctaaacgagcagctgccaaacaaacaaaatggttcccgtttgttgggcaagctgtatctgcatccattagctattattttatgagcaaattaggtaaagatcatattaataaatgtgaaaaagttatcaataacttatag

SEQ ID NO: 542 - DNA, 1074 bp, Staphylococcus epidermidis
atgaagcgattttttcaacttatcatttctgctatagttattggtattttatgtttaatgattagtcattggtttaaatcaaaagataatacccactcaaatgagaaattatatgtttacaattggggagaatatattgatcctagcttaattaagaagtttgaaaaagaaacaggtatacaagtcgtatatgaaacctttgattcaaatgaagcaatggaagcgaaaattcgaaatggaggcacacactatgatgtagcttttccaagtgaatatactgttcaaaaattaaaaaaagctaaactgcttgagactttaaatcatgacaaaattccaaatatcagaaatttagacaatgattatatgaacttgtcatatgacccaaacaatcgatattcaattccatatttctttggtaccgtaggaattttatatgataaagagaaatatcctaatgaaacgttcgatagttgggacgatttgtatcattctcaattcaaaaatgatattttattagtagacggtgcacgcgagataattggaatgggattaaataaattagggtatagtcttaatgacaaaaatccgacccatatttatcaagcagaaaaagatttgcataatttagcacctcaagttagagggatagtaggcgacgaaattactatgatgcttcaacaaaacgaaggacatgttgcagtagtttggagtggcgttgctgcaccacttgtacaggaaaatactcgttataattacgtgatacctaaagaaggctctaacctatggtttgataatatggtgatacctaaaactgcacaaaataaagaaggtgcgtataagtttatgaatttcttactagacgcgcaaaatagtgcccagaatacggaatgggtagggtatgcaacacctaataaagcagctcgaagtaagttgcctaaaaaggtaagaaatgattatagattttatccatcaaatcaagaacagcaacggttagaagtctataaagatttaggtcaaacgtctctcagtgaatataatgaaagctttttaaattttaaaatgtctttaaaatag

SEQ ID NO: 543 - DNA, 957 bp, Staphylococcus epidermidis
tttactatatcattatattatatgagaaatttaaggaggggaattatgaacaaagatcaaactttgtcacatactacgggccgtgtatccttcaaagaattacaacaaattattaaaatggcccttgttcaaggtaatttaatacctgcttttgcaggcgcatggcttgcaatagtaatgacaaaccattccttcctatcttccattccacaaatactattgatgctagttggctctacgctaattatggggggcgcttgtgctttaaataattattatgatcaagatattgatcgcattatgcctagtaagcaaagtagaccaacagtaaatgatagaatatctgatagaaacttattaatgttaagttttgggatgatgttaataggtgaagcatgtttattcttattaaatataccttctggtgttttaggattaattggtattgttggatatgtatcttactattcaatttggtctaagcgccatacaacttggaatactgttgttggaagttttcctggagctgtaccaccattaattggttgggtagctatcgatggatcattaagtttagcagcagtagcactctttttagttgtcttttgttggcaacctatccatttctacgctctagcaattaaacgtagtgatgagtatgcgcttgcaaatattcctatgttaccatcagtgaaaggtttcaaacggacaagagtaagcatgtttatttggttagtgttattattaccattgccattcttattatctaatttaggtgtaacttttgttgttattgctacactacttaatttaggatggttagctttaggttttacaacgttcagaaaagaatctaatcaaactaaatgggcaacgcaaatgttcgtttattcattgaactacttagtagtattctttgcactcgttgtagttgtttcattaatcaagatgatataa

SEQ ID NO: 544 - DNA, 1242 bp, Staphylococcus epidermidis
gtaaagtttttagcttctcaattattcaaaggaggtttttttatcgattacttaggtgttgatattagtaaaagaagtagtgtagttgcacattataaaaatggaaaattccaaaaagagtttttcatccaaaataataaaaatggttacaattatttactcaagtatttgaatgacttacaccacccacaactcatttttgaatctacaggtatctattcaagaggtatgcaacgattttgttgtgtaaatcaaattaactatattcaaatgaatccgttagaagccaaatttaaaacgagcactctaagatcatggaaaactgatcaggcagatgctcataagcttgcttgtttaggaccgacgcttaaacaaacaggcaacttacctatacatgagttaatattctttgaattaagagaacgcgtccgttttcatctagaaatcgagaatgaacaaaatcgacttaaatttcagatccttgaattactccatcaaacattccctggtttagaaagattatttagtagtcgatattcaatcattgcactcaacatcgcagaaatctttactcatccagacatggttcttgatatcgacaaggatgtactgattacacatatattcaattctacagataagggaatgtcaatggataaagctacaaaatatgcacttcaattaagagtgattgctcaagaaagctatcctaatgtcgatagacattcctttctagtcgaaaaattacgcttacttattcaacaattaaaacaatctattcatcatctcaaacaattagatgatgccatgattcaattagcacaacaactcgattattttgaaaatattcattcgatacctggtattggtaagctaagcacagctatgattattggggagattggtgatattaagcgatttaaatcaaataaacaactcaatgcttttgttggcattgatatcaaacgatatcaatcaggtcatacacactgtagagataccatcaacaagcgtggtaataaaaaagcgagaaaacttttattttgggtgattatgaatataataagagggcagcatcattatgacaatcatgtcgtcgattattactacaaactaagaaagcagcctaatgagaaacctcataagactgccatcattgcttgtataaatcgattattaaaaacaattcattatcttgtaatgaatcataaattgtacgattatcaaatgtcaccacattag

SEQ ID NO: 545 - DNA, 1725 bp, Staphylococcus epidermidis
ataattatgtctaaattaattaaagggattgctgcatcagatggtgtggcaatcgcaaaagcttacttaattgtagagccagacttatcctatgacagtaacgaaaaagttactgacatagaaagtgaagttgaaaagtttaatgacgctatcgaagcttcaaaaatcgaattaactaaaataagaaataatgccgaagctcaattaggtgctgataaagcagcgatttttgatgcacatttacttgttttagatgatccagaattaatacaacccattcaagacaaaattagaaatgacaaagtcaatgctgcaactggtttggatgaagtaacgacacaatttatttctatttttgagtcaatggataatgaatacatgaaagaacgtgcagctgatatcagagatgtttctaaacgtgtattggctcatattctaggtgtagatttacctaatcctagtttaatcaatgaaagtgctgtcattgtaggtaatgacctcacaccttcagatacagcacagttaaataaagaatttgttcaaggttttgtaactaatatcggtggtagaacaagccactctgcaattatgagtcgttcattagagattgcagctgttgtcggtactaaatctatcactgaagaagttaaacaaggtgatatgattattgtagatggtatgtccggagatgttatcatagatcctacagaagatgagttaattgcttatcaaaataaacgtgagcgtttctttgaagataagaaagaacttcaaaaattgcgcgatgctgatacagtaacagttgacggtgttcatgctgaactagctgctaatattggtactccagatgacttatcaggagttattgataacggtgcacaagggataggtttataccgtacagaattcttgtacatgggtagagatcaaatgcctactgaggaagaacaattcgaggcttataaaaaggtacttgaaactatggacggtaaacgtgtagttgtacgtactttagatattggcggagataaggagcttccatacttagatttgcctaaagaaatgaatccattcttaggttatcgtgcgatacgtttatgtttagcacagccggaaatctttagaccacaattacgtgcattactacgtgcttcagtctatgggaaattgaatattatgttcccaatggtagcaacaattaaagaattccgtgacgctaaatcaatgcttcttgaagagaaagaaaatcttcttcgcgaaggttacgaagtttcagatgatattgaattaggtattatggttgaaattccagctaccgcggcacttgctgatgtatttgctaaagaagtagatttctttagtataggaacgaatgacttaattcaatacacattagctgctgaccgtatgtctgaacgagtttcatacttatatcaaccatataatccttcaattttacgattagttaaacaagttattgaagcttctcataaagaaggtaaatggactggtatgtgtggtgaaatggctggagatcaaacagctgtgcctttattattaggtttaggtttagatgagttctcaatgagtgcgacttctatcctaaaagctagaagacaaatcaatggtttaagtaaaaatgaaatggctgaactcgctaatagagctgttgaatgctcaacgcaagaggaagtcgttgatttagttaaccaattagctaaataa

SEQ ID NO: 546 - DNA, 1053 bp, Staphylococcus epidermidis
atatatttgttctttattgattcatttccaccttactatgtaaagagcctgagacttaaaagtctcaggctctttttatttcgttatcgtaacaatcccataccatgttatgctttaattattatgaaatacggagatgatgatatgtctattcccattataattgatactgatcctggtatagatgatgctacagcaattagtatcgcactttcacaccctcaatttgacgttaaaatgatatcaactgtgaatggtaatgtaggtattgagaaaacgacagcaaatgcattaaagctaaaaaggttttttaatagttctgttcctgtacatagaggggcatcccaaccattgattaatgacatctttgaagctacatcaattcatggtgagtctggtatggatggttacgagtttccacaaataaatcaagatgatttaacatcaattcatgcagttgaagcaatgagaaatctattagtaaatactcaagaacctttaaccttgattgccataggtccactaacaaatatcgctattcttttaactagttatcccgaagttcaaccatttattaaggaaattgttttaatgggtggtagtaccggtagaggtaatgtaacgcctttagctgaatttaatatatattgtgatccagaagctgctcaaattgtatttaactctggattacctttgactatgattggtcttgatttggctcgtgaagcattgtttactcaccattttgtaaaagacttcaaagatacaaatgcaacttcaaacatgttatataatttatttcagcactataagagtgaagattttgaaataggatttaaattatacgatgtattcactatattatatttgttggatccagaagcctttaatgtcaaggaggcgtatactcaaatagaattaaatggcaactttacaaggggagccacagtggtagactttaatatggagcatcccaattgtacagttgttttaagtcctgttgaaagacagtatgaggatttattcttaaacgccctttcttattgtaaataa

SEQ ID NO: 547 - DNA, 705 bp, Staphylococcus epidermidis
gtgtcattgttatatgaaggtaaagctaaaagagtattcacgacaaatattgatggacaattacgagttgaatataaagatgaggtaacagcaggaaacggtgcaaaaaaagatactatgattggcaagggtaagttaaataatcaaattacttctattatatttgattatttaactcataatcatattgacaatcactttattaaacaactttcacaaacagaacaactcgtccaacaagttgatattatacctttagaagttgttgttagaaacattgccactggttcgatcacaaaacgtcttggttttaaaaaggggcatacatttgaagaacctctagtagaattcttctacaaaaaagatgaacttaatgatccgcttattactgatgaccatgtaaaattactcggcatagcgaacgatgaagaaataaaacaacttaaacaaatggcaaaagatattaatcaagtactgattcaattgatgaatgaaatgagtttgagacttgtagattttaaggttgaatttggtaaaaccaatggtggaaaaattttacttgcagatgaaatctctcctgacacttgtagaatatgggataaaaatacggatactaactttgataaagatgtatatagaaacaacactggctcgttgattgaaacttatcaaacatttttaaataaattggaggatcttaaataa

SEQ ID NO: 548 - DNA, 222 bp, Staphylococcus epidermidis
agccaattgtttttacgatatttctttttcacactgaacccaacaccaaatgttgcaatgagaagtataaatgttaaaatcatcaatggaacattagcaacacctaatgcgaaactaaataaagttaaaaaaatgacagccaatattgagaagatccagaaaatacctttagattttttttgttgcatcccataccccaccttttacttatcttttcaataa

SEQ ID NO: 549 - DNA, 234 bp, Staphylococcus epidermidis
gaggacaatacaacaatggcagtatttaaagtattttatcaacataataaagatgaagtcatcgttcgtgaaaatactcaaacaatttatgttgagggacaaactgaggaacaagtgagacgttatttgaaagaccgaaattttaatattgaatttattactaaattagagggcgcacacttagaatatgaaaaagaacattcaacacactttaatgtggagaacgccgaataa

SEQ ID NO: 550 - DNA, 258 bp, Staphylococcus epidermidis
acttcaaatacaaaaatggccaatacggtaaagattaatgttcccacgatagcttcaatctttctaaagccaaatttcatgatgaataataataaaaatacatcaaatacagtgattaatgcgcctacaattaatggtatgccgaagattaaatctaatgcgatagcgctgcctataacttctgcaatatcagtagcgataattgctaattctgcaataatccagaacataattgctacaggcttatttaaaaaatga

SEQ ID NO: 551 - DNA, 294 bp, Staphylococcus epidermidis
cggatgaatacaatcgtaaaacatacagtaggttttattgcttctatcgtactaacgcttttagcagtttttgtaactctatacactaatatgacattccatgctaaggtaactatcatctttggttttgctttcattcaagctgcccttcaattattaatgttcatgcatttaactgaaggtaaagatggacgtttacaatcgttcaaagttatctttgcaattatcattactttagtaactgttatcggaacatactgggtaatgcaaggtggacactcttctcacttataa

SEQ ID NO: 552 - DNA, 240 bp, Staphylococcus epidermidis
actaaattaacgaggtgccttatgtataaagattataacatgactcaacttactctaccaatggaaacttcagttcttatccccacaaatgatatttcacgacatgtaaatgatattgtagaaacaattctagagactgaattcagacatcatcgtgatgcaatatcataccatccaaaaataatgttaaaagtagttttatatgcctatacccaatctgtgttttcaggacgtagatag

SEQ ID NO: 553 - DNA, 1905 bp, Staphylococcus epidermidis
tataataaaacagttgcaattaaaagtgggagtatacacaagaaaggaatttataaaatgactaatttaagagaagatgttcgtaatatagcgattattgcgcatgtcgaccatggtaaaacaacattagtagaccagttgcttaaacaatcaggtatatttcgtgaaaacgaacatgtcgacgagcgtgcaatggactctaatgatttagaaagagaacgtggtattacgattcttgctaagaatacagcgatagattataaaggaacgcgtatcaatatattagacacacctggccacgccgattttggtggtgaagttgaacgtatcatgaaaatggttgacggtgtcgtactagtggttgacgcatatgaaggtacaatgcctcaaactcgttttgttcttaaaaaagctttagaacaaaacttaaaaccggttgtagttgtgaataaaattgataaaccagctgctagacctgagggagttgtagatgaagtattagacttattcattgaattggaagcgaatgatgagcaattagacttcccagttgtttatgcttcagctgtgaatggaacagcaagtttagactctgaaaagcaagacgaaaatatgcaatccctatacgagacgattattgactatgtaccggcaccagtagataattcagatgaaccattacaattccaaattgctttactagattataatgattatgtaggtcgtataggcgttggacgtgtgttcagaggtaaaatgcgtgtaggtgataatgtatcactaattaaattagatggtacagttaagaactttcgtgtgacgaaaatatttggttactttggtcttaaacgtgaagaaattgaagaagcacaagcaggagacttaatagctgtttcaggtatggaagatattaacgttggtgaaacagttacaccacatgatcatcgtgacccattaccggtgttacgtattgatgaaccaaccctagaaatgacttttaaagtaaataactctccgtttgctggacgtgaaggtgattatgtaacagctcgacaaattcaagaaagattagatcaacaacttgaaacagatgtttctttaaaagttacacctactgatcaaccagattcatgggttgttgctggtcgtggtgaactacacttgtctattcttattgaaaacatgagacgtgaaggctttgaattacaggtttctaaacctcaagttattttaagagaaatcgatggtgtgttaagtgaaccatttgagcgtgtacaatgtgaagtgccttctgaaaatgccggggcagtgattgagtcattaggtgcacgaaaaggtgaaatgttagatatgatgacgacagacaatggtttgacgcgtttaatctttatggtacctgcacgcggtatgattggttatactactgaatttatgtctatgacacgaggttatggaattattaaccatacatttgaagaatttagacctcgcgttaaagctcaaatcggtggtagacgtaacggtgcattgatttctatggaccaaggtcaagcaacatcttatgcgattattaacttagaagatcgtggtgttaactttatggaaccaggtactgaagtatatgaaggtatgattgttggtgaacataaccgtgagaacgatttaacagtaaatattactaaagcaaagcatcaaacaaacgtacgttcagctactaaagatcaaacacaaacgatgaatcgtcctagaattttaacattagaagaagcgttacaatttatcaatgatgatgaattggtggaagtaactcctgaaagtattcgcttaagaaagaaaatacttaataaatctgcccgtgaaaaagaagcaaaaagagttaaacaattaatgcaagacgaacaataa

SEQ ID NO: 554 - DNA, 264 bp, Staphylococcus epidermidis
ataatgaaaacgattgaactacatatcactttacaaccacaagttttagatacacaaggacaagctttaaaccgagcagttcacgatctcggttatgaacaagtgaatgacattcgagtaggtaaagttttatatatgacagttaatgaaccaactgacgaggctgttgataatattattacgacactaagtgaaaagttatttgctaatacagtcattgaagaatatagctataaagttatcgatgaaaaggagaaagcataa

SEQ ID NO: 555 - DNA, 243 bp, Staphylococcus epidermidis
attatttatttaatacgatttgagattatatcttttatctttgaatttcttacaaaaaggagtttagagctaaaagttcttaaactagtaaaaagagacaatttctatattatttcatatagaaattgtctcttttataattttcaaactataataagcttgttgatatactatcttacttatataagttcctttaatacaaatcatattccttctataactagccaattgtttttggtttag

SEQ ID NO: 556 - DNA, 198 bp, Staphylococcus epidermidis
aaattattttatatgactatgcatcacttaaaagaacattcaatcaataaactaaaacaatatatcctactattaacctacctaaaatcagacacatcttatagacatattattcaacttaattctttctatataagatcatatttttctataagtaatattctttttttgtatctaattgataagatttatcaataa

SEQ ID NO: 557 - DNA, 747 bp, Staphylococcus epidermidis
gtgaaaagttatttgctaatacagtcattgaagaatatagctataaagttatcgatgaaaaggagaaagcataatatgaaatttgcagttcttgtgttccctggttcaaactgcgatagagacatgtataacgcagctattaaatcaggtgttgatgcagcgtatgtcgattatcgtgaaacgactttagatggttttgatggtgttttaatacctggtggtttttcatttggcgattatttgagatcgggagctatggcaagtgttgctccgattattaaagaagttaagcgatttgcgaaagaaggtaagcctgttttaggagtatgtaatgggtttcaaattttaactgagattggattgttaccaggcgcattacttcataatgattcacatttatttataagtagaaacgaaactttaaaaattactaataatcaaacaccttttacgcatttatatgtgaaaaatgagaatgttgtttatcctgtagcacacggtgaaggtcattattattgtactgatgaaatatatcgtgaactcaacgataacaatcaaattatccttaaatatacgaataaccctaatggctcttatgaggatattgcaggaatagttaataaagagggaaacgtttgtgggatgatgccacaccctgaacgcgcacttgaaacattattaggaacaaatagtggtgtgaaattgtttgaatcaatggtgaaaagttggagggaacaaaatgtctaa

SEQ ID NO: 558 - DNA, 1827 bp, Staphylococcus epidermidis
aagcgatatcatatagattttcaaactttatctaattggagtgatgtttctatgtattatacaaatagtaattatgaagcgtttgctcggcctaaaaaacctgaaaatgttgataataaatcagcctatttgataggggctggattagcttctttagctgcagcatgttttttaattagagatggacaaatgaaaggcgagaatatccatattttagaagagttagatatctcaggaggaagtttagatggcatcaatatggagcatcatggctatgtagtacgtggtggcagagaaatggaaaatcattttgaatgcttatgggatttattcagaagtataccatcacttgagcaaactaatgcttctgtgttagacgagttttattggttaaataaagaagaccctaattattctaaatgtagagcgattgaaagtggaggtaagcgtattgatactgatggtgattttacattaacaaaaaaagcaattaaagaaattttaaatttatgtttgatgaaagaagaagatttagacgatgttaaaatcactgatgtcttttcaagagactttttaaattctaatttttggctttattggaaaacaatgtttgcattcgagccatggcattcagcgatggagatgcgtagatatcttatgcgttttgtgcatcatattggtggtttagcagattttagtgcattaaaatttactaagtataatcaatatgaatctttagtattaccgatgatagaatatctaaaatcacatagcgtgaactttgaatttggagtacaagtgaataatattttagttgatgcaacaccatctactaaaattgctagagaaatcattttaactagagatgataaagaagaatctatcccgttgacagttaatgacttggtatttgttactaatggaagtattaccgaaagttcaacctatggtgataatgaccatcctgctcctataacacattctttaggtggtagttggacattatggaaaaacttagctaatcaaagtcctgaattcggaagacctgagaaattctgtgatcacattccagctaaaagttggttcgtatcagcaacggcaacaacagataataaaaaaataatctcatatatcgaacaattatgtaaaagagatgttttatcaggtcggacagtcacaggcggtatcatttctgtcgctaattcgagttggcaacttagttttacagtgaaccgtcagcaacaatttaagaaacaacctaaaaatcaagttagtgtatggatttacgcattatactctgacgaaaaaggagacttcattaaaaaaccaatcacggaatgtactggtagtgaaatctgtcaagaagtgttatatcatatgggtgttccacaagaggaaattgttgaattagctcaatcagaatgtaacacgattcctgtttatatgccatatgtaactgcatatttcatgcctagagcatacaaagatcgaccgttagtagtaccgaatggctctaaaaatttagcatttattggaaactttgcagaaacagcacgggatactgtattcactacagaatattcagttagaacagctatggaagctgtttatcaattattggatgttgatagaggtgtacctgaagtttatgcctctgaatttgatgcacgcgtactgatggatgcattttatgaattaaatgatcgtaaatctttacatgaacttgttaataaaaactttattaaaagatcagtattaaatacagtgctgaagaaaatacgtggtactttcattgaagaattgttacgtaaacataaattactatag

SEQ ID NO: 559 - DNA, 609 bp, Staphylococcus epidermidis
gtcatgagtcatgatgcaaatactattgattctcgtacacacgaaggcgaattaaataaacttggcttttggattttccttacagctgaatttgcgttattcggtaccctatttgcaacgttattaacgttacaacatggtggcggatatggcggtaaattaactaccgacttattcgaattacatttgattttaataatgacttttgcattattaattagttcttatacttgtggtattgcaatttattacatgcgacaagaaaaacaaaacttaatgatgttttggatgattatcacagttatcctaggtcttgtattcgtaggtttcgaaatttacgaattcgcacactatgcttctgaaggtgttaacccaactattggctccttctggtctagtttctttatactactaggtacgcacggtgcacacgtatcattaggtattgtttgggttatttgtttgttaattcaaatcggcactcgtggtttggattcatacaatgctcctaaattatttatagtaagtttatactggcacttcttagatgttgtttgggtcttcatctttactgccgtatatatgatagggatggtgtatagcggatga

SEQ ID NO: 560 - DNA, 894 bp, Staphylococcus epidermidis
cacatgatccagaaattattaaacgatatccaacaagacgattacgcgtggaagatggatgtcttaaagaaatggaaggtgaacacattgtttgaaagatggaaaaaacgccacaccttcgttgatgatgtaaatattattactaagttacttttaggtatcgcattattctttttcattatatttatccataacttcgactttatgatttatatcgtcatattaatgtttatgttcttacttttatttaacggtacagaatttaaaataactgcaatatttattttagttacaaccctctttgccttgatgtcatcattatttatgattttatatggtgatggagaacatatgcttgtaaaatttggtattttgcaaataagtacagaaagtattgtacgaggtcttcatctatctatgagaacaattaccgtttcaatttttggtatactaatcgcattgacttcacaaattgtaatgattttttatagtttaatgcaacatttaaaggtaaagccaaagtttgcttatgcttttatggcagcgattagaatggttccacttataataagttctcttattcaattaagacgttccctaaaaatgcgttatcaaatgatagatgcatctaactataaaggaatcaagcgtcttaaccatttagtcatacctttattaagtcaaaatattcgacgtgcacatcaactttcagttgcaatggagtctaaaggttttaaagatggtccgagaacatactactatcgggtaccattttcatataaagatatcgtatttattgcttgtatattaattatcattactttgtcatttgtcttatcatcataccttccaattactggtattcatgatgtccgttttggacaattagactaa

SEQ ID NO: 561 - DNA, 633 bp, Staphylococcus epidermidis
cttctgacgcacaactttcctagagaaggttgtgcgttttttaggaggatgttttttatgtcaaaaggtttgaaactatctgaaattcttgtgacagttttaatttcagtagtatttgccatcatttataacttatggtggtttgtttacaatattgtacaagttgcgggtattcacttagaacaacttacatatggtgtatggtttatggcagcagtcgtttgttacttaatcattcctaagccaggtatagcattattagcagaaatcgcagctggagctggtgaaacgattgttatgggaaaatttgatatacctactatcatatatgcgatattacagggattggcttgtgaaattatatttgctatttttaaatacaaatcacgttctgctgctgtagcaatgcttgctgggttagcaactgctttaatctctttcccagtggattacttctatggttacttaaacgaagttgctggatggaacttactactatttatagttttccgttcaattagcggaattgtattagctggtttagtttcatactggattgtcaaagcattagataaaaccggtgtaactaaattctttagaccagcatcacaacaagattacgataacctataa

SEQ ID NO: 562 - DNA, 1224 bp, Staphylococcus epidermidis
agtgtgaggcaaacaataaagatgaaattaaataaatttaaaatcgtattttttattatcgtattattaactttagtcgtgtcaataggtatattaggtgttgaatggacaagacacctagaattaaaaaaacaaacgttaagtcaagaaagtggaaatacgaattatatagaaaagagagataagactgttgagaaacctaaaaaaataaagactaaatatgataaaaaagatcctacttccaaatcgataaacaaatatttagaaaaaactcaatttaatggaactgtagctgtatttgataatggaaaagttaaaatgaataaaggatatggttatcaagatatagagaaaggcaaaaagaacactgcaaatacaatgtatttaataggatcagcgcaaaaatttacaacaggtttaatgctgaagcaacttgaagtcgaaaataaagtgaatttgcaagattcagtcactaaatatattccttggtttaaaacaaataaagaaattacaattaaagatttaatgttacataaaagtggactatataaatatgaagcttcaactaatatcaaaaatttagaacaggctgttagagcaattcaagctcgaggtattgatgatacagtttatcataagcatcaatataatgatgctaattatttagttttagctaaagttattgaaaatgttactggaaaaccatatgttaaaaattattatgaacgattaggtaataaatataatctcaaacatactgctttttatgacgagaaacctcttcaaagtgagatggcaaaaggctataagtttaaaaataatactttttcattccttaaacctaatatattagatcaatattatggagctggtaatttatatatgacgccacatgatatgggcaaattaatttatacgttacaacaaaataaaatctttaatgcacgtcaaactcgacctattttacatgaatttggaactcaagaatatccagaagaatatagatatggtttttacataactccgtatttaaatagagtcaacggggtattctttggtcaaatttttactgtttactttaatgatcggtatattgtcattttagggacgaatgtaagtaatacacctggattagtgagtaatgaagacaaaatgagacacattttctataatattcttgaccagaaaaagccttataatacagcaggtgttaaagttgagtaa

SEQ ID NO: 563 - DNA, 669 bp, Staphylococcus epidermidis
ataaactttaaaagtttatgctacaatatccataatcatattaaaaggaggcatattatgacccaatatactttttcacctaaggattttaaagcttttgaagtcgaaggtttagaccaaagaatggaagcacttaatgactatgtcagacctcaacttcatcaattaggatcttattttgaagaatatttcactacacaaacaggtgaaactttttatgctcacgtagctaaacacgcacgtagaagtgtcaatccacctatcgatacatgggtagcttttgctcctaataaacgtggttataaaatgttaccacactttcaaatcggattgtttagaaatcagcttttcattatgttcggtatcatgcacgaaggtagaaataaagaagaaaaagtgaaaatatttgataaacattttgataaactgacatctttaccaagtgattatagtgtttctctagatcatatgaaaactgaaaagcactatatcaaggatatgagtaatgaagagttgcatgctgctatcgatagagttaaaaatgttaaaaaaggtgaattttttgttgccagaacattatcaccaaccgataaaagattaaaatctgataagtcttttctaaaatttgttgaggaaacttttgatgaatttttaaaattttatcaataa

SEQ ID NO: 564 - DNA, 873 bp, Staphylococcus epidermidis
gagtggtttaaggtggttgctaaaattttagatggtaaacaaatagcaaaagaatatagacaaagacttaaaaatcaagtcaatgacttaaaagaatatggttttactccaaaattatcagtcatattagttggtaatgatggtgcaagccaaagttatgtaaaatcaaagaaaaaagcagcagaaaaaattggaatgatatcagaaattattcacttagacgaatccacatcagaagaagtagttttaagcgaacttaatcgattaaacaatgacgatactgttagtggtattttagttcaagtaccattacctaaacaggtaagcgaacaaaaagtacttgaagctatcaatccggaaaaagatgtagatggtttccatccaattaatattggaaaattgtatattgatgagcaaacctttgtaccatgtacacccctgggtattatggaaattttaaaacacgcagatattaatttagaaggaaaaaatgcagttgttattggtcgtagtcatattgttggccaacctgtttcaaagttattgttgcaagctaacgcaactgttacgattttacattcacgtacaaaaaatatgaatgcacacttaaaacaagcagatgtgattgttagcgcagtaggacaacctggtttagttactaaagaaaatgtcaaaaaaggcgcagtaattatagatgttggtaatacacctgatgaaaatggaaaattaaaaggagatgtagcatatgatgaagtaaaagaaatagctagtgcaattactccagtaccaggtggtgttggtcctttaactattacaatggtacttaataatacacttcttgcagagaaattaagacgtggcttaacaaaataa

SEQ ID NO: 565 - DNA, 276 bp, Staphylococcus epidermidis
gttgtacttaaatcattattggctaaaatttgttgtacgagttcattattattaagtgtgttttctaaattggcaattgacgtatcattactaaaagatacgagcgcaataaacattgaaacaatagttaatatgagtaagaatacccaactaaaccaacctaatattttttcagttagccgatttgctggacgcttaatttgtgtatattgctctcctaacattcgttacaactccttaacttacttatcacattattatattaaaaaattctaa

SEQ ID NO: 566 - DNA, 1113 bp, Staphylococcus epidermidis
atggctcctaagttacaagcccaattcgatgcagttaaagttttaaatgagactcaatcgaaatttgaaatggttcaaattttggatgaagacggaaatgtcgttaatgaagacttagtacctgatttaacagacgaacaattagtggaattaatggaaagaatggtatggactagaattcttgatcaacgttctatttcgttaaatagacaaggacgtttaggtttctatgcaccaacagcaggacaagaagcttcacaattagcatctcagtatgctttagaaagtgaagacttcattttacctggttatcgtgatgtgcctcagattatttggcatggcttacctcttacagacgcattcttattctcaagaggacacttcaaaggtaaccaattccctgagggagttaatgcacttagccctcaaattattatcggtgcacaatatattcaaactgccggtgtagcgtttggacttaaaaaacgtggcaaaaatgcagtcgcaattacttatacaggtgatggtggttcatcacaaggtgacttctatgaaggaattaactttgcatctgcatacaaagcacctgcaatttttgtaattcaaaacaataactatgccatctctacaccacgtagtaaacaaacagctgcagaaacattagcacaaaaggctatttcagttggtatccctggaattcaagttgatggtatggatgctttagctgtttatcaagcaacattagaagcacgtgaacgtgcagtagcaggagaaggtcctactgttatcgaaactttaacttatcgttatggaccacatactatggctggtgatgatcctactcgttatagaacttcagatgaagatgctgaatgggagaaaaaagacccattagtacgtttcagaaaatatttagaagctaaaggtctttggaatgaagacaaagaaaatgaagtggttgaacgtgcaaaatctgaaataaaagcagctattaaagaggctgacaatacagaaaaacaaactgttacttctctaatggatatcatgtatgaagaaatgcctcaaaatttagcagaacaatatgaaatttacaaagagaaggagtcgaagtaa

SEQ ID NO: 567 - DNA, 1551 bp, Staphylococcus epidermidis
ttcagacgtaaaaataaaagaaaacgtttcagatatcaaacaaaaatgggaaggggctatagttcaatgtctaactactcaggattaaatgaagaatgtggcgttttcggtatttggaatcatcctgaagcagcacagttaacatatatgggtctacatagtttacaacacagaggtcaagaaggtgcaggtattgtagtttcaaatcacgaaacgctaaaaggtgaacgaggattaggcctattaactgaagcaattaaagacgaacatatgtcaaatataaaaggttatccacatgcgataggacatgttcgttacgcaacctctggtaataaaggcattgaaaatattcaaccatttttatatcacttttatgatatgagcgtaggtatatgtcataacggtaatttaattaacgctaaatcattacgtcaaaatttagaagaacaaggtgcgattttccattcttcttcggatactgaagtcattatgcacttaattcgtcgtagtaaggcgccgacatttgaagaggcattgaaagagagtttacgactcattaagggtggatttacttttgccatcctaacaaaagatgcgttgtatggtgcagtagatcctaatgctattcgaccattagtagttggaaaaatggagaacggtgcttatattttagcaagtgaaacatgtgcgattgatgttttaggtgctgaatttatacaagatattcatgcaggtgagtatgttgttattacggatgaaggtatagaagttaagacttacacacgacaaacaacaactgcaatttcagctatggaatatatttattttgcgagacctgattcaacgattgcaggaaaaaatgttcatgcggtacgaaaggcatcaggtaaacggttagcacaggaaaacccagcaaaagcagatatggtaataggcgtacctaattcatcattatctgcagcaagtggttatgctgaagaaataggcctaccatatgaaatgggactagttaaaaatcaatatgttgctcgaacttttatacaacctactcaggaattaagagagcaaggtgtacgtgtgaaactgtcggctgttaaggatattgttgatggtaaagatatcgtacttgtagatgattcgattgttcgaggtacaacgattaaacgcatagttaaaatgcttaaggattcaggagctaaccgcattcacgtaagaattgcttctcccgaattcatgttcccttgtttttatggtattgacgtatctacaacagctgaactcatctcagcaagtaagtctcctgaggaaattaaaaatcatattggtgcagattctcttgcttatttaagcgttgatggcttaatcgagtctataggacttgattatgatgcgccatatcatggcttgtgtgtagaaagttttacaggtgattatccagcaggactttacgattatgagaaaaattataaaaagcatttaagtgaacgtcaaaaatcatatatagctaataataaacattattttgatagtgagggaaatttacatgtctaa

SEQ ID NO: 568 - DNA, 1422 bp, Staphylococcus epidermidis
tggaggggtaaaaacatggtagttggagatttcccaattgaaacagatactattgtaataggagcaggtccaggtggatatgtcgcagccattcgcgcggctcaattaggacaaaaggtaacaatcgttgagaaaggtaatttaggtggtgtatgcttaaacgttggttgtataccttcaaaagcattactacatgcttctcatcgctttgttgaagcgcaaaattcagaaaacttaggggtaattgctgaaagcgtttcgttaaactatcaaaaagttcaagaattcaagacttctgtagttaataaattaactggcggtgttgaaggacttttaaaaggtaacaaagtagagattgttagaggtgaagcttatttcgttgataacaatagtttacgtgtcatggacgaaaagagtgctcaaacttacaatttcaaacatgcgattatagctacaggttcaagaccaattgaaattccaaattttgaatttggtaaacgtgttatcgattcaacaggagctttaaatctacaagaagtacctaacaaactagttgtagttggtggcggatatatcggttctgaattaggtactgcttttgcaaactttggctctgaagttactatccttgaaggtgcaaaagatattttaggcggatttgaaaagcaaatgacacaacctgttaaaaaaggtatgaaagaaaaaggtatcgaaatcgttactgaagcaatggcaaaatctgcagaagaaactgaaaatggtgtcaaagtaacttatgaggcaaaaggtgaggaacaaactatcgaagctgattatgtattagttacagttggccgtcgccctaatactgatgaattaggattagaagaacttggtctgaaatttgctgatcgtggattactagaagtggacaaacaaagtcgtacttctattgaaaatatctttgcgattggagatattgtacctggattaccattagctcacaaagctagttatgaaggtaaagttgctgctgaagcgatagatggtcaagccgcagaggtagactatattggtatgccagcagtttgctttacagaaccagaattagcacaagttggttatactgaagctcaagcaaaagaagaaggtttatcaattaaagcttctaaattcccttatgcagctaatggacgagctttatcattagatgatacaaatggttttgttaagttaattacacttaaagaagatgatacgcttattggagcacaagttgtaggtactggcgcatctgatattatctctgaattaggtttagctattgagtcaggtatgaatgctgaagatatcgcattaactgtacatgcacacccaactttaggtgaaatgacaatggaagctgctgaaaaagcaattggttatccaattcatactatgtaa

SEQ ID NO: 569 - DNA, 210 bp, Staphylococcus epidermidis
tcaatattcaattcatcatatttcatcggaagttcaattaaattaggtactattccacttaatacattaagtaatgtgcttttacctgatccggaaggaccgagtaaaagcactttttctttatttttaatctcaagatttaagttattgaatattttcctatcaccattcggatactttaaacgtaaatttttaacacgtaacaattaa

SEQ ID NO: 570 - DNA, 321 bp, Staphylococcus epidermidis
gttatgaacaaattactacagtcattatcagcacttggagtttcagctacattagtgacacccaatttaaatgcagaagccactactaatactgaacctcaattaaaaggtgttaacgatatcgttattgaaaaaggacaagaatataatttacttaaaggcataagtgcttacgataaagaagacggcgatcttactcataaaatcaaaattgatggtcaagttgatacatccaaagcaggtaagtataaagtaaaatatcaagttaccgattctgatggtgctgaaaaaacttctataagaaatattgaagtaaaatga

SEQ ID NO: 571 - DNA, 1071 bp, Staphylococcus epidermidis
ctaataataaacattattttgatagtgagggaaatttacatgtctaaagcatatgaggaatctggtgtaaatattcaagcaggatatgaagcagtcgaaagaataacaagtcatgttgaacgtacattgcgcaaagaagtattaggtggtttaggtggatttggtgcaacatttgatttgtctcaattaaaaatgaaagcgccagttctggtatcaggtactgacggtgtgggtacaaagttaaaattagcaattgactatggaaagcatgacacaattggtattgatgctgtcgcaatgtgtgtaaatgatattttaacaacaggtgctgaacctttatactttttagactatattgccacgaataaagtagtgccaagtactatagagcaaatcgttaaaggtataagtgacggttgcgaacaaaccaatacggcacttataggcggtgaaactgctgaaatgggagaaatgtatcatgaaggtgaatatgatattgctggttttgcagtaggagcggtagagaaagaggactatattgatggttcaaatgttgaagaaggacaagcaattattggtttagcttcaagtggtattcattcaaatggctatagtctagttagaaaaatgataaaagaatcaggagttcaattacatgatcaatttaatggtcaaacctttttagaaaccttccttgcaccaacaaaattgtatgtaaagcctattcttgaattaaagaaacatattgatatcaaagcgatgagccatattactggtggaggtttctatgaaaatattccgcgtgcccttcctaaaggtttatcagcaaaaatagatacacaatcattcccaacgttggaagtctttaattggcttcaaaaacagggcaacatttcaacgaatgaaatgtataacatatttaatatgggtattggatatacaattattgttgacaaaaaagatgttcaaacaacattaacaacgttacgtgcaatggatacaactgcatatgaaattggtgagattataaaagatgatgatacacctattcatttattggaggtagaatag

SEQ ID NO: 572 - DNA, 957 bp, Staphylococcus epidermidis
agaaatccaaataaaaatagcaaaacgactaagacagagcaatttaaacaggtgaataaggatgctgagaaccctaaacctaaagaaaggatagggacttggattggaaaagatattaaaacactaacgcatcattatggacaagctgatcggtcttatccatataaaaatgggttaaaaaattatgtctttaaacagaaagatgaatattatattgtaagtactaataaaggaacaatcacatcagtttatgccacaggtaaaggtgtgaaagtgagcccacttaaaataggtgaaagttcatctcatatttttgaagatactagtattaatccagaaccaactgtcaaaacgaaaggtaaaacttataaatttgaaatgtctgatgaagacttaaagacacagacgttaattaaatatggagatgtttatgctcaaatatattctgatcaacaaactaataaaattttggcagtgagatttttagatgcaaatacattggcaacactacaaccatataagttaaatagagcagaagatgagggacaaattagtgaaagttccgacgataaaattccacatgaacaaaaccctaatcaattgattacactctatgaagtaacgaataaaatgagagaaatgaaaaatttaaattcacttaaagttaacaacgatattgctcgtattgctgctatcaatctgtatgaagcaacggataaaggatcaaacagtgtggagtttactgagaatgctttaacacaacaactggatgaacgccatgtaagttataagtcagcaagtcaaaatgtaggttatgattttgacgatgtacctacacttattcatagttggattaattctgatattcatcgctcacgcttgttaagtaataaatatgatgaaatgggtggagaagtgatgagtgattattattcattaatatttgtagaaaagtaa

SEQ ID NO: 573 - DNA, 1227 bp, Staphylococcus epidermidis
tatatgaaaaattttaaaaatataatgcgatatattggaaagacttctaaatttatcgattatccattgttaataacttatgttgtcctctgtttgattggattagtaatggtttatagcgcaagcatggttgcagctacaaaaggtacgttaaccgggggagtaccagtttccggaacatacttctacaatcgacaacttttatacgttatcatgagctttgttatcgtattttttatggcttttattatgaatgttaaagtattaaaaaagcctaatgttcaaaaaggtatgatgattggtatttttatacttttactactaacattagtaataggaaaaaatatcaatggttctaaaagttggattaacttagggttcatgaacttacaagcttcggagttattgaagatttcaataattctatacataccatttatgattgaaaagaagatgcctgcggtgaggcataatataaaattaatattaggaccaattttgtttgttgtaacttgtctgatacttgttctttttcaaaaagatgttggtcaaacaatgctgattgtgatcatattcttctcaattattttttactcaggtatcggtgtgcagaatatgttaaaatggggcgctttggtagctattggttttatcatcgtagctacatttatgttcatgttagatatggttccaagttatttgcaagcacgttttagtacgttaaccaatccatttagtcaagaatcaggcacaggatatcatatttctaattctcttttggcaattggcaatggtgggttgttcggacgtggtctaggaaatagtattatgaagcttggttatttgccagagccacatacagactttatatttgctattatttgtgaagagatgggattaatcggtggcttaatcgttttaattttagagtactttattgtatatcgcgctttccaacttgctaataaaacgcaatcgtatttttataaattagtttgcgttgggatagctagttatatcggaagccaaacattcgtaaatatcggtggtatttctgctacaattccacttactggtgtaccgttaccatttattagttttggtggttcatcgatgattagtttaagtatagctatgggattactacttattacagcaaaacagataaaacaagatgataaacgactgaaacaacgtaaggtagatattaaacgtcgatataattaa

SEQ ID NO: 574 - DNA, 552 bp, Staphylococcus epidermidis
gtggttagaaagatggatattggatacaaattacgtaatttaagaagaataaaaaatttgacacaagaggaattagcagagcgaactgatttatcaaaaggatatatatcacaaattgaaagtaatcatgcttcacctagtatggaaacatttttaaatttaatagaagtacttggtacttctgcaagtgacttttttaaagaaccgtcagatgagaaggtactttataagaagaaggaacagaccatttatgatgagtatgataaaggttatatcttgaactggcttgtagcgaattctaatgaatttgacatggaaccattaatcctaactttacgaccaaatgcctcatataaaaactttaaaccatctgaatcagatacttttatctattgtttaaatggtgaagtatcacttcaattaggaaatcaagtatataaagcttgtaaagaagatgtactttattttaaagcgaaagataaacatcgcttatataacgaaacagataaagaagtgaaggttttaatcgttgccacagcttcatatttatag

SEQ ID NO: 575 - DNA, 537 bp, Staphylococcus epidermidis
ttgaatagaaaagtagaaaaaagattagcgtggattgcaaatatcttgagcctattatttttaatttttggtattctatcgatatttgttattaataacacatcaaatcaacaacaatataatgaattaatgaagcagttttcaggtaataatcaagatatgtcatctgaaatgtttttagtttctcttattgcgtcattagtcattttaggtttttcaacgctattaggttttgttggtacaatggtaattgaaggtataaaaaaccttgctgctactttactcatagcagcggctatcgtaggtttatttacgactaatttaatcgcaatggttttatggatgattgctgcgattagactttttgcaaaaaaagataaaacagatgtaaatgaaaatgctacggctcaacttcgtcaaaaccattcaaagagccaaagtgattggaatcatcaacaaaaccaacaacataaagatgcttgggatcctgaacaagaaatcaacaaacaaaaaaaggacgatccatatatatattaa

SEQ ID NO: 576 - DNA, 423 bp, Staphylococcus epidermidis
tataatttgaagataaaggagtttgatttatttatgaaacaatcatttattaaaattggtgaaggtttaaccgatttattcgaatttacaactcttatagaatataatcataagcgaatcaatcgtattgtgtatttccatacacctcattctgagaaacaattatcgtccgttgcaataataatgaaccctactgctgaaaaacatttccaggctatgtatatcatgacaaatgccttaaaatatccctatccagagggcaacaaaaaattcaatatgattaattcagctgcagaaaattatgacataccagttgtaggtatcgacgtacaacctcctgatgtatatccagacttagaattatattttaactaccttatcagtgttttgcgtcttcaaagatggataccacctttgcaataa

SEQ ID NO: 577 - DNA, 228 bp, Staphylococcus epidermidis
agccatatgaaatggtcaataacacaattgagaaaatatcaaggtaagccatttgaatttaatcaaacggttaattttgagcatttaagagaatcattagatttaattgatctttcagatatcaatgttgaaggacagttgacagtcaaatcaaatgaagtgattgcagacatgcatgttactggaacttacacgatgccttgtgctgtcttcaccacgcgcggatgg

SEQ ID NO: 578 - DNA, 633 bp, Staphylococcus epidermidis
cagttcatgaattttaaaaagactgtagcaattgtcctaacgtcagcagtgttattagctggatgtactatagataaaaaagaaattaaaaaatatgatgatcaagtacaaaaagctatggaccaagagaaaaccgttaatcaagtaagtaaaaaaataaacgaattagaagagaaaaagcaaaaattatttaaaaaggtaaatgataaagatcaaagcacacgtaaaaaagcagctgaagatatagttgaaaatgtaaaacaaagacaaaaagaatttgaaaaagaagagaaggctctagataattctgaaaaagaatttaaacaagccaagcaatatcttgaacatgtagaaaacaaagcaaagaaaaaagaagttgaacaacttgatagtgctattaaagaaaaatataaatcacatgatgcttatgcaaaggcttacaaaaaagcacttaataaggaaaaagaactgttttcttatttgaatgaagataatgcaacacaatcggaagtagacggaaaatcgaaagatctttctaaagcatataaagaaatgaataataaatttaatgcttactcaaaagccattgagaaagtaaaaagagaaaaacaagatgtagaccaattaaaataa

SEQ ID NO: 579 - DNA, 477 bp, Staphylococcus epidermidis
gtaaggatgaaacttatgaacgtacccattttaccaacgataagtacatcgtgtattgttattagtgcgattttagtcgctattggttgggcattgatttggaaacgtcaagttcataagcataaaaacattatgctatgggctgcctttttcgctttaacattctttattatttatgcagcaagaactatttttatcggtaatacagctttcggtggaccaagttctattaaagtttattacactattttcttagttttccatatcattcttgcaacagttggtggcgttttaggcttaattcaaatcattttagccttcaaagataaacttcatattcacagaaaaattgggccttgggcttcaataatttggttctttaccgcaattactggtgttgcagtttatgtattgttatatgtattgtatccaggtggagaaacaacatcattgcttaaagctacattaggtctataa

SEQ ID NO: 580 - DNA, 672 bp, Staphylococcus epidermidis
tggaggacgaatatggataaagagtatgtcgtaattggactagggcgttttggtggtagtattgttagagaacttaacgcattagacatggatgttatggctattgatagagacgaaaatcgtgttaacgaatatagtgatatagcaacacatgcagttgttgctgatacaactgatgaggcagtaatgaagagtttaggaatacgtaatttcgatcatgttattgtcgctattggtgagaatatacaatctagtacactaacgacgttaattcttaaagaattaggtgttaaaaaggttactgctaaagcccaaaatgattatcatgctaagattttaaataaaataggtgccgatactgttgtgcaccctgaaagagatatgggaagacgtattgctcataatgttgctagtgctagtgtccttgactacttggaacttgctgatgagcattcaatcgttgaattaaaatctacagaaaaaatggcaggacaaacaattattgaattagatattcgagctcaatatggtattaacattatagcaattaaaagagctaaagaatttatagtctctccagaccctaacatcaatattgaaataggggacattttaattatgattggtcatgataatgacttaggtcgctttgaaaaaaatataagcaagtaa

SEQ ID NO: 581 - DNA, 1314 bp, Staphylococcus epidermidis
gaggacaagaacgtggcatttgaatttagattacccgatatcggggaaggtatccacgaaggtgaaattgttaaatggtttattaaagccggcgatacaattgaagaagatgatgtattagcagaagttcaaaatgataaatctgtagtagaaattccttctccagtaagtggtactgttgaagaagtgttagtagatgaaggaacagtggcagtagtaggagatgtcatcgttaaaattgatgcacctgatgcagaagaaatgcaatttaaaggtcatggcgatgatgaggattctaagaaagaagaaaaagaacaagaatcaccagtgcaagaagaagcttcatcaactcaatcacaagaaaagacagaagtagatgaaagtaaaactgttaaagcgatgccgtcagtgcgtaagtatgcacgtgaaaatggtgtcaatattaaagctgtaaatggttctggtaaaaatggacgaatcacaaaagaagacatcgatgcatacttaaatggtggtagttccgaagaaggttcaaacactagcgcagcatctgaatcaacttctagtgatgtcgttaatgcttctgcaacacaagcattaccagaaggcgacttccctgaaactacagaaaaaatacctgcaatgcgcaaagcaattgctaaagcaatggttaattctaaacacactgcacctcatgttacattaatggatgaaattgatgtgcaagaattatgggatcaccgtaagaaatttaaagaaattgctgctgaacaaggtacaaaacttactttcttaccatatgttgttaaagcattagtttctgcacttaaaaaatatccagcacttaatacttctttcaatgaagaagctggagaggttgtacacaaacattactggaatattggtattgctgcagatacggataaaggattattagtaccagtagttaaacatgccgatcgtaaatcaatattcgaaatttctgatgaaattaatgaactagctgtaaaagcacgtgatggtaaattaacttcagaagaaatgaaaggtgcaacatgcacaattagtaatatcggttccgctggtggacaatggttcactccagttatcaatcacccagaagtagctatcttaggaattggccgtatcgctcaaaaacctatcgttaaagatggagaaattgtagctgcaccagtgttagctttatcattaagctttgaccatagacaaatcgatggtgctactggacaaaatgctatgaatcacattaaacgcttattaaataatccagaattattattaatggaggggtaa

SEQ ID NO: 582 - DNA, 564 bp, Staphylococcus epidermidis
atgaaatggaagtgtgagtcaatgcgtgtaattgcgggtaagcataaaagtaaagcgctagaaagtttagaggggcgaaatactcgtccaactatggataaagttaaagaaggtatttttaatagtttatatgatgtttctggtttaggattagacttatttgccggtagtggtgcacttggcattgaagcattatcccgtggtatggataaaatgatttttgtagatcaaaattttaaagcggtcaaggttataaaagctaatcttaatcaattagatttaatgtcacaagctgaagtctataaaaataatgctgacagagcacttaaagcacttgctaaacgagaaatacaattcgatgttatctttttagacccaccttataataaagggcttataaatgaggcgatttctcgtatagcagagtttaacttattaaaagaaaatggtattatcgtttgtgagtttagtcataatgaaaaaataacaattgcgccatttcaaatgattaagcgttatcattatggtttgacagatactttgttacttgaaaaaggagaataa

SEQ ID NO: 583 - DNA, 240 bp, Staphylococcus epidermidis
tgtatgactgatacagtgattatttatacacaagatgactgtccaccttgtgcttttattaaaaattatttagtaaataaaaatataaaatttacagaaaaaaatatcaaaaaccaaaaatataaaaatgaaatgatggattacgatgcttttgctacaccttttattttgcttaaagggatgccaatgtatcaagtagatatggaaaaattgaatgatgaattgaatattacaccttaa

SEQ ID NO: 584 - DNA, 450 bp, Staphylococcus epidermidis
ataaaggatgattctgtgattactgaagaaacattagacattttagatgatattgaggatatctcggatatgattgtacaatctgatatttatgtctcataccgacgagctaaaatgcaattagatgctgatgatgaggcaagtctactttatcaagcttttctaaaagtgaaagataagtatgatgatgtgatgagatttggaaaatatcatcccgattacaaagatattatgttagaaactcgaaaacgaaaacgtgcttatgaaatgcttccagtagtaatggagtataaagcaaaggaagtggcattacaaaatttaattgacgaagtgatgtccaaaatagcattagctgtttctgagcatgtaaaaattgaaacaggtaatcctttcttccaaactggacatgatggatgtgcatctggtggcacatgtaactgttcattgtaa

SEQ ID NO: 585 - DNA, 903 bp, Staphylococcus epidermidis
  unsure (6): Identity of nucleotide at the above locations are unknown.
ttttcnggtgaagacgttggtgttaacggtggtgtattccgtgttactgaaggtttacaaaaagaatttggcgaagatcgagtatttgatacaccattagcagagtctggaattggtgggcttgcactaggcttagcagtgactggcttccgtcctgttatggaaattcaattcttaggattcgtttatgaagtatttgacgaagtagctggtcaaattgctcgtactcgtttccgttcaggtggaactaaaccagcgcctgttacaattcgtacaccttttggtggtggcgtccacactccagagttgcatgctgataatttagaaggtatcttagctcaatcacctggtttgaaagtagttattccatcaggtccttatgatgctaaaggattattaatttcttctattcaaagtaatgatccagttgtatatctagaacatatgaaattatatcgttctttccgtgaagaggttcctgaagaacaatacaaaattgacattggaaaagccaatgttaaaaaagaaggtaatgatattactctaatatcttacggggcaatggtacaagaatcactaaaagctgctgaagagttagaaaaagatggttattcagttgaagttattgacttacgtactgtacaaccaattgatatagatactttagtagcatcagttgagaaaactggacgtgctgtagttgtacaagaagcacaacgtcaagctggtgtgggtgcacaagtggcagcagaattagcagagcgagcaattctttcattagaagctccaatagctcgagtagccgcatcagatacaatttatccatttactcaagctgaaaacgtttggttaccaaataaaaaagatattatagagcaagctaaggcaactttagaattctaa

SEQ ID NO: 586 - DNA, 183 bp, Staphylococcus epidermidis
tccaattacgacatactctttatccatattcgtcctccactatataaaagaggaatgattactaacattcctcagagtcttattatttctttccttccacatatgctttgtcgaaaacaaataatcttaataataatattaacgatggaattaataaaagtaaacctaaaacaaaaacaataa

SEQ ID NO: 587 - DNA, 192 bp, Staphylococcus epidermidis
ttacagcaagatatagataatatgaagcgatacacccataagagcagagtcttttattataaagttgatagaaaggtgactctttatacgaaatatgacaaaaaagttcaggtcagtgaaagaataacgttgactacaatgggattaaactacaatttatgttttgtatctaacactatgattgagctgtaa

SEQ ID NO: 588 - DNA, 504 bp, Staphylococcus epidermidis
aaatttagggagtgggcatttatgattcaaataaaaggagcagtcaatttccctatttcattggatagtacgacttggatatttgacgatagaaaagttactattgatgatttagaacgtggggtatttgatggtactagacccatcaactttgatgataacaaggaatggaaccgtgctattttagaaggacaaacaaatccaccaacgcttgattctgaaattaaatataaaaaacgatcggttttagatgaaacatttgtgataaatatgacaccatttttcaaaaacgccgaacctatggaaaatgctagcacaataaaactttctaataaagattattccatcaatgtacccatggacttattaccttatttgttctttcaattttctagtaatggcaaacgtttatatagtgataatgctgttgatagtttcatatatattcctgaagaaggatactctcatcaatttaagtatgtcacacatatagaggtgatttaa

SEQ ID NO: 589 - DNA, 339 bp, Staphylococcus epidermidis
tacttggcactactttattcgtggcaatatagtctaaaaagtataaaggttcagcacctgttgttaaaatatcatttacacacattgcgacagcatcaataccaattgtgtcatgctttccatagtcaattgctaattttaactttgtacccacaccgtcagtacctgataccagaactggcgctttcatttttaattgagacaaatcaaatgttgcaccaaatccacctaaaccacctaatacttctttgcgcaatgtacgttcaacatgacttgttattctttcgactgcttcatatcctgcttgaatatttacaccagattcctcatatgctttag

SEQ ID NO: 590 - DNA, 519 bp, Staphylococcus epidermidis
cagatactttgttacttgaaaaaggagaataatatgagtaagacaagagcagttattcccggtagttttgatccaattacatatggtcacttagatatcattgaaagaagcgccgaccgctttgatgaaatccatgtttgtgtactaaaaaatagtagtaaaggtggaacgtttgactcagaagaacgcatgacgttgattgaagagtcggttaaacatttgcctaatatacaagtgcatcattttaatggattgcttgttgatttttgtgatcaagtaggtgcaaagacaattattcgaggtttaagagctgtaagtgactttgaatatgaactacgacttacttctatgaacaaaaagttaaatagtaatattgaaacaatgtacatgatgacaagtgcaaactattcatttataagttcaagtattgttaaagaagtagctgcatatcaagcggacatttcaccttttgtaccacctcatgtcgaaagagcattaaaaaagaaatttaatgtttaa

SEQ ID NO: 591 - DNA, 3465 bp, Staphylococcus epidermidis
ggagtgtcttggcttttgaaacaaataaagaaattacttgttgctaaccgtggtgaaatcgccattagaatttttagagcggcagcagaattaaatatcagtacagtagcaatttattctaatgaagataaaagttcgttacatagatataaagcagatgaatcctatctagttggaagtgatttaggacctgctgaaagttatttgaatatcgaacgtatcatcgaagtagctcttcgcgcaggtgtcgatgcaattcatcctgggtatggttttttaagtgaaaatgaacaatttgcacgccgatgtgctgaggaaggcattaaatttataggtccgcatcttgaacatctagacatgtttggagataaggttaaggctagaacaactgctattaacgctaacttacctgtaatcccgggtacagatggtcctattgaaagttttgaagctgcagaacagtttgctaatgaagcaggttacccacttatgattaaggccacaagcggtggcggtggtaaaggtatgcgaatcgttcgtgaatcaagcgaattagaagacgctttccatcgtgcgaaatcagaagccgaaaagtcatttggtaatagcgaagtttatatcgaaagatatattgataatccaaagcatatagaggttcaagttattggtgatgaattcgggaatatcattcatttgtatgaaagagattgctccgtacaacgacgtcatcaaaaggttgttgaagttgcaccttcagtaggtctttctaacaaattaagagagcgaatttgtgatgccgcaattcaactgatggaaaatataaaatacgtcaacgctggaacagtagaatttttagtttctggggatgaatttttcttcattgaggttaatccacgtgttcaagttgagcatacaattactgaaatgattactggtatagacattgtgaaaacgcaaattttagttgctaatggagaatcgttatttggagataaaatctctatgccacagcaaaatgaaattcaaacattagggtatgcgatacaatgtcgtataacaactgaagatcctactaatgattttatgccagattctggcacaattattgcatatcgatcaagtggcggttttggtgtgagacttgatgcaggggatggattccaaggtgcagaaatttcaccttactacgattcactattagttaagctttctacacatgccgtttcatttaaacaagctgaagagaaaatggaacgttcattacgcgaaatgcgaattcgtggcgtaaagacgaatattccatttctcatcaatgttatgcgtaatgataaatttagaagtggtgattatactactaaatttattgaagaaacacctgaacttttcgatattgcaccgacattggacagaggtaccaagactttagagtatattggtaatgtgacgataaacggatttcctaatgtagaaaagcgtccaaaaccagaatatgaatctaccaaaatcccaaaaatttctcaaaagaaaatcaatcagttatttggaacaaaacaaattcttgagcaacatggaccaacaggtgttacaaattgggttagagaacaagaagatgttttaattaccgatactacatttagagatgcacaccaatctttacttgcaacacgtgtaagaacaaaagatatgatgaacattgcatctaaaactgctgaagtttttaaagatagtttttcattagaaatgtggggtggtgcaacatttgatgtcgcctataatttcttgaaagagaatccatgggaacgtttagaaagattgcgcaaagccattccgaatgtgttattccaaatgttattacgagcttcgaacgcagtaggttataaaaactatcctgataatgtaattaagaaattcgttcatgaaagtgcaaaagctggtgtagatgttttccgtatattcgactcattgaactgggttgatcaaatgaaagtagcgaatgaagctgttcaagaagctggaatggtatctgagggtacaatttgctatacaggtgatattttaaatgctgaacgttccaatatttatactttagattattacgttaaaatggctaaagaactggaaagagaaggattccatatattagcaattaaagatatggctggtttattgaaaccgaaagcagcttacgaattaattggtgaattacgtgaggcaacacatcttccaattcatttacatacacatgatactagtggaaatggattgttgacatataaacaagcaattgatgctggcgtagatattatagatactgctgttgcatctatgagtggtttaacgagtcaaccaagtgcaaattcattatattatgcactaaatggatttccacgtaatttaagaactgatattgatgggttagaagagttgagtcattactggtctgtagtcagaccttactatgcagactttgagagtgatatcaaatcaccaaatacagaaatttatcaacatgaaatgccaggtggccaatattcaaacttaagtcaacaagctaaaagtttaggattgggcgaacgttttgatgaagtcaaagagatgtatcgtcgtgtcaacttcctgtttggagatcttgtaaaagtaacaccatcttcaaaggtagttggagatatggcactatatatggtgcaaaatgatcttgatgaagatacggtcatcaatgatggttataaattagatttcccagaatctgttgtgtcattctttaaaggtgacattggacaacctgtcaacggattcaacaagaaattgcaagatgttattttaaaaggacagcaaccaattactgaaagaccaggtgaatacttggagccggtcgattttgaagcaatccgtcaagaattaagcgacatacaacaagacgaggtaacagaacaagatataattagttatgtactttatccgaaggtatataaacaatatattcaaacgaaagagcaatttggtaatgtatctttactggatacaccgacattcttatttggcatgcgtaatggtgaaacagttgaaattgaaattgatactggtaaacgtctaattattaaattagaaacaatcagtgaaccagatgaaaatggtaagcgtacaatttattacgctatgaatggtcaagcaagacgtatctatattcaagatgaaaatgttaaaacgaatgctaatgttaaacctaaggcggataaatcaaatccaaatcatattggtgctcaaatgcctggttctgtaactgaagtcaaagtgtctgtaggcgatgaagttcaagctaatcagccattattaatcactgaagcaatgaagatggaaacgacgattcaggcaccatttgatggaattattaaacaaatcaatgttgctaatggagatgccattgccacaggagatttattagtggaaattgaaaagcaatcataa

SEQ ID NO: 592 - DNA, 1152 bp, Staphylococcus epidermidis
tcgcaaaagtggaggaaatgcaaaatgaacttcagtaaacttaaatttggcgcgacaataggaatcattggcggagggcagttaggaaaaatgatggctcagtctgcacaaaaaatgggttataaggtgattgtcctagatcctaatgaagactgtccttgtcgttatgtcgcacatcagtttattcatgcaaattatgatgatgagcaagctttaaatcagttaggtgaaaattctgatgttgttacttatgagtttgaaaatatttcgtctgaacaattaaaaaaactcactcagttatatcatattccccaagggtaccaagctattgaactattacaagataggctaaccgagaagcaaacattactagaagcaaatactcaaattgttccttttgtacaaattcacacaaatcaagacttattaaaagccatagaaaaattaggctttccgtgcatagtgaaaacacgttttggtggatatgatggtaaaggacaaattttggtaagaaatgattcggaattagacgaagcataccagctagttgagaagcaagaatgtgttgctgaacaatatcttgatattcaaaaggaagtatctcttacagtaacaattggaaatgaacaacaaacaacatactttcctcttcaagaaaatgaacatcaaaatcaaatattatttaaaacagtcgttccagcaagatctgataaagaaaatgaagcacgtaaggaagttgagaaaatcactcgcgcaattcattttgtgggaacctttacagtagaattctttattgataaagaaaataacttatatgtaaatgaaattgcaccaagaccacataattctggacactattctatagaagcttgtgattattcacagtttgatacacatattttagccataactggtcaaaaacttccgcaagctattgaattattaaagccaacagtaatgatgaatttattaggtcgcgatttggatttacttgaaaatgaatttagcagacatccagattggcatattcacatttacggtaagaaagaaagaaaacctgatagaaaaatgggacacatgactttactgacggatgatgtcaatcaaacagaacaatatatgttaatgaaatttgaagggagagacaagtaa

SEQ ID NO: 593 - DNA, 2007 bp, Staphylococcus epidermidis
tcatggaggtggacattaatgaattttccatgggatcaactactagttaaaggaaattggatgattatctcagcacaaattgctgcgccattcttagtcatcggccttatagcagttatatcttatttcaaattatggaaatatctatataaagaatggttcacatccgtagaccataaaaaaatcggtatcatgtatttaatttctgccgtattaatgttcgttcgtggtggtatcgatgcgttaatgttacgtactcaattaacaattccagataacaaattcttggaagcaaaccactataatgaagtatttactacgcacggcgtaattatgattatatttatggctatgccatttatctttggtttatggaatgttgttattccattacaacttggtgcacgcgatgttgccttccctgtaatgaataacgttagtttctggctattcttcgctggtatgattttattcaacctatcatttattgtaggtggatcaccagctgctggttggactaactacgcaccacttgctggtgaattcagtccaggtccaggtgttaactattatttaattgcaattcaaatatctggtatcggatcgttaatgactggtatcaacttctttgttacgattctaagatgtaaaactccaacaatgaagtttatgcaaatgccaatgttcagtgtaacaacattcattacaacattaatcgttatattagcattcccagtgttcactgtagcacttgctttaatgactgctgatagaatttttggaactcagttcttcactgtagcaaatggcggtatgccaatgctttgggcaaacttcttctgggtatgggggcaccctgaagtttatatcgttattttgccagcattcggtatgtactcagaaatcatccctacttttgcccgtaaacgtttattcggtcatcaaagtatgatttgggcaactgcaggtatcgcattcttaagtttcttagtttgggttcaccatttcttcactatgggtaatggtgcgttaattaactcattcttctctatctcaacaatgttaatcggtgttccaaccggagttaaactatttaactggttgctcacattatacaaaggtagaattacatttgagtcacctatgctattctcattagcattcatccctaacttcttattaggaggggttactggtgtaatgcttgcaatggcatcagctgactatcaatatcacaacacttatttcttagtagctcacttccactatacattggttactggtgtagtatttgcctgcttagctggtttaatcttctggtatccaaaaatgatgggctacaagttaaatgaaacattaaacaaatggtgcttctggttcttcatgatcggatttaacgtttgtttcttaccacaattcattctaggtttagatggtatgccacgtcgtctatacacttacatgccttctgatggttggtggttactaaacttcatctcaactatcggtgcagtattgatggcaattggattcttattcctagttgcaagtatcgtttatagtcatatcaaagctccacgtgaagctactggagataactgggatggacttggtcgtactttagaatggtctacagcatcagctattccacctaaatacaactttgctatcactcctgattggaatgactacgatacattcgttgatatgaaagaacatggtcgtcattatttagacaaccataactacaaagatattcatatgccaaacaatactccagtaggattctggatgggtatatttatgactattggtggtttcttcttaatcttcgaatctattgttccagcacttatctgtttagcaggtatcttcattactatgatttggagaagtttccaaattgatcatggttaccacatccctgcttcagaagttgcagaaactgaagctcgtttaagagaagctcgaattaaagaaagggaggctgtaagtcatgagtcatga

SEQ ID NO: 594 - DNA, 1701 bp, Staphylococcus epidermidis
tgtggagaacgccgaataatgaaacaactacattcaaatgaagtaggtgtatatgcacttggtggtttaggtgaagttggaaaaaatacctatgctgttgagtacaaagatgaaattgtaatcattgatgctggaatcaaattccctgacgataatctgttaggaattgattatgtaattcctgattacacttacttagaacagaaccaagataaaattgtcggtctgtttattactcatggacacgaagaccatataggtggtgtgcccttcctattaaaacaaattaatgtacctatttacggtggtccattagcattaggtctcattcgcaataaactagaagaacatcatttgcttagaacgactgaattacatgaaatagatgaaagtagcgtaattaagtctaaacattttgaaatttctttctatctaaccacacatagtattccagaagcatatggcgttatagtcgatacacctgaaggtaaaattgttcatacgggagacttcaaatttgactttactcctgtaggtgagcctgctaacatagctaaaatggctcaattaggtcatgaaggtgtgttgtgcttactatcagactcaacaaacgcactagttccagattttactttaagtgaacgtgaagttggacagaatgtcgataaaattttcagaaattgtaaaggtcgtattatctttgcaacttttgcttctaatatttatcgtgttcagcaagcagttgaagcagcaattaaatataatcgtaaaatcgttacatttggacgttcaatggaaaacaatatcaaaattggtatggaactaggatatatcaaagcgccaccagaaacgtttatagaacctaataaaataaatagtgtacctaaacacgagttactcattctttgtactggttctcaaggtgaacctatggctgcattatcaagaattgcaaatggtacacataagcaaataaaaattataccggaagacactgtagtatttagttcttcgcctattccaggtaacactaagagtatcaatcgtacaattaatgcgttgtacaaagctggtgcagatgtgattcatagtaaaatttcaaacattcacacttctggacacggttctcaaggtgatcaacaattaatgttacgtctgattcaacctaaatacttcctgccaattcacggtgaatatcgtatgcttaaagctcatggtgagactggtgttcaatgcggtgttgatgaagataatgtatttattttcgatatcggtgatgtacttgctttaacacatgattctgcacgaaaagcaggaagaattccttccggcaatgtacttgttgatggcagtggtataggtgatattggcaatgttgtcatcagagatcgtaaattactttcagaagaagggttagttattgttgttgtgagcattgactttaatactaacaaattactatctggccctgatattatttcacgcggttttgtttatatgcgggaatctggtcaattaatttatgatgctcaacgtaaaattaaaggcgatgtcatttctaaacttaacagcaataaagatattcaatggcatcaaattaaatcttcaattatcgaaacattacatccttatctttatgaaaaaacagctcgaaaacctatgattttacctgtgataatgaaagtaaatgaagataaataa

SEQ ID NO: 595 - DNA, 1401 bp, Staphylococcus epidermidis
cctaatattttatttaggttaatatattctcatatattaatgggggtgattttattgaattccaataataacaatcatgaacaacaacgaagtttagatgaaatcaataacaccataaacttcaatcataatgatagtgcaagtcaaaaatttctggcttttttaggaccgggattgcttgttgcagttggttacatggatcctggaaattggattacatccatgcaaggaggagcacaatatggctataccttgttattcataatcttaatctctagcttatctgctatgctgttacaaagtatgactgtgagattaggaatagcaactggtatggatttagcacaaatgacacgtcattttttaaataagcctgtagcaattatgttctggattattgcagaattagcaattatcgctactgatattgcagaagttataggcagcgctatcgcattagatttaatcttcggcataccattaattgtaggcgcattaatcactgtatttgatgtatttttattattattcatcatgaaatttggctttagaaagattgaagctatcgtgggaacattaatctttaccgtattggccatttttgtatttgaagtttatatttcttctccacatataatagatatgcttaatggttttgtgcctcataaagaaattattacaaaccaagggatactttatattgcactaggcatcataggtgctactattatgccacataacttatatttacattcttctattgtacaatctcgaaaatatgatagacacagtattcatgaaaaagcacaagcgattaagtatgctaccatagactctaatatacagctatccatcgcttttgtagtcaattgcttattacttacacttggtgcagcactattttttggaactaaaactgaagatttgggtggtttttatgatctttatttggctctaaaaacagaacctgctttaggtgcaacgcttggcggtattatgagtactttatttgctgttgcccttttagcttctggtcaaaattcaactataacaggaacgttagcaggccaaattgtgatggaaggatttcttaaattatccattccaaactggttacgtcgtcttatcactcggtctttagcagtgatacctgttatcatttgtcttatagtatttaaaggaaatactgaaaaaattgaacaattacttgtcttttctcaagtgttcttgagtattgctttgccattttcgttaataccgcttcaattagctacaagtaatcaaaatcttatgggtccttttaagaataagacatggattaacatcatttcttggttactcataattgtcttaagtggacttaacgtatatcttatcattcaaacattccaagaattatga

SEQ ID NO: 596 - DNA, 900 bp, Staphylococcus epidermidis
gtctgtattttgaaccagaagcaatacacatcatggtaccaggtgaaactgaagaagaatttgataagcgaattgaaagttatgaggactatcatcatgcataatatcaataaatggttactggttccttacttattatggatggttatatttattatcattccagtcattttacttgtttacttttcttttatagatattcatggtcactttagtttcacaaattatgagcaggtattttcaacaagatatttaaaaatgtttattgattcaatatggtatgccgctttaattactatgattaccttaataataagttacccagctgcgtactttatttcttattcaagatttcaaaatatactgcttatgttgttaattatccctacttggattaatttacttcttaagacctatgcatttattggtttgttggggcatgatggagttattaaccaagctctacatatatttcaaatacctaaattaaatttgttgtttacaagtggtgcatttttattggtggcgagttatatttatatcccatttatgattttgcctatatttaacagcatgaaagcaattcctaacaatattttgcaagcctctaatgatttgggcgcgagtacatttactacgtttcgtaaagtaatcgttcctttaacaagagaaggtattaaaacaggtgtgcaagtaacatttataccagctctttcactgtttatgattactaggttgattgccgggaacaaagtaatcaatgtaggtacagcaattgaagaacagttcttaactatacaaaattatggattaggttccactatagcactttttctcattatttttatggcctttttactcattattacaaaatcaaaatcatctaatgggaaggggtga

SEQ ID NO: 597 - DNA, 303 bp, Staphylococcus epidermidis
aaagttttcagaaccaaaaacaaaaagcatctacagtcaagaaaaattgatgtggagcctgtttttggatttatgaaggctattttgggttttactcgaatgtccgttcgagggataaataaagtcaaaagagaactaggatttgtgctaatggcacttaatataagaaaagtaacagctcaacgagctgaaaataatcaaaaaaataataaaaaagacaatttctatataatttcaatagaaattgtcttttttatttatcttggaactttaagtcccacactctttatttatgtgagatag

SEQ ID NO: 598 - DNA, 513 bp, Staphylococcus epidermidis
caatccaaaagtttcgaaagggtgtacaaagtgaaagtagcagtcattatgggcagttcctcagattggaaaattatgaaagaaagttgttcgatgcttgaagaatttgaaataccgtacgaaaagaaagtcgtttcagctcatcgtacgcctcaaatgatgttcaatttcgctagtcaagcacgccaaaatggttttgatattatcattgccggtgcagggggagcagcacacttacctggaatggtagcttccatgacaacattacctgtgattggtgtgccaattgaatctaaaagtctaaaaggattagattcattactatctatcgtccaaatgcctggtggtatcccagttgcaaccacagcaattggaaaatcaggtgctaaaaatgctgggatattagcggcaagaatgttaggaataacaaatgaatcagttcaaaataatttggaaaattatgaaaaatctttagtcgcaaaagtggaggaaatgcaaaatgaacttcagtaa

SEQ ID NO: 599 - DNA, 222 bp, Staphylococcus epidermidis
ttgataactggagtgaaccattgtccaccagcggaaccgatattactaattgtgcatgttgcacctttcatttcttctgaagttaatttaccatcacgtgcttttacagctagttcattaatttcatcagaaatttcgaatattgatttacgatcggcatgtttaactactggtactaataatcctttatccgtatctgcagcaataccaatattccagtaa

SEQ ID NO: 600 - DNA, 1155 bp, Staphylococcus epidermidis
cgaatgttaggagagcaatatacacaaattaagcgtccagcaaatcggctaactgaaaaaatattaggttggtttagttgggtattcttactcatattaactattgtttcaatgtttattgcgctcgtatcttttagtaatgatacgtcaattgccaatttagaaaacacacttaataataatgaactcgtacaacaaattttagccaataatgatttaagtacaactcaatttgtgatttggttacaaaatggagtttgggcaattattgtttattttattgtttgtttgctcatctcgtttttagcgttaatttctatgaatataagaattttgtctggttttctttttttaatagctgctatagtcacaattccgcttgtattgttgattgtaactctaatcattcctatcttattctttatcattgcaatgatgatgtttgctagaagagatagaatagaaacagtgccatcttattataatgaatatgatcaaccatactatgatgagagaggtttttatgaaccagagtcaagaaatgaacatggatataatgatgatgtgtatgaacctatgcatactaaaaaggaagatagaaatacaagacgtcaattcaatagaaatgctcagcaacaagattcctataatggtataactgataatcaacccgatgaagatacatcttccgatcaactttattcagacgaatatgtagataatgaagataaatattctcaatttccaaaaagagcagttgaaagtgaatatgcatctcaacaaactgaagatgaaccaacagtcatgtcaagacaagctaagtacaataaaaaatctaaaaatacggattttgaagatgcgcaacaggaacatatggaaggtaatcaatttgatgacgtaggagttgttgaaccacaaattgatcctaaagaactaaaagcgcaaagaaaaagagaaaaagcagaaatacgtgctaagaaaaaagaaaagagaaaagcatataataaacgtatgaaagaacgaagaaaaaaccagccaagtgctgttaaccaacgacgtatgaattatgaagaacgtcgacaaatgattaataatgaacaagaagatacagataataacttaaatcaacaggaagattcaaaaaaagaaaattaa

SEQ ID NO: 601 - DNA, 288 bp, Staphylococcus epidermidis
ctgtacaaaggagagtttaatatggaacaaaaatcatatgtaatcacagacgaaacagggattcatgctcgccctgctacaatgctagtacaaactgcatcaaaatttgattcagatattcaattagaatataacgggaagaaagttaatttaaaatcaatcatgggtgtaatgagcttaggtgtaggtaaagatgctgaaataactatttatgctgacggtagcgatgaaactgacgcaattcaatctatcactgatgtcttatcaaaagaaggtttagctgaataa

SEQ ID NO: 602 - DNA, 1149 bp, Staphylococcus epidermidis
agaagtgaaggttttaatcgttgccacagcttcatatttataggaggaaactgtatgaatccattgctttcttttaaagatgtcagtaagggctttgaagatgtacaaatactaaatgaaattaatattgatattgaaccaggctatttttatacactattaggtccctcaggttgtggaaaaacaacaattttaaaactcatagcaggatttgaatatcccgatagtggagatattatatataaagataaacctattggtaaaatgccaccgaataagcgtaaggtaaatactgtattccaagactatgcattgtttccacatttaaatgtattcgacaatattgcatatggtttaaaattaaaaaaattaagtaagtcagaaattaagcgtaaggttactgaagcacttcagttggtgaaattaagtggttatgaacataggcaaatacaaggtatgagtggtggacaaaaacaacgtgtagccatagcacgggcaattgttaatgagcctgaaatattattattagatgagtctttatccgcattagatttaaaattacgaactgaaatgcaatatttattgagagaacttcaatcccgtttaggtataacctttatatttgtaactcatgatcaagaagaggccttagcattaagtgattatatttttgttatgaaagatggcaaaattcaacaatttggcacaccaatagatatatacgatgaaccagttaaccgatttgttgctgattttataggagagtccaacatagttcacggtacaatggttgaagattttgtcgttaatatttatggtcaaaattttgattgtgtagatatgggaataaaagaaaataaaaaagttgaagttgtaattagacccgaagacatttcacttgtttcacaaaatgatgggctatttaaagccaaagttgattctatgctatttagaggtgtacattatgaaatttgttgtaaagatagaaaagggtatgaatgggtaatacaatcaacaaaaaaagctaatgtaggtagtgaagtaggtctgtattttgaaccagaagcaatacacatcatggtaccaggtgaaactgaagaagaatttgataagcgaattgaaagttatgaggactatcatcatgcataa

SEQ ID NO: 603 - DNA, 2208 bp, Staphylococcus epidermidis
aaagttggagggaacaaaatgtctaaatttatcgaaccaagtaatgaagagattaaacttgaaaaactttatcaagatataggattaagtgataaagaatatgacaaagtggttgaaattcttggtagagaacccaacttcacagaagtaggaattttctcagtgatgtggagcgaacattgctcatataaacattctaaaccatttttaaaacaatttcctacgacaggagagcacgtattaatgggaccaggagaaggtgcaggtgttgtagatataggcgataatcaagccgtagtatttaaagttgagtctcacaatcatccatctgcaattgaaccatatcaaggtgcggcaactggagtcggaggtattattagagatattgtttcaattggtgcccgtccaattaatttactaaatagtcttcgttttggtgagttaactgtaaaacaaaatcaacgattacttaaaggtgttgtaagtggtattggtggatatggcaactgtattggtattcctactacggctggtgagattgaatttgatgaacgctatgatggcaatccattagtcaatgctatgtgtgtaggaatcattgatcatgatatggtccaaaaaggaacagctaagggtgttggtaattccgttatatatgtaggtttaaaaactgggcgtgacggtattcatggtgcaacatttgcatctgaagaacttactgaggaaagtgaaagtaaaagaccttcagtacaaattggagatccatttgtaggcaaaaagctaatggaagcaacattagaagcaattacttttgatgaactagtaggtatacaagatatgggagcagctggtttaacttcatcttcatctgaaatggcagctaaaggtggtagtggtttacatttaagacttgatcaagttccaacaagagaacctggaatttccccatatgaaatgatgttttcagaaacgcaagaaagtatgctgttagttgtagaaaaaggtacagaacaaaagtttttagatttattcaataaacacgaactagatagtgcagtaatcggtgaagtaacagacactgatagattcgtgcttacatacgatgatgaagtgtatgcagacattcctgtgcaacctcttgctgatgaggcaccagtgtatattttagaaggagaagaaaaggaatataatacatcaaaaaacgattacagcaatatagatgtacatgatacatttatcaagttattacaacacccaacaatagcatctaaacatcatttatatgaacaatacgatcaacaagtaggagcaaatacaattattaagccaggtttacaagcttcagttgtgcgcgtagaaggaacacaaaaagctattgcttcaactatagatggtgaagcacgttatgttttcaaccaaccttatgaaggtggaaaaatggttgttgctgaagcctatcgaaatttaattgcagtaggggcgacaccattggctatgactgattgtctaaactatggttctccagagaagaaagaaatctatcaacaattaatagattcaacaaaaggtatgtcagaagcttgtaaagtgcttcaaactcctgtagtttcaggaaatgtttcattatataacgagacacgtggaacctctatcttccctacacctgtcgtaggtatggttggtcttattgaagacgtgagctatctaaaagagtttaaacctaaagcaggagataagatttatttagttggtgaaacgcgtgatgactttggtggtagtcaattggaaaaattgttgtatggatcagttaatcatgagtttgaatctattgatttaagtgatgaagtttcaaaaggaaaattaatcaaacaggctattcgtaatggcattgcatctcatgtacaaacagttggtaagggcggcttattagttactttagctaaaattagtgcccattatgatttaggtatgcaagctcaattggatgttaccaatgcacaattatttagtgaaactcaaggacgatatattgttgttgttaaagaagggcaaactttggatatagatcaagctcaagaaattgggcatttaactcatcagcagttatttgatatatctaattcagacgtaaaaataaaagaaaacgtttcagatatcaaacaaaaatgggaaggggctatagttcaatgtctaactactcaggattaa

SEQ ID NO: 604 - DNA, 1260 bp, Staphylococcus epidermidis
aaagaaaggggtaatctattgaaagttttaatagttggagctggtggacgtgaacatacattagcttctaaaatcaatcaatctccaattgtagataaggtttacgcgattccaggaaatgatgcaatggtcaatattgctgaagtgcacagtgaaattgctgaatcagatcatcaagctattttacattttgctcagcataacgcaattgattgggtaatcattgggcctgaacaacctttaatagatgggttagctgatttattaagaaatgcaaatattaaagtgtttggtccaggacaagatgccgctcaaattgaaggttcaaaattatttgccaagcaattaatggacaaatatcgtattcctacagcagaatataaagaagtaagttcacgtaacgaggcgttgcaatatgttgaaacttgtgatttaccaatcgtaataaagaaagacggtttagcagcaggtaaaggggttattattgcttttacgagagaagacgcattagaaggggtcaaaaaaatttatcaagaagaaaaagggaaagtcgttttcgaaagttatttagaaggagaagagttttctttaatgacttttgtaaatggagattatgcggttcctttcgactgtattgctcaagatcataagcgagcatttgataatgatcaaggaccaaatactggtgggatgggcgcatattgccctgtaccccacattgatgcatctgttcttgaacaaaccaataaggagattgctcaacctattgctaaagctatggcacaagaaggtcatgacttcttcggattactatatattggtgcaattttaacaaaagatggacctaaagttattgaatttaatgcacgttttggtgatcctgaagcacaagtattattaacacgtttagaaagtgacttaatgcaactcattatcgatttggaaaattgccaacccattcattttaactggaaagatgaagctgttgtaggagtaatgctagcatctaaaggataccctggttcatatgaaaaagggcatgaaataagtggttttaatctagattctcattattatgtgagtggattaaagaaagaaggtcaatgttttgtgaattctggtggaagagttatcctagctataggggaaggtccaacagttgaaaaagcacaagcaaatgcatatgaacatgcacgacaaataaaaagtgataatcttttttatcgtaatgatattgggaataaagccatcactaagtaa

SEQ ID NO: 605 - DNA, 1176 bp, Staphylococcus epidermidis
actaaaattattggtaagccctacatttgtagtattaggaggtcaaaaaaagtgtcaaaatttaagtctttgcttctattatttggcacactaattttacttagtggttgttcaaatatagaagtttttaatgcaaaagggccagtagcaagcagtcagaagttcttgattatctattcaataattttcatgcttgttattgttgctgtagtgctttccatgttcgctatttttatttttaaatatagctacaaaaagaatagcgaatctggtaagatgcaccacaattctctaattgaaacaatttggtttgtggtacctattttaatcgtaattgctttagctattcctacagttaaaactttatacgattatgaaaaaccaccagaaaaagacaaagatccacttgtcgtttacgcagtaagtgctggctataaatggttctttgcctaccctgatcaacatattgaaactgttaacacattaacaattcctaaagatcgaccagttgtattcaagcttcaatctatggatacaatgacaagtttctggattccacaattaggtggtcagaaatatgccatgactggtatgactatgaattggactttaacagctgatcaattaggtactttcagaggtcgtaactcaaacttcaatggtgagggattctctcgtcaaacatttaaagttcactctgtaagtcaaaatgattttgataagtgggtaaaagaggctaaaggtaagaaaactttaagtcaagatacttttgacaagcaactcttaccaagcacatctaacaaagaattaacatttagtggaactcatatggcgtttgttgaccctgcggctgatccagagtatatcttctacgcttacaaacgttacaactttgaacaaaaagatcctaacttcacagctgaagaggatttatacaaagatgtaaaagataaaccaatcaaacctgctcgtaaggttcatataacaaaccctaactatgaacgtcacggtatgaaacctatgattctcggcaacaatgaaaaatacgataatgagttcaaaaaagaagaggatcataactctaaagaaatggaaaaaatttctaagggagcaaaagacgaaaatgcgtctaaacttcacaaaaaagaacacgatgatcatggaggtggacattaa

SEQ ID NO: 606 - DNA, 255 bp, Staphylococcus epidermidis
gaaatgaatataattcctagaacgagtttaattatttatttaaaacatatgaaacatgagcgacaaattagaaaatatggacacatcgtgcactcaaaccgtcaacgaaaatatgttgtgatgtatataaatgaagcagatgctgacaatattgttcataaacttatgcaactcaagtacgttcacgaaattcaaggttccccatataaatatttgaaaaaaacatatgaaaaagaaaaacatgaaatacaatag

SEQ ID NO: 607 - DNA, 1329 bp, Staphylococcus epidermidis
acgatcttcatatataataattttgaggtgaacagtatgtcttttcttaggaaacacaccgaaattatatttagttatatcatcggtatcgtttcactttttacaggtctcattatttttattaacttacctttaatcaaacaatttaaaggtgacaaaaaggttgatacgcatgtgcataacgtatgggaattcctaaatgccttttttgccgagattataaaagtgatgagtaaatttattggtggctttccaattacaagtgccatagtaatcatcgtatttggtattctagtgatgctgttaggtcacactttatttagaactattaaatacgattatgacatttcaattttctttttagttattggcattatgtactttatcattacattattgctaatgacacaagtgtatggcttttttgctatcgtctttattattccttttacagttcatattggttacatagtttataaagatgagttgaaccaagacaatcgaaagaaccattatatgtggattattgtaacttatggaatgagttatcttattacccaaatttcgctatatggacgtattgacgcaaatgaaattgaatcaattgatattttaagtgtaaatacattcttcattattatgtggttattaggtcagatggctatatggaatttcttattcctaagacgttcattaccactcactaaagaagaattaggcgaagaggaacctgaactttcaagaactaataaaggcaatgtatctaatcaaactaaagttcacttaaaacaactacaaaataagacaaccgagtatgcacgtaagactagaagaagtgttgatttagataaaattagagccaaaagggacaaatttaagcaaaaaattaacagcatagtagatatacaagaggacgatattccaaattggatgaaaaaacctaaatgggttaaacctatgtatgttcaattgttttgtggtgtaattattctgttttttgcttttctagaatttaataatagaaacgcattattcttaactggtgaatgggagttatcacaaacacaatatgtagttgagtgggtaacattattattgctacttttcattattattatttatattgcaactacattaacttattatttaagggataaatattattatttacaactctttatgggcagtattttattctttaaatttcttacagaatttatcaatattatggtacatggattattattatcaattttcattacgccaatcttattattaatgcttattgcaatgattgttgcttattctttacagttgagagaaaaataa

SEQ ID NO: 608 - DNA, 846 bp, Staphylococcus epidermidis
tatgtagtaataggagatgatacgatggctttatatgattttgcaaaagggttgatactagaagcaggaaataaagtaaggttgatgatgcaagaagagttagacattaaaactaaatcgaacccaaatgatttagttacaaatgtggataaggcgacagagaattatctatatgaaacgattcttcataattatccagatcatcaggttattggcgaagaggggcatggtcataatctcgagtatttaaagggggttatttgggttattgatccaattgatggaacacttaattttgttcaccaaaaagaaaattttgccatctctattggtatttatcatgatgggaagccttatgcaggttttgtttatgatgtcatgaaagatgttttatatcatgcaaaggttggacagggtgcatttgaaaatacacataaacttgaaatgattcaaaatactgaacttaaaagaagtattataggtattaatcccaattggctgtcgaaaccaatactcagtgatatttttagttcaatagtgaatgaggcaagaagtgcacgagcatatggtagtgcagcattagaaattataagtgtagcgaagggtcaattggcggcttacctaacacctagactacaaccgtgggattttgcaggtggattgttgattttgaacgaagtaggtgggataggaactaacttattaggcgataaattagacttcaatcaaccgaattcaatattaatagcaaatcctagccttcatcgtgaaatattaaatcatcatttaaatcagcaaagagatacacttattacactccatgaaaaaaggtttggaaagagatag

SEQ ID NO: 609 - DNA, 633 bp, Staphylococcus epidermidis
agcaataaaatctttgagtatctattaatgtacttgtgtctatcttatctgatatattatttaataaggaaggtgtatgacatgataacaatgaaagatattataagagatggtcatccaacacttcgtgaaaaagcgaaagaattaagcttcccactttctaacaatgataaagaaacattgcgcgcaatgcgtgaatttctaatcaatagtcaggatgaagaaaccgcaaaacgttatggtttacgttctggcgtaggtttagctgctccacaaattaatgaaccaaaacgtatgattgctgtctacttacctgatgatggaaacggtaaatcgtatgattatatgctcgtaaatcctaaaataatgagttacagtgtacaagaagcttatttaccaactggcgaaggttgtctaagtgttgatgaaaacatcccaggtttagtgcatcgtcatcatagagtcactattaaagctcaagatattgatggaaatgatgttaaattacgtctcaaaggctatcctgcaattgtatttcaacacgaaattgatcatctaaatggcattatgttttatgattatattgatgccaatgaacctctaaaaccacatgaagaggccgtagaagtctaa

SEQ ID NO: 610 - DNA, 1149 bp, Staphylococcus epidermidis
aaaggagaaatgcaaatgaaaagtgttggactgataactgaatataatccttttcataacgggcacttatttcacgctacattgtcaaaacaacgctctgaaactaatgtaactattgctattatgagtggcaattttgtgatgcgtggagaaccagcaatctaccataaatttaaacgcactaaaatggctttatccgccgtagatttagtcgttgagctaccattgataggtagcctatcttctagtgatacctttgcggaaatagctattaaaacagctcagtatctcgatatagatattatatcttttggcagtgaaagtgcatccttaaaagatttacaatatcttgcaacacaaatgattgactatgaaaaacatccagattttaaagagaaattaaaacaaggtaaaagctatccacgaatcttaagtgagttaacacataacgacacacttttacaatctccaaacaatattttaggaataagctaccttaaagcaatgcagcaatttgcgcctcacatgtcagcattgactattaaaagagaaggttcacttcatcatcaaaaagtaattgatcaccatcattttgcaagtggaacatctattaggcgttcgctaatgaatgataatgtagactggaaaaatgtggtcccaaatcaaatacaatctttatattgtaaacctcatactacggttgaggatacatttccttttatcaaacaccaattaattacacaaccaaaagagagccttcattctatttacacaataaatgaggggtttgaaaatcgcttgcaaacaatgattcatcgaagcgattcctttgagtctctattatcaaaccttaaaacaaaacgttatacgcagacatatattcaacgtgtattaatgaatgtgttattaaatataacaaaagatgatgttaacaaggaaattaacgctgttagagttttaggaatgagtgaaaaaggacgctcatatttaaaatatttaaaagctaattatccaaatcgtcactacattactaatgtaaatcaaaagactgcacactattttaaaaatgaaattaaagcgactcatgtatataatctattaagtaatcaatcacagacagactttaacacacctttagtacgcatttaa

SEQ ID NO: 611 - DNA, 1023 bp, Staphylococcus epidermidis
aacaaaatgatttacgcttatatcggtataacagtattatgggtatttttattttgttatattattatcgcctccattgattttggtgcaggatttttcgcattgcattctaaaatgacaggtaatgagaaaaaggttaatcatttaatccatagatacctcaatccagtttgggaagttacaaatgtctttttcgttttcttttttgtaggatttataggtttttttcctgattctgctaaatacttaggaacagttttattagtacccggatcaatagctttaattcttatttctatacgaagtagtttttatgcttttgaaaattatggtcaagatactaaactgccctggattgtattatatggtttaacagggctgttaattccagcttctctagcaactgctctaacaatttcagaaggtggttatatctatgagcatggcacacatattgatttagactggatacaattattattaagtccatttgcatggtctgtagtattcttagccattgtttcagttctttatatttcatcaggttttttaacatattatgctcataaagcaaatgatcaacctgcttatgatatgacacgacaatggcatattttttgggggccacctatgattgtgatttcattatttgttttcttatctcttagaattcaaaattctgatcactttagaactgctatttttaattattggtggatgtttgcaatcagctttatattttttataatagctggattactgactatatttaaaaagaaacacggtctagcttttatcatggttatattgcaaatgttatttgcattctttggctacggaatgagtaaacttccatatttactttatccgtttattaaaattacagactcccatgtcaatccggaaatgggattatcattagttattgtttttgttttaggtttacttttattaattccatcgttaatattattattaagattatttgttttcgacaaagcatatgtggaaggaaagaaataa

SEQ ID NO: 612 - DNA, 939 bp, Staphylococcus epidermidis
gaggattcgattatggctcattcaaaaaaatggtttattaatggtacgttggcaacagccggtattataagcagtctattttactttttaaaaaataaaaataaatcaccgcaacaattaaaatctattccacctttcttctcaggacaagcaccttacatatttgcacatagaggtggcatggcaatgcgaccagagcaaacacagttggcatttgataatgctgttgaatatggattggatggctttgaaacagatgtacgactaactaaagatgaacaactcattgtttttcacgatgcacttgtcgaccgtacaactaatggttcaggtaaagtgagtgaacatactctagctgaactaaaacgattagatgcgggatatcattttactgacatcaataatcaaacaccttatcgcgggcacgataaagctaagattttatcattcgaggaactgcttgaattgtaccctaatatgtatatcaatgtggatttaaaagatgcgccagacacatatgaaggtcgtatcgcaccaaaagtgatttacgataatatcatcaaacatggggcgcaacatcgagtgctcgttacaagcttccataaaaaacaaattcaacgtttcactgagtataaccaagctgacattgctatcggtgctagtgaaggcgaagttgctgaaggttttattaaatttaacggcatgttaggtcacacatttaaaccacaagcagacacattccaaatgccagttgcatataaaggaatttcattaacttctaagcgtttcattcaatggcttaacttaaataatattgtacccggttactatggtgtgaatagtatagatttaatgacagatttatatcataaaggtgttcatactttagttacagatcgcccagatttaggtcaacaatttaaagaaactttaaaataa

SEQ ID NO: 613 - DNA, 204 bp, Staphylococcus epidermidis
gatggcactgtttctattctatctcttctagcaaacatcatcattgcaatgataaagaataagataggaatgattagagttacaatcaacaatacaagcggaattgtgactatagcagctattaaaaaaagaaaaccagacaaaattcttatattcatagaaattaacgctaaaaacgagatgagcaaacaaacaataaaataa

SEQ ID NO: 614 - DNA, 288 bp, Staphylococcus epidermidis
ggggaatatgtcatgtctaaccaatcgaagttaaatagtgcggcatatgaccaattgaataaagatgcagacagaatattacatctaattaaagttcaaatggataacttaactttaccttcttgtccactttatgaagaggttttagatactcaaatgtttggtttacaaaaggaagttgatttcgcagttcaacttggattagttgataaagaagatggtaagcaattaatgttaagacttgaaaaagaactttctaaattgcatgaagcatttacgaatgtttaa

SEQ ID NO: 615 - DNA, 1404 bp, Staphylococcus epidermidis
ttgttacgtgttaaaaatttacgtttaaagtatccgaatggtgataggaaaatattcaataacttaaatcttgagattaaaaataaagaaaaagtgcttttactcggtccttccggatcaggtaaaagcacattacttaatgtattaagtggaatagtacctaatttaattgaacttccgatgaaatatgatgaattgaatattgatcatgatagtggcgttatatttcaagatccagataatcaattttgtatgccaaaagtatatgaagaacttgcatttgttttagaaaatagaaatattcctagaagtgagatggatcaagaaatcgaagacgcactaaagtctgtagaccttaatgttactcataaaacatatgtcaataatctaagtggtggcatgaaacagaagttagctattgttgaaacaatactacaaaaatcaaagacactttttttagatgagcctactgcaatgctcgacgtgaaagcaactgaagatttatggaagaaattaatcaatctttgggaagatcaaacagttttaattgttgagcataaggttgaacatatttggcaacatgttgaccgcgtattgttattaaattatgatggtgaaattgttgctgacgacaccccagaacaaatcttggatcattatgaagcgttattaactgaatatggagtttggcaccctagagcatggcacagtgcaccacgccccatcccattacctaatcaaacaaagaacctcttatttcattttgacgacgggcaaattattagaggtaaaaagacacttttttcatccaaggagcttaaactgtattcaggtgaatggttaacaatcactggtaaaaatggtgctggtaaaacctctttactagaagctatgttacaactgattaaatatgaaggtgacatgttttatcgcgatcaattattatctaaaattaaacaagcggcaaagcatatgtatttggtatatcagaaccctgaattacaatttattactaattctgtttatgatgaagtgtatattcattataatcacttagatcctaagcatgcgaatgatgaaaccatggatctgttaaaattattacatttagatcaagttaaggatcatcatccttttgaaatatcaacaggtcaaaagcgtcgtttaagtgttgcaacagcattaagttcaaaggcagagattattttactagatgaaccaacattcggcctagatagtcataatacatttcaacttattaagttatttcaagaacgcgttaatcaaggtcaaacaattatcatggtgacacatgatccagaaattattaaacgatatccaacaagacgattacgcgtggaagatggatgtcttaaagaaatggaaggtgaacacattgtttga

SEQ ID NO: 616 - DNA, 222 bp, Staphylococcus epidermidis
aataaatgcttatatattttcctagctaaaatgataatgacttttttatttaatcacacgactacacttaaacgattaaaagattttaaatactttaactgtaatttaataatactttggttatctgtgacacatccagttacttttaagaattacaatgcaactaatattatgatattcataatgtcaacgaatacaaatacttgttcaagaacgttataa

SEQ ID NO: 617 - DNA, 1356 bp, Staphylococcus epidermidis
atggattcagtagaaatagctcgattgttgacgggtatgacacttgcagtgcatatcatatttgcaacaattggtgttggtatgccacttatgtttgcaatagcagagtttattggcataaagaaaaatgatgcgaattatatcacattggctaaaagatggtcgaaaggctacacgataaccgttgctgttggagtcgttacaggtactattattggtttacaactttcacttgtctggccaacatttatgaaaatgggcggtcatgttatcgcattaccactattcatggaaacttttgcattcttttttgaagcaatctttttaagtatttatttatacacttgggaaagatttaaaaataaatggacacattttttcatatctatacccgttattataggaggttcattctcagcattctttattacatcagtcaattcatttatgaataccccagctggttttgaaattaaaaatggtcgtatggtaaatgttcagccattagaagcaatgtttaattcatcgtttatggttcgtgctttacatgtagttgcaactgcaggtatgacgatggcgtttatattagcagccatcgcagcgtttaaattattacgtcataatcatacagaagatagaacataccatacaaaagctcttaatttaagcatgattgttggattcatcaataccgttctttcgatgattgcaggagatttatctgctaaatttttacacaaagttcaaccagataagcttgcagcatatgaatggcattatgatacgcaatctcatgcgaatttagttcttttcggtgtattaaatgaaaaaacacatgaagtttcaggagcactagagattcccggattacttagttttttagcagataatagctttaatacaaaagttaaaggtttaaatgaatttcctaaaaatgaattacctcctatgatagtgcattactttttcgatttgatggtatcaatgggaatattctgttttatcatttcaggactatatatgttatttttaattgttaaaaagttacgtaaatatgtaactagtaatatgatgttatacgctatcttgttaactggtcctgcatcaatgttagcgatagaatttggttggttcttaactgaaatgggtcgtcaaccgtggattatacgaggatatatgcgcgtatcagaagctgctacccaggcggggggaatcacattagtaacgacgctattcggtttactatatcttttattactagttacttcggcttatgtactaattagaatgtttaaaaatcaacctgcttataaagatgtagaaaaagtgattaaagagagaggtgaaacaaaatga

SEQ ID NO: 618 - DNA, 309 bp, Staphylococcus epidermidis
aaaataaaagtatatgaaggagaggacactatggaatatcaatatccattagatttacattggactaatgatgaaatgatgaaagtaattcatttctttaataaaatcgaaaattattatgaggcatctgtaaaaggtgacgaagttttaaatgcttataaaaattttaaacatattgtgcctggaaaagctgatgaaaaacagatttttaaagaatttgaaaataaaagtggttataatagttacaaagtagttcaagaaattaaaaaaaatccaaatcaaactttatttagtaaagatttcgactaa

SEQ ID NO: 619 - DNA, 831 bp, Staphylococcus epidermidis
tgggaaggggtgattagtgtgaaatggtacggaaaattatatatagctctattaataagtgtgctttatattcccattttctttttaatgatttattcttttaattctgcgggtaatatgagtcacttcgaacattttactttagaacattaccactccctttttcataatgatcggttgatgtcggtgatttttaatacagttgcagtggcacttttatctgcatcgattgctacagttataggtacatttggtgcgatcgctttatattacttacgcaacaaacggtttaaggttacgctattaacgatgaataatgtattaatggtatcttcagacgtagtcattggtgcttcttttttaattatgttcactgcaataggacatttcacaggtttaggtttaggattttcaacagtgctagcatctcatatagcgttctgtattccaattgttgttatcatcgtcttaccccaattatatgaaatgaatgataacatgttaaatgcagcaagagatttaggtgctaatgaatcacaattattaactagcattatcatacctaatattatgccctcgattataggaggattctttatggcattaacatattctctagatgattttacggtaagcttctttgttactggaaacggatttagtgtattgtctgtagaagtttatgctatggctcgaaaaggtataagtatggagattaatgccatttctacaataatatttattgctattatgtttggagtatttggatattactttattcaacatatcgttaatcgtcagaaaaagatgaagcgaggtgttaatgaatga

SEQ ID NO: 620 - DNA, 1512 bp, Staphylococcus epidermidis
ctaaaatcattaaatagaggagtatcttatagaatgaaaaaagcaatattaagcgtttctaataaaagtggaattgtagagtttgcaaaagcattaactaatttagactatgaactgtattctacgggtggtacaaaacgtgtattagaagatgcgaatatcaatattaagtccgtgtcagaattaacacaatttccagagattatggatggtcgtgttaaaacactacatccagcagtccatggtggtattttagctgatcgagataaagaacatcatttagagcaattacgagaacaacatattgatttaattgatatggtagtagtcaacctatatcctttccaacagactgttgctcaacctgatgtaacagaaactgatgcaatagaaaatattgatattggtggacctacaatgttaagagcagctgctaaaaactttaaacatgttacaactatcgtacatccttccgattacaacgaggtaattgagagaattaaaaatcatcaattggacgaagcatatagaaaatcgctaatggttaaagttttccaacatacaaatgaatatgatcatgctattgttaactatttcaaagacaataaagaaacactaagatatggcgaaaatcctcaacaatctgcatattttgttagaacatctgatagcaaacatacgattgctggtgcaaaacaattacatggtaaacaattgagttttaataatattaaagacgcagatgcagcgctcagtttagtaaaaaaattcaacgagccaactgctgtagcagtaaaacatatgaacccgtgtggagtaggaattggacagtcgattgatgaagcatttcaacatgcatatgaagcggataatcaatcaatatttggcgggattatagcattgaatagaacggtagatgttaaattagctgaagcattacattctatctttttagaagtagttatcgcacctcaatttactgaggaagctttaaaaatattgacacaaaagaaaaatattcgtttattacaaatagatatgacaattgataacgctgaacaagaatttgtttccgtttcaggtggttacttagtacaagataaagataataaagatgtgactcgaaatgacatgactgttgctaccgacattcaacctacagaagcacagtgggaagctatgctcctaggttggaaagttgtaagtgccgttaagagtaatgcagtgatattgagtaacaacaaacaaacagttggtataggtgcagggcaaatgaatcgtgtaggttccgctaaaattgcaatcgaaagagcaatagaaattaacgataatgttgcgcttgtttcagatggtttcttcccaatgggagatacagttgaatatgctgccgaacatggtattaaggcaattattcaaccaggtggttcaattaaagatcaagattccattgatatggctaataaatatggcattacaatggttatgacaggtatgcgtcattttaaacattaa

SEQ ID NO: 621 - DNA, 939 bp, Staphylococcus epidermidis
tactttaaattaatgatggggtgtttatcattgtttagaaagcaaaaccttaaatggttaggtgttttagctacgattattatgacctttgtacaattaggtggcgccctcgtaactaaaacgggatcagaagatggttgtggctcgtcttggcctttatgtaacggcgctctacttccagaaaatttaccaatacaaacaattatagaactgagtcatcgtgcagtatcagccatttcacttatagttgtattatggcttgtaattacagcttggaaaaacattggatatattaaagaaatcaaaccactctctattattagtgttggttttttattagttcaagcacttgtaggtgctgctgctgtgatatggcaacaaaatccttatgtattagcgctacattttggtatttcacttatcagtttctcttctgttttcttaatgacattaattattttctcaattgacaaaaaatatgaagctgacattttatttattcacaaacctttacgtatcttaacttggttaatggctatcatcgtatacttaactatttatacaggtgctttagttagacatactaaatcaagtcttgcttatggtgcttggcctattccatttgatgatatcgttcctcataatgcgcatgattgggtacaattttcgcacagaggtatggcgttcatcacttttatctggattatgattacatttatacacgctattaagaattattcagataatcgaactgtacgttatggttatactgcatcatttatacttgttatccttcaagttattacaggtgctttatcagtcataactaatgtcaatttaattattgcgttattccatgctttgtttatcacttacttattcggaatgattgcttattttattttactaatgttaagaacgacgagaagtctaaaataa

SEQ ID NO: 622 - DNA, 597 bp, Staphylococcus epidermidis
tacacctattcatttattggaggtagaatagtgaccaatatagcgatttttgcctcaggatcaggtagtaactttgaaaatattgtaaaacatatccaaacagggcaattatctggtatcaatgtaacggcactgtatacagataatgaaggggtaccctgtattgatagagctaaaaatttaaatattccaattcatattaacaagccaaaagacttttcatccaaatctttatatgaacagcatctacttaaattattatccagtgaggaagttcagtggattgtattagctggttatatgagactagttggccaagacttattacaagcttatgaaggacggatattaaatatacatccctcattattgcctaaattcaaaggtttagatgccataggtcaagcgttagaaagtggagatactgtaactggatcaactgtccattatgtagatagtgggatggatacgggagaaattattgaacaacagcaatgtgatataaaaccggacgatactaaagaacaattagaagatagagtaaaacatttagaatatgaactttatccaagagttatagctaaaatcattaaatag

SEQ ID NO: 623 - DNA, 1188 bp, Staphylococcus epidermidis
gagaggtattcatttatgaaacttgctacgctaaataaaggcaaagaaacaaagtatttaaaccactatccattaatagatgaagaagatttatttgaacatgatcatcttaaagaaggtgatttgataacactggtgacagagcaacaacaatatatagctactggatatattggaagacaacataaaggattaggatgggtattgagttataatcaaaatgaagagattaacactttgttttttaaacgtttatttgaagctgcattagaagagcgacaatactatttcaacatagaaggtacaaatgcatttagattatttaatgctgaaggtgacggtgtaggtggcctgacaattgataattataacggacatcttttaattcaatggtattcgaaaggaatatataaatttagatttcctatcttagaagcaatcaaagaggtatatgaatacacttcaatttttgagaaaatgcgttttaaaggtacttcctacactggtggctttgtagaaggtaatgctcctgaatttcctatcgttgtagaagaaaattttaccttttataatgtagacctaaacgatggtcttatgactggtatatttttagatcaaaaagaagttagaaaaaaattaagagatcagttttcagaaagacgacacgtacttaacttattcagttacactggagcgttttcagtaatagcagctgaaaatgcaaactcaacaacaagtgtagacttagcaaatcgctctagagggctaactgaagaaaattttggtttaaatggtattaatcctaaatctcaatatatttatgttatggatacgtttgatttttataattatgcaggacgacatggacatcaatacgatacaattgttattgatccacctagctttgcgagaaataagaaaaaaacattctctgttcaaaaagattataatttattaattgaaggagcccttaacattttatcgccaggaggtacattactattatgtacgaattcaagtgcattttctcttaaggcatttaaaaacgtaataaagaaaacattagcccaaaataatattgtatatgaaataaatgaagtaatggggttacctaaagattttaaaactcatcctcactacaaaccttcaaaatatttaaaagcagtatttgtaacaataaaacattaa

SEQ ID NO: 624 - DNA, 810 bp, Staphylococcus epidermidis
tttttattatctgttgaatgcattgatctatttggttgttctggtgcacctgattgtgctggcgtacctggttccactggtttacctggttccactggtttacctgattccgctggtttacctggttctgctggcgtacctggttccgctggtttacctggttctgctggcgtacctggttccgctggtttacctggttctgctggcgtacctggttccgctggtttacctggttctgctggcgtacctggttctgctggcgtacctggttccgctggtttacctggttccgctggtttacctggttccgctggtttacctggttctgctggcgtacctggttccgctggtttacctggttctgctggcgtacctggttccgctggtttacctggttccgctggtttacctggttccgctggtttacctggttctgcttttgttggaccatactcaacaatttcgtcaacaggttgtttagtgactttttctgttgatttaccttcgccaactttttctcctgtaataggattaactaatattggtgttgtaattgtttttgttcctggttcacctttttgtttaacgcgctcttcacctggttttaaatcaggattaaatacacgtttcttatcaaatggaatctcttccgttgatgtgattggattaccaactttcggaccatattttgtcacatcatccactggtggggtaacaacttcacctgtatcaggatttttaactcctggtttacctggaacttcagttttactatctacaggtgcatttggatcaaattcatctttatga

SEQ ID NO: 625 - DNA, 378 bp, Staphylococcus epidermidis
gtcatgacatctatagtagtagtaagtcatagtcataaaatcgcagaaggtgttaaacaattaatcaatcaaatgactgacggtggtgttgaccttattgccgttggtggcttaagtgacgatgaaatcggtacatcatttgatcaaatcgtctctgtaattaatggacttgaaaatgatgcgctttgtttctatgacattggttcagcaggcatgaatttagacacagctttagaaatgtacgaaggtgaccacaaaattgttaaaatggaagcgccaatcgttgaaggaagctttattgcaagtgtaggaattaaatcaaatatgagtatggatagtgttatctctgaagtaagagctaaatatcctgaagaataa

SEQ ID NO: 626 - DNA, 1617 bp, Staphylococcus epidermidis
aaacttggatcatattccactaatcccacaatcacgtgtatccaatattccacatcatcaatttttggagatgattcaatgaagacctataagccgtaccgacatcaattaaggcgttcgctatttgcctcaacgattttcccagtatttatggtgatgattattggtttaataagcttttatgctatttatatatgggtcgaacatcgcaccattcatcagcatacctatcaaactcaaaccgaattacaacgtatcgacaaacattttcatacgtttgttacgcagcaacaaaaacaatggcgtcatgttgatttatcacatccagctgatatcacaaagatgaaacgccaactattaaaacaagtccatcaacaacctgcgatattgtattacgatttaaaaggttcttcacaatctttcacaaacaattatgaacaattagacacaacaaagatgtatttaatatcaaaatatcgaattgattttaaagacgatacttatatccttaaaatatatatgtcaagcacaccactacttaaaaacattaagaaaaatagtggacaatctgcactcattgttgattcatatgatactgttttatatacaaatgacgaccgattctctatcggtcaaaaatatcaaccaccacagtttgggtttataaacgagtctttaaaactcaattctcatcatgcgcatcttattatatataaagatattcatgaaaccattgaagatggaattgcattactagttgtcatgggtgttgttcttattctgcttgttatttttggatatataagcgctgatagaatggcaaagcgccaatctgaagatattgaagcgattgtccgaaaaattgatgatgctaaaaatcgacatcttggtagttacgaaccgttaaaaaaacatagtgagttagaggaaataaataattatatctatgacttgtttgaatcaaatgagcaattaatacaatctattgaacagaccgaacgtcgtttacgtgatatacaattaaaagaaattgagcgacaatttcaaccccatttcttattcaatacgatgcaaacgatacaatatttaattcctctttcacccaaagtagcacaaacagtcatacaacaactatcacaaatgctacgttattctctacgcacagcatcgcacacagtcaaattagcagaagaattaagctacattgagcagtatgttgccatacaaaatatccgcttcgatgatatgatacagctttacatcgatgctactgagggtgtacaacatcaaacaattggtaagatgatgcttcaaccactcgtagaaaatgccatcaagcatggtcgtgatagtgaacctttaaagataacaattcgtatcagacttacgaagcgcaaattacatattctggttcatgataatggcatcggtatgtctccatcacatttagaacacgtgcgccaatcccttcatcacgatgtttttgatacgacacacctaggtttaaatcatttacataatagagccatgattcaatatggaacatatgcacgtctgcacattttctcaagaagccagcaagggacattaatgtgttaccaaataccacttgtctag

SEQ ID NO: 627 - DNA, 7215 bp, Staphylococcus epidermidis
tgtaagttgtttatgagttattatgggaatgaatatgaaagaaggactctaatgaatattgaagcactatattttcaaaaatatttttattttaaacatttaaatcaatcaagttcagaacacagggtgacatactgggtaaagttaagtcgcgacattgagttacgtagattaatgtatgcattattagatgtcgttcaaagtcaacctgtgttgcgtacacagtttgtgacagatgattttaatcaactcaagataaatttaagagatttttttccatttattgaaattaaagaagttaatgaaatgtcgcaaagcatagatttagaagcattctttacacgtaatttaaattcctaccatttcaatcaattacctctgtttaattttaagatttatcaatttcttgatgaagcctacctacttttagattttcacgctactatttttaatgaaagtcaattaactccatttttacaacaattaaatatcgcttatacccactctttaaaaagtgaatatagtatctcggatttttataattggattaaagaaatgaatcaaaagatggatcaaaatcaagttgtgtgtccatcaaagcacttcaacgtattgaatgcagacggtgataattacgcttacatacctgttaagaatacatgtgaaaagaaaaaaatgtgttctttgcatgcagaactaccatctttagacattgatgtgtggattgtaagtatttacttagcgcatcattttataagtcagtcttctgatgtgacgttaggcatccatttttcgatagataataaaaatactgagaatatgatggttttaaacacagacattgccccacttaatttaagtattagtcaaagtgacgtcgtaaaagatatggtagatgagtgttccgctctacttgaagagcttcaaatgtgtggtgcgtcttttgttgttcaacctaaagcagtacaaatagatgtagaaacgatgattcatattgaaaaagtacaagaacaatttgagcttaatcatatatgtcatcatatacatcgtctatacaatgaagcatcatcattcgcggatttagagttttatcctcatgtgcaggatggttttgatatagtttataatgacaacgtttatgatgatttaactgtacatacgttagtcaaattaattaatgggatttatatgcaaattacacaaaatccatcattattaattaaagatataaaactcagtgatcgctcagatttagctaaatataatgacatcaatcttcaaaacaatgacattaattatagtgaggtcacttataaaaccgtggttgaaagattcgaacgtcaagtgcaccaacatcccgatagtattgcgttgcaatatgaacaacgatcgatgacatatcatcaattaaatcaatgtgcgaatcttttagcatatagattgcgtttaaatcatcagattgaacctaatgatatggtggcattaatagcagaacgcagcttagaaatgattattggaatgttagggatcttgaaagctggtgcaggctacataccaattgatccggattatcctgaagaaagaatgaattatattattgaggacgcaaaacctaaagcggttgtaacatatcgtacatcatttcaatcaggtttacctcaaatggatatagaattgatagttgattcaagagaacatgatattgataacccgagaggcattaattgttcagaagatatcgcttatgtcatctatacatcaggaacgactggtaaacctaaagggacactggtgccacatagaggaattgatcgcttagtacacaatccaaattatgtcgaattgaacgaaaatacaaccgtcttattatcaggaacagtagcttttgatgcagcaacctttgaaatatatggtccattattgaatggtggacggttagtcattacatctaaagatacgttgttaaatcctcaattgttagatcaagctattactgaaaataaagtcaacacgatgtggttaacgtcatctttatttaatcaaattgctagcgaacgtatcgaagcactagaatctttaacttatttgcttattggtggggaagtgttaaatgctaaatgggttcacttattaaattcgcgtgagtgtcatcctcaaataatcaatggttatggaccgacagagaatacaacatttactacaacttttgcgattccacaagagatgccttcacgtatacctattggtttacctattagtggaacgacagtttatgtcatgcaaggtgatcgtatttgtggcgtaggtgttccaggtgaattgtgcattggtggtgcaggtttagcaaaaggttatttaaatcaacctaaacttactgctgaacgttttattcagtcaccttttaataatgaaatgctttatcgaagcggtgatttagttcgccttcaagaagatggctatattgattatattagtcgtatcgataagcaagttaaaatacgtggttttagaatagaattatcagaaattgaaaaagcattagaagctatacgtgatattaataaagctgtagtcatcgttcgagagcaagaccaagataaacaaatagtggcatattatgaagcatcgcaattaaaatcaacaggtcaattaaaagatattttaagtgaaacattacctgaatatatgatacctgtacattttatgaaggtagatcgtatacctatcacgatgaatgggaaattagatgtgcgtgcattacctgaaattaatctaaagaataatagaaattatgtagaaccacgtaacgatattgaacgcactgtttgccgtattttcgaagagattttacatgttgatcaagtaggtgttaaagataatttctttgaactaggtggacactctcttagagcaacattagttgtaaaccgtattgaagaaaggttaaaaaaacgtcttaaagtaggtgatttaatgaaatcgcctactgtagagcaacttggacaacaaattgaagaactgcaaaatgatgtctatgaagtgattcccaaagcaaatgaatcgtatcaatatgatttaagtgcgtctcaaaaaagtatgtatcttttatggaaggtcaatcctaaagacacagtgtataacattccattcttatggagattatcttctgaacttaatgttatgcaattgcaacgtgcattatctaagttgattgaacgtcatgaaatattacgaacacaatatgtaattgatgacaatgaagttaaacaacgtattgcgacacatgtttcgcctgattttgaagaggtaacgacatctctaacgaacgagcaagatattattcaatcatttatggaaccgtttgatttagaacaaccaagtcagatgcgagttaaatatatacatggaccacaacaagattatttatttatggatactcatcatagtattaatgatggtatgagtaacacgattttactatctgatttgaacgctttataccaagataaatcattacctgaacttaagcttcagtataaagattatagtgagtggatggtgcacagagacttatctaaacaacgtcacttttggttacagcaatttgaaaatcaggttccaatattaaatatgcctacggattatcctagaccaagtattaaaacaaccaacggtaatatgttgacgtttcattacaatcgtcaaatcaaacagcaattgaaatcttatgtagaacaacatcaagtgacagactttatgttctttgctagtgcaatcatggtattattgcacaaatatacacgtcaggacgatatcgctattggtagtgtaatcagtgcgcgtactcatcgcgatactgaaaatatgttaggtatgtttgctaatacacttgtatatcgtggtcgaccacatgatcaaaagacatgggatcaattgatggctgagatgaaagagatgtgtctaggggcatatgaacatcaagaatatccttttgaaagcttagtcaatgatcttgttgatgaaagagatgcttcacataatccgttatttgatgtgatgctcgtacttcaaaataatgaaacaaatcatgcgaattttggacatagtcaattgacacatattccacctcagtcaacaacagctaaatttgatttgtcatttattattgaagaagatcaagatgactatgtcgtcaatattgaatataatacagatttatataaacaagagaccattcatcatattgctgaacaacttcaaatgattattaaacatgtaatatctaccgaaaacctaaaaattcaagatattgatgaaaatgatgacttattaatttggttggacaagcatgtgaatgattgttctttagacttgccaaaaaataagtcaatacagcaacttttacatgatgtcatgaaagcgaaagcagatgatgtagcacttaaaatgaatggacaatcgatgacgtatcaagaacttgatgattattctaatagtatggctcaaacattgatacaaaatggcattcaaaaaggggaacgtgtagcccttttaactgaacgaagttttgaaatggttgctagtatgattgctgtattaaaagttggaggttcttatgtacctattgacgtcacttatcccgataaacgcattgaatttattattgaagacgctgaagtcgcagcagtgctcacatatggaaaagcaatatcctcacatataccagtaattaaaattgaagatattgataacactgaaaataataaaaggttaaatatagaatatgcagggaatttggaagatgatatgtatcatatttatacatctggaacaacaggaaagcctaaagcagtatcagtgaaacaacgtaatatattaaatttagtatgtgcttggacaaaaagactcaatttatccgatgatgaagtctatctgcagtacgctaattatgtgttcgatgcttcggcaactgatttctactgtagtttattaaatggatatccgcttgtcattgcaacatcagttgagcggaccaatacagatttattagaaaagttaatttcacaagaaaatatcaccatcgcatctattccactacaggtatataatgtgatgcatcatttctatattcctaaagtgattacaggaggtgcgccaagtactccagcatttgttcaacatatttctaagcattgtgatatgtacgttaatgcctatgggccttctgaaaatacagttatcacatcttgttggatatacgaaaaaggtgacgccataccatcgactattccgattgggaaaccgttagctaatgttgatatttttattatgtcaggcggtaaactatgtggcgttggtattccaggtgaattatgtattgcaggagaaagtttaacttcaggatatttaaacagacccgaactttctgctgaaaaatttataaataatccttttgggccaggacaactttatcgaagtggtgatttagcacgattgatgccagatgggcaaattgaatttcttggtagaatagacaagcaagttaaagtacatggctatcgcattgaactaggtgaaattgaaaatatcattaattcagtagatactgttacagatagcgttgttattttagctaaacagggtgagcgtgaagtgctgcatgcttattatgttggaagtcaagaagatgaaaatcatatttcacaacatttaaatcaatatttgcctaaatacatgattcctaagacattaacagctattagcgaaattccattaacaggaaatgataaggtggatgagtcaagattacctgtacctaatgtacacaaaaataaatttgttgcaccacgtaataatatcgaacgagaaatagcacaaatcgttagcggagtgttggacgtatcgtctatgagtatagatgatgacttctttgaaatgggtggtacatcactagatgctatggtggtagtatcaaaactaaaatcaaatggcatacacattacaatgcaagatgtatatcaatttaaaactgttcgttatatagctaatcacacagaaaaacgccaagcactaccagaagtagtattaccagatcatctaccacaattacaatctttggttgaaagacgataccaactaaaatcacaacacctaacgcaatcatctctaggtcatgtattgctaactggtgcaacagggttcctaggcgcatatttaattgatgaaatgcaagatgatgctgatcaaattacatgtattgtcagaggtcatgatatcaatcaagctaaaactaacttggaaaataatttaaattgttattttgatacggctcatgtggataaattaatgaagcacattgatattattttagcggatttatcagaacttgaccatcttattatcgattcagccattgatacaattattcatgctggagctcgtacagatcactttggcgatgatgaaacatttttcgatgtcaatgtaagaagtacacaagcattaattgatttagctaagaataaaaaagcgaaattaatctatatatcaacgataagtgtgggtacggtatttgaagtacatcaagacgatattacattttctgaaaaagatttatataaaggccagttatttacatcaccatacactaaaagtaagttttatagcgagattaaagtgttagaagcggttaatgaaggtttagcagctcagattataagattaggaaatctgacaagtgcttctactggaccattaaatatgaaaaatttaacaactaatcgttttagtattgtcatgcatgatttattaaaaatgccgtttataggagaaagtatatcgaaagctaaagttgaattttcatttatcgatgtcacagcgcgccatattattaaattggcaagatccaatgcaatacctattatttatcatgtatacgcaccatgttcgataactatgaaacaagtaattgacaatgccaaagggtcagaaatgactgtagtaagtgatagtgagtttgaacagaaattacatgaattaggtatgcatgaattgattggtcttaatagtaatggagataatcaaatttcaggtgtgacagattcaaatatgactcaaacagtaatgaaagaattacaaggtgagtggccacatctttcttaccaatggttgcagcagtggtaccatttattgtttgaaaaatttgatgccaactag

SEQ ID NO: 628 - DNA, 939 bp, Staphylococcus epidermidis
gcataccatcccttgaaaaatggtgtagaaaataaatttttaataattagtatgtactttaatttaaaaataaaaaggatgaataaaatgaaatttaaaaaatcactcataacagctttagcaaccataactttggtaccatcattgatgattttagatacacagcatgaggcaaaagcagtaggaaattattattacaatggcatggaagatcataatgcgagtgctgcatatcataaagcgaagaaagttgataatagtcaaatagtcataaaacgttataactatgcgcataaaaataaatataaagcagtaggaagagtatcgaacatggatggttggaaaggtccaggcaaagatagtatgggaacaggatttatggtaggcaatcatacgtttgtaaccaatgcacatgttgtagataagaaaaatggtcaaagaacgagtccgagtaaaataaaatttcaattaaacagagacggtaaaaagataccctatcaatttcatgctaaaaagatatataaaatcccttcatacgatatggttgtcgttgaaactaaagaaaatatggctcaaaaagctaacgtgcaaccacttaaacttgcaaccaatcaaaaaattaagagtttaaaatttaacaagaaattatattctttaggatatccagtgatgaacgggaacaatacatatgcatactggaataagttacgttttttacaagaagcatcgaataaatcagaactcatgacaaaagataaatttagagctggtgattcaggatctcctatggtagatagccagtacgttgtttatggggttcgtacgtatggatataatttaagaggtagttctaatcatccttatgcccaacaagaagttgcaggtgcagaatcattatatggtaatccaagagattttattcttaagcataataagtaa

SEQ ID NO: 629 - DNA, 216 bp, Staphylococcus epidermidis
attaaagtaccgccattcatattaaacaacaacatcccatccttacgtatcattgaaaacagaatacctggtgcaagctgtgtaggtacatctagtagccataataaaggtatgaatgcatttgatataaaagtcaaaataggcgtaagagacaatagacttacaataaggcaaattcctataaaaataggtaaggcttgtacaataaacatttga

SEQ ID NO: 630 - DNA, 624 bp, Staphylococcus epidermidis
ttgaaaaagtttttaaaaggatttattttattttttctcattgtgatgctaggatttgcagggggattgggatacagtcattataaagattcaaaagcaaacactgatgtatcttcaaaagagactcagacttcaaataaaaatactcatgaagatacaatttcacaagatgaaatgcaaaatcaagttgatagccaaacaaacgaagtatcaaatgagacatcaactaaaacacttagcgaaaaagcaaagcggttaagagaagcttttaacgttaatgatgaggaagctcaaatattagcagatgaaatcgatagagcagatgtaaataaagatggcacgattactatggatgaaatgacgcctactttagatcgttttgcaaaagaagggaaattccaaccatctgcaggtggcacaactaacgaagcacatcatcctaaatatacagcagaagatgctagaaatatgtcagatgatgaatttctagacgcgtatacagaaggcatgtcagatgatgaagctgcgacaattcacgaaagtgctcaagaatctaacgagtatatgaaatttttaagaggacaagttgaagcacgtgcaaaaggacagggcggtaattattaa

SEQ ID NO: 631 - DNA, 963 bp, Staphylococcus epidermidis
atgaaaaagttaattcaagataaaaacacaattttaaaagatatgcttgatggaattacagtttcaaacaacgatgttgaagttgtatctgacactattgttgttagaaagcataaaaaacaatcaggtgttgcactcgtttctgggggcggcagtggacatgaacctgcacacgcaggatttgtagcagaaggcatgctcgatgcagctgtatgtggagaaatcttcacttcacctacacctgataaaatattagatgccattaaagctgtggacaatggtgacggcgttctacttgttattaaaaactatgcaggagacgttatgaactttgaaatggctcaagaaatggctcaaatggaagatattaaagttgaaagtgttattgtcagagatgatattgctatttctgacccggaaaaacgccgtggtgtagcgggtacagtatttgtgcataaatatgctggatacctagctgaaaaaggtgttgcacttgatgaaatcaaatctaaagttgaggcacttttaccagatattaaaagtattggtatggcattaacgcctccaatggtgcccacaactggtaaaaacggtttcgatattgaagacaatcaaatggaaattggtatcggtattcacggtgaaaaaggtttacatcgtgaagacgtacaacctattaacgtgattgttgaacgtttactcgatcaattatacaaagaaattgagaaaaaacctttaatcgtaatggttaatggtatgggtggtacgccactatcagaattaaatatagttactaaatatctagatgaacaattcaatcagaatgatattgatgttaaacaatggttcgtaggtgactatatgacagcattagacatgcaaggcttctctataactgtactccccttcagtgaagaattgagtgaagctttagctgcacctacagcaagtaaatatttttaa

SEQ ID NO: 632 - DNA, 843 bp, Staphylococcus epidermidis
tgggaaaagttatttcaacggcgcaccgtggctcttcttcttccctggtgtattgttaggaggtttcgccttattatgtcaaattatcaacaaaaaaataacgcagtaaatacggtagtcaacgtcaatcaattatcgattttagatcaagagaaagtattgttaaaggatgttgatttgacagtaactaaaggtgcatttcattgcattataggtgaaagtggcagtgggaaatcactgttaacaagaacaatacttggaatgaaacaatcacaattatgttatcaaggagatattgacatcgatttaactcaaacagatgcagtgtttcaagatgttcaaagtaatatgtttcaaaatataacattagctaagcatttccaatacatttatgaagccaatcgcacacatctcactaaacagcgtattaaggaagatgtcttacagatgatgcaattacttggtttaagacaaggggaacaattgcttgagcgttatcccttcgaacttagtggaggtatggcacaacgtgtcgcctttataatgtcattaattagacgtccgaactacttatttttagatgaaccaacgagtgcacttgatcaagaaaatattaaaaagtttatgcattaccttcttagggcacaggagcgctaccaaatgaccattgtttttatcacacatgatattaacttagtgaaagattgtgccacacatattagtattatgcagcaaggtaaattgatagaaaatggtgaggccgcgtcgatcttaactaagccgacacataattacacgaaaaaattaattacgattgcacatcggagacaaccttatgcttaa

SEQ ID NO: 633 - DNA, 231 bp, Staphylococcus epidermidis
gctcccattacaattccaattacagtattcgtcgcccccaagtcatgtcctcttagaggtatgaaaacattgagtatggcattcgcactaaaaaacatcaatgttaaaatatataatcttaaaaaaggccaagacatggcacctttcatattgtcactccttagattgatagttgtttatcaatcagttctcttgtataaccattttgttgcctatgcaattcacttatag

SEQ ID NO: 634 - DNA, 984 bp, Staphylococcus epidermidis
aagaaggagttaaagattatgacattaaacctagctcaacgtgtgttaaaccgagaaccattaactaaagaagaagcattaacaatttttgaaagttccgaactagatacatttgatttattaaatgaagcctacacagtgagaaaacattactatggtaaaaaagttaagcttaatatgatattaaatgctaaaagtggtatctgtgcagaagattgtgggtactgtgggcaatctgtaaaaatgaaagaaaagcaacgttatgcacttgttgaacaggaccaaattaaagaaggcgctcaagtggcaactgaaaatcaaatcggtacatactgtattgttatgagtggtagaggtcctagtaacagagaagtcgatcatatttgcgaaacagtagaagatattaaaaagatacacccacaactaaagatttgtgcgtgcttaggattaacgaaagaagaacaggctaaaaaattaaaggctgctggtgtcgatcgttataatcataatttaaatacgagtgagcgttatcacgatgaagtagtaactacacatacatatgaggatagagtgaatacggttgaaatgatgaaagataataatatttctccttgttcaggtgtgatatgtggtatgggagagtcgaatgaggacattattgatatggcatttgctttaagagccatcgatgctgatagcattcctattaattttttacatcctattaaaggaactaaatttggtggattagatttattgtcaccaatgaaatgtttaagaattatagcgatgtttaggttaatcaatccaacaaaagaaattcgaattgcaggtggacgggaggtaaatctacgttcattacaaccactcgcattgaaagcggctaattcaatttttgtaggagattacttaattacaggcggtcaaccgaatgaggaagattatcgcatgattgaagatttagggtttgaaatcgacagttaa

SEQ ID NO: 635 - DNA, 390 bp, Staphylococcus epidermidis
ttccgctggtttacctggttctgctggcgtacctggttccgctggtttacctggttctgctggcgtacctggttccgctggtttacctggttctgctggcgtacctggttccgctggtttacctggttctgctggcgtacctggttctgctggcgtacctggttccgctggtttacctggttccgctggtttacctggttccgctggtttacctggttctgctggcgtacctggttccgctggtttacctggttctgctggcgtacctggttccgctggtttacctggttccgctggtttacctggttccgctggtttacctggttctgcttttgttggaccatactcaacaatttcgtcaacaggttgtttagtgactttttctgttga

SEQ ID NO: 636 - DNA, 429 bp, Staphylococcus epidermidis
atggaaataacaagtgttaatcatatttgtttttcagtgagtgatttaaatacctctatacaattttataaagatattttacatggtgacttattagtatcaggtagaacgacagcatatttaactattggtcatacttggattgcactgaatcaagaaaaaaatataccaaggaatgaaataagtcattcctatacgcacattgctttctccatagatgaagaagattttcaacagtggattcaatggcttaaagagaatcaagtaaatattttaaaagggcgaccaagagacattaaagacaaaaaatcgatatattttacagatccggatgggcataaaattgaattacatactggaacattaaaagatagaatggaatattataaatgtgagaacacgcatatgcaattttacgatgagttttga

SEQ ID NO: 637 - DNA, 822 bp, Staphylococcus epidermidis
aagcacgtgacactgcttaaagtagcacatttaggaattaaggacacatggtcagatgagacgctcgttgataacgtgaatttcacagttcaatgtggagaaacattaggtattattggagaaagtggaagcggaaaatcgattacttgtaaggcattaataggtttaaacgctcaacgtttatctgtaagcggagatatcttttttgaacatcaaaatttaaatacaataactgaaaagcaactacgcaaaattcgtggtaaagatattgcgatgattatgcaacaaggaacacgggcatttgatccttcaactaaagtgggaaagcaaatgattgaaactttgcgtgcacatacgacattatcaaagcaacaaataaaacaagaacttattcattatatgacgtatatgaagttgaaagatcctcagtcattattaaaagcatatccctacatgttgtcaggtgggatgcttcaacgtatgatgattgcactagcattagcattgaaacctaaattgatcattgctgatgagccgaccacagcattagataccatcacacaatatgaagttatcaatgcttttaaagatataaaacatcattttgattgcgccatgatttttatatctcatgacctcacagtgattaataaaattgcagaccgtgttgtagttatgagagaaggtcgtgtgatagaagaaggtcgaacaaatatggtattacaacaacctcgtcatcactatacagcttatttattatcaactaaaaagacaatttatgattattttcagtttgtgctgaggggtgatttcaatgcttaa

SEQ ID NO: 638 - DNA, 930 bp, Staphylococcus epidermidis
tttcattatttaaaggagagaaacgaaatgaaaagacactttttagcaatcggagcaattacaataacaacattacttgcgggatgcgattttggagatttggtaggacagcatcagtctgataagcaatcagaaaatagtaacactcaaaccgagcaagcttcaaataataaaaattcaaattctgataatgatcattcaaataataacgatgagtctagagatagagtggaagatttaactcaatcgcagaaggtagcattagctatcaatgatccctcagtttctcaatatgtcgttaatgcaagtgaattaaggaatcattcattttatgcaaattataacggcggaggccaacgtaaaagtattcatacgtataagttggaatcattacccaaaaaagtagaaggtgcacctaatgatatgacattctatactgcaaaaccatcaaaagggtcatttgttactcttatcggtattggtaatgaaaaggtattaattgcaggcacacaaagttcaggtacatatcaacaatatgctcattcggaagcagcaagagaattagatttacatgaattattagataaatacggtaaaagttcaaattataaaaatctagcaaatcaaattacgtttacacaaggtcaattatcaaatgcaagtgaatatacatcagatgaagggacgtctaataatgatgcatctaatgatgacaaagttactcgtgataatgtaatagataaagttgaagcgtatgaaggtcatcagctagataccgatacgtatacatttaaagaacccgaacagaacgaagacggagattggggattttctattttagataaggaaggcaatcttgaaggttcttatattgtgacatctgatggtgaagttacaaaatacgatgaaaacggggaagaaatagagtaa

SEQ ID NO: 639 - DNA, 198 bp, Staphylococcus epidermidis
ttattatatttcaagattattatagtttttaaatacatcattttagtaataagtatattaattgttagtgagataaaatttaatagtactactacacaaaaaagagagggcgaattcgttctctcttttcttggatttttaaaagtgaataaaaaagtattaagcaacggaatggagctacttaatattttttcataa

SEQ ID NO: 640 - DNA, 984 bp, Staphylococcus epidermidis
gtgttatatttagaaatgacttactgctcattatctataaagatttatacattgaaaatattgattgttttaacaataggaggtcatgttgttattatgagtcagtttaaggacacattatataaactatttgagccaatgatgaaaatagagttctatcaaaatctattggttaatcttttaattatacttgcttatatcttgatgggtatgattgtaattgcgatatcaagaaagttagttactaaatttttcaacgttaatgaaaagaaaaagaaccgtcataaaattaaaagaagtgaaacactatccacattgattcaaaatttaataagttatgtcgtatggtttattgtccttacgtcaatactttcacgtttcggtattagtgtatcagcaattttagcaggagctggagttgttggtgttgccgttggtttcggagcacaaacaattgtaaaagacattattactggtttctttatcatatttgaaggacagtttgatgtaagtgattatgttcaaattaatgcatctggggtaacaattgctgaaggtacggttaaaacaattggtttaagatcaacacgtatacaatcagatactggagaaatttatacattacctaatggtatgattagtgaaatagtcaattattctgctacagatgtttcacctattgtgatgataccgatttctccaaatgagaattataaagtgatagaagagaaattattaacatttttacctacattaaagaataaatatgacatatttgtatctgcaccagatttacttggtttagacagtgttgatggcaatgaaatggtgattaaacttttagcacatgttaagcccggaatgcattttccaggacaacgtttgcttcgtaaagaggtcatacaatacttcagtgaagaaggcattcatattccaaaaccaacacttgtaaaacttgataaagaattgaataaaaaagaatag

SEQ ID NO: 641 - DNA, 627 bp, Staphylococcus epidermidis
atcatgtatttgtatgtgactaagatgacagaaactttagaggaagtagaattgcttttaaatagaagttctcgtcagttgaaaaagccagaacgaatacactatagatttttaaaggatcgacttatgcaccaattaggtgatgcattgattcagtatgctattgaacaatgtgctggattaactcctaaagaatgggagtatcacatcacaactatgggtaaagtagagatacgaagttcttgtcatatatacgtgagtatttcgtatagttatccttatatcatttgtataatagataatcagcctattggtattgatatcgaagaaatgaaagacttggattataaacatttggcgaagaattttacaaaaaatgaatttaaccaagtgactacacttaaagatttttatgaaatttggactaagaaagaaagttatacaaaactcatcggtgagggattgatgaatggtttagactgctatgatgtgacgcaaaatttgagatttttaaaaaaacatgtccaatttacctcagtagattattttaaaagactcattcaaatatgtcatatgagtaaacatagtttgaactttgaagtggtgccgctcacacaattattataa

SEQ ID NO: 642 - DNA, 879 bp, Staphylococcus epidermidis
caatttaatttgaaaatttacattaaaaaggagtgttttatgcaacgtcaagtggtcgaattttcaaaatataatccatctgggaatatgacaattcttgttcattcaaagcatcaaccgagcgaatatgctgcgattgcacatcagttgatggcgacaacacacatgtgttgtgaacaagtagggtttattgaatcagtaaactatgaaaatggggataactatcacttggtaatgagtggaaatgaattttgtggtaatgcgactatgtcttacattcactatttaaaagaacgtttattgatacagcatcaacaatttcaattaagagtttcggggtgttctcatcctgtagagtgtaaagttcattcgcaacattatgaagtgactatgccaaaagtacatcaagttaaggaaagatttgtgaaattaggggaacagcagtttaaagcatttgaaattagctatgatacatacattcactatgtgatgatgtgtgatgatgtagatttggcaataaaacagtgcgtggaagattttgtcagtgcgcaaacatggcatcgacaatttaaaacaattggtgtcatgctttttcaacaagataaacaattcatatatccactgatacatatacctgcaatagatagcttaatctgggaaaatagctgtggttcaggagcggcttctatcggtgtgttggttaattatctaacagatcatgatattcaagattacctagttaaccaacccggaggcagtattattgtctcatccagaaagtctggacaaaatgaatatcaaacaacgattaagggtcaagtttcaactgtcgcaacaggacaagcatatatagaacaggagacaatgacgcaaatatga

SEQ ID NO: 643 - DNA, 1512 bp, Staphylococcus epidermidis
tatataaatttagaaaggaacatgcacatgagtgaagcaaatcataaaaacatcgttgttgtaggtgcaggaattattggtacgtcagtagctacaatgctttcaaaagtaagtcctaactggcatatcgatatgtttgaaagactagaaggcgctggtattgaaagttcaaatgaaaataataatgctgggacaggccatgcggcattatgtgaattaaactatacagttgaacaagatgatggttcaattgatgcatctaaagcgcaagaaattaatgaacaattcgaattatctagacaattctggggtaatttagttaaaaatggtgatatttctaatcctgaagaatttatccaaccattacctcatatcagtttcgttatgggaccaacaaacgttaactttttaagaaaacgttatgaaacactaagaactcttccaatgttcgatacaatcgaatatacagaagacatggaaacaatgagaaaatggatgccattaatgatggaaaatcgtgaaccaggtcatcaaatggcagcaagtaaaattgatgaaggtacagatgtgaactatggtgcgttaacacgtaagttagcacattacttagaacaaaaatctaatgtttcattaaaatacaatcatgatgttgtagatttaacacaaagagaagatggcaaatgggaagttgtcgttgaaaatagagaaactaaagaaaaagtaactaaaatagcagataaagtgtttattggtgctggcggtcactctattccgttattacaaaaatctggcgttaaacaaagagaacacctaggtggtttcccaatcagtggtcaattcttaagatgtacaaacccagatattattaaacaacatgcggctaaagtttacagtaaagagcctcaaggtaagccaccaatgactgtaccacaccttgatacacgttatatcaatggtaaacaaacattattatttggtccatatgcgaatatcggccctaaattcttgaaattcggttcaaatctagacttattcgaatcaatcaaaccatataacattactacaatgttggcttcagcagttaaaaatgtacctttaattaaatattcaattgatcaaatgatcaaaactaaagaaggttgtatgaactatttaagaacatttattcctgatgctaaagatgaagattgggaactttacactgctggtaaacgcgttcaagttattaaagatagtgaacaacacggtaaaggtttcgtagtatttggtactgaagttgtcaattcagacgacaattctatgattgcattattaggtgaatctccaggggcttcaacatcattatcagttgtattagaagttttagagaaaaacttcgctgatgacaaagaagcatgggaacctgttgttaaagaaatggtaccaacatacggtcgttcattaattaatgacgaaaaattaatgagagaaacacgccgtgaaacttctaaaaacttacatttaaatagataa

SEQ ID NO: 644 - DNA, 1248 bp, Staphylococcus epidermidis
aataaatgttatattcagtttgaaagagttgcaaaaaactttagtaaaggagtactttttatgaagaaaaaattaagttatatgattaccattatgcttgcttttacgctaagtttagcacttggcctatttttcaatagtgctcacgccgactcgttaccacaaaagaatggtgcaaaccaaaaaacaactaaagtcactgtcagtaataaagacgttccagatgcagttcgcaaacttgctgaagaacaatatttatctcgtgtagctttattagataaagcttccaaccacaaagcaacatcgtatacacttggtgaaccttttaaaatttataaatttaataaggaaagcgacggcaattattattatccagtgctcaataaaaaaggagatgtcatttatgtagtaacaatttctcctaatccttcaaattctaaagcttcaaaacagcaaaacaattattccattaatgtttctccatttctttctaaaatattaaatcaatataaaaatcaaaagataacaattttgactaatacaaaaggatattttgcacttactgaagatggtaaagtgacacttgtgcttaaaacgccacgtaataatgaaaaaacatatgaaaatgccactgaatccactaaacctaaagatttaaatgattttaaacaaactgcatcagtaacaaaaccaactttagaatatcaaagtacacgaaatgaaatgtacgcagaatatgtaaatcaattaaagaatttcagaatacgagaaacacaagggtataatagttggtgtgccggctataccatgtcagcactactcaatgccacatataatacaaatcgatataatgcagaatcagtaatgagatatttacatcctaatttaagaggtcacgacttccaatttacaggactaacatctaacgagatgcttcgttttggtagatcacaaggcagaaatactcaatatcttaatagaatgacttcatataatgaagtagaccaattaacaactaataatcaaggtatagctgtattaggtaagcgtgttgaatcaagcgatggtattcacgctggacatgccatggctgtggctggtaatgctaaagttaacaacggacaaaaagtcattttaatttggaacccatgggacaatggtctcatgactcaagatgcacatagtaatatcattccagtatcaaatggcgatcactatgaatggtatgcatcaatttatggttattaa

SEQ ID NO: 645 - DNA, 897 bp, Staphylococcus epidermidis
gagaaaagatatagaattggatattttaaaaaagtacaaggcattggaaaggaagtggtaccaacagtagtcatagatttagtggatcaattaaaagtaaaatattcaatcaaattgatactagaagtattaaacatacctaaatcaacatattaccgatggaaaaacaaaacctataaaaatgataccgtaacacaaaaagtcattgaattatgtaaagctaaccactatacctacggttatcgtaagattacagcattgattaatcaatgttatacatcaccaattaatcataagagagtacagagaatgatgcagaagcatcatttgaactgccgagttagacctaaaaagacgacaagaataggtaaaccgtattataaaacggacaatttattacaaagacaatttaaagcgagttgtcccatagaagtattaacaaccgatattacttatttaccatttggtcattctatgttgtatttatcttcgataatggatatttataacggagaaattgtggcgtataaaatagatgataaacaagaccaaagtttagttaatgatacattaaatcaaatcgatatacctgaaggttgtatattacatagtgatcaaggcagcgtttatacatcttatgcttattatcaattgtgcgaagaaaaaggcattatcagaagtatgtcccgaaagggaacacctgccgataacgccccgatagaaagtttccatccctcgctaaagtctgaaactttttacatcaataatgagcttaatcgctctaatcatattgtaatagatattgtcgaaaagtacattaaaaactataataataatcgaattcaacaaaaactaggctacttatccccagtaaaatacagagaattaatagcctag

SEQ ID NO: 646 - DNA, 240 bp, Staphylococcus epidermidis
aatactttgtattgtacgagcaaaagaatatatataacaaacaatggaggacatcatgattttaactattttatttatctttttctgtattcgactcatcagcttaaagatatctatgcaacacgcaaaacagctaaaggtagagggcgcggtggaatatggtgtgaaaaattcaaaatatctagccattacgcatgtattaatttacatgagtgcagctatagaaacattcattcataa

SEQ ID NO: 647 - DNA, 513 bp, Staphylococcus epidermidis
cttgacgattttcacctgtatcaggtaattgatttttattatctgttgaatgcattgatctatttggttgttctggtgcacctgattgtgctggcgtacctggttccactggtttacctggttccactggtttacctgattccgctggtttacctggttctgctggcgtacctggttccgctggtttacctggttctgctggcgtacctggttccgctggtttacctggttctgctggcgtacctggttccgctggtttacctggttctgctggcgtacctggttctgctggcgtacctggttccgctggtttacctggttccgctggtttacctggttccgctggtttacctggttctgctggcgtacctggttccgctggtttacctggttctgctggcgtacctggttccgctggtttacctggttccgctggtttacctggttccgctggtttacctggttctgcttttgttggaccatactcaacaatttcgtcaacaggttgtttag

SEQ ID NO: 648 - DNA, 786 bp, Staphylococcus epidermidis
gaaaagaggtacgatgtgatgaaaaaatatcaaacgtacatcgcaataggttcactattgagtttgatggttgtattaattacgtatggtttaatgcaagacacgcaacatttgaacccacttgagtcacctaatggacaacattggttgggtaccgatcaattaggcagagacttcttagtaagactgattgtcggtagtcttgtcacattgagtttaacaggcatagtgattctattaagcgtttgtatgggacttatctttggcttaattgcaggcatagaaagacgatggttagatcaaatcatcatgtttgttgccgatatgttgctggctattccgtcatttattatcgcattagtcatcttaagtttagtaagtaactccatgataggtttgatacttgctttaacgattggatggataggacgttatttacgttacttcagaaatttaacgcgagatattcaaaaacgtccatttgttcaatatgcacgattgagtgggaactcaacattcaaaacgacagtaacacatgtgattccacatttattaagtagtatattcgctttggtaacggctgactttggcaaaatgatgctcagcatatctggacttgcttttctaggactaggtattaaaccgccgacgcctgagttaggaacaattctttttgatgggaaaagttatttcaacggcgcaccgtggctcttcttcttccctggtgtattgttaggaggtttcgccttattatgtcaaattatcaacaaaaaaataacgcagtaa

SEQ ID NO: 649 - DNA, 1482 bp, Staphylococcus epidermidis
atgatggatttttggtcttcaaaacgaggcaagatgttagaaatcactgtcctcgtgtttattacaatttttggtgtaggctctcaatttttttcaaatttagcctatagtttaaatcaaggtatccttcaaacatcctttggtattggctctcaatatctgattatcccctctgtattagctaatttcacttttgctttaggtataccgttggggcatacactcacacataaatatggattcaagcgtaattacttatgctttgtgtttatatttctcattggttcaatcttaggacttctatcttttaacttaatcattctgtctattgctaaaatgattcaaagtttcagttcaggtgtattattctttaccttgttacctaaacttttcttgaactttccaaaacaatatagaaatgtatttttattgatggttattgtaggtttatttggttcaaatgcgcttggaggattatctggtagtttatcattagaattagatcgttggcattggatttttgtagtaaatatcatctccgcgatattatgcttaattctaggcaacgtcatattaagaaaaaatgaatatcatcaaacatcagatattcatattagtcgatcaatgatgattactttagtattaagtaccatttctttaatgattcctatgtcacttcttactcaaaaaggctaccattcattatgggtgtggccgatactcttaattgcaatattttttattgtaaattttatcattacaaatcggcaagctacacatcccattgttcactttcatacactattcagtaaaaagcctttcgtcggtgcaacaatggcaatttcatcacatttaactttattaacaggcattgctggtatcaatgtctatatcgtaagaatattaaagttgccttttgatatttcattacatttctatttctttttctttgttggagtcattataacgggtatcttaaaaatgttcttttatagctctgtcggtgcaggttttttaggtacattgggatcgtcagccttactatatgtaagcatccattggattattctgggaaatacgattaacattccattactttatattcaaggtcttctgctcggcttcggtgcaagcatgaccttagttagtggctcgatggctacattattggacggagatttaaaagaagcagcacaacgttctcaaaccatgcatacaataagaaatttctctgctgctatgttgataccgattatagcttatacgattaagaatcatatccaaaaaggaacacagtctatatatgctgaaaacattactgataaaatgatttaccttaaaaagttgcaagatgttgcgattgatgctgatcatcaaatattcttattaatgattattttcaatatggtcatgttcgtttcttcaattatacaaatgattttaggtaaaggtagacgtattacaccacctcgggaatcataa

SEQ ID NO: 650 - DNA, 1434 bp, Staphylococcus epidermidis
aaggagtaccattctatgtctaacatttcgatgacgacttctaaacgtaatgctatcgttacggtaatgctcattagtgcttttgtgtctatgctcaatcaaactattttaaacactgcactaccagcaatcatcaaaggactgaacatcacagaaacaacagcacaatggttaattaccggatttatgcttgttaacggtataatgattccactcactgcctttttaatggataaatattcgacacgccatttatatattttctcaatggctatttttcttataggatctattgtagcggcattttcacctacgtttacaattttaatgatatctcgtattatccaagcgattggtgccggcatccttttaccattgatgcagtttacagtatttacactgtttcctgctgaacaacgtgggtttgcgatgggattggcaggggtggttgtacaaagtgcgcctgcaattggaccaacgttaactggattattcgtagatttatttagttggagaatgccattttatcttgtttcagcaattgctgcggtagcttttattttaggtttcttcttcgtagaaaataatacaaaaacaaaagacattgttcttgataaaatttctgtagtttattctactttcggctttggtttaattttattcgcatttagtagcgtgagtacgtttggtatcacctctctacctgtcattgtgacatttgtactcggtatagccattatcataatttttacaacgcgtcagcttaaattaaaacatccattgttaaatatgcgtgtgtttaaaaataaagtgttcacactttcagctgtttcttcaatgcttgtatatattacgatggtaagtcctgcgttactcatacctatttacattcaaacaggtttaggtcaatcagcattactatcaggtgtcgtcgtacttccaggcgcggtcattaatggattaacgatggtttatacaggaaaaatttttgataagcatggtattaaagtgcttgtgatacctggttttatcttactcattagtatgacattcttatattcattccttactacaggaacgccatattggtttgttattcttgtttacactataagaatgattgcgttaggattattagttatgcctcttaatacagttggactgaatgcacttgagtcagatgatgtctcacatggtacagcaattatgaattccttacgcatcattgcaggtgctatgggtacagcggttagtgtgacgattctatcaatagtggcaaaacagtatacagcttcacactcgacaatgtcaaaaatgaaactaacacaagaagcaactgtacatggtatagatgttgcatttatttttactacagtattaatcattattggatttatcttagcgttattcataaaagaagaaaaaaatcattaa

SEQ ID NO: 651 - DNA, 1395 bp, Staphylococcus epidermidis
tgtgaattgcacatgttaaaggtaacctttaatttacgtgatgggacgtttactgacattccagatgatgcacattactttttaattgaagactatgacaaattaactcccagtcagcaaactttattaaaacgttacattatcaaacatcaattagatatttcattacaacatgctattctttcatctccactccatagtttaaatatgattaaaaagttagagacttttgttaaggagagcaaagcataccatcctcaatttcacaatattatttgtggatggtgctttattgtacttatgtttgctttacccatctacttgtcttatcacgtttcagacggattacaatactacgtgtcacactggttaactaaactatcccaaatatcattatttcaagaaaataagctacaacatattttattcggtcattatggtgtcatttctttaggtacatattcattcgtctgggcgttaccagttgttttcatgattagtttatctacagctcttatagatataactcatttaaagcattatatcgtttggtctatcgaacctacgatgatgagacttggtcttcatggatcagatatcatacccttgttagaaggatttggatgtaatgctgctgctattactcaagctacacatcaatgtcatcgttgtacaaaagtacaatgtatgagcttggtaagtttcggaactgcatgtagttatcaaattggtgcgacattatcgatattcaacgcaagccaccgctcttggttgtttttgccatacataggcatggttttcttaggaggaatcatacataacaaactatggtatagtcatcaaacacctaagacaacaccatcagtttttcaacgacaactcgtacgttggcctaaaccaaacctactcttaaaagcagcgtggaaaagtattcaaatgtttattgtacaagccttacctatttttataggaatttgccttattgtaagtctattgtctcttacgcctattttgacttttatatcaaatgcattcatacctttattatggctactagatgtacctacacagcttgcaccaggtattctgttttcaatgatacgtaaggatgggatgttgttgtttaatatgaatggcggtactttaattcaaagactttccgcattccaattattgttgctagtcttttttagttcaacatttacagcatgttcagtaacaatgactatgctcatgcgtcgactcggttcaattctaggaattaaaatgataatgaaacaaatggtatcgtccacaatttgcgtcaccatactagtcatagcaatgttaagcataactaaaatttcagacttaggagtgatgttatggaaatcattattatcggtggttttttag

SEQ ID NO: 652 - DNA, 663 bp, Staphylococcus epidermidis
ttacgattgcacatcggagacaaccttatgcttaaaatagagagattaaccaaatatatagacacgcaactgatatttaaagagatatcatgtacaattaacgaccagcacttactcataagtggggagagtggttgtggtaaatccacattagccaagattatcgctggcttagatacggattatcagggcgaattatatcttaatgggcgcttacgtgaatcttatacgtctaaagagtggatgaagcacatccaatatgtacctcaatatcaacgtgatactttaaatcagcgtaaaacggtattagctacattattagaaccacttaagaattataaggtaaataaacagcgttatacatcaagcattgaagcagtgcttgatcagtgtaatttaccacacgatatacttaatcataaagtttcgacattaagtggtggccaatttcaacgcgtctggatagctaaagctttaatattagaaccagagattctcatattggatgaagctacaaccaacttagatgtcattaatgaagaagctatacttcaaatgttgatttccttaaagatgacacaattaatcattatttcacatgatacatacgtcttaagccaatttgaaggaattcagttacagctaaataaattgaataattaa

SEQ ID NO: 653 - DNA, 384 bp, Staphylococcus epidermidis
acaatgaagcaccacagatgtcttctacattgcaagcagaagaaggaagcaatgcagaagcacctcaatctgagccaacgaaggcagaagaaggaggcaatgcagaagcacctcaatctgagccaacgaaggcagaagaaggaggcaatgcagaagcacctcaatctgagccaacgaaggcagaagaaggaggcaatgcagaagcacctcaatctgagccaacgaaggcagaagaaggaggcaatgcagaagcacctcaatctgagccaacgaagacagaagaaggaagcaatgcagaagcaccgaatgttccaactatcaaagctaattcagataatgatacacaaacacaattttcagaagcccctacaagaaatgacctag

SEQ ID NO: 654 - DNA, 846 bp, Staphylococcus epidermidis
ttatcatttaagaatgatactggaggaatgaagatgacaaatcgtttaatattattcgactttgatgaaacttactataaacatcgtactaatcaagcagatattccttatttaaaagaaatggaaagtttattacagaatataactgctaaaaacaatgtcattacggcgattttaacaggaagtactatagaaagcgtactgaaaaaaatgagtaaagttaatatgtcatataaacctcaacatattttttcagatttaagttctaaaatgttcacatggaataactgcgaatatattgaatctgatgaatataaaaacgaagtgttgatagaaccgttcttattggaagatatattagatatattaaaacacgtttcttctaaacataaagtagagtttataccgcaaagaatttttcgagaaaatgaaacattgtataatttttatctttattcttcgggtgacacgcatttagataaaacaattttagaagacctcagtcaatattctaagacaagggattatacgatgacatttaatcgttgtaatcctttagcaggtgatcctgaaaatgcttatgatattaattttactccaaagaatgcaggtaaattatatgccacaaaatttttgatgaataaatatggcgttccaaaagaattgattattggctttggtgatagtggtaatgatgaagcgtttttaagttatttagatcacgcaatgattatgtctaacagtcaagatgaggaaatgaagagtaaatttaaaaatacaaaatatccttattacaaaggtatttatacacatgtacgtgaatttatagaatatgaaaatgtttaa

SEQ ID NO: 655 - DNA, 915 bp, Staphylococcus epidermidis
tgcaatattaaatccgcgtttaagggaggcaatgaaatgattgtgttacgtcgtctatttcaagatagaggtgccatatttgctatagctattattacaatctacgtagtgcttggagttttagctcctttaattacattctatgaaccgaatcacattgatacagcaaataaatttgctggtataagttggtctcactggttgggaacagaccatttaggtcgagatgtattaacacggataatatacgccataagacctagtttgttatatgtatttgtcgcattgattatttccgttgtgataggagcgatacttgggtttatttcaggttatttcccaggttatatcgatgcaataattatgcgtatatgcgatgtgatgttagcttttccaagctatgtggtcacattggcattgattacgttgtttggcatgggtgtagaaaatattattattgcatttatattgactcgatgggcgtggttttgtcgcgtgattcgaaccagtgtaatgcaatatattgaagctgatcatgtaaaatttgccaaagtaattggtatgaatgatttaacaatcattcgcaaacatattttgccactaacctttactgacatagcgattattgctagtagttcgatgtgttcaatgatattacaaatgtcaggattctcattccttggattaggtgttaaggcacctacagccgaatgggggatgatgcttaatgaagcacgaaaagtaatgttcacacatcctggaatgatgatgacaacaggtgtggctatcgtcataattgtgatggcgtttaactttttatcagatgctttacaaatggcgattgatcctcgtatgtccgctaaagaaaaacgactggctctgaagaaaggtgtgaaagcacgtgacactgcttaa

SEQ ID NO: 656 - DNA, 1425 bp, Staphylococcus epidermidis
aagcattgtttaattatccatctcaagcaactgacgaaacacaatggcgatgtgaagaactacaaacacgaccgaagcagatttttgatattgcactttatcgtaaagtggcatcaaaagttggtgttgaacatgtctaaaatattaatggttggtagtggaccggtcgctattcaacttgctcgactatgtaacttacatggggaacatatggttgatatggtgagtcgcgttcatgcatcaaccaaatctaagagagtctttgatgcgtatcatcgtgacggctttttttcagtaatgactcaaaatgatgcacatcagtgttttttaggtaagtttacggttagacatttttttaaagatgttaaagacattacacaatattatgacgtggtgattttagcatgtactgctgatgcgtatcgaccgatattacagcaattatctaagtccacattaaaacgtattaaacaaattatcttggtctcgccaacattaggatcacatatgcttgttaagcaaatactatcagatgttcattgtgaaggtgaagtgatttcgttttccacttatctaggcgatactcgaatatttgataaagcacaaccgcattgtgtcctaactacacgagttaaatcaaaattattcgtaggttcgactcattctcagtctattacattgtataagcttaagtctttattcgactatttgaatatagaattaacaacgatggacacaccgctacatgcggagatacataatagttcactttatgtacacccaccattgtttatgaatcaattttcattaaaggcggtatttgaaggaacgaaagtgccagtatacgtatataagctatttccagagggtccaattacaatgaccttaatacatgaaatgcgattaatgtggcaagaaatgatgatgatattaaaaaaattaaaggtaccctcggtcaatctcctgaagtttatggtgaaagaaaattaccctatacgtgatgagaccatgcgcgaagttgatattgaaagctttgaaaatttatcagctattcatcaagagtatctactttatgtgcgatatacagcaattttaatcgatccattttctaatccggacgatcaaggtgcatattttgatttttctgccgtaccatacaaacatgttgatactgatgaacaaggagttatacatataccacgcatgccgagtgaagattattatcgtactttgatgattcaagcaattggaagagcattaaacgttgcaacaccgatgattgacacattgttattacgttatgaaactaccgttaaacaatactgtgatacacatttacatcaacaactatcaaagcaattcgaattacatcattttaaacaggatttagcgttagtgacgaactacttaactttttataaataa

SEQ ID NO: 657 - DNA, 1137 bp, Staphylococcus epidermidis
tataaatataaaagatgttttggaggaatacttatgtctaaatttatttatcaatcaccaggaagatatgtacaagggaaaggtattgttagctctatcgctgaagaaacagaacgtcttggtagtcacgcgttgattattgcagatgaagtggtttggaatatcactgaagaaaaaataaaagaaagtttctcagcaaataacaacgttgattttgaatatgaagtatttaaaggagaatcttctgaagaagaaattcaacgtatagttaaacaatataaagaaaaaaacattgacgttgttattggtttaggcggaggtaaagcgttagatacaggtaaagctgtagcatttgaacttaaagcaagcgtcatcgattttgcgtctacagcatcaatggatgcaccaacagcagcagtatctgttatttataacgaagatggatcatttagtggttatgaattctaccctaaaaaccctgatacagttatcgtagattctgaaattgttgcacaagcacctgtacgtttatttgcatcaggtatgagtgatggtttagcaacattaatcgaagttgaatctacacttcgtagacaagggcaaaacatgttccatggcaaacctacattagcaagtttagcaatcgctcaaaaatgtgaagaggttatttttgaatatggttacagtgcttatacttctgtagaaaaacatatcgtgacaccacaagtagatgctgtgattgaagccaatacattactttcaggtttaggatttgaaaacggcggattagcaggtgcacacgcaattcataatggattcacagctttagaaggagatatccaccacttaactcatggtgaaaaagtggcatacggtattttagtacaattagtacttgaaaatgcgccaactgaaaaattcatgaaatacaaaacattcttcgataatatcaatatgccaacaacattagaaggtcttcacattgaaaacacaagttatgaagaattagttcaagtaggtgaacgtgcattaacaccaaatgatacgtttgctaacttaagtgataaaatcactgctgatgaaatcgcagacgcaattttaactgttaatgatttatctaaaagtcagttcaactaa

SEQ ID NO: 658 - DNA, 201 bp, Staphylococcus epidermidis
tttacagataatgccgtatatattgttgtcacaacagcgattccaaatgctgcacctagtgtagaagtcattttgataattcctgatgcagtacctgctttttcagctggaacattagatacagcagtagatagcgcgggagtagcaaaaaatcctaatcctagacctataaagataaagccaatacatgccacaatataa

SEQ ID NO: 659 - DNA, 1218 bp, Staphylococcus epidermidis
acaactatcaatctaaggagtgacaatatgaaaggtgccatgtcttggccttttttaagattatatattttaacattgatgttttttagtgcgaatgccatactcaatgttttcatacctctaagaggacatgacttgggggcgacgaatactgtaattggaattgtaatgggagcttatatgctaacggcaatgctatttcgcccctgggctggtcaaattattgcacgtattggtccgattaaagtattgcgtattatattattgattaatgctatggcactggtattatatgggtttacaggacttgaaggttatttgattgcacgtatcatgcaaggtgtgtgtacggcattcttctcaatgtctttacaattgggtattatagatgctttacctgagaaatatcgttcagaaggtgtatctctctattcattattttcaacgattcccaatttattaggaccattaattgcagttgggatttggcacgtggaaaatatgtccatatttgctattgttatgatttttattgcagtaacaacaaccttatttggttatagaactacttttgcaaatacacaaaaagaggtatcaccaaaagacgaagtcttgccttttaatgcaatgactgtatatgtccaattttttaaaaataaagcactcttctgcagtggtatgattatgatcttgtcatctatcgtgtttggtgcgatgagtacttttataccattatatacggttagggaaggtttcgcgaatgcaggtattttcctcacaattcaagccattacagtagtgatagctagattttatttacgtaagtatgtaccatctgatggtttatggcatcaccgttttatgatgattgtcttaacgttactgatggttgcttcagtcattgtagcttttggaccacatatagtgagtatatttgtatatataagtgcaatctttatcggaataacacaagcgctcgtttatcctacattgacaacgtatttaagttttgtcttaccaaagataggacgtaatatgttattaggattgtttatagcatgtgcagatttagggatttcactaggaggtgtgctaatggggccaatatcagatacggtaggatttaaatggatgtatattttatgcgctttattggttactattgcaatgacactaagtaaaattagacaaagacaaagtgtttcaaaagcctcatag

SEQ ID NO: 660 - DNA, 1026 bp, Staphylococcus epidermidis
ttcattcacaaggagttgttattgatgaaaaatttacgtaacagaagctttttaactttattagacttttcacgacaagaggtagaatttttattaacactctccgaagatttgaagcgtgccaaatatatcggcactgaaaagcctatgctaaaaaataaaaatatcgcgcttctttttgaaaaagattccactagaacacgttgcgcattcgaagttgccgcacatgatcaaggtgcacacgtcacttatcttggacctacaggttctcaaatgggtaaaaaagaaactgctaaagatacagcacgtgtacttggtggtatgtatgatggtattgagtaccgaggtttttctcaacgtactgtagaaacattagcgcaatattcaggtgttccggtatggaatggattaaccgatgaagatcaccctacacaagtgcttgctgactttttaactgctaaagaagtattgaaaaaagagtatgctgatatcaactttacttatgttggcgatggacgtaacaatgttgctaacgcattaatgcaaggtgctgccattatgggtatgaatttccatcttgtttgtcctaaagaactcaatccgacagaagaattattaaatcgttgcgaacgtattgcgacggaaaatggcggtaacattttaataacagatgatattgataaaggcgtgaaagattctgatgttatttatacagatgtttgggtatcaatgggcgaacctgatgaagtatggcaagaacgccttaaacttttaaaaccatatcaagttaaccaagcactattagaaaaaaccggcaatccaaatgttatttttgaacattgtttaccttctttccacaatgcagaaactaaaattggtcaacaaatttatgaaaaatatggcattagtgaaatggaagtcactgatgatgtcttcgaaagcaaagcttctgtagtattccaagaagctgagaatagaatgcatacaattaaagcggtcatggtagcaactttaggagaattctaa

SEQ ID NO: 661 - DNA, 768 bp, Staphylococcus epidermidis
ggtgggagcaaaatgcttaaaggacacttacactccgttgaaagtatgggcactgtcgacgggccaggacttagatatatattatttactcaaggttgtttgttaagatgtttatattgtcataatccagacacttggaagattaacgaaccatcaagagaagtgacggttgatgaaatggtaaatgaaatcttgccgtacaaaccttactttgaagcttcaggcggtggggtaacagtcagtggtggcgaaccattactacaaatgcctttcttggagcaattattcaaagaattaaaagcaaatggtgttcacacatgcattgatacttctgcgggctgtgtaaatgatacaccagcatttaatcgtcattttgatgaattgcaaaagcatacagatttaatcttattagatattaaacatattgataatgataagcacatcaaattaacaggcaaacctaacacacatattttaaagtttgcacgtaaattatctgatatgaaacaacctgtttggattagacatgttttagtacctggtatttcggatgataaagaagatttgataaaactaggagaatttattaattctttagataacgttgaaaagtttgaaatcttaccatatcatcaactcggtgtgcataagtggaaaaatttaggcattccttatcaactcgaaaatgttgaaccgcctgacgatgaagcggttaaagaagcttatcgctatgttaattttaatggcaaaatacctgtaacattatag

SEQ ID NO: 662 - DNA, 213 bp, Staphylococcus epidermidis
tttgtattaaaaaagcaatgctattctatagataacttaattaggaggagggaatacaacgtggaacatgtttctaaattagctgaagctatagctaatactgtatcagcagcacaagcagaagatggtgctgagttagcaaaaagtatcgttaatatcgtagcgaatgctggcggtattattcaagacattgcacatgcattcggttactaa

SEQ ID NO: 663 - DNA, 234 bp, Staphylococcus epidermidis
atacataaaaataccgagacatttgatgatgtctcggatatttatcatatatcactagttgatttatctacatgccttttcaagtcccaacttactagcgtcatcatttacacaacactatttaataacaaaacgcttttcgttaaacttaatcctcacgttgttatttatgatgttcaactttatttatatgatataaaacctgaaaatttctcaacgactgttatgccataa

SEQ ID NO: 664 - DNA, 1365 bp, Staphylococcus epidermidis
ttaatgatgaaaaataaactaacattaaaagagaatctatttatcggctcaatgctgtttggtctattttttggtgctggaaatctcatttttccaattcacttaggtcaaactgcggggtcaaatgtatggaccgccaatttaggatttcttatcacggctatcggactacctttcttaggaattatagcgataggtgtatctaaaacaaacggggtctttgaaatttcctcaaggataagtaaaatatatggttatttgttcacaattggcttatatcttgttataggtccgttttttgcgttgccaagacttgcgacgacgtcatttgaaatagcattttcaccatttatttcatctggtacggcccaagcgttgttgcctatttttagtattttattcttcggagtagcgtggttattttcgcgtaaaccttctaaaatattagactatattggaaaattcctaaatccggtctttctcatcttgcttggaattgttgttgtgcttgcatttatccgtcctatgggtggaattagtcatgcgccagtaagtgctgattatagcaatagcgtgttactcaaagggtttatcgatggatataatacattagacgctttggcatcattagcatttggtattatcattgttactacaattaaaaagttggggattactaatccgaatacaatcgctaaagaaactttaaaatcaggtacgattagtattatagctatgggcgttatttatactttattagctttaatgggtacgatgagtttaggtcgttttaaagtaagtgaaaatggtggtattgcgcttgctcagattgcacaacattatttaggggattatggaattattattttgtcactaatcatcattgtggcatgtctgaaaacagcaataggattgatcacagccttttcggaaacatttacagagttattccctaaatctaactatctttggttagctactggggtgagtatattagcttgtatatttgctaatgtaggtttaacaaaaattattatgtattcaacaccagtattgatgttcatttatcctttagcgattactttaattttattagcgttacttagtccattatttaaacattctaagattgtctatcgatttacaacattatttacaatggtggcggcatttgtagatggtgtgaaagcaagtccagagttctttgttaatacaaaatttgcacaaacaatcattggatttggagaaaattatctcccattctttaacattggtatgggatggattgttccagcatttattggtttcattattggtattattgtatactttatgactgctaaaaaatcgtcccacgtacaataa

SEQ ID NO: 665 - DNA, 453 bp, Staphylococcus epidermidis
aataaagtgaaacaatcttattattcgcatacacctcaatctaaaataaaaagtgtagctatcaataaacatgctcatcaatccatttcaattggcattgtatttgttgtcgtcatctttgtaagtgttatccaaatcctattacatcaacgtcttaaacagaacgcacctctcgaaagattatatttggtaccttatagtcaacttaaactatacttgacttatatcagtgtacatgtggtcatactgatgctcatgctattgatgattagccttttaatgcatcaaccattaagcattcttttctacttaaaaacactgattatagttttattttatgaggcaggtattgctttattactttttaaaattaatgttcttagtcaccgtatattcatggctattatttatacggtagcgataggtattatatatttatggattcaattgtaa

SEQ ID NO: 666 - DNA, 225 bp, Staphylococcus epidermidis
gagagaccgaattatgggatgaacctgggacacaaatcgatgttccaggttttttataatgtaaaaacagtgatgaacttctgggcattaacagagtgtatttcaatagacaaagcaatttggctatcgactatcaaagagtggcacaatgaaggcattatgaatatatgtcttatacttcagctttttagtagaaaatcaaatggactaatggtggttaaataa

SEQ ID NO: 667 - DNA, 528 bp, Staphylococcus epidermidis
gaaatgaggaaatgtgtattaatgacggtagcagcaagtgctacgctcttattggcaggttgtggcaatggtcaaaaagaagataaagatgttacggtatcgctacctactgaagcaaaggcggataaacttgacgcgcaaggctatgatgcagcgatgcccgtttatagtgcagtgtatgatgcattagttaaatatgataaagataagggtattaaagcaggtttagcagataaatggagcgttgatgaatcagggaaagtttatgaattccatttgaaaaagaatgttaaattctcagatggttcagcattagatgctaaggacgtgaaattctcgattgatcgtgcgaaagcgatgaacaaagattcgactgtagaaacgttaaaaaaattagataaggtcgttgttaaaaatgagcacgtggtccaaattagattgaaatctccttcaaatcaagtgttaaatgaattaacacaagtgagaccgttgcgtattatgagtccacattcagtagaaggttgttaa

SEQ ID NO: 668 - DNA, 792 bp, Staphylococcus epidermidis
ataaggaggaagatagatatgagtaaaacagcaattataacaggtgcagcaggtggattaggtaaaggtattgcagaacgtcttgctaacgatgggtttaatatagtactacaagatattaatgaagcacttctattagaaactgagaaagaattcaaagaaaaaggttatcaagctgtcgcattcaagagtgatgtatctaaaaagaaagaacaggaagaattagttcagttcgcagttacagaatttggtcaattagatgtcatggtgaataacgcaggtgttgatgcagtgacgccaattttagaaattggggaagaggaattatctaagttatttaatattaacgtatttggtacattgtttggaattcaagcagctgctaaccaatttattaaacaaaaaagtaaaggtaaaattatcaatgcatgtagtattgcaggacatgaatcttatgaagtactcggcacttactcagctacaaaacactctgtacgttccttcactcaaacagctgctaaagaattagcagacaaaggcattaccgtaaacgcttattgcccaggagttgccaaaactgaaatgtgggatcgtattgatgaagaaatggtgaaacttgatgatagtctagaaataggagacgcgtttgaagcattttcttcagaaatcaaacttggaagatatcaagagccatcagatgttgcgaacttagtatcattcttagcttcaaatgattctgattatattacaggccaatccattttaactgatggtggattagtgtacagataa

SEQ ID NO: 669 - DNA, 360 bp, Staphylococcus epidermidis
attagctttgatagttggaacattcggtgcttctgcattgcttccttcttctgtcttcgttggctcagattgaggtgcttctgcattgcctccttcttctgccttcgttggctcagattgaggtgcttctgcattgcctccttcttctgccttcgttggctcagattgaggtgcttctgcattgcctccttcttctgccttcgttggctcagattgaggtgcttctgcattgcctccttcttctgccttcgttggctcagattgaggtgcttctgcattgcttccttcttctgcttgcaatgtagaagacatctgtggtgcttcattgtttacagtaggttgatttgtgttttcaagtga

SEQ ID NO: 670 - DNA, 1338 bp, Staphylococcus epidermidis
tgcaaaattgaattgcgtttaatttatatgaggttaatcactttctttaaagatttaaaaagtattatatgttttaacagagaaagaaggatgaatgtgaagcaattaagtacaactttaaaagtccgattaatatgcgatttttttcaaaatattatagtcacggcatttttaccatttattgcgttgtatttaacagatatggtcaatcaacatttttcagggctttttttatttgggcttgtaatgataaattttccaatttctttgatttcaggtcatattattgaacgtttacctaaaaagacgttaacacttagttatcaatttatattaagtttaatgctcgtaattatggcgatttcaatatcacaacatacttttaagatcattttattttgtatcgcttacacaatatttagtatcacaataggcatgcagcaacctataatggacacgattattatggatgcgattacgcctgaagttgagcaatatatttataagataagttattggctgacgaatattgctgtcgcctttggtgcgctcataggtggattgatgtatggggcacataaatctatgttgtttttcatcgcttttgtcatttacattatggtttttatagcacttatcgtatggttgcctaaagatttaaatattgttactcagtcgcacacacatcatgctaatgagaaacaattctccatgggtcaaatattaaaaagttataaaccagcatttaaagatacaacatatctacttctaattataggatttagtattttaacaatgggtgagttatctgcatcatcgtacatttcagtgcgtttaaaacaagagtttgatccgatgatattgttttcgttacatatcaatggcgttaaaatgtattcacttctattaatgacgaatacaatcattgttataatttttacctattttatttcaaaaattgttatgagaatgaatgttaaaacagcattattggttggaattattttttatgtcattggatattcgaacctcacttatcttaatgattttacgttacttatcatatttatgattatagcgacgataggtgaaatggtatattctccaattcttgaagaaaatcgttttaaaatggttccttctcataaaagagggacatattcagcagtgcatgctttaggatttaacctagctgaattacttgcaagatttggaattatattaggagtgtttttaacttcaatggagatggggatctatatgtttgttttattattactaggtggcatgtcactttacattgcagtgagtcgttttaataatacaaattcacaataa

SEQ ID NO: 671 - DNA, 243 bp, Staphylococcus epidermidis
aaaaccaccgataataatgatttccataacatcactcctaagtctgaaattttagttatgcttaacattgctatgactagtatggtgacgcaaattgtggacgataccatttgtttcattatcattttaattcctagaattgaaccgagtcgacgcatgagcatagtcattgttactgaacatgctgtaaatgttgaactaaaaaagactagcaacaataattggaatgcggaaagtctttga

SEQ ID NO: 672 - DNA, 528 bp, Staphylococcus epidermidis
ccacagttagacgatacaacaccgtttaaaaaaggtgttggcatagatttagcacgtttatctttggaaaaggcagagacattaaaaggacaacgtccacttacatactatttaacagataaaccgcaagaaacgaagcacgtgtttgatacggcagtaagtacgtctgtcttgtacttaatagaagatattccgcaacatgcaaaagatttaaaagaggtattgaaaccaggcggtgtttattacgcttcattcgcggatttaactaataacccaagtcgtcagtttatggatgacacgattaatcaatatggtgcaacaccttctcagaatcactctctaaaacatatcgttgatagctttgtggatgcaggatttgaagttgcagtaatgaaagagcatgtacctgacgtgattgatttaacacattatagcgatttttatttatcaccgaatgattatttacaaacactatatgaagaatcgtttttaataaaagcaagtgtgaaagaaggtactgagaaatga

SEQ ID NO: 673 - DNA, 1473 bp, Staphylococcus epidermidis
tataaaaaagatagaggtgctttaaacatgaaaaataaaaagaattcatatagcattcgaaagttaagtgtaggtgcgtcttcaatcattgttgcatcgatgttatttattggcggaggctcagtacatgctgctgaatccaatcaccttgaaaatcaagaacaatcagaagtaagtgcatcacattctattgagatgcaacacaaaaatcaagaaactcaacaaactgagaataaagataataaaactaaccattcagaaacaattgataagactccaactatacataacaatggctactcatatcatgagacacctagtactgacgttaaatctaatgaagacaaacaaattgatagtcaattcaatcaacctcagacatctatgccaaataatgatcaacaaaaccctaaaaaagtagcggaacatacaacgaaaagtataaatgcaaaaaaagaagaaactagaaagaatgaaaatgcaaagagcctagtacaaccccaacaagatgataaaacaacatctgaacaaacaaaaatgaaagaatcacgtgaacaggagattacaaacgagcaaaagcagttacaaagtaaagatgtaaaaaatgctcaacaagaaaatcaaaatatagaccaagaaaaatctcaagaaaaaattaaagtccaacaatcgaacatcgaaaaggctcaaaaatcttcaagaatagatggaaaattagataatcaatacaataaagatgcaacgcaatcggatgaggggactgcatctgagaacgtttcagaacagcatataacagcaaaagatggaggtgttacacgaaataatcgtggagataaacatttaaatcaagaaaagccaacaacatcatcagataaagaacttaaagtggatgacatagacaaagatctttccacaaaagaatctcctgaaaatgaaaaagatgattctagaaaagggattaaagcaatcactaaaaattctcaggcaacaacaagaaatactgcgacaacagaagcatccaaagaattgaaggatcaaacaaataaagtagcatcacaaaaagaatataaaaatcatgaccctattattcttgtacacggctttaatggttatgcatcaggaactggtcccgttacaggaaaaggtaactattggggtggtgaccgtctcaaaattattcaagattatagagctaaaggttataacgtgatggaagcaagtgtaagtgcatttggcagtaattatgatagagctgtagaattgtactattacattaaaggtggacgcgtagactatggtgcggcacatgctgcaaaatatggacacgagcgttacggaaaaacatacgccggtgcttataaggattggaagcctggtcaaaaaattcatctcattggccatagtatgggtggtcaaacaattcgttatcttgaagagttattacgacatgtagtcctcaccccgggtagggcc

SEQ ID NO: 674 - DNA, 984 bp, Staphylococcus epidermidis
atcatgaaagaaaatttttggagtacattgccacgtccgttttttattctggcacctatggaagacgtgacagatattgtctttcggcatgttgtcagtgaagctgcgagaccagatgtattttttactgaatttaccaatactgagagttactgtcaccctgaaggtattcatagtgtgcgcggacgcttaacttttagtgacgacgaacaaccaatggtagcgcacatctggggcgataaaccagaacaattccgagaaatgagtatcggcttagcggatatgggctttaaaggtatagatttaaatatgggttgccctgtcgcaaacgttgcgaaaaaaggtaaaggatccggcttaattctacgacctgaaacggcagccgaaatcattcaagcttctaaagcaggtggtctaccggtcagtgtaaaaacacgtttaggttattacgatatcgatgaatggcgagactggttaaaacacgtcttcgaacaagatatcgcaaatttatccattcatctacgtacccgtaaagagatgagtaaagtagatgcacactgggaattaatcgaagcaatcaagacattacgtgatgaaattgcgccaaatacactattaactatcaatggtgatatccccgatagacaaactggtctagaactcgcaaataaatatggtattgatggcattatgattggtagagggatcttccataacccattcgcatttgaaaaggaaccacgcgaacattcaagcaaagaattattaggtttattacgcttacatctctctttatttgaaaaatatgataaagatgaagcccgacacttcaaaagtttacgcagattcttcaaaatctacgtacgcggcattagaggcgctagcgaactccgccatcaattaatgaacacccaatccattgccgaagcaagagaactactcgatacttttgaagcacgtatggatgcacgttcagaagtataa

SEQ ID NO: 675 - DNA, 513 bp, Staphylococcus epidermidis
caaacaatggaggacatcatgattttaactattttatttatctttttctgtattcgactcatcagcttaaagatatctatgcaacacgcaaaacagctaaaggtagagggcgcggtggaatatggtgtgaaaaattcaaaatatctagccattacgcatgtattaatttacatgagtgcagctatagaaacattcattcataaggatacatttaatctacttaacggcattggcttaatcatattaatcgtcgcttatatcatgttatttatagtcataaagacactagggcgtatttggacattgaaattatttatactgccaaatcaccctattatcaaatcaggattatataaagtaacaaaacatccaaactattttttaaatatcattccagaattaattggtgtattactactaacaaatgctacatacacaacactcttattagttccatatgcttattttttaattgtacgtatccgtcaagaagagaaattaatgaatatataa

SEQ ID NO: 676 - DNA, 978 bp, Staphylococcus epidermidis
tcattgaaggaggataatatgaagaattataaaaaatatctgattgttttagtattatgtctaacagtgttatctggatgtaacttacccggtttaaaaaatagtcattcagatgacgatgttagaatcacaagtttaggaacaagtgaatcacaaattatatcgcacatgctgagattacttattgaacatgatacaaaaggtgaaattaaacctaccttaattaataatttaggttcaagtacgattcaacataatgctgtcacaagtggccaagctaatatgtcaggtacgcgttatacaggcactgacttaacaggggcgttgaaagaagatccgattaaagatcctaaaaaggccatgaaagcgacacaagaaggatttaaaaagaaatacaatcaaacattcttcaattcgtatggtttcgaaaacacgtatgcattgatagtgacaaaagaaacagctaaaaaatatcatttagaaactgtttcagacttggaaaaacatgcgaaagatttaagagtaggtatggatagttcatggatggaccgcaaaggtgacggttatccagcatttaaaaaagaatatggttatagctttggtactgtgagacctatgcaaattggcctggtttacgatgcacttagttctggcaaattagacgtagcagtaggttattctacagatgggcgtatttcagcatacgatttaaaagtgttggaagatgatcgtcgattcttcccaccatacgatgccagtccccttgcatcagatcaattgttaaaagagaagccagagctcaaaccgattgttaaaaaattagaaggtaagatatcaacagaacaaatgcaagaattaaattatcaagctgatggtaaaggaaaagagcctgcaacagttgcagaggacttcttgaaaaaacatcattattttgaagacgatgacaataaaaaagataaacagaaaggtggtcaataa

SEQ ID NO: 677 - DNA, 1578 bp, Staphylococcus epidermidis
ctgtcgaaggagatgaaaccgttggaacaagcgatcaatgataataaaaagaaaaaacgttttaactttagaatgccaggtgcatttatgattctctttatcctaacagttgtcgcagttatagcaacttggataatccccgcgggtgcatactcaaaactttcatatgaaccttcatcccaagaattaaaaattgtcaatcctcatcatcaagtaaaaaaagttcctggaacacaaaaggagcttgatcgattaggagttaaaatcaaaatagaacaatttaaatctggtgcaattaataaacccgtttcaattcctaatacttacgaacgtctaaaacaacatccagctggtcttgatcaaattaccagtagcatggttaaaggaaccatcgaagccgtcgatattatggtctttatacttgttctaggtggattgattggcgttgttcaagcgagtgggtcctttgaatcaggattgttagcacttactcaaaaaacgaaaggccacgaatttatgcttatcgcctttgtctccatacttatgattataggcggaacgctatgtggtattgaagaggaagctgtagcgttctatcctgttctcgttccaatatttattgcgctcggatatgattctattgtctcagtcggtgcaattttcttagcaagctctgtgggcagtacattctcaacaatcaacccattctcagtcgtcattgcttctaacgcagcaggaacaacttttactgatggtctttattggagaataggcgcttgtatcatcggtgctatatttgttattagttatttgttctggtattgtaaaaaaattaaaaaagatcctaaatcctcttattcttatgaagacaaagcagcatttgaaaaacaatggtctgtgctccatgatgacggttcttctgagtttacattacgtaaaaagattattcttacgcttttcgtcttaccgttccctattatggtttggggcgtcatgacacaaggatggtggttcccagtcatggcatctgcattcttaatctttaccattgtcatcatgtttattgctggaacaggacaatatggtttaggtgaaaaaggtactgtagatgcattcgttaatggcgcttcaagtttagtaggtgtatctttaatcattggtttagctcgaggaattaacttagtattgaataaaggaatgatttctgacacaatcttgcacttttcatcatctatcgtgcaacatatgagtgggcctttatttatcattgttctgctctttatctttttctgtttaggatttatcgtgccatcatcatcaggattagcagtactatctatgcctatctttgcgccattagctgatacagtaggtataccaagatttgttattgttacaacatatcaattcggtcagtatgcaatgttgttcttagcgcctactggacttgtaatggcaacacttcaaatgttaaacatgcgttactcacactggttacgtttcgtatggcctgttgtcgcgtttgttttaatatttggtggaggcttactaattacacaagttttaatatactcataa

SEQ ID NO: 678 - DNA, 879 bp, Staphylococcus epidermidis
gggtcaagtttcaactgtcgcaacaggacaagcatatatagaacaggagacaatgacgcaaatatgaatgagcatacaaaaatagagaaccaattacaatattatttagaacaatttacgtacttacatcaactcgttttggaagatagtcggcatattgttgatttagaaaatttgattgatgaatacagtcaatggatacttcaacctttggcagagcatcattatttaacatggaatgatttagaaacaaaaataagctttaccaagaagcttcaagaggtatcagcaaagtgtgtgaaacaggtagaagtcattcgagcacaacgtttgttgaatggtagggcctccacgtcaggttatttcgaaaatatagagcattgtattaatgaagaattcggaagatggcaaattggacaaaatgacaagttgttactgattgggtcgggtgcatatcctatgacattaattcaagttgctaaagaaactggcgctgcggtcattggtatagatatagattcggaagcagttgatttagggcaacgtgtcgtcaatgtactagctccaaatgaagatatcgttattagtaatcaaacagttgatcaattagaagacatccaatctgtgactcatattattttcagttcgacgatacctatcaaatatgacattttgaatgaactttacacattgacgaatgatgaagttgttgtagctatgcgatacggtgatgatatgaaagcattgtttaattatccatctcaagcaactgacgaaacacaatggcgatgtgaagaactacaaacacgaccgaagcagatttttgatattgcactttatcgtaaagtggcatcaaaagttggtgttgaacatgtctaa

SEQ ID NO: 679 - DNA, 921 bp, Staphylococcus epidermidis
aaaataaaacttttagaggtgttaatgatgcaaaaagttgttttaacagcagctattactggcgctggagatacaatacaaaaaaatgagaacgtaccagttacaccacaagaacttgcagattcagcaattaaatgtgcacgagcaggagcaactgtcgcacatattcatgtaagagatcctgaaactggaggagtaagtcatgatccagaactgtatgctgaaacagttagattaattagagaagctgatgaagatatcgtcattaatgtgacatctggtggcggtggagacttcattccaagtcttgaacatccagagacaggtggagaaggaacttggatacaaacaccagaagaacgttttaaacctattggtgacttgttaccagaaatgtgtacattagattgtggtagtgtcaacatgggagatgcaatttatttaagtccggcatcatggctacgtaaacaagcacaaatggttaaagatgcaggagtcaaaccagagcttgaatgttttgatacaggccatgtgagttttgccaaacaaatgatagaagaaggattaattgatggagaccctatgttccaattttgtttaggtattccttggggtgcagagaatgatcctgaaacaatagaatatcttaaatcacgtataccagaaaatgcacattggtcagcatttggcattggtaagatgcaactgccaactgtaagaaaagttgcgcaacgtggaggaaatgttcgtgttggattggaagataatatttatttaagaaaaggtgtaaaagcaacgaatgaagcattggtagaagaggcaaaaagaattttagcagaactagatattgagccacttacacctgctgaagcaagagaaaaatttaatcttagaaatcctcatggtaaaggagacaaataa

SEQ ID NO: 680 - DNA, 1959 bp, Staphylococcus epidermidis
gggaaaaaacttatagaggtgatttttttgaaaaataataatgaaacaagaagatttagcattaggaagtacacggtgggagtcgtgtcaatcattactgggattacaatatttgtcagtggtcagcatgctcaagctgctgaaatgacacaatcatcatcagattctaacgaacagtcacaacaaacagaacaagttgaacacaaagaagatacaactcatttatctaacgaattgaatcaagagggtgagacagcgagccaatcaaagactagtcaagagaatcaatctgatggcaatgtacaaaaaaagagtaatcaaatacaacaagattcaacacaaacgtcaccattaaatgaccaaaaacaaacttcaatggaacaacaatcaaaagacaatcatgttaccccaaattcacgtcaggatacatatccaaaaggccaaaatcaagatgataaaggcaaacaacagtttaaagataatcaacactcacaaacaggacatcaacctaatactcaaaaccaaaataatgatcaagattcatcagataaaaagcaacacccatctgatcaaactcaagactcatcttcaaaaggaacacaacctaaacaatcacagtctatagaagatagagataaaacagtaaaacaaccatcttctaaagtacacaaaataggtaacacaaaaactgataaaacagttaaaacaaatcaaaaaaagcaaacatcattaacttcaccacgcgttgtgaaatcaaaacaaactaaacatatcaatcaacttactgcgcaagctcaatataaaaatcaatatccagtcgtgtttgtacatggatttgtaggtttagtcggtgaagatgcattcagcatgtacccaaattattggggtggtactaaatataacgtgaaacaagaacttacaaaattaggttaccgagttcacgaagccaatgtaggggcatttagcagcaattatgaccgtgctgttgaattgtattattatattaaaggtggacgagtagattatggtgctgcacatgctgcaaaatatggtcacaagcgttatggcagaacatatgaaggcatcatgcctgattgggaaccaggtaaaaagatacatcttgttggacatagtatgggtggccaaacgatacgcttgatggaacattttttaagaaatggaaatcaagaagaaatagactaccaacgtcaatatggtggtacggtatctgatttgtttaaaggtggccaagataacatggtgtctacgattactacattaggaacacctcataatggcacgcctgctgcagataaactagggtcgactaaatttatcaaagatacaattaatagaattggaaaaattggtggaactaaagcgctcgatttagaactaggtttttctcaatggggcttcaaacagcaacctaatgaatcatatgctgaatatgcaaaacgtatagcgaatagtaaagtttgggagactgaagatcaggctgtaaatgatttaacaactgctggagcagaaaagttaaaccaaatgacgacattgaaccctaatatcgtctatacatcgtatacaggtgctgcaacacatactggaccattaggcaatgaagtgccgaatattagacaattcccactattcgatttaacaagtcgtgtgataggtggagatgataataaaaatgtcagagtaaatgatggcatagtacctgtgtcttcttcactacatccaagtgatgaagcatttaagaaggtaggtatgatgaacctagcaactgacaagggtatttggcaagtgagacccgtacaatatgattgggatcatctagatttagtcggattagatactactgattataagcgaactggagaagaattaggtcaatgttatatgagtatgataaataatatgttgaaagtcgaagagttagatggtattacacgtaagtag

SEQ ID NO: 681 - DNA, 906 bp, Staphylococcus epidermidis
aatttcagacttaggagtgatgttatggaaatcattattatcggtggttttttaggaagtggcaagacctcagcaataaatcatttaatcgctgatgcacttgaaaacaacttaaatcctgctgttattatgaatgaatttggaaaaagaagtgttgatggccaacttatagaacgtcctgaagtacctatgagtgaaatcactgaaggatgcatttgttgtgcgatgaaatcagacgtatcacaacaactacatgaactatacttaaaatatcaaccagatatcatctttattgaatgcagtggtgtagctgaaccactagctgtcgtcgatgcatgcttcacacccgtacttgcaccttttatcactttaaggagtatggtgggaattattgatgcaagcatgtattcacgaattaaatcttatccacaagacattgcagctctattttatgaacaacttcgtcattgttcgactttatttgttaataaaatagataagatagaggtggaagaaaccgcccgcttgctacgtcaactcgagcgtctcaatagcgatgccaatattcaagttggtcaatttggagaattaaatttaaaatcactgctagagccaacacatataaattcaaatgcatgtggcactttgcatagtaatataaatcatcaattcatcgaaaatcctaggctacaaacaaaagaagaaatgattagtgcgttagataacttgcctcaagatgtttaccgtgtcaaagggtttgttcgtttttcagatcagcaacacgtttatttagtacagtatgcacaaggaaatatagaattatctcccattcaacttaaaaacgatgtaccattgtacctcattgttataggcaaacatttaaaacaaatacaacttgatttataa

SEQ ID NO: 682 - DNA, 720 bp, Staphylococcus epidermidis
actttaaaatgtaataagtttacattaaagataggtgacatgataaacatgaatatatttgtaactggaacgaatactgacatcggtaaaacgtatgtcactaaatatctctataaagcattaagaacgaggggatatcgggtatgtattttcaaaccttttcaaactgaagaaattggtggaggtagatacccagatttagaaatttataaaaacgaatgcgatttagactatgacgttacgtctctttacacattcaaagatccagtttcaccacatttagcattcaaaattgaaaggcatcagcaattgaaccatcaaacaatgatagacaaactcgaatcactaaaagcacaattcgatatgattctcattgaaggtgcgggcggtattgcagtgcctatctatgaatacagtgaccatttttatatgacaacagatttaattaaagacacatcggatttcattgtgagtgtcttaccttcaaagttaggtgcgattaatgatgccatcgttcaccagaaatatattgatcatcaagaacttcccccgaacgtgttaatcatgaataactatactgatagtgctattgaacaggataatttacataccattgaaaaattaatacacaagtctgtttatacgttaggtcatcaagcgactcaagaaagcttttccgaagcatttatacaacgaattataggaggatccaatggctaa

SEQ ID NO: 683 - DNA, 804 bp, Staphylococcus epidermidis
atagaaagatgtgaaaatatgcaacattcaagcaaaataatagtatttgtaagtttcttaattttaacgatttttattggaggatgtggttttataaataaagaagatagcaaagaaacggaaatcaaacaaaactttaataaaatgttagacgtgtatccaactaaaaatctagaagacttttatgataaagagggctatcgtgatgaagagtttgataaagatgacaaaggaacatggattattaggtctgaaatgacaaaacagccaaaaggtaaaattatgacctcaagaggtatggttctctatatcaatcgcaacactagaacagccaaagggtattttttaatagataagataaaagatgatagtaatggtagaccgatagagaatgaaaagaaataccctgtaaaaatgaaccataataagatctttccaacaaagccaatatctgatgataagttaaaaaaagaaattgaaaacttcaaattttttgtgcaatatggaaattttaaaaacttaaaggattataaaaacggggatattttatacaatcctaatgttcctagttattctgcgaaatatcaattgagtaataatgaatataacgtacaacaattaagaaaaagatatgacatcccaactaaaaaagcacctaaactattgttaaaaagggatggcgacttaaaaggatcatccgtaggtcataaagacctagaatttacctttgtagagaataagaaagaaaacatcttttttacggatagtattaattttaaaccgactgagcgtgatgaatcatga

SEQ ID NO: 684 - DNA, 669 bp, Staphylococcus epidermidis
acagaaaggtggtcaataaacatggaagggaatttaatacaacaactcgttcactactaccaaatgaactttggctacctatgggaattgtttgttaatcatttgttaatgtctgtttacggtgttttactagcatgtttagtgggcatacctcttggtatcatcattgcaagatttggtaaattatcaggtgtgattattactatcgcgaatattattcaaactgttccggttattgctatgttagcgatattaatgcttagtatgggactcggtatgaatacagtcatttttactgtgttcttatatgccttgcttcctattattaaaaatacgtatacaggaattaatgaagttgatccaaatattaaagatgctggaaaaggtatgggaatgacgcgtaaccaagtattaactatgattgagttacctctgtcactttcagttattataggtggtattcggattgcccttgttgtagctattggtgtcgtagctgtaggttcatttattggtgcgccaacattaggtgatattgtgattagaggtacaaatgcaactgatggaacactattcattctagcaggtgcaatacctatcgttatcattgtcatacttatagatgttttattacgtttattagagaaaaagctagatccagctacgtaa

SEQ ID NO: 685 - DNA, 963 bp, Staphylococcus epidermidis
atagcaatgctcaaacgtacaattaaattcatactttatttaatcgtaagttcgtttattatcttcattttagttgagaagacatctggtaatccagcgattctgtatctacaacgtcatggttatacgtcgattacgcaagacaatattgaagcggcacaacatcaacttggcttaggacaacatgtgttactaagatatatcgattgggttggacatgcactcacgggcaacttaggatacggctttagtacgaacgaagcagttaccgctatgataatggaagccatcgtgccgacgcttgtgctaatcattgtctctagttgtatcatgttgccatttggctatattgttggttacttcgttgggacgcgtccgcatacacgttacgctaatggaattcgtggattcgcccaagtgatgacctcaatgccagaatactggttagctattttattcatttattatttaggcgtacgttggcaattgttaccatttgtaggtagtgattcatggcaacactttgtgctgccaatcttcacaattgttgttatagaagggtgtcatatcttattgatgacagcacatctgattacacaaacgttagatcaagatgcgtatcaactggcgcagttaagacatttttcgttaaaagcgcgtatcatcgtacaaattaaagagatatttgcaccactaatgacgatttcaattaacagtatcattcatttaattggaaaagccgtaatactagaagtcatcttcagcatgtctggtataggtaaattgttgattaatgctattaaccaacgagattatccactgattcagggcattgtcatctttatcattgtctttattatgctaatgaattatttaggcgatgtgattattttgaagaatgaacctagacttcgacgacgtcatacccagcagtcaggcaatgagaaaagaggtacgatgtga

SEQ ID NO: 686 - DNA, 330 bp, Staphylococcus epidermidis
aaaggtgtgcttatgcataattacaacaacattaacatcgtaagtgatgattcaaaatatcaagaaatttgttggttccatacattagaaggtatttggcaccctgtagaagtagaaacttcaccattaaatattacatttaataaagatataacacctaattacgtttgtacgttaataaatgaagattccagaaaaataattttaagtaatgtagacaatccgaatatcattattgaaatgattcttattaattcaaaaaaattggtttttaatgctataagtaaagaaggcttaggtacctcgcctaaaatcacatttacaaaataa

SEQ ID NO: 687 - DNA, 1035 bp, Staphylococcus epidermidis
atattaaagcgtaacaatttcgatttaggagatgtacacatgtataaaaaaggtttaattttattttttgtagcagtactaacattggcacttgctgcttgcggtaaagatagtcataatcagtcatctgatcataaaggaaaattagatgtgaacacaacagtctatccacttaaatcatttgcacagcaaattggtggtaaatatgtaaatgttgaatcggtttaccctaaaggcgtagatccacatacatatgatccaagtcaaaaacaaatggtagatattgggaaatcagacttattcttatatactggtgataacttagatcccgtagctaagaaaatcgctaaagctataaatgataaagataaaacactatcactagaatcgactttagataaaaataaagatttattaaaaggcgaagaacatgaacatgagcacggagaaggtcacgaacatggtgaatcacatgaagatgaacacgaacatgaacatcatcaccatggaaaatacgacccacacatttggttggatcctgtagtaagtcaaaaatttgctaaagcgattaaagatgaattgattgagaaagatagcaaacataaatcttattatgaaaagaattacaaccaactagttaaagagttaaaagacttagataaagatatgaaacatgctgtgaaaggtaatgaagataaaactgtttatatttcacacgactctataggttatctagctgaacgctatcattttgaacaagaaggcattgaaaatatgaatgcggaagaaccaagccaaaaagatttaacaaatattgttaagcaaattaaagaagataaagtgaaaaatattttaatagaagaaaatgtatctcataaagtagcagatacggtaagaaaagagacaaatgctaaaacaattaaattttacaatatgggatcacacacaaaacaacaagatgatgacaacaatacttaccaatcatttatgaaagaaaatattaaagctattgaaaaagccctacaaaatgaataa

SEQ ID NO: 688 - DNA, 195 bp, Staphylococcus epidermidis
tctaatattttagaaggtttacgcgaaaataaccacgctactccgaagaataaaatactaaaaataggcaacaacgcttgggccgtaccagatgaaataaatggtgaaaatgctatttcaaatgacgtcgtcgcaagtcttggcaacgcaaaaaacggacctataacaagatataagccaattgtgaacaaataa

SEQ ID NO: 689 - DNA, 1401 bp, Staphylococcus epidermidis
cggaagagtaggaggccacttacgatgagcgaacagtttaataaagggaaacaactaattgtagcgattatcttagggattctcacatactggttatttgcacagtcttttttgaatatcgcaccacatgttcaacgtttttatcatgtagatatgagtattgttaatattgcggtcagtctgacatcactcttaacaggtgtatttatagtcgtagcagggggattatctgataaaataggtcgagttaaaatcacaaatgcaggtctaatattaagtatacttggctctattgcattgatcatctcgcatgcaccaattttattattattagggcgtgttttacagggcttatctgccgcatgcttacttccagcaaccatcgcgttaattaattctttcttccaaggtgaagaaagacaaaaggtgcttagttattggtcattcggatcctatggtggaacagggttagcatccctatttgctggaattatagctacatttattggatggcgatggattttcgtgttgtcaatcattttttcaattatcgccttaatattgcttagaggtataccagaatctaaagatgagtctgcatataataaaaaatttgatatcgttggaatcattatttttgttgtcatgatgttaagcattaacgtagtgattacgcaaggagatagaattggatggttaaatcctcttatattgatattaattgctatattcattgtgacattaattgcattttatatatttgaaaaacgtcaagatgaaccttttatagatttaagtttattttcaaataatgtttatattggaacaacattagccaacttgatggtgaacatggatattggttcattagcattatttaatatttatgttcaagacgataagcatttatcagctgcacaagccggtttaattacaattccatatatgctgtgtagtttgttaatgattcgtgttggtgaacgttttatgcaaaaaagaggaccgcaattgccattgatgttaggtccggtatcaattactgttggtattatacttttagcattcacttctttgcctaatatgatttattatattgtggcatgtattggctttatctttataggtctaggattaggattttttgctactcccgcgctatctactgctgtatctaatgttccagctgaaaaagcaggtactgcatcaggaattatcaaaatgacttctacactaggtgcagcatttggaatcgctgttgtgacaacaatatatacggcattatctgtaaatcacccggcatatttagcagctactatcgcatttatcgtgggtgcaggtttagtgtttatcgcatttattgcggcgtattgtttaattcctaaaaagaatgtagatatttaa

SEQ ID NO: 690 - DNA, 948 bp, Staphylococcus epidermidis
aaggaagtgagtgaaatggctaaaattgtagtagctttaggtggaaacgctttaggaaaatcaccacaagaacaacttgaattagtaaaaaatacagctaaatccctagtaggattaattactaaaggtcacgaaattgtgattagtcacggtaatggaccacaagtaggaagtattaaccttggtctgaattatgcagctgaacacgatcaaggtcctgcttttccatttgctgaatgtggcgctatgagtcaagcctacatcggctatcaacttcaagaaagtttacaaaatgaacttcattcaatgggcatagataagcaagttgtcacactagttacccaagtagaagttgatgaaggcgatccagcttttaatagtccaagtaaacccatcggtctgttctacactaaagaagaagcaaatcgtattcaacaggaaaaaggttatcaatttgtagaagatgctggtcgaggttaccgtcgcgttgtaccatcaccacaaccaatatctattatcgaactggaaagtattaaaactctagtagaaaatgacacactcgtcatcgctgcaggtggaggtggtataccagtcattcgcgaacagcatgatagctttaaaggtatagatgccgtcatcgataaagacaaaacaagtgcattattaggtgctgatattcactgtgatcaactcattattttaacagcgattgattatgtttatatcaactatcatactgaccaacaacaagcacttaaaacaacaaatatagatacgcttaaaacatatattgaagaaaaacaatttgccaaaggcagcatgctacctaaaatcgaatctgccatctcctttattgaaaataatcctaacggtagcgtgctcatcacatcattaaatcaattagatgcagcactagaaggtaaaattggcacactcattacaaagtaa

SEQ ID NO: 691 - DNA, 336 bp, Staphylococcus epidermidis
atcatacggaggtttttttctatgaaaagagcttcttattcagtagaaacaaagtataaagcagttgaaatgaaagcagcaggattttcaacaaaagaaattatgaaagaattaaatattagaaataggacgcaagtgaaaacttggtggcgatggtatcgaaatggggaaagttatagattttcacaacaagttggtaaacaatatacctacggtaaaggattagaagagctgtcagaagtagaacaattaaaattagaaaataagagaaaagatatagaattggatattttaaaaaagtacaaggcattggaaaggaagtggtaccaacagtag

SEQ ID NO: 692 - DNA, 246 bp, Staphylococcus epidermidis
tataataggaggaacagtaagatgaaagtgtataagttgaattatcaacaccataaagatattgttgatgataatgtattaacgatgttcgtaacagctgacaatcaagatgaagttgaagcgtttgcgaaaaaattacattacaagattgaacatttatctccattaactaaaaaggaatttgaagatgagaaagcgaaagattcacactatagacttgaacacgtggatcactatttaaattaa

SEQ ID NO: 693 - DNA, 3552 bp, Staphylococcus epidermidis
atacatgggaggtataatatgggcaaacgtagacaaggtcctattaataaaaaagtggattttttacctaacaaattaaacaagtattctataagaaaattcactgttggtacggcctcaatattacttggttcgacacttatttttggaagtagtagccatgaagcgaaagctgcagaagaaaaacaagttgatccaattacacaagctaatcaaaatgatagtagtgaaagatcacttgaaaacacaaatcaacctactgtaaacaatgaagcaccacagatgtcttctacattgcaagcagaagaaggaagcaatgcagaagcacctcaatctgagccaacgaaggcagaagaaggaggcaatgcagaagcacctcaatctgagccaacgaaggcagaagaaggaggcaatgcagaagcacctcaatctgagccaacgaaggcagaagaaggaggcaatgcagaagcacctcaatctgagccaacgaaggcagaagaaggaggcaatgcagaagcacctcaatctgagccaacgaagacagaagaaggaagcaatgcagaagcaccgaatgttccaactatcaaagctaattcagataatgatacacaaacacaattttcagaagcccctacaagaaatgacctagctagaaaagaagatatccctgctgtttctaaaaacgaggaattacaatcatcacaaccaaacactgacagtaaaatagaacctacaacttcagaacctgtgaatttaaattatagttctccgtttatgtccttattaagcatgcctgctgatagttcatccaataacactaaaaatacaatagatataccgccaactacggttaaaggtagagataattacgatttttacggtagagtagatatcgaaagtaatcctacagatttaaatgcgacaaatttaacgagatataattatggacagccacctggtacaacaacagctggtgcagttcaatttaaaaatcaagttagttttgataaagatttcgactttaacattagagtagcaaacaatcgtcaaagtaatacaactggtgcagatggttggggctttatgttcagcaagaaagatggggatgatttcctaaaaaacggtggtatcttacgtgaaaaaggtacacctagtgcagctggtttcagaattgatacaggatattataataacgatccattagataaaatacagaaacaagctggtcaaggctatagagggtatgggacatttgttaaaaatgactcccaaggtaatacttctaaagtaggatcaggtactccatcaacagattttcttaactacgcagataatactactaatgatttagatggtaaattccatggtcaaaaattaaataatgttaatttgaaatataatgcttcaaatcaaacttttacagctacttatgctggtaaaacttggacggctacgttatctgaattaggattgagtccaactgatagttacaattttttagttacatcaagtcaatatggaaatggtaatagtggtacatacgcaagtggcgttatgagagctgatttagatggtgcaacattgacatacactcctaaagcagtcgatggagatccaattatatcaactaaggaaataccatttaataagaaacgtgaatttgatccaaacttagccccaggtacagaaaaagtagtccaaaaaggtgaaccaggaattgaaacaacaacaacaccaacttatgtcaatcctaatacaggagaaaaagttggcgaaggtgaaccaacagaaaaaataacaaaacaaccagtggatgaaatcgttcattatggtggcgaagaaatcaagccaggccataaggatgaatttgatccaaatgcaccgaaaggtagtcaaacaacgcaaccaggtaagccgggggttaaaaatcctgatacaggcgaagtagttactccacctgtggatgatgtgacaaaatatggtccagttgatggagatccgatcacgtcaacggaagaaattccattcgacaagaaacgtgaattcaatcctgatttaaaaccaggtgaagagcgtgttaaacaaaaaggtgaaccaggaacaaaaacaattacaacaccaacaactaagaacccattaacaggggaaaaagttggcgaaggtgaaccaacagaaaaagtaacaaaacaaccagtagatgaaatcacagaatatggtggcgaagaaatcaagccaggccataaggatgaatttgatccaaatgcaccgaaaggtagccaagaggacgttccaggtaaaccaggagttaaaaatcctgatacaggcgaagtagtcacaccaccagtggatgatgtgacaaaatatggtccagttgatggagattcgattacgtcaacggaagaaattccgtttgataaaaaacgcgaatttgatccaaacttagcgccaggtacagagaaagtcgttcaaaaaggtgaaccaggaacaaaaacaattacaacgccaacaactaagaacccattaacaggagaaaaagttggcgaaggtgaaccaacagaaaaaataacaaaacaaccagtggatgagattgttcattatggtggtgaacaaataccacaaggtcataaagatgaatttgatccaaatgcacctgtagatagtaaaactgaagttccaggtaaaccaggagttaaaaatcctgatacaggtgaagttgttaccccaccagtggatgatgtgacaaaatatggtccgaaagttggtaatccaatcacatcaacggaagagattccatttgataagaaacgtgtatttaatcctgatttaaaaccaggtgaagagcgcgttaaacaaaaaggtgaaccaggaacaaaaacaattacaacaccaatattagttaatcctattacaggagaaaaagttggcgaaggtaaatcaacagaaaaagtcactaaacaacctgttgacgaaattgttgagtatggtccaacaaaagcagaaccaggtaaaccagcggaaccaggtaaaccagcggaaccaggtaaaccagcggaaccaggtacgccagcagaaccaggtaaaccagcggaaccaggtacgccagcagaaccaggtaaaccagcggaaccaggtaaaccagcggaaccaggtaaaccagcggaaccaggtacgccagcagaaccaggtacgccagcagaaccaggtaaaccagcggaaccaggtacgccagcagaaccaggtaaaccagcggaaccaggtacgccagcagaaccaggtaaaccagcggaaccaggtacgccagcagaaccaggtaaaccagcggaatcaggtaaaccagtggaaccaggtaaaccagtggaaccaggtacgccagcacaatcaggtgcaccagaacaaccaaatagatcaatgcattcaacagataataaaaatcaattacctgatacaggtgaaaatcgtcaagctaatgagggaactttagtcggatctctattagcaattgtcggatcattgttcatatttggtcgtcgtaaaaaaggtaatgaaaaataa

SEQ ID NO: 694 - DNA, 195 bp, Staphylococcus epidermidis
cgtatttatggttattggtcattgattccaaagtttagttattatatttttaatgaaataccatgccattttcatatctttaacagtataaataattacattatctttttaaaaataaaatatattaagattttctttttcatttttaatatcatcatatcagtttatttacccaccttaccattagcgttataa

SEQ ID NO: 695 - DNA, 318 bp, Staphylococcus epidermidis
tcctcccatggaaccatttgctttaagccttctcttataatcctttcatcatcacaaataactactttaaacatctttattcctcctagacaagtggtatttggtaacacattaatgtcccttgctggcttcttgagaaaatgtgcagacgtgcatatgttccatattgaatcatggctctattatgtaaatgatttaaacctaggtgtgtcgtatcaaaaacatcgtgatgaagggattggcgcacgtgttctaaatgtgatggagacataccgatgccattatcatgaaccagaatatgtaatttgcgcttcgtaa

SEQ ID NO: 696 - DNA, 1128 bp, Staphylococcus epidermidis
attcagaaaggatgtactatcatgtctcatcatcgcatcatcatcatcggcgcaggagccgctggtgtgggtatggcaatcactttacaagaattcaatattaaagatgttctaattgttgaaaagggaaccatcggtcattcatttaaacattggcctctatcaacaaagaccatcacaccatcatttacaactaatggttttggcatgccaaatatgaatgcaatagctaaagatacatcacctgccttcactttcaatgaagaacatttatctggaaaacgttatgctgaatacctctcactagtagctacgcattacaatctaaatgtcaaaacaaataccaatgtttcacgtgtaacatacatagatggtatatatcatgtatcaacggactatggcgtgtatacagcagattatatatttatagcaactggagactattcattcccatatcatcctttttcatatggacttcattacagtgaaattcaaacattcactcaattaaaaggtgatgcttttacaatcattggtggtaatgagagtgcttttgatgcagccataaaccttagtcaaacaggtgcaaaaatatcaatatatacatctaaaactggacttaaaaaggaagatgcagacccaagtataagattatcaccgcatactcaacagcgattacagaatgctatacaagagggtgcattaatcgaaatgcatgttggctaccaggcacgcaaaataacatatcaaaatcattcctataagatacactttgataatggacatattgttcactctcatactgaaccgattattgcaactggatttgatgttacccaaaaccctttaatagaacaactatttcaagtacgacaatcagaagttcaattaacagaattagacgaatctacaaagtttcctaatgtatttttaattggggcgactgtacgtcatcaaaatgccattctttgttatatatataaattcagagcacgttttgcagtattagcacgcatagtaagcctacgcgaaggcttacctgaagatacgtctttaattcagtcatatcgtcaaaaaaatatgtttctagacgattatagttgttgtgatgtgaattgcacatgttaa

SEQ ID NO: 697 - DNA, 939 bp, Staphylococcus epidermidis
gtggaaagggggagtcaaaaggtgaaaacgctaatgattaaagcaatggggacggtgatacgtttatcgattgaacatcaacatccggatacattacttcaagaagctgaaataaaaattcgtgcttgggaatcacaatttagtgctaatgatccgaaatcagatttgatgaatgtgaatcaacatgcaggtatcgcaccagtcaaggttagttctgaaatctttaacatgatacgttatggttatgaaactacattatcttctaattttaagatgaacattttgatagggccactagtcaaattatggaaaattggttttaaagatgcattgaaacctaaagaagtggatatacaacgtgctttattgtgtatgaatcctgaaaatcttgttctaaattcaaaaacacatgaagtatttcttacacaatcaggaatggagattgatttaggagccatagttaaaggttattttgctgatcaattacagcaatactttttagctcatggtgtatcttctggcattatcgatttaggtggtaatgttttaacaattggtagacaacccgaaacattagaaaaatggcatgtaggtgtacgtaatccatttcataaggatacactaccactcgttacattaagcgtagagcatcaatcagttgtcacatcaggtatctacgaacgctacttcatacaggaaaatcaattatttcatcatatattggattcaacaacaggttatcctgtagataatgatatcgctagcgtgacaatcatatctgatcatgggattgatggcgaggtatggagtacaatttgtagttttggtcagtcacaaaaaaatattgaattattaaatctcattgacggtattgaaggcattattgtgacaagagatggaagcgttttaatgacttcgaaaatgcaaaagtatttataa

SEQ ID NO: 698 - DNA, 984 bp, Staphylococcus epidermidis
tgggatattatgaaagttaaactttatacgttgttattattactcatttttctgatagcatgcgctccaacatcgacttcacaatcacctcatcctttacgtacgttgattgtttattctccttatccatcacatttaattcgtccgattttaaatgattttgaaaagcgagaacatgtgaaagttgaaatcaaacatggctcaactcaagtattactatctaatattcacaaagaagcactttctaaacgtggggatgtctttgtgggtggcgtgttatcagagatgatagatcatcaagaagattttgttccttaccataatcgttctacactgaaacaaatagaggattatcgctctaacaacccattagtcacgagctttctattgatgccaacagtaattgtagtgaatacagatttacaaggtgatatgactattcatggatataaagacttacttcagtcttcactaaaggggcgtgtcgtttattctaatcctcattctacgacgacaggataccaacatatgcgtgcgatgtatcatatgcgtcaccaagtaagcgatgttcatcaatttcaacaccatgctgtacagttatctaaaagttctcaagtgattgaaaaggtggctaaaggtgcttattacgctggattgagttatgaacaagatgctagaacgtggaaacaaaaaggataccctatctcaatcatttaccctactgaggggacgatgttaaatgtagatggtattgctttagttaacaatgcacaacctcatcccaaacgtaaaaagttagtacaatatttaacaagccgttctgtacaacaacgtttggcagaagaatttgatgctaaatcaatacgtaaagacgtgactgaaacaaatcactcatctattgaaaacttggatcatattccactaatcccacaatcacgtgtatccaatattccacatcatcaatttttggagatgattcaatga

SEQ ID NO: 699 - DNA, 777 bp, Staphylococcus epidermidis
gccaagattatggctcatattacattaaattatttatctaaaactttaggaatgcatcaaacgattaatgtcattcttccagaagataaaagttactttgatacaaatgaaaatgcgaaaccattaaaaactatgttattgctacatggtttatcaagtgatacttcctcttatatgagatatacgagtatagaacgctacgcgaatacccaccaactagcagtggtgatgcctaatgccgatcatagtttctattcaaatatggcttatggacatagttattatgactatatactagaagtttatgattatgttcatcaaatattgccattgtctaaaaagagagaagataattttatagcaggtcactctatgggaggttatggtgcaatcaaatttgcattaacgcaaagttatcgtttctcaaaagccgccatgctttcagcgccatatgatgtttctatgattggtcaatatcaatggtatgattttacgccagaagcgattgtaggtaatacgcaacatgtcgcggggacatcttttgatccatactatttagttgaacaagcaatagacaatggacaagcgttaccacaactatatattacttgtggaactgaagatgaactgtatcaaggtaatattgattttgtgaactatttagatgaaaaaggtattccatatcaatttaaaaaagcgccaggtaatcacgattatgcattttgggataaagcaatagaagatgtcattgaccgttttacatcatcacatatttaa

SEQ ID NO: 700 - DNA, 195 bp, Staphylococcus epidermidis
acttatgttatgtatacaaaatgttacacatgtactttatattcaacttcactttttttcttatcaaaatacggtacaacaaatattacaaataaagcacatccaatagctaacaaaaaacctaaattttccaatttattcactccttattttgtgtacaatatcaacactattattcttcagaaatactcttaa

SEQ ID NO: 701 - DNA, 393 bp, Staphylococcus epidermidis
ttagtttatattataaatatattaatatttaagattttaggagatgcacaaatgcttaaaattaatttttttaataaggaatatggagttttaaaatcacaaaattacgaaagaatttcactagaattattgaacaaacattaccatataactgaaaatgattttaaaaacaaagattattgtttggataaatttaatagtaaagatacatttattggcgatatagcacatacagagaaagagttaatttctttaattgaagataatattaaaaatcctaaaaatatggagcatcaaaatctatcaagcatattcgattatacagatcatcataataaccaacgtgtctatcacagtattttagatcttatacaagacaatacgtcttcttaa

SEQ ID NO: 702 - DNA, 774 bp, Staphylococcus epidermidis
tcaccgtatattcatggctattatttatacggtagcgataggtattatatatttatggattcaattgtaaaggagtcatattcaatgatagatattcaaaatgtttccaaaagctataaaaagaagcatattttcgattccctagatatgcaatttcaaaatcataaaattactattttattaggtgaaaatggtgctggaaaatctacattattgcgtttaattgcaggtattgagaatgcagacgaaggacgtattcaatacttcaatcaatatttgtcaagacgtcgaatacgtcatattgtaggctatgtccctcaagacatcgcactattcgagcatatgactgtcatggagaacattgagtttttcaagtcactttgtgaaaatcctatttcagatgaaacacttcattcttatttatcacaattaaactttactgatacaaaagtgaaagtatctaacctttctgggggaaataaacgtaaagtcaatattatgataggtctacttagtcggcctaaaatacttattctagatgagccaacagaagacattgatttagaatcaagatatgatattcacaacttattacaacaaatgaccgatcaatgtttaatcatcatgacgacacatcatttagacgaagttgaagcactagcagatgatattaaagttataggtcaaaatcctttttatcatgatattttagaaaataaaggttggtcttttaaaaaatatgcaaatgccttagctgataatacgaaatcttaa

SEQ ID NO: 703 - DNA, 219 bp, Staphylococcus epidermidis
ataattaatattgaagctacccaatatgagggtagagctgttagtagaaaagctattgaacgtatagcacgatctggaaatctaccactagtcaaagcactcactatgcctagtacaacagacgttatcatcaccacaacactggaaatcaaagtgagttttaatgtattcataaacgctggccccatacgctcagatactggatcccctgtgatataa

SEQ ID NO: 704 - DNA, 396 bp, Staphylococcus epidermidis
gaagcaaatatttcattaaaaataaggtgcatatcaatgaaaagattgatttttatagttgttattctctttatccaagcctgtagttatgttgttattaactttttcttcttcgacatgtgggtgattcactctagtgaacaacaattaaatcaatccatacaacatcatgacacaaagcaacttcataagattgctaaagataagcagacatatcagtttttaaaaactataaaaaaagccgatttcgaaaatgcgacagataaccaaggtggtgggcctattggttattatcgtttagatattaataaaaaacccgtcggacttacaatcaatattaaatataacttccttccagaaaagacaactattaaatcaataaagttatatcaataa

SEQ ID NO: 705 - DNA, 3054 bp, Staphylococcus epidermidis
tgtgaaaatattcacaaaaaactaggaggatttgctatgagtaaggaaatattcgatacttttaaatttaaatgtggtgccgaattaaaaaatagagtattaatggcacccatgactatccaagctgggtattttgatggaagtgttacatcagaaatgattgattattatcaatttagagctggtgatgcttcagcaatcattgttgaaagttgttttgttgaaaatcacggacgaggatttccgggagctataggtattgataatgatgacaaaatacctggactcaaacgtttagcagaagcgattcaagctaagggatcaaaagcgattttgcaactttatcatgccggaagaatggcaaatcctaaatttaatgaaggagagcagccgatatctgcgagccccattgcagcattaagacctgatgctgtaccacctagagaaatgacacatgctcaaatcaatcagatgattgatgactttggagaggctacacgtcgcgctatagaagcggggtttgatggtgtcgaaattcatggcgccaacacatacttattacaacaatttttctctccacattctaatcggagacaagattcatggggaggcagtcgtgaaaaacgtacacgatttccaatcgaagttttaacaaaggttcaacacgtcgttgctgaaaaagaggcttctcattttattataggatatcgattctcacctgaagaaattgaagaaccaggcatacgttttgaagataccatgtttttactaaatacattagcagaatatgaacctgattacttccatatatcagcaaacagttatcaacgtacatctattgtgaatcaagaagatacagaacctttaattaataagtacatcaaaatgcaaagtgcacagttggcaaaaattccattaattggtgtaggtagtattgcccaacgacaagatgcagaacatgcccttgaactaggatatgatcttttaagtgttgggaaagcctatttagtggaaccacaatggacagataaaatttcacaaaacgaagaagtagaacaatttgtcgatatacatgatcagaaagtacttcacataccatcccctttatggaaagtaatggactttatgattttagataaagaagaagagcatcgtaaatatgaaaaattaaaagcacttcaaaataaaaaagttaaatttaacaaaggtacgtatcatgtctatgcaaaaggtcataatggcaacttacctatgaaagtccaattatcagaagataagattgtaagtatcgaggtagatgatagcggagagtctgaaggcatagcgaacccagtgtttgaacgtttacctcaagatattatcaatgggcaaacactgaatgtagatgtcatttcaggtgcgacagtaacaagtgaaggcatcgtgcaaggtattgcagatgcaattgaacaagcaggagaagacccagatattttacgggcgcgtcctaaaccagtcgttcagtggtctgatgaggtcgttgaagagacgactgacgtcgttgtgatcggtacaggaggtgccggactcagtgcagctgctacggtattagatgaaggaaaagaagtcatcatgcttgagaaatttgcggctataggtggcaatactatccgtacaggtggtcaagtcaacgctgctgagcctaaatggcaaaatgcattcccggcacttgctggtgaaaaagagacactcatacagttattaaatcatgatgaaaatgatatagatgaagcttacattgaagatttcaatactttaaaacgtcaaattaaagactaccttgaaaatagcagtaatgaagatgaatatctttttgattctgtcgaattacatcgtattcaaacatatttaggtggtaaacgtaaagatcgtaataatgtcgaaatatcaggtgattatgatttagttaaaacactcacagataacgttttggaatcagtatattggttgaaagacaaaggtgtacattttgatcgttcgtttgtagatatgcctgtaggtgctttatggcgtcgtggtcataaaccaatgaaagcacaaggtttagagtacattgaaaatttaggagactacgttaaacataatcatggtcgtatttttacagaaactactgcagaaaagttaatcaaagaaggtaatcaagttgttggtattgaagcacgtaaagcaaatggtgctaaagtgaagattcatacacgtcatggtgtagtgttggctactggtggctttggagcgaatacaaaaatgctacaacaatataatacgtattgggataatattcctgatgacattaagacaacgaattctcctgcaattacaggtgatggtatacgtttaggtgtgcaggcaggcgctgacatcgtaggtatgggattctctcaaatgatgccgatttctgatccgaagacaggtgcattgtttactggattaattgtaacaccttcaaactttgtcttcgttaataaggaaggacagcgttttgttaacgaatttgaaagtagagatgtattatctaaggcagcattagaacaaaaagacggtatcttctatattattgcagatgcaaatattaaagcactagctatgaatacaactgaggataaaattaatcaagaattagaagacggcactttagtaaaagcagataccttagaagcattagcccaaaaattaaacattgatacaactacttttgtgaacacgattgaaagatataataccttcgtagaacaaggacaagatgaggatttcaataaaaatgcatttgatttaaaaattgaaaaagcaccattctacgcgacaccacgtaaacctgcaatacatcatactatgggtggtttaaaaataaacacgcatgcacaagttatagatgttgaaggtcatatcattgaaggtttatatgcggctggtgaagttgccggtggtattcatgctggtaaccgtttaggcggaaatgcactggcagatatttttacttttggtcgcattgcaggtcaaagtgctgtaacgaaataa

SEQ ID NO: 706 - DNA, 192 bp, Staphylococcus epidermidis
tacgaaatcttaagctgtactttcactccatcacttcatcaatatttaacatcaaaaaggcttgccctttcgtcgtatatttctcgattgaaaaggcaagccttaataaattttatacacatttatttatcgtgtctaacttatctgtacactaatccaccatcagttaaaatggattggcctgtaatataa

SEQ ID NO: 707 - DNA, 1221 bp, Staphylococcus epidermidis
gtatgtctaataaagaaattaaaaaaatggttaaaattttcaacaaagccttacatcaaacattgggtaagaagtaagaggggatttatggacattaaagcacagttaaaacagattcaagataaaggtttatatagagagcttcagccgattcagtccgtagaaaaacaatatatttatatcaatgaccaatcttatattaattttacttcgaacgattatctcggtataggacaacttgaatatcaacctcaaaatttcttagattttataaagacatatagtatccatctatcaagttctagattagtgagtggcaactcagtcgtttatcagcaattagaacaggcaattagcgagcattttaattttgaagacgccttaatttttaatagtggttacgatgcgaatttggcggtatttaatatttttaaaaataataatgtagttatcttttcggatcaacagaatcacgccagtataatagacggtattaaattaagtggtttatcaaaagtgatttatcaacatttaaactatgatgacctggaaagtcatttagcacggcacaccaatccagatgttcaaaaagtaattgtctctgatagtgtgttttctactaatggcactaaagcagatattaataggctagtacatctcaagcaacgttacaatgcgattttaattattgacgcatctcatagtttaggattaaatctctttgagtatcatgcagacattgacatagttacttcaagtttatctaaagcgtggggagcccatggtggcttaatactaagttcaaaagatataaaagatttaattattaataaaggtcgttcgcttatctactcgagtagtttacctagctatcatttgtattttattcaagtgagcttacaacatgtgattgaagatacatacagacgagagaagttgaatgcacttagtgaatattttaaccaccaatttatggaattatttcccaatcaaccattatctaatacacctatcaaaaatatcgtttgtgatagtttggcttcagcacaagcacaatacgacatgttatttgaacatggtatatttgtcagttatttaaggtatccaacagtgtcacagccaacattaagaatttcattatcctattttcatgacacagatgatattaatcgacttttcaatgtaatgaaacaatacgatgaaggtgatagctatgtatag

SEQ ID NO: 708 - DNA, 321 bp, Staphylococcus epidermidis
tgtgactttttcaaaaaaatgtgtcgtaaaattcttgtatataagcatactatcacagtaattaagggtttctttctccacacttcacacaatttttttaatacccctttactatcaatagttatcgagtttaactacataccttttgatattggtaagcttaataaaacttttcaaacatacaaacaattgaatataccattattattcaaaagaatcctttctaacgaactatatactataattaaagttttacaaaaatttgaaagtctaaattttacatattttatatatatagcgcacttcattattatgctataa

SEQ ID NO: 709 - DNA, 885 bp, Staphylococcus epidermidis
ggtgaatcaatgaataaattatcaaagtacattgcaatagctacattagcatcgacagttacaatttcagcaccaattcatacatatgcatgtgaatctcatactaaagataaccataatcaaacgacacaacatcaaaatgaccccaaccttggtgaacaaaatgtaatggctgtctcatggtatcaaaattctgccgaagcgaaggcactttatctacagggatacaatactgcaaaatatcagttagatgaacatattaaaaagaataaaggtaagaaaaaacttgctatagctttagacttagatgaaacagttcttgataattcaccatatcaaggatatgcttctatgcacgatacgtcttttccagaaggatggcatgaatgggttgctgcagcgaaggcaaaacctgtttatggcgccaaatcattcttaaaatatgctgacaaaaaaggtatcgatatttactatatttctgaccgtgataaagaaaaagattttaaagctacaaaggaaaatttaaaaaatattggactaccgcaagcgaaagataatcatattttactaaaagggaaaaacgataaaagtaaagcatcacgacgtcaacaagtcgaaaaaaatcataagttagtgatgttatttggtgacaatttgttagattttacagatcctaaaaaatctactgctaaagaacgtgagaaactcgtgaagaaacatgcaaaagattttggcaaaaagtatattattttcccaaatccaatgtatggaagttgggaatcgacactttatcataatcaatacgaaataagtaagaatgagaaggatgaactacgaaaggcatcaattaaacaatttaatcctaaaacgggtgaagtaaaataa

SEQ ID NO: 710 - DNA, 1365 bp, Staphylococcus epidermidis
gaggatccaatggctaatacacgagagttaaatcataaagatgcacagtatgtatggcacccattcacacagatgggagtctatgctaaaaatgacaatattattattgaaaaaggtcgcggaagttatttatacgatactgaaggtaataaatatttagatggttatgcgtcattatgggtcaatgtgcatggacatcagcataaaaagttaaataaagctattcataaacaacttgataagattgcccattctacgctattaggttcgtctaatattccatcgattgagctagccgaacagttagtcaaattaacaccagatagattacaaaaagtgttttactccgatacagggagtgcgtcggtagagattgctattaagatggcttatcaatattggaagaatatcgatgctaaacgatatgcgaagaagaataaatttcttacattacatcatggatatcatggagatacaataggttctgttagcgttggtggtatcgatagtttccacaaaatttttaaagaccttatttttgaaaatatacagatagaaacaccgtgtttatataaaagtaagtaccgcaatgaagcggaaatgcttaattcaatactgaatcaaattgaaaatatattatctgagagaaatgatgaaatagtaggatttattctagagccacttatacaaggtgcaacaggtttattcgttcatccgcatggttttttgaaagctgtagaacagttatgtagaaaatatgatgtattactaatttgtgatgaagtagctgttggtttcggacgtacgggagaaatgtttgcttgtaaccatgaagatgtacaaccagatattatgtgtctgggtaaggcgattacaggtggttatttaccgttagcggcaactttaacatctcaaaagatatatgatgcttttttaagtcagagtcacggtaagaatacgtttttccacggtcatacatatacaggtaatcagttagtttgttccgtagcacttgagaatattaatctttttaaaaagaagcatctgattgggcacattcaaaagacatctcaaacattaaagcaacgcttagaggcacttcaacctcataaaaatattggagatattaaagggcggggattaatgtatggtgtggaattagttgaaaacaaatcaacgcagacaccactcgatattccaactgtagaactgattatacgtcgatgtaaagagaatggattgatgattcgtaatttggaaaatgtcatcactttcgtacctattttaagtatgtctaataaagaaattaaaaaaatggttaaaattttcaacaaagccttacatcaaacattgggtaagaagtaa

SEQ ID NO: 711 - DNA, 588 bp, Staphylococcus epidermidis
ataattacaattatatattatttagaattcgataaagaaggtgacgaaatgcctagaatttccaaaagacaattaatattagaatcggccgcagctattattaatgaaaaaggtgctgattatctcacgttggatgctgtagctcaaagggctggaataagtaaaggtggtttattttatcattttaaaagtaaagatgaactcatcaaagagctggttaactatgccaataatttgtacagagagaacgtgaaccaacatatcggtaatgaaaagaacaaaaaagggcaatggctcaacgcatttatagaagcgacaagagcacatcgtacggataatgcgcctattacttctggaatgttagcggcgcaagggactaatagaagtttattatcaccattaaagacctcatatcaagaatggcaatatcaaattacccacgacgggttagatgaggtagatgcaaccattattcgtttagctgtcgatggtttatggttgtcggaaatattcggaattagtgctatagatgaagaaatgagagagaaagttattgaacgtttaaagatgcaaatagaaaaaaagtaa

SEQ ID NO: 712 - DNA, 816 bp, Staphylococcus epidermidis
atgtatacaataatagagagatgtgaaaagatgaaatattatgggaagtgcatttcttacataagcattttaatattaacgttttttattggcggatgtggatttatgaataaagaaaataataaagaagcagagattaaagaaaattttaataaaacattaagtatgtatccaattaaaaatttagaagatttatacgataaagaaggctatcgtgatgaagaatttgaaaaagaggacaaagggacatggattattaattcagaaatgaatattcagaaaaaaggtcaagcgatgaaatctagaggtatggttttgtatatgaatagaaatactagaaagacgactggtcatttttatacaaatataattacagaagataaaaaagggagagtgcacagtaaagataaagaatatccggttcgccttaaaaacaataaaattgaaccgactaaatctatcgccgatgaaaaattaaaaaatgaaattaaaaactttcagtttttctctcaatatgggaattttaaaaatttaaaagactacaagaatggaaatgtgtcttataacccaaacgtaccaagctattcggcagagtaccaattaagtaatgaagatgacaatgtgaagcaactcagaaagaggtatgatattccgattaagagagctcctaaactaatattaaaaggggacggtgaccttaaaggttcatctataggttataaagatatcgagttttcttttgtcgacaataaagaagaaagcgtctactttgtggatagtttggaatttaatccaagtgatgtaaataatgagtag

SEQ ID NO: 713 - DNA, 195 bp, Staphylococcus epidermidis
gttattcaaatgaatcattttggtaagcttcatcgtatatcattaatattaaatattatgtttttaatactcatgcctaaaatctatagttttgataatatttatttatcaataatttggactttgttaggaatagcaaatgctgtctacttattgattaagcaaaaacaagaaaacaccattaaacgtaaataa

SEQ ID NO: 714 - DNA, 978 bp, Staphylococcus epidermidis
aggagacaaataatgaaattcgcagttgttggaacaggtgtaattggtagtggatggattactagaatgcttgcgcatggtcatgaagtgattgctactgatccaagtgaaggtgcatatgaacgcatgttgacacaagttaaacaaaattggccttacgcagagcaaatgggccttgctgaaaatgcatcaattcaaaacctaacatttacaccacatttagaagaagcggtcaaagatgcggatcatattcaagaaaatgtaccagaagtagaagaaattaaagatgctgtattaaaagagattgatttttatgcgaaacctgaagcaacaattggttcaagtacatcaggaattatgccttcagaattacaagctaacttatcacatcctgaacgattagttgttgcccatccatttcacccggtatatattttgccattagtcgaaattgtgccaggtaagcaaacatctgaagaaacaacagttaaagccgaacagatttatgaaagtattggtatggatgttttacatgtgcgtcatgaaatagaaggacatattgcagatcgtcttatggaagcattatggcgtgaatcattgcacatagttaatgatggtattgcaacaacagaggaagttgataaggcgtttacccatgcagcaggtttacgttatgcacaatatggtccatttatgacgttccacttggcaggtggtgaaggtggtatgcgtcatatgttaaaacaatttgggccagctttaaaaaaaccttggacaaaactcatcgcgcctgaactgacagatgacctatatcataaagtagtaagtggtagtgaagcatcttctcaaggatatacaatgtctgaacttgatcaaaaaagaaacgaatttctaattaaagtgaaagaattagcagaacaatattggccaagtgatagtaaagcgatgaaaaagtctaacggagcggaattacaatga

SEQ ID NO: 715 - DNA, 1257 bp, Staphylococcus epidermidis
aaagtgaaaatcattactaaaaatgaggaggactgtgaaatgactgtattgagtgagcaagacaaaataagattattagctgatatcgtcaagattcaaactgagaatgatcatgaaattgaagtatgtgagtacttaaaagacctgttaagtcaatatgatattgattctaagattgttaaagttaatgattcacgcgctaatttagttgctgaaattggtagtggcgctccagtcttagcaatcagtggacacatggatgttgtagatgctggtgaccatgatgattggacttttcctccatttgaactcacagataaggatggcaagttattcggcagaggtaccactgacatgaaaggtggtcttatggcgatggtcatcgcgatgattgaattgaaacaatcaaacgcattaaagcaaggtacgatacgtttattagctactacaggagaagagacggaacaatatggtgcacaattacttgctgatgaaggttacttagatgatgtgagtggtttaattattggcgaaccaactagtaatatcgcttactatgctcataaaggttctatgagctgtgtagtcacagcgaaaggtaaggctgcacacagttctatgccacacctaggtacaaatgctgttgatattttagttgattttgtaaatgaaatgaaacaagaatataaaaatattaaagagcatgataaagtacatgagctagacgctgttccaatgattgagaagcatctccatagaaaaattggtgaagaagaatcacatatctactctggatttgtaatgttaaactctgttttcaatggtggtaaacaagttaattctgttcctcataaagcgacagctaaatataatgtaagaactgttccagagtatgacagtactttcgtgaaggatttatttgaaaaagtcattcgtcatgtgggtgaagattatttaactgtagatatacctagcagtcatgatccagtggcaagtgatcgtgataatcctcttattcaaaatattacacgtattgcaccgaattatgtacatgaagacattgttgtgagtgcattgattggtacaactgatgcatctagtttcctaggaacaaatgaaaataacgtagattttgctgtctttggacctggtgaatctattatggcgcatcaagttgatgaatttattagaaaagatatgtatttaagttacattgatgtttataaagatgtatttaaagcatatctagaaaaataa

SEQ ID NO: 716 - DNA, 2271 bp, Staphylococcus epidermidis
caatacgaaatggaggcggagagtatgttagaaacaaataatcatactaatgcttggcaaggatttaaaacaggtcgttggaataaaaatatagacgtgagagaattcatacaattgaactattcattatatgaaggtgacgatgaatttttagaaggtcctacaaaagcaactgaaactttatgggatcaagtaatgcaattatcaaaagaagaacgtgagcgcggtggcatgtgggatatggatactaaagtggcatcgacaatcacttctcatgacgctggttacttagacaaagatttagaaaaagttgttggtgttcaaactgaaaaaccattcaaacgttctatgcaaccattcggtggtattcgtatggcaaaagcagcatgtgaagcgtatggttacgaattagacccagaaacagaaaaaatcttcactgaatatcgtaaaacacataaccaaggtgtattcgatgcatattcaagagaaatgttaaattgtcgtaaagctggtattattactggtttaccagatgcttacggacgtggacgtattatcggagactatcgtcgtgttgctttatacggtgtagacttcttaatggaacaaaaacttaaagactttaacacaatgtccactgaaatgtctgaagatgtgattcgtttacgtgaagaattatcagaacaatatcgctcacttcaagatttaaaagaattaggacaaaaatatggatttgatattagccgtcctgctactaacttcaaagaagctgtgcaatggttatacttagcatatttagctgctatcaaagaacaaaatggtgcagcaatgagtttaggacgtacttcaacattcttagatatttatgctgaacgtgatttacaaaatggtgacatcactgaacaagaagttcaagaaatcattgaccacttcattatgaaattacgtatcgttaaattcgcacgtacgcctgaatataatgaattattctctggagatccaacttgggtaactgaatctatcggtggtgtaggtattgacggccgtccgatggtaactaaaaactcattccgtttcttacactcattagataatttaggtccagcaccagaaccaaacttaacagtattatggtctacacgcttacctgaaaacttcaaaatctattgtgctaaaatgagtattaaaacgagctcaatccaatatgaaaatgatgatttaatgcgtgaaagctatggcgatgattatggtatcgcttgctgtgtatctgccatgaagattggtaaacaaatgcaattcttcggtgcacgtgctaacttagctaaagcattactttacgctatcaatggtggtaaagatgaaaaatctggcaaacaagttggaccaagttatgaaggtattaaatcagacgtactagattatgatgaagtcttcgaaagatatgaaaaaatgatggactggttagctggcgtatacatcaactcattaaatatcattcactatatgcatgataaatacagctatgaacgtcttgaaatggctttacatgatacagaaattattcgcacaatggcaactggtatcgctggattgtctgtggcagctgactctttatcagcgattaaatatgcacaagttaaacctatccgtaatgaagaaggtcttgtaactgactttgaaatcgaaggcgacttccctaaatatggtaataatgacagtcgtgttgatgaaattgcagtagatttagttgaacgtttcatgactaaattacgtagccataaaacataccgtaattctgaacacacaatgagtgtattaacaattacttcaaacgttgtttatggtaagaaaactggtaacacaccagatggacgtaaagctggcgaaccatttgcgcctggtgcaaacccaatgcatggtcgtgaccaaaaaggtgcattatcttcactaagttctgtagctaaaataccttatgattgctgtaaagatggtatctcaaatacatttagtatcgtaccgaaatcactaggtaaagaagaagcagatcaaaataaaaacttaactagtatgttagatggttatgcaatgcaacatggtcatcacctcaatattaacgtgtttaatagagaaacattaattgatgcaatggaacacccagaagagtatccacaattaacgattcgtgtatctggatacgctgtaaacttcattaaattaacacgtgaacaacaattagatgttatttcacgtacattccacgaatctatgtaa

SEQ ID NO: 717 - DNA, 504 bp, Staphylococcus epidermidis
cggagcggaattacaatgatgaatcaacagtatgtgtttcacacaaaagtacatcgtgattgggtagatcataacgggcacctaaatgatgcaatgtataaccgaattttcagtgatacaacagatgattggttaggtcatttaggcttaactattaatgccattcaatcttatcaatataccgtattcaccttagaaaatcatgtcatgtttcttaatgaaatgaaagaaaatgaagatgtcattgttaaagtacatcttcacgattatgatagcaaacgattacatgtcctaatggaaatgtttaatgcagatgatgatttatgtgcaacatatgaagtgatgctgatgggcattgatacgacttcaggaagaccttcagcctttccgaacgacattttgaataacattgaacactattataatattgagaatgtggagatgacatctcaatatataggtcatcgtattggcatcaagaaaaagccaaaaagcaaagagtaa

SEQ ID NO: 718 - DNA, 255 bp, Staphylococcus epidermidis
tacgttatgatggattttttacattacatactgccagtcattatatacgctgttttgcttgctattcattactttttatcgcgtacgggaaataaaatattaggccttattgtgcctgttggtgtgattgcaagtcttgtatatatgtatcaagccgatattatacatatgaaaatgattggcgttattattataggtattgtggctctattattcttggcagaggagtggcagagagcacaaaaggataaataa

SEQ ID NO: 719 - DNA, 642 bp, Staphylococcus epidermidis
gacaccatgataaagtttatttcggaacatagtggtatgttatttgcaaagactttcgaacatttgtacatatcgatagtggcattggttattgcaatgatcgtagcggttcctttaggcattttattatctaaaaaagaaaagctttcgaaagtgtcattgacgatagctggcgttttacaaacgatacctacattagcggtattagctttaatgattccattatttggcgtaggaaaaacacctgcaattatagcgttatttttatatgtattattaccaattttaaataatacgattataggcattcaaaatatagattccaaccttagagaagcaggacgtagtatgggaatgactaactttcaattgatgaaagatgttgagttgccactcgcattaccattaatacttagtggaattagactgtcttcggtctatgtcattagttgggcaacattggcaagttatgttggtgctggtggtttaggtgattttatctttaacggattagcgctatttgaaccgagtatgattattactgcaactattcttgtcactgctattgcacttattgtagattatgttttatcactgattgaaaaatgggttgtacctaaaggattaaaagtttccagataa

SEQ ID NO: 720 - DNA, 192 bp, Staphylococcus epidermidis
ttaaactcgataactattgatagtaaaggggtattaaaaaaattgtgtgaagtgtggagaaagaaacccttaattactgtgatagtatgcttatatacaagaattttacgacacatttttttgaaaaagtcacactatcaaaaattaaaaaatattattataataaatgttgtgaaaaacgtattagattaa

SEQ ID NO: 721 - DNA, 711 bp, Staphylococcus epidermidis
aacaatacgatgaaggtgatagctatgtatagtataaaaatgcgtgcaagccacgaagatgttcatattagtggtgctgaaacaatgtgtgaatttgaggatttagaaaattatttaaaaaaatattttaataaagcctttaatcatgaaaatggaaatatagatttcttaaatttgaaaattgaaaaggttaaggcaccgattcaaacgttagtagcattaccagtggttgaaaatctaaacgatactttaacacaattagcaaaacaaacaggtgtttctgaatatgcgctaaacaaagggttagaatttataaaaaatgatattacttatactggagccattattctatctgcacaaaccggacaacgacttgatagcactgaacaacgaggtatcagggtaacacaattagcatttaaaacatgcaaatgtaatggagaaatatcagaaagagtaaaagatgcacgtgcacttgcaacttgtatcaatgcatttgaaggtgtaaaagcagaactatgtgtatcagacgatttgcattacacgactggatattttgcgtcgcctaagttaggatatcgtagaatctttaatattaaagaaaaaggtacgcgtcacggaggaagaattatcttcgtagacgaaggaataaatttaaatgaatatgtttcctttttagaaacagtacctaaagaaattatagaaaaataa

SEQ ID NO: 722 - DNA, 579 bp, Staphylococcus epidermidis
agaatgaatgtagcagatatcaaagcacgcttattagatttagaaaatacttttaaagaaaaagaaagtgaactgactgatttagacagagctatcggtgatggagatcatggtgtaaatatggtcagaggtttcgaacacttaaaagaaaaaatagatgatcaaagtatgcaagcgctatttaaatcaacaggtatgacattaatgtctaacgtaggtggtgcttctggaccattatacggatttggttttatcaaaatggcgagtgcagtgaatgatgaaattgatcatgataatcttaaagaggtacttaaagcgtttgctgatggcattcaacaacgtggtaaagtcgaattaaatgaaaaaacgatgtatgatgttatcgaacgtgcgagagaagctgttgaaaaaaatgaaacagtagatctagataaactacaatcatttgctaatgaaaccaaagatatggtagctactaaaggccgtgcatcatattttaacgaagcttcaaaaggttatattgatcctggtgcacaaagtagtgtttatattcttaatgcaattataggaggagagtaa

SEQ ID NO: 723 - DNA, 228 bp, Staphylococcus epidermidis
aatatttgcttcttatatttaatttatcataatattgttcagtttaacttaaaattcacgatgttcaatatatattcatcattctatattttgtataaaaagcatggactatatttaacagtttgctcatttacttttcggcccactatatgtttaagtaatcagtctaaaacttatttttatgtcacttttgtaaattgctcgagatttactactactaaatattaa

SEQ ID NO: 724 - DNA, 948 bp, Staphylococcus epidermidis
aggagcgtcgtcatggttaaatttattatgaaacgtcttacgctcatgattccattattgattgtagtgacttttatgactttcatgatgacctatctcacgaacgaagatccagccgtaacaattttacatgcccaaggaacgcctaatataacgcaagatttaatagctgaaactaaagaaaaatatggattaaatcaaccgatattcacgcaatataaaaattggcttgttgatgccttgcagtttaaatttggaacgagttatatcacaggggatccagtatctgagcgtatggggccagcgtttatgaatacattaaaactcactttgatttccagtgttgtggtgatgataacgtctgttgtactaggcatagtgagtgctttgactagtggtagatttccagatcgtgctatacgttcaatagcttttctactaacagctctaccctcatattgggtagcttcaatattaattatttatgtatctgtaaaactcaatttattaccaacctcaggactcactggtccagaaagttatattcttccagtctttgttattacgattacctatgcaggaatttattttagaaatgtccgacgatctatgcttgaacaattaaatgaagattatgttttgtatttaaaagctagtggtgtacctcgtctgacaatgttgctgcatgtattacgtaatgcattacaggtagccatatctattttttgtatgtcgataccaatgattatgggaggtctagtcgttattgaaaatgtatttgcgtggccgggtttaggaccattaagtattaaagcgattactgaacatgattttccagtaattcaagcatacgtgctcattgtcgcggtgttgtttattctttttaatacacttgcagacatcattaatgcaatattaaatccgcgtttaagggaggcaatgaaatga

SEQ ID NO: 725 - DNA, 774 bp, Staphylococcus epidermidis
ttgacgatggtaaacattatggaaaaatttaaattaactggtaaggtggcaatggtcattggaggtgcaactggcattggtaaagctatggcagaggcattagcacaagcaggggcaaatatcgttatcgctgatttgcaatccaatattggtcaagaaacagccacaactatatctacacaatcaggtgttaaaaccacatcattaaaattagatataactcatctagatgaagtaaatcaaattgttgattatgtagtaagggaatatggaaaaatagatattcttgtcaataacgctagtatctcaattcaagatgatactgaaaatatttcgtatgaagaatggttaaaagaaatcaatttaagcttaaatggagcattctctgtagcgcaaacagtaggacgtcaaatgattgagaagggcagtggttcgatgattaatgtctcttcagtattaggattgattgctaataaaacgcaagaccagagctcttatgaaacgtctaaagccggtgtgacgatgctgactaaaagcttagctagagaatggtctagatatggaattaaagtaaatgcaattgcccctggttacatgagaacaatcgaaacggaaaagatactaaatgataatactgaaacaaatacaacgcctatggaacgagtaggtgagcctgaagaattagctggaataacagtttatcttgcttctgatgcatcatcgtttactcaaggtagtgtatttaatattgatggcggttattcagcattataa

SEQ ID NO: 726 - DNA, 585 bp, Staphylococcus epidermidis
ttaatcctattacaggagaaaaagttggcgaaggtaaatcaacagaaaaagtcactaaacaacctgttgacgaaattgttgagtatggtccaacaaaagcagaaccaggtaaaccagcggaaccaggtaaaccagcggaaccaggtaaaccagcggaaccaggtacgccagcagaaccaggtaaaccagcggaaccaggtacgccagcagaaccaggtaaaccagcggaaccaggtaaaccagcggaaccaggtaaaccagcggaaccaggtacgccagcagaaccaggtacgccagcagaaccaggtaaaccagcggaaccaggtacgccagcagaaccaggtaaaccagcggaaccaggtacgccagcagaaccaggtaaaccagcggaaccaggtacgccagcagaaccaggtaaaccagcggaatcaggtaaaccagtggaaccaggtaaaccagtggaaccaggtacgccagcacaatcaggtgcaccagaacaaccaaatagatcaatgcattcaacagataataaaaatcaattacctgatacaggtgaaaatcgtcaagctaatgagggaactttag

SEQ ID NO: 727 - DNA, 1422 bp, Staphylococcus epidermidis
tgtgatatattttttttaacgaagatgataggggtgttagggatgaacttttttgatattcataaaatgccaaacaaagggataccattatctgtacaacgcaaattatggctcagaaactttatgcaagcgttttttgtcgtattctttgtttacatggcgatgtatttaattcgaaacaattttaaagcggcacaaccgttattaaaagaagaaatcggattaacaacattagaactaggttatataggattagcgtttagtattacttacggtttaggaaaaacaatactcggttatttcgttgatgggcgtaatacgaaacgtattatttccttcttattaatattatctgcgattacagtacttattatgggatttgtattaagttatttcggttctgtgatggggctattaattgtattgtgggggcttaacggtatatttcaatctgtgggtgggcctgcaagttactcaacgatttcaaggtgggcgcctcgaacaaagcgcggtcgttatttaggcttttggaatacatcacataacattggtggtgctattgctggtggtgtcgcactttggggcgcgaatacatttttccacggtaatgtggttggaatgtttatttttccttccgtcatagctttaatcattgggattgtgacattatttattggtaaagatgatccagaggaattaggttggaatcgtgccgaagaaatttgggaagagcctatcgaccaagaaaacattgattctcaaggtatgactaaatgggatatctttaaaaaatatatccttggaaatcctgtgatttggattttgtgtatctctaatgtttttgtatatatcgtgcgtattggtattgataactgggcaccgctatacgtatcagagcatttacattttaataaaggtgatgcggtgaatactattttttactttgaaataggtgcattagtagctagtttattgtggggctatatctcagatttattaaaaggtcgtcgtgcgattgtagcgattggatgtatgtttatgatcacctttgttgtactcttttataccaatgcaacaagcgtgacaatggtcaatatttctctatttgcattaggcgctttaatcttcggtccacagttactcattggtgtatctctgactggctttgttcctaaaaatgcaattagtgtcgctaacggtatgacaggttcatttgcatatctattcggggattcaatggctaaagtgggtctggctgcaatcgctgatccaacacgtaatggtttaaatatttttgggtatacgttgagtggttggacagatgtctttattgtattctatgtagctttattcttaggaatgatattattagccattgttgcttattacgaagaaaagaaaattagaaaattaaaaatttaa

SEQ ID NO: 728 - DNA, 1632 bp, Staphylococcus epidermidis
gtttacatattttcgaaaagaaagaggaaaacaatgaataaactcacaaaactaagtacagtcatttttgtatctgggattattttagccggttgtggaagtaacaaagaactaacagagaaaaaagagaataaagtattatcatatacaactgtcaaagatattggagatatgaatccccatgtttatggaggttcaatgtccgcagagagtatgatttatgagccgttagttcgcaataccaaggatggtattaagccattattagcgaaaaaatgggacatttcacctgatggtaaaacatatacgttttatttaagggacgatgtatcttttcatgatggtacgaaatttgatgcagacgcagtgaagaaaaacatcgatgcagtacaacaaaataagaaactacattcatggttaaaactttcaacactgattgatgatgtcaaagttaaggataagtatacggtacaactacatttgaaggaagcttatcaacctgcgttagcagaactagctatgccacgaccatacgtttttgtatcgcctaaagattttaaacacggtacaaccaaagatggtgtgaaatcatttgacggtacaggaccatttaaaatgggtgaacacaaaaaagatatatctgcagaatttaataaaaataatcaatattggggagaaaaggcaaagttaaataaagtagaagcaaaagttaaacctgctggagaaacagcatttttatcaatgaaaaaaggagaaaccaactttgcttatacagatgatagaggtacagacagcttagataaagatagtttaaaacaattaaaagaaaccggaagctatcaagtaaaacgtagccaagccatgaatacaaaaatgcttgttgttaattctggtaagaaagatagtgcagtcagtgataaagcagtcagacaagcattaggtcacatggtaaatagagataaaatagctcaagatattttaaacaagcaagaaaagccagccacacaactatttgctaaaaatgtgacagatataaactttaatttaccaacaagaacatatgataagaaaaaagcacaagcgttattagataaggccggatgggtgctttcaaaagatcgacaagttcgtcaaaaagagggcaaagatttgaatcttaagttgtattatgacaaaggctcttccagtcaaaaagaacaagctgaattcttagaggcagaatttaagaagttaggtgtacaactagatataaacggagaaacgtcagataaagtagctgaacgtcgtagttctggtgattacgatctaatgtttaatcaaacatgggggctattatatgatcctcagagtacattagcagcatttaagacgaaaacgggatatgaaagtgcaacattaggtattaagaataagtcacaactgtacaaagatattgatgaggcgttcaaaattcaagatgcaaaggcacgttcaaaagcgtatcagcaaattttgaaacaagttgacgatgaaggtgtctttattccaattactcacgggagaatgactgttgttgcacctaaagatttacaaaaattatcctttacacaatcacaatatgagcttccatttaatgaaatgcaatataaataa

SEQ ID NO: 729 - DNA, 516 bp, Staphylococcus epidermidis
ttcatgatattatgcttcttctgcaagtattccatatgtcaaatctttattatgtatgaatcctacactcattcatcacaaataagaggtagctactctatgtcaaaaaagaaaatcttgatctttattagtgtcatattaatcatttttggaggtgtctacctcaaaatgaaatatgacgaaaaagcaaaacaaaaagaaatctactacaaagagcaacaagaacgtatcacgctttatcttaaatacaacacaaaaaaacctaatactatcaaatctgtccatttcacaagtttaaaacagggaccaatgggtgatgctattattgaaggctatatcaataacaataaagaaaatgaatttgttgcatttgcatcatctgaagataattttcaattccaaggtgatatgatagaaagcaaaaaagtatcaaatctaataaaatatcaaacaaaaacacctgatgaaatcaaaaaagatttagacaaaaagaaaaacgctaaagatttttactga

SEQ ID NO: 730 - DNA, 210 bp, Staphylococcus epidermidis
tgtcctccattgtttgttatatatattcttttgctcgtacaatacaaagtattttatatagaaaatgtttcaaatgccattaactatttattaactttagcaccaactcataactcttctaacacctcacatattaagttcagtttttcggataatttaatacttttaaggatattaagcgcttacattgatgtgatatattttttttaa

SEQ ID NO: 731 - DNA, 1026 bp, Staphylococcus epidermidis
accgttaaatttgaaaaagcgattggaacaggtgcatttgttgttgataaaactgttaaggaaaaaacgacattgaagcccaataaatattttgaccacggtcacccaatcaattatcatcttgcattccaaacgattgaagatggggactccagaaattctccagtacaaagtggttttgtagatatttctggtggtgctttaggtatgctctcagacgaacaaatcaaacaagataagaaaaataagaacttaacgattgaagatagacctagcacagtaagtcactttatggcatttaaccctaaaaatgatgtattaaatcaacgcacaattcgtgaagcgataagtaagagcatcgatgcgaaagacattgcgggcaaatctgtaaatggtctgttccagaagaacgtacaatttgtgactaaaaataatcaacagccacacgattatgatatgaaagcggctgaaaggttacttaaatcagaaggatatcataaaaacgatgacggcatctttgaaaagaatggcaaacctttatcatttaacttagtcattcaaactgcagagttcccaaattggaaagataaagctgaaaaagtgcaacgtcagcttaaacaagccggtattaagttaaatgtgaaaacgttagattcacaatcatactatgatacattatggacgaaaaaagactatgatttgattttctatagaacgtattcagatgcattaatgccttacaactttataagttcagtgtttaaaaataatgatggtcaaccaggggtgttagctgatgatgaaacattaacgaaacagctagacgatttcccatcaaccgtatcaaaagaagaccaacagtgttcatttgatgacatatttaaacactttaatcaacaatactatggtgtgccaattgcttatccaaatgagacgtttgtagtgagtgataaagtaaaacaattcaaattctctggacttacggatgcaccaattgattataaagcgttgaaagttaatgaatag

SEQ ID NO: 732 - DNA, 762 bp, Staphylococcus epidermidis
ggggtgatttcaatgcttaaggttcaaaatgttattaaattttatggaaaaaaatcaatgtttcgtgataaacgtattcctgtagttaaaggcgtgtcatttgattgtcccactggtgcatcagtagcaattattggtgaaagtggaagtggaaagtctacgttgagtcgtatgattttaggactagaaaaaccagatcaaggacaagtgactttggacggtcagcctgttcatttaaaaaaagtgagacgtcatcgaattgctgcggtttttcaagactatacttcttctttgcatccttttcatactgtcaaagatattttgtttgaagtaatgaatcaatgtcgatgtacatcgaaggagaatatggaagagtatgtaacagtgttactacgtgaagtagggttaaaatctgattgtttgtattgttatccacatatgctttcaggtggagaagcacagcgtgtagctattgcacgtgcgatatgtatgcaaccagattatatattatttgatgaggcgattagttcattagatatgtctatgcaaacacaaatattagatttattgaaaaggttacgtcactcacaccagctgagttatatctttattactcatgatatacaagctgcgacatatatatgtgatgacttgcttatttttaaaaatggttgtatcgaagctaggacatctataagtgaattgcataggcaacaaaatggttatacaagagaactgattgataaacaactatcaatctaa

SEQ ID NO: 733 - DNA, 1221 bp, Staphylococcus epidermidis
caaattgaattacctatagaaaggaatggacatatgttaagtattaaaaacttatcaaaggtctatgcaggtggtaaaaaagctgtagataatatgaccatagacattgaatcaggagactttattgcatttattgggacaagtggtagcggtaaaacaactgcccttagaatgattaatcgtatgattgaatctacagagggagaaattaccattgacggtaaaaatatcaaagagcttaatccggttgagcttcgtcgcagtatcggttatgtcatacaacaaatcggcttaatgccacatatgacagtgaaagagaatattgttctcgtaccaaagttattaaaatggtcacaagagaaaaaggatgagaaagcgaaagaacttatacgcttagtagatttaccagaagaatatttagatcgatatccttcagaattatcaggtggtcaacaacaacgtattggtgttgtaagagcactcgcagctgaacaagatattattttaatggatgaaccgtttggtgcactcgatccaataacaagagatacattacaagacttagtcaaaaaattacaacaacaattaggaaagacattcatttttgttacacatgatatggatgaagcaatcaaacttgcagataaaatatgtattatgacaaatggacaggtggttcaatatgacacgccagataatattttacgtagtccagcgaatgatttcgttagagactttattggtcagaatcgcttaattcaagatagacctaatatccgtacagttaaagatgcgatgattaaacccgtgacagtacatgttgaccgttctcttaatgatgcggtgaatattatgagagagaaaagagtcgatacgatatttgttgtcggcaatgatgagcatttattgggttatttagatattgaagatattaacgaaggattaagacatcataaagaacttatagatacgatgcaacgagatatttatagagtacgtattgatagtaagttacaagattctgttcgtacaattcttaaacgtaatgtacgtaatgtacccgttgttgacagtgataataaaacattattaggccttgtcactcgagctaaccttgtagacattgtttatgacagtatttggggagagttagaatcggataacaatgataatcattctgggattgttgaacccgaatccacaggagttgagacaccatga

SEQ ID NO: 734 - DNA, 861 bp, Staphylococcus epidermidis
agccatgattcaatatggaacatatgcacgtctgcacattttctcaagaagccagcaagggacattaatgtgttaccaaataccacttgtctaggaggaataaagatgtttaaagtagttatttgtgatgatgaaaggattataagagaaggcttaaagcaaatggttccatgggaggactatcatttcaccactgtttatactgccaaagacggcgtggaagcattgtctttaattcgccaacatcaacctgaactcgtcattactgatatacgaatgcctcgaaaaaatggtgttgacctactagatgacatcaaagaccttgattgccagattatcattttatcgagttatgacgacttcgaatatatgaaagccggtatacaacatcatgttcttgattatttactaaagccagtagaccacactcagttagagcatattctagacatattagttcaaaggttattagaacgcccacattctaccaatgatgacgcggcatatcatactgcctttcaaccattattaaaaattgattacgatgactattatgtcaatcaaattttgtctcaaatcaagcaacattatcacaagaaagtgactgttcttgacttaattaatcctattgatgtaagtgagtcatacgccatgaggacgtttaaagaacatgtaggcattacgatagttgattatctaaatcgttatcgtattttaaaatcattacatcttttagaccagcactacaagcattatgaaattgctgaaaaagtaggtttttctgagtataaaatgttttgctatcattttaaaaaatatttacatatgtcaccaagtgattataataagcaatcaaaatag

SEQ ID NO: 735 - DNA, 255 bp, Staphylococcus epidermidis
agtgcttttttatcaattttatctcctttatttaaaggatctacttggaagaggacttcaaaaccaccttgcaaatctagaactaaattaacatttttaactacattcttatacgtcatacccattcctgtgaatagtagagctatgaggagtatgaatgcaattattctactcgttttcttcacatgcacacctcattatttacttatgtatctagaatactcgatgaataaattatcgtgcaagttaaaatga

SEQ ID NO: 736 - DNA, 330 bp, Staphylococcus epidermidis
ggagtgacatcaatgaaaacattgaaattattgaaaaaaacacgagcatttaccttgatagaaatgcttttagtattactaataataagtttattgttaatacttataattccaaatattgcaaaacaaacatctcatattcagtcaactggatgtgatgctcaagttaaaatggtaaacagtcaaatagaagcctacgctttaaaacataatcgcaacccttctaatattgatgatttggtttcagatggttttataaaagaaggacaaaaaacatgtaaatccggtcagacaattagtattgcaaatggagaagcagttgccaattaa

SEQ ID NO: 737 - DNA, 1596 bp, Staphylococcus epidermidis
ttaattatgtcaaagatatattgcattaaagtaataaaaacgttactatatcaaagatacatagaagtgacaggttataaagatgaaagcgagaaggataaaatggataagcaagaacgatacaatagaagagaaaatattagaaatttctccattattgctcatatagaccatggtaaatcgacattagctgatcgaattttagagaatacaaaatcagttgaaactcgagaaatgcaagatcaattacttgactctatggatttggaaagagaacgaggcatcactattaaactaaatgctgttcgattaaaatacgaagctaaagatggagaaacttacacatttcatttgatagatacaccaggacatgtcgactttacatatgaggtttctcgctcattagctgcatgtgaaggtgcaattcttgtagttgatgctgcccaaggtatagaagcacaaaccttagcaaacgtttatttagcattagataacgatttggaacttttgccagttgttaataaaatagacttgcctgcagctgagcccgatagagttaagcaagaattagaagatgttataggtatagatcaagaagatgtagtacttgcaagtgctaagtcaaatataggtattgaagaaattttagagaaaatagttgatgttgtaccagcaccggacggtgatccagaagccccacttaaagcacttatctttgattcagaatatgatccatacagaggagtaatatcttcaattcgaattattgatggtgttgttaaagctggagataggattaaaatgatggctaccggtaaagaatttgaagttacagaagtcggaatcaatacacctaagcaactaccggtagaagaattaacagttggtgatgtgggttatattatcgcaagtatcaaaaatgttgatgattctagagtaggtgacacaattactttagctgaaagacctgctgacaaaccgttacaaggatataaaaagatgaatccaatggtattttgtggtctattccctattgacaataaagactataatgacctaagagaagctttagaaaaattacaacttaatgacgcatccttagagtttgaaccagagtcttcacaagcacttggttttggatacagaactggatttttaggaatgttacatatggagattattcaagaaagaattgaaagagaatttggtattgaactcattgcaacagcgccttctgttatctatcaatgtatcttaaaagatggttctgaagtttcagttgataatccagcacaaatgcccgaaagagataaaatagaacatatttatgaaccatttgtcaaagctacgatgatggtgccgaatgattatgtaggtgcagtgatggaattatgtcaacgtaaaagaggtcaatttataaacatggattatcttgatgatataagagttaatattgttcatgaaattccattatcagaagtaagtttttcgatttctttgatcaacttaaatctaacacaaaagggtatgcttcttttgattatgaatttattgagaataaagaaagtaatcttgttaaaatggacatattactga

SEQ ID NO: 738 - DNA, 1011 bp, Staphylococcus epidermidis
gctaatatgtcaggacaagttatcttactattagatgaaattcatcgtttagacaaagctaaacaagattttttattaccacatcttgaaaatggcaaaattgtattaataggtgcaacaacttcaaatccttatcatgcgataaatccagcgatacgatctagagcacaaatatttgagctttacccattagatcaagatgatataagattggcattagatagagctataaatgataaggaaagaggtttaagtacttatcatcctattgtagatgaagatgctatcgaatatttttcaacgcaaagccaaggcgacgttaggagtgcattaaacgctttggaattagctgtactaagtgctcatattggtgaagaaaacgaaagacatattacattagatgacgcaaaagattgcttacaaaaaggtgcttttgtaagtgataaagatggagacatgcattatgacgtcatgagcgcttttcaaaaatcaattagaggtagtgatgtcaatgcagcactccactacttagcacgtctaattgaagctggtgacttacctacaatcgtacgtcgattacttgtaattagttatgaagatgttgggttagcatcacctaatgctggtcagaggactttagcagcaatacaatcagctgaacgtctaggttttccagaagcacgaattccccttagtcaagctgtaatagaattatgcttatcacctaaatcaaattctggtatcacagcaatagataaagctcttggcgatataagaaatggacatataggtcaaataccggattatctgaaagacggtcattattcaggtgctaaaaagttaggacgggctataggttacaaatatcctcataactatgaaaatggtcatgttgtacaacagtacttaccagaaaaattaaaaaacagagtgtattatgaaccaaaaaccacatcaaaaagtgaacaacaatttaaaacaatttacgataacttacgaaataaaacataa

SEQ ID NO: 739 - DNA, 747 bp, Staphylococcus epidermidis
agaatacggtcaggcagtattttagtcatgaatcaatatgaagatatgagtttagtatatgacaaacttactcaagatcaaccgtatcattcgtggtttaatattgttgagcatttcttaccttctgatagtcatgatttgttagatattggttgcggtactggcaacttaacacaattactaacgtcactaggtgaagtcactggtatggatattagtgtagatatgttatcaatagctagacaaaaaacaaatcaagtgaagtggatcgaaggtaatatgactcactttaatttgaacaaaaaatttaatatgattacaatattttgtgattcactgaattatttagaaacattaaatgacgtaaaaatgacattcgaaagagtgtatcaacatttaaataaaaatggtgtttttatttttgatgtacatactgttcataaaatgaaaacattatttaataataaaagttatattgatgaatctgataatgtttttgtaggttgggatgcaatatgtggggatgaaccattaagtgtttatcatgaaatgactttctttgtatcacagcaaaatggattgtatcaacgctttgacgaatcacattatcaaagaacatatgaggaacaaatttatcgaaatttactaaaagatgttgggtatcatagtgttaagacttttacagactttaacattcacagtcatgaagaagatgcccatcgcttgttttttgttgctaaaaaataa

SEQ ID NO: 740 - DNA, 525 bp, Staphylococcus epidermidis
tggtattttccttctggacatgttgaaaatatacattttgtatcacatgctcaactaaataatattaatttaaataaaatagcaaactttttgaccgaacatttcagttttaatcgtaaagtactaactcaaaacattgagtcttactttagtcaaaaagaagagctattacttgcaaatgaagtagttgagatgataaatttacaaattggtaatcaaagtaatagcatttatatgggtggaaaggttaaacttattgatgcgttaaatgagtccaacgtttcatctattcaaccgattcttcaatatatagaatcaaataaaataactgaattattagaagatatatcaacatctcaaatcaatgtccgaattggtaaagagattgatgatagtttaagcgatatatcaattgtgactagtcagtatcattttgatgagtcactaaaaggtcaaattgcagtaatcggaccaactgcaatgcattatcaaaatgtaattcaattattaaaccgtatatggtag

SEQ ID NO: 741 - DNA, 681 bp, Staphylococcus epidermidis
ttttttgtgtttaatattaacagacgatatatcgatttttttatgaaatggaagttgtacatcttgattatattaataatgttaacaacattctttttttacttactcaatgataacaataatgatttgatacagaatagtcaggaaagacaatctaaaatatctgaccagcaaataaaaaatagcaaaaagttaaataaaaaagaagtgtctattcaaaaagataatacaaaagaaactaaaatatttatcgatattaaaggtgctgttaaacatccgaatgtatatgaaatgtcttcttcgaatagagtcattgatgctttaaataaagcagaggtattaaaggatgcagacttatcacaattaaatctttctgaaaaattagttgatcaaaaacttatctatgttcctaaaaagggtgagaatagtatgaaaatcaattcacagcaatcaacattgaattcgagtgacgtaaaaatcaacacgaatcaacctttaaatttaaactctgctactgaagaacaattgaaaaacataccaggaataggtccaagtaaagctaaagaaattttaaattacagagaacaaaatcatggatttaatagtatcgatgacttaatgaaaataaaaggattcggaaagaaaacatttgaaaaactgaaagaacattttactatttaa

SEQ ID NO: 742 - DNA, 1404 bp, Staphylococcus epidermidis
ggagaggcttttatggttaaaaatatggatacaattgtacaacttgcgaagcatagaggatttgtattccctggtagtgatatttatggtggattatcgaatacatgggattatggtccgttaggtgttgaattaaaaaataatattaaaaaagcttggtggcaaaaatttattacgcaatcaccttacaatgtgggtattgatgctgcgattcttatgaatccaaaaacatgggaagcatcaggacatttaggaaattttaatgatcctatgattgataataaggacagtaaaattcgttatcgtgcagataaattaatcgaagattatatgcaaaatgaaaaaggtgacgaaaactttatagcagatggcttaagttttgatgagatgaaaaaaattatagatgatgaaggaattgtttgtccggtcagtaagactgcaaactggaccgatatccgtcaatttaatcttatgttcaagactttccaaggtgttactgaagattctactaatgaattatttttacgacctgaaacagctcaaggtatttttgtgaactataaaaatgttcaacgttctatgcgtaaaaaattaccttttggtattggtcaaattggtaaatcattccgtaatgaaatcacaccaggaaactttattttcagaacaagagaattcgaacaaatggaacttgaattcttctgtaaacctggcgaagaaattgagtggcaaaattattggaaaacttttgcaagtgaatggttaacagatttaaacatctcagaagacaatatgcgccttagagatcatgatgaagatgaattatcacactattccaatgctactactgatattgaatataaattcccatttggttggggtgaattatggggtattgcgagtcgtacagactatgatttaagacaacatagtgaacattcaggtgaagattttaaatatcacgatcctgaaacaaacgaaaaatacattccttattgtattgaaccatctcttggtgcagatcgtgtgactttagcatttttatgtgacgcgtatgctgaagaaggtgttgaaggtagtaaagatgcacgtacagttatgcacttccaccctgctttagcaccatataaagcggcagtattaccattaagtaaaaaattatcaagtgaagctattaaaatttttgaacaactaagctctagctttgcaatagactttgatgaatcacaatctattggtaaacgttatcgtcgtcaagatgaaataggtacaccatattgtattacttttgattttgattcattagaggacaaccaagtaacagtgcgtgacagagatagtatggaacaagtacgtatgccaatatcagaacttgaaacatttttagctgagaaagttaaattttag

SEQ ID NO: 743 - DNA, 1068 bp, Staphylococcus epidermidis
cctatgaacactttaatactactaacgaaaagagggaataatttgaatatcgaagatttcgattatcatttgccagagtctctcattgcacaaacaccactaaaaaacagagaccaaagtagattgttagttcttagcaaagatactggtgagctgacacacttacattttagagatgtcatccattattttgagcctggtgatacattggttcttaatgatacacgtgttatgcctgctagattatttggcctaaaagaagaaactggtgctaaagttgaaatgctaatgctcacccaaattgaaggtaatgattgggaagttttacttaaacctgcaaagagaattaaaaaaggtcatcgtctaaattttggagatggtaaaatcgttgctgagtgtattgaggaacttgaacagggcgggcgtattatgcgtctacattatgagggtatactccaagaacgcttagatgaattaggcgagatgccattacctccatatattaaagaaagattagatgatcctgataggtatcaaacggtttatgctaaagagagtggatcagcagctgcaccaacagcgggtttacattttactgatgatttgctaaataaaattaaacaaaaaggggtacatatcgcttttattacattgcatgttggattaggaacctttagacccgtaagtgttgaaaatatcgatgatcacgaaatgcatagtgagtattatcaaatgacacaagaaacggctgatttattaaataaaacaaaagaaagtgggaagcgtgtgatatcagttggaacaacatcaacgcgtacattagaaacgatacgtcgtgatcatcctcaatttgttgccacaagtggatggactgatatctttatttatcctggctttgagtttaaagcgatagatgggttaattactaatttccacttacctaaatcaacgttagtcatgctagtatcagcatttagcaataaaaaatatattttaaacgcttatcataaagctgttgaaatggagtatcgattctttagttttggagatgcaatgttaattatataa

SEQ ID NO: 744 - DNA, 276 bp, Staphylococcus epidermidis
agaggagtaactaaaatggaattaacttcattgattataccaattttattattggtcgtaatgtatttcttattaataagaccacaacaaaaacgtgcaaaagaacatcgtgcaatgattaaccgtgttgaagcgggtcaaaagattactacaatcggtggtattaaaggaactataaaagctgtagatgaaacttctgtaatcattacagtaaatagtaatggaacagaaatgacttttgaaaaaccagctataaaacaagtagatccttcataa

SEQ ID NO: 745 - DNA, 993 bp, Staphylococcus epidermidis
aaagtaatgacagatattattttagctgctgatataggcggaacaacttgtaaattggggatatttgacaaggatttagaacaattgcataaatggtctattgatactgatacaagtgaccacactggtgagttacttttaaaaaacatttataattcttttactgaaaagattgcagaatataaatatgattttaacaatgtagttggagtcggtattggtgttcctgggcctgttgattttgatactggagttgtatacggagctgttaatttacattggcccgatagtgtcaatgtaagagaaattttcaaacaatatgttaattgtccagtttatgttgataatgatgctaatgttgctgctttgggagaaaaacataaaggtgccggcgaaggtgctgatgatgtagtagccattactttaggtaccggcctaggtggaggtataatttctaatggagaaattgtacatggacacaatgggtctggcgctgagattggacatttaagagctgattttgatcaacgttttcaatgcaattgtggtaaatcaggttgtatagaaacagttgcttctgctactggtgtagtaaatttagttaatttctattatcctaaattaacgtttaaatcatcaattttacaacttattaaagataaccaagtaactgcaaaagctgtatttgatgcggctaaagctggcgatcaattctgtatatttataactgaaaaagtggcaaattatatcggttatttatgcagtatcattagcgttactagtaatccaaaatatattgttctaggagggggcatgtctacagcgggacttatccttatagaaaatattaaaactgaataccgtaatttaacttttactccagctcaaaataatactgagatagtacaagctaagttagggaatgacgctggtattactggtgcagctgggcttatcaaaacatatatcatagataaagagggtgctaaataa

SEQ ID NO: 746 - DNA, 1143 bp, Staphylococcus epidermidis
catatgcctgcagtgacatatgagcatataaaaacatgtaaacaatccggtgccagattaggaattgtacatacaccgcatggatcttttgaaacaccaatgtttatgccggttgggacaaaagcaacagttaaaacaatgagcccggaagaattaagaaacatagaagcaaagattatattaggaaacacatatcatttgtggttacaacctggaaatgatattatcaagcacgctgggggattacacaaattcatgaattgggacggtccaattttaacagattctggtggtttccaagtatttagtttaagtaatttgcgtaaaatttctgaagaaggtgtagaatttagacatcataccaatggctcaaaactatttttgagtcccgagaagtctatgcaaatacaaaatgatttaggttctgatattatgatggcatttgatgaatgtccaccaatgccagctgaatatgattacgtcaaagattcaatcgaacgtacaactcgatgggcagccagatgtttaaaagcacatcaacgccctggagatcaagcactgttcggtattattcaaggtggagaatacaaagacttaagagaacaaagtgctaaagagctagtcagtcttgattttccagggtatgcaataggagggctgtctgtaggtgagccaaaacctgttatgtatgacatggttgaacatacagaacaatttatgccgaaagataaacctagatatttaatgggagtaggttctcctgatgctttgattgaatgtagcattaggggcatggatatgtttgattgtgtattacctactagaattgctagaaatggtacttgtatgacatcaaatggtcgattagttgttaaaaatgctaaatatgcagatgatttaagaccacttgatgaacaatgtgactgttatacatgtcaacattacacaagagcttatattagacatctagttaaagcggaagagacttttggtatccgtcttactactattcataatttacattttctgctaaaattaatggaagatattagacaagccattcgagaagaccgtcttttagattttaaagatgaattctttgaacaatatggattaaatgtagaaaaccctaaaaacttttaa

SEQ ID NO: 747 - DNA, 606 bp, Staphylococcus epidermidis
ttatttatggcttttgaattaccaaatttaccttatgcatatgatgcattagaaccacacatcgacaaacaaactatggaaattcatcatgacaaacatcataacacatatgttacaaaattaaattcagcagttgaagggacagatttagaagctaaatcaatcgaagaaattgttgctaatttagatagtgtgccatctaatattcaaacagctgttcgtaataatggcggtggtcaccttaaccattcattgttctgggaactattatcaccaaattctgaagaaaaaggtgaagtagtagataaaattaaagaacaatggggttctttagatgaatttaaaaaagaatttgcagataaagctgcagcacgctttggttcaggatgggcttggttagttgtaaacaatggacaattagaaattgttacaacaccaaatcaagataatccaattactgaaggaaaaacaccaattttaggtttagatgtttgggagcatgcttattatcttaaatatcaaaataaacgcccagattatatcaatgcattctggaatgttgttaactgggaaaaagttaatgaattatataatgcaactaaataa

SEQ ID NO: 748 - DNA, 762 bp, Staphylococcus epidermidis
gtggataatttgcaaagatattttatgaatcaaagcgctgatgaaaatcagtgcttttttattgaaaacaaagaagactatcatcatatcgtgaatgttatgcgctataaagaaggacaaaatattattgtcactttttcagatgaaaatgtattcaaatgtaaaattatttcaataaacgatcaatcgattgaaattaaattagtagaaaagcaacaaattaacactgaactacctcagaacattacaatatgtagtggtttaatcaaagcagacaaatatgaatggatgatacaaaaagcaactgaaatgggggcaaatgagtttatagctgtagccatggaacgttctgtggtcaagctcactgattctaaagtagaaaagaaattatcgagatggcaaaaaattataaaggaagctgcagaacaaagttatcgtttaacaataccaaatataaaatttaagtcgaatttaaaagaaatttatggtatgataagtcaatatgactatgttcttatagcatatgaagaacaagcaaagcacggtgaattaagtcaatttaagcaaacaattaaacaatttaagacacaggatcgtgttttaatcatatttggacctgaaggtgggctatcagatagtgaaatttcattattcggtgatgtaagtactatagttggattaggtccacgtatcttgcgtgctgaaactgcacctctttacgctttaagtgcagtaagttatgaaaaagaattattggggtga

SEQ ID NO: 749 - DNA, 2220 bp, Staphylococcus epidermidis
ccaatgttttacattgctcttgcttttttggtaggggtactttggataaaattcaaagtaatctctatctccttaatattaactcttttgttactaattatgataaaaaggcttaatattataatactattattaatgtttatttcagctataagtttcttttttttaataagttcctataaccaaaccgaaattaaaaacataaatagtttatataatgaaccgtttattgatgattttgttactttcaaatcttttacgcctaaatcaacatactatactggcatattaaattataaaaataaagactatagatacttttacaaaatattaaagtcaaatttcaagcaagatttaactcataaaagttgtcgagttaaaggagaatttaaattcgaaaaagagttgtccttgttgaatatttcaacagttcaatttaagtcttgccaagaaaacaatattttcactcctatatatcatcatcaaaattatatcaccaaaataattcatatatctggggtcacgcatcctgaaagaatattagcgttgataacaggtgatacctctctaattgatgaatattacaaatctaacatcaaagatataggtatttaccatttactagctataagtggtacacatgttggtacaattattgtcctcgtttatcaactgttagtacgtttaaatatacctctagttctcattaaaggtgtaactattttactattattaatctacgctgtttatactggatttgtacctagtgccatgcgtgccatttcaattgcaatcattatacttatgttgccaatccattttaggaaaagttctatacatgtgctttcatttatatttgtgttaatgattctcttaaatcctcaatttataaatcacattggttttcagttctcttttttgataagtttatttattatattggcaaaaccatatataagtgctttaaaaccacttaaatgtttgtttattattagttttttggctcaattaggttcaattgtaattaatacctatcattttaatcaatttcaatggataggtttgctatctaattttatatttgttccattctattcttttatattatttccttcggtcattatctactttattttaattcacttttttcaacatagcttcctattaaatacttatataaatatgctttttaaaattcatgactggctagttcaattatttttaaatttaaatcatttaaagtggtacattcctaaattaaaccaatatagtttacttattttgattatactaacgttaatttttctttacatacttgtctatagagggtttgttacatccgtactaagttttttaattgttttaatcatttttacacatttaattagaccacattatgccgagttaacactttttgatgtgggtcaaggagatagcattttattcaaaacaaagtcaaataaaagtgttttgattgatacaggaggtaaaaaaaatgaaaatgtaagttttaaacataataatattgccaaatataaaattttaccaattattaaaaaaaagggtattaccactataaattatttagtaattacacatcctcatgccgatcatatgggtgaattaatatattttttaaataatattaatgtgaataatctcgttttaaatattgaaagtttcccattaaaattacttaaagaggttacgacaaaatgcaaggaaaaaaaaataaatatcttggatgtaaatcaagtgaaaaaaatagatattgataatagtaaaataagctttttaaatagttttataccattaattgatgataaaaatgaacattccattgttacattaattgaatataacggcattaatattctactgatgggagatgcaactgttaataatgaagacattctaatgaagagatataatttaccaaaaatagatattctaaaagttggtcatcatggaagtaggacaagtagttcgaaattatttattaaagatatagaacctaaaatcagtcttatatctagtggtaaaaataataagtatcatttacctaatttggatgttattcaaagattaaaatattatggtagtaaagtttttgatactcaagacaacggggaattaactataaatttagatgaagaagtttacatagtctaccgtgataatttaaatcaaaagagtttagctagagaaagtgtatcgtaa

SEQ ID NO: 750 - DNA, 732 bp, Staphylococcus epidermidis
attctatcctactcttttttaatacatataaggagtttaaaaatgattaaccttaaccaaagattatcaattgtatgctcatttattaaaagaggaacattggctgatattggttcagaccacgcatatctacctatatatgcaattcaaaacgacttatgcacaaaagcaatagcgggagaagtgattcaaggaccttataaggctgctaaaagaaatattgcaaattatgaattaaatcaacaggttgatgtacgtctaggcgatggtctaagcgttataaactcagaagaccaaattgataatataactgtttgtggtatgggagggccattaattgcaaaaatattaaacgatggaaaagataaattagttaaccatccaagactcatactacaaagcaacatacaaactcaagcattaagacaaactcttaataaactttcatatgaaatcgttgatgaaagaatcattgaggaaaagggtcacatatatgaaatcgtggtagctgagtttaataataacttagttaaattaaatatattacaagaaaaattcggaccatttttacttagagaatgtaataacatttttcaaaaaaaatggcaaagagagttagaagcactgcgtgatataaaatcccaattgaattcaacatcacatcatgagagactaaaagaaatagaagatgaaattaacttaatacaagaggtgttaattaatgaaaattag

SEQ ID NO: 751 - DNA, 273 bp, Staphylococcus epidermidis
ggagtgtcgtatatggaaaattttgataaaacaatgaaatttagttatgaagaaattccaaaggaagatgtcaaatcagttcttcagaatgtccatcgtacattagaagaacgtggatataatgcagttaatcaaatagtgggttacttattatctggagatcctgcatatattccacgtcaaaatgaagcaagaaaccaaatacgtcatatagaccgtgatgtaattatggaagaactcgtttcaaactatttaaaagagtctaagaattaa

SEQ ID NO: 752 - DNA, 888 bp, Staphylococcus epidermidis
ctacggcatcaacggactctatcggtacgcaagacttttgtcttgcgtatttttatgtatataattataaagaagcatagatataatgaattggaatcaaaggagctaaagatgaaacatcaattttcaaggaatgaattagcaataggacaagaagggctgaacttactaaaaaataagactgttgcagttttaggtgttggtggcgtcgggtcatttgcagctgaggcattggctcggactaatatagggcacatcatacttatagataaagatgatgtcgatattacaaatgtgaacaggcaaattcatgcactgacttcaactattggtcaaagtaaagtcacgctaatggaagaaagaatcaaattaataaatcccgattgtaaagtaacttctttgcatatgttttataccgaggaaacatacaaagatatcttcaataattatgatattgattattttattgatgcaagcgatacaatcatttataaagttcatctcatgaaagagtgtttagaaagaggaattgagttaatttcaagtatgggtgcagcaaataagactgacccgacacgttttgaaattgcagatatttcaaaaacacatactgatcctatggctaaagtaattagaaatcgtttaaaacgccttggtattcgtaaaggtgttaaagtagtattttctgatgaaagtcctattgttattcgcgaggacgtaaaagaaacagtaggagataaaaatgcaatcaatagaaaagggcaaatgcctccatcttctaatgcatttgttccaagtgtagtaggccttatttgtgcaagctacgttgtcaacgatattttaaaagatatacctgtaaggcgaattaaagataaaggacaaaattaa

SEQ ID NO: 753 - DNA, 1350 bp, Staphylococcus epidermidis
atattgagtcatcgttatataccattaacagaacaagataaaaatgaaatgctaaatagtattggggcaaaatctatttccgaattatttgatgatatacctacagatattttattaaaaagaaatttaaatattgccgaaagcgaagcggagacgatattacttagaaggttaaatcgtctcgcagctaaaaatacaactaaagaaacacatgcaacatttctaggtgcgggcgtttatgatcattatactccagctgttgtcgatgcaatgatttcaagatctgaattctacaccgcatatacaccttatcaacctgaaatttctcaaggtgagttacaagcaatttttgaatttcaaacactcatttgtgaattaacagatatggatgtagcaaattcttctatgtatgatggtatgactagttttgctgaagcatgtatattggcactaagtcatacaaaaaaaaataaaattgtagtttcaagtggactacattatcaagctttacaaattctacacacatacgccaaaactcgtgatgaatttgaaataattgaagttgaccttaaaggtactattactgatttagagaaattagaacaacttatcgatgacaacacagcagctgtcgctgtccaatatcccaatttttatggttctattgaagatttagaacaaattaataactatataaaggataaaaaagctttatttatcgtatatgccaatccactttctttaggattactaacacccccaggtacattcggggcagacatagtagtgggagatacacagccttttggtattcctacacaatttgggggtccgcattgtggatactttgctacaacaaagaaattaatgagaaaagtacctggtcgattagttgggcaaactcaagatgacgaaggtaatcgtggatttgttctcacgttacaagctagagaacaacatatccgccgtgataaagcaacttctaatatttgttcaaatcaagctttaaatgcacttgcatcttcaatagcaatgtcagctttaggtaaacaaggtatttatgaaattgcagttcaaaatcttaaaaatgccaattatgccaaaaataagtttgaagaacatggttttgaggtactaaaagcacaatcttttaatgaatttgtagtcaaatttaatcaaccaataaaaaatattaatcttaaattagcagaatatggatatattggtggttttgacttaggtgaagtatctgatgattttaaaaaccatatgttagtagcagttacagagttaagatctaaagatgaaatcgatgatttcgttacgaaagcaggtgagttaaatgattag

SEQ ID NO: 754 - DNA, 1095 bp, Staphylococcus epidermidis
acaaaatgtctaaagaaggtgttatatgtgaagaagttgtcgataaatacatttaaatataagaggaataaatatcttactgaaatacaatcaatagacttactacagagattacaacagcttttaagtcacggattcactttatatcaaagttttaaatttttaaactcctattttaaatataaagagcgaacaataaataaaaagattatccaacatctacaaaacggtgctacatgttatgatattttaaaaataatagggtatccagaattagttcttcttcaaataaaatttgctgaaaactacggcaacattgaggaggctctcgttgatactgttcaatatatgaaaagaaatctgaaagctaaaaaacgactcatcaaaaccttacaatatcctgttgcattaatttctatcttcttattcatattaaccattttaaatataactgtcatacctcaatttcaacaactttatgagactatgaatgttaaattatcaacatttcaaaatctactaactcttattattacccgtcttcccaaactaactttcatttttatctttattagtggtatagcattttttatcacttataaattctactattatctaccaattgagaaaaagttaaaatctattttaaaaatcccaatgattaatacgtattataaaatatatagaacttatcaactttccaatcaactttctttattttacagaaatggtacaagtcttcaacaaattgtccgtatatatcgtaatgagcaagataacgattttcttaaatttctgggtgattatctttttaaagaagctaataaagggctcccgttacctgttatattaatgaatttaaaatgttttcaaaatgatttgattaaattcatagaacaaggagagaaaaatgggaaattagatatagaattaaagttatacagtcaaatgctattacagcaatttgaagaaaaagtgttaaaacaaacaaaatttatacaacctatcatcttctttatcttgggaatttttattgtatctttatacttagtcattatgcttcctatgtttgaacttatgcaaacaataaaataa

SEQ ID NO: 755 - DNA, 1782 bp, Staphylococcus epidermidis
aaaggaagtctaaaaatgaataaaagaacaacgtattgtggtttagtcacagaagaatttttaaacgaaaaagtaacattaaaaggttgggttcataacagacgagatttaggtggattaatttttgttgatttaagagatcgtgaaggtattgtccaaatagtttttaatcctgacttttccgaagaagcattgcaagttgctgaaacagtacgctcagaatatgtagtcgaagttgaaggtgtagtaacaaaacgtgatgctgaaactattaacccaaaaatcaaaacaggtcaagttgaggttcaagtttcaaatattgagattattaacaaatcagaaacacctccattttcaattaatgaagaaaatgtaaacgttgatgaaaatattcgattaaaatatagatatttagatttacgtagacaagaattagcgcaaacttttaaaatgagacatcaaactacgcgttctatccgtcaatacttagataataatggcttcttcgatattgaaacaccagtattaacaaaatcaacacctgagggtgcgcgagattatctagtaccttcccgtgtacacgagggtgaattttacgcgttgccacaatcaccacaattatttaaacaactattaatgataagtggttttgataaatattatcaaattgttaaatgtttccgtgatgaagacttacgtgcagatcgtcaaccagaattcactcaagttgatattgaaatgagttttgtcgatcaagaagatatcatagccatgggtgaagatatgttacgtaaggttgtaaaagatgtaaaaggaatagacgttagtggcccattcccacgtatgacatatgcagaggctatggaccgttttggttcagataaacctgacactcgtttcggtatggaacttatcaatgtgtcacagcttggtaaagaaatgaattttaaagtttttaaagatacggtagataacaacggcgaaattaaagcaattgtcgcaaaagacgctgcaaataaatatacacgtaaagacatggatgcattaacagagtttgtaaatatatatggtgcaaaaggattagcttgggttaaagttgttgatgatggtttaagtggcccaattgctagatttttcgaagatgttaatgttgaaacacttaaacagttaacagaagctaaacctggagatttagtaatgtttgtagctgataaacctaatgttgttgctcaaagtttaggggctttaagaattaaattagcaaaagaattaggtttaattgatgaatcaaaattaaatttcttatgggtaactgattggccgttattagagtatgatgaagatgcaaaacgttatgtagcagcacatcatccatttacttcacctaaaagagaagatatcgaaaagctagacactgaacctgaaaatgtacaagccaacgcttatgatattgttctaaatggttatgaacttggtggtggttctataagaatacacgatggtgaattgcaacaaaaaatgtttgaagtattaggatttactaatgaacaagctcaagaacaatttggtttcttattagatgcttttaaatacggtgctccacctcatggtggcatcgcgttaggtttagatagacttgtgatgttattaacaaatagaacaaacttgagagatacaattgcattccctaaaacagcatcagctacatgtcttttaactgacgctccaggagaagtatctgataaacaactccaagaactctcactaagaatcagacactag

SEQ ID NO: 756 - DNA, 1461 bp, Staphylococcus epidermidis
atgaatattaataaactttattggaaggctttatactactggattaggtatcttaattataatgtaatttatcgtgataaagaggacgatgaaatatggttgtctcataagagaaaacattcaattgttgtatttagaaaagatgtcacatctacccaagagattaggtttgataaatcaaaaattatggaacgacctgaagaaatacaacaattcatcggttatatacctgaatcttatgaattttattattttacggataaagagctttcaaaagaaaatttaaatgaagaaaaaccaattaaactgaaatttaaaattataagcaatgagcaaagcttaaattcactccctataaactttttacttttaaaaatgctaattaataatgaagataaaaggacttaccttcattacaaaagaaaagttttaacacaaaatcttgttgataaacatatgcaacgttttacccctattacatatacacttatcttaattaatattgtgatatggttatgtatgattttatacttaaatcgattttctgatgttaaactattagaagtaggtggacttgttcattttaatgttgttcacggagaatggtatagacttatttcgtcaatgtctttacattttaatttcgaacacattttaatgaatatgctctctctatttatttttggtaaaattgtcgaatcaatcattggatcatggcgaatgctaataatttatataatatccggattatatggaaattttgtttctctatcatttaatacgactacaatttcagtcggtgctagtggagcaatatttggtctaattggttctatttttgtgattatgtatttaagcaagaattttaataaaaaaatgattggccagttattaattgctttggttgttttaatcgttttttcactttttatgtctaatattaatataatggcacatttaggtggatttatcagtggtgtattaattacattaataggctattatttcaaaacacaacgctctttattttggtcatttttgattgtatttttacttatattcatcattttacaaattagaatatttactataagtgaggataatatctatgataaattaattcgggatgaaatgattaaaggtaattatagcgaagcaaaaaatgttgtaaaacaaacacttaataataattacgccgatgatgaaacatattaccttagtggtttgattactgcaactaagagttcgcaagcagaggccgtatcagaatgggaaagaggtttaagaaaatttccaaattcaggtgtacttaattatgaattagctatagctaatcgttctttaagtgatgataaaaaggctttaaaatatataaaaaaagctgtagcaattaatcctaataataaaaaatatgttaatttaaaaaaagagttgagtaaatctaatgacacgaaaaattaa

SEQ ID NO: 757 - DNA, 441 bp, Staphylococcus epidermidis
atggatattaaaaaaattgaggaagtcattaaattggtaaaagctaatgatgtaaaaaaatttaagtataaggactctcataatgaaatagaacttgattttactaatggagcatctcaacaacattcgcaacaatcatctcaagatattcaacaagagaatattaaatccttagatgaaaagcaagagtccatatcaaatgaccagcaagagattaaatctcctatggttggaacatttttcttacaagatagtaaagaactaacagaacctaagattaaagttggcgatactgtaactgaaggagatattatcggttacattgaagctatgaaagttatgaatgaagtaactacggatgttactggtgaggtcactgaaatattagtagaacatggagacaatgttgaatatgatcagctactagtcagagttaaatag

SEQ ID NO: 758 - DNA, 369 bp, Staphylococcus epidermidis
ctagaaattaatatgaaacgttttaaatatgcatatgagggtttttgcgcaattttaaaaaaagaccaaaatttcttattacacattttagcggccataattattatcatattaggatttgtgttaaatattgatcgtatagattggatattaatcatcgtagctataggacttgttttaagttttgaagctattaatacctcaattgaatttgttgttgacctaattacaactgactatcatgaatatgcaaaatacgctaaagatatagctgcgtttagtgttgtcatcgtttcaatcgtttcaatatgtattgggttaatcgtttttttaccatatatattagaaatatttaagggaggaatgtaa

SEQ ID NO: 759 - DNA, 558 bp, Staphylococcus epidermidis
aatcattataaaggtaaaggtgaaaagatagtgggaatcataaaaaaattatttatgccaaatgcatatgtgaaatcaatatttgaaattgatatagaaaaacttgccgatagtggtgttaaaggtatcataactgatttagataatacacttgttggttgggatgttaaagaacctactaagggtgttaaatcatggtttgctaaggctaaagatttaggaataactgtcacaattgtgtcaaataataataaaagtcgagtatcaagtttctcaagtaatttaggtgtagattatatattcaaagcacgtaaaccgatggggaaagcctttaagatggctattaaaaaaatgaaaattcaaccgagagaaaccgttgttgtaggagatcaaatgcttactgatgtgtttggtggcaattgtaatggtttatatacaattatggtagtacctgttaaacggactgatggattaattacaaagtttaatcgattaattgaaagacgattattaaatcattttagaaaaaaaggttatattaaatgggaggaaaattga

SEQ ID NO: 760 - DNA, 696 bp, Staphylococcus epidermidis
agaggtgataagatgaatattggcattatcattttcatcatatctgtgataattacaggtgttagcgcattacgagataaaagtcacgaggacagacaaaatcaaagacccaatcaaaaaacctcaaacgagcaacatcaagaaggtggtttctttgaaaaattagaaaaaacttttcaagaaattagtgacgaattaaatgatgaacctgaaaaaaaacagagtaaaccttttgaaacttcattaccaccactgaacgaagattggaatgaaaatgaaaagaaaaaaacatcacatcataaagaaaaacaaaatacttcacaatccaaacgtcaaacaacgtctactcatgaacatcaaaatatccctcagccagataaaacaacatcaagagatgataattatgaaaaacttaagcaagaacttgaacaagatgtaactaaaaatttaattgacgtacgtaaagaaattgataaagaaaaagaaaagcaacttgttatgattgagaggaaagctcaagacattatcaacgataaatatctttcagaaagaacaaaacgatatagaataaaacaactactaaattctaggaatgttgagaaaaacatgtcgcgctctgcttttcaatatgatagtgatgaagttattaatggtattatttggtcagaaattttaaataaaccaaaacagctttaa

SEQ ID NO: 761 - DNA, 1509 bp, Staphylococcus epidermidis
atgattagtaaatcaagtcctttaatatttgaaagatccaaaaaagatagatatgcgtattcattaccacaaaatgacattgagaatatcagtattgcttcactcttagatgataagtatattcgtaaacataaggctgaatttcccgaggtttcagaattagatttagttagacattataccgaactatcaaataaaaatttcggggtagatactggattttacccattaggttcttgtacgatgaaatataatcctaaaatcaatgaaaaggtagcgcgtatttctggttttagtgaatctcatcctttacaagaagaagaacacgttcaaggttctcttgaaattatatatagtttacaagaagaattgaaggaaattactggtatggatgaagttaccctacaacctgctgcaggtgcacatggtgagtggactgctttaatgattttcaaagcttatcatgaaaaaaatggacaaagccatcgtgatgaagtaatagtgcctgattcagcacatggtactaatcctgcttctgcctcatttgctggatttaaatcagtaactgtaaaatctaatcaacgtggggaagttgacatagaagatttaaaaagagtagtaaacgataatacagctgcaatcatgttaactaatccaaatacattaggtatatttgaacagaatattattgaaatagggaaaatcgttcatgaagcaggaggtttattatattacgatggagcaaatttaaatgctattttagataaagtacgtcctggtgatatgggctttgatgcggtacatcttaatttgcacaaaacattcactggtcctcatggcggtggtggaccaggatcaggaccagttggagtagtagagaaattagccagttatctacctaagcctatggttataaaagataacgataggtataaatatgataatgatattccaaattcaattggacgagtaaaaccgttttatggaaatttcggcatttatttaagagcatatacttatatcagatcaatgggagccaatggtttaaaagaagtatctgaagctgccgttcttaatgcgaattatataaaatctcgccttaaaaatcactttgaaattccgttcaatcaatattgtaaacatgaatttgtattaagtggaactttacaaaaacaatatggtgtcagaacattagatatggctaagcgactgttagattttggtgtgcatccacctacaatatattttcctctcaatgtcgaagaaggaatgatgattgagccaacagaaactgaatctaaagaaacacttgattactttattgatgcgatgattcaaatcgctgacgaaacaaaaaatgatccagataaagttttagaagcaccacatacgactataattgatcgattagatgagaccactgcagcacgaaaaccaattcttaaatttgaagaacttaaggacgaaaagtataaagaacacacaaatattgattctgaagataattaa

SEQ ID NO: 762 - DNA, 1272 bp, Staphylococcus epidermidis
tattcaatccttatagggggtcaaaagatgggggaaaatacaaaacaagatttcaatcaaaaaggacaaaattttaaattcacaaaaaaacatagacgattattatatggttcagtttttttaatggctacatcagctattggtccagcatttctgactcaaactgcagtgtttactgcacaattttatgctagttttgcatttgcaatattaatttctattattatagatataggcgctcaaataaatatttggagaatattagtggtaactggattacgtggacaagaaatatctaataaagtattacctggacttggtactattatctccatactaattgcatttggtggtctcgcatttaacataggtaatattgctggtgcaggtttaggtttaaatgcaatgtttggtcttgatgtaaaatggggtgctgcaataacagctatttttgcgatacttatctttgttagtagaagtggtcagaaaataatggatgttattagtatgattctaggtatcgtaatgattttagtagtcgcttatgtcatggttgtttcaaatcccccttatggagatgcattagtacatacatttgcacctgaacatcctttcaaacttatattacctataattacattagttggtggtacagtagggggttatattacttttgcaggtgcacatagaattctagattctggtataaaaggtaagtcataccttcctttcgtaaatcgatctgctgtagcaggtattttaacaactggtgtcatgcgcaccttattgtttttagctgtactaggtgttgttgtaactggcgttacgcttagttcagaaaatccaccagcatcagttttccaacatgcattaggtcctataggtaaaaatatttttggcgtagtaatatttgcagcagcaatgtcctcagtaattggttctgcatatacaagcgcaacatttttaaaaacactacacaaatcgttactcaataaaaataatcttatcgttattacatttattgtaatttcaacttttgttttcttatttattggtaaaccggtgagtttacttataatagctggtgcgattaatggttggattctaccaatcacattaggtgcaattctcattgcaagtaggaaaaaatctatcgttggtaattaccaacacccaacatggatgcttgtttttggtattatagccgtaattgtcacaataatgactggtatcttttcattacaagatttagcaagtctttggaaaggttaa

SEQ ID NO: 763 - DNA, 2694 bp, Staphylococcus epidermidis
ataatactcaactatgactatctaactgcgataacaaaaacgtatgaaggagagtttttatttatgaaaaaaatgaaagctagtgaaattaggcaaaaatatttgaatttctttgtagaaaaaggacatatgattgaaccgtctgcaccacttgtacctatcgatgatgattcattattgtggatcaattctggtgtagctaccttgaaaaaatactttgacggacgcgaaactcctaaaaaaccaagaattgtcaattctcaaaaagctatacgaacaaacgatatagaaaacgtcggttttactgctcgccatcatactttttttgagatgctaggtaatttttcaatcggtgactactttaaacatgaagcgattgaatttgcttgggaatttctaacaagtgataaatggatgggcatggaacctgagaagctatatgtgactattcatcctgaagatactgaagcttttagaatttggcatgaagacattggtttagaggaaagtcgcatcattcgaatagaaggcaatttttgggatatcggggaaggaccatctggaccaaatacagaaattttctatgatcgtggatcggcttatggaaaagatgatcctgctgaagaaatgtatcctggtggtgaaaatgaaagatatttagaagtttggaatctagtgtttagtgagtttaatcacaataaagacaatacttacacaccactaccaaataaaaatattgatactggcatgggattagaacgtatgacgtctatctcacaaaatgtaagaacaaattatgaaacagacttatttatgcctataattaaggaagtagaacatgtttcaggaaaaaaatatttaattgatgatgcacaagatgttgcatttaaagttatcgcagaccacattagaacgatttctttcgcaattgctgatggcgcattaccagctaatgagggtagaggatatgtattaagaagattattacgcagagcagttcgctttagccaatcattaggaattaatgaaccatttatgtataaacttgttgatatagtcgctgatatcatggaaccatattatccaaatgtcaaagacaaatccaactttattaaacgtgtcattaaatcagaggaagaacgcttccatgaaacgcttgaggaaggtcttacgattttaaatgaactgataaaagaagcgaagaatagtgatcaggttattaaaggtcatgatgcttttaagttatatgatacttatggattcccaatagaattaactgaagaattagcaactcaagaaaatttgtctgttgatatgcctacttttgaacaggaaatgcaacaacagagagatcgagctagacaagctcgacagaattctcaatcaatgcaagttcaaagtgaagtactaaaaaatattcaagatgaaagtcaatttgttggctatgaaactacggactatcaatcattaataactcatatcatatacaatggtgaagaagttaaacatgttgaagcaggagaaacaatttactttattttaagagaaacgcctttctatgcagtaagtggtggacaggtcgcagataagggaacagttggtaatgagagctttgaaataaatgtaactgacgtaactaaagcgcctaatggccaaaacttacacaaaggtattgtgcaatttggtgaagcaacacagaacgcgaaagtagaagcacgtgttaacaaagaggatagacgacttattcaaaaaaatcatagtgctacacatttattacatgctgcattaaaagaagtattaggagatcatgttaatcaggctggttcgttagtagaacctgaaagactacgttttgatttctcacattttggtcctatgacacaagaagaaattaatttagtagaacgtagagtaaatgaagaaatttggagagctatcgacgtccgtattcaagaaatgagtattgaagaagccaaatcaataggcgctatggctttatttggtgaaaaatatggagatattgttcgcgttgtcaatatggcaccattttcaatagaattgtgcggtggaatacatgtgaataatactgcggaaattggtctctttaagattgtgagtgaatctggaacaggtgccggtgttagaagaattgaagctttaacaggtaaaggtgcattcttacatcttgaagaaattgaaacacagtttaataatattaaaaatcatttaaaagttaaatccgataaccaagtagttgaaaaagttaaacaacttcaagaagaagaaaaaggactgcttaaacaattagaacaacgcaacaaagaaataacatcactaaagatggggaacattgaagaacaggttgagttgattaataatttgaaagttttagcaacagaagtagaaattccaaatccaaaagcgatacgttcaactatggatgactttaaatctaaacttcaagatactattatagtgttagtcggacaagttgatggaaaggtttctgtaattgctacagtaccaaaatcacttacaaatcaagtaaaagctggagatcttatcaaaaacatgacaccaattattggtggaaaaggtggaggtcgtcctgatatggctcaaggtggcggaactcaacctgaaaaaataacagaagcattacgctttattaaagattacattaaaaatctataa

SEQ ID NO: 764 - DNA, 498 bp, Staphylococcus epidermidis
aagaaggacaaaaaacatgtaaatccggtcagacaattagtattgcaaatggagaagcagttgccaattaaaaacattaaagcatttagtttagtcgagatgatttttactttatttattatcagttgcttgttgataacaactttatggtcacgaagcctgttcgacattcagctaattgatgaagaatatgaaattaaacaattaataacaaaatttaattactataaatctaaagctattagcaacaacgaatcaataactttattattttttaataattcaaatagagtacaagtaattgaagaaaatggagataaatatagttttaaacttaataaaggcaaagtgattaatatagctaaaattcaaacattaaattttgataaaaatggaaatataaatcattttggatcgctcattttacaatataattcacatgcttatagattaatcttccatattgaaaaggggcgtttgagatttgtcaaaatataa

SEQ ID NO: 765 - DNA, 399 bp, Staphylococcus epidermidis
ggaggatgcaagatgagtatctctttgtacattgcaattggtattattgttattatcattgcatatatgattatccaacaaattcttaataagcgagctgtaaatgaattagaccaaaatgaattccataaaggtttaagaaaagctcaagttattgatgtgagggaaaaagtggattatgattatggacatattaatggtgcacgtaatattcctatcacagtatttaagcaacgatatcaaggactaagaaatgaccaacctatttatttatgtgatgctaatggtatagcaagttatcgtgctgcacgtatattaagaaaaaatggatataaaaatatttacatgcttaaaggcggttacaaaaaatggacaggtaaaataaaatctaaaaagtaa

SEQ ID NO: 766 - DNA, 957 bp, Staphylococcus epidermidis
tggattagcaatatctataaaaggagaatgactatggttgaattattagttactcctaagtcaataactcatatggaaacactaatagataaaggtgcagacgcatttgttattggtgaacaaaaatttggtttaagactgccgggagaatttaatcgtgatgctatgcaagaagctgtagcattagcccataaaaataacaaaaaagtatacgctgctgtgaatggtattttccataattaccacttagatgccttggaagactatattaactttttacatgatattcaagtagatcgcattatatttggtgatccagctgtcgttatgtatgttaaacaacacgagcatccaattccattaaattgggatgctgaaactcttgtaacgaattattttcagtgtaattactgggggaaaaaaggtgcaaatagagcagttttagctcgagaacttagtttagatgaaataattcatattaaagagcatgctgatgtagagatagaagttcaagttcatggtatgacttgtatgtttcaatccaaaagaatgctattaggaaattattatactttccaagagcgacaaatgaagatagaacgccaacatgatcatggagacttattattatatgatgaagaaagagataataaatatccagtttttgaagattataatggtactcacatcatgtctccaaatgatatctgtttaatagaagaattagagcctttttttgaggcaggaatagatgcgtttaagatagatggtattttacaaagtgaagaatatataaatgtagtcacagagcaatatcgagaagctatagatttatttaatgaagatccggatgcatatgaagatgaaaaattcatgctcgttgatcctatagaagaaatacaacctgaacatcgtccattcgacgaaggtttcttgtataaacaaacagtatattaa

SEQ ID NO: 767 - DNA, 1386 bp, Staphylococcus epidermidis
tcagagttaaataggaggaattcaatgatgtatcgatgtttgattgcaaatagaggcgaaatagcagtaagaattataagagcttgtagagagcttaacatagagacagttgccatttatgcaaaaggtgatgaaaatagcttacatgtaagtttagccgatcaagcaatatgcataggtgaagcaaatccattagacagttatttaaatattgatcgtattatatctgctgcaaaagttacagaatcaaacgtaattcaccctggctatggtttcttatcggaatctacgaattttgcgaaagccgttgaagacaatcatatacattttattggacctagtaagacaactatggaaatgatgggggataaaattactgccagacaaactgttaaacaagcaggagtacctgttataccaggttctaatgatgctgttcaaagtgtagatgaaattaaattattatccaaagaaataggatttccagttgtactaaaagcagctagtggtggtggtgggaaaggcatcagaattgttaaagaagcatctcatttggatcaggctttgaaagaagctaaaagtgaaggacaaaaatattttaatgatgatcgagtgtatgtagaggcgttcataccagtagcaaaacatgtagaagtgcagattatcggagacggtaaaaataactatgttcacttaggtgaacgcgattgttctgttcaacgaaagaatcaaaaattaatagaagaagcgccttgtgctgcattaactgaagaaagaagaacaagaatatgtggcgacgcagttaaagtagctcaagcttcaagatatcgtagtgctggaacaatagaatttttagttacagaagatgcacattattttattgaaatgaatgctcgtattcaagttgaacatacagttacagaaatgcgtgctgatagagacctattacaagctcagttatatttattaacacacggtgaattaccattcactcagaaagatattttatttaatggtcatgtaattgaggcgcgtataaatgctgaaaatcctgaaaaaaactttttacccactccaggaaaagttaataaattacacttaccacaaggatttaatatacgtgtagattctttactttacacaggttatcaggtttctccttattatgattcacttgtagctaaagtgattgtaaaggattctaatagacaaactgctattaataaattaaaagttgcgttagatgaaatggtcatcgaaggttttactactacagctgactttttatatgcggttttaaattatccaatatatgcaaaaggcgatgccagtaaagtagatataaaatttcttgaaaaacatcaaatcattaaagaggtgaaatga

SEQ ID NO: 768 - DNA, 348 bp, Staphylococcus epidermidis
caatcgataaaatcaacgcataatcgtatgattactgttgatattacggttaatgacgaaggtaaggtcacagatgtagtcatggatggtcatgctaatcatggtgaatatggtcatgatattgtctgtgcaggagcatcagcagtcttatttggaagtgttaatgctataatgggattaacatcagagaagccagatatcaactacgaagatgacggcggatattttcatataagaagtgttgatacgaataacaaagaagctcaattaattcttcaagcaatgttagtttctttacaaactatagaagaagaatataatgaaaatatcaaattaaattataagtga

SEQ ID NO: 769 - DNA, 189 bp, Staphylococcus epidermidis
ataacggtaaaaccttttctgaaccatacgcatagcgcatggttttctttatacaataaagaagccagtaatgaatttataaaaaattcatttactggctattttgctaggaattatatcccagactcattgaactcaaaatttatatatattactatccggaaccgagtttggaaagtacttcaatga

SEQ ID NO: 770 - DNA, 297 bp, Staphylococcus epidermidis
gatttgtcaaaatataaatttaaagggtctttaattattgatgcattgctagccttttttatagttagtacaataacaatgattttaatacctatgttttcaaacttaaacaatcagtatcttatcaatttaaataatataaaaatcaagcaaatcatgataactagccttcaacactataaaaagaaagaactttatcaaggggttgtaatagaaaattatgaaatacaattattcaataataaaatatgtggggaggataaagcatttaatacgcgaacatgtatttcaatttaa

SEQ ID NO: 771 - DNA, 1020 bp, Staphylococcus epidermidis
agaaatcgaaaaataaaaaggagcgatttaatgtttagtattggttttataatcattgcagtcattatagtagttgcactactcattctgttttcatttgttccggtcggattatggatttcagcactagctgctggagtacatgttggaataggcacacttgtggggatgcgtttaagacgggtttcaccaagaaaagttatcgcacctctgatcaaagcgcataaagctggtttaaacttaactacaaatcaacttgagtctcattacctagcaggcggtaatgttgatcgtgttgtagatgcaaacattgcagcacaacgagcagatatcgacttaccatttgagcgaggcgctgccattgatttagcaggtagagatgtattagaagcagtacaaatgtcagttaatccaaaagttattgaaacgccatttattgcaggtgtagcgatgaatggtatcgaagttaaggcgaaagctcgtattaccgtacgcgctaacatagcaagacttgttggtggtgctggtgaagaaacaatcattgctagggtcggagaaggtatagtatctacaattggttctagtgagcatcatacagaagtgctcgagaatccagataatatctcaaaaacagtactaagtaaaggtttggactctggaactgcattcgaaattctatctatcgatattgccgatgttgatattagcaaaaacatcggtgctgatttacaaacagaacaagcacttgctgataagaacattgcacaagctaaagcagaagaacgtcgcgcaatggctgttgcttctgaacaagaaatgaaagcgcgtgttcaagaaatgagagctaaagttgttgaagctgaatccgaagtgcctttagctatggcggaagcattaagatcaggcaatattggagttaaagattattataaccttaaaaatattgaagcggatacaggtatgagaaatgcaataaataagcgcactgatcaaaacgatgatgaatcaccacaacaataa

SEQ ID NO: 772 - DNA, 693 bp, Staphylococcus epidermidis
tcgtgtagaaatgagggagaaaagatgcacgaacaaagtaagatataccaaaatattaaagatggtaaattagataccgctttgaaagacttgtttgaaaatatagaagaaaatccggccattgttgaaaattatattaacgcaggtattgtattatcagatgttggagaaattgaaaaagcagaacgttttttccaaaaggcattaactattgaacctgaaaatggtgctgtttattataacttggcaaatatttattataatgaagaacgttataacgaagcgataaagctatatcaaactgcactacaatatgaagtagcgaaaaaagattgtaattatatgattggtatgtcgtttaatcaactaggtgcttttaaagaagctttaccatttttaatgactgcagctgaaatggacgatgatagagatttagaagtacagtttcaatatgggttagtactatgccaactcgaaatgtttgatgaagctattaaacaattaaataaggttctttctatcgattcacagcacgtagatggtatatataatcttggtttagcaacatatatgaaaaatgaaaatttagatgaagcaattgcatattttgaacaagcaatatcaattgatgaaaaacatttacttagtcaacatgcattaaagacattcaaaacaatgaaagaggaggaataa

SEQ ID NO: 773 - DNA, 519 bp, Staphylococcus epidermidis
attaatttgaagagtattcaagtgcctattattttagttggtttcatgggaactggtaaaactactgttggaaaatatctttcagatttatataatttaagttatgtggatttagataattttattgaagtaaatgaatgtaaatctatacctaatatatttaatgatatcggagaaaaaggatttagatcattggagactagatacctaaaatcttgtctcaatactttcgatattatttcaactggaggaggtattatagaagatacgaattcattaaagctcttaaaaaatcaaaagcatgtagtttggctagactgtgacattgaaatcattttcaaacgagttaaaaatgattcacatagacccaatgctaaaagtaaaaatcttaaccaacttgatgccttgtattcttcaagactttcaagatataatgaaatcgcattcatgaaagttgatagtgcacagagtgtttctgaaatttgcactttaattaaaacaaaattattaagcgattga

SEQ ID NO: 774 - DNA, 498 bp, Staphylococcus epidermidis
aaaattatgaaatacaattattcaataataaaatatgtggggaggataaagcatttaatacgcgaacatgtatttcaatttaatataaaagcatttacttacatcgaagcattatttgctttatttgtgactactttaattctcgctttattacctactatacttaaattgacttcgttttatcttaatactgctcaaaataacgaagatattcaatttgaattttttagaagagatttacttaaagagaaaatgacgactcaaaacaattatgagatagaaaatgcatatacaattaaacttaagaaagataaagatgttattagatatatttataaaaaccgtaaaatttacaaaaacattaatcaaaaaggtaatattacattgttaaatcacgtcttgtctactcgtatattaaaaacgaacgataatatagtaaaattattaataacaacaggagaaacgaacgatgaacacaaagaaatcctgtttatatag

SEQ ID NO: 775 - DNA, 276 bp, Staphylococcus epidermidis
aaaggtgtgaaaaatgtgagtacagaaccattagcctctcgaatgagaccgaaaaatatagatgaaattatatctcaacaacacctgtttggtccgaaaggtataataagaaggatggtagatactatacgtctttcttctatgatttcttatggtccacctggaattggtataacaagtattgcaaaagcaatttcaggcagtacacaatctaaattcagacaattaaatgccggtccaaataccaagaaagatatgcacctaattgtcgactaa

SEQ ID NO: 776 - DNA, 210 bp, Staphylococcus epidermidis
caacaggagaaacgaacgatgaacacaaagaaatcctgtttatatagccgaaaagcgttcattagtttatatttaatagtaattttttcaatttatttatcaattatatctttttatatctctcaatatagtttaaaattaaagacaatacataacttagatgtttactacaataaagttatcgttaataagttaaaagaggtagattaa

SEQ ID NO: 777 - DNA, 2448 bp, Staphylococcus epidermidis
aagaggaggaataatatgtctgaccctacactttttgattattcaatgatcaaaggtacagttgatgctattttatttcaaaatacggataatttttatactgttctaaaagtagatactatagaatcaaatgaaaaatttgatagtatgccaactgtggtagggtttcttcccaatgtagttgaaggcgatgtttatacttttaaagggcaagtcgtacaacatccacgttatggtaagcaattaaaggctgaaacatttgaaaaagaattacctcaaactaaagaagccattattagttacttatcaagtgatttatttaaaggcatcggtaaaaaaacggctcaaaacattgtaaatacactaggtgaaaatgctataaatgatattttaactcgtccagaaatcttagaaagtgtacctagtttaccaaagaagaaacaaaagcaaattgctgatcagattaatgcaaaccaagaatctgagaaaattatgatacgtttacacgacctagggtttggtccgaaattatcaatggctatatatcagttctatatgggtgatactttaaatgtcttagataaaaatccttaccaattagtatatgacattaaaggtattggttttaataaggctgaccaacttgctcgaaatgtcggtattgagccacattcacctgaaagattaaaagcagcattattatttacgttagaagaagaatgtatcaaacaaggacatacatatctacctcgtacaattgttatagaaacaacacaaaatttactcaatgaagatattgagaaaccaattgaaacagagcaattactagaaatcattgacgttttatcagaagagaaaaaattaatatctgaagctgatcaggtatcaattccaagtttatactattcagaattgaaaagtgtgcaaaacttataccgaattaaaacaaacacatctaaattaaaagaaatagaacagtctgatttacaaatacatattggtgatattgagtcacaaaatgaggttaattactctgcctctcaaaaagaagcgcttgaaacagcaataaattctaaaattatgcttttaactggtggtccgggtaccggtaaaaccacagtcattaaaggtatagttgaattatatgcagaaatacatgggctctcgctcgattatgatgattacaatgaagatgattatccagtagtgttagctgcacccactggtcgtgcttctaagcgccttcacgaatcgacaggtttagaagcaatgacaattcatcgtttaatcggttggaaccaagatacacaaccacaggatattttagaaaatgagatcaatgcaagactcattatcatcgatgaaatgtcaatggtagatacttggttgttccatcaatttttaagcgctgtgcctttagaagcacaaattgtatttgtcggagatgaagatcagttaccatcagtaggtccaggacaggtatttaaagaccttattgattctgaaataataccgcgtgttaatcttaccgaagtatatcgtcagcaagatggttccagtattattgacttagctcaccgtatgaaattaaatgaacctatcgatattactaaacgttatcatgatcgtagttttattcgttgtggtacgaatcaaattccagacgttgttgataaagtagttaaaagcgctgtagctaaaggctatgatatgagtgatatacaagttttggctcctatgtataaaggtaacgctggtattaagagacttaaccaagttctacaatctattcttaatccgaagcaacaagatgatcgtgaaatagaatttggtgaagctgtgtttagaaaaggggataaagtacttcagttagttaatcgacctaatgataatatatttaatggggatataggtataatagtaggtatattttgggccaaagaaaatgctctaaataaggatgtgttagttgtagattttgaaggtaatgaaattacatttactaaacaagatttaatggaactaacacatgcatattgtacatctatccataaatcacaaggttcagaatttcctattgtaattatgcctattgttagacaatattataggatgttacaacgtcccattctttatacaggattaactagagctaaacaatcacttgttttgcttggtgaacaagaagcatttgatataggtttaaaaacaaatggacaaatacgattaacgcaattaaatgatttgttaaaatcgtattttggacaaaacaaagataatttaactacaaataaacaaacgattaacgaacaaaaagaaaataacaatcatctggatttgaaaaatgaaaaagaaaatgatatccaattaaacgagtcgacaattttccaaatcgatccaatgattaatatgggggaaatgacgccatatgacttcgttgaacgttga

SEQ ID NO: 778 - DNA, 189 bp, Staphylococcus epidermidis
ctttcacttgagggatcgattaatattacattttcttcattctcaatgaaatacgtattagtatcaactattcctaatgttaaatttgaaattcgcattataattcaccactatggtctagatgtttttgtactgattttaatttatcattcatttttcttgatttatctcgacgatcatcaattctaa

SEQ ID NO: 779 - DNA, 270 bp, Staphylococcus epidermidis
gaaaagaacctagtgacaataactgaggttctttttattaattataggccattggtcgtatttattaaaatttatgcatttttatgtttaatcttcacaaatttgagatatatttatagtatatcaattagtaggtttagaaaaatattaacaagattcacattaacaattttgtttaattgtcgtgtgagtcgggaaaataatttaataattaaaacttttttgaaagcatattctttgttgcttataaatctacttgttatgatatag

SEQ ID NO: 780 - DNA, 615 bp, Staphylococcus epidermidis
aggagtactgacatgtatgcatatattaaaggaacattatctcagttgttccctacacatgtagtggttgagacatgtggcataggttatgagatacaaacgcctaattcctatcgttttcaaaaatatcttgaaaaagaagtccaaatttatacttcactaattgtacgagaagatgctcaactactatatggctttattaatgaagaggaaaaagaaatgtttcttagcttaataaaagtgactgggataggacctaaatcagctttagcgatacttgcttcaagtacaccacatgaagttaaattggctatcgaaaatgaaaatgatgcttatttaacacaatttcctgggataggaaagaaaactgcaagacaaattgtgttagatttaaaagggaaggttacaattactgaagaaaatagtgacgatttattacaaactcaagttaatggtaatgaacaaaaccaaataatatctgaagcactattagctttacaagcactgggctattctaaacgagaattaaccaaagtagaaaaatccttaaacaaacataatgtgaatagtgtggatgaagccgttaaaataggactacaaacactagtttcttaa

SEQ ID NO: 781 - DNA, 651 bp, Staphylococcus epidermidis
caacatgatgagaaaggaaattggctaatgaatcagacaacgattattggcattgcagggggttcaggctctgggaaaaccacagttactaatgcaatcatgaagaatttagaaggtcatagtgtcgcactcttagcacaagattattactataaagatcaatcacatttaacttttgaagaacggcttgaaacaaattatgaccacccatttgcatttgataatgatttacttattcataatttaaaagatttaagaaatggaaaaccagtagaggtacctacgtacgattattctcaacatacacgtagtaaagaaacaattgcatttgatccaaaagatgttattatcgtagaaggtatctttgctttagaaaacaacacattacgagacatgatggatgtgaaaatttatgtcgatactgatgctgatttacgaattttacgtaggcttacaagagatactaaagagcgtggtcgtacaatggaatcagtaattaatcaatatcttaatgtagtaagacctatgcatgagcaatttattgaacctacaaaaaagcatgctgacatcataattcctgaaggaggcagcaataaagttgccatagatattatgactactaaaatccagtcactcgtaagcaaaaaatag

SEQ ID NO: 782 - DNA, 780 bp, Staphylococcus epidermidis
  unsure (118): Identity of nucleotide at the above locations are unknown.
aaggttggtgatcaactgatgctaatgacacaaaagggcatcattatcaaatctgttgattatggtgaatcagacaaaattattacaattttaaatgaatacggagctaaaataccantaatggccagacgagcaaaaaaagttaagtctggacttcaagcaaatacacagcttttcgtatatggcttatttatatataataaatggcgaggcatgggaacactaaattctgttgatgtgattaatcaacattatgaactccaactcgacttatttgaaagtagctatgcatctttatgtgctgaaacaattgaccgatcaatggaagagaatgaggtttcaaaatataattatgacttacttcaatttgttctttccaaaattaacgaaggaacccctgcacaattaatgtctgtaatcgtcttattaaaaaatatgtctaaatttggattcacagcttcatttgatcactgtgcaattaccggcattcaagatcaatcaaaacttatagcgtatagttttaaatttgacggtgctatttcagaatctgcattatatcaggatcaacatgcttttcatctctctaatcgcaccttatatcttcttaatatcctgcagcaattacctataagtaagatgaatcatttaaatattcagcaagacatattaaatgaaatgtctgaactacttatcatgctttatcgtgagtatgctggtatgttttttaaaagtcaaaaattaataaatcaattaaatagattagaaaaagattcattgtaa

SEQ ID NO: 783 - DNA, 726 bp, Staphylococcus epidermidis
gggcgaggtgaaaaaatggataacttacatctaatacatatgctatttatggcaaaacctttaaatggaatgaattgggttgaaaaccttgcacagtttatcactcaaccttttgtttctcttattttcacttgtattatatttattggctttttataccaactatattcaaagcgcataaacttaatgggaataatagcattacttgctttactacttttatttttagcattcctaattaatggcgatgtcaatgtgatgtcagtattactgtttacaattggcctcatactactgattgttgaattatttgttataggcgctgtaataggtattattggtattattctaataacactaagtattattatacttggtgacaatattttattaatgcttggaaatgttatagttgcattaatattatcaattgtagaatgggtgattttagtgaaaatattcaatagaaaaattccatttttagataaagttattttaaaggattcaacaaattctgaagcaggttatcgttcacatgacgaccgctctcatcttgtaggaaaaactgcacatactgttaccgatttaagaccagcaggaattataacttgtgacaatgatcgaatagacgcagtatctgatggatcatttattttacgtaatcgacaagttaagattcttgaagttgaaggtacacgtgttgttgttagagaaatcgaaaaataa

SEQ ID NO: 784 - DNA, 630 bp, Staphylococcus epidermidis
agacctatagaattaagtcaaagacaagaacaaataatagagattgttaaatcggaaggacctatcacgggcgagcatatagctgaaaaaatcaatttaactcgtgctacattacgtcctgacttggctatactcacgatgtctggttttatagaggcacgtcctcgagtaggttatttctattctggtaaatctaaaaataaaatcataaacgaaaaattacgaaaatatgttgtaaaagattatatgtcgcatcctgttgtcataaaagaaaacatgactgtttatgatgctatatgtaccatctttttagaagatgtcagtacattatttattacaaatgagaataacgattttgtaggagtatgttctaggaaagacttacttcgtgcctcaatgattggtgaggacatacatacaatgcctatcagtgtaaatatgactagaatgcctcatgtttcatatttaaaagaacaggaactcgttatttatgctgcaaatcaaatgattgataaagagatagattcattaccaattgttagacctaaagaaaacgacaaatttgaagtaataggtcgcatctctaaaacaacaatcactaaattattcgtttcattatttaaagaatag

SEQ ID NO: 785 - DNA, 1068 bp, Staphylococcus epidermidis
ttattaatagattatcagtatttactaaaatcgggaggccttttcatgtctgacaaccaagttaaaattaaaaagcaaacaattgatccgactttaacactagaagatgttaaaaaacaattaattgataaaggaaaaaaagaaggtcatttaagtcacgaagaaatcgctgaaaaactgcaaaattttgaaatggactcagatcaaatggatgatttcttcgaccaattgaatgacaatgacattacacttgttaatgaaaaagatagttctgacacggatgataaaatcaatcctaatgatttgagtgcccctcctggtgtcaaaatcaatgacccagtgcgtatgtatttaaaggaaattggtagagttaatcttttaagtgctcaagaagaaattgagcttgcaaaaagaattgaacaaggtgatgaaattgctaaatcacgattagctgaagcaaacttgcgtttagttgttagtattgctaaacgatatgttggtcgtggaatgttattcttagatttgattcaagaaggtaatatgggcttaattaaagctgtggaaaagtttgattttagcaaaggatttaaattttcaacatatgccacttggtggattagacaagctattacacgagcaattgctgaccaagcacgtacaattcgaataccagtacacatggtagaaacgattaataaattgattcgtgttcaacgtcaattattgcaagatttaggaagagatccagctcctgaagaaattggagaagaaatggatttaccaccagaaaaagtcagagagattttaaaaattgcacaagaacccgtttcattagagacgccaattggtgaagaagatgatagtcatttaggagatttcattgaggaccaagaagctcaaagtccatctgaccatgcagcatacgaattgttaaaagaacaattagaagatgttttagatacacttactgacagagaagaaaatgttttacgtttacgttttggtttagatgatggacgaacaagaacactagaagaagttggaaaagtattcggtgtaaccacgtga

SEQ ID NO: 786 - DNA, 852 bp, Staphylococcus epidermidis
cttttgatagatgcgttattaaattttgattttattagatattctttgattagcggtctgcttattggctttatcgcaccattaataggtgcatttattgtagttcggagactatctttaattgctgacgctttaagccacgtgacattaggtggtatttcctttggtatgtttttgcttaccattattcccgttttctcagtaataaaccctatgtggtttggtattctttttgctgttattggagcgttattaattgaaaaattaaggacttcgttttctaattatcaagaaattgcaattcctattataatgagcgctggtattgctctaagtgctatttttatttctctagcagatggttttaatcaagaaatcgtaggcctactatttggatcaattagtgcagtaaatattagtgatttaactacaattattatcattacaataattgttctcatatttattgttttattttataaagaattgtttattttatcatttgacgaagaatatagtaaggtcataggtataccaaagtggattcaatttttatttatagtaattgttgctatggtaatatctgcatcaatgagagttgtaggtatattattagtaagcgcgttaataactcttcctatagcaatttcaatgagaataactaaaggatttaaacaattaatagcattaagtgttatattaggagaattatctgtaattctaggattaattatagctttttatatgaatatatcacctggtggcgtcattgttgtactattggtattaatgctcatactaacgatgattattcagaagttaaaaattaagtttaaaaagggagtcgtttaa

SEQ ID NO: 787 - DNA, 354 bp, Staphylococcus epidermidis
atgaattcagaagaattattaaatattgctgtcgaagcggcagagaataagaaagcagaagatattatttctctcaatatgaatgaaattagtgatatgacagattattttgtagtctgtcacgggaacaatgaacgtcaagttcaatccattgctagatctgttaaagaagtggcacataaacatgatattgacgttaaacgtatggaaggctatcaagaagctcgatggatacttattgatttagcaaatgtagttgttcatgtttttcataaggatgaaagaagctattacaatttagagaaattatatcaagatgcacctattaaagaatacggtcaggcagtattttag

SEQ ID NO: 788 - DNA, 1164 bp, Staphylococcus epidermidis
tttgacaaggagtgtccaaacatggaagtatacgcagattatgctgcgactacgccagtaaaaccagaagtaatagatgctatgatggaaatatatcaatctcattttggtaatccatcgtcaatacattctattggtagagatgcacgcaaatatcttgatcagtcacgtcgtacagttgcacaattgttgggagcgaatccgaatgaagtaatatttacaagtggtgcaacagaatcgaataacactgctattaaaggattagtgaaagcgaatgaacaattaggtaatcatattattactaccaaaattgaacaccattcagtattacacgtatatgagcaacttgaaaaagaaggttatgatgttacgtatctagatgtagatgatactggtgcagttgatttagaccaattaaaagaaacaattaatgatagaacaattttagtatcaattatgtttgtaaataatgagattggaacagtacaaaatatttatgatattgaagatattattggagacactcatgcgttattccatgttgatgctgttcaagcaattggacatttagatttagattttcataattttaaaattgatacaatgagtatttcagcacacaaatttggtggtcctaaaggtgttggtctactattagtaaaagagcatacaccaatagcatataatcaacttggtggtgaacaagaaaccaaacgtcgagcaggtacagaaaatttacctcaaattgttggattaacaaaggcacttgaattagctataaccaatcaagatgtaaataatgttcatttaatgaatttaaaagaattatttttagttcagttacaggaaagggcaattccatttgaattaaacggttcaatgacagattcaacgggtcatattttaaatatttattttccatttatagatgttgaaacaatgttaacattattggatttagcccatgtatatgtatcttcaggttctgcttgtacagcaggttcaacgactccatctcatgtacttgcagctatgtttgaagatgaagaacgagcaaaacattcagtacgttttagctttaatgaacaaacaacaacgcaagaaattaaatatattgtagctgaaattcataaaatctatcataaatttaaggaggaatcatag

SEQ ID NO: 789 - DNA, 996 bp, Staphylococcus epidermidis
tatatagaggaaggtgtacgtatgagcaacaatatcttcactgtctacggtgaagtaccagaattagtcgaaaagaaaacaaaagaaattgtaaatgattatctaggacaagagatagatgactttaattatgtaaaatacaacttgtatgagagtgacctaactccgattattgaagagacacttactatgccttttttctcaaataaaaaagcaattgttgtaaagaactcgtatgtttttacaggggaaaaattttctaaagatttaaatcacaattctgacgagcttataaaatttttagaaaaatatgatggtgaaaatctcattatctttgaagtgtatcagcctaaactagatgagcgcaaaaaactcacgaaaacgttgaagaaaaatgcacaacttaagaaaattgaacaaatgtctgaaaaggaattaaagcattggattaaaaatacactaaacaataattataaagatattaagcaagatgctcttgaattatttattgaattaactggtgttaactataatattgtttctcaagaattagaaaaattaattttattcataggtgagagacctataattaataaagaagatatcgatttaattattaatagaagtttagaacaaaatgtatttctactaactgaatacattcaaaaaggtaataagaataaagctatacaattagtcaatgatttaatcattatgaaagaagaacctataaaattactggcattaattactagtaattatagattatattatcaatgtaaaattcttagtcaaaaaggctatagtgggcaacaaattgcaaagactgtaaatgcacacccttatagagtaaaactagcactcaatcaatcccgacattataaactagaaagtttgtttaacatcataaacgcttgtgcagagactgactacaaactaaaatcatcttatatggataaacaactcattttagaattattcatactatctctataa

SEQ ID NO: 790 - DNA, 1173 bp, Staphylococcus epidermidis
ctttttcattgtcttctccctaaaccaaaaactattattattattactagttatgctatcattttaatgtataaaataaaaatgtacaaatgtaaacgtaggagggaaaaaatgaataaattaagaaaagttctagatatcattgaacataagcacttagatgcaatcatagtattatcagattataatagacgttatctttcagatttgactggtacaagtggtgcactaatcataacacctaaaaaacaatatcttattactgattttagatatatagaccaagctacagaacaggcacaggattttgaaattataaatcgaaaatcaagtttgatttctgaaattaaatccatattagaaagagaaaatttatcaaatattggttttgaaggtcatttaatcagttatgatacttatgttgaacttaataaaggattaattactttaataagcatatctaatgaaattgataagattagagaaattaaaaataaggaagaaattcagctcattcaaaaagcggctaagatagtagatcaaacatatgaatatatcctcactcaagtaagtatcggaatgacagaacgagaaattaaagctaaattagaaagtaagatgttagaattaggcgcagatggcccttcattcgacacaatagtggcttcaggttaccgaggtgcgttaccgcatggtgttgcaagtgataagcgtattgaaaagggtgatatgattacattagattttggtgcatactatagaggatattgttcagatattacgcgcacgtttgcaataggagaaccggatccaaaactcaaagaaatatttaatatagttctaacttctcaaaagaaagctattgaacaaatcaaaccaggtatgactgcaaaagaagcagatgctatatctagagagtatatttcatctcacaactatggtgagcagtttggccattcacttggtcatggtatcggccttgatattcatgaaggtccactattatctcaaaatagttcagatgaattaaaaataaataactgtgttactatagaaccaggcatatacattgagggattgggtggcgttagaatagaagatgacattcttattacagaaaatggatgtcatgtctttactaaatgctcaaaagaccttattattttagagtaa

SEQ ID NO: 791 - DNA, 942 bp, Staphylococcus epidermidis
tcaatgaattggatggaactctcaattgtagttaatcacgaagtagaatacgatgttacagaaattcttgaaagttatggctctaatggagttgtaattgaagattcaaatattttagaagaacaacctgttgataagtttggagaaatttatgacttaaaccctgaagactatcctgaaaaaggagttcgattaaaagcttactttaatgagttcacttataatgaaaacttaaaatctaacatcaattatgaaatattaagtcttcagcaaattgataaaacaatttatgattaccaggaaaaacttattgccgaagtagattgggaaaatgaatggaagaattattttcatccatttagagcttcaaaacaatttacgatagtaccaagttgggaatcatatgttaaagaaaatgataacgaattgtgcattgaattagatccaggtatggcttttggaacaggtgatcatccaacgacaagtatgtgtttaaaagcaattgaaacttttgtaaaaccaactgattcagttatcgacgttggaacagggtcaggcattttaagtattgctagtcatttacttggagttcaaagaataaaggcattagatatagatgaaatggctgtaaatgtggcaaaagaaaactttaagaaaaatcattgtgatgatgcaattgaagcagttccaggtaatttattaaaaaatgaaaatgagaaatttaatatcgttattgcaaatattcttgctcatattattgaagaaatgattgaagatacttataatactttaattgaagatggttattttatcacatcaggtattattgaagaaaagtatcaagatatagaatcacaaatgaagcgtattggtttcaaaattatttcagtagaacatgacaatggctgggtttgtatagttggtcagaaagtgagtggataa

SEQ ID NO: 792 - DNA, 636 bp, Staphylococcus epidermidis
attcattactggcttctttattgtataaagaaaaccatgcgctatgcgtatggttcagaaaaggttttaccgttatctaaaaaaacatctcatcatgctagaatatatattggtcagccaaccaaaatattcaacacgaggagatgcttttttatgtcatctgacacaaacagtttagcacatacaaaatggaattgtaagtatcacatagtctttgtaccaaaatatagaagacaagtgatatacggaaaaatcaaaagagatattggagttattttacgtcaactatgtgaaagaaaaggcgtagaaataatagaagcagaagcatctaaagatcatattcatatgttagttagtattccacctaaattaggagtatcctcatttgttggatatttaaaaggtaaaagcagtttaatgatttttgatagacatgctaatttaaaatatagatatggaaatagaaagttttggtgtaaaggattttatgtagatacagtaggtagaaataaaaaggtaattgaaaattacattcgtaatcaattacaagaagatatcgttgcagatcaaatttcaatggaagaatacctagatccctttacaggagaagaaattaaaaaaagacgaaaaaaatag

SEQ ID NO: 793 - DNA, 372 bp, Staphylococcus epidermidis
aatggcagctgtatttattttacaaggctatttagattctattcaataaaggagaaattaaaaatgacagaacataatcacgatgctgagttaacaataaataatgaagaggaattacttacgttatatgatgaaaacggaaatgaagttttataccgtaaaatgttagaattttatcatccagaattcaaaaaagaatatgtcgttcttgcagaagaaggtgcacaatcagatgacgaagatatgattgaacttgtaccaatgataaatgaacctgatgagtctggtgatggtgggaaattagtccctattgaaacagatgaagaatgggatatgattgaagaagttgtaaatactgagattaacgaataa

SEQ ID NO: 794 - DNA, 897 bp, Staphylococcus epidermidis
atcgcaggatgggaaaataatatgaagaaaatagattcatggctaactaaacatggtctaaaaaatcgacttacgctcgtagtaattgtaatttttattatatttttaattttactttttatgtttgttaatttaagtgatgaagatacaggtcaaattactataactgagaatgctgagttaagaacaggacctaatgccgcctatcctgttatttataaaatagaaaaaggcaaaagttttaagaaaatagatcgaaaagggaaatggattgaagttcaaaatcacgctggcactgagaaaggctgggttgctggttggcacacaaatttgaacattccagctgatcaatcactttcgtcaaaccctctaaaaggaaaaacaattgtacttgaccctggtcatggtggaagtgatcagggcgcctcaagtagtacaccatctaaaagtctcgaaaaaaattacacacttaaaactgctaaagaattaaaaaagttattaaataaggaaggtgctcatgtaaaaatgactcgttccaatgataaatatgtgtccctagatgatagaaatataaagggtgacgcatttattagtatacataatgatgcgcttgattcttcaaatgccaatggagtgactgtttattggtttaaagacaagcaagaatcacttgcacaaactttaaattctgcaattcaaaagaaggcattattgacaaatcgaggttctagacaacaaaattatcaagtgttgagacagacagatataccagcagtactgttagagttaggctatataagtaatcctactgatgaatcaatgattaatgatcaattacatagacaagtggttgaacaagctattgttgatggtttaaaacaatatttctcgtcctag

SEQ ID NO: 795 - DNA, 2097 bp, Staphylococcus epidermidis
gttgttttgctaaaaagattaaaagaaaaatcaaatgatgaaaaaatgagaaacaccatgaataaaagaatcaatttcatatttggatttatagtatttatctttgctatagtcgtattgagattaggttatttacaaatagcacaaggatctcattacaaacaattaatcaaaaacgatgaaaacataactgttaatgaatcagtaccaagaggccgaatactagatagaaatggcaaagtactagttgataatgcttcaaagatgtctattacatacactagaaaccgtaaaacatcacaaaaggaaatgttaaatactgctaagaaactgacagatttaattaaaatggatacagataaaattactgagagagataaaaaggatttttggattcaaatgtatccgtcatttgctaaaaagttaatgagaaaagaacaattaatgttagaggatggcagtatttcacaagaccaatttgatacccaacttagagataaaataggaaaaaaacaattaaaacagttaactaaaaaagatttgcaagttttagcaatttatcgggaaatgaacgctgggtcaactctagatcctcaaacaattaaaaatgaagacgtaagcgagaaagaatatgcagccgtatcacaacagctttctaaattacctggtgtaaatactacaatggattgggatagaaaatacccatacggtgatactttaagaggcatatttggagatgtgtcgacttcgactgaaggtatacctaaagaattaactgaacaatatttatcaaaaggttattcacgaaatgatcgggtcggtaaatcttatcttgaatatcaatacgaagatgttcttaaaggcacgaagaaacaaatgaaatatacaactgataaatctggaagagtaataagttcagaagtacttaatcctggctcaagaggtcatgatttacaattaactatagatattgatttacagaaaaaagtagaatctttattagaaaaacaaatttctaaattacgtagtcaaggtgctaaggatatggacaatgcgttaatggttgtccaaaatcctaaaaatggagacattctcgctattgcaggaaagcaaattgataagcaaggtaaactcaaagattatgatatcggcaactttacagctcaatacacagtaggttcttcagtaaaaggaggaacattattagctggataccaaaataaagctattaatgttggagaaactatggtagatgagccattaaaattccaaggtggtttaactaagcgttcttattttaataaaaatggtcatgtatctatcgatgataaacaagcacttatgcattcatcaaacgtatacatgtttaaaaccgcacttaaattagcaggtgacccctatacttcaggtatgtcattacctaataatatagcagatgctggtcgtaaattgcgtaaagggttaaatcaagtaggtcttggcttaaaaacaggtattgacttaccgaacgaaacgccaggccaaatagaacccttaactaataatcctggtaactatttagacttagctattggacaatacgacacatatacaccacttcagttgtcccaatacgtatcaactattgctaatgatggctatagaattcaaccacatattggattgtctatttatgaatctactaataaagatgaaactggtccattaaaacgtaaaattaagggtaatgttttaaataaggtaaataactcaaatgacgaaattaaagaagttcaagaaggcttcaaaatggctttcaatgaaaagcaaggtacaggttatgctagttttagaaatactgtagtaccttcagctggtaaaacaggaactgctgaagtttttcaagacggagaacctagagttaactcaacatatatcggttatgcacccgtcgatgatcctaaattatctttttcaattgtctatacaaatcaacctgttccaccaccttggttaaatggtggagatttaggtagagacgtaatcaactactattttaaagataaggataataaaaaagatgactctcaatctaataacgaagagaaagaagattaa

SEQ ID NO: 796 - DNA, 438 bp, Staphylococcus epidermidis
aaagggagtcgtttaagaatgaatacaaatgatgcaattaaagttttaaaggaaaacggacttaaatatactgataaacgtaaagatatgctagatatctttgttaaagaggataaatatttaaatgctaaacatattcaacaacaaatggataaagactatcctggaatatcatttgatactgtatacagaaatcttcatttatttaaagatttaggcattatagagagtaccgaattagatggagaaatgaaattcagaatcgcatgcacaaatcatcaccatcatcattttatttgcgaaaattgcggagaaactaaagtgattgatttttgtccaatagaaaagattaaaagtcaattacccaatgtaaatattcatactcataaattagaagtgtatggtatttgtgaagaatgtcaacgtaaagcaaactaa

SEQ ID NO: 797 - DNA, 1317 bp, Staphylococcus epidermidis
aagactattttaatcttttttaataataaaggagagagttttatgattaagatgccaagaggtacccaagatatcttgccgcaagattctgctaaatggcgttacattgaaaatcgattacacacattaatggaattgtataattataaagaaataagaacgccaatttttgaaagtactgaactttttgcaagaggcgtgggggattctactgacgttgttcaaaaggaaatgtatacatttaaagataaaggggatcgtagtttaacattacgtcctgaaggaactgcagccgttgtacgttcatatattgaacacaaaatgcaaggtgaacccaatcaacctatcaaactttactacaatggtcctatgtttagatacgaacgtaaacaaaaaggaagatatcgccaatttaaccaatttggtgtcgaagcaataggagcggaaaatcctagtattgatgctgaaatactcgctatggttatgcatatatatgagtctttcggattaaagcatttaaagttagttatcaatagtattggtgatagtgaatcacgtaaagaatataacgaagcattagtaaaacattttgaacctgtgattgatacattttgttcagattgtcaatcaagattacacactaatcctatgagaattttagattgtaaaatcgatagagataaagaagcagtaaaaaatgcaccccgtatcacagattatctcaataatgattctaaatcttattatgaacaagttaaattacatcttgataatttgaacatatcttatgttgaagatcctaacttagttcgtgggttagattattatactcatactgcctttgaattaatgattgataatccagagtatgatggagctatcactacattatgtggtggtggtcgatataatgggttgttacaattattagatggtccagatgaaacaggtattgggtttgcactaagtattgaaagattattgatggcacttgatgaagaaggtatttcattagatgtaagtgaagattttgatttatttgttgtgacaatgggagaagatgccgatcgttatgctgttaagttaatcaatgatttaagaagaaatggaataaaagtagataaggattatctaaacagaaaaattaaaggacaaatgaaacaagctgaccgtcttaatgctaaatatacagtagtaattggagatcaagagcttgaaaataatgaaattggtgtgaaaaacatgatttcaggcgaatcagaaaatgtacaattagacgaattggttaattattttaaaagtagaaaggaagtctaa

SEQ ID NO: 798 - DNA, 465 bp, Staphylococcus epidermidis
ttaatggaacgaattaaatgggaagaatacttcatggctcagagtcatttactggcattaagatcaacgtgtaaaagattatcagttggtgctacaatcgtaaaggataatagaataatagcgggtggatataacggctcagtagctggagaagtgcactgtattgatgaggggtgcttaattgaagatggacattgtatacgtactatacatgcagaaatgaacgcactactacaatgtgcaaaacagggtgtatcaacagaaggagcaacgatttacgttactcatttcccttgtttaaactgtacgaaatcaataatacaagcaggtatcaaaacgatttactatgcacaagattatcataataatgactatgccattaaattattgaagcaatcaggaattgaatataaaaaaattccgttttcacctgaatatgttgctcaatatctgactcaagaataa

SEQ ID NO: 799 - DNA, 1803 bp, Staphylococcus epidermidis
tgtcttttgcgtatagatcaatccgtcattgatgaaataaaaaataaaactgatatattagatttagttagtgaatatgtaaaacttgaaaaaagaggacgcaattatatcggtttgtgtccttttcatgatgaaaaaacaccctcatttacagtttcagaagataaacaaatttgtcattgttttggatgtaaaaaaggtggtaatgtttttcaatttacgcaagaaattaaagacgtatcatttgttgaagctgtaaaggacttgggtgaacgagttaatattcaagttgatatcgggcagaaccaaacaaattcctcgacaaaaattgcgtctgatgagttgaaaatgattgagatgcatgaactcattaaagattattatcattatgctttaatgaaaacagttgaaggtgaggaagccctaaattatttacatgaacgcggctttacggatgaccttattaaagaaagagaaattggatatgcacctgataactcacatttttgtcatgattttcttgaaaaaaaaggatatgatatagaactagcatttgaagcgggtttgttatctcgtaatgaagagaatttcacatattttgatagatttagaaatagaattatgtttccattaaagaatggacaaggacgaattgttgggtattcaggacggacatatactgatcaagaaccaaaatatttaaatagtccagaaacacctattttccagaagcgtagaattttatataatttaaataaagcacgtaaatttattcgaaagcaagatgaaattattttattagaaggtttcatggatgtaattaaatcagattatgctggtttaaaacaagttgtcgctagtatgggtacacagttatcacaagaacatattacttttttacaaaaactaacgcaaaatgtaacattaatgtttgatggtgattatgctggtaaagaagctactctaaaaactggacaagcactgttgaatcaaggcttaaatgtgtatgtggttcaactaccttcaggtatggatcctgatgactatattagaaaatatgataacgaacaattcttaaaatttgttcaacaagacaaacaatcatttgtgctatttaaagttaaaatgtatcaaaatgagattaatcataatgatcttgcatacgaaaaacattttaaagaaactgtgcgagacctttctttagtcaattcaggtatcattcgtaataaacttattcaaaacatagctgatatatttaaagttaatccagaaaccattcaatatgagttagatgcaacttatcaacatcagatgtcgtcgaacacttatcccacttttcaagatgagccaagcaaacaacaattaatactcggtcgtctgactaaaaatgagaaagcagaaagagctttaattaagcatttaacgaaagataaagatacttttttgaattattatcaaaaaattgtgccagaagactttacaaatagctatttaaagcgtatatttagttatttatacgactattattcaaaaaatgattattatacaattagcgatatgatgcaatatattgaatctaatgaattgagagaagttcttattgaattagatcaatatcatctaaatgatgaaccttatgaaaacgaaatagaggactatattcaaattattaaaaataataataacgaagattccttagaaagtttgaattataaattaagggaagcatcgcgtattggagattcagaattacaaaaatattatttgcaacttatcgttaacaaaaataaaaatcgaatgtaa

SEQ ID NO: 800 - DNA, 630 bp, Staphylococcus epidermidis
attataatgcgaatttcaaatttaacattaggaatagttgatactaatacgtatttcattgagaatgaagaaaatgtaatattaatcgatccctcaagtgaaagtcaaaaaataataaaaaaattaaatcaaatcaataaacctttaaaagcaattttattaacacatgcacactatgatcatatcggagcattagataatattattgaaaaatatcaggttccagtttatatgagtaaagatgagtttgattttttaactgatccagataaaaatggctcatctaaatttacacaatatggtttatctaaaatagaaagtcacgcaaatcccttaagtttatcagaaggtcctgcagagattgaaggatttaaatttaaagtattacatacgccaggtcattcgccaggtagtcttagttttgtttttaatgactttgctgttgttggcgatactctgttcaaaaatggtatcggtcgtacagacctttataagggagattatgaaacattaattgattcaataaaagataaattatttgaattagagggtgatatgccacttttccctggacatgggccttacactacagttgacgatgagcaactcaatccgtttataaatggttaa

SEQ ID NO: 801 - DNA, 852 bp, Staphylococcus epidermidis
tatttcgataggggtatgattatgactgaaatatggaattttataaatactggaagcaaaaatccttattataatatggcaatggacgaagcgttactaaattttgtatcgcgtggagaaatcgatccagttataagattttatacttggaatcctgcaacactctcaataggctactttcagcgtctccaaaaagaaattgatattgataaagtaaaagaaaagggctatggcttagtaagacgtcaaacgggtggtagaggcgtgttacacgataaagaattaacatatagcgttattgttcctgagtctcatccaaatatgccttcaactgtaactgaagcttataaaattatttcacaaggattattagaaggttttaaaaatttaggttttgaaacttatttcgctatcccccgttctaaagaagaacgagacaaattaaagcaaccacgaagttcagtatgttttgatgcacctagttggtatgagcttgtagtagaaggcagaaaaattgcaggtagcgctcaaaccagacaaaaaggtgtcattcttcaacatggttcaattttacaagatatagatatcgatgatttatttgatatgtttaaatttaaaaatgaacgactaaaagcaaaaatgaaagaaaattttgttcaaaaagctgtagctattaatgacatttcaaatcaacatattacattaaatgaaatggagaacgcctttgaggcaggttttaaaaaaggactgaatatagattttaaacctctagaattaacggaaaaacaattagaggaagtacaagaactcgaagataaataccgctctgaagcatggatgtaccgtaaataa

SEQ ID NO: 802 - DNA, 357 bp, Staphylococcus epidermidis
tctagaaccagatataaaagcaatgaaaaacatagtaattcaaaaattgaaaggagcattatgatgttaactggtaagcaaaaaagatatttacgtagtttagctcataacattgatccaactttccaaataggtaaaggtggtattaatgaaaatatgattcaacaaatttctgaaacattagaaaagagagaattaattaagattcatatattacaaaataattttgatgataaaaaagatttagcagcaatagtatctcaacaaacgcaaagtgaattggtacaaataatcgggtcaatgattgtgttatataaagagtctgaagaaaataaagaaatcaaattgccacaatga

SEQ ID NO: 803 - DNA, 447 bp, Staphylococcus epidermidis
aagagtctaagaattaatatgctaaagcataaaattttaggactagatgttggaagtaaaactgttggcattgctataagtgaccttatgggttggactgctcaagggttagacacactccgtatcaacgaagaacaagatgatttaggaattgatcaactcgtgaagattattaaagataatcaagttggaactgttgttattggcttgcccaagaatatgaacaattcaataggttttcggggagaggcttcaataaaatataaagaaaagttacaagagtctatcccttctattgatattgttatgtgggacgaacgtttaagtacaatggctgctgaaagatctttacttgaagcagatgtttcaagacaaaaaagaaaaaaggtaatagataaaatggcagctgtatttattttacaaggctatttagattctattcaataa

SEQ ID NO: 804 - DNA, 822 bp, Staphylococcus epidermidis
aaattaataagttgtatagttatatgcgaggtgaaaaccatgacaacaccagtttttgaattacgaaatttagattattatttcgataataagcatgtattagagaacataaatatcaaaattaatcagggagaatttttagcaattgttggtccgaacggggcaggcaaatctactttactaaaagttatactagggctattgcctatacaaaagggcgagataattgttgatggaaaaccatttaaaggtaataaatcttcattgaaaattagctatgtttctcaaaaagcttctgccttcaatgcaggtttcccagctagtgtaaaggaagttgttttaagtggtctgactaaaacaaaaaaattatttcaaagatttaataaaaatgactatcaaaaagtcacaaaggtattagagagattaaatatatctcatttaataaataaaaatatagctgaactatctggtggtcaacaacaacgtgtacttattgctagagcacttatttcagacccaagtgtgctagtgttagatgaacctacaaacggaattgatgcaaaacatgtaagcaaattttacgatacacttgataaattaaaaaaacaggggattacaataattttagtcactcacgatattggcgttgtagcagataccgctactgaagtagcatgtttaaataaacatcttcatttccacggttccacagaagcatttaagtctttagatgaagttgaaatttcaaaaatttatggtcatcctattcaatttgttgatcatcaacacaaccgaacatgttgtaatgagggaaatgaataa

SEQ ID NO: 805 - DNA, 321 bp, Staphylococcus epidermidis
gaggtgcaaagtatgtttgctataattgaaacaggtggaaaacaaatcaaagtagaagaaggtcaagaaatctacgttgaaaaattaaatgctaacgaaggtgactcattcacttttgataaagttttatttgtaggtggcgactcagttaaagttggtgctccaacagttgaaggtgcatcagtaactgcgacagttaataaacaaggacgcggtaaaaaaattactgtcttcacttacaaacgtcgcaaagactctaaacgtaaaaaaggccatcgtcaaccatatactaaattaacaatcgataaaatcaacgcataa

SEQ ID NO: 806 - DNA, 702 bp, Staphylococcus epidermidis
ggtgtgaaaagatatatgataggaattattggagcaatggaagaagaagtgacgattttaaagcgtaaattgaatgatatgaatgaaataaatattgcgcatgttaaattttatgttggcaagctaaaccacaaagaggtggttttaacacaaagtggtataggtaaagttaatgcttctatctcaacgactttgttaatagaaaaatttaatccagaagtcgtcattaatactggatcagcaggtgcactagatcaaacactatctattggagatatattagtgagtaatcatgtattatatcatgatgctaatgctacagcgtttggttatgaatatggacaaatacctcaaatgcctaaaacttatactactgatcctactttgttgaaaaaaacaatgcatgtattagaacaacaacaactgaatggtaaagtaggtatgattgttagtggtgatagttttataggtagctcagaacagcgacaaaaaattaagcaacaatttccagaagctatggctgtcgaaatggaggcaactgcaattgcgcaaacatgttatcaatttaaagtaccatttatcgtaactagagctgtttctgatttagcaaacggtaaagccgatatttcttttgaagaatttttagataaagcagctttatcatctagtgagacagtttcattattagtagaatcattataa

SEQ ID NO: 807 - DNA, 1080 bp, Staphylococcus epidermidis
aataatttgagcaattcaatattgaaaatcaaaaatgattgttatacttcaattattattaattatggaaaggaagcatcatgtatgaaaaatataaaattatctgcgttaaacttagtacctatacgtgaaggtcaagaagataaagatgcaattaacgatatggttacactcgctcaagcattagatgatttagattatgagcgctactggattgcagagcatcataatgctccaaatttagttagttcagctacttctctattaattcaacatacattagaacatactcattctatcaaagtaggttctggaggcataatgttaccgaatcatgcaccactagtcgtagcagaacaatttgggacattggaaacattattccctcaacgtgtggacttaggattaggacgtgctcctggtacagatatgatgacagcgagcgcattaagaagagatcagcataatggtgtttatcaattccctgaagaagttgaacaactgcaacaatattttggaccgagtcatcaacaagcatatgtacgtgcttatcctgcggtagataaaaatgtcccaatgtatattctaggttcatctacagattctgcacatttagctgcacgtaaagggttaccatatgtttttgcaggacattttgctccacaacaaatgaaggaagcactacaaatttatagagaattatttgaaccttcagaagtacttgataaaccttatgtaattgtttgtttaaatacaattgtgtcagattctgatgaacaagcagaatatttagcaactacgatgtctcaaataatggtaagtataacacgaggaaaaatgcaacctgtccaaccaccaacagatgatttaaaggccctattaacaccacgcgaatatgaattagcacaacaacgtttaaaagggtcacttataggatctgaagatacagttaaacaaaaacttgaatcgttcataaaagagtacggggatatcgatgaacttatggcaattagttatatctatgatcaagacaaacaaatagaatcatatcgaagattagaacgtgcaattaaatcatag

SEQ ID NO: 808 - DNA, 492 bp, Staphylococcus epidermidis
aggaagatgagatttatggaaaaccaaaaacaatatcctatgactcaagaaggttatgagaaacttgaacaagaattagaagaattaaaaacggttaaaagacctgaggtagttgaaaaaataaaagtagctcgttcatttggagacctatctgagaactctgaatatgatgctgctaaagatgaacaaggctttattgaacaagatatacaacgtattgaacatatgattagaaatgcgttaatcattgaagataacggtgataacaatgtagttcaaattggtaaaacagttacttttattgaattacctggagatgaagaagaaagttatcaaatcgttggttctgctgaagctgacgcatttaaaggaaaaatttctaacgaatctccaatggcaaaagcactaatcggtaaaggattaaatgatcaagtacgtgttccacttcctaacggtggcgaaatgaatgttaaaatcgttgaaattaaataa

SEQ ID NO: 809 - DNA, 1851 bp, Staphylococcus epidermidis
ttaaattggaggaattatattatgggtaaagtaattggaattgatttaggtacaactaactcttgtgtttctatcttagaaggagatgaaccaaaagtaattcaaaacccagaaggtgcacgtactacaccatcagtggttgcatttaaaaatggtgaaactcaagtgggtgaagtagcaaaacgacaagctatcacaaaccctaacactgtacaatctattaaacgtcatatgggtacagattataaagtagatattgaaggtaaatcatatacaccacaagaactttcagcaatgattttacaaaatttaaaaagcactgcagaaaactatttaggggatacagtagacaaagctgttatcactgtccctgcttatttcaatgatggtgaacgtcaagcaactaaagatgctggtaaaattgcaggcttagaagttgaacgtattatcaacgaacctacagctgctgcacttgcttatggtttagataaaactgaaacagatcaaaaggttctcgtatttgacttaggtgggggaacatttgacgtatctattctagagttaggcgacggcgtatttgaagtattatcaactgccggagataataaacttggtggcgatgacttcgaccaagtgattattgattatcttgtttcagaattcaagaaagagaatggtgtagatttatcacaagataaaatggcattacaaagattaaaagatgctgccgaaaaagctaaaaaagatttatcaggtgtttctcaaactcaaatttcattaccattcatttctgctggagaaaatggcccattacacttagaaattagtttaactcgttctaaatttgaggaattagctgattcattaatcaaaaaaactatggaaccgactcgtcaagcattaaaagatgctggtttatctacttcagaaatagatgaagttattttagttggtggttcaacacgtattccggccgttcaagaagctgttaaaaaagaaattgggaaagaaccacataaaggtgttaacccagatgaagttgtagcaatgggtgctgctattcaagctggtgtaatcacaggtgatgttaaagatgtagtattacttgatgttacgccattatctttaggtatcgaaattatgggtggacgtatgaacacattaattgaacgtaatactactattccaacttccaaatcacaagtttattctacagcagctgacaatcaaccagcagtagatattcatgtattacaaggtgaacgtccaatggcatctgacaacaaaactttaggaagattccaattaactgacattccacctgcaccacgtggtgtacctcaaatcgaagtaacatttgatatcgataaaaacggtattgttaacgttacagctaaagatttaggtactaataaagaacaaaacattacaatacaatcaagctcatctctatctgatgaagaaatcgatcgcatggtgaaagatgctgaagaaaatgctgaagcagataaaaaacgtcgtgaagaagtagacttgcgaaacgaagcagatagtctagtattccaagttgaaaaaacagttaaagacttaggcgaaaatattagcgatgaagataagaaaaatgctgaagagaaaaaagatgcacttaaaacagcattagaaggtgaagacatcgacgatattaaagctaaaaaagaagaacttgaaaaagtaattcaggaattatctgcaaaagtttatgaacaagctcaacaagcacaacaacaaggccaagaagaacaaggttctcaagatagcactgttgaagatgcagactttaaagaagttaaagatgacgaagataaaaaataa

SEQ ID NO: 810 - DNA, 237 bp, Staphylococcus epidermidis
attaataggagttttgagatgcgcaaattcatcttttatttaatattagcgatagctgcatttggtttaatgatgaatcttgatgagtttttattttcgattatgaaagccattattagttttgcaattatagctttaattatttatattatatactatttcttctttttaacagaagatcaaagaaagtataaaaaagcacttcgtaaatataaaagacaaaaaagaaagcaataa

SEQ ID NO: 811 - DNA, 675 bp, Staphylococcus epidermidis
accgtatatggtagtaattggaattgtattggaggtcagactatgtcagaaaaagatcagtcagtgaataatactgaggaagatttcaatgtagaaactgaagacaatcagaatgatacaaatattgaaaactcagtatctaacacagataatagtgaagctaatgctagcgattcagaaaataattcagaagaaagtatcaaggatgaagagtcagagtctcaagatactaaaattaaagaattagaaaagcttgcaaatgacaatgaagaaaaatatttaagattatatgctgaattcgaaaattataaacgtcgaattcaaaaagaaaatcaaattaatgctacttataaagctcaaggtgttttaactgacattttaccgtctatagataatattgagcgtgcactacaaattgaaggtgatgatgaatcgttcaaatcacttcaaaaaggagtgcagatggttcatgaaagtttactaagagctttaaaagacaatggtcttgaagaaattttagctgaaggtaaggaattcgatcctaatttacatcaagctgtcgttcaagatgacaatcctgattttaaatcaggagaagttactcaagaattacaaaaaggatacaaacttaaggatcgtgttttaagaccatcaatggtaaaagtaaatcaataa

SEQ ID NO: 812 - DNA, 699 bp, Staphylococcus epidermidis
tcaatacatgggctgatttattttgtttttgtaattgttaatgataaaggaagttttaatgatatggattcaaatcaaaaatatttagcacaattacatcaatcaattgatactgaaatcgaagaacttagagtttatgctgaagaaaatcaagttcctattgtagataaattaacacttgatttgataagacaactcattcgaatgaatagaactaaaaatattttagaaattggtacagctattggttatagttcaatgcaattcgctaatatttcgaaagatataaatgtaacaacaattgaacgaaatgaagacatgattcatcttgcaaaaaagttcataaaaaagtatcgataccagaatcaaatccgtttaattgaatacgatgctttgaatgcatttgaacaagtcaatgacaaacaatatgatatgatatttatcgacgcagctaaagcacaatcaatgaaatttttccaactatatacaccgttattaaaaaaaggtggaattgtggttactgataatgttttatatcatggatttgtttcaaatatagacgttgttcgttcgagaaatgtgaaacaaatggttaagaaagtgcaacagtacaatgaatggttgatggagcaatctcaatttacaacaaactttataaatatggatgatggattagcaatatctataaaaggagaatga

SEQ ID NO: 813 - DNA, 1026 bp, Staphylococcus epidermidis
tttcttaatggaggaagtcaaatggataaaagaatggtcgatcaagaatttcataatgaagatactgacttggaattatcactaagaccaacacatttaaagcagtatataggtcaatcctctataaaaagtaatttagaagtctttatcaaggctgccaaacttagacaagagccactcgatcatgtcttgttatttggtcctccaggactaggtaaaacgacgctatcaaatatcattgctaatgagatggaggtaaatattcgtaccatctcaggaccatctttagaaagaccaggtgacttagcagcgatattatctgggttacagccaggtgatgtgttatttatcgatgaaattcatagattaagtagtgttgttgaagaagttctgtatcctgctatggaagattttttcttagacatcatcatcggtaaaggcgatgaagcaagaagtattcgaatagatttgccgccatttacattagttggagcaacgacaagagccggtagtttaacggggccattaagagatcgttttggtgtgcatcttagattagagtattataatgaaaatgatttaaaggaaataatcacgcgaactgcagaggtcttaggaacggacatcgataaggaaagcgccttagaattagctcgtcgttctagaggtacacctaggatagcgaataggttactaaaacgtgtaagagacttccaacaagtaaatgaagacgatcagatatatattgaaacgactaaacgagcattacaattactgcaggtcgaccaacacggtttagattacattgaccataaaatgatgaattgtattattaatcagtacaatggtggtcctgttggattagatacaattgcagtttcaataggtgaagaacgagtgactatagaagatgtatatgaacctttcttaatccaaagaggtttcttggaaaggactccacgtgggagaaaagcaactgctttagcctatgaacactttaatactactaacgaaaagagggaataa

SEQ ID NO: 814 - DNA, 837 bp, Staphylococcus epidermidis
agaataggtggtaagtacatggataatataaagataattgttgcctctgattcaattggtgaaactgcggaactcgttgcaagagcaggcgtttcacaattcaaccctaaacaatgtaagcatgaattccttcgatatccatatatcgaatcatttgaaaatgttgatgaagtgattcaggttgctaaagatacgaatgcaatcattgtttatacattaataaaacccgaaattaaaaagtatatgatatcaaaagtcaatgaacatgcattgaaatctgttgacatcatgggtccactaatggaattgttatcgaattctattgaagaaacaccttattatgaaccaggaatggttcaccgattggacgatgcttattttaaaaagattgatgcaatcgaatttgctgttaaatacgatgacggaaaagatcctaaaggattgccgaaagcagatattgtgttacttggcatttcaagaacatcaaaaacacctttatctcaatatttagcacataaaagctataaagtaatgaatattccaatagtacctgaagtgactccaccagacggtttatttattgttgatccatcaaaatgtattgcgttaaaaattagtgaagaaaaattaaatcgtatacgtaaagagagattaaaacaattaggattaggtgacaaagctagatatgcaactgaagcaagaattcaggaagaattagattactttgaaaagttagtcgataagattggttgtcctgttattgacgtttcagataaagccattgaagaaacagcaaatgatattattcattttatcgaacaaaataaatcgaaatga

SEQ ID NO: 815 - DNA, 891 bp, Staphylococcus epidermidis
atgttaataggatcacatgtttcaatgagtggcaaaaaaatgctgcaagggtcagcagaagaagcacataaatatggtgaatctacatttatgatttatacaggtgcgcctcaaaatacaagacgtaaaaatattgaagatttaaatatcgaaaaaggccagcaggcaatgaaaacatatggcttatcaaatatcgttgtacatgcaccatatatcattaacattgcaaatacaaccaaacctgaagtatttaatttaggagtcgactttctacaaaaagaaatcgaaagaactcaagcgctcggagcgaaagatattgtactgcatcctggagcgcatgtcggagcaggtgtagataaaggaattcaaaaaattattgaaggacttaatgaagtactcacacatgataataatgtaagaatagcacttgaaactatggcgggtaaaggaacagaagtagggagatcttttgaagaaattgctcaaataattgatggtgttacacataatgatcgcttatcagtatgttttgatacgtgccacactcatgatgccggttataacgtcaaagaagatttcgatggtgtactagaaaaattcgacagcataattggagtagatcgaattaaagtagtacatgttaatgacagtaaaaacctaagaggtgcacagaaggatcgtcacgaaaatatcggctttggtcatattggctttgatgcacttaattacgtagtacatcatgatacttttaaaaatattcccaaaatattagaaactccatatgttggtgaagataaaaaaaataaaaaaccaccgtataaattagaaatagacatgttaaaatcacaaaaatttgatccagaactcaaaaacaaaattttaactcaataa

SEQ ID NO: 816 - DNA, 1368 bp, Staphylococcus epidermidis
acatttaaaggagaacaaattatgtcaaaacatccatttgaacactttaatttagatgagaatttaattgaagctgttaaaaatctcaattttgaaaaaccgactgaaatccaaaatagaatcataccgagaattcttaaaggaacaaatttaataggacaatctcaaactggaactggaaagtcacacgcttttcttttaccattaattcaacttatagaaagtgacattcaagagccacaagccatcgtagtagctccaacacgtgaacttgctcagcaactatatcaagttgctatgcatttagtaaaattcaaaaaaggtataaatgtaaaacttttcattggtggtaccgatttagaaaaagataaacaacgatgtagccatcaaccacaactcattattggtacaccaacaagaattaatgatttagcacattcaggttatcttcatgcacatttagcgtcatatttaattatagatgaagctgatttaatgattgacctcggtctcattgaagatgttgaccatattgcagcgagattagatgatgaaaatgctcatctagcggtatttagtgcaacaatacctaaatcattacaaccatttttaaataaatatttaagtcaaccagaatttgtagaagttgatggcaaagctcataataaagaaaatatcgaattttatctaattcctacaaaaggttctgctaaggtagataaaacattggaattgatagatatattgaatccttatctatgtattattttctgtaacagtcgtgaaaatgccgatgaattggcagacactttaaataaagaaggaattaaaataggtatgattcatggtggtttaacaccaagagaacgtaaacaacaaatgaaaagaataagaaatttagattttcaatttgtcattgcaagcgatcttgcttctagaggaatagatattgaaggcgtaagtcatgttattaatttcgatgtacccaatgatatcgatttcttcacacatcgcgtaggtcgaacaggaagaggtaattataaaggtgtagccattacattatatagtcctgatgaagaaagtaatattactcttattgaagacagaggttataaatttgaaaatgtagatattaagaatggtgaattaaaaccgataaaggcatacaatatgcgtaaatcaagacagcgcaaagatgaccatttaacaaatgaagttaaacacaaagtaagaagtaaatcaaaacgtaaagttaaaccaggctataaaaagaagtttaaacaagaagttgaaaaaatgaaacgtcaagaaagaaagcagtatagtaaaaagcaaaatagacaaaaacgaaaaaataataaaggatag

SEQ ID NO: 817 - DNA, 537 bp, Staphylococcus epidermidis
ctttcaggaggaaaaacaatggatttaaaacaatatgtttcagaagtaaaagattggccttcagcaggtgtaagctttaaggatataacaactataatggataatggtgaagcttatggatatgctacggatcaaattgttgaatacgcaaaggaaaaaaatatagatatagtagttggtcctgaagccagaggattcataatagggtgtccagttgcttactcaatgggtattggatttgctccagtacgtaaagaaggaaaactacctcgagaagttattcgttatgaatataatttagaatatggaactaacgtattaactatgcataaagacgcgattaaaccaggacaacgagttttaatcactgatgatttactagctacaggtggaactattgaagctgcaataaagcttgttgaacaattaggtggtatagttgtaggtattgcttttattattgaacttaaatatttgaatggaattgataaaataaaagattatgatgtgatgagtttgatttcatatgatgaataa

SEQ ID NO: 818 - DNA, 2211 bp, Staphylococcus epidermidis
attgagtggggtgtcattaaagtgaataacgagtatccatatagcgcggatgaggtgctttataaagctaaatcatatttatcaacaagtgaatatgaatatgttctcaaaagttatcatatagcttatgaggcacataagggtcaatttagaaaaaatggcttaccttatattatgcatcctattcaagttgcagggattttaacagagatgcgtttagatggacccactattgtcgctggatttctacatgatgtgattgaagatacttcttatacatttgaagatgttaaagatatgtttaatgaagaaattgcacgaatagtagacggagtaactaaacttaaaaaggttaagtatcgctctaaggaagaacaacaagcagaaaatcatcgtaaactatttattgctattgctaaagatgtacgcgtaattttagtgaagttagcagatcggcttcataatatgagaactttaaaggcaatgccaagagagaagcaggtaagaatctctaaggaaaccttagaaatctatgctcctttagcacatcgtctcggaatcaacacgataaagtgggaacttgaagatacagcgctgagatatattgacagtgtgcaatatttccgcatcgttaatcttatgaagaaaaaacgtagtgaacgcgaagcttacattacaaatgcaatcaataaaattaaaaacgaaatgactaaaatgaatctttcgggcgaaattaacggtagaccaaaacatatttacagtatataccgcaaaatgataaaacaaaaaaagcaattcgatcaaatatttgatttgcttgctatacgtattatagttaattcgataaatgattgttatgcgacacttggtttagttcatacattatggaaaccgatgcctggacgttttaaagattatatagctatgcctaagcaaaatatgtatcaatcactacataccactgtagttggacccaatggcgatcctttagaaatacaaattagaacgcacgaaatgcatgaaatcgctgaacatggtgttgctgcacattgggcttataaagaaggtaagacagttaatcaaaaaacacaggattttcaaaataagcttaattggttaaaagaacttgctgaaaccgaccatacttctgcagatgcgcaagaatttatggaatccttaaaatatgatttacagagcgataaggtatatgcatttactccagctagtgatgttatagagttaccttatggtgcagtaccaattgattttgcttatgcaatacacagtgaagtaggaaataaaatgattggtgctaaggttaatggtaaaatcgtacctatagattatgttctacaaactggtgatattatagagattcgtacaagtaaacattcttacggtccaagtagagactggttgaaaattgtaaaatcttctagtgccaaaagtaaaatcaaaagtttctttaaaaaacaagatcgtttttctaatattgaaaaaggtaaatttatggtagaagcggagattaaagaacaaggattccgtgttgaagatattctaactgagaaaaatttagaagtcgttaatgaaaaatatcattttgctaatgatgaagatttgtacgcagctgttggattcggtggtgttacatcaatacaaatcgtcaataaattaactgaacgacaaagaatattagataaacaaaaggcattaaatgaggcgcaggaagttacaaaatctgtacctataaaaaaagatattaccacagacagtggtgtatatgttgagggattagaaaacgtcttaatcaagttatcaaaatgttgtaatcctataccaggtgatgatattgttggttatatcactaaaggacacgggattaaagttcatcgtacagattgtccaaatataaaaaatgagacagatcgattgatttcggtagagtgggtaaaatctaaagattcaacacaacaatatcaagttgatttagaagttactgcatatgatagaaatggcttgcttaatgaagtattacaagctgtaaattctactgctggaagcttgattaaagtatctgggcgttcagacattgataaaaatgcagtaattaatattagtgtgatggtaaaaaatgtcaatgatgtgtaccgtgtcgttgaaaaaattaaacaactaggtgacgtttatacagtatctagagtttggaactag

SEQ ID NO: 819 - DNA, 207 bp, Staphylococcus epidermidis
catgtgtttatttacttttcaacccgcggttccacccaaattagtgtaaacactcgcttttataaaaatttaatcatatgccaaaatatatttgttaagctcacaccatccttaactcgcttattaataattctaattgaaataatttttaatagcaagtgtttatatgtatttgtagcaattgaaaataaaagttataatgagtaa

SEQ ID NO: 820 - DNA, 501 bp, Staphylococcus epidermidis
gtgacgtttatacagtatctagagtttggaactagaggtgcaaaagatatgaagataattgtacaaagagttaaaaatgctagagttacgaatgatacaattgataaccaaattaataaaggctattgtttacttgtaggagtaggtcaaaattctactgaagaggatgtaaaagtcatcgcaagaaagattgctcatgcacgtctctttgaagatgaaaatgacaaattgaatttaaatattcaacaagttgaaggagaaattctttcagtttcccaatttactatatacgctgatgttaaaaaggggaatagacctggattctcaaattctaaagctccagaacaagctaaagacttatatcaaaaatttaataaagaattagaaggttatggcttaattgtcaaaacaggtgagtttggaacacatatgaatgttgaaattaataacgatggacctgtcacattgatttatgaatcgcaggatgggaaaataatatga

SEQ ID NO: 821 - DNA, 465 bp, Staphylococcus epidermidis
aattccattatcagaagtaagtttttcgatttctttgatcaacttaaatctaacacaaaagggtatgcttcttttgattatgaatttattgagaataaagaaagtaatcttgttaaaatggacatattactgaatggagataaagttgatgctctaagttttattgtccatagagattttgcatatgaaagagggaaagcgcttgtcgaaaaattaaaaacattaattccacgacaacaatttgaagtgccagttcaggcggctattggtcaaaaaattgttgcacgaacaaacattaaatctatgggcaaaaatgttttatctaaatgttatggtggagatatcagtcgtaaacgaaaacttttagaaaaacaaaaagcaggtaaagctaaaatgaaagcagtaggcaatgtagaaattccgcaagatgcatttttagcagtattaaaaatggacgatgaataa

SEQ ID NO: 822 - DNA, 1371 bp, Staphylococcus epidermidis
aaaagaattattggggtgaagattatgtcaacagttgcgtttcacacattaggttgtaaagtaaaccattacgaaactgaagcaatttggcaattatttaaagatgcaaattatgaaagagtagaatttgaaacaaatgctgatgtatttgttattaatacatgtacggtgacaaatacaggggataaaaaaagtcgtcagataataagaagagctattagacaaaatcctgatgcagtcgtttgtgtaactgggtgttacgcacaaacatcatctgccgaaattatggaaatccctggtgttgacatcgttgtaggtactcaagaccgacataaattgttagactatatacaacaatttcaggacgagagacaacctattaatggtgtaggcaatatcatgaaaaatagaacttatgaagaattagaagttccttactttactgatagaacacgtgcttcattaaaaatacaggaaggctgcaataatttttgcacgttctgtattatcccgtgggcacgtggattgatgcgttctagagatccagaaaaagtagtagaacaagctactcaacttgttaactctggttataaggagattgtattaacaggtattcacactggtggttatgggcaagaccttaaaaattataatctagcacaattgctaagagatttagatactattgaagggcttgaacgtatacgtatttcttctattgaagcaagtcaacttactgatgaagttattgatgtcattggaaactcaaataaggtggtacgtcatttacatataccgctacaatctgggtctgatgatgtgttaaaacgtatgagacgtaaatataccatggcacatttttcagaaagattgacaaaattacatcaagcattacctgatttagcagttactagtgatgtaatcgttggtttccctggagaatctgaagatgaattccaagaaacttacgatttcatcgtaaatcatcatttttcagagttacacgtattcccttattctcctagaataggaacgcctgctgcaagaatggacaatcaaattgatgaagaaacaaaaaatgttcgtgtacacaaacttattagtctaagtaatcaattagccaaagaatatgcttctaaatttgaagatgaagttttagaagttatacctgaagaaatgggtgaagaaccacatacacttgttggctatgctgacaattatatgaaggtaagatttgaaggagatgactcattaataggtcaaatagtaaaggtcaagatagttaaagccaattatccaattaatgaaggcaaagcaatacgtgttgttaaacatgcaacgaatcaatctgaaaaagaagtacttgtttaa

SEQ ID NO: 823 - DNA, 468 bp, Staphylococcus epidermidis
atgtttactatagattttagtgaccatacaggtctagtagaaacgtcttggtttgaccaaatagatcaattattaacattcgctaagaagaaagaaaatattcataatgatgccgaattgtcagtaacttttgtagataaagatgaaattcaaaatataaataaagtatatcgcgacaaagataaagttactgatgtcatctcatttgctctagaagaagatgaaccagaaatagatttcaatgactttgatataccacgtgttctaggtgatattattatatgtacagatgttgccaaagaacaatcagaaagctacggacactcatttgagcgtgaattaggatttttagcattacatggctttttacatttgctaggatatgatcatatgaatgataatgatgaaaaagaaatgtttggtcgacaagatgctatactaaacgaatttggtctaactagaaattaa

SEQ ID NO: 824 - DNA, 240 bp, Staphylococcus epidermidis
tgcaaaactatacaagggacgattcaccgtgttgccaccctatttgattatactgataaaagcataatccactcaaaacgcttaacgtgcgctatccgacttttaattaaaagtacctcttcttgcgttcaaatttttaaattactaagtacaatcttacagccaaggattgtatttctacgcattaaatgctacctacttcatttaaaatttcaagaatcatatcggttttatttataa

SEQ ID NO: 825 - DNA, 987 bp, Staphylococcus epidermidis
gaggtgatttttttgaaaattttatttgaacagattatcaatcatgcaattaagcaagaagcaagtgacatacactttataccatgtgaggaacacactataattaagctaagaattaaagatgagctcacaatatatgatagactttcatttccaatttataaaaaattacttatatacatgaagtttcaatctggcttagatgtatcaacacagcatagagcacaaagtggtagatatagttataagatgaagcatttatattatttaagaatctctacattacctttatcattaggcaatgaaagttgtgtaattcgtatagtacctcaatacttccaaactacacgagaatcatatgaatttaaagattttaaacactttatgaaaaagaaacaaggtctacttttgtttagtggaccaactggctctggcaaaagtactttaatgtaccaaatggtcctttatgcacatcaaaaattgaatttaaatgtaatatcagttgaagatccagttgagcaaatacttaatggaatcacacaaatatcagtcaatgaaaaggcaggtataaattatgaaagctctttcaaagccattttaaggtgtgatccagatgtaattttaattggtgaaatcagagattctaccgtagctaaatacgtgattcaagccagtttaagcgggcatttagttttgtcgacaatgcacgcgaatgattgcaagggagcactattacgattattagaaatgggtatttctgtccaagagttgtgccaggcaatcaatttaatttctaatcaaagattaatcactactactacaaattatcgtcaactagtatcggaattaatgtttcaaagccaaataaattatttttttgaacataatcattctttacctaaaaatttcacaaaattagctacacatttaaacaaaatgtctaaagaaggtgttatatgtgaagaagttgtcgataaatacatttaa

SEQ ID NO: 826 - DNA, 300 bp, Staphylococcus epidermidis
gtgaggtgtatcccgatgttaaaattaaacttacaattcttcgcatctaaaaaaggggtaagttctacaaaaaacggacgtgactctgagtctaaacgtttaggtgcaaaacgtgctgatggtcaatatgtatcaggtggttctatcctttatcgccaacgtggtactaaaatctaccctggtgaaaatgtaggtcgtggtggcgatgatacattattcgctaaaatcgacggcgttgttaagtttgaacgcaaaggtcgcgacaaaaagcaagtttctgtatacgcagttgctgaataa

SEQ ID NO: 827 - DNA, 744 bp, Staphylococcus epidermidis
ttccttagtatttttaaaaggagggattttgttttgaggacacaatttattaatgaacaaacaatgatgatttactttgaaaatgaaattagtgaatcaactttcaaaaaggtacaacaaacaattcaatatataaaatcgaaaaatttatctgaaataacaaacatgataccttcatatcgtgctattctaatttactttgataattcggggataaacggaactgaattattagaaaatttagaactcgatgaaaattcgaacagtagaaaacaatcacattttaaacagcgtatcattcatatacctgtattatatggtggagattttggtccagatttatcagaagtagctaacgttaataaattaagtcaggaagaagttattcaaatacatacacaacaaccttatctaatctatatgcttgggtttatgccgggtttcccatacttaggtggattggatgctaagttgcacacacctagacggtctgaacctagaatcaaaattaacgctggttctgttggaatagcaaataatcaaacaggtttatatcctatggactcacctggtggttggcagataattggtcgcacaccaataaaagtctttgatttaaataggacaccaatgacgttatatgaagctggtgattacatacaattttatagtataaattatcaagagtttgaaaaaatatcaaacgatattaataaaggaaaatttgatatagataagtggtga

SEQ ID NO: 828 - DNA, 1302 bp, Staphylococcus epidermidis
acaaacagtatattaaggaggcttatcattaaaatgaaaactttagaagaagttaaatccaaaacccaaaagataatgaaaaagcctgaactacttgcaccagctggtaacttagagaaacttaagattgctgttcattatggtgcagatgcagtgtttttaggtggccaagaatatggattacgttctaatgctgataattttactatggaagaaattgctgaaggtgtagactttgctaatcgttatggcgctaaaatttatgttacaacgaatattattgcacatgatgaaaatatggagggactagaagagtacttacaaaaccttgaatctacaggtgctactggtatcatagtagcggatcctcttatcatagaaacttgtaaaaaagttgcgcccagattagaaattcatttatcaacacaacaatcactttcaaattataaagctgttgaattttggaaacaagaaggattagaccgtgttgtacttgcacgtgaaactggtgcaatggaaatgagtgaaatgaaagaaaaagttgatattgaaatagaagcgtttatacatggcgcaatgtgtatcgcatattctggtcgttgtactttaagtaatcatatgacagctcgagattctaatcgaggtggttgttgtcagagttgtcgttgggactatgatttacttgaagttgatagtgatggagaattagatttatattacgacaatagtgatgttactccttttgcaatgagtcctaaagatttaaaattaatagaatctatacctcaaatgatggaattaggcatcgattcgttaaaaattgagggacgaatgaaatctatacattatattgccacagttgtttctgtatatcgtaaagtcattgatgcatatgccgaggaccccgaaaactttaaaataaaaacggaatggttaatggaattaaataaatgtgccaatcgtgacacagcaccagctttctttcaaggtacacctggttatgaagagcaaatgtttggtgaagaacagtctaaaaaatcatcttatgatttttgtggcctcgtgctagattatgaccatgaaacacaattagcaacaatacagcagagaaatcattttaaaccaggacaagaaattgagttctttggtccagaaattgatagttttaaacaagttgttgaagcgatttacgacgaagaaggtaattctttagatgcagcacgtcatccattacaaattgtacaaattaaagtagataagcctatttattctaacaacatgatgagaaaggaaattggctaa

SEQ ID NO: 829 - DNA, 288 bp, Staphylococcus epidermidis
actaagattttttcatcgttagatttcttctctttgtgtactactaatttattattttttgtctttttaaactgtcgtttcttaagcatgccccataatggtacagcaatgaaaattgacgagaatacaccagataataatccaattagtaatgctaaagagaaattaaatattgttggtgcacctaatattaatattgcaactacaactacaactacagtcaacactgtattaatagaacgtgtcatagtttgtctaatagagcggttgactatatcatcaatttga

SEQ ID NO: 830 - DNA, 1131 bp, Staphylococcus epidermidis
ggaggaatcatagtgtctaacaaagatatacgcgtagttgtgggcatgtctggtggagtggatagctctgttactgcatacttgttaaaagaacaaggttatgatgtaataggtatatttatgaaaaattgggacgatactgatgaaaatggggtgtgtacagccactgaggattataatgacgtgattgcagtatgtaatcaaattggcatcccatactacgctgttaattttgaagaacagtattgggataaagtatttacttattttcttgatgaatataaaaaaggtcgtacacctaaccctgatgtgatgtgtaataaagaaattaaatttaaagcatttttagaacatgctttaaaattaggcgctgattatgtcgctacaggtcattatgctcgtatacgtcgtcatgatgatgggcatgttgaaatgctaagaggtgttgacaataataaagaccaaacctactttttaaatcaattatcccaagaacaactatccaaagtcatgttcccaattggagatattgaaaaaagtgaagtaagacgtattgcagaagagcaaaatttagctactgccaagaaaaaagactcaacaggtatttgttttattggtgaaagaaactttaaagaatttttatcacattacctaccagctcaatctggtgaaatgttgacattaaatggaaaaaaaatgggacagcatagtggattgatgtattatacaattggtcaacgtcacggcttaggcatcggtggagatggagatccatggtttgttgtaggtaaaaatttaaatgataacgtattatatgttgaacagggatttcaccatgatgcactttatagtgattatctcatagcttctgattattcatttgttaatccaagtgaaattgatttggaaaaaggttttgaatgtacagctaaattccgttatcgccaaaaagatactaaagtttatgttcaacgcgaaaacgagaattctattagagtaacttttgctgaaccagttagagcgattacacctggtcaagcagttgtcttctataatcaagaagtatgtttaggtggcgctacaattgatgatgtttataaaaacgaaggtcaattaagttacgttgtataa

SEQ ID NO: 831 - DNA, 939 bp, Staphylococcus epidermidis
attattaccattaggattttctggaaaggatttaaattaatgacagaacataaatcaggatttgtttcaattatcggtagacctaatgtaggtaaatctacctttgtaaacagagtaataggacataaaattgctattatgtcagataaagctcagacgactagaaataaaatacaaggtgtgatgacaagagatgatgctcaaatcatctttatcgatacacctggtatccataagcctaaacataaattgggagattacatgatgagagtagctaaaaacacactttctgaaattgatgctattatgtttatggttaatgtaaatgaagatataggtagaggagacgagtatataatggaaatgctaaaaaacgtcaaaacacctatatttttagttttaaataaaattgatttggttcatccagatacaatgatgccaaaaattgaacaatatcagtcatatatggattttacagacataattccaatttctgctttagaagggttgaatgttgatcattttattgatgtattaaaatcttttttaccagaagggcctaaatattatcctgacaatcaaatttcagaccatcctgagcaatttgtggtgagtgaaatcattagagaaaaaattctacatttgactagtgaagaaattccacatgcaattggtgtcaatgtcgatcgtatgattaaagaggatgaagatagagtacgtattgaggcgacaatttatgttgaaagagattcacaaaaaggtatagtaataggtaaaggtggtaaaaagcttaaagaaatgggtaaacgtgcacgtagagatatcgagatgttacttggctcgaaagtttatcttgaattatgggtgaaagtacaacgtgattggagaaataaggttaattttataagacaaattggatatgttgaagatcaagattaa

SEQ ID NO: 832 - DNA, 207 bp, Staphylococcus epidermidis
tctttatacataaggcacctcgttaattttgtttattggtatttattaaattatgtgaaaggtccttatttttcaaagtattttaatgtaaaattacatataaactcaaagtattttggcgagactcttgagggaacaggacaagctgaagactacaggctgaagctgtcccctaagaaagcgagccaacaaaacgaagtattgtaa

SEQ ID NO: 833 - DNA, 489 bp, Staphylococcus epidermidis
ggtgaaaacatgattacaaaaagacaattaagcatccttaatgctattgttgaagattatgttgattttggacaaccgattggatctaaaactctaattcatcgtcatcacttggatgtgagtccagctaccattagaaatgaaatgaagcaacttgaagaaatgcatttcattgagaagacacacacatcttctggaagggtgccatctgaatcagggattagatattatgtcaatcgccttttagaacaaacatctcatcaaagtcaaaacaaaattcaacgtttaaatcaattattaattgagaatcattatgatagttcgactgcactcacaaactttgcacacgaattatgtatgaaatctcaatatgcaacgttggtagtccgccctaatcataaacaagatgttataaatgatatacatcttattcgtgctaacaaccatttgattattttagtaatggtattttccttctggacatgttga

SEQ ID NO: 834 - DNA, 633 bp, Staphylococcus epidermidis
aatgatagcataactagtaataataataatagtttttggtttagggagaagacaatgaaaaagttaatattaatagttggtgcgagcagtttgcttatgggttgtggaagtcagaacttagctcctttagaagataaaacgactgagttacgtgatgataatcatcaattaaaacttgatattcaagaacttaatcaagaaattggcgaacataaatctaaaatagccgcccttaaacaagataaagaaaatactaaagaggcttcatctaataagttaaaaataaaaaatttaaaagcatcatctgattattacgactctattgcaaaaaccattaaagattatagagatattgaatcaaaagttaataaaaataataataaagtagcgattcaaagaaaattagatgacattttaaatgatattgacggtactttcattaaatataaagaatctgtagactctgaatcacaatctgaagaagataagaaaaaagaaaaagaaatacgtcaacttaataaagacttatcttcagcattcaatacaataaaaaaaggatatgaaacgaaagataataaaaaaatagaaaaaggtcaaaaaaaacttgcaacaataaatacaaatttaaattaa

SEQ ID NO: 835 - DNA, 1116 bp, Staphylococcus epidermidis
aaattattaattgggggtacacgtatgacaacagatttgaaaaaaacacctttatatcaaaattacgttgatagtggtgctaaaattgttgagttcggaggatgggcaatgcctgttcaattctcaagtatcaaagaagaacataatgcagttagatttaatgttgttctttttgaagtaagtcatatgggagagatagaaattagtggtaaagatgcagaacaattcatacaatacatcctttctaatgatacaaatcttctaacaaatgataaagcaatgtatagtgcgttatgtaatgatgaggggggcatcattgatgatttagttacatataaacttaatgaaaaccactacttgcttattgtaaatgcagccaataccaataaagattatcaatggattaagaaacatagctctaattttactgtagatgtgagcaatacttcagacaaatacggccaattagctattcaaggtcctcattcaagagcattaataaatgaattagtggatatagatgtaagccatatggcaatgtttgaattcaaacagaacgtacaaatctttggtaaatctattattctttcgcagtctggttatactggagaagatggctttgaaatttactgtaagcaagaagatactaaggatatatgggagcaattattagaatacgatgttacaccatgcggtttaggtgctcgtgatacgctaagacttgaagcaggattacctttacatggtcaagatttatctgaatcaattactccttatgaaggagggatagccttcgctgctaaaccgttaattgaaaatcattttattggcaaatccgtactcaaagctcaaaaagaaaatggttccgagcgtagaacagtaggtcttgaactattaggtaaaggcattgctagaacaggttatgacgtactagatgaaaatagtaatgaaattggtttcgttacatcaggaacacaatccccatcttctggtaaatctatagcacttgcaataatagatagagatgcatttgaaatgggcaaaaaagtaattgtgcaaatacgtaagcgtcaagttgaggcaaaaatagttaaaaaaaatcaaattgagaaataa

SEQ ID NO: 836 - DNA, 210 bp, Staphylococcus epidermidis
gtaaatctaatgacacgaaaaattaaaagtttttatgacgtgttacaattacttaaaacatatggtttcattatatattttaaaaatccagatgatatgtatgaaatgatgatacaagagattaaatccttatatagttatcaattgttaacgaaggatgaatatctaaattgtatactgataattaatcaaagaaggaatgaaaagtaa

SEQ ID NO: 837 - DNA, 432 bp, Staphylococcus epidermidis
ggttatacaatgaaaatatcaacaaaagggagatacggattaacattgatgatatctcttgctaaaagagagggtcaaggttgtgtatcactaaaaacaattgctgaagaaaataaactaagtgatttatatcttgaacaattagtaggccctttaagaaatgctggattaattcgaagcgttcgaggtgctaaaggtggttatcaacttagagttccatcagaagaaattactgcaggagatattatccgattactagaaggaccgattacgtttgtagaaagtattgattcagaaccgcctgcacaaaagcaactatggattagaatgagagatgctgtaagagatgttttagatcatactacattaaaatatcttgcagattacaaagatacgaatgaagacttagagggttatatgttctatatttaa

SEQ ID NO: 838 - DNA, 330 bp, Staphylococcus epidermidis
ataatggcaattgttgatgtagtagttattccagtaggaacagagggacctagtgtaagtaaatatatagctgaaatccaaacaaagttaaatgaatttaaacaacaagggaaaattgattatcaattgacaccaatgaatacattaatcgaaggtgatttgaaagacctttttgaggtgattcaagcgattcatgaattaccttttgataaagggttagatagggtttgtacaaatattagaattgatgatcgtcgagataaatcaagaaaaatgaatgataaattaaaatcagtacaaaaacatctagaccatagtggtgaattataa

SEQ ID NO: 839 - DNA, 939 bp, Staphylococcus epidermidis
ataattcaaattgacgatattaatcaatctcaagctttaataggaaataacgatgaaaacctaaaagcgattgaagcacattttaatgtcgtaatacatgctagaggtcaagaaattgctgttaaaggtgaaaaaatagagcatgttgaaaaagcagaattagttctaaagaatttacttaaagtaattgaattaggtaatacaattacgcttaaagatgtagaagctgctataaaaatggccgacaataatacaattcatcatttattagatttatacgatgaagaaattacaaaagatgcttatggtaaaacaattcgtgctaagactatgggacaacgtatatatattaatgctatgaaacgtaatgatttagtatttggcattggtccagctggaactggtaaaacctttttagcagtcgtatatgcggctaaacaactacgtaaaggatctgttaagcgtattgttctaacgagacctgctgttgaagcaggtgaatctctaggatttctaccaggcgatttaaaagaaaaagtagatccatatttaagacctctttacgatgggttaaatactgttttaggtagagagcaaactcaaagactcatcgaacgaggtgtaatagaaattgcgccattagcatatatgagaggtagaaccctagatgatgcatttgttatattagatgaagctcaaaatacgacacatgcacaaatgaaaatgtttcttacccgcttaggatttggatcaaaaatggttgtcactggtgatcaaactcaaatcgatttaccaaaaggtgtaaaaagtggtttgaaagaagcggtaaaaaaactaagtggtgtcagcggcataagtatcatgaaaatggatcaaagtgatgtagttagacatccacttgtaagtaaaattattaatcgttatgaaggagttgaataa

SEQ ID NO: 840 - DNA, 594 bp, Staphylococcus epidermidis
  unsure (298): Identity of nucleotide at the above locations are unknown.
agaaatcaaattgccacaatgaataaaaaaatcgttctctttggcggtcaatttaacccgattcacactgctcacttagcagtagcaagtgaggtttatcatgctattaaaccagatatatttttctttttgcctagttatatggctcctttaaagcatcataatacacaattatattctgaacatcgagtgaaaatgatacagctcgttattaaggagattggatttggtgaaatttgcagtactgatttagatagaaaaggtccaagctatatgtatgaaaccattttgcatctcnaagaaatatatcataatgcacagttatactttattattggaacagatcagtataatcaattggataagtggtataaaattaatgaattaaaaaaacttgtaacctttattgtagtgaatagagaaactgataaccaaaatgtaagtaaagagatgatttctataaagatacctcgaatagatataagctcaacaatgattagaaatagagtgagaatgaaccaatctataaaagttttagtacctaaaagggtagagaattatattaaagaggaggggttttatggagataagtag

SEQ ID NO: 841 - DNA, 1104 bp, Staphylococcus epidermidis
ttaatgaaaattagtgaactgatggaagttttaaataatcacgttccatttcatcaagctgaatcatgggataatgtaggattattaattggtaatgataagttagatattacaggtattctgacaacactcgactgcaccgatgatgttgttaaccaagcaattgaacttaataccaataccatcattgctcatcatccacttattttcaaaggagtaaaacgtatcgttgaagatggatatggtagtataattcgtaaacttatccaaaataatatcaatcttatagcattacacactaatcttgatgtaaatcctaaaggtgtcaatcgaatgttagcggatcaaataggtttagagaacatatcaatgattaatacaaatagctcatattattacaaagttcaaacttttatacctaaaaattatattgaagatttcaaagacagtttaaacgaacttggattagctaaagaaggtaattacgaatattgtttctttgaaagtgaaggtaaagggcaatttggaccagtaggtgatgcaagtccttatatagggaagttagatagtatcgaatatgttgatgagataaaacttgagtttatgataaaagacaatgaattagaaataactaaacgtgctattttagataatcacccatacgaaacaccagtttttgattttattaaaatgaacaaagaaagtgagtatggattagggattattggacaattaaaccaaactatgactttagatgaattttctgaatatgccaaaaaacagctcaatataccgagcgtacgatatacaggtcaacatgatagtccaattaagaaagtagctatcataggtggttcaggtataggatttgagtataaagctagccaacttggagcagatgtttttgttactggtgatattaaacaccatgatgctttagatgctaaaatccaaaatgtaaatttattagacatcaatcattatagtgagtatgttatgaaagaaggattaaaagaattattagaaaaatggttatttaaatatgaaaatcaatttccaatatatgcttctgaaatcaacacagatccatttaaatataaataa

SEQ ID NO: 842 - DNA, 1101 bp, Staphylococcus epidermidis
ttgaatgaaatactaaaatgtattggatgtggtgcacccctacagtcagaaaataaagacgcacccggctatgttccagaacataatatgtttcgagaagatgtcatctgtagaagatgttttagattgaaaaattataatgaagttcaagatgtgggtatggaaagtgaagattttttaaatctacttactggactatctgaaaaaaaaggaattattgtcaatgtagtagatgtgtttgattttgaagggtcattcatcaatgcaatacaacggattgttggtaataaaaaaattatattagtggcaaataaaatagatttattacctaaacaaattaatcatcgacgtgtaaaagaatggttgagaaaatctgctcgtaaatatggattagaagcagaagatgtcgttcttatttctgcaaataaaggttgggggattgatgaattattgcaatctataaaccatgtaagaaataaagatgacgtatacattgtaggtacaacgaatgttggaaaatctacattaattaataaattaattgaacagagtgtgggagaaaaagatgtagtaactacatcacgctttccaggaacaactttagatatgatagatattccattagacgaaaaatcatttatgtttgatacaccaggtatcattcaatcacatcaaatgacaaattatgtatctgaaaatgagttgaaaatcattatacctaaaaatgaaataaagcaacgtgtgtatcaacttaatgaaaaacagacattatttttcggaggattggcacgcattgattatgtatctggtggtaaaagaccacttgtttgtttcttttcaaatgatttaaatattcatagaactaaaaccgagaaagctaatgatttatggaaatcccaattaggcgcattgctttcaccgcctcaagatgcacaacaatttaatcttaatgatgtaaaagcagtaagactggaaactggtaaaactaaacgtgacatcatgatatctggtttaggattcataactattgatgctggtgcaaaagtgatagttcgtgttccaaaacatgtagatgttattttaagaaattcaattctttaa

SEQ ID NO: 843 - DNA, 768 bp, Staphylococcus epidermidis
agaggtgaaatgaagttgaaaattgatttaaattgtgatttaggagaagcttttggtaactatacattcggtggagatcagcacattttaccattaataacttctgctaatattgcttgtggttatcatgcaggtgatgaagatgttatgaatgaaactgttcaattagcgaaaaaaaataatataagtattggagcacatccgggtcttcctgatttgaaaggctttggtcgtcgtaaaatggatcttactccaaatgaaatttataacttagttatatatcaattaggtgcgttaagtggcttttgtaaaatcaatcatgtaaaaatgatgcatgttaaacctcatggtgccctttatcaaatgggggctagaaataaagaaattgcacatgcaattgctcaagcagtttttgatttcgactcaaatctaattttcgtcggcttagcgaatacattacttatttcggaagctgaattagtggggcttaaggtagcttcggaagtatttgctgaccgtcgttatgaagatgacggacaattggtaagtagaaaaaaaaccgatgccactatcactaatactgacgaagcaatccaacaagcattaaaaatggttttggaaaataaagttgtaagtaaaaatggaaaaatcatcgatttgaaagctgatacaatttgtgttcacggagatggaaaacacgcattagaatttgttacgcaaattagaaatgaattaatgaaagaaggcattgatattcaatccttatag

SEQ ID NO: 844 - DNA, 2298 bp, Staphylococcus epidermidis
cctgtggaaatgaggacgattataatgattaaatcaaaatataattgggatataactcaaccgaatacctttataagtgagagtagcagtgatcaatttaaactttcacctatagtaaaaaaggtattagagagtaaaaatattgtggataatcaggagattcaaaatctatttgaaggcactaacattagtcatgattatatgttattaagtgatatgcaaaaagccattgatcgtattaaattagctatcgatcaaaatgaacgaatactagtatatggtgactatgatgcagatggtgttacatctactacaattctagtgtctactttacgtctacttggcgctcaggtggggtggtatattcccaatagatttacagaaggatatggacctaatgaattagcatttaaaaatgcttatgacgaagggatttccttaataataactgtagataatggtatacagggacatcatgaaataagtaccatacaagaattaggtgtagatgttatagtgacagatcatcatgaaataggagaaactttacctgatgcttttgcaattgtacatccgatgcatcctaattttgaatatccttttaaatatttatgtggtgcgggtgttgcttataaattggcccaaggattgatagagcatccacctcaacatttcatagcattagctgccataggtacaattgcagatttagtatcattgacagatgagaatagatatattgtaaagcaaggattaaagatattaaacaatcatacaccatcgtccataaaggctatcttaaatcaagcgggttttaatgatgaaataacagaagaaacaattggttttattattggacctcgattaaatgcggttggtagactagaagatgcatcattagctgctgaacttttattgtccgatgaatttgaagaggcggaatttttagctgaacaagttgaacattttaatcatgaacgtaaagatatagtatctaaaattactgatgaagcattgttattagcagaggaacaaatcaagcaaggccatttgtttcttttacttgccaaagaggggtggcatgagggtgtattaggtattgttgcatctaaaattgtagaaacatatgcactacctacattaattttaaatattgatgaaaatcaaaatcatgccaagggttctgcgaggtcaattgaacaagtttccatgtttgatattttaaatgaccatcaacagttaattgataagtttggtggtcatcacatggctgcaggaatgacaatgtctatcgataatattgaacatttacgtaaagagctagatatgtggatgaaagaactaactgttaccacttcattagagccttcaataaaggtggatgcacaacttgaagaaaaagaaattaacattaaaaatattaaagatatatttcaattaaggccttttggtacggactttaatagtcctctttttatggttagagatctaattgtcaagtcaacaaagggaattggacaggataataagcatcttaagttaacgcttggtcattcaggtttaactgctttattttggaatcatggacatttggcaagtgaacttgaaccaggtcaaccgattcatataataggaacattgcaaattaatgaatggaatggtaatcaaacacctcaatttatcatcaaagacattgctatagaccaattacaaattttagattatcgtagtaaacgtaaaaatatacaatttaaagaatctgaatcaaatgttgcctatgtcattcatccgaaacttaaaaaaagcaattcacattactatcattatggtgaggctattgatagaccttatgataaaatagtgtttagagatttacctaatactatggttgaaattgaacaaaccttagaacattcacaaatttctcaactatatttagttctgcagcatgaaaagtcaatatattttgaaggtatccctagcaagtcgctttttaaaaagtgttacaaagctttaataaacaaaaaagaaactgacttaattaaagaaggtatgctgctttgtgagtacttaaatattaagccagaaatattaacattcatgcttaaagtctttaaagaattggagtttatttacgacgaaaagggattgattaagataaatccagcgccaaataaacaagatatagaaaatagtcgtatttaccaaatgagacgagcacgtatggaagtagaagaacgtcttctctatgatgattttttaaatataaaagaatggataatatcaaagttaacatag

SEQ ID NO: 845 - DNA, 480 bp, Staphylococcus epidermidis
atttgtcgaataggggtgtctaaattggtcaataaagacaatcgaaaattttatttaattagagaagatgtactaccagaatctgtcatcaaaactttaaaagttaaggatgctttaaaaaataattcgaatttgtccatttatgatgctgtaaaacaattcaatctctctagaagtgcattttacaaatatagagagacaatatttccagtagatgaaaaaatattagatcaaagagaatttactttgattttatatgtaaatgatattgttggaatgttagcccaagttcttaatgcaatctctcaacttcaattatcagtgttgacaattcatcaaagtgttccaattgaagataaagcgacaatcacactatctttaaatgcgagaaattctaatttatccattgatgaggtcattgaatcattaagagagataaatcatgtaactaaagtagacttaataagtatgactatgtaa

SEQ ID NO: 846 - DNA, 189 bp, Staphylococcus epidermidis
cactctttgatcagggagcccaataggttttctcgcagcgcacacgcctctataggaggacttgcaaaacgagaaacagggcacccacctgtatatagcaggccgaatgatcaagctatttataactacggcatcaacggactctatcggtacgcaagacttttgtcttgcgtatttttatgtatataa

SEQ ID NO: 847 - DNA, 285 bp, Staphylococcus epidermidis
attttactgattgaccgtcatttagagttatattatactaataactgcatagttttactatgcaatgactataaagttccgttgatatttggagggagggaaatacagatgtctaaaacagtagtacgtaaaaatgaatcactagaagatgctttacgtagatttaaacgttcagtatcaaaaagtggaactattcaagaagtacgtaaacgtgaattttacgaaaaaccaagcgtaaaacgtaaaaagaaatctgaagctgcacgtaaacgtaagttcaaataa

SEQ ID NO: 848 - DNA, 270 bp, Staphylococcus epidermidis
cttataatgattcaagttttgatctctattctctctaatactgatcaatcgcttaataattttgttttaattaaagtgcaaatttcagaaacactctgtgcactatcaactttcatgaatgcgatttcattatatcttgaaagtcttgaagaatacaaggcatcaagttggttaagatttttacttttagcattgggtctatgtgaatcatttttaactcgtttgaaaatgatttcaatgtcacagtctagccaaactacatgcttttga

SEQ ID NO: 849 - DNA, 825 bp, Staphylococcus epidermidis
aaagaggtgataaaagtgaaatttgcagtaattggaaaccccatttctcattcattatcgccattgatgcatcatgctaattttcaatctttaaatttggaaaacacgtatgaagcgataaatgtaccagttaatcaatttcaagacattaaaaaaataatttcagaaaagagcattgatggattcaatgttactattccacataaagaacgtattattccgtacctagatgatattaatgaacaagcgaaatctgttggggcggtaaatacagttttagttaaagatggtaagtggattggttataatactgatggaattggttatgttaatggtttaaaacaaatatatgaaggtatagaagacgcttatatattaattttaggtgcaggtggagcaagtaaaggtatagcaaatgaattatataaaatcgttcgtccgactttaacagttgcaaatagaacgatgtctcgttttaataattggtcgttaaatattaacaaaataaatttaagccatgcagaaagccatttagatgaatttgatattataataaacactacacctgctggtatgaacggcaatacagattctgtaatttctttaaatcgtttagcttcacatactttagtaagtgatattgtttataatccatataaaacaccaatactaatagaagctgaacaaagaggtaatccaatctataatggtcttgatatgttcgttcatcaaggtgctgaaagttttaaaatttggactaatctagaaccagatataaaagcaatgaaaaacatagtaattcaaaaattgaaaggagcattatga

SEQ ID NO: 850 - DNA, 1014 bp, Staphylococcus epidermidis
  unsure (32): Identity of nucleotide at the above locations are unknown.
catatcaagatgagtattaaaattttaaagcntggcctgttttcaacaattcaagatataggtagattagggtatcaggatttaggattttctgaagcaggtgcattagattactatagtttatctattgcccaaaaacttatcggaaatcatggaccagcaattgaatatactttagtaggtcctaatatagaatttttaacagacaatacttttgccattgtcggtggtgattcagaaccgaaacttaatggtaacaaaattgacttattaactgtttatcatgtaagaaatggagaccaattagacattggtcaaatcactgaaggagcaagaggatatattgtttttggacacccacttaaaattaataaagtggctcaaagctattctacacatgttagaagtggaatgggcggatttaaaggtcgtgcattaaagaaatacgatgttattgcaactcaagtaaatcataactataaaactaatttaggaaaaacaattgatttctcatctatacctgataataattacatacacgtcattgaaggacctcagatcaatgaatttgatgaagaaacgatagctaaattcgtaaatagcgatttcaaaatttctgatcaatcagatcgaatgggatacagattaaaaggtaatacagtagcacctaaaaatagtgctgatatcatttctgaacctgtcgctttgggaagtattcaagtacctaacgatggtaatcccattattcttttaaatgataagcaaacaattggtggttatacaaaaattgcaacggtaacacaattagatttaagaaaattagcacagatgaagcctggagacattatacagtttaaatggataactgttgaagaagcttcaaaaaagcttaaagaatttaatactaaatttgaacaattattaaagcgttttgatgagcaaccattgtttaacctaaatcaacttagacatacttctaataaaatcgcagaaataattaaggaggatagataa

SEQ ID NO: 851 - DNA, 1158 bp, Staphylococcus epidermidis
actattcttgttaaacgtataaaaggagaggtaattatggccaaaagagactattatgaagtcttaggcgtaaacaaaagcgcttctaaagacgaaattaaaaaagcttatcgtaaattatcaaaaaaataccatccagatataaataaagaagaaggcgcagacgaaaaattcaaagaaatctccgaagcatatgaagttttaagtgatgaaaacaaacgtgcaaattatgatcaatttggtcatgacggaccacaaggcggatttggaagtcaaggctttggtggcagtgactttggtggatttgaagatattttcagctcattctttggtggcggttcacgtcaaagagatcctaatgcacctcgcaaaggtgatgaccttcaatacacaatgacaataacatttgaagaggctgtattcgggacaaaaaaagaaatatcaataaaaaaagatgtaacatgtcatacatgtaacggtgatggggctaaacctggtacaagtaaaaaaacttgtagctattgtaatggcgctggtcgtgtttctgttgaacaaaatactattttgggtagagtgagaactgaacaagtttgtcctaaatgtgaaggtagtggacaagaatttgaagaaccatgtccaacatgtaaaggaaaaggtactgaaaataaaacagttaaactagaagtaactgttcctgaaggtgtagataacgaacaacaagttcgtttagctggagaaggttcacctggtgttaacggaggaccacatggtgacctatatgtggtgttcagagttaaaccatccaatacatttgaacgtgatggagacgatatctactataatctagatattagcttttcacaggctgcactaggtgatgaaattaagatacctacattaaaaagtaatgttgttttaaccattccggcaggtacacaaacgggtaaacaattccgacttaaagataaaggtgtaaagaatgttcatggttatggctacggggacttatttgtcaacataaaagtggttacaccaacaaaattaaatgaccgtcaaaaagaattattaaaagaatttgctgaaattaatggtgaaaatataaatgaacagtcatctaatttcaaagatagagcgaaaagattctttaaaggagaatag

SEQ ID NO: 852 - DNA, 2301 bp, Staphylococcus epidermidis
ggtgtgcatgtgaagaaaacgagtagaataattgcattcatactcctcatagctctactattcacaggaatgggtatgacgtataagaatgtagttaaaaatgttaatttagttctagatttgcaaggtggttttgaagtcctcttccaagtagatcctttaaataaaggagataaaattgataaaaaagcacttcaagctacatctcaaacattagaaaatcgtgtaaatgttctaggtgtatcagaaccgaaaatacaaatcgaagatccaaatcgaattcgtgtacaattagcaggtatcaaggatcaagcacaagcgcgtaaattattatcgacacaagctaatttaacaattagagatgctgaagatcatgttttaatgtctggttcagacattaaacaaggctctgctaaacaagaatttaaacaagaaactaatcaaccaacagttacatttaaagtaaaaagtaaagataaatttaagaaagtaactgaaaagatttctaaaaaacgtgacaatgtcatggtagtttggttagatttcgaaaaaggcgatagttacaagaaagaagctaaaaagcaacaagaaggtaaaaagcctaaatttatatctgcagcgagtgtagaccaacctattaattctagtagtgttgaaatttcaggtggcttcaatgggaaaaaaggtgttgaagaagcgaaacaaatagctgagttattaaatgccggctcattaccagttgatttaaaagaaatttactctaactctgttggtgcacaatttggtcaagatgctcttgataagaccatgtttgcatcaattgtaggtatagcattaatttatttatttatgcttggtttctatcgtttgcctggtttagttgcaatcattgccttaaccacttatatttatttaactttagtcgcattcaatttcatatcaggtgtattaactctacctggattggcggcattagttttaggtgtaggtatggctgtcgatgccaatatcataatgtatgaacgtattaaagatgaactaagaattggacgcacgcttaaacaagcgtattcaaaagcaaataaaagttcattcttaactatatttgattccaacttaacaactgtcatcgctgcagctgtgcttttcttctttggagaaagttcagtcaaaggcttcgcaaccatgttactcttaggtattttaatgatatttgtaaccgcagtattcttatcaagagggttgttatcattactggtatcttcaaacttctttaaaaaacaatactggttatttggtgttaagaagatggatagacatgatattaatgaaggtaaagatgtacatgatttaaaaacatcatatgaaaggttaaactttgttaaattagctaagccacttatttcacttagtattttaattgtaattattggtttgattatcatttcaatatttaaattaaacttaggtattgatttctcatccggaacaagagcagatattcaatctaaaaatgctataacacaagcacaggttgagaaaactgtaaaatcagttggattggaaccagatcaaatacagattaatggtagtggaaataaaaatgccacagttcagtttaaaaaagatttatcacgtgaggaagacaataaattaagtgctaaggtgaaatctgaatttggagataatccacaaattaataccgtttcacctctcataggccaagagctagctaaaaatgctgtaactgcattaatacttgcttctataggcattattatctatgtttcactaagatttgaatggcgtatgggtctatcttctgtacttgcattattacatgacgtatttatcatcattgcaatctttagtttgtttagattagaagtagatttaacatttattgcagcagtattaactatcgttggttattcaatcaatgatacaatcgtaactttcgaccgtgttcgagaaaatctgcataaagttaaagtaattacgcatactgatcaaattgatgatatagtcaaccgctctattagacaaactatgacacgttctattaatacagtgttgactgtagttgtagttgtagttgcaatattaatattaggtgcaccaacaatatttaatttctctttagcattactaattggattattatctggtgtattctcgtcaattttcattgctgtaccattatggggcatgcttaagaaacgacagtttaaaaagacaaaaaataataaattagtagtacacaaagagaagaaatctaacgatgaaaaaatcttagtttaa

SEQ ID NO: 853 - DNA, 1176 bp, Staphylococcus epidermidis
atatataatgtaaaaactatactaaatgatttaaagattggtggttataaagtgaatgtaaaaagtgcatatattcatattccattttgctatagaatttgtacttattgtgatttcaacaaatactttatcgataaacagccagttgatgaatacttagacgcacttattagcgagatgcaagttaaaaataatagagaccttgaaacaatgtatgtcggaggtggtacaccgacagccttgaatatgagacaacttgagaagctacttagagcaattaatcaaacatttacaattagcggagaattttcttttgaagctaatcctgatgagttaacttatgaaaaagttgcacttttaaaacaatatggcgtaaatagaatatcgatgggtgtacaaacatttaaacctgaattattaaaaattttaggcagaacccataaaactgaagatatatatgatgctgttagtcatgcccgaaaggcaggtattgaatcaataagtttggatttaatgtatcatttaccacaacaaactatcgacgattttaaagacagcctggagcgtgccattgcattggatattgatcatatttcaagttatggattaattcttgaacctaaaacccagttttataatttgtatagaaagggacatttaaaattaccaaatgaagatttaggggcagaaatgtatcggtttttaatggagcgtatgaaaaactcaccatttcatcaatatgagatttctaattttggtaaacttaatcatgaatcaaaccataataaagtatattggttaaatgaagaatactatggctttggtgctggtgcaagtggttatgtaaacggtgtacgttacacaaatcttaatccagtaaatcattatattaaagcgataaatgaagggaaaaaaccaatactatctgaaacgtctcctacttataacgaaagaatggaagaagaaatgtttcttggtttaagaatgaatcaaggtgtgagtaaaagccgttttaagaaaaagtttaataaattaatcgatgaggtgtttggtgaaactattaaagatttgaggtgtaggggactcataaaagaagaaggagaatttatatctttaaccgaacgcggaaaagttataggtaacgaagtttttgaagcatttttactaaactcataa

SEQ ID NO: 854 - DNA, 417 bp, Staphylococcus epidermidis
gggaggaatgtaatgagttatcaatcacactactttaaagaagtccgagaggcacaaaaaaatgcttacgcaccatacagtaactttaaagttggtgcttatttaaagacgaaagatggtcgatgtttttatggagcaaatgttgagaacgctgcatatccgatgggaatatgtgcagaaagatcaagtttagtaagcgctatatcagaaggttatcaaccaggtgattttgaatccattacagttactgtcgatgctgataaaccatcatccccatgtggcgcatgtcgccaggtgatgatggaactttgtgataaagatatgcctgtatatatgaccaatcaaaacggagatatgatagaagctacagttgatgaattattaccattaggattttctggaaaggatttaaattaa

SEQ ID NO: 855 - DNA, 558 bp, Staphylococcus epidermidis
atgatttcagtaaatgattttaaaacaggtttaacgatttctgttgataacggaatctggaaagttattgatttccaacatgtcaaaccaggaaaaggttcagcttttgttcgttctaaattacgtaatttaagaacaggtgctattcaagaaaaaactttcagagctggcgaaaaagttgagcaagcaatgatcgagaatcgtcgtatgcaatatttatatgctgatggcgataaccatgtattcatggataacgagacatttgatcaaatcgaattacctggtgactacttaaaagatgaattaaattacttaaaagcgaatatggaagttcaagttcaatcttatgaaagtgaagttattggtgttgaattaccaaaaactgtagaacttgaagttactgaaactgaacctggaatcaaaggtgatactgccactggcgcaacaaaatctgcgactgttgaaacaggttatactctaaatgtacctttatttgtaaatgaaggtgacacactagtgataaatactagtgatggaagtcacatttctagaggataa

SEQ ID NO: 856 - DNA, 264 bp, Staphylococcus epidermidis
gaggtgacagtaatgccaaatattaaatctgcaatcaaacgtgtaagaacaactgaaacagctgaagaaagaaatatttctaagaaaaacgctatgcgtacagctgtgaaacgagctaaaacagctatctctactgatgctgaaaacaaagatgaattattaagatttgctatcaaacaagttgacaaagcatctcaaagtaatttaatccattctaataaagctgaccgtattaaatctaaacttatgtcagctaataaataa

SEQ ID NO: 857 - DNA, 1320 bp, Staphylococcus epidermidis
aatttcggagtaaaagaggtgagatatatgttcgtcgatcaagtgaaaatatctctaaaagctggtgatggaggtaatggcatcactgcttacagaagagaaaaatatgtaccttttggtggtccagctggtggcgacggtggtaaaggtgcttctgtggtatttgaagtggatgaaggattgagaactttattagatttcagatatcaaagacattttaaagctaaaaaaggcgaaaatggtcaaagtagcaacatgcatggtagaaatgcggaagacttagtgttaaaagtaccaccaggtacaattattaaaagtgttgaaagtgaagaagtgcttgcagatttggttgaagatggccaacgtgctattgtagctagaggaggacgcggcgggcgtggtaactcaagatttgctacccctagaaatcctgcgccagattttagtgaaaatggtgagccaggcgaagaattagaagtgactttagagttgaaattgttagcagatgttggattagttggttttcctagtgtgggtaaatctacattgctttcaatagtttctaaagcgaaacctaagataggtgcttatcactttacgacaataaagcctaatctaggtgttgtttcaactcctgatcatagaagttttgttatggcagatttaccaggattaattgagggcgcttctgatggtgtcggccttggacatcaattcttaagacatgttgaacgaactaaagtgattgttcatatgattgatatgagtgggtcagaaggtcgaaacccattagacgattataaaattattaatcaagaattaatcaattataaacaacgcttagaagatcgtccacaaattatagtcgcaaataaaatggatttacctgattcacaagggaatttatcgcattttaaggaacaattagataacgatgtgacagttgttcctgtttcaactattacgagagacaatattgatcaattattatatcaaattgccgataagctcgaggaagttaaagatgttgacttctcagttgaagaagatgagaatttaggtgttaatcgtgtattatataaacacacaccatcagcagataaatttactatttctagagatgatgacggcgcatatgtagtgagtggcaatgctattgaaagaatgtttaaaatgactgattttaatagtgatccagctgtaagaagattcgcaagacaaatgcggtcaatgggtattgatgatgctttaagagagagaggttgtagcaatggtgatattgttagaatcttaggcggagaatttgaatttgtcgaatag

SEQ ID NO: 858 - DNA, 570 bp, Staphylococcus epidermidis
acgaaatgggtgaataaaatggataaaaaaggactacgtagaaatataattaaaaagatgaaatcttacgacaaagaacaaaaatatttggctgatgaatggttggctaagaaattatatcaaagtgaagcttatcgcaaagctaacacaattggttttgttttatcgatgcctcatgaagttaatacatatccaattattactcattcgctaaacaataataagaaaatttttgttcctgaaacaaattatcaacagcaagacatgacttttaagcaactattatcaattgaggatatcgagaaagatagcaaaggtatttatcattctatttccccagtcggtacaacgaataaaatggacttagttgtagtaccgggggttgcatttgacaaattgggctatcgaataggatatggtggtggttattatgaccgattcctgagccaacataaatgtaatacagttagtttactatacgattttcagttagcccaattcaatatagaaccacacgatcaacctgtagagcaattaattatttatcacaataaagtggtggaggaataa

SEQ ID NO: 859 - DNA, 612 bp, Staphylococcus epidermidis
agaattatattaaagaggaggggttttatggagataagtagagctaaagaactggtaaaagaaaaactgcctgataaacgttatcaacattcattacgagtggcggatacagcagttaagttagcagaaatatacgatggtgatatcaaaaaagctgagttggcaggtatattacatgattactgtaaatacgaagacttaagtacaatgtatcaaattgttagacaatacgaacttgaaagtgatttgcttagctatggtggagagattcttcatggaccagtatgtgcggcacttatgaagcatgaatttgatgtaaatgatgaagaagttttacttgctataaaatatcatacgactgggcgtcaacaaatgactaaaacagagaaacttgtttttattgcagactatatagagcctggtagaaaaacgcctggagttgaagaaattagagatatggcatacaatcaaggtagcttagataagacaatttatgagatttctaagcgtactgtattatttttaatagaaaaggatattactgtatatggcgccacaattgcgtgtttaaattattataattatagcgatgaaagaataaaggatgattaa

SEQ ID NO: 860 - DNA, 270 bp, Staphylococcus epidermidis
atggaaatattttataaaacccaaattaataaaactttcagaacaaaaagcaaaaaccatctacagtcaaagaaaatttggtctggaagcttttttggatttgtgaagtctattttgagtttcacacgaatgtccgttcgagagataaataaagccaaaagagaactagaatttgtactaatggcacttaatataagaaaagtaacagttcaacgagctaaaaataatcaaaaaaattataaaaagacaatttctatattttttcaatag

SEQ ID NO: 861 - DNA, 231 bp, Staphylococcus epidermidis
ccgttcaaaccaactaggggagaaatgaggcctcctaaaataaattggaataggccaagtaaacttgaagcattgccacttccacctgtgcgttcagccattgccatagaaaaacaaagtggtgctatagaagtgactggacatatattaataaaaaagccaataagtaaaacatacaatggaagatgtaatgttaaagtaaatattaaaattacaacacctaacatttga

SEQ ID NO: 862 - DNA, 192 bp, Staphylococcus epidermidis
tggagcccaactggcatttttaataagatgcctaagatgactattaaggtaatgattgttaaaaatataaaaatcattttccaacttgcaatagataaagcgaggccacctaacagtggagcaatgatggtgattataccgtttatgaccataagagaagttaaaaattttgctaatttgtttccgtcatag

SEQ ID NO: 863 - DNA, 461 bp, Staphylococcus epidermidis
  unsure (326),(404),(405),(428): Identity of nucleotide at the above locations are unknown.
gtgaaggtgactcaaaatgaaaatttgaagttagcgcaacgaggtgcatttcttagtttagtcatctatattatactttctattgcgaaatatatgactggatatgtttatgattcggcggcagttagagcggatgctttaaataacatgacagacattttagtttcagtagcagttatcgtcggacttaaaatctctattaaacctgctgatcaaaaccacccatatgggcacttaaaatctgaaaatatttccacattgctagtatcattcattatcatgtttgtgggaatacaagttattatagaaaactttccgagattatntacacatgattcacatattcctaactttattactattattataagtatgatcagtggacttgtgaagttatgtgtctnngctattaattatcgattatctanaagaacgaaaagtagctccataaaatcagcagc

SEQ ID NO: 864 - DNA, 1152 bp, Staphylococcus epidermidis
atgtcaccatataaagttatcattgcacctgattcttttaaagaaagtatgtcggcaaaggaagctgctttagctattaaagatggattccaagaggtgttcgattccagtactatatatgacattattcctatggctgatggtggcgagggaacaaccgaagtattgaaagaagccttaaatgctacctcttattgcgtagaagtaaaagatccacttaatagaaatatcatggctagttatgcgagaagcgacgaacaccaaacagctatcattgaaatggcagctgcttcaggactagcattattgagtaaagatgaaagagatccatctattacaacttcgtacggtaccggccaactcattaatgatgcacttaatcacgatgttaataaaattattttaggaataggtggaagtgccacgaatgatggtggtgtaggaatgttaaaggctttaggtgtctcttttaaagataaaaacaatcaagagattcgcgatggaggtttagccctatctcaaatagaatacattgatattactcgtataaacccacgattgaaagatgtgaatattaaagtagcctgtgatgtaactaatccattattaggagacaatggagcaacaatagtttatggtccacaaaaaggcgctcaacaaaagatgataccaaagttggattccgcattacgtcactatcatgataaaattgaaagagaattaaatatgaatgtaaaagatatcccgggcgctggtgctgcaggaggcatgggaacagcgttaattgcgtttctaaacgctgaattacgtcctggaattgatgtagttcttgaagagactcaatttaaacaaagaataaaagatgcgaatttagttgttactggcgaaggtaaaatggataaacaaacaatctatggcaaaacacccattggcgtagctaaagttgcaaaatcatatgatatacccgtcattgctatttgtggtagtttaggaaaagattacgaagtaatttatcaccacggtatcgatagcgtgtttagtatcatggaacgtccatgccaccttgacgaagctttgaaagaaggcgcacttcatgttaaacatacaacaacaaatttcgcacgacttttacaattaaaaattgaaaactga

SEQ ID NO: 865 - DNA, 1242 bp, Staphylococcus epidermidis
aacgtatataatagatgctataacttttctaggagaataatgatgatgactacaagttccaaacacttatctaaaatattaatcgttatacttggcgttatgactgcatttggtcctttgactattgatatgtacggaccatctttacctaaagttcagcatgcgtttggttcatcaatttcagaaatacaacttacattatcctttgctatgataggtttagctattggtcaatttgtattcgggccactatcagatgtattaggtcgtaaaaaaatggcactcattttattgattggatatttaatagcctcattactatcagtgtttacagttcatttaacaatatttttaattatccgtttaattcaaggtttagcaggagggggtgcaatcgtcatagccaaagcttctattggagataactatgacggaaacaaattagcaaaatttttaacttctcttatggtcataaacggtataatcaccatcattgctccactgttaggtggcctcgctttatctattgcaagttggaaaatgatttttatatttttaacaatcattaccttaatagtcatcttaggcatcttattaaaaatgccagttgggctccatcaaaaacaatctcagttaaattttaaagcaatatttaaagattttggtttgttattaacaaaacccaccttcgttattccgatgttattgcaaggattaacttatgtcatgttattcagttatttgtcagccgcaccttttatttctcaaaagatgtatcatatgacaccacttcaatatagtgcaatgtttgctattaatggagtgggtttgatagtcgtcagtcagataaccgctattatagtagaaaagataagccgatatgcgatgctcatatatttaacaatcattcaaatgttaggtgttgtaattttaatatttactttaacattacatcttccattgtatgttttacttattggcttttttattaatatatgtccagtcacttctatagcaccactttgtttttctatggcaatggctgaacgcacaggtggaagtggcaatgcttcaagtttacttggcctattccaatttattttaggaggcctcatttctcccctagttggtttgaacggtcagcatgatatgtccccgtatctaattattattagtgctacagctgttttacttattgcactacaaattatttatttcaaattatttatgaaaaacacatag

SEQ ID NO: 866 - DNA, 1491 bp, Staphylococcus epidermidis
agaacagagaggtcaacaatgaattacttaaaacaatatgaatcatttttttggttaataggaatttttatcttttatcttataatggcaattctaacaccattatcaactacggattggcatgcatataaagttaatctaagtcaatatttgactcaagaaaatggtcgttatttaggacatttatttgaatgggttgccgtacataatatcataataagagctttaatatatgcgataacttcgtttttagttatctatttagttgcttatatggttcaattacatacgaatcgtttttattttattttgagttttgtgttaatggttactgtacctaatacaatttatagcgaaacttacgggtggtttactggattttttagttatatacctgctacagtcctatcactttttattctttttactgtagttaaaatgattgagtcgcacgatacagtttctgaaatgcaattatgggtatttttattagtaagtttgtttggacaattcttcttggagaatctttccatcgctaatagcttaattattttaataggaatggtagtctatttctttgttaaaaaaagactcagttatttcttaattgtaggatttatgcttagttgtataggtaacattataatgtttttaaacttcaattattttttaattaaggatggattaaatacgcattattcaatttccgatagtcatggaatgatacataaagcaggtgtgacgttatttaagcttgtaccagaatatatgtttattaatcaaatgattattcttaccgtgatatcaatagtaagtatagttttacttaagcaaaataaaagcctgaagcatatgagagtttatattaaaataccactactcttaggtttaattactttacctatttataagatcttcgtttacaatcaatttcattttgaattatataaagcttcattttctatagccgttttgaatacaacgatttgcttcatttacatgataagtgtgatatacgttgtgtttaaaatgatacagcaaagatacataagaatgattgtgatggggagttttatagctatggcttcatctgttttgccacttttatttgtgacgcctataagttatagaaatttttattttatttatactttatggatcgtgatattactttgtttaattcagcaatgtgatgtgctatttaaacaacttgaacatataattaaaatatttgcgattatcatcagcatcattatgatgattggatttacttttatacatattagtagtgtgcacagaatagacttcattaaagaacaaataacacaacatcatcgctatcagaaaataacattggaaagattaccatttgagcgatatactcatatgactacaccaaagtcgaaggaacaacttcaagatttcaaacactattatgatttgcccaaagacatcacatttaaagtagtcccatatggtacaaaacaataa

SEQ ID NO: 867 - DNA, 711 bp, Staphylococcus epidermidis
ggtgacaatatgaaaagaacagataaatatagagattcatacaaatatgatgaccaatatcaaaatcatcgtaaacgttcagaagaagatatgtatcgacaacatcaagagtcccaacagagagcaaattcaaatcgtgcaacacaaagtgaaaatgatagagagtatgaaaatcatcctgaacgttattacaatggaagagactatcgacgtgagcagcaattggaagaagaaaatgaaaaatcaagcaaaactaaaaaatggctgattgcaatcatagttattttactcattattgtagctatctttatcacgcgtgcaattatcaatcataataatgataaagtaagtaatgaccctaacgtttcacaaaactataaaaaagaagttgaaaatcaaaacgacgacattaatcgacaagttgattcagccaaaagcgatataaaaaataaaaaggacacccaatcccaaattgataaactacaaaatcaaattgatcaattaaaacaaaatgaagaaactaatgcggattctaaattcacaaaattttatcaaaaccaaatcgacaaactgaaaaatgcaaataacgctcaacttaataacgaaaatcaaagtaaagttaacaacatgcttgaagacatcaatacaaaatttgatagtattaaagctaaactagaaaatatcttgaatggatcaaattcaggaaactaa

SEQ ID NO: 868 - DNA, 435 bp, Staphylococcus epidermidis
agtagtcccatatggtacaaaacaataactgttcaaaggagaaatattatgaagttaacccgaatacattatgagattataaagtttatcatagttggtggaattaatacctttaactactatataacatacttatttttgttaaaggtgttacatgtgaattatatggttagtcacattgttggatttattgtaagttttattatttcatattatttaaattgttattttgtatataaagtaaaacctacaatagaaaagtttttaagatttcctatcactcagatagttaatatggtaatgcaaacgttattattatatatattcgtaaagtggttgaatatcgcttcagaaattgcaccttttgcgggtctaatcattacaatcccagtgacattcatactttctaagtggttacttagagataaagtttaa

SEQ ID NO: 869 - DNA, 816 bp, Staphylococcus epidermidis
gtgagattgttaatgttacattataatttttatgaatctaagaaccaaagtaagcaattattggtgatgttgcatggttttataagtgatgctactacttatcattcacatatagaacgcctcgtagaacatacaaacgtgctcacaattgacttgcctggccatggcttagatacttcatctatggacgaagtgtgggatttcccgtttattacacgtcaacttgatgaagttttaatacaatatcaaacatatgatgtgtttcttctaggttactctatgggtggccgggtagcactttattatgctatacatggtaatgaaacgctatcagggttgctcttagtgagtacttcagcaggtattcaaaatgagacggataaagtagaacgtgcccaagtggatgctgcacgtgcaaaagtacttgaaattgctggtttagatatttttgtgaatgattgggaaaagttaccactttttcgttcgcagtataatctagcacctgagatacgccaaagtattcgcaataatcgcttgaatcaagatgctaataaattggccaaagcacttcgtgattatggtactggtcatatgcctaatttatggccacatctatcattgatacgcattcctactttaattttagtaggggaaaaagataaaaagtttgttcagataggacaacaattagagaatcacttacaagatagtcataaagttcaaatttctaatgtcggacatacaattcatgtggaagatagtacggaatttgatacaataatattaggttttttaaaggaggagcaaaatgactag

SEQ ID NO: 870 - DNA, 225 bp, Staphylococcus epidermidis
aatagtgatcccgcaggtttaaaaaaggctgtaatgatgacaatgatgtatgcgatggcatacattattgccataaaaataactgaagcacgtttacctaaaagtataggcaaagtttttctaccgctagccttgtctttaacacggtcacgaatattgttacccatattgattaaaccaattgtgatgactattggaatacttaaccatacggcatatccttga

SEQ ID NO: 871 - DNA, 240 bp, Staphylococcus epidermidis
aataaccatacggaggtagacataatgaaagttaacaaaacaatttatattatagttgcattgattttaggtggtctgggcgtgcataaattttatgccgaccaagttggacaaggtattctacatctcgtctttttctggactggcattccaagtgttgtcgcaatcattcatgctatcattgttatttttactaaaaaagcagatgaatacggctacataacttttgataaaaaataa

SEQ ID NO: 872 - DNA, 1023 bp, Staphylococcus epidermidis
aaaaggagagcgtttatgacagccatcaaagatagggattattttttcgataatgctcgagcaatattgatatttctagtcgtattaggacatttattacagccttatacatctgaagataaatttttacaagctttatatttattaatatatagctttcatatgcctacctttctgtttatctcaggctattttgctaagaatttagataaacctaactatttagaaaaaattgcaaaaaaattacttcttccttatgtaatattttttgcgtttttctcactttattactatttcactggtaaagaagatgcaattcaattagacccatttaatccggtttttgcattgtggtttttactcaccctttttttctttcacgttgttttagttatagtgagaaggtataatccgtatattgtattattcatatccatacttgtttctgtattagctggtttctctggcaatatcgatagttatatgagtatatcaagaaccattgtgttcttccctatcttctttataggacatttggttacacaatcacatacggaaaaacttagaaataaaaaatggatccccatttcaataatcattctgattaccttctttataggatacacaatccatcctattaatggagattggttattaggaagtacaccttatacttctttagaaagtaacggggaggatgtttatagtcctctaaaacgcttattactctatatcattatacttttaactatgtgtgcatttctaaatctaatgccacaaactaagcgtatttatacatatataggacagcgcacaatgtttgtttatttattacacggtatcgttataggagtcattcgcgggtttgatttatatccatttaaggatcagatttctatctttacctatctttatttatttatcagtgcgagtgtgattgtattaatattatcttcaaaatgggtttgcaaatggacgaatccgttcattaatttaaaaaggccctctcaatttaaaaattaa

SEQ ID NO: 873 - DNA, 426 bp, Staphylococcus epidermidis
aacaacatgtataaacaacttgaaaaacttatcacactgacaaataatgatttgaatttagttaatagacgctttggtcaacgaactgacattacttctgaacaattagagttactacgtattttatataattatgatcgtttatctcaatacgatttaactatgaagattagtagggaacaatcaattgtatcaagatggattaaaaagttagtccaaaaaggttatatcatgagtcaacaatctcatgaagatttacgatgtaaagaactgatattaactgaagaagcaagggctttaattcagcaaatcaacacggcgagatgcgagttaattgaagcgagatgtcaatgtctatcttcagacgaaattgcaagtttaaatcaattattaaacaaacttaatagtagacacattttcatctga

SEQ ID NO: 874 - DNA, 540 bp, Staphylococcus epidermidis
cgaggaattcattgttccgaattattaaaaggactaggatttaaaagatatgcctatcgtcatgataaatatggttttaaacgagactttaaattatatgaatgtgatgattgttcagaatgccctctgaaacaacaatgtatgaacttcaattcaaaaacaaataaaaaaataatgaaaaattataattgggaatattttaaagcccaaattaataaaaagctttcagaaccaaaaacaaaaaccatctacagtcaaagaaaaattgatgtggagcctgtttttggatttatgaaggctattttgggtttcactagaatgtccgttcgagggatagataaagccaaaagagaattaggatttgtgctaatggcacttaatataagaaaagtaacagctcaacgagctgaaaataatcaaaaaaataataaaaaagacaatttctatattatttcaatagaaattgtctttttttacttatcctgggactttatgtcccacactcattatgagcaaaaggaaatctgttttaataaataa

SEQ ID NO: 875 - DNA, 954 bp, Staphylococcus epidermidis
gaggttgtgcatatcatgtcagatcaatatcaacaatattccactgttaagaagtactggcaattgatgagacctcatactttaacagccgctgttgtccctgtactcgttggtactgcagcagctaaaatatatttactcggtagcgaagaccatctgaaattcagtcttttcttagctatgttgcttgcatgtttgttaattcaagctgcaacaaacatgtttaatgaatactatgactttaaaaaaggtcttgatgatcatacctctgtgggtattggtggcgctattgtacgtaatggtatgagtcctaaacaagtaatgaatttagcaattgctttttacatcattgcagcacttttaggtatctttttagcaatacaaagctcattctggattattccagtaggcatagtttgtatggcaattggctatctatataccggtggccctattccaatttcatggacaccttttggtgaactattttcaggattatttatgggtatgattatcatactactttcatttttcatacaaaccggtaatgttcaaggatatgccgtatggttaagtattccaatagtcatcacaattggtttaatcaatatgggtaacaatattcgtgaccgtgttaaagacaaggctagcggtagaaaaactttgcctatacttttaggtaaacgtgcttcagttatttttatggcaataatgtatgccatcgcatacatcattgtcatcattacagccttttttaaacctgcgggatcactattttacttgttagttttattatcattcccaatgcctattaaagcagtgagacgttttaataaaaatgatacacctgaaacaatgatgcctgcgatggctgcgacaggtaaaacgaatacattctttggtttattgtatgcattaggaatctatattagtgcacttttaggtgcaatctaa

SEQ ID NO: 876 - DNA, 183 bp, Staphylococcus epidermidis
aattctaataactctcttaataatattctgcatgttaactccccttatattttgtttgatattttatacccagtttttgtaggagctaaaagtaaaatttgttattttggaaaatatgaagaaatatttttagatgttattttttatcaaaagttatgtagccgtattcatctgcttttttag

SEQ ID NO: 877 - DNA, 780 bp, Staphylococcus epidermidis
ttaatgtgcaaagcctttgttgaagcagttgatgaattaggtggtatatattatgacgtaccatataacttaaatgaacctaacagtgatgatactggtagaattaaaataaaaaaaggataccaaaagctaaacggcgaccaagcattagctgtagctcgaactagacaccatgattcagaccttaaacgtggtcaaagacaaatggaacttattaaaatattgttccaaaaagctcaaaatttaaaatctatagataaacttgacaatgttattagtattgtagggaaaaatgctaaacataatttaactcaaaaagaaattaagtctctagccaaaatgtatcttggtggtagtactgaaattaaaacatcacaacttaaaggtaaggatgactacttaaatgatatatactattaccacccaagcgtaaaaagtattatggaatattcaaatcttttacgtaatgatttagatttatctaaaataacaaacaaaaacgatttcttagatcaaagagtcattaaacgatatggttcactcgtacccttaacagaattagatgaagacttattgcgtaagaaccaaaaggaatcgactgatagtcagaaagagtctgattcttcatcacaaaataatgatgaagaagatcaaactaacgaacaaacagaccaaaatagcttaaacggaaacgaacagtacccaaatcaacaagacaacaatcaaaccaatggtgaaaatggtatgataaataatgacaattatccttacgcacaataa

SEQ ID NO: 878 - DNA, 831 bp, Staphylococcus epidermidis
aggaggagcaaaatgactagacagtgggaaacacttagagaatatgatgaaattaaatatgaatttttcgaagggattgccaaagtaacgattaatcgtccagaagtaagaaatgcatttactcctaaaacagttgctgaaatgattgatgcattttcacgtgcgcgtgatgatcaaaatgtatcagtaattgtattaactggtgaaggggacaaagcgttttgttcaggtggagatcaaaaaaaacgtggacacggtggttatgtaggtgaagatgatattcctcgtttaaatgtattagatttacaacgtttaattcgtgtgattcctaaaccagtaatagcaatggttagaggctatgcaattggtggaggaaatgtacttaatgttgtttgtgatttaactatcgctgcagacaatgctatttttggacaaactggaccaaaagtaggctcatttgatgctgggtacggttctggctacctagctcgtatagttggccataaaaaagcaagagaaatctggtacttatgccgtcaatataatgcacaggaagctttggatatgggcttagtgaatactgtagttccattagaacaagttgaagacgaaacagttaaatggtgtaaagacatcatgcaacactcaccaactgctttacgtttcttaaaagcagcaatgaatgctgatactgatggtttagctggtttacaacaaatggctggagatgcgactttactttactatactactgatgaagcgaaagaaggacgtgacgcgtttaaagaaaaacgtaatcctgattttgaccaattccctaaattcccataa

SEQ ID NO: 879 - DNA, 4008 bp, Staphylococcus epidermidis
atggcgaaaaaattcaattacaaattaccgtctatggttgctttaacgttatttggcacagcttttactgcacatcaagcaaatgctgctgaacaaccacagaatcagtctaatcataaaaatgtattagatgatcaaactgccctcaaacaagcagaaaaagctaaaagcgaagttacacaatcaactacaaatgtatctggtacacaaacatatcaagaccctacccaagttcaacctaaacaagacacacaaagtactacatatgatgcatcattagatgaaatgagtacttataatgaaatttcatcaaatcaaaagcaacaatctttatcaacagatgatgcgaatcaaaatcaaacgaattctgttacaaaaaatcaacaagaagaaacaaatgatttgacacaagaagataaaacatccactgatacaaatcaattacaggagacacaatctgtagcaaaagaaaatgagaaagatttaggagctaacgcaaataatgaacaacaagacaagaagatgactgcaagtcaaccttccgaaaatcaagcaattgaaactcaaactgcttctaatgataatgaaagccaacaaaaaagtcagcaagtaacttctgaacaaaatgaaactgctacacctaaagtatcaaatacaaacgcatctggttataattttgattacgatgatgaagacgatgatagctcaacagaccatttagagcctatctcattaaacaatgtgaatgctacatctaaacaaactacttcatataaatataaagaaccagctcaacgtgtaacaactaatactgtaaaaaaagaaacggcatctaatcaagcgactatagatacaaagcaattcaccccatttagtgcaactgctcaaccgagaacagtttattctgtatctagtcaaaaaacatcatcattaccgaaatatacaccaaaggttaattcttcaataaataactatattcgtaaaaagaatatgaaagcaccaagaattgaagaagattatacgtcatatttccctaaatatggctatagaaacggtgtgggacgtcctgaaggtatcgttgttcatgatactgcaaatgataactcaacaatcgatggcgagattgctttcatgaaacgtaattacacaaatgcattcgtacacgcatttgttgatggcaatagaattatagaaacagctccgacagattacttatcttggggtgcaggtccatatggaaatcaacgttttatcaatgttgaaatcgtccatacacatgattatgattcatttgcacgttcaatgaacaactacgctgattatgctgcaacgcaattgcaatattataatttaaaacctgatagcgctgaaaacgatggaagaggaacagtttggacacatgctgctatctctaacttcttaggaggtactgatcacgctgaccctcaccaatatttaagaagtcacaattatagctatgcagaattatatgacttaatttatgaaaaatatttaattaaaacgaagcaagtagcaccttggggcacaacatctacaaaaccgtcacaaccttctaaaccatcaggaggaactaataataagttaactgtgtctgctaatcgtggtgttgctcaaattaaaccaacaaataatggcttatatacaactgtttatgacagtaaaggtcataagactgatcaagtacaaaaaactctatccgttactaaaactgcaacattaggaaataacaaattctatttagttgaagactacaatagcggtaaaaaatacggttgggttaaacaaggtgatgttgtttataacactgctaaggcaccagtaaaagtgaatcaaacatataatgttaaagcagggtcaacactttacacagttccttggggtacaccaaaacaagttgctagcaaagtatctggtactggaaatcaaacatttaaagcaactaaacagcaacaaattgataaagcaacgtatctttatggtacagtgaatggtaaatctggttggattagtaaatattacttaactacagcatctaaacctagcaatccaactaaaccttcaacaaacaaccaattaacagtgactaacaatagtggtgttgctcaaatcaatgcaaaaaatagtggcttatatactacagtttatgacactaaaggaaagacaacaaatcaaatccaacgtacattgtcagtgacgaaagctgccacacttggtgataaaaaattctatcttgttggtgattataatactggtacaaattatggttgggtaaaacaagatgaggtcatttacaacacagctaaatcacctgtaaaaatcaatcaaacatacaacgtcaaacctggtgttaaattacacacagtaccttggggcacatataatcaagtggctggaacagtttcaggtaaaggcgatcaaacttttaaagcaactaaacaacaacaaattgataaagcaacatatctttatggtacagtgaacggtaaatctggttggattagtaaatactatttaactgcaccatcaaaagttcaagctttgtctactcaatcaacaccagcacctaaacaagtaaaaccatctacacaaactgtaaatcaaattgctcaagtgaaagctaataattctggaataagagcatctgtatatgataaaacagccaaaagtggtacgaaatacgctaaccgtacattccttatcaataaacaacgtactcaaggtaataacacgtatgtactacttcaagatggaacaagtaatactccattaggatgggtaaacattaatgatgtgacaactcaaaatatcggaaaacaaactcagtctataggtaaatattcagtaaaacctacaaataatggtctatattctattgcttggggtactaaaaaccaacaattactagcacctaatacgctagctaatcaagcatttaatgcttccaaagctgtttacgttggtaaagatttatatctatacggtacagtcaataacagaacaggatggattgctgctaaggatttaatccaaaacagtactgacgctcaatcaacaccatataactatacttttgttatcaataatagtaaaagttatttctatatggatccaacaaaagcaaaccgatattctttaaaaccatattatgaacaaactttcacagtcattaagcaaaaaaatattaatggcgttaaatggtactatggtcaacttttagacggtaaatatgtttggataaaatcaactgacttagttaaggaaaaaattaaatatgcatatactggaatgactttaaataacgcgataaatatccaatctcgtcttaaatataaaccacaagtacaaaatgagcctttgaaatggtcaaatgctaattatagtcaaattaaaaatgctatggatacaaagcgtttagctaatgattcatccttaaaatatcaattcttacgtttagatcaaccacaatacttgtcagcacaagctctcaataaattattaaaaggcaaaggtgtacttgaaaaccaaggcgctgcatttagccaagctgcacgtaagtatggtctaaatgaaatttatcttatctcacatgctttagtagaaacaggtaatggaacttcacaacttgctaaaggtggagatgtttcaaaaggtaaattcacaactaaaacaggtcacaaataccataatgtctttggaattggtgcatttgacaataatgcacttgtagatggtatcaaatacgctaaaaatgctggatggacttctgtctctaaagcaattattggtggcgctaaattcattggaaattcatacgtgaaagcaggacaaaatacgctatataaaatgcgttggaatcctgcaaaccctggtacgcatcaatatgcaactgatattaattgggcaaatgtcaacgcacaagtattaaaacaattttatgataaaattggtgaagtcggtaagtacttcgaaattccaacatacaaataa

SEQ ID NO: 880 - DNA, 1389 bp, Staphylococcus epidermidis
aattcggaggagaaagaagtgaaaaaaatggatgtgaatgtagacgaacaggcaatcgtcgataagttatatgaaagtacaaaagattgggtttcagttgaagttgaattaaataaaactatgaaacctagtgtgttgtttcatttaactgaaaaagatgctggggaccgtttttacatgcgcttaaatgataattattcttcgtattttggatatcatgctattcataggtttaaaaacgactttgagaataagcaatccatttttaaggactgggaaaaattaaaaaataatattgaacttattcatccacataataaatatcatcatcttagattgtgtggcggttttcaattttcgagtcacaaatcagatgatgaatggagagaatatggtttaaaccattttgttttacctaaagtattaatttctaatgaaggtacgcgtacttatctaacttatacaacaaagcgacaagattttgatttacaagcatttaaaactttagtggcacattttgaacaaacaaccatggataaccctgaggaagcacttggagatgtgacgcgtatggaagatatttataaggatgattggcgtgatctcgtaaaagaagcgattgatacgattgacgacaataaaaaaatcgttctcgcacgtcgtcgtttagtcaaatttgataaaaaaatcaatattccatatgttttaaaccgggctcttgaaaatgaaaaaaatagttatatatttttattagaagctaatcagtcaatattcttttctcaaacgcctgagcaattaatcaaagttgaagatggtgttttatctacaaaagctgtagcaggtaccattaaacgtacacataatgagcaaatagataataagaatatagaggcatttcttaaagataagaaaaatttaggagaacatcgttttgttgttgagagcatcttaaatgatattgagccttttgtacaggatgtagagtacaatgaaacgcctaatattttaaaaaatgatcatatgtatcatttatatacggaaatcaaagctaatttaaatgacaaatcatacattggtttaatcgatcgtttacatcctacacctgcgttaggtggctaccctaaagaagaagcgcttgattttattgagaataaagagtttggtactcgaggtttatatggcgcgccggtaggctatattgatgtttatgatgattgtgaattcattgttgctatacgttctatgctaattaaagagcaacaagcgactttatacgctggatgcggcattgttaaaaattcggatcctgatagtgaagttgctgaaactgcagttaaattctcaccaatgatgaacgccttaggagtagataataatgatgaatcatag

SEQ ID NO: 881 - DNA, 453 bp, Staphylococcus epidermidis
gggaaaaccagtgaaaatggaggtgatactgtgtttcaaatagcaaaaaaccaaacgatgctagatgattgctttgaaataagaaagtgtgttttcgtcgaagaacaaggcgtaccactcgaaaatgaatttgatcaatatgaagattactcattccatatagtgggatatataaatggtgttcctatggcaactgctagaattagacctttaaatactcatatttgtaaaattgaacgtgtagcaatcatcaagtggtatcgtggtcttgggtacggtaaaaatttaatacatgctattgaaacaattgcaaaaaaacaccaatacaatgaactcactatgaatgctcaattacaagctcgagacttttacttaaaactaggttactcaccttttggtaaagtattcttagaagaaaatataaatcatattagtatgaataagtttttataa

SEQ ID NO: 882 - DNA, 312 bp, Staphylococcus epidermidis
tgccccaggcttttttattgcaaacacagacaacaatttaatttaaaaacccgcttaatatcgagttatttcaacatttgtctaaacccagaatttcaaacagaaattctacagacaaggcaagttggggttcggggccccaacatagagaatttcaaacagaaattctacagacaaggcaagttggggttcggagtatgtttagacaacgcgcttataacttatgccccactgaaaccatttataaaaattcaatctgtaaacaaaattaatgtttattcatttatatacatcacacacctttcattatga

SEQ ID NO: 883 - DNA, 606 bp, Staphylococcus epidermidis
aaattgagtataaactttagctatcaatatctaaaaggggagtcaaatgtgattagaaaagcgaaaacgagtgataatcgacagattgcagagttatgttaccttatttggagagatatggaattagatattaccaaggaaataactaaagatcgtattattgaagcgatagaattaagtattgtgaatgtgagatatcggtcgttttatgagcatatttgggtatatgagaaagacggggttgttgctggatgtgtaattgcgtatcctgggaaagaggaaatggattttgaacaacaatggcttaagttaccacttgaagaagatatccttcagttaggtacaccattacctgaaaaagaatcatacgatgatgaaatatatatagaagcagtagtaacgactccaaaatatcgaggacaaggtattgcaacacaacttttaaagtatgtaatttccactcatgcacatgaaaaatggggattgaattgtgattatgataataataaagcacgccacctatatcacaaattagggtttaaagaggatgcgacaattcgtttatatggccatcaatattttcatatgacattgaataataagtaa

SEQ ID NO: 884 - DNA, 1680 bp, Staphylococcus epidermidis
ataataatgatgaatcatagtgaagctttaactgaacaagtattttcatttgcttcagagctttatgcttatggtgtaagagaagtagtaattagtccaggttcacgttcaacaccattagcacttgttttcgaagcacatccaaatattaaaacatggattcaccctgatgagcgaagtgctgcattttttgctttaggtcttattaaaggtagcgaaaaacctgtagcaattctttgtacatctggaacagccgctgcgaactacacacccgctatagctgaaagtcaaattagtcgtttgcctctcgttgttttaacgagcgacagaccgcatgaactgcgcagtgtgggtgcacctcaagcaatcaatcaggtaaatatgtttagtaattatgtgaactttcaatttgatttgccgattgctgatggaagtgaacatacaattgatacaattaattatcaaatgcaaattgcaagtcaatatttatatggaccacaccgaggaccgattcattttaatttaccatttagagaaccactaacaccagatttagatcgtgtcgatttattaacatctgtaactaaaacgttacctcattatcagaaatcgatttcggtagatgatataaaagacatattacaagaaaaaaatggtctcatcattgtcggagatatgcaacaccaagctgttgatcaaatattaacgtattcaactatatatgatctgccaatcttagcagatccccttagtcagcttcgtaaagagaaacatcctaatgttataaccacttatgatttattgtatcgagcaggattaaatttagaagtagactatgtcatacgtgtaggtaagccagttatttctaaaaaattaaatcaatggttgaagaaaaccgatgcgtatcaaattattgtgcagaataatgatcaaattgatgtatttccgacaccacctcatatatcttatgagatttcagcaaatgattttttccgttcattaatggaagaaccacttgttgaacgaaaaaaatggttacagcaatggcaatcacttgaacaacaagcacgcattgaaataagtgattacttaaagcatgcgacagatgaagcggcatatgtagggagtttaattcaaaaacttacaaaagaagatacattatttgttggaaatagtatgccaattagagatgtcgataatttactgtttgatagtgaggcatctgtatacgctaatcggggtgccaatggaatagacggagtagtttcaactgcgctaggtatggcggcacataagaatgtgacattgcttattggtgatttatctttttatcatgacatgaacggtttattaatggccaaattaaatgaacttcatattaacattgtattagttaataacaacggaggaggtatcttttcatatttacctcaaaaacgatcggctacaaaatattttgagcgattatttggaacaccaacaggcttaaactttgaatatactgcactgttatatgattttacatttaagcgctttgataatttgactgactttaaatatgctgaattatctaaaatgggttctcacatgtatgaagttataaccaatagagacgaaaatttgcatcaacaccaaaatttatatcagaaattgagtgagattgttaatgttacattataa

SEQ ID NO: 885 - DNA, 507 bp, Staphylococcus epidermidis
acttatgtagtaaatatacttaaaaggagcgcaaatatgagtcgtaaaacatatgaaaaaattgctaatattaatggtatgttcaacgtacttgaacaacaaatcattcatagtaaagatatggcattatttaggaatgaatttttttatgtaaaccatgaacacagagaaaattatgaagcgcttttgatctactacaaggatagtttagataatcccgttgtagatggcgcatgttacattcttgcattacctgaaatatttaataaggttgatgtgtttgagtctgatttaccttttacctgggtttatgatgaaaatggactttctgatacaatgaaaagtatcagtgtgccccttcaatatcttattgcagccgctttggaagtgactgatgtaaatatatttaagccttcaggttttactatgggcatgaacaattggaatattgcccaattacgtattttttggcaatactgcgctatcgtcagaaaagaggctttataa

SEQ ID NO: 886 - DNA, 1188 bp, Staphylococcus epidermidis
caaatgaaattatcattaaattcaagttcaaaatttttaagagcccctagtattcgtcaattttctaatagaattaaagcgattgacgattgtgttaatttaacaattggacaacccgattttcctatgccagatgtggtcaaaaatgcttatatcaaagcaatcaaaaacgataaaacaagttattctcataacaaaggtttatttgaaacacgcgaagctattagccaatattttaaacgaaaatataatttcctttatagtgaggaagaaatcatcgttactaatggtgcgagtgaagcattagatacatcgttaagaagcattattgagcctggcgatgatatacttattccaggaccgatatacgctggttatatcccattagttgaaactctaggtggaaatccagtatatatagataccacacaatcagattttaaagtaacacctgaactgattgagtcgcatctaacgcataaaactaaagctatacttctaaattaccctaccaacccaacaggtgtaatactcgaacgctctgaagtcaaaaatatagtagacacacttgtaaacaaacacatttttataatcagtgatgagatttatgctgaaaatacgtttaaaggacaacatacatcttttgctgaatttccagaaattcgagatcaattattacttataggtggtttgagtaagtcccattctgcaacaggtattcgaatcggctttttacttggtcctgaatatttaattgaaaaattaacctttatgcacgcttacaattgtatttgtgcaaatgtaccagctcaaattgcttgtactaccgctttaaatgaagggataaatgcccctctatacatgaatcgtgattatatcgaacgtcgtaattacctgaaagaaaaattagaatcattaggcttcgaattaactgctcaacctgaaggcgcattttacatcttccctagtattaaaagatttacggaaaacgattttgaattttgtgttgatgtgttggagaaagcacacttagctatggttcctggttcttccttcaccgatattggcaaagggtatattcgaatttcatatgcttatgatatggaaacattaaaaaaaggaatgcatcgattagaaaattatttacagcaacattatccagagcaaatgaccactccaactaaataa

SEQ ID NO: 887 - DNA, 300 bp, Staphylococcus epidermidis; identical to SEQ ID NO: 233

SEQ ID NO: 888 - DNA, 351 bp, Staphylococcus epidermidis
gcaattataccacatatgactccattaattgtcaatggtatggctataattaaatgctttaagtacacaggaatcatcattttagcagcacctatgagtaataccacgttaactccaagagaattaactcttaaagatccaaataaaaaggttacacaagctgcaactattcccatatttgcagcaccacttcctaaaccagtaaggttaattgctgttgctatagcaactaacgagattggagttaccattaataaagaaaatgttacacaaattaatatagacattaataatggatttaattctgtaaacctgtttactaattttcctagtgactgcgtaataacttga

SEQ ID NO: 889 - DNA, 294 bp, Staphylococcus epidermidis; identical to SEQ ID NO: 235

SEQ ID NO: 890 - DNA, 240 bp, Staphylococcus epidermidis
ctacggatcaagaggttatgggttcgactcctatcgggcgcgcttattttacgggaagtagctcagcttggtagagcacttggtttgggaccaaggggtcgtaggttcgaatcctgtcttcccgatagtaaaataaattttgggggcttagctcagctgggagagcgcctgctttgcacgcaggaggtcagcggttcgatcccgctagtctccaccaatattaatttacaaactacataa

SEQ ID NO: 891 - DNA, 1080 bp, Staphylococcus epidermidis
tgttttaaatggaggtttaacatgagtcattcgcaaataaatggaaagcgattttttaacaacattttgaatgcagtaggagcaggggtagttattgcactgttacctaatgccttattaggtgaattattaaaattcttcaaagaaggtaatcatgtactagaaacgatttttcagctagtaacaatcatacaatcttttatggcttttattataggggttcttgctgcgcaccaatttaaatttaaaggtacaggtgctgcaattattggtatttcagcaatgctaggttctggagctgtacactataatggacaaacaattgaattaaaaggaattggagatattataaatgtaattttagtagttatattagcgtgtttcatttatatgtttttagaggggaaattaggttccttagaaatgattattttacccgttttagttcctgtaattagtggattaatagggttattaacattaccttacgttcaagttattacgcagtcactaggaaaattagtaaacaggtttacagaattaaatccattattaatgtctatattaatttgtgtaacattttctttattaatggtaactccaatctcgttagttgctatagcaacagcaattaaccttactggtttaggaagtggtgctgcaaatatgggaatagttgcagcttgtgtaacctttttatttggatctttaagagttaattctcttggagttaacgtggtattactcataggtgctgctaaaatgatgattcctgtgtacttaaagcatttaattatagccataccattgacaattaatggagtcatatgtggtataattgcttatattttaaaaattaaagggactgcactatctgctggctttggttatactggattggttggtcccatcaatgcattaaaccgtatgtcgggaaatccatctatgaatattattttattaattattggatatttcgtgataccatttgcaggtgcctttattgtacacaaaatttgtaaaaaagtattaagtacatacagtgatgaaatatataaatttgaaatctcaaaagattaa

SEQ ID NO: 892 - DNA, 936 bp, Staphylococcus epidermidis
tcacatattttatcagtttatatatataatttaattgtaacaactgttattaaaaaaataaattttataatttttggaggttatcatatgaaaaagagatttttatctatatgtacaatgacaattgcagcgttagcaactactacaatggtaaatacttcttatgcaaaaaccgatacagaaagccataatcattcctcacttggcacagaaaacaaaaatgttttagatattaatagttcgagtcataatatcaaaccaagtcaaaataaaagttacccaagtgtaatattacctaataataatagacatcaaatttttaatactacacaaggtcattatgatgctgttagttttatttatataccaatagatggtggatatatgagtggttcaggtgttgttgtaggtgaaaatgaaatattaactaataaacacgttgttaatggagctaagggtaatccaagaaatattagtgtccatccttcagctaaaaatgaaaatgattatcctaatggcaaatttgtgggtcaagaaatcataccgtatcctggtaatagtgatttagcaatcttaagagtgtcaccaaacgaacataatcaacatattggtcaagtagttaaacctgcaactataagtagcaatacagacactagaattaatgaaaacatcactgttactggttaccctggtgacaaaccattagccacaatgtgggaaagtgtaggtaaagttgtctatattggtggcgaggaattaagatatgacctaagtactgtaggtggaaactctggatctccagtatttaatggtaaaaatcaagttattggaatacattatggtggcgtagataataaatacaatagcagtgtttatattaatgatttcgttcaacaattcctaagaaacaatatacctgatataaatattcagtaa

SEQ ID NO: 893 - DNA, 207 bp, Staphylococcus epidermidis
ctgtgttggctttctaacccgcaccacttatcgtggtgggagacagtgtcaggcgggcagtttgactggggcggtcgcctcctaaaatgtaacggaggcgctcaaaggttccctcaaaatggttggaaatcattcatagagtgtaaaggcataagggagcttgactgcgagacctacaagtcgagcagggtcgaaagacggacttag

SEQ ID NO: 894 - DNA, 747 bp, Staphylococcus epidermidis
aagagggtatcgctcatgattgaattgtctcatatccataagtcttttaatgaaactgaagtgattaaaggtattgatttgaaaattaatcaaggtgaagttgtgacactaattggacgttcaggttcaggtaaaacaactttacttagaatgattaatgctttagagatacctactgaaggtacagtgtatgttaatggcatgacatataacactaaagataagaaatctcaaattaaagtaagacaacaatcaggaatggtttttcaaaattataatttatttccacataaatctgcattagaaaacgttatggaaggtcttataacagttaaaaagatgaataaagcaacggctaatgaagaagcaatgaatttattggctaaggttggattggtacatgttaaagatcaacggccgcatgctttatcaggagggcaacaacaacgtgtcgcaattgctcgtgcattagccatgaatcctaaagtgatgttatttgatgagccaacatctgcacttgatcctgaattggtcaatgatgtattaaaagtcattaaagaattggctgacgaaggtatgacaatggtcattgtgactcacgagatgcgttttgccaaagaagtttccaatcaaattgcttttattcatgagggcgtcattgcagaacaaggtacgcctgaagatatatttaatcaccccaaaacagaagagcttcagcgatttttaaatgtgattaatgaaaaatag

SEQ ID NO: 895 - DNA, 828 bp, Staphylococcus epidermidis
gaagacatgttcaagaacaacaaaagtattgaagatacttatgcaacaaaacctattattcagaatatcgttggtcaggcacaaatcaaacaagtgatggcgaaacaaacacccatgagatatacgttgaaagctatcatggctggttttctattatcaatagttacagtttttatgttagcaattaaaacacaattcgcttcaacgcataatgacgggttaatcaatttgatgggagctattgcgtttagtttaggtctcgtattagttgtgttaaccaattctgaattattaactagtaattttatgtatctgactgttggttggtattataaagcaattagtgtaagtaaaatgatatggatttttattttctgttttataggtaatatcttaggtggatttattttatttttcctcatgaaatatgcacatgttatgacgccagaaatgacagatagtttaacagcattagtacataaaaaaacagtagaatcgacttggttaaatattttgattaaaggtatattttgtaatttctttattaatatcggtatttttatttcaatgcagtttaaagagggactagccaaagcattctttatagcttgtggagtgattgtctttgtatttatgggttacgaacacgttgtttttaacgctggattatatgcaggtatgatgttctttaatatggatggattatcttggttgggtgtgctaaaaaatattgtttttgcattccttggaaactatatcggtggaggtatctttattggattagtgtatgcatatttgaacggtaaacgtgacagcctccaaccatag

SEQ ID NO: 896 - DNA, 216 bp, Staphylococcus epidermidis
taccttcatacttttctaaagaaaccaggttcagcgaatggtattgtatccatgatgggaggaataggcggtttcttcccaccactggtgattacttttgtaacgagtatcactggttcaagtcatctcgctttcttcttcttggctatatttggtgtaattgctcttattacaatgattcatttaaataaaaaagagaaagctattcgtatataa

SEQ ID NO: 897 - DNA, 471 bp, Staphylococcus epidermidis
gcgactttaacaagggatcattacatgtatgtagagaatagttatttgagcaaacaattatgttttttattttatgtttcctctaaagaaatcatcaaaaaatatacagattacctaaaagagtatggtcttacatacacaggttatattgtattaatggcgatagaagatgatgagaaacttaacattaaaaaactaggcgaaagagtcttcttggattctggcacgctgacaccattattaaaaaaattagagaaaaagaattatgtcattcgaactcgtgaagaacaagatgaacggaaccttcaaatttctttaacagaacgtggcaaggatattcaaaatgttctatctgatatttcacaaagtgtttttaatgaatttaatattactcaagaagaaacccaaaatttagttgaagacttgcaaaattttgtaacgaaaaattttgataaaacagtggaaaagtga

SEQ ID NO: 898 - DNA, 201 bp, Staphylococcus epidermidis
acgcgatctgcgtcatataataaaacacctaaatatctcatacgtcctgtacaagtttcggaacaaacagttggcataccagcttcgattcgtgggaaacaaaatgtacatttttcagctttattcgttttccagttaaaatatacttttttatacggacatccagtcatacagtatctccaacctcgacaggcttcttga

SEQ ID NO: 899 - DNA, 951 bp, Staphylococcus epidermidis
tggagatatttacttatgtctataacttatcctggcacagtttatctaatcggtgcaggaccaggcaatccaaacttattaactaaaaaagctgaacggttaattagatcagctgacgtgattttatttgatcgtctcgtaaatcctttcatcttacagtatgcttcttctcaaacaaaagtgatcaatgtgggaaagaaaccttattgtaaacacattcaacaagaggagattaatcaaaaaattgttgaagcagccaatcaatatcaatgtgtggtgagactgaagggtggagatcctgcgatttttggtagaattacagaagaagtacaaacattagaagatcatcatattcattacgagattgtccctggtgtgacatcagcaagtgctgccgtagcaactatgaatatgggattaacaatgcgttctatcgcaccgagtgtgactttctcaactggtcattttaaagattcggttaatcacgatatggatattaggaacttgattaatggaggcactttagctatttatatgggtgtgaaaagattaggtcaaattattaaacaaattgaatcgtatacgaatgaagactaccccattgcaatagtgtttaatgcttcctgctacaatgaaaagattgttataggtcatttaagtacgattgaagaacaattggtttctcaacaactagaaggtcatccaggcatatgcattttaggtaatatacttgatgacattaatcgtacgttattgaataataataagaatgacaaggggaatctatatttaattaagggagataaagaacgtgcaattgcaaaggctgaaactttatatgatgaaggaatccaatgtctgattgattttgaccatagctaccacatttctcaacaaaacgtgtataacgaaatgattaaacataagagtattaaaacaatatatgtataa

SEQ ID NO: 900 - DNA, 639 bp, Staphylococcus epidermidis
agaagagaatatgtattaatcgttttaggaaaaggagaaacgatgaaaaaattaatcggattattgatgattttatgtatggttttgctatacagttgctcaggtccaatggactctccaaagcattctaataatagcaaacctgtagtggtaatatacggtgattataagtgtccttattgtaaaaaaacagaagatcgcgtgatgccaaagcttaagaagaagtatattgatacaaacaaaattaaatatcaatatgtgaatttggcattcttaggaaaagattcaattgtaggttcaagagcgcagcatgcggtaaatcattatgctcccaagaagtcacttgaatttcagaaattaatgtttaatcaacaaaaagatgaacataagcaatggattacaacacgtcttgttgataagcaaattgataaattaagtatcagtgatgacaaaaagaaaaaaataaagactgattataaaactaaaggttccatctcgtggaaaaaagccaaggaagatcaacaaattgcgaagaaaaatcacatcaagcaaacacctacagcgtttgttaatgataacaaggttgaagatccatatgacttttctagctacgagatgttgctagaaaacgaaaagtga

SEQ ID NO: 901 - DNA, 312 bp, Staphylococcus epidermidis
tcgggtatacaggttttggaatttttaaagagtcgattttcaccattaagtgatggtttcaatgaacaagatttagaagaatacagactagacatattagaagttgaagatgtaatcgatgttaataatattaaaggtagatatcatggaagtagtatctttatagatgtgaccatggtagtagatcgttatctttcactttatgaagcacatcagatttgtgataaagttgaaattcatttgcataataaaggaatttcgtctgtatatgaacatccagaaccctatagtacaaaagacgaagtaaaataa

SEQ ID NO: 902 - DNA, 189 bp, Staphylococcus epidermidis
tgtaattcacatttaaaattaaaatcggggatttccctaatggcatggatatggttttctaggatgaaattgaggccaaaattaaaatatattattaactattttataatatatgttgcaattgaaattacactttacgctgtcattttaaaccacaaactattttataatgagctgcattcattatag

SEQ ID NO: 903 - DNA, 714 bp, Staphylococcus epidermidis
atacttataaagcgcaaggaagtcaaggttacggtggagagtactttggctctaattgtgaaggttgtggtgttgcagttcaatcaggtaaaactggacaagaaatttataatgaaaatttctatggagggatcttccgtgattaaccttgaacaattaagtctataccaagatagcttaggctatcttggtcaacaaatgaattttccagaaaaaatgacatttcatccaaaaatatttgaagaaactatttctaagtctcaccccggctacgaagatttgcttgcatatagagaagtcatgatgaattatactttgtcagaaattaaagctatctatacagatacatttgattttagtaaaaaacacccactctatatgacatttaataaatttgacacgcaaaaggaacggggtcaaatgctagctaaattaaaggttttatacgaaatgtttggactaaaaatggttgataatgaattatctgattttctcccattgatgctacagtttttgcaagttgctgattttaaaaatgatagtcgagcacaggaaaaccttcaacttgtcattatgattattgaagatggtacgtatgaaatggcaaataccctagctgaaaacaataatccctatgcatatgttgtcagtgcattaagaaaaacgttaaaagcgtgtatcgtgcctttgaaagaggtggaaaatcatgcttaa

SEQ ID NO: 904 - DNA, 2409 bp, Staphylococcus epidermidis
agtatggcaaaacaaaaacttgtaatgattggtaacggcatggcagggttaagaacgatagaagagattttagaacgttcacaatcacaatttgatattactattattgggaaagaaccttatccgaactataacagaattatgctatccaatattttacagaagaaaatgactgtcgaagatacaattatgaatccttatgattggtatcaagagaataatattgaacttataaataatgatccagtggaaaaagttgataaagaaaacaaaatagttactacttctaaaggtattgaagtagagtatgacatttgtattttcgctactggatcaaaagcttttgtgttacctataccaggttcaaaccttcctagtgtcattggatggcgaacaattgatgatacaaataaaatgattgaaattgcccaaacgaaaaaacgagcagttgtcattggtggaggtcttctaggcttagagtgtgccagaggacttctagatcaaggaatggaagtgacagttcttcatttagctgattggctcatggaaatgcaattggatcgtaaagctggagaaatgcttaaagcagatttagaaaagcaaggtatgaagattgaacttcaagcaaattctaaagaaatcattggtgataaagatgttgaagccattaaattagctgacggtcgggtgattgaaacagatttagtagttatggctgttggtatcagaccttatactgaagttgctaaagatagtggattagatgtcaatagaggtattgttgtaaatgattatatgcaaacatctgattctcatatttatgcagtcggtgaatgtgccgaacatgatggtaaagtttatggattggtggcgccactttatgaacaaggcaaagtgctagcagattatttaactggtaaagaaacaaaaggttataaaggatctactactttcacttcacttaaagtatctggttgtgatttatatagcgcagggcaaattgttgaagatgaagatattcatggtgtagaaatttttaatagtgtagacaatatctacaaaaaagtgtatttaagtcatgggcaagtcgttggtgctgtcttgtatggtgatactgatgatggatcacgattttataatatgatgaaaaaacatgaaacgcttgaagattatacacttgtttctttattgcataaaggtgatgaagatgcggggacatctatcgctgatatgtctgatgatgaaacgatttgtggatgtaatggtgttgataaaggaacaatcgtcaatgctataacaactaaaggtttaacgtctgtagatgaagtgactaaagcaacaaaagcaggtaattcatgtggtaagtgtaaaggtcaaataggtgagttattacaatatacattaggtgacgactttattgctgcaaaaccaacaggtatttgtccatgtactgatttaacaagagaccaaattgtaactcaaataagagctaaaaatctcaaatcatcaaaagaagtacgacacgttcttgatttcaaagataaagatggttgtcctaaatgtcgacctgcaattaattattatttaaatatggtttatccttttgaacatagagacgaaaaagattctcgcttcgctaatgaaagatatcatgcaaatatacaaaatgatggtactttctcagtgattcctcaaatgcgcggtggtgttacagatgctgaccaacttattcgattaggagaagttgctaaaaagtataacgtaccacttgttaaagtaacaggttcgcaacgtgtaggtttatatggattgaagaaagaagaattaccacaagtttggaaagatttaggaatgcgttctgcttctgcttatggtaaaaagacgcgttctgttaaaagttgcgttggtaaagagttttgtcgttttggtacacaatacacaactcgactaggaataagacttgaaaaaacatttgaatatattgatacacctcataaatttaaaatgggagtatcaggttgtccgagaagttgtgtagagtctggtgttaaagattttggcgtcatatctgttgaaaacggctaccaaatatttatcggaggtaatggtggtactgatgttactgtaggtaaattgttaacgacagttgaaaccgaagatgaagtgattcaattatgtggtgccctcatgcagtattacagagaaacaggtgtttacgctgaaagaacagcaccatggttagaacgtatgggctttgaaaatgtcaagaatgtcttattaaatcaagaaaagcaaaaagaactgtattcaagaattatggaagccaaaaaagctgttgagaatgaaccatgggaaactattgttgaaaataaagaagcacaaaaaatctttgaagttgagaaggtgtaa

SEQ ID NO: 905 - DNA, 549 bp, Staphylococcus epidermidis
ggagtgaaaaatatgtcgaatattaatattagagtggcacatgaacaagatgctgaagaattacatagcatcatgcaaattgcttttacacctttaagagaactaggtattgattggccatcagttcacgctgatcttgaaatggtaaaggataatttaagacaaaatactacatttgtacttgaaaatgaaaaagaaattatttcaacgattacggtttgctatgcatggagtagtgtaaaacccatttcaggttatccgttcgtttggtggtttgcaacacgaccaacttatgatggacaagggtatgggagtcaacttttaaaatatgtagaggagacatttttacgcgatactttaaaagctgctgcggtaaccttaggaacatcagcacgtttgcacccttggttattaaacatttacgaaaagcggggttatgaaatatacgctaaacatgaaaatgatgatggtgatttaggagtcataatgcgtaaaattttaataccagaacaatttaatgatgacattttgggccgaccgccattttag

SEQ ID NO: 906 - DNA, 1146 bp, Staphylococcus epidermidis
attaaaatgaacatgaaaaagggtgtttctcagcttacgttacagacattgagtttggtcgcaggctttatggcatggagtatcatttctccattaatgccatttatttcacaagatgttgatatttctccaggacaaatatctgtcattttagctattcctgttattttaggttctgtactacgtgtaccatttgggtacttaactaacattgtaggagcgaaatgggtgtttttctggagttttattgtactattacttccaatttttcttttaggtcaagctcaatcacccggtatgctaatgttatcaggattctttttaggaattggtggcgcatttttttcagtaggtgttacttcagtacctaaatacttttcaaaagacaaagttggtttagcaaatggtatatatggtgtaggtaatattggtactgcagtttcatcattttgtgccccagtgttagcaggtgcaattggctggcaaaatacagttcgtagttatttaattattctaagtatatttgcaattttaatgttttttttaggagataaaaatgagccgaaagtgaagattcctttgatggctcaagtcaaagacctatctaagaattataagttgtattatttaagtttgtggtattttattacttttggagcttttgtggcttttgggatttttttaccgaactttctagttgatcattttagtattgataaagtggatgcaggtattcgttcaggtatatttatagcactagcgacgttcttaagaccggttggtggtgttataggtgataaatttaatgcagtacaagcgcttatcatcgacttcgtgataatgattattggtgcgcttatattaagcttatctagtcatattgttctgtttacgataggctgtttagcaattagtatctgtgcaggtataggtaatggtttaatatttaaattagtaccttcatacttttctaaagaaaccaggttcagcgaatggtattgtatccatgatgggaggaataggcggtttcttcccaccactggtgattacttttgtaacgagtatcactggttcaagtcatctcgctttcttcttcttggctatatttggtgtaattgctcttattacaatgattcatttaaataa

SEQ ID NO: 907 - DNA, 693 bp, Staphylococcus epidermidis
aagaggtggaaaatcatgcttaatcaatttgtatgggttatttatccatatttatgtttagcaatatttgttattggacatatcgcaagatataaatatgatcaattttcatggacagcaaagtcgagtgaaatgattgaaaagaaacgattaaaatggggaagtttactttttcatttaggtattattccggtattctttggtcatgttgtgggattattgattcccgctaattggttagaggcgataggagtaaataatcatatctatcatataggtgcagtttatataggtagtgtttttggtataataacattaataggaatgttgttgctaactttaagacgactatccatcaaaaacgttagacgattaagttcattttcagatatatttgtgaatatcgttttgttgattattttaataatgggttgttattctacgcttgtaaccaatgcgattcaacctgaatttgattatcgtcaaaccattgcgatatggtttagacatttattcatgttttctccaaatgctgacttaatgttaaacgtgccttggtcgtttaaactgcacatattattagggtttacagtgtttgcgtgttggccatttactcgtttagtacatgtttggagtgtaccactgtcttatatgaacagaagatatattgtttatcgcaaaaacaaaatttaa

SEQ ID NO: 908 - DNA, 243 bp, Staphylococcus epidermidis
atgaattgttgccacaggctgctaaaacaaaaacaagtgcaacaatgcaaagtaaaagtcttttcatttaatcaaaccccttattcttattattctaatcggaataaaaatattttatcccgttattacataatagtcaataaagagttacttgctaacaagtgttcagaaagttcaaactctattaactattattttaaactatttacaaatcgtaataattactatttacaaataacttaa

SEQ ID NO: 909 - DNA, 789 bp, Staphylococcus epidermidis
atgaaaagacttttactttgcattgttgcacttgtttttgttttagcagcctgtggcaacaattcatctaacaataaagataatcaatcaagcagtaaagacaaggatacgttaagagttggtacggaaggtacatatgcgccctttacttaccataataaaaaagatcaattaacaggttatgatattgatgtgattaaagcagttgcaaaagaagaaaatcttaaacttaagtttaatgaaacgtcatgggattcaatgtttgcaggattagatgctggtcgttttgatgttattgcaaatcaagtgggtgtgaataaagatagagagaaaaaatataaattctctgaaccttacacatattcaagtgctgtacttgttgttcgtgaaaatgaaaaagatattacatcattcaatgatgtaaaaggtaaaaagttagcacaaacgtttacgtctaattatggtcaattggctaaagataagggtgcggacattactaaggtagatggatttaatcaatcaatggacttactattatctaaacgtgtagatggtacatttaacgacagtttatcttacttagattacagaaaacaaaagcctaatgctaaaattaaagcaatcaaaggacatgcagaacaaaataaatcagcatttgcattctctaagaaggttgatgaaaaaacgattgagaaatttaataaaggcctagaaaaaattagagataatggtgaattagctaaaattggtaagaaatggtttggtcaagatgtttctaaacctgaataa

SEQ ID NO: 910 - DNA, 327 bp, Staphylococcus epidermidis
gaaggtgtaagaatgaaaggtaaagaaaaggttaaagttacaacaatgaatgaaatgattcctcaaataggcaaaaaagtagttgtaaacgaaaaagaaataggtatttttcttacagataatggtgatttatatgccattggaaatatatgtccacataaagaaggaccgttgtctgaagggactgtaagtggtgattatgtttactgtccgttacacgatcaaaaaatagctttaaaaactggagaagtacaacaacctgatacaggatgtgtagaaacatatgaagtagaagttattgatggagatatttacttatgtctataa

SEQ ID NO: 911 - DNA, 711 bp, Staphylococcus epidermidis
attatagaaaggaagtttttatttatgccaaaattaatactatgtcggcacggacaaagtgaatggaatgcgaaaaatttatttacaggttgggccgatgtcaaactatcaaaacaaggaattgaagaggcgcaatcagcaggtaaaaaaatttacgacaatcaaattgaaattgatattgcgtttacctctttactcactagagctttagaaacaacacaatatattttagcaggttctgaccaacagtggattcctgtttataaaagttggcgtttaaatgaacgacattatggtggtttacaaggtttaaataaagatgatgcgagaaaaaaatggggggaagatcaggtgcatcaatggagacgctcatatgatgtacgtccgcctagagaaagtgaagaacaacgagaagcatatttaaaaaatcgtcgttatcaacatattgatcaccgtatgatgccttattgtgaaagtttgaaagatacattagaacgagttgttccgttctggactgatcatatttcacaacacctattagatgataaaactgtacttgtttcggcccacggaaattccattcgcgcattaattaagtatttggaaggtttatcagaagaagatatcgtcggatatgaaattaaaacgggtgcaccgctagtatatgaactcacagatgatttagttgttaaggataaatattatttataa

SEQ ID NO: 912 - DNA, 1362 bp, Staphylococcus epidermidis
aattcgttgagagtttacaaatataatcatgccaaatgtatttatatttactacataattacatttttaaatatctcaaataattcatatttagagaggatttcatttatgaaaaaattgattactcttattgtcatgatatcttttgttttagcgagctgtgggggcacatcaagtacagacaaagacaccctcaatgttgaaatacctttgaaaactaaatcaattgcaccttacgaaactgatatcccagttaaaacaggtgccttggaatcgctttttaaaatgtcgaagaatggtaaagtaaaacctttattagtcaaaaattatcatcaagtatctgacaatcaactagaactcactttaaaagataatattaaatttcaaaacggtcatcatttaacaggcgaagctgtaaaacgcagtctcgaagaaggaatgaaaaaaagtgatttgttaaaaggatcacttcctattaaatcaatcaatgctcatggacaaaaagtcacaatcactactaaagaaccttatccagaattaatgtctgaactcgcaagcccatttgctgctatttacgacacaaaagctaaaaacaaagtaactgatcaacctgttggtacgggtccttataaaattgatcagtataaacgttcgcaaaaaatcgtactaaaacaattcaaagactactggcaaggtacgccaaaattaaaaagaattaatgtcacttatcatgaagatggtaatactcgtgttgatcacttattatcaggcaaatcagatttgactactgatgttccaattgaacgcgttgatgatgtaaaaaaatctaacaaagcaaacattcaaagtacatcaggctttagaacgcatttaatgttatacaatcatgatagtaaaaaagttaataaaaaagtaagagaagcactagatatgattattaatcgaaaagacattgctaaaaatgtttctaaaaattatgctgagccagcatcaggtccttttaaccatcgattaaaatcattagaaaaagaggaaattcaatcacaagacatcaagcgtgcaaaagaacttttagctcaagaaggttattccaaatcgcatcctcttaaattaaacatggtcacatacgatggcagaccagaattgcctaaaattggacaggtgatacaatctgaagctaaaaaggcaaatgttgatatacaattacgcaatgtagatgatatcgaaggatatctcaaaaacaaacagagttgggatgtttcaatgtatagttatttaagtgtgccacgtggtgatacaggttatttctttaacactgcatacttacctgatggagcattaaataaaggtaattataggtaa

SEQ ID NO: 913 - DNA, 375 bp, Staphylococcus epidermidis
gtaggagtgagtatgttgaagaagttattagtcggggttagtgtactaactttattattagcaggttgcatgagtcacgagtacgcagacaaaatagataaagcggttaaactacaagagaaaaagcaacaaaaaattgctaaaaacgattcaggtgatgaagttaaacattttgataaaaaagatgccaatatttatgtgtttgacaaaggaaaatatgttgtattggagtataaaccacttagtgatgatgctgaagcgcgttactatacttatgaatttaaagataaaaaagcatattataataaagactttaatgcaaaagcatactaccaatctcatgagcctgactataaagaagagaatatgtattaa

SEQ ID NO: 914 - DNA, 480 bp, Staphylococcus epidermidis
ggtacatatatgacgatagaaaaaaagaaaaataagattatttttactagaacttttagtgcaccaattaataaggtatttgatgcttatacaaagcgggaactatttgaacaatggtttcatcctcaagacgcatctgtcacagtttatgattttaatgctacgaaaggaggaaacgctttttatgctattcaagctcctcagatgacaagttatactattgctgaatatctgcaagtggatgcaccatattatatagagtatttagactattttgctacgtcaaaaggggaaaaagacacaagtatgcctggtatgcatatcactttgaattttgaagaagtaaaaggaaagactactgtaacatcgacatcgacttttccaactgaaagtgccgctcagcaagcgatagacatgggtgtagaaacaggtatgaattcaacacttaatcagttagagaaattactaaatcaaaagtga

SEQ ID NO: 915 - DNA, 1044 bp, Staphylococcus epidermidis
gtggtaaatatgttggagcaaactgatttaagtttagagcaattacttaagaattattatgaaaccacgaacgagaaaattgtatttgttaatagacaaggcaaaattattgctatgaatgacgcagcaaaagatattttaactgaggaagataattataatgctatgacaaatgcgatttgtcatcgatgcgaaggatactctaatgaatatgatgtacaatcgtgtaaagattgttttttagagacaacgcaattacaacattccaatttccaagtatttatgaagacaaaagataatgaaattaagccttttacagctatgtatcaaaatattgatgaacaaagaggtattagtgcatttaccttacagaatgtggcgcctcagattgaaaggcaagaaaaaatgtatcaacaaaaaatgttacatcgttcaattcaagcacaagaaaatgaacgaaagcgtatttctagagaattacatgatagtgtaatacaggatatgctcaatatagatgttgaactaaggcttttgaagtataagcacagggataaggtgttagctgaaacatctcaacgtatagaaggcttattatcacagcttattgatgatattagaaatatgtctgttgaattaagaccttcttctctcgacgatttaggcattgaagcagcttttaaatcatattttaaacagtttgaagaaaattatggtatgcatattaaatatgattcgaacattaaaggcatgcgttttgataatgaaattgaaacagttgtgtatcgtgtagttcaagagggtgtatttaatgctctaaaatatgctgaggttaatgaaattgaggtaagtacgcatagtgatggcaagcagcttgtagcagaggttgtggatcgaggtaaagggtttagtttagatcatcaccctaaaggctctggacttggattgtacggaatgagagaacgtgcagaattagttaacggtcatgttaatatagagacacatattaatagaggtactataattacattagatataccgatttaa

SEQ ID NO: 916 - DNA, 1257 bp, Staphylococcus epidermidis
agaaatataatgaaatttgtaaatttaacttctgaagaattcgagcaatttacttcagaaaatttctcgcattatacacaatccagtatacattataataatagatcgaaaacaaaaggtgacgtacatttagtgggagttaaagatggtcaagaagatgtcattgctgcgtgcttattaacagaggcacgttctttaaaattctttaagtatttttacacacatagaggaccagtcatggactttaacaatttagttttagttcgcttcttttttaaatcacttactgcttatttaaaaaaacacaattgtttatatgtactcgttgacccttatgtattagaaaatttacgtcaacctaatggagaaatcattgaatcctttgataatcgcgcattgattaaaacaatggaagaattaggttacaaacaccaaggatacactgtaggttatgatacaatgagtcaaatccgctggttatcagtacttaaccttaaagataaatctgaagatcaattattaaaagaaatggattaccaaacacgtcgaaatattaaaaagacttatgaaatgggtgttaaagttaaaacattacccattgaagaaacaaatacattttttgaattattcaaaatggctgaagaaaaacatggctttaaattccgtgaagagccttactttgttgagatgcaaaaaacttatgaagatcatgctatgttaaaacttgcttacatcgatttacaagattatttagatacgttgcaaactaaacatcaaaaccttaatcaacaactaaaagatgttgaaaaaacattagaagaaaatccaaattctaagaaaaataaaacgaaacatacacaagtcaaacaacaattcgatagtaatgcgcgtaaaatcagacaaactaaagagaaaatagcagaagaaggtcaagttcttcatcttgctgcagcattatatatatataatgatcacgaagtgtattacttatcaagtggctctaaccctaaatataatgcttatatgggagcatatcgattacaatgggatatgattcaatttgcaaaagaacataatatcgatagatataatttctacggtgttaccggagactttagtgaaaatgctgaagatgctggcgttcaaaaatttaaagaaggatttaacgctaaaatttatgaatatattggtgattttatcaaaccaattaaaccactattttataaagtaaaacaagaattagaaagtcgtagataa

SEQ ID NO: 917 - DNA, 759 bp, Staphylococcus epidermidis
ttattcgtaataatgataatacaaaagggtgggataattatgataggtaatattctagtcgctcacggcatgagaaaaggaaatcagaatgaagctttagaagaatttatcggaactttattaaaagatgagcaatattattatgagttagcatttttagaaagtgaaacacaaaatcttgaaatcataatggagaagatgattaagcaaggaattacaaaatttcgtattgtacctttactcatttttagtgcaatgcattatatcagtgatattccacaaatacttaaagagatgaaagctcgatatccacaaattgatagtaaaatgagtgcgcctcttggtacacatccatatatgaaaacattagtagaaaatagaattgctgatgaaaaagtcagtgaaggttcaaccaaagcaactatagtaattgcccatggaaatggaagtggacgttttacgaaagcacatgatgaattaaaagcatttgttaaaacgcttgatagtcatcatcctgtttatgcaagagctttatatgggacattagcatttaaaaatgatttagataaaatctcagagcaatatgacgagttagtcattgtcccattatttttatttgatggtagattggtgaataaagtaaaacgtcttttaggtgaaatgacattgcatagtcaattacacattacgccatcgattaactttgatccaattttaagattaattattagagaaagacttgaagcgttagatatttaa

SEQ ID NO: 918 - DNA, 1569 bp, Staphylococcus epidermidis
aggaggtcaattggcttgaagattaaagcgcaagttgcaatggtattgaatctagacaaatgtattggttgtcatacttgcagtgtgacatgtaaaaacacatggacaaatcgacctggtgcagaatatatgtggtttaataacgtagaaacaaaaccgggtgtaggatatccaaaaagatgggaagaccaaggacaatataaaggtggttgggtgctaaataaaaaaggaaagcttgaattaaaatctggtaacagatggtcaaaaattgctttaggtaaaatcttctataatccagacatgccactcattcaagattattatgaaccgtggacatataactatgaacacttaaccaatgctaaacaaggacagcactctcccgtggcgacagctcactctttaatttcaggtgatagattgaatcttaaatgggggccaaactgggaagatgatttagctggaggtcacattacaggaccagaggatccaaatattcagaaaatagaagaagatattaaattccaattcgatgagacatttatgatgtatttaccaagactatgtgaacactgtttaaatccaagttgcgtagcatcttgtccatcaggagctatgtataaacgagatgaggatggtatcgtactcgtcgatcaagaagcctgtcgaggttggagatactgtatgactggatgtccgtataaaaaagtatattttaactggaaaacgaataaagctgaaaaatgtacattttgtttcccacgaatcgaagctggtatgccaactgtttgttccgaaacttgtacaggacgtatgagatatttaggtgttttattatatgacgcagatcgcgttcaagaagcggcttcagctaaagatgaaaaagacttatacgaaaaacaattagacctattccttgatccatttgatgaggaagtcattgcacaagctgaaaaagatggaataaatcaagaatggattacagcagctcaaaactcaccagtgtataaattggcaatagaatataaaatggcctttccattgcatcctgaatttagaactatgccgatggtgtggtattgtccacctttaagtcctattatgagttatttcgaaggtgaaaatgcaggtcaaaatccagatatgattttcccagctattgaggaaatgcgtttacctattcaatacttagcaaatttattaactgctggcgacacaaaacctgttaaagagggcttacaaaaaatggcgatgatgagaagttatatgcgttctcaaataacaaaccaacctttcgatacttctaaattagaacgattaggacttactgaaagacagatgactgaaatgtatcgcttactaggtattgctaaatatgaagatcgttttgttgtgccttcttcccataaagaaacatatttagatacttataaagcgcaaggaagtcaaggttacggtggagagtactttggctctaattgtgaaggttgtggtgttgcagttcaatcaggtaaaactggacaagaaatttataatgaaaatttctatggagggatcttccgtgattaa

SEQ ID NO: 919 - DNA, 537 bp, Staphylococcus epidermidis
gttgggggaattgaagtgaaaatagttatagcggatgaccatgcagttgttaggacaggattttcaatgatattaaattatcaagaagatatggaagttgttgcaactgcagctgacggggttgaagcttatcaaaaagtgttagaacatcgaccagatgttttaattttagatttgagcatgccgccaggagagtcaggcttaatcgcaaccagtaaaatttctgaaagttttcctgatactaaaattttaatacttacgatgtttgatgacgaagaatatttatttcatgtgttaaaaagtggtgctaaaggatacattttaaaaaattcacctgatgagcaattaatattggccgtacgtacagtatatcaaggtgaaacttatgttgatatgaaattgacgacgtctttagtcaatgagtttgtcaatcaatcacaaacggatgaagtgtcatcatcttcagatccatttaaaattttatcgaaacgagagttagaaatattacctcttatagcaaaagtgctatggcaataa

SEQ ID NO: 920 - DNA, 3780 bp, Staphylococcus epidermidis
tataatgactttgtgaaaaaatgtacaataaagataagacacaatacctatgcattgagaaaggatataaccttgtatggtgggaggattaataaaatgggaaaatttggattgaatttctttaaaccgacagaaaagtttaatggaaattggtcggtattagagcataaaagtcgagaatgggaaaagatgtatagagaaagatggagccacgacaaagttgtaagaacgacgcatggtgttaactgtactggatcatgttcatggaaagtatttgtcaaaaatggcgtaattacatgggaaaatcaacaaattgattatccaagttgtggacctgatatgccagaatttgagccaagaggttgtccgagaggtgcatcattttcttggtatgagtatagtccgttaagagttaaatatccttatattagaggtaaattattagatttatggaccgaagcgcttgaagaacaaaatggaaaccgaattgcggcatgggcatccatcgtagaaaatgaagaaaaagccaaacaatataaagaagcaagaggtaaaggtggacacgtcagagcaaattggaaagatgtcacagatatcattgcagctcaaattttatacaccataaaaaaagatggaccggatcgtattgctggatttactcctattcctgctatgtcgatgattagttatgcttcaggagcaagatttattaatttgttaggtggagaaatgttaagtttttacgattggtatgctgatttaccacctgcatctccacaaatttggggtgagcaaacagacgtgccagaatccagtgattggtacaacgcctcatacataatgatgtggggatcaaacgttccattaacacgtacacctgacgcacattttatgactgaagttagatataaaggggcgaaagttatttcagtagcacctgattatgctgagaatgttaagttcgccgatcattggcttgcaccacatccagggacagatgcagcggtagcacaagcaatgacacatgttattttacaggaatattatgaaaatcaaccgaatgatatgtttattaactatgctaagcaatattctgatatgccgtttgttattatgttagatgaagatgagaatggctataaagcaggtagattcttgcgtgcttctgatttagggatgtcaggtgaaaataatgaatggaagccagttattcaagacaaattgagccaacaattacttgttcctaatggcacaatggggcaacgctgggaagaagggaaaaaatggaatttgaaacttgaaacagaggatggtacaccaattgatccaatgttatcaatggttgaaagtgactatcatgttgaaacgattcaatttccatattttgatagcagtggtgatggtatctttgagagacctattgcaacgagaactattcaattagctaacggagaagaagttaaaattgctacggtttatgatttaatgacgagtcaatatggtgttcaacgttttgaacatgaactagaagctacatcttatgatgacgcatcttctaaatatactcccgcttggcaagaacaaattacaggtatcaaaaaagaattagtgacgaaagtggcaaaagaatttgcacaaaatgctattgatactggtggacgctcaatgattattatgggggctggtatcaaccattggtttaactccgatactatttatcgttcaattcttaacttagtactattgtgtggttgtcaaggcgttaacggtggtggttgggcacactatgttggacaagaaaaatgtcgaccaattgaaggatggaatactattgcatttgctaaagattggcaaggtcctccacgtttacaaaatggtacaagttggttctatttcgctacagatcaatggaagtatgaagaatcaaatgtagataaattaaaatcaccattagctgaaaatattaagcatcaacatccagctgattacaatgtaacagctgctcgtatggggtggttgccttcatatccacagtttaataaaaacagtctattatttggtgaagaagctaaagatgaaggtgatgattcaaatgaagccatcttacaaaaagcgattgaatcagttaaaaataaagatacacaatttgcgatagaagatccagatttaagaaaaaaccatcctaaaacattatttgtatggagatctaatttaatttctagttcagctaaaggacaagaatactttatgaagcacttgttaggtgcgcgctctggtttaatggcagagccaaatgaagatgataaaccagaggaaattaaatggcgcgaggatacagaagggaaacttgatttattagtatcacttgatttcagaatgactgcgacgccattatattcagatatcgttttacctgctgcaacttggtatgaaaaacatgatttatcttctacagacatgcatccatttattcatccatttaacccagcgatcgacccattatgggaatcgcgttcggactgggatatttataaaactctaagtaaagctgtttcagaaatggccaaagattatcttccaggtaaatttaaagatgtcgtaactacaccattaggacatgattcaaaacaagaaatttcaactgaatacggtattgtaaaagattggtctaaaggagaaattgaaggtgtgccaggtaaaacaatgcctaatttttctatcgtagagcgagactatacacaaatttacgataaattcgttactgttggtccaaaactagaaaaaggaaaaataggtgctcatggtgtgagttatagcgttagtgaagagtacgaagaacttaaaagtatggttggaacttggaatgatgataatactacttcagttaaaaatgatagaccgagaatagatacagcgagaaaagtagcagatgtcattttgaatatatcctctgctacaaacggcaaattatcacaaaagtcatatgaagatttagaaaatcaaacaggtatggaacttaaagatatttctaaagaacgtgcttctgaaaagatatcattcttaaacattacttctcagccaagagaagtgattccaactgcagtattccctggctctaataaagatggaagacgctactcaccgtttacaactaatgttgaacgtttagtgccatttagaacgctaacaggacgtcaaagttattatattgatcatgaggtattccaacaatttggtgaaagtttaccggtatataaacctactttacctccaatggtatttggtgctcgtgataaaaaagttaaaggtggacaagatacattagtgcttcgataccttacacctcatggaaaatggaatattcattcaacttatcaagataatgaacgcatgttgacattgtttagaggtggaccagttgtatggatttcaaatgaagacgcagctgaccatggtattaatgataacgactggttagaagtatacaacagaaacggagttgttactgccagagctgtaacatctcatcgtatgcctagaggcacaatgtttatgtatcatgcacaagataaacatatagagacacctggttctgaaattactgatactcgtggaggttctcataatgcacctactcgtattcacctgaaacctactcaattagtaggaggatatgcacaaattagttatcactttaactattatggaccaattggaaatcaaagagatgagtatgtagctgttagaaaaatgaaggaggtcaattggcttgaagattaa

SEQ ID NO: 921 - DNA, 462 bp, Staphylococcus epidermidis
ggtgaaagtgtggaaccagaatctttaaaacataatcaacatttacaaatgaatttagataagttgagagcacaagagggttatgattttggtggtatcgctttatatgattatcatcacacttcatcaccaattaaatggcaatatgtttcaggtaacacaaatgatagatataaacttatcattttgagaaagggtagagggcttgctggaatggtgatgaaaaccggtaagcgtatggttattgctgatgtagatacagctttatctccagaagagaaagttaaatttccaatcattcttagtgagtcattgacagctgtagttgcagtccctttatggttagaaaattcaatgtatggcgttttattattaggtcaaagaaatcatcagccgttacctcagtcattggaccaacttaatattgaaaaacaaatcggtatttttacagaaataaactag

SEQ ID NO: 922 - DNA, 750 bp, Staphylococcus epidermidis
ctaaaattggtaagaaatggtttggtcaagatgtttctaaacctgaataatgaacaacaacatgcattagatgcagccaaacaagcatttggtccaatgttagagggattggtgaaatactcaatccctattactttggtcactttcattctaggtttaatcattgcattgtttactgcacttatgcgtatatcaaccagtaaattgcttagaggtattgcgcgtgtctatgtatcaattattcgtggtacacctatgattgtacagttatttattattttttatggtataccggagcttggaagattggtaactaacaatgctgataatcaatggacacttgcacctgttattgctgcagtcattggtttatctttaaatgttggtgcttatgcttctgaaattatacgaggaggtatattgtctattcctaaaggacaaacagaagcggcttattctataggtatgaactatagacaaactgtgcaacgtattatcttaccacaagctattcgtgtatctataccagcactaggaaacacatttttaagtttaattaaagatacatcattacttggatttattcttgttgcagagatgtttagaaaggcacaagaagttgcttcgacaacgtatgagtatctaactatttatttgttagtagctttaatgtattgggtcgtatgttttatcatctcaattatccaaggatggtatgaatcacgcattgaaagagggtatcgctcatga

SEQ ID NO: 923 - DNA, 204 bp, Staphylococcus epidermidis
ttaaaggaattaaatactactttcggtgacaagcaacgtggtcaagtgactaatgaaatactaaatgaatctaaaaaagatattcctaacagctatatcacatacaactctcaaatagatggtgtgaataataaagtaagacattttaatgttacaccagaatctatctatttaattgattataaattaagtaaaaaagaataa

SEQ ID NO: 924 - DNA, 237 bp, Staphylococcus epidermidis
gctaatttatctttactcatcgaatataacattcttgttgaagcatacattcctgagttacctgctgataatacacttgttaatataacagcattcataaatgaagcagcaaaagctaatccagcattcttaaatactaatgtaaaaggtgaagtagctatactatcaccaccgcccattaatgccttactatcatatggaatcaacataccaataatgaaaatagctagaatgtaa

SEQ ID NO: 925 - DNA, 1704 bp, Staphylococcus epidermidis
agcttaatgttgaagttccatttgcgtttattactattaattagtactattacaatcattagttttattggtttaggcgctatcattcacaacacaatttatcaaacattaactagtaatcaaattaaaagcttagatagtgaagcccgtaattatgttaatctctttaataataataaagagaaagaaatcactaatatagctcataatgaaaaaaatatcatattaataaaagaaaaagataaagataaaattatttactcaagtggaaatattaaagatattgaccatagaattgataatgaagctaatccttcgaaattaatcaataaaaacacaaaactcggtatgcgttacacctataagaatacaatagatgataaaacaatatacataagtggaattaataatgaaattattgatttacaaaaggatttatggaaatacttgtctattgttggagtcattgtattatttacggtctatttagcaagtagaagtatcaatcgaacatatattagacctatcaatgaagtaacttatgctacatcacttctagcagatggatattaccatgttcgtgttccagaaagtaatgtgaaggaaactagggcattatttgtgactacaaatgacttagcacgacgattgcaaaaattaaacaatagtcaaaaaattcaatccaatagattaaaaactaccttagaaaatataccgagttcagtactgatgattgataaacatggagaaattgtagttgctaatcatgcttattatcaggtgtttaaccctgatcaaatggtagaaaataaaagttacattggtttcatagatgatagtattgaaaaattaattattgaaagttttagaactgaaaaagttatctatgaacaattagaagttgctattaataacgtacatactaaatatttcgatgtatcttgtatccccattttaactaaatctaaaaaaaatttacaaggtatggtggttgtgcttcatgacattactaatttgcagaaattagaaaaccttagaagggaatttgttgcaaatgtgtcacatgaactaaaaacaccgattacttcaatcaaaggttttgcagaaactctgattgaaggtgctaaaaatgatgaacaatcgcttgatatgtttttaaatattattttaaaagaatctaatagaatagagtcattggttacagacttattagatttatcacatatagaacagcaaaaagaacttgaaataaattacatgaatttatctgaattagctattaatataatagataatttgcaaacacaagcatacaataagagaatcaaaatacaatctgaaattgaaaaagatgtcatcattgaggcacatgaaaataaaatagcgcaagttattactaatttgctatcaaatgctataaattattcttcagaagataataaggtaatagtaagagtatatagaaatgacaataaagtttatttagagattcaagattatggtattggtataagtgaaacagatcaaaagcgtatatttgaacgtttctatcgtgtagataaagcgagaagtagagattcaggtggtacaggacttggtctgtctataacaaaacatattgttgaagcacataatggtagaatagacgtgaaaagtgcacctggcaaaggttcgatattcaaagttctatttaatgataattaa

SEQ ID NO: 926 - DNA, 249 bp, Staphylococcus epidermidis
aacaatacgccaatagcaattaaaataactactaatattgctaatatgataaataacaccatatacttctcctcctattttatcatcttacattataacgtaattttgtgcgtcgttaaatcacaaaatcaattaattgatagattatttttaaaagattatactaaattaaaaattgtagtaacgaggtatgacgatgacaaagaatattccaacaaattacaaactgatatcaaaacaacttgctag

SEQ ID NO: 927 - DNA, 507 bp, Staphylococcus epidermidis
gaggtcgttacgatgactcaaattacatttaaaaataatcccattaaattatcaggttctgaagtgaatgaaggtgatatcgcaccaaatttcacagtgcttgataatagtttgaatcaaattactttagatgattataaaaacaaaaagaaattaattagtgttataccatctattgatacaggagtatgtgatagtcaaactcgaaagtttaatgaagaagcttcagcagaagatggtgtagttttaacgatatcagtagatttacctttcgcccaaaaaagatggtgtgcatcaagcggattagataatgtaattactttaagtgatcataaagatttatcttttggtcgaaattatggacttgtgatggatgaattacgcttacttgcacgttcggtatttgtgttaaacgaaaacaataaagtagtatataaggaaattgtcagcgaaggtacgaattaccctgattttgaagctgcattaaaagcttacagaaatatttag

SEQ ID NO: 928 - DNA, 1149 bp, Staphylococcus epidermidis
ggacacgttacgataaggttggaggtagataatatgaaaattgggattcctaaagaaataaagaataatgagaatcgagtggggttatccccaagtggtgtacatgcacttgtagaccaaggacatgaagttttagtagaaacaaatgctggtctaggatcttactttgaagatggtgattatcaagaagccggtgccaaaattgttgatgagcagtcaaaagcttgggatgttgatatggtcatcaaagttaaagaaccacttgaatcggaatacaaattctttaaagaagagttaatcttatttacttatttacaccttgcgaatgaacagaaattaactcaggcacttgtggacaacaaggttatatctattgcctatgaaactgtacaattaccagacggttctttaccgttattaacaccaatgagtgaagtggctggtagaatgtctacacaagtgggagctgaatttttacaaagatttaatggaggtatgggtatcttactaggtggcatacctggagtacctaaaggcaaagtcactatcattggtggtggtcaagcaggtacaaatgcagctaagatagctttaggattgggagctgaagtgacaatactagatgttaatcctaaacgtttagaagaattagaggacttatttgatggcagagtaagaacaattatgtctaatccattaaatatagaaatgtatgtgaaagaaagcgatttagtgattggagcagtccttattccaggtgctaaagctccaaacttagtgactgaagatatgataaaagaaatgaaagatggatcagtgattgtagatattgcgatagatcaaggtggaatttttgaaacaactgataagattactactcatgataatccgacttacactaaacatggtgtcgtgcattatgctgtagctaatatgccaggtgccgttccacgtacatctacaattggattgaacaatgcaacattaccttatgcgcaattattggctaataaaggttatcgtgaagcatttaaagtaaatcatccattatctctaggtctgaatacatttaatggacatgtgactaataagaatgtagctgatacatttaattttgaatacacttcaattgaagatgcattgaaataa

SEQ ID NO: 929 - DNA, 378 bp, Staphylococcus epidermidis
cgaggtatgacgatgacaaagaatattccaacaaattacaaactgatatcaaaacaacttgctagtttaatcgaagatgaaaagaatttaattgcaatattaagcaatacttctgcccttcttaacgatacaattgatcaaattaattgggtaggtttttaccttattgaaaataacgaacttattcttgggccatttcaaggtcatcctgcttgtgtacatattgctattggtaaaggggtttgtggcactgccgtttcatctggtgaaacacaacgtgttaaagacgtccatcaattccctggccacatagcttgtgacgcaaatagtcaatcagaaattgttattctcattacatcgtcttcgaccacagggtat

SEQ ID NO: 930 - DNA, 1332 bp, Staphylococcus epidermidis
aaagactgttataaagaaataagaggtaacgggatgacaaagaatgaacaaataattaaacatatcgaatctttatcaattggctctaaaatctctgtacgaaagattgctaaagatcttaatgtgtctgaaggtactgcgtatagagcaattaaagatgcgagtcaacttggaattgtagcaactattgacagagttggtactgttagaatcgagaaacgaagtagggaaaatttagataacttaacgtttaatgaaattgcaaatattgtcgagggccaaatacttgccggtagagctggacttaataaatcagtttcaaaatttgcgataggagcaatgcaatttgatgatattctgaaatatataggcaaacacacattattaattgttggaaatagagaaaatgtacagattgaagctttaaaacgtgaaacttcaatactcatcacaggtggttttcgtccaagtgctgaaattatacgttatgcagatgagcatgaattaccaattatttcttcaagttatgatacattcttagttgctaatatcatcaataaagcaatgtttaatcaaaaaatacgcaaagaaatacttgtggttgaggatatagttaaaccaatcaatgaactatcagtgttatttgattcaatgacaatacatgattacaaaaaaatagcgaatgaaaccggccatacaaggtttcctatagtaaacgaagaatttaaattagtaggtatagtaactagtagagaaatcattaatatgaacgaagaagacctattaggtaaagttatgactaaaaatccattgagtgttaaattaacaaatacggttgctagttgtgcccatttattaatttgggaagggattgaattattaccagtaactgataataataaaaaagctgtcggtgtgattaacagacaggatgttttaaaatcaatgcaattattaggtagacaacctcaaattggtgaaacagtcaatgatcaaattgccaaacatatttcaatacatcaacaaggaataaatgtcgacgtatctccactcattacaaatcattacggtacactaagtaaagcagtatttgttggaattattgaggaaacgattcggcacgaaatgagaaagtataaaaaaggtaatgtcatgatagaaagtatgagtattatctatattaagactgtaccaattgaatctactattgaagtacattatgaaatgttagatgttggccgatattttgctaaattagaagttactatgattaataatggtgaaaaagttgctaatgcattagtaatttgtcaaatgtttgatggattttaa

SEQ ID NO: 931 - DNA, 1707 bp, Staphylococcus epidermidis
gaggagaagtatatggtgttatttatcatattagcaatattagtagttattttaattgctattggcgtattgttttatatgcgctcaaacaaaagaaatttaattgaaaaaacagaagagcgtaagaacgaaattgaacaattacctttagatgataacctaagaaaacttactggtttaaatttaaaaggtgaaacaaagactaagtatgatgcaatgaaaaaagacaacacagaaactacaaataaatacttagctccagtggaagaaaaaattcaaaatgctgaagagttgttagagaaatttaaattcacggcagcacaaactgaaattgatgatgctcacgaattaatggatcaatacgaagagaattatcagcatcaagtaactcaagtggacgacattataaacttacataaagaaaatgaagcattgtatgaaaagtgtaaagttgactatcgtgaaatgaaacgtgatgtattagccaatcgtcatcaatttggtgaagcagctgaaccacttgaaaatgaaatcgaaaattatgagcccaagttaaatgaatatgagaatttaaaaagtgaaggtaattatgttcaagctcataatcacattgctgctttagaagatcaaattaaaaatttaaaatcttatatggatgaaattccagaattaattcgagaaactcaaaaagaattaccaggacagtttcaagatttaaaatatggatgtagagacttaaaggttgaaggctatgatttagaccatgtcaaagtcgatggtacaatacaaagtcttaagacagaattaagttttgttgaaccaatgattagtcgattagaattagatgaagctaataataaacttgaaaatattaatgataaattagatgaaatgtatgatcttattgaatatgaagtaaaagccaaaaatgaagttgaagaaacgaaagatatcattactgatgacttatttaaggccaaagatatgaactatacattacaaaccgaaattgaatatgttcgtgaaaactactatattaatgaatcagatgctcaaagtgtaagacaatttgaaaatgaaattcaaagtctcatctcagtttatgatgatattttaaaagaaacttctaaatctgcggtacgttacagtgaagtacaagataatttacagtaccttgaagatcatgtatctgtgattaacaaagaacaagataaacttcaaaatcatcttatccaattacgcgaagatgaagctgaagcagaagataatttattgagagtgcaatctaagaaagaagaagtttatcgacgtttattagcttctaatttaactagcgtcccagaacgttttattatcatgaaaaatgaaattgataatgaagtaagagaagtaaatgaacaatttagagaacgtccaattcatgttaaacaactaaaggataaagtagcaaaaattgttattcaaatgaatacatttgaagatgaagctaacgatgtacttgtaaatgctgtatacgcagaaaagcttattcaatatggtaatagataccgtaaggaccatcatcatgttgataaaagcttaaatgaagctgaacgattatttaaaaataaccgatataaacgtgcgatagagatagctgaagaagcattagaaagtgttgaacctggtattaccaaacatattgaagagcaagtgattaaagaatag

SEQ ID NO: 932 - DNA, 1113 bp, Staphylococcus epidermidis
aaactatatcttattagcatagaattaatatatcatcacatgatggaggttcattatatgactaaaataaaagaaatcaaaaaagttttacaaaaagaagatgctgatgcagcatggattacgacacccttaaacatcttttactttactgggtatcgaagtgagccacatgaaagactcttcgctttgcttattccatcaaatgaagagcctgttttattttgtccaaaaatggaagttgaagaagtaaaacaatcaccgtttaaaggtaaaatcatcggttatttagatactgaaaacccattcgacaaatactctaaaactttctctaaaatgctcattgaaagtgaacatcttacagttaaacgtcaaagagaactaacaaaagcctttaatatagaacactatcaagatgttgatcaatcaatcaaggacttacgcaatatcaaatcagaagatgaaattatcaatataaaaaaagcagctgcgttagctgataaatgtattgaaattggtaaatcctttcttaaagaaggtgttgaagaaagagaagttgtcaaccatatcgaaaacgaaataaaaaaatatggtgttaatgaaatgagtttcgacacgatggtactcttcggtgaccatgctgcttcaccacatggaacacccggtgacagaaaattacagcaaaatgagtttgtactatttgatttaggtgttgtataccatcattattgcagtgatatgacacgcacaattcattttggcacacctaataaggaagcacaaaatatatataacattgttttaaaagcagaaacagaagcaattaaatctattaaaccaggagttaccatcaaagatattgataaaattgctagagatatcatcgaagaagcaggttatggtgattacttcccacatagactaggtcatggattaggtcttgaagaacacgaatatcaagatatatcaagtgtaaataataatcaacttgaagcaggcatggtgattactatagagcctggcatatatgtccctcatgtggctggtattagaattgaagatgatattttagtaactgaaaatggttatgaaatattaactcaatacgaaaaataa

SEQ ID NO: 933 - DNA, 1161 bp, Staphylococcus epidermidis
aagccatttcataaagaaacagtaaaggggaaatttatcatggcagaattaaaaagaggtttagaaggggttattgcagctgaaactaaaattagctcgataattgacagtcagttaacatatgcgggctatgatattgacgatctcgcagaaaacgcgcaatttgaagaaataatttttttactatggaattatagacttcctaatgaaaatgagttaagtgaattaaaagaaaaattatttgattatatgactcttaataatagagtatacaagcactttgaggagtatgtgacggatcatgtacatccaatgactgctctacgtacatcagtatcatatgtagctcattttgatccagaagcggaaaatgaatctgatgagaataaatatgatagagctattcgtattcaagctaaaatcgcttctttagtaacggctttcgctagagttagagacggtaaagaacctgtcaaacctaattctgaacttagttatgcagcaaatttcttatatatgttaaggggagaactaccaacagaagttgaagttgaagcatttaataaggcattaattttacatgctgatcatgaacttaacgcatctgcatttacggcacgttgcgcagtatcttcattatcagatatgtattcaggtgttgttgcagctattggttcattaaaaggaccattacatggtggtgcaaatgaacgagtgatgtcaatgcttaaagaaataggaagcattgataatgtagatcactatttagatgaaagatttgcaaataaagataaaattatgggctttggtcatcgtgtttataaagatggtgatccaagagctaaatatttaagagaaatgagccgtaaaatcactgaagaaacagggcaaagtgaactgtttgaaatgtcattagccattgagaagagaatgaaagaagaaaaaggacttattcctaatgtcgatttctttagtgctacagtctatcatagtatgaatattccacatgacttattcacaccaatatttgcagtaagtcgtacttctggttggattgctcatattttagagcaatatcgagacaatagaattatgcgaccaagagctaaatatataggtgaacaaaatcgtaaatatgtgtctattgaagaaagaccataa

SEQ ID NO: 934 - DNA, 1371 bp, Staphylococcus epidermidis
gggagttgtcttatggctgagaatttacaaagagaattgagcaatagacatgttcaattaattgccatcggaggtgctataggaactggtctgttcctaggtgccggacaaactatcgcaatgactggtccctcaatattacttacttatattattatagggttcatgttatttatgttcatgcgtggattgggagaaattattattcaaaatacgaatttcaaatcttttgctgacgtgaccaacacatatataggaccgttcgcaggatttgtaacgggttggacttactggctatgttggattattactggtatggctgaagtgactgcagttgccaaatatataagtttttggttcccagacatacctaattggattagtgctttattctgtgtacttattctaatgtctttcaatttattaagtgcaaagttgtttggtgagcttgaattctggttcgcaatcattaaaatagttacaatcattgctttaatcgttataggtgtaatcatgattttattcgcattcaagacaccatttggtaacacaagtttaactcatttgtatcaacatggaatttttccaaaaggagcttctggattctttatgtcattccaaatggcattgttctcatttgttggtattgaaatgattggtgttactgccaggagaaaccaaagatccagaaaaactatacctaaagctatcaatagtgtacctattagaattttaatcttttatgttggtgcattagcagtcatcatgtccattattccatgggataaagtagatccagataatagtccattcgttagattgtttgcattaattggtataccgtttgcagcaggaataattaatttcgttgttttaacagctgctgcctcttcatgtaacagtggtattttctcaaacagcagaatgctttatggactttcaaaccaaaatcaagcaccaccaacatttgctagtactaataaacatggtgtgccacataaagcaatcattgcatcatcagctttattgttaattgcagcactactgaattacatattccctgatgcaacacttgtatttacttatgttactacgatttctacagtattatttgttgtggtttgggcattaattattattgcttatattaactatagtcgtaaaaatccagaacttcataagaaagcgacatataaactaccaggcggtcaatacatgggataccttatacttattttctttgtttttgtatttgccttgttatttataaatgttgatacaagaagagcgatttactgcacgcctatttggtttattttattaggtttaatgtacttaagatacaaaaaagctgataaagaatcacgataa

SEQ ID NO: 935 - DNA, 1371 bp, Staphylococcus epidermidis
atggggttacaaacctatgaatatggtctaaaaccacaagatggatttgaggtgattacacatttcgaattcacctcacaacatttagatattttaaatcgactattcacccctttaatcggagttgaatcaattggactctatcattttatgagtcaattcatagatgaaagtcaacaactcgggttaacgcattatatattcatgaatgaactaaaaattaacttattagatttcagggagcaaatggacaatttagaggctattggattgattaaaacatttgtaaggcatgaaaaaaagtactctcactttgtttatgagttaattcagcctccaacagcctatcaattttttaatgatcctatgttatcagtatttttatttagtgaggttgataaaaaacgttatcaagcacttaaatcttatttcgaaaaagatgagaaagatttaagcaaatatcaacagacaactagaaaatttacagaagtattcaacgtacctaaaaaggtcaatgtttctgatcaaattaatttaaagcaaatcaaacactatgatggtatagatttatctaatgaaacttttgattttgaaatgttgagacagatgttgaaccatcattttattagtaatgaaattatcgataaagaagctaagaatttgattatacaacttgcgacactttatggaattactgaagatggtatgaaaaatgttatattaagttccattaccagtgcacaacaattatcttttgaagaaatgcgtaagaaagctagaacttattacctgattgaacatgataatcaattaccaaaattagagcatcaaacaaataaaattaacgatgaaaaaaaagatcgacaagcggaagatacaacaaatgattggttacaactgctagatgaaacaagtccgattgatatgttagcaagttggtctgattcggaacctacacagtcgcaaaaaagtatgatagaagaattgattaaccgtgaaaaaatgaattttggtgtaatcaatatacttttacagtttgttatgttaaaagaagatatgaagttgccaaaatcttatatttttgaaattgcttccaactggaagaaaattggtatttcaaatgccaaacaagcatatgaatatgcattacaagttaatcaacctaaaaattacgaaacacattctaatgataaacgacagaacaatcgtggaagacaaaatcaatttttatccaaagaaaagacacctaaatggcttcaaaatagggacgatcaagaagaaaataaagaaataaatgatgacactctcgaagaagatcgacaagcatttcttgaaaagttaaatcaaaagtggaaggaggaagataactaa

SEQ ID NO: 936 - DNA, 1239 bp, Staphylococcus epidermidis
ggagctgttaaagtaatgcaatatgatcatttattagttagatatggagagcttacgcttaaaggtacgaatagaaaaatgtttgttaatcaacttaaagataatgtgaaacgcgcgcttattccattaagtggttatcatgtcaaaggaaagagggatagaatgtacatagaattatcccctgaagcagacataaatgaaatcattcaacgcttatctaaagtttatggtataaaatcaattagtccagttataaaaattgataaaaacgaagagaaaattaatcaatcagcaatacagttatctcatgactttgaaaaaggttcaacttttaaggttgatgtaaaacgcgttgacaagtcatttcgattggatacgtacgaattgcaacgtcaagtcggtggagcaatactaaaaaaaaataataatataacagtgaatgttaaaaatcctgactatgaaattaaaatagaagtaagaatggatgctatttatatttatgaaaaagtaatcgctggtgcaggtggactgccagtcggtacaggtggtaagacattacttatgttaagtggtggtattgattctcctgtagcgggaatagaagtaatgaaacgtggtgtaactgttgaagcaatacattttcatagtccaccgtttacgagcgaaaaagctaaagataaagttatcgaattaacaagaattctagcggaacgtgttggtcctatcaaattgcatctcgtgccatttacagaaatacaaaagcaaattaataaagttgtacatcctcgttatacgatgacttctacaagaagaatgatgatgcgtatatctgataaagttgtacatcaaataaatgctaatgctatcgtaaatggagagaatcttggtcaagtagcaagtcagacgctaaagagtatgtacgctattaatcatgttacagctacacctgttttaagacctctattaacgttagataaagaagacattattaagaaagcgaaagaacttggtacatttgaaacatctattcaaccctatgaagattgttgtacaatatttactccgaaaaatcctgtaactgaaccggactttgacaaagtaataaaatatgaaagtgtatttaattttgatgaaatgatagaaaatgcagttgaaaatattgaaacattaacaatagatcaaaattataaaagtgcgaaagaacaatctacagattcattgattaaagatttattctaa

SEQ ID NO: 937 - DNA, 1038 bp, Staphylococcus epidermidis
tggaacgttaaaaaaatttatggtaatttagagttgaagataaatctagttaaggaaaggtatgtcgtcatgaagaagattgcagttttaactagcggaggagattctccgggtatgaacgctgctgttcgtgcagtgactcggacagcaatttacaataatattgaagtttatggtgtttatcaaggttaccaaggtttacttgatgatgatattcataagcttgaattgggttcagtaggggatacaattcaacgaggaggaactttcctcttttccgcaaggtgccctcagttcaaagaagaggatgtacgtaagaaagctattgagaatttacgtaagcgtggtatcgaaggtttagttgttattggaggagatggcagctatagaggggcacaacgaattagtgaggaatgtaaagaaattcaaacaattggtattcctggtacaattgataatgatattaatggtacagattttacaattggttttgatactgcattaaacactattattgaatcagtcgataagattagagatacggcatcaagtcacgcaagaacgtttattgttgaagttatggggcgtgattgtggagatttagctttatgggctggattatctgtaggtgctgaaacgattgttttaccagaagtcaatacagatattaaggatgtagctgaaaagattgaacagggtattaaaagagggaaaaaacattctatcgttatggttgcagaaggttgtatgagcggccaagaatgtgcagatgagttaacgaagtatattaacattgatacacgagtttcagtgttaggtcacattcaacgtggcggtagcccatctggtgctgatcgagtattagcttctcgacttggtggatatgctgttgaactattaaaacaaggtgagacagctaaaggtgttggcattaggaataatcaattaacctctacgccgtttgatgaaatttttgctgaaagtgatcgcaaatttaatagtcaaatgtatgaattagcaaaagaattatcaatttaa

SEQ ID NO: 938 - DNA, 387 bp, Staphylococcus epidermidis
ataagaactaatgacaatgctataatgattagcggttttaaaatatttgctggtatgtatgtcgcaatgatagcaccaccaccagaagcaacaaatattagtggaaacatctttcctactattttcaagtcaactttacctgaacgtaaaaattttaatgcacttgttaacgtactaaaagaactcgcaaatttatttgtacctaaagcaacagatggtggcaaaccaactgcaagtaatgcgggggttgaaattagtccacccccaccaactacagaatcgacgaatgaagcgataaaaccaaaggcaacaatcatcaacataatcgataaattccaatccatattaagcctaacccctttgtttttattacattacgaattttag

SEQ ID NO: 939 - DNA, 417 bp, Staphylococcus epidermidis
tttatgtataaacatattctacttggggtagacactcaaattaaaaatgagaaagctcttaaagaggtgtctcgtttagctggtgaaggaactatcgtcacagttttaaatgccattaatgagcaagatgctcaagcgtcaatcagagctggcgtacatttagataagctaaccgaaaagcgttctaaaggtttagaaagtacacttaaaactctagaagactacggcattgattatgatgaagttattgtaagaggcaatgctaaggatgagctattaaaatttgcaaatagtggtaaatatgaaattattgttctaagtaaccgaaaagctgaagaaaataagaaatttgttttaggtagcgtaagtcataaagtagctaaacgtgctactattcctgttttaattgttaaataa

SEQ ID NO: 940 - DNA, 888 bp, Staphylococcus epidermidis
agaaaggataatatcatgcctgaactacctgaagttgaacatgttaaaagaggtattgagccatttataaaaagtgcaaaaatagagaaagtaacttttgctaaaaatgtaattaacggtaagaataataaccgtgagacgattataaaaggtatggaattagatacttttaaaaaacttactgaaggttatgttataaaaaaagttgaaagaagaagtaagtacattattttttatatagcggatcatgacgatgatagaatcttagttagtcatttaggtatggcaggcggattctttgttgttaataaccttgatgagataagtacaccgaattatcgaaagcattggcaagtcattttcgatttggataataaacaaaaattagtctattctgatatcagacggtttggagaaattagaaatatagtcaattttgatagttatccatctttattagaaatcgctccagaaccatttgaagaggtggcatttgaacactatttagaatgtttgacaatgaaaaaatataagaataaaccaataaaacaaacgattcttgatcatcgtgttatagcaggagctggaaatatctatgcctgtgaagctttattcagagctggtattactccggataaaattactaattcactcactaaacaagaaagaaaatccctcttttattatgttcgagaagttttagaagagggtataaaatatggaggtactagtatttcagattataggcatgcagatggtaaaactggacaaatgcaattacatttaaatgtatataaacaaaaaaagtgcaaggtttgtggtcattcgattgaaacaaaagtgatagctggtagaaatagtcatttttgcccaaactgtcagagataa

SEQ ID NO: 941 - DNA, 1428 bp, Staphylococcus epidermidis
tgtggtaacaagttagcctctacttatgaaggaaagggagcttctatgaaaaagaataataaacaaaatgacggtgttcaaagaggattaaaagatagacatatttcaatgattgccattgggggatgtataggaactggtctattcatgacttctggtggagctatacatgacgcaggtgcattgggtgctttgattgcctatgcagttattggagcgatggtgttctttctaatgacgtcgttaggggagatggcgacatatttgcctgtgtcaggttcatttagtacttatgctacacgctttgtcgatccttcactaggttttgctttaggatggaattattggttcaactgggtgataacagtagcagctgatgttactattgcagcgcaagttatacaatattggtcccctatgcaaggtataccagcttgggtctggagttgtattttccttattattattttcgcgcttaattctttatccgttagagtatatggagagagtgaatattggttcgcacttatcaaagtagttacagtcatcatatttataggaattggtatcttaactattttagggattatgggtggagaatttgtaggatttgatacgtttacaaaaggagatgggccaatactaggtgggaatttaggaggtagcttgctatcaattcttggtgtatttctagtcgcaggcttctcattccaaggaactgaacttattggtattacagcaggtgaatctgaaaatccagaaagagcagttccaaaagcgattaaacaagtattttggcgtatacttttattttacattctagctattttcattattggtatgttgattccatatgatagtaaggcattaatgggcggtggtgatagtatagctacttcaccttttacattagtatttaagaatgctggattagcttttgctgcttcatttatgaatgctgttatattaacaagtgtattatcagcaggtaactcaggaatgtatgcttcaacaagaatgttatattcgatgagtaaagataaattagcttataattcttttggaaaaacaaataaaagtggcgtaccttatgtatctctaattgcaactggagtactagtcattcttattttcgcattgcaacatttaagtggagatgcatatgaatacattgtagctgctagcggaatgactggttttattgcttgggttggtatagcaatcagtcactttagatttagacgcgcatttgataaacaaaattatgataaatcaaaattaaaatataaagcgaagttattcccatttggtccgatttttgcaggtattttatgtgtaatagttatcattggacaagatgtagattttattaaaacaggtaactttgatatgaatagattttttataacgtccatgggaataccttta

SEQ ID NO: 942 - DNA, 738 bp, Staphylococcus epidermidis
atgtataaaaagattaggaggcacactatgtcacaaaaaatattagtggttgatgatgagcaatccatcgtgaccttactaaaatataatttagaaacagcagggtatatagtcgaagtcgcttatgatggtgaagaggcattgaaaaaagttgaaacagaacaaccggaactaattgtattagacgttatgttgccaaaaaaagatggtatagaagtatgtaaaacaatcaggtctgataaaaatttagtaccgattttaatgttgacagcaaaggacgatgaatttgatcgagttttagggcttgaactaggtgctgatgactatatgacaaaaccattttcacctagagaggtagttgccagagttaaagcaatattaagacgttctcaatttgtaaatgaaattgagaaggaagatgttgatgatgaagatattatcattggttcaattagaattcgacctgaattctttgaagtctataaagaagatgaattattagaattgacgccaaaagaatttgaattgttattatatttaattgaaagacaaggaagagttattactcgagaacatatgttgaattcagtgtggaattatgaattcgctggagattctcgaattgttgatgtacatataagccacttaagagataaattggaagaaaatcctaagcaacctaaattgataaagactgtacgtggtttaggttataaactggagagacctaaagcttaa

SEQ ID NO: 943 - DNA, 795 bp, Staphylococcus epidermidis
tgtaataaaaacaaaggggttaggcttaatatggattggaatttatcgattatgttgatgattgttgcctttggttttatcgcttcattcgtcgattctgtagttggtgggggtggactaatttcaacccccgcattacttgcagttggtttgccaccatctgttgctttaggtacaaataaatttgcgagttcttttagtacgttaacaagtgcattaaaatttttacgttcaggtaaagttgacttgaaaatagtaggaaagatgtttccactaatatttgttgcttctggtggtggtgctatcattgcgacatacataccagcaaatattttaaaaccgctaatcattatagcattgtcattagttcttatttataccgtcatacaaaaagattggggaaatataagaacatttaccgattttacttttacaaaagcagtattatttacattaatatttattgttattggattttatgatgggtttttaggtggtggtacaggctcctttatgctatttacacttttattatttggctttgactttttaagtgcagctggtaatgcaaaggttttaaattttgcatcaaattgtggtgcgttattatttttcatgattttaggtcaggtcaattatttttatggtattattatggcttctagcatgatgataggtgtgttgttaggtgctcaatttgctttgaaaaaaggggtaggatatgtaaaagctttatttttagtggttactgcaatattaattataaaaaatctctacgattttattgtgcagtaa

SEQ ID NO: 944 - DNA, 1953 bp, Staphylococcus epidermidis
ataggaggaaaaaatatgaatcaaattaatattcaatttccagatggtaatacaaaagaatttgataaagggactactacagaagacatcgctcaatcaattagtccaggattaagaaaaaaagcagttgcgggaaaattcaatggtcaacttgtagatttaacacgccctttagaacaagatggagctattgaaattattactcctgggagtgaagaagcgttagaagtacttcgtcattcaacagctcatttaatggcacaagcattaaaacgtttatacggagacgttaaatttggagttggacctgtaatagaaggcggattctattatgattttgatatggatgataaggtttcatcggatgattttgataaaattgagaaaacaatgaaacaaattgtgaacgaaaatcataaaattgtaagagaagtagttagtaaagaaaaagcaaaagacttcttcaaggatgacccttataaattagaacttattgatgcaattcctgaagatgagagtgtaacactttatactcaaggtgaatttactgatttatgtcgaggtgtacacgtaccttctacttctaaaattaaagagttcaaactattatctacagctggtgcttattggcgtggaaatagtgataataaaatgttacaacgaatttatggtacagcattctttgacaaaaaagatttgaaagcacatctaaaaatgttggaagaacgtcgtgagcgtgatcatcgtaaaattggtaaagatttagaattgtttacaaacaatcaactcgttggtgctggtttaccattatggttaccaaatggtgctacaatacgtagggaaatagaacgttatattgtcgataaagaagtaagtatgggatacgatcatgtttacacaccagtattagccaatgttgatttatataaaacatctggtcactgggatcattatcaagaagatatgttcccagcaatgaagttagatgaagacgaagcaatggtcttaagaccaatgaactgtccacatcatatgatgatttataaaaacaaacctcattcttatcgcgaattacctatacgtattgctgaattgggtactatgcatcgttacgaagcaagtggtgcagtatcaggtttacaacgtgttcgaggaatgacattgaatgattcccatattttcgttagacctgatcaaattaaagaagaatttaaacgtgtagttaatatgattcaagatgtgtacaaagattttggttttgaagattatcgcttcagattgagttatagagatcctgaagataagcataagtactttgatgatgatgaaatgtgggaaaaagctgaatccatgcttaaagaagcatcagatgaattaggtttaacttatgaagaagctattggtgaggcagcattctatggacctaagttagatgttcaagtaaaaacagctatgggaaaagaagaaactctatcaacagcacaacttgattttcttttaccagaacgttttgacttaacgtacattggtcaagatggagaacaacatcgtcctgtagttatacaccgtggtgtagtttctactatggaacgttttgttgcatttttaacagaagaaacaaaaggtgcatttccaacttggttggcgcctatgcaagttgaaattattcctgtaaatatagatttacattatgattatgcaagacttttacaagatgaactaaaatcgcaaggtgtccgcgttgaaattgatgaccgtaatgaaaaaatgggatataaaattcgtgaagctcaaatgaaaaaaataccttatcagattgttgtaggtgaccaagaagtagagaatcaagaagtaaatgtaagaaaatatggttctgaaaaacaagaatcagttgaaaaagatgaatttatttggaatgttattgatgaaatccgtttgaaaaagcatagataa

SEQ ID NO: 945 - DNA, 2718 bp, Staphylococcus epidermidis
tgcgtagtgaatactaaactcgcttactcgttatgtatttgtatatatgctaaaatatatgtaaatctgttctggaggttacgtattttgaataaattagtattaatagatggtaatagtctaagctttagagcgttttatgctctccctttactttcaaaccatgcaggtattcatacaaatgcagtttacggctttgctatgctcttagaaaaaataattaaagaagaaaaaccgaatcattttttagttgcatttgatgcaggtaaaacgactttcagacattctaagtacagtgaatataaaggtggtcgtcaaaagactccacctgaattaagtgagcaatttccatatattcgtcaacttttagatgcgtatcatattaaaagatatgaacttgataattatgaagctgatgacattataggaaaattaagtagacaagctgatgaagaagattttgaaaccattatcattacaggtgatagagacttaactcaattagccactgataatgttacaatatattatacaaaaaaaggtgttaccgacgttgatcattatacacctaaatttatagcagagaaatataatggtttagtgccgaaacaaattatcgatatgaaaggtctaatgggggatacctctgacaatattcctggcgttgctggtgtcggcgaaaagacggctattaaattacttaatcaatttgagtcagtagaaggggtctatgaacatattgaggaggtcactgcaaaaaaattaaaagaaaaactcatcaatagtaaagatgatgccttaatgagtaaagatttagcaacaatcaatgttcacagtccgattgaagtatcattagaagatacaaaattaactctacaagacgacactacagaaaaaattgaactatttaaaaagctagaatttaaacaactattagcagatatagacacatcctctacgaatgaagaagtcatagataaaacttttgaaattgagcaagactttcaaaatgtagatttgaatgatttaaacgaagcggtaatacattttgaactcgaaggcactaattatcttaaagacactattctcaagtttggtttttatacaaatcatcaacatgtagtgataaatgctgaggatgtaaaggattataaacatttagttcaatggcttgaagataaaaatacaactaaaattgtctatgatgcaaaaaaaacttatgtatctgctcatcgattagggattaatatagaaaatattgaatttgatgttatgttagcaagctatattattgacccatcacgttctattgatgacgttaaatctgtggtaagtttatatggacaaaattatgtaaaagataatattacaatatttgggaaaggtaagaaacatcatatacctgaagaaccaattctaaacgaacacattgcctctgtgacagaagctatagcagctgtaactccaaccatgaaatcacagttagaagattataatcaaattgaactgttgaaagatttagaattaccattagcaagaattttaagtgaaatggaagaaattggtatatataccgatatcaatgatttgaaagaaatggaattcgaaattcaaaaaaaattggatgtattaatatccaatattcatgagtcggctggtgaagcgtttaatatcaattctcctaagcaattaggtgttgttttatttgaaacattacaattgcctgtcattaagaagaccaaaacgggctattcaacagctgtagacgtattagaaaaactacaaggtgagcatcctattatagatgatattttagaatatagacaacttgctaagttgcaatctacgtatgtagagggattacaaaaagtaataagcaaagatcatagaattcacacacgttttaatcaaacgcttgctcaaactggtagattatcaagtatagatcctaatttacaaaatatacctatacgattagaagaaggaagaaagattagaaaggcctttaaaccaacttctaaagatagtgtgattttatctgctgattattcacaaattgagttacgtgtacttgctcatattacgcaagatgaaagtttaaaacatgcatttataaacggacatgatattcacactgcaacagcaatgaaagtatttaatgttgaatctgaccaggttgatagtttaatgagacgtcaagcaaaagctgttaactttggtattgtatatggtatcagcgattatggattgagtcagagcttgggtattactagaaaacaagcaaaagcatttattgatgattatttagctagttttccaggtgtaaaacaatatatgtcagacattgttaaagatgcaaaagcacaaggttatgtggaaacactacttcatcgtcgtcgatacattcctgatataacaagtagaaacgttaatttaagaagttttgcagaaagaacagcaatgaatacacccatacaaggtagtgcagctgacataataaaattagcaatggttaaattcagtgaaaagattaaagaaactaaatatcatgctaagttattattacaagttcatgatgaactcatatttgaaataccaaaatcagaagtagaagattttagtaaatttgtagaagaaattatggaacaagcattagtgctcgatgtacctttaaaagtagattcgaattatggtgcaacatggtacgatgctaaataa

SEQ ID NO: 946 - DNA, 1026 bp, Staphylococcus epidermidis
atggcaacgaatattgcaattaacggtatgggtagaataggtagaatggtgttacgaatagcactaaataataaaaatttaaatgttaaagcgattaacgctagttatccacctgaaacaattgcacatttacttaattatgatacgacgcatggagtttatgataaaaaagttgaaccgattgaaagtggtattaaagtgaatggacatgaaattaaattactttctgatcgcaatccagaaaatttaccatggaatgagatggatattgatgttgttatagaagcgacaggtaaatttaatcacggagataaagcagttgctcatattaatgcaggtgctaaaaaggtattactcactggaccgtctaaaggtggagacgttcaaatgattgttaaaggagtcaatgataatcaacttgatattgatacatacgatatttttagtaatgcatcttgtactactaattgtatcggaccagttgcaaaagtcctcaatgataaatttggaatcataaatggtctgatgacaactgttcatgcaataacaaatgatcaaaaaaatattgataatccacacaaagatttaagaagagcacgttcttgtaatgaaagtattattccaacgtcaacaggtgctgctaaagcacttaaagaagtattgcctgaagttgaaggtaaacttcatggaatggctttaagagtaccaacaaaaaatgtctctctcgttgatttagttgttgatttagaacagaatgttacagttacacaagttaatgatgcatttaaaaatgccgatttatcaggtgttcttgatgttgaagaagctcctttagtttctgtagactttaacacaaatcctcattcagcaattattgattctcaatctacgatggttatgggacaaaataaggtgaaagttatcgcttggtatgataatgaatggggttattcgaatagagttgttgaagtagctgacaaaattggacaattaattgatgataaagcaatggtaaaagccatttaa

SEQ ID NO: 947 - DNA, 1167 bp, Staphylococcus epidermidis
ttaaaatttgaaggagaagtgttatcagtgatttatttagacaatgcagccactaccaaagctgatcaagatgttgttgattcattcgtgaaagtgaaccaaacattatacttcaatccaaatagtcctcatcatgcaggggttcaagctgaacaattattattaaaagcaaaaagtgaaatcaatcgtatattaaacttaaataatcagtttgatatcatttttacaagtggcgcaactgaatcgaataatatactgctaaaaggtattgcgtatatgaaaaaagaaactgctaatgagattatcacatcagtcttagaacatccttcagttttggaagtaatgaggtatttggaaagggaaaaaggttttaaattaaaatacgttgatgtgacaaaagaaggtaagttggacacagaacacttaaaatcattaatgacagataaagtaggacttgtgacatgtatgtatgtcaataatattatgggacaaattcaacctattgaagaaatagcaaatattgtaaaaaattacccacgtgcacactttcatgttgatgcagtccaggctttaggtaaagtgcctatgcaaattaatcatattgatagtttgagtttaagtggtcataagtttaatggacttaaaggtcagggactactacttttaaaaaatattcaaaacatagaacctatagtacatggtggtgggcaagaatatgggctacgaagtggtacaattaatctaccaatggctatctctatggttagagctataaagaatgcagttgatcaaacaaaagagcttaatttacgtttaagcaattataaaaataaattactttcatttttagcagaatataaaaatgtatttatcaactctcctcaaaatgcatcacctcatattataaatataggatttccaggtgttaagggtgaggtacttgttaatgctttttccaaacaaaacgtaatggtttcaactacaagcgcttgttcttctaagatgaataaattgaatgaggttttacttgcaatggaaattgcagagtcaaaaatagaaggtagtataagaatttctttaggggcacatacgactgaaaacgatatattaagttttatgaatgcatttgaatctgtatataaggaaattaaggagctgttaaagtaa

SEQ ID NO: 948 - DNA, 627 bp, Staphylococcus epidermidis
aggaagagtgaaataatgtctaaagtgattgggataactggtggtattgccactggaaaatcaacagtttcagaattattaacagcatatgggtttaaaatcgtagatgctgatattgcttcacgcgaagcagttaaaaaaggctctaagggtcttgaacaagttaaagagatttttggggaagaagcaattgacgaaaatggtgagatgaatcgtcaatatgtaggagagatagtttttaatcatcctgacttacgcgaggctcttaatgaaatagttcatcctattgtaagagagataatggaacaagagaaaaacaattatctagaacatggatatcatgtaattatggatatcccattgttgtacgaaaatgaactacaagatactgtagatgaagtttgggtggtttatacatctgaaagtattcaaatcgatcgtttaatggagaggaataatttatcattagaagatgctaaagcacgtgtttatagtcaaatatctatagataaaaaaagtaggatggcagatcatgtgatagataatctaggtgataaattagaacttaaacagaatttacaaaaattacttgaagaagaagggtatattcaatcggagagtgaatag

SEQ ID NO: 949 - DNA, 948 bp, Staphylococcus epidermidis
ctaatgttagattttgaaaaaccactttttgaaattagaaataaaattgattctttaaaagaatcgcaagaaaaaaacgaagttgatcttcaagatgaaatagatatgctggaagcatcattaaaaagagaaactacaaaagtgtacactaatctaaaaccttgggatcgtgttcaaatcgctcgtttaccagaaagaccaaccacattagattatattccctatatttttgattcatttattgagttacatggcgatagaagttttagggatgatccagcaatgattggtggaattggttacttagatggtaagtcagtaacagttataggccaacaacgtggtaaagacacgaaagataatatttatcgtaattttggtatggctcacccagaagggtatagaaaagctttgcgtttaatgaaacaagcagagaaatttaatcgtccaatatttacttttatagatactaaaggtgcttatccgggtaaagcagctgaagaaagaggtcaaagtgaatcaattgcaaaaaatttgatggaaatggcttcattaacggtaccagttattgctgttgttattggtgaaggcggaagtggcggcgctttaggaattggaatctcaaatcgtgttctgatgcttgaaaatagtacttattcagttatttcacctgaaggagcagctgcacttttatggaaagatagtaacttagctcaaattgccgctgaaactatgaaaatcactgcgcttgatttactagatttaggtattatagatgaagtgattaatgagccacttggtggtgcacaaaaagatgaagaagtacaagctttatcaattaagaaaatgttccttaaacatttaaatgaattaaatcaactcacacctgaagaattagcaaatgatcgttttgaaaaatttagaaaaattggttcagttgtggagtaa

SEQ ID NO: 950 - DNA, 210 bp, Staphylococcus epidermidis
cgtcatctagaagcctctaaccttatcttgtcaatttctacaatcattatctttcaattaatcattcttttattacttttattattcaaatacagaaatatatcccctctatatttattttttatattttttgtaaattataaaaaatacaatatagatgacatttggtgttctactttaaaatcaataactagtgttataaaaggttga

SEQ ID NO: 951 - DNA, 189 bp, Staphylococcus epidermidis
agcattctgctgtttgagaaaataccactgttacatgaagaggcagcagctgttaaaacaacgaaattaattattcctgctgcaaacggtataccaattaatgcaaacaatctaacgaatggactattatctggatctactttatcccatggaataatggacatgatgactgctaatgcaccaacataa

SEQ ID NO: 952 - DNA, 972 bp, Staphylococcus epidermidis
ataatatttagaagtttaaagggagtaattaatatggaagtaaaaatgaatgaaataatggaagcattagaacaaagtgaattaattattattcacagacatctaagaccagatccagacgcatatggttcgcaattaggtttgaaatattacttacaaaagaagtttccaaacaaacaaatttatgcagtaggagctaatgaagattctttgaaattcataggtttgatggacgaaattgacgatgatatgtacaagaaagcgactgtagttgtatgtgatacggcaaatgcgccaagaatagatgaccaacgttatgatacaggtaccaaacttttaaaaattgatcatcatcctgctactgatcagtatggagatattaactatgttaataccaaagcttcttccactagtgaaataatttacgaattcattttacatttcaatgatgaacatatcattgatgaacaagttgctagagtattatatcttggcatcgtcggtgatactggacgttttttatttaataatacaacgccacgaacaatgcaaattactggaaaattacttacatatccttttgatcacaaccaagaattaaacaaaatgtctgaaaaggatccaaaactattaccatttcaaggatatatattgcaaaattttgatttaaatgataaaggattttgcaaagttaaaataactaaagacatacttgaaaaatttcaaatacaacctaatgaagcgtctttatttgtaaatacaatcgcagatattcgaggattaaaaatatggatgtttggcgttgatgaaggagatcaaattagatgtcggttgcgttctaaaggtcatattattattaatgatgtcgctaatacatttggtggtggtggacatccaaatgcatctggagtttcagtaaatagttgggagcaattcgagcaactcgccgaagctttaaacgacaagttataa

SEQ ID NO: 953 - DNA, 1230 bp, Staphylococcus epidermidis
atgtctttaagagatgacgctttagaaatgcatagagagaaccaaggtaaactagaaattacaccaaatgttaaagtgacaaataagcaacaattaagcttagcatactcacctggcgttgcagaaccttgtaaagaaatccatgaagattcaagaaaagtatatgagtacactattaaaggaaatacagttgctgttgtaacggatggaacagctgttctcggtttagggaatattggagcagaagcaagtattccagtaatggaaggaaaggcagcactgttcaaaagttttgcgggtattaatggtgtgccaatatctctagatacaactgacactcaagaaatcataaaaacagtaaaacttattgcaccaaactatggtggaattaatcttgaagatatatcagctccccgctgttttgaaattgaagaaaccttaaagaaagagaccaatatacctattttccacgacgatcaacatggtacagctattgttactatggctgggttaatcaatgctttaaaaattgtagataaagagttaacgaatataaaagttgtattaaatggtgcaggtgcagcaggtatcgctatagtgaagttacttcatgcttatggtgtgaataatatgattatgtgcgattcaaaaggtgctatttattctggcagaaattttggtatgaatgatacaaaaacatatgtagctaagtggacgaataaagataaagttgaaggttcacttgaagaagtgattaaagatgcagatgtttttataggtgtatctgtagcggatatattaactcaagatatggtgaagacaatggctgatgatccaattatttttgctatggctaatcctaatcctgaaatcaatcccaatgaagccaaacaggcaggtgcaaaggttgtgggtacaggtcgatctgattttccaaaccaaattaataatgtattagcatttccaggtctttttagaggtgcattggatgttgaagccactcatattaacgaagatatgaaaaaggcagctgtagaagctatcgttcatttaatagacgaaaatgagttacatcctgattactgtataccaggaccgtttgataaaagagtagctccatcagtagccaaaaatgtagctaaagctgctatggaatccggtgtagcaagaattaaaattgatacacaagaaatatttgataaaactatgaaacttactgacttaaaatag

SEQ ID NO: 954 - DNA, 1806 bp, Staphylococcus epidermidis
attagcaaaagaattatcaatttaaatttatttgggaggattataaaaatgagaaagactaaaattgtatgtacaataggaccagcttcagaatcagaggaaatgctcgaaaaactaatgaatgcaggaatgaacgttgcgcgtttaaatttctcacatggtagtcatgaagaacataaagcaagaattgatacaattcgtaaagttgctaaacgtttaaataaaacaattggcttgttattggatactaaagggccagaaattcgtacgcacaatatgaaagatggacttattgttttagaaaaaggcaaagaagtcattgtcagtatgaatgaagttgaaggaacacctgaaaaattctctgtaacatatgaaaatctaatcaatgatgtcaatattggatcatatatactattagatgatggtttagttgaacttcaagtcaaagaaattaacaaagataaaggcgaagttaaatgtgatatcttaaatactggtgaattaaaaaataaaaaaggtgttaacttacctggtgttaaagttaatttacctggtatcactgataaagatgccgatgatatcagatttggtataaaggaaaatgtagactttatagctgcaagttttgtaagacgtccaagtgatgttttagatatccgtcaaattcttgaagaagaaaaagcagaaataacaattttccctaaaatcgaaaaccaagaaggtatcgataatattgaagaaattcttgaagtatctgatggattaatggtagcacgtggtgatatgggtgttgaaattccaccagaaagcgtaccaatggttcaaaaagatttaattagaaaatgtaataaattaggaaaacctgtaattactgcgactcaaatgcttgattctatgcaacgtaatccacgtgcgacacgtgcagaagcaagtgacgtagctaatgcaatatacgatggtactgacgctgtaatgttatcaggcgaaactgcagcaggtcaatatcctgaagaagctgttaaaactatgcgtaatattgcagtttctgctgaagcagcgcaagactataaaaaattattaagtgatcgtactaaattagttgaaacttcattagtaaatgcaattggtgtttctgttgcacatactgccttaaacttaaatgtaaaagctattgtagcagcaactgaaagtggttcaacagcacgtacgatttctaaatatcgtccacattcagatatcattgctgtaacacctagcgaaaaaactgctagacaatgtgcaattgtatggggagtaaatccggtcgttaaagaaggacgtaaaacaactgatgctttactaaataatgctgtagcaacagcagtagaaactggtagagtttcaaacggagatttaattattattactgctggtgtacctactggagaaaaaggaactacaaatatgatgaaaatccacttagtaggtgatgagattgctaaaggccaaggtgttggtagaggatctgttgtaggccatgcaattgtcgcagatagtgctagtgatttagaaggtaaagatttatctgataaagttattattacaaattctgttgatgaaacattagtaccatatgttgaaaaagctataggtctaattacagaagaaaatggtattacttcaccaagcgcaattataggtttagaaaaaggcatacctactgttgttggtgtagaacaagcaactaaagaaattaaaaatgatatgttagtgactttagatgcgtcacaaggtaaagtgtttgaaggttatgctaacgtcctttaa

SEQ ID NO: 955 - DNA, 924 bp, Staphylococcus epidermidis
ctaatgaaaagtttcagaaatatcatgggcgattctcaaaatctagataaacgtatacaaaaaataaaacaaaatgtaatcaatgatactgacgttaaacattttcttgagaaaaatcgtagtaatataactaatgagatgatagacgaagatttaaatgttcttcaagagtataaagatcaacaaaaagtttatgatggacatcgctatgatgattgtccgaattttgtaaaaggacatgttcctgaactatatattgaaaatgaaagaatcaaaattagatatctaccttgcccgtgtaaaattaaacatgatgaggaacgatttgattcacaacttattacatctcaccatatgcaaagagatacacttcatgcaaagctcaaagatatttatatgaataatcgagagagacttgatgtagcaatggcagctgatcaaatctgtacagcaattactaacgatgaaaaagtaaaggggttatatttatatggtccttttggtacaggaaaatcattcatattgggtgctattgcaaatcaacttaaatcgcaaaagatttcatcaacaattgtatatttaccagaatttattcgcactttaaaaggtggctttaaagacggtagttttgagaaaaaattacaacgtgtgcgagaagctaatattttgatgttagatgatattggcgcagaagaagtcacaccgtgggtaagagatgaagtgattggtcctttattacattatagaatggtacatgaacttcctacattttttagttctaactttaattatagtgagcttgagcatcatctttcaataactagagatggcactgaaaagactaaagcagcacgaattattgaaagaattaagactttatcgacaccttattatttgactggtaaaaattttagaaacaattga

SEQ ID NO: 956 - DNA, 1278 bp, Staphylococcus epidermidis
acaaatgatggaggacaatgtcttatgtcaaaattaattttggcggtaaatgctggtagctcatctttaaagttccagctaattaagatgcctgaagaaaaactagtaactaaaggtgtgatagaacgtattggtttaagcgattctatcttcaccattcatgttaatggcgagaagcttactgatatcagagatatccataatcatgaagaagccgttaatataatgttagatagttttaaagaacatgaaatgattaaagacatcactgatattcaaggaacaggtcatcgtgttgtacacggtggtgaaactttccctaaatcagttgttgttactgatgaagtagaatctcaaattgaagaattaagtgaattagcacctttacacaatccagctaatttaatgggaattagagcttttagaaagttattaccagaaatcccacacgttgcagtgtttgatacttctttccatcaaactatgcctgaacaagcttatttatatagcttgccatatcattactatgaagactatggcatacgtaagtatggtttccacggtacaagtcataaatatgtatctcgtagagctgctcaaattgttggtagaccaattgaagatttaagaattatttcttgtcacatcggtaacggtgcatctattgcagctatagatggtggagaatctattgatacatctatgggattcacaccacttgctggtgtaacgatggggactcgttcggggaatcttgatccagcattaataccattcattatggaaaaaacgggtaaaacagctgatgaagttttagaaatacttaataaagaatcaggattattaggtcttactgggacatcaagtgatttgcgtgatttaactgaagaagctaaacatggacgtcaacgttcccgtgttgctctggatttatttgcttcaaaaattcacaaatatattggctcttatgcagctagaatgcatggtgtagatgttattgtatttactgcaggaataggtgaaaattcacatattattcgtggtaaagttttagaaggacttgagtttatgggtgtttattgggatcctaagaagaatgaaagtttacatggtgaagaaggttatattaactatccacattcacctgtaaaagtacttgttgtacctactgatgaagaagtaatgatatctcgtgatgtgattaaatatggtaaacttaatgataatacacccaaaaaagaagaatttgataccaacgaaagtatcgaagtgaattaa

SEQ ID NO: 957 - DNA, 207 bp, Staphylococcus epidermidis
tctttatacataaggcacctcgttaattttgtttattggtatttattaaattatgcgaaaggtccttatttttcaaagtattttaatgtaaaattacatataaactcaaagtattttggcgagactcttgagggaacaggacaagctgaagactacaggctgaagctgtcccctaagaaagcgagccaacaaaacgaagtattgtaa

SEQ ID NO: 958 - DNA, 570 bp, Staphylococcus epidermidis
ttattattaattaaatattctgtttattatgttaaaatagaattaagaaagataaagggggcaataatgatgatttcttataaaaacatattaatcgcagtcgatggatctcacgaagcagaatgggcttttaacaaagctgtcggtgttgctaaacgtaacgatgctcaattaactattgtgaatgtaattgactcacgtacgtattcttcttatgaagtatacgatgctcaattcacagaaaaatcaaagcatttctccgaagaattacttaaaggttataaagaagtagccacaaatgcaggtgtaaaaaatgtggacacacgtttagaattcggctcacctaaagcaattatacctaaaaaattagcgcgtgatgttggtgctgatttgattatgagtggtacatcaggtttaaatgcggtagaacgttttattgttggctctgtatcagaagcgattgttcgacatgcaccttgtgacgtattagttgtgcgtacagaagaaatgcctgaagatttccaacctcaagtagcaacacctcaattacgtgaaaaatatcaagattag

SEQ ID NO: 959 - DNA, 504 bp, Staphylococcus epidermidis
tgtacggtgattaaacttgggagggtgacatatatgaaatgcccaaaatgtaattctacacattccagagtggttgattcaagacatgcagatgaggccaatgcgattagacgtagaagagaatgtgaaaattgcggaacgcgttttacaacatttgaacatattgaagttagtccattaatagtagtgaagaaagatgggactagagaacaatttttaagagaaaaaatattaaatggtttagtaagatcttgcgagaaacgaccagtacgttatcaacaacttgaagacataactaataaagtggagtggcaacttagagatgagggacaaactgaaatttcttctagagaaattggagagcatgttatgaatttgttaatgcatgttgaccaagtttcctatgtaagatttgcatctgtatataaagaattcaaagatgttgatcaactcttagagtcaatgcaaggtatcttgagtgataataaacggagtgataaatag

SEQ ID NO: 960 - DNA, 273 bp, Staphylococcus epidermidis
gttaaacttgtgttaccaaatggtgtcttgaatgcgaataaaatcatgattacacctataacgattaaagcaatgattgtaactattttaatgattgcgaaccagaattcaagctcaccaaacaactttgcacttaataaattgaaagacattagaataagtacacagaataaagcactaatccaattaggtatgtctgggaaccaaaaacttatatatttggcaactgcagtcacttcagccataccagtaataatccaacatagccagtaa

SEQ ID NO: 961 - DNA, 192 bp, Staphylococcus epidermidis
aatattagtgtctcaggtttttttattaacaataaatttaaaataaacctatttctatcttatcttgaacattcactctgcttaaatttcatatttcttttattaaagtttcctttaagaaaatatatgttgaagttactatttcgtataattgttaagggtaaatttataacttttattaagattatgtaa

SEQ ID NO: 962 - DNA, 1014 bp, Staphylococcus epidermidis
ttatttagagttaattcatactatcaatcacggatggacacttttttaaatagaaagggatattttatgtctgaagaaaatactattatggaacgtctatttcataaattagatgataaagctaaaacgttaaacaaagaaaatggacagagttttatcgaaaatttagggttagctatggaagatatttatacaaaccaaagagaacttttagaacaagcaacgcttcaagatagaaggaaagcttttcaatttgcatatttaagtttattacaagaagaaaatattcaagctaatcatcagatcacgcctgactctataggactcattctcggttttcttgttcaacgctttttagaacataaaaaggaaatgcacattgtagatattgcaagtggggcaggtcatctaagtgcagctgtgaaagaagtactttctgataaaacaattatgcatcatctgatagaggtagatccagtgctatcacgtgtaagtgtgcatttggctaattttttagagataccgtttgacgtttatcctcaagatgcgattatgccattaccattggaagaggctgatgtcgtgattggagatttcccaataggatactatcctttagatgaacgtagtagagaaatgaagttaggctttgaaaagggacacagttattcccatcatctgttaatagaacaatctattaatgcgctaaaaggggcaggttatgcatttttagttgttcctagtcatctctttgaagatgataaagtgaaacagttggaaaatttcattgctacagagactgagatgcaagcatttttaaatttacctaaaacattatttaaaaatgaaaaagcacgtaaatctatattgattttacaaaagaaaaaatcaggcgaaactcgaccagttgaagtcttattagccaatatccctgattttaaaaatcctcaacaatttcaaggtttcatttctgaattgaatcagtggatagtcacaaatcatacaaaaaaatag

SEQ ID NO: 963 - DNA, 3204 bp, Staphylococcus epidermidis
gagaccatggtagcacatttaaatattcatacttcttttgacctgttagattctagtttaagaattgatgcattaatagataaagctaaaaaagaaggatatcgtgcgcttgcaataaccgatacaaatgtattgtacggttatccaaagttttatgatgcttgtattgcagctcacatacatccaatctttggtatgactatatatttaacggatggtctctatactattgaaacggttgttttagcaaaaaataatcaaggactcaagtcattatatcaaatttcttctgctataatgatgagaaataaagaagaagtgccaattgaatggctaaaaagatacgacgaacatttaattatcatatttaaagaggctgagttgtctcataagcaaattattgatgcttttgaaggtaagaaagaattatatttaaatcacaatagtaataatacattgactggcaaacgtgtatggatgcaatctgcaagatacttaaatgaagatgatgctgaaaccattccagcgttacatgccataagagataatactaagttagatttaatacatgagaaagaaacacttgatgaacattttcctagtatagaagaacttcaaacactaaatcttagtgaagatatgattactaacgcgaatgaaattgaagaattatgccaagcagaaattgcataccatcaatccctgttgccacaatttgtgacacctaatggtgaaacttcgaaagattatctttggacgatacttatacataggttacgagaatgggaacttaatgataaaacttatttcaatcggttgaaacatgaatataaaattattactgatatgggtttcgaggattattttcttattgtaagtgatttgattcattttgctaaaacacatgaagtgatggttgggccaggtcgtggttcatcagcagggtcattagtaagttatttattaggtattactactatagacccgttaaaatataatcttttatttgaaagatttcttaatcctgaacgcgtaactatgccagatattgatattgattttgaagacacgagacgtgaaaaagtaattaagtatgtacaagataaatatggtgaacatcatgtatcaggtattgtgacatttgggcatctgttagctcgtgctgttgctagagatgtaggaagaataatgggatttgatgaaacgagtttaaatgagatttcaaaacttattccacataaattaggtataactcttgaagaagcataccaaaagccagagtttaaagcatttgttcatcgtaatcatagaaatgaacgttggtttgaagtgagtaaaaagttagagggattaccaagacatacgtctacgcatgctgcaggtatcattatcaatgatcaaccattattcaaatttgccccattaacaactggtgatacaggattattaacgcagtggactatgacagaagcggaacgtataggattattaaaaattgatttcttgggattacgcaatctatcaattattcatcaaattattttacaagttaaaaaggatttaaatataaatattgatatagaagctataccttatgatgataaaaaagtttttgatttattatcaaacggtgacactacaggtatatttcaattggaatcagacggtgttagaagcgtattaaaaagattgcaacccgaacattttgaagatatcgtagctgtcacatcattatatagaccaggaccaatggaagaaataccaacttatataacccgtagacataatcctaaccaagttgcttatttacatccagatttagaaccaatcttaaaaaacacatatggtgttatcatttatcaagaacaaataatgctaatagcaagtcaagttgctggttttagttatggtgaagcagatattttaagaagggcaatgagtaaaaagaatcgtgcaatcttagaaagtgagcgtcaacatttcattgatggtgcaaaaaataacggttacggtgaacagataagtaagcaaatttttgatttaatacttaagtttgcagattatgggttcccacgtgcccatgctgttagttactcaaaaattgcatacattatgagctatttaaaagtgcactatcctcattatttttatgcaaatatcttgagtaatgtaataggaagtgaaaaaaagactgcagctatgattgacgaagctaagcatcaaagaattagcatcttgcctcccaatattaatcaaagtcattggtattataaggcaagtaataaaggaatatatctgtctttaggtacaattaaaggaattggatatcaaagcgttaaattaattattgatgaacgtcagcagaatggaccttatagagatttctttgatttttcaagacgtataccaaaaagggtgaaaaatagaaaattacttgagtctcttatcttagtaggcgcattcgacacttttggcaaaactagagcgacattattacaagcaattgatcaagtattagatttgaattctgatgttgagcaagatgaaatgcttttcgatcttttaactcctaaacaatcgtatgaagaaaaagaggaactacctgatcaattattaagtgattatgaaaaagaatacctaggattctatattagtaaacatccagttgaaaagaaatttgaaaagaaacaatatttaggcatatttcaattgtctaatggaagtcactaccaacctatacttgttcaatttgaccatatcaaacaaataagaacgaagaatggtcaaaatatggcatttgtaacgatgaatgatggaagaacgatgatggatggagtgattttcccagataagtttaaaaaatacgaaacttctatttcaaaggaacagatgtatatcgtattaggtaaatttgaaaagcgtaaccaacaaatgcaacttatcatcaatcaactttttgaagttgaagcgtatgagcaaacaaaattgtctaattcgaaaaaagttattttacgtaatgtaacacatctagaaccacaatttgaacattcaaaagtagaatctaatgaacaacatgcattaaatatttatggttttgacgaaagtgcaaataagatgacaatgttgggacaaattgaacgtcaacgtcaaaattttgatctattaatacaaacttattcgccagctgatattagatttatttaa

SEQ ID NO: 964 - DNA, 1287 bp, Staphylococcus epidermidis
aatatggaggttaattgtatgtctgcagaaaaaataacacagagtaaagatggtttaaatgtacctaatgaacctattattccgtttattattggtgatggtattggaccagatatttggaaagcagctagccgagtaatcgatgcagctgttgaaaaagcgtataatggagaaaaacgtatagaatggaaagaagtcttagcaggtcaaaaagcttacgatgaaactggagaatggttgccacaagaaacgttagaaacaatcaaagaatatttaattgctgttaaaggtcctttaacaactccaattggtggtggaattcgttcattaaacgtagcactgagacaagagttagatttattcacttgtttacgtccggtacgttggttcaaaggcgttccttcaccggttaaacgacctgaagatgttgatatggttattttccgtgaaaataccgaagatatatacgcagggatagaatttaaacaaggtacatcagaagtaaaaaaagttatagatttcttacaaaatgaaatgggagcaactaatattcgtttccctgaaacttctggtattggtataaagccagtatctaaagaaggtacagaacgtctagtaagagcagctattcaatatgcacttgataataatcgtaaatcagtaactttagttcataaaggtaatattatgaaatttactgaaggttcatttaagcagtggggctatgatttagctcataatgaatttggtgataaagtgtttacatggcaacaatatgatgaaattgttgaacaaaagggtaaagatgctgcgaatgaagcacaaagtaaagctgaacaagaaggtaaaattattattaaagactctattgctgatatcttcttacaacaaatattaactcgtccagctgaacatgatgttgtggcaactatgaatttaaatggtgactatatctctgatgctcttgcagctcaagttggaggcattggtattgcgcctggtgctaacattaactatgaaactggacatgccatttttgaagcaacacatggtactgcacctaaatatgctgatttaaataaggttaatccgtcatcagaaattttaagttcagttttaatgcttgaacatttaggttggcaaaaagccgcagataaaatcactgactctattgaggcaacaattgcttcaaaaatcgtaacatatgattttgcgcgtcttatggatggtgcaaaagaagtttcaacatctgattttgctgatgaactaattaagaatattagataa

SEQ ID NO: 965 - DNA, 732 bp, Staphylococcus epidermidis
ggtatactattaaaagatattacttttaggagggtaactcttatgaaactttcatttcatggtcaatcaacaatttattttgaaggtaacggcaagaaagttatagttgatccatttatctctggcaacgataaatgtgacctagatgaacaaacgttagaggtagattacattatcttaacacatggtcacgctgaccattttggtgatgtagttgaattggctaatcgtaatcatgcaactgtgattggttcggcagaattacaaggatatttatctacttatcacggagtcgaaaatgttcatggcatgaacattggtgggaaggctaaatttgattttggaacagtcaaatttgttcaagcattccatagttctagctttacacatgacaatggtgtgcctgtatatttaggtatgcctatgggaattattgtcgaagctgaaggcaagactatctatcatactggggatacaggattatttagtgatatgaaactgatagcagatagacacccagttgatgtatgttttgttcctattggagataactttactatgggaatagaagatgctagttacgctattaatgaatttattaagcctacaatcagtgttcctattcattacaatacattcccgttaattgaacaagatccagagcaatttaaggatgcagttcaggtaggggaagtacaaattcttaaaccgggtgaatcagtggaattttaa

SEQ ID NO: 966 - DNA, 882 bp, Staphylococcus epidermidis
cagaggatatttggaggtttaccaatgtttaaagatttttttaatcgaagtaagaaaaagaaatatttaacagttcaagattctaaacaaaatgatgtacctgctggtataatgacaaaatgtcctaaatgcaaaaaaataatgtatacaaaagaattgaatgaaaatttaaatgtatgctttaattgtgatcatcatatagctttaaccgcatataaaagaatagaagcaatttcagacgaaggatcatttatagaatttgatagaggtatgacatctgctaacccattagactttcctgggtatgaagaaaaaattgaaaaagatcagcagaagactggacttaatgaagcgttagtgtctggtactgcgaaattagacggaatacaatatggtgtcgcagttatggatgctcgttttagaatgggaagcatgggctctgtagttggtgaaaaaatatgtagaattattgattattgtacagaacatcgtttgccatttattctgttttctgcgagtggtggagctagaatgcaagagggaattatttctttaatgcaaatggggaaaacaagtgtttctttaaaaagacattctgatgcaggactattatatatttcttacataactaatcccactactggaggggtttctgcaagttttgcttcggttggagatattaatttaagtgaacctaaagcactaatcggatttgctggtagacgtgttatagaacaaacaattaatgaaaagttgcctgatgatttccaaactgctgagtttttattagagcatggtcaacttgataaagtcattcatcgaaaagatatgcgtgagactttatcaaatattttaaaaatccatcaagaggtgagtaactaa

SEQ ID NO: 967 - DNA, 309 bp, Staphylococcus epidermidis
tctactgctttagatctagaaaaaatgatacctactacaaaaatcacagttaatagagcaaatattataccaaaaataagatttgcagtgaaaaaagaaaaaatagaaagtgctgctgatagaatagtcaaaacaataaatcctattctcaaaaacttttgtcttttatttttttgtgtttgttcttcttcaaaagtttcttttaacttttcatacaagttctctttttcatgtaattctaaaacttgttgtgtatattcctttttcttttcaaaggtttcgtcaggaacaagctcattctcaacttga

SEQ ID NO: 968 - DNA, 1263 bp, Staphylococcus epidermidis
atgatatttacatccatgtcacacaaggtagtagtgcttatgaataacgaggcgttaactttgtttagaaaacgacaacaagctatacgtaaggagaaaaactattataataaatttatatttaatggtcactttacagtttttctacttatactattaggagcatttatatttggatatggcgaatggttaagtcacattcctccccaaatagactatgcactatttgctagtatagcattagctgttgtttcattattcccaattcgtacactcttaaaagaagcggaccaaatcttcttactaccttttgaaagacacatgaaaaattatattaatgcaagtctgttttatagttatatttcaagaatcagtttaccgttcattttgctaatcgtattctttccattgttttataaattaagtcacaatcattatggattttatatcgcattttctataagtacattgctatatccatatttggtattactcatcaaatggcaatgggttaaattaaataaaaatgtgttcattatcaacatattattatttatacctttagcagtaacgcattacatgattttaagatttcataactatttagcttttttaataatgattatattatttgtaatttatttagtcctaaagactaaagcagatcactatttacttccttgggaaaaagtgattgcaattgaacaacaacatcacacaaattattataaattcgttaatatgtttacagacgtaaaacacctaagagaatcagcagtacgtcgtagttatcttgatttcttactacccgttcctaaaggtgccaaatttaatgagaatcggatgtatttatatttatttataagaagttttgtcagaggacgcgatgctttttctattattttaagattagttattatcgctattatattaatggtatggttatcacaaccggttgtttcattaattatcggtagtttgtttatgtatattattttattacaaatgtctcaattttatacgcaacaagcatacggtttatggcctcaagtttggcctgtatctgatacaaaagttattgcgggatatcagcaatttttaaatcgcttgatgattataatcgctattacatttacgattgtttatgtaatcaaacaccatgacttattcttttttgctgtattattctttatagtaggctggctaaccattcgaaatgcagttaaaaaattaaaatatcaagaaacattattacgtgactaa

SEQ ID NO: 969 - DNA, 624 bp, Staphylococcus epidermidis
atgtttgaaacgataacgacagccgccatcctgtatattgctacagcggttgatttattagttatattattaatattttttgcaagagctaacaattatcaacagtataaagatatttatattggacaatatctagggtcattaactttaatttttgtaagtttgttttttgcttatgtacttaactatgtaccagataaatggattttaggattgcttggtcttataccaatttatttaggaattaaggttgctatattcgatgattgtgaaggggaaagaagagctaaagatgaactaaataaaaaaggattatctgagttatcaaaatctgtagcagtagtcacattagcaagttgtggtgcagataatataggattatttgtaccatatttcactaccataaataattatgaattagttatcactttaatcacatttgtaatcttaatttttattcttgtctttaccgctcaaaaattggctaatatacctggcctaggtgaagtcattgaaagatttagtaggtggataatgtcaatagtctatattggtttaggactattcattatcattgaaaacggaacagttcaaaaactctttcattttgtttttttagtgtaa

SEQ ID NO: 970 - DNA, 522 bp, Staphylococcus epidermidis
agaagtgcagctcgaaatgaaaaaaggtttgcaaatgaggagagaacaaaaatgacaaatcatattgtactatatcaaccagaaataccagcaaatacaggaaatattgcacgtacttgtgcgggtactttaacccatcttcatctaattaaaccactcggctttagtacggaagacaaaatgttaaaacgtgcaggacttgattattgggagcatgttaatattacatatcacgatagtattgaggaattttttgctaatacagaaggtcattactatttattaacaaaatttggtaaacagacctacagcgattttaatttttctaatactaatgaggattattattttatctttggtaaagaaactactggtcttcctgaatgggttaaggagaaatatgcaaaaacagctttaagaattccaatgagtgacaatatacgctctcttaatctttctaatactgctgctttactgatttacgaagctttgagacaacaagattatcctaacctttcataa

SEQ ID NO: 971 - DNA, 507 bp, Staphylococcus epidermidis
gccatgtatttatatacatcttatgggacttaccaatttttaaatcaaattaaacttaatcatcaagaacgtaatttatttcaattttccactaatgattcctcaataatcttagaagagtctgagggaaaatcaatcttaaaacatcctagtgcatatcaagtgattgatagcacaggtgaatttagcgaacatcatttttatagtgctatttttgtccctacatctgaagatcaccgtcaacagctagagaaaaaattattacacgtagacgtacctttaagtaattttggtggttttaaaagctatcgtttattaaaacccactgaggggtctacctacaaaatttactttggttttgcaaatcgaacagcatatgaagatttcaaagcttctgatatatttaatgaaaacttttcaaaagatgcattgagccaatactttggtgctagtggtcaacattccagctattttgaaagatatttatatccaatagaagatcattaa

SEQ ID NO: 972 - DNA, 1161 bp, Staphylococcus epidermidis
aacattttctatttaaagggagtgtatatgatgcataccatattattagtagtttttatgataattttaggagcaataattggtggagtaactaatatgattgcaattaaaatgttatttcatccatttaaaccgtattatatttttaggtttcgtattccattcacaccaggtttgatcccaaaacgtcgtgaggaaatcgccagaaaaattggacaagttattgaggaacatcttattactgaagaactaattcgacagaagttaaatcaaccgcaatcgagaaatatgatacagcaattaatccataaacaaataagtaaattaaaaaatgatgatgtgacaataaaaaaaatagctggatttttagggatagatgttaatgagttggtagattataaattgactactaaatttctaaataaactaaacttttggtatgagtcaaataaatatagaaagttaagtgaaatattacctcagtctttcttagatcaatgtaaaggtcaaatagaatatattactgacttcctatgtgaaagggctagaaattatttaagttctgaaaaaggtgaacgtgatatttatgaaatgttagacacatttttcaatgaaaagggacgcatcattggtttactacaaatgtttatgacaaaagaaagcattgctgacagaattcaacatgagttgattagactaactcaacatcctcaatctcaaaaaataattactaaagtattaaatgatgagtatgaaacatttaaagataagaacttagatgagatcattaaagaacaacaatttaaaaattatagtcaattagtacttaatgaattaaaaacttatttaaatctaaaagataaaacagagagacctatcaaacaagttgttccgcagtttattcaattcctagaagatgatacatcaaaacgtatgactgattttattattaaaggtacttcaaaacatttaacaaacattatgaaaaagattaatttacgtcaattagttgaagaacagattaatacatttgacttaaagtatattgaaaatctaattattgatattgccaacaaagaattaaaattaatcatgacattagggtttatattaggaggtatcattggatttttccaaggagtgattgcaatctttgtctaa

SEQ ID NO: 973 - DNA, 1254 bp, Staphylococcus epidermidis
acaatcttgtacattttttcaattaactttgcagatattctaaggagaatcaaacttatggttaaatttatacactgtgctgatttgcatttggacagtcctttcaaatctaaaagttatcttagtccaaatatttttgaagatgtccaaaagagtgcatatgaaagttttaaaaacatagtcgacttagctttaaaacaggaagtcgattttattattatagcaggtgatttatttgatagtgagaatcgtacattgcgtgctgaagtctttttaaatgaacaatttgaaagattaagaaaagaacaaatatttgtttatatttgccatggcaaccacgatcctcttacttctaaaataacaagtcagtggcctaataacgtatccgtattttcaaatcaagtagagacatatcaagctatcactaaatcaggagaaacaatttatattcatggattcagctatcaaaatgatgcgagttatgaaaataaaatagacgcatacccatcaagtcaaggtcagaagggcatacatattggtgtattacatggaacttatagtaaatcttcggtgaaagaccgttatactgaatttaggttagaagacttaaatcaacgtttataccactactgggcattaggacatatacaccaacgtgaacagttaagtgacatgccagtcattaactatccaggtaatatccaaggaagacatttcaatgaattaggagaaaaaggttgtctattggtcgaaggtgatcatcttaaactcactacacaattttatcctactcaatttattaaatttgaagaagctacaattgaaactgatcatacatctaaacaaggactttatgatgttattcaatcttttaaagataaagtaagaactgaagggaaatcattttatagattgaacgtacgcattaatagtgaagacattattgcaccacaagatttaattcaattaaaagaaatgattactgagttcgaagaaaacgaaaatcaatttgtttttattgaagatttaaatcttcaatatgttcaaaatgacgaaatgccaatagttaaagagttttcaccagaattacttgatgatgcgtcactttttgattcggcaatgactgatttatatcttaatccaagggcttctaagtttttagatgactataatgaatttgataaagttgagttagtcaatcatgcagaaagacttttaaaggatgaaatgagaggtgaacaaaatgataattaa

SEQ ID NO: 974 - DNA, 993 bp, Staphylococcus epidermidis
aggagctatcaacttatgaaattaatgaataaaattatcgtacctgtaacagcaagtgcacttttgttaggtgcctgtggttcaaatgcaactgaatcgaaggataacacacttatttcttctaaagctggtgatgttaaagttgctgacgtaatgaaaaaaatgggcaaagaacaaattgctaacacatcttttagcattgtattaaacaaagttttagcagataaatataaagataaagtagatacaaaagatattgataaagatattaaaaaagaagagaaacaatacggcggtaaagatcaatttgaaagcatgttaaaacaacaaggtatgtcacttgatgattataaagaacagaagaaattatcagcttatcagaaacaattgttactagataaagttaatgtatcagataaagaaatcaaagaaaactctaaaaaaacatcacacattttaattaaagttaaatctaaatctagcgataaagaaggtttatcagataaaaaagcgaaagaaaaagctgaaaaaattcaaaaagaagtggaaaagaatccaaataagtttggagaaatagcaaaaaaagaatcaatggacagttcttcagctaagaaagatggttcattaggttatgtgattaaaggtcaaatggtagatagcttcgaaaaagcactatttaaattaaaagaaggagaagtttctaaagtcgtaaaaacagactatggctatcacattataaaagcagataaagaaactgattttaatagtgaaaaatcaaatatcaaacaaaaattaatcgaagaaaaggtacagaagaaacctaaattattaactgatgcatacaaagaattattaaaagagtataaagtagactacaaagatagagatattaaaaaagcaattgaggattctattcttgatccagataaaatcaaacaacaacagcaacaacaatcacaaggtggttctggattaactaattcaggttcttaa

SEQ ID NO: 975 - DNA, 603 bp, Staphylococcus epidermidis
ataatacgtaacgaatattcacatagagaagaggcatatattatgtttttatgtactcggcaaatcgatatacatgcacggttcggtattcaaagaattgcatttttaagtttagttgcgacaatatttacatttttagttagttatgaagtgatgtattattttttagatacaccactctcagatagacatttttttgtacttatagtgtttatattgctcatgtaccctattcataaaatagtacatcttttattctttttgccttattataaatcttttaaaatccataaattatctagtaagaaatgggtaccatattttaatacttatgttaatacgcctgttcacaaaatttatttttgtattaatctcattctacccatctttttcctatctggtatatttataatgctaagtatatatttacctcaatatggacattattttatgtttttattatcacttaacataggctgttcaatgatggatattttatatttaaagatacttctattttcaaatgatggacattatgtcgaagaacatcaatcaggtcttcatattttaaacaaggtagacaatccttatatacaacactga

SEQ ID NO: 976 - DNA, 636 bp, Staphylococcus epidermidis
aggagcatccttatgcataaagtcattctcgtcgatgatcactatattgtaaggcaaggtttagagtttttattatcaactgtagatgatttatcagttttaaagggttttaaagatggcgcaacatttttatcttatttaaaaaacaatgaaagaccggacatcgtgcttttagacttagtaatgccagagatgaatggtatagaaattactgaaatactcaaacaacaatatcctgaaatcaaagtattagtacttacgagctatgtagatgatgaacatgttatttcagctattgataaaggagctgatgggtatgaaatgaaagatgttgaacctcaaaagttaattgagacaattcataaagttttgcaaggtgaacgtatcatacatcctcaagctaaaagcgtgattaaggccgtatcaaaaaaaccgcattatacgaataagttatctaaacgtgaaaaagaagtgcttaaggaaatggttaaaggtaaaacaaataaagaaattgcaagagcattgtttgtatcagaaaagacagtaaaaacacatgtgagtcatatttttagcaaactagaagtctccgatagaactcaagccgctatttatgcaatggaaaataaattgatttaa

SEQ ID NO: 977 - DNA, 2952 bp, Staphylococcus epidermidis
gaggtgaacaaaatgataattaaatcattagaaatatacggatatggccaatttgttcaacgtaaaattgaatttaatcgtcaatttactgagatatttggtgagaatgaagctggtaaatctactattcaagcatttattcactctattttgttcggatttcctactaaaaagtccaaagaaccacgtttagaaccaagattaggtaatcaatatggtgggaaattatcactcattttcgacgatggcattgaagcagaggttgagagaatcaagggaagtgctcatggagatgtcaaaatttatcttaaagatggtactattcgagatgaagtttggctaaataaaaaacttaattacatttcaaagaaaacatatcaaggtatattctcttttgatgttttaggtcttcaagatattcataaaaatctagatgaagagcaactacaagattatttattagaagcaggtgcacttggatcaactgaatttacaagtatgagagatagaattggacaaaagaaagaagaattatataaaaaatctggaaaaaatccaattattaatcaacaaattgagcaacttaaacaattagaaaatcaaattcgaaatgaagaaagtaaacttgatacatatcatcgacttgtagacgataaagataaatcatcaagaagactagaaaatttgaagcaaaatttaaatcaattatcaaaaatgcatgagcaaaaacaaaaagaggttgctctacacgatcaaacacaagaatggaaaaggttagaacagtcgcttaatatagagcctataaattttcctgaaaaagggatagatagatacgaaactgctaaatctcacaaacaatcacttgaacgagataaaagtttgcgagaagaaagattaagcatattaaataaagaggcggagtccatcaatccagtagaccaaaagtatattgattcgtttaatagcctttatcaacaagagactgaaattaaacaaaaagaatttgagttacgttcaatagagaaagatattgctgataagcaacgtgaactagaagctcttcaatctaatataggttggcaagaagtgttttacgacgcagacagtactgaagcgatgaaaagtcatatgagtgatttagtattaggcaagcaagaacaaattgcttatatcaatcagttagaacgtggacttgaagaaaataaaattgaaagaaactctaattctaatgagattaatcaagttgagaatgagcttgttcctgacgaaacctttgaaaagaaaaaggaatatacacaacaagttttagaattacatgaaaaagagaacttgtatgaaaagttaaaagaaacttttgaagaagaacaaacacaaaaaaataaaagacaaaagtttttgagaataggatttattgttttgactattctatcagcagcactttctattttttcttttttcactgcaaatcttatttttggtataatatttgctctattaactgtgatttttgtagtaggtatcattttttctagatctaaagcagtagattatagcacagcaataagtcaggaaattaatgatttagaaaaccaactcacgcaacttgaaaaagaatataatcttgacttcgatttagaatatcaacaacaagttcgtgaacaatggcgtcatgctaaaaaaaataaaaaaatacttgaagaaaaacatcaatatatcaatcaatcattaacgactgcaaatgagcgattagatagtttaaaacatagcattattgaaataaaaaaagagttacgtttatcagaaaaactttctgatgaattagtggttgaaagtatctcaaccattggtcaaattaaagcgcatgataaatacattattgatttaaatcaacaacgcaataatctgctaaaagatatcaatcacttttatgaacgtgcacaatctgtaactgaaccacatttaaaactatttaatcagatgtctttcttccatgatgtgaaacagtggttaaaaaatgcagaagaacaaaatgaggcttggaataaaaatcaaactgaaacgcaattactcaataatgaattaaagcaattgaagtcacgcttaagtgaaacgaatcaaatgattaagcaattatttgattatgttgatgtagataatgaagaagattattatacacatcatcatcattttgaaacatatcaaagtgatttaaatcgatttaatgatttaaatcaatatttagaaaatcaaaattacacttatgaaatgagttcgcaattaagtgagaaaactactgctcaactagaagaagaagatcatagattggctaaacaagttgacgattacaatgatcaatttttagaaatgcaagcagaagttagtgatttaaatgctcagattaatcatatggaaacagatagaactttagcacaattaagacatgaatattatagcttaaaaaatagacttaacgatattgctaaggattgggcaagcttaagttatatgcaagctttagtggaagaacatatcaagcaaataaaagataagcgtctaccacaagtgattaatgaagctgtatctatttttaaaaatttaacaaatggtacttacaatatgattcattatactgaaaatcataaaatacatgtaaagcattctaacggacaagtatttgagccagttgagttgagtcaatctacaaaagaattattatatgtggctttacgtattagtcttattaaagtattaaaaccgtattatccattcccagtgattgtagatgatgcatttgttcattttgataaatatcgtaaagaacgtatgttgaaatatttgagagaactatcagaacattatcaaatactttattttacttgtacaaaagatcatgtcataccggctaaagaagtattaactttaaataaattacaggaaggcgggaaaaaatga

SEQ ID NO: 978 - DNA, 993 bp, Staphylococcus epidermidis
aataagggcaaaataggggtcattaagagaaaaggcacaaacggacatgaagataaaaaaatttcttcactcaatagattacctgaagctatattatctgtaaaaagtggaaaagtaacaggtgtagttgttgaaaaaccagtaggtgaggcatatttaaaacaaaattcagaactaacattttcaaagattaaatttaatgaagaaaagaaacaaacatgtatagctgttcctaagaactctcctgtacttttagataagctaaatcaaacgattgataatgtaaaagaaaaaaatttaattgatcaatacatgacaaaagcagccgaagatatgcaagatgatggaaattttatttctaaatatggcagttttttcattaaaggaattaaaaatactattttgatttcattagtaggtgtggtattggggtctattttaggctcttttatagctttattaaaaataagtaaaattagaccattacaatggatagcaagtatatacatagaatttttaagaggtactcctatgcttgtgcaagtgtttattgtattttttgggactactgcagctttggggttagatatttcagctttaatttgtggtactattgcgcttgttataaattcttcagcctacattgccgagattattaaagctggtattaatgctgtagataaaggacaaactgaagctgctagaagtttaggattgaattatagacagactatgcaatcagtagttatgccacaggcaattaagaaaattttacctgcattaggtaatgaatttgtaaccttgattaaagaatcgtctatagtttccacaattggagtgagtgaaatcatgtttaatgcacaagttgtacaagggatatcttttgatcctttcacaccattgttagttgcagcattactatatttcttacttacatttgcacttacacgtgttatgaattttattgaagggagaatgagtgccagtgattaa

SEQ ID NO: 979 - DNA, 261 bp, Staphylococcus epidermidis
ggattttcaaatatgttttgtggtgtaccagattcaaccacaacaccatcggccataaatactactttatcacttatttctttagcaaagttcatctcatgcgtgacaatcaccattgtcatactttcattcgctaattgtctcattacttttaaaacatcccctactacttcaggatcaagtgcagatgttggttcatcaaataacataacatcaggttccattgccaaagctcttgcaatagcaactctttgtttttga

SEQ ID NO: 980 - DNA, 405 bp, Staphylococcus epidermidis
atgttaagaaaatactggattcactttgtcatagttactgttatagtgagtttgatatctataaaaggttttccacttgctttaggcgctttatacttgccactactgttcaaaattgtacaacttcagcttaatttatcaaaaggtcttattgataatgtcaatgtacatacatttataaaaagtaatcagtctggtgtggtgatcagtgtgatttgttgtctattaataacgggagttttgacatacaccttggatgatttttataatgaattaccaggatttttaggtgttttagtaagtataagtcctgttactctcactataggcgtgatactatttgttttaactgcaattgctattgttcaggctactaaagcaaaatatcaacaatctaagaattaa

SEQ ID NO: 981 - DNA, 183 bp, Staphylococcus epidermidis
atgatggcgaacaaaaaagattccaaattaaattatcatgaagaagaaaatgctatggttaccgacttagatgatttaaaagaattaggaaaagaaatggaacagatttcacaggaaaatgatgaagaaaaattaaatcaatctcatgataacgaagttcgttcagatttaaaaaaacagtaa

SEQ ID NO: 982 - DNA, 981 bp, Staphylococcus epidermidis
attccaaaccttacttcattgattcaaattaaagatttaaaaggaaggtttttattaatgactaaaacaataggcttattagtaatggcgtatggtacaccatataaagaaagtgatatagagccttattacactgatattagacgtggaaaaaaaccaactgaagaagaactgcaagatttaaaggatagatatgaatttattggtgggctttctcctttggcaggaacaaccgatcgtcaagccgaagcattactcgaagcattaaataaagaacaagatgatgtgaattttaaactttatctcggattaaaacatatatctccatatattgaagaagcagtagagcaaatgcataatgatggaattaaagaagcagtaacagttgttcttgcgcctcattattctagtttttctgttggctcttatgatcaacgtgctcaagaaaaagcagatgaatatggcatccagttaacacatattaaacactattatcagcagccaaaatttattaaatattggacggaaaaaattaatgaaacattagaacaaatacctaatcaagaacatgatgaaactgtattagtagtttctgcacatagtttaccaaaagggttaattgaaagaaataatgatccatatcctcatgaattgcatgaaacagcggaaattcttaaacaggaatctaacatcatccatgttgctgaagggtggcaatcagaggggaatactggaacaccttggttaggcccagatgtccaagatttaactcgtgatttatataaggaacaccagtttaagcactttatctatacgccagtaggttttgtttgtgaacatttagaggtgctttatgataatgattatgaatgtaaagtggtttgtgacgatattggggtaaattactatcgtccagaaatgcctaacacacatccattatttatcggtgctattgttgacgaaattcaatcacatatataa

SEQ ID NO: 983 - DNA, 1167 bp, Staphylococcus epidermidis
aatagcatatgtaattttaaaaaggtggcaaagctaatgaacaataaactaaaaaaagaaattatagactttgctcattctataggcattgatagtattggatttactactgcagatccttttgatgaattgaaacaaaaattagaggaataccatgcaaaagggtatgcatcgggttttgaggaatcaaatatatcattacgtacagaacctaaactaagcttacctagcgcacgttctattattgcaatagctgtgggttatcctaataaacttaaaggtgcaccaaaaagtgttaaaggtgatcgtagaggcatgtttgcaagagcatcatggggccaagattatcatagcattatgcgtaagagacttgataaattagctgatttcatcaaagaaaaagtacctgatgtcgaaatccaatcgatggttgataccggtgtattgtcagatagagcagtagcagaaagagctggattaggattcacgggtaggaatggatttgtgatttctcctgaattagggacttggtcttacctaggtgaaatgttagtaagtataccgtttgaacctgatgatcctttattagatagttgtggtgactgcacaatttgtgttgatcgctgtccaacaggtgcacttgttggaaatggtcagttaaatagccaaaaatgtattagttttttaactcaaactaaaggttatcttcaagatgaatatcgatataaaattggaaatagattatatgggtgtgatacatgtcaacaagtttgtcctaaaaatcgtggtattaatactcagcatgatgatattgtcttggaacctgaaattttgaaaccacgtcttgtacctttacttcaaatgagcaacaagaaatttaaaagtacatatgggcatttggcaggtgcttggagaggtaaaaaaccaatacaaagaaatgctattatagctttggcacattttaaagaagaaagtgctataccagaactaaaagaagttgcattaaatgatccaagacctatgattagaggtactgcatattgggcaattggacaaattttagaggatgatgctatatcttttattgatgagcattatgaaaatgagattgaagaagtgcagctcgaaatgaaaaaaggtttgcaaatgaggagagaacaaaaatga

SEQ ID NO: 984 - DNA, 1386 bp, Staphylococcus epidermidis
atgtcagtcagaattgaacatgatacatttggagaaattgaagtaccagaagacaaatattggggtgcacagactgaaagaagtaaacgaaattttccagtcggcaaagagcatatgcctatacaagtcatttacggatttgctcaactaaaaagaggtgcagccttagcaaatcatgaattaggaaaattgagtgatgaaaaaaagaacgccatcgtttatgcttgtgatcgtattttaaatggagaactagataatcattttccacttgtgatttggcaaacaggtagtggtactcaaagcaatatgaatgtaaatgaagtcgtaagctatgtagctaatgaataccttaagaaacatggaagtaaggaaactatccatccaaatgatgatgtaaataaatctcaaagttcaaatgatacatttcctacagctatgcatgtcgcattgttccatgaagttgaaactaagttagagccagcacttaaccatttacgtcaaacttttaaagaaaaagaagaccaatatcaatcaatcattaaaattggacgcacacatttgcaagatgcaacgcctattaaactaggtcaagagataagtggttggcgctatatgttagaaaaatgtgagcaattactatcagaatcaaaaaagcatattttaaatttagcaattggtggaactgcagtaggaacgggaattaatgctcatccagaatttggtcataaagtagccaaatatatttcccaaaacacagggtatgctttcgtatcatctgaaaacaaatttcatgctttaacttctcatgatgaaattgtacaattacatggaacattaaaagcgctagcgacagatttaatgaaaattgcaaatgatattagatggctagcctctggaccgcgtgcaggtcttgctgagatttcaattccagaaaatgaacctggatcttctattatgccaggaaaagtaaatccaacacaatgtgaaatgttaactatggtagcagtacaagtcatggggaatgatacgacggtaggtatcgcaagttctcaaggtaattttgaactaaatgtatttaaaccggtaattatgcataacactttacaatctatttacttattagcagatggaatgaatacctttaataaaaactgtgcaattggtattcaaccgatagaagaaaatattaataattatttaaatcaatcattaatgctagttacggcactgaaccctcatattggatatgagaaagcagctcaaatagctaaaaaggcacacaaagaaggacttactttaaaagaatctgcaatagaaagtggatatgtaactgaatcacaatttgaagagtggataaaaccagaagatatggtagacccacattga

SEQ ID NO: 985 - DNA, 234 bp, Staphylococcus epidermidis
aatatctgcagtatattctgctactttttcactattatcaaatactttaaaattcattgccatgttaactacactcctctaagtttgctcttttatttaagtcgatttaatttaaagtataccctttgtattaattatcaaactattattttttattggctcacaattaatataacatttcttgggtttatcttgcatttactttatctattagcgttaattatgaaaggttag

SEQ ID NO: 986 - DNA, 963 bp, Staphylococcus epidermidis
attacaggaaggcgggaaaaaatgagaaatgtagaaaaattaaatcccggcgactcagtggatcattttttcttgatccatcgtgcaactcaaggtgttacagctcagggtaaagattacatgacactatttctgcaagataaaagtggtgatattgaagctaaattatggactgctacgaaagatgatatgcaaactttaaaaccagaaacaatagttcatgtcaaaggtgatatcatcaattatcgtggacgcaaacagatgaaaatacatcaaatacgtcttgcacaagctgaagacaaagtgtcaactaaagactttgttgacggtgcgccaatgtcacctacagaaatacaagaggaattatcgcattttatgttagatattgaaaatgctaacttacaacgcattactagacatttaattaaaaagtatcaagatcgttttttcacttatccagcagctagttctcatcatcataatttcgcgagtggattgagttatcatgttttaacaatgttgcgtatagcaaaatctgtatgtgatatttatcctctgttgaatagaagtctattatatagtgctatcattttgcatgatttaggtaaagtaagagaattgagtggtccagtggcgacgacctatactgttgaaggaaatttacttggtcatatctctatagcaagtgatgaagttgctgaaacagccaaagagttaggcattgatggagaagaggttatgttacttagacatatgattttagcgcatcatggtaaaatggagtttggatcgcctaaattgcctcatttaaaggaagctgaaatactttactttatagataatattgatgctaaaatgaacatgtttgataaagctttcaaaaaaacagaaaaaggtcaatttacagaaagaatttttggtttagaaaatagacaattttataatccaacaacacttgattaa

SEQ ID NO: 987 - DNA, 696 bp, Staphylococcus epidermidis
agtcaatggaggtgccttatgacagtaaaagttgaacatcttacagggggatatggaaaaaaacctgtaattaaagatttgaattttgaattagaaaaaggtgaaattgtaggtttaataggtctaaatggtgctgggaaaagtactacaattaaacatatgctaggattgattaatccaatggaaggcaaattatcaatttcaaatattaaaattaatgaagatattgaaaattatagaagaaagttatcttatatacctgaatcaccagtcatctatgatgaactaactttagaggagcacattgaaatgacggcgatggcttatcaattaagtagagaagaggttatgcgtagagctaaaccattacttaaagtttttagattagaaaatgaacttaaagtatttccaagtcatttttctaaagggatgaaacaaaaagtgatgattatttgtgcatttatagttgatccagaattatatattattgacgaacctttcctcggtttagatcctttggggatacagtctatgttagatttaatggtagaaaaaagaaatgaaaatcgaacagtattaatgagtacacatattttggctacagccgaaaggtattgtgatagatttattattttagataaaggtgaaattgttgcatttggtaatcttgatgagttacggaacaaacaggattaa

SEQ ID NO: 988 - DNA, 600 bp, Staphylococcus epidermidis
  unsure (552),(600): Identity of nucleotide at the above locations are unknown.
agtgtttttatttacaatagaattaataaaggagtgagaggaaagatgacagacattataattgtacactcaaaacatggtaattctaaaaatcattggtacgaatggttaaggcataatttaactttggaagggtatgatgtttctttattcaatcttgaagcaaatgatcatgctcaaattgatgagtgggttaatgaaatgaaacaacaactacatatccgtaaaaaagatacatattttgtgacccacggatttggctcaatcgctgctttaaaatttcttgaagaaacgcatcatcacattgaaggtttctttagtatcgcaggatttaaagaagatgcacaagatatagacgaagatgtagatttaaaaggggtaaccatcgattacgataaaataaaagagcaagtagataaattttatggactcacgtctaaagatgatcaatatgtttcatacaaggaaacacaaaggctgatgaattcacttaatggacatacacgtgtagtagaagatgggggacactttttagaagaggaaggttttgtnacatttacttctttaattaacagaatgcaaggatatatgactaggtan

SEQ ID NO: 989 - DNA, 1458 bp, Staphylococcus epidermidis
agtcggtatatggcgtattttaataaatttttaagcaattctgaaaggaagcgtggaaaagtgagtaagaaagtggcaattattggagcgggaatcactggtttatctagcgcatatttcattaaaaaacaagacccttctattgaagtaactatcttcgaagcctcaaatagagtaggtggaaagattcaaacatatagatcagatggttacacaattgagttaggccctgagtcttatttaggtcgtaagacaattatgactgatgtggcaaaagatattggattagaaaatgaccttataacaaatactactggccaatcttatatttttgctaaaaataaattatatcctattcctggtggctcaattatgggaattcctacagatattaaaccatttattaaaacaagactcatttcacctattggtaaattaagagcggggcttgatttgtttaaaaaaccgatagaaattgaagatgatatttctgttggtagtttctttagacaacgattaggtaatgaagtattagagaacttaattgaaccactaatgggtggtatttatggcactgatattgatcaattgagcttaatgagtacatttcctaactttaaggaaaaagaggaacaatttggtagtttgattaaaggaatgaaagacgaaaaagaacaacgtattaagaaacgtcaattatatccaggtgctcctaaaggacaattcaaacagtttagacacggattgagttcttttatagaggctcttgttaaagatattgaaagtaaaggtgtccacatacgatataacacgccagtcaaagatatattgatttcgcaaaaagattatgaaattttattagaagatgacagtaaagagaaatttaatggcttacttgtaacaacaccacatcaagtatttctgaactggtttagtcacgatccagcatttgattactttaaaaacatggattctactactgtcgcaacagttgttttggcctttgatgagaaaaatattaccaatacgtacgatggaactggctttgttattgcaagaacaagtcaaacggatattactgcatgtacttggacatcaaagaaatggccatttactactccagaaggtaaagttttaattcgagcatatataggaaaaccaggtgatactgtagtagatgatcacaccgatgaagaaatagtatcaattgttagaaaagacttaagccaaatgatgaccatctcagggaatcctgattttacaattgtaaatcggttacctaagagtatgccccaataccacgtgggtcatattaaaatgattaaagaaattcaacaacatattaaaacaacttatcctagattacgtgttacaggggcaccgtttgaagctgtcggtttaccagactgcatacaacaaggtaagaatgcagttgatgaaatattagaagagttataa

SEQ ID NO: 990 - DNA, 474 bp, Staphylococcus epidermidis
ataaatagtattgatagacagagtttcacagatttaattcaaacaaaatttaagatggtccgtatagaagcaggctatactcaagatacaatggcacaaaccattggactttccaaaaaaacattggttcaaattgaaaaagaaagagttctaccaaactggactacatgcgtatcaatttgtgctttattcagagattcagatgtattaaatagtacattcggttgtgatccgctcgaaattgtacaaacaatttctagaaaccattgtgcttatccaaatcactcaacaacaagtgatatttactggaatactattgatacacgtaatggtttcattttacaaagtaataaagtaagtaacatttatcgtgttctcaataatgaaaaacagccaatctttggtacttcaaaaatgagggaagctgaaacttacttcaatagaaatgctaaagaagaattaatacacgtataa

SEQ ID NO: 991 - DNA, 441 bp, Staphylococcus epidermidis
aggagtgtcattattatgtcagaaacgatattcagtaaaattatttcaggtgagattcctagttttaagatatatgaaaatgattatgtttatgcattccttgatatatctcaagtttcaaaaggacatacgctattagtacctaaaaaaccttcagcaaatatatttgaaactgatgaagaaacaatgaaacatataggggttgctttacctaaagtagcaaatgcaattaaaaacgcatttcaccctgacggcttaaacattattcaaaataatggtgaatatgccgatcaatcagtatttcacattcatttccatttaataccgagatatgaaaatgatatagacggatttggctataaatgggaaacacatgaagatgtaatcgatgatgaaactaaacaaaaaatagcaacacaaattcaagcacaaatatcttaa

SEQ ID NO: 992 - DNA, 1116 bp, Staphylococcus epidermidis
catttaagcatattaaaatacttaattaagtgcaatatgctatcattggtaagaatgattcaattgtggggggactcaagggtgcgcagcaaaaacgatacaattttaaaagctataaaaggagaaagtacgtcacatacacctgtttggtttatgagacaggctggacgttctcaacctgagtatcgaaaattaaaagaaaaatattctctatttgaaatcacacatcaaccggaattgtgtgcatatgtgacacatttaccagtagataattatcaaaccgatgcggctgtattgtacaaagatattatgacaccactcaaaccaattggtgtagatgtcgaaattaaatcaggaataggacctgtaatttccaatcctattcaaactgttaaagatgtagaaaggctatcccaaatagatcctaaaagagatgtcccatatgtattagatacaattaagttactcactgaagaaaaacttaatgtacctttaataggttttacaggagcgccatttactttagcatcttatatgattgagggagggccttcaaaaaattataattttactaaagcgatgatgtatagagatgaggaaacatggtttgctttaatgaaccatctcgtcgacatttctattgattatgttgtagcacaagtggaagcaggagcggaaatcattcagatttttgattcctgggttggtgcactcaatgtgaaggattatcgctattatattaagccagccatgaataaattgatttctggcattaaagcttattatgatgtacctatcattctttttggtgtcggtgcaagtcatttaattaatgaatggaatgatttaccgatagatgtactaggccttgattggagaactacaataaagcaagctgacaaaatgggagtcaataaagcaattcaaggtaatttagacccatctgtactgttagcgccatgggatgtcatagaatcacgactcaaagacatattaaatcaaggtttaaatcgtggaaagcatattttcaatttaggtcacggtgtatttccagaagttaaaccagaaactttgcgaaaagtgactgaatttgttcataattatacagcgaaatag

SEQ ID NO: 993 - DNA, 1143 bp, Staphylococcus epidermidis
ggggataaaatggagaaaccaactagacttgcattacttaaggaaatagccgaatttctaaatgaagaaactgaaatatatagcatgatgcaaggagctttgcgtttacttataaatgggagcgacttttcaactggttggattttctatattgatgaagaggggcaccatgatttagtttcctctgtagatttacctgaagctttatctaaaaaccattgttactatttgacaaatggttcttgttggtgtgtgcaagcatatcaaaatcataaattaactaaagcttctaatataataaattgttctagaatcaatttagctaatcatgcttatgataaagaaacgaatcatattactcatcatgctactgttccattgcagtctgggagcgaaagattcggtttgcttaacgtagcatctcctaacaaagaacattatagtgaagaagacttagaactattagaatctgtagcatttcaaattggttcagctataaagagaattcagctaactaataaagaaaaagaaaatgccaaaattaatgaacgtaatcgactagctagagacttacatgattcagtaaatcaaatgttattttctttaaaattaacggctcacgctgcaaaagggataactactgacgagcaagcgcaaagagcttttaagactattgaggaaacaagtcaaaatgcagtaaatgaaatgagagcactgatttggcaactaaaaccagttggattagaacaaggcttaattcatgcattacactattatagtaaaatgttaggattagatttgaaagttactattaatggactaatagatttatctaatgatatcgaagaaaatgtatacagaattattcaggaagcaatgaataatgttattaagcacgctaaaactaacaaagtttatcttgatttatcacaaaatgttgattatcttgaggtagatattagagataacggtcaaggttttgacacgcaatcaattaatacgtttttatttaatggtttaaaaaacataaagcaacgtacacagtatttgaacggtaaagttactatagaatcaaaaataaatcagggcactcggatttatattaaaattccattgaagttaaaggagcatccttatgcataa

SEQ ID NO: 994 - DNA, 834 bp, Staphylococcus epidermidis
gaggaaaaaatgaaatttacaatacctaaacaatttaacgattatacattgagagagattttccaatatttaaaattacctaaaaaagacttacatcaactgaatatgtctaaagaaattttaattaataaagagtacggtacattattaaataatgttaaaactggtgatcatgttgagataccaacccctaatgaagtaagtaattatttaccaagttatcgatatgctcaaatttattacgaggatgatgacttggccattgtcatgaaaccaaaaggtgttaaaacgcatcccaatgatttaaaagagagcaacacacttatgaaccatgtgatttacactgttgatagtgaatatgttgagcccatacatcgactagatcaagaaacagtaggtttattgatagttgctaaaaatccgcttatgaaaaaaatcttagaccgaatgttagaatataatgaaattacgcgtatatataaagcaaatgtcaaagcgttgttacctattaagccacaaacgatagatatgcctattggtaaagataaatttcattcaaacaaacgaagaatttccaacacaggtcaacgtgcaatcactcacattattaactctaaaatgattaaagaaggtgtatgtcaactcgacattaaactagatacaggtcgaacacaccaaattcgtgtgcaccttgctgagattggccatccagttattggggatccactttatggaacttcaacattacgacaattagagctaaatagtcatcaaattgaatttactcatccactgactcaagaaattatttctgtaagtctagatgataaatag

SEQ ID NO: 995 - DNA, 729 bp, Staphylococcus epidermidis
gtgccagtgattaatattaaaaatttaaataaaaaatttggagcaaatgaagtattgagagatattaatcttactgttgaaaagggtgaagtggttgcaataattggaccatctggaagtggtaaaagcactttactccgttgtatgaatttgttagatgtaccttcaaaaggtaaagttatatttgaagataatgaattaactcaacataatgttcatttagataatttacgacaaaaaatgggtatggtatttcaaaattttaatttatttcctcataaaaaggtcattgaaaatgtaatgttggcaccacttttattacataaagatagtaaagatcaattaaaagagaaagctttatatttacttgaaaaagtggggcttaaagacaaagcagattcatatcctaatcaactgtctggaggtcaaaaacaaagagttgctattgcaagagctttggcaatggaacctgatgttatgttatttgatgaaccaacatctgcacttgatcctgaagtagtaggggatgttttaaaagtaatgagacaattagcgaatgaaagtatgacaatggtgattgtcacgcatgagatgaactttgctaaagaaataagtgataaagtagtatttatggccgatggtgttgtggttgaatctggtacaccacaaaacatatttgaaaatcctcagcacagtcgaactgaaaattttttatcacgagtgttataa

SEQ ID NO: 996 - DNA, 615 bp, Staphylococcus epidermidis
aggagtgtagttaacatggcaatgaattttaaagtatttgataatagtgaaaaagtagcagaatatactgcagatattctacgtaagcaatttaataataatccaactactattgcaggatttcatttgagcaaagaacatgcaccagtgtttgatgaacttaagaaaaatgtagaaaatcatacagttgatttcagtcaaataaatattttagattatgatgataatcattcttattatgaggctttgggtgtgccaacaggccaaatttattccatttcttacgaaaatgatgcaattgactttatctcagataagattaagactaaagaaaataaaggcaaactgacaatgcaagtccttacgattgatgaaaatggtaaacttgacattagcgttcgtcaaggtttgatggaagctagagaaattttcttagttattactggtgctaataaacgcgatatggtagaaaaactttaccgtgaaaatggtaagactagttttgaaccatcggatttaaaagcacaccgtatggtcaatgttatcttagataaagaagcggctgcaggcttacctgaagacgtaaaagagtacttcactgcacgttttgcataa

SEQ ID NO: 997 - DNA, 366 bp, Staphylococcus epidermidis
ctcaaaggagtgcaaagacttatggcagtaaatttatatgattatgcaaatcaattagaacaagctttaagagatagtgatgaatataaagctattaaagatgcatttgctaaagtaaaagaaaacgaagaatcaaaaaaattatttgatgaattccgtgaaactcaaatgagcttccaacaaaaacaaatgcaaggggaagaaattcctgaagaagatttacaaaaagctcaagaacaagctcaagctatagaaaaagatgaaaatatttctgaattaatgaatgctgagcaaaaaatgagccaagtattccaagaaattaatcaaatcatcgtaaaacctttagatgaaatttacgctgactaa

SEQ ID NO: 998 - DNA, 447 bp, Staphylococcus epidermidis
tcatgcatatttcttgttatactgggtatgaaatactattacaattatccgacaaataaagtgaggagaatcataatgaaagtctcaagaatattatttggtttaggtgtaggtgctgttgcaggatttgcagttgctttaagacatcgtgataaccaaagcgtaaaaaatcatacgattgatgctagtcaacccactggagctcaatcagaattacaacgtgaaatagagaatatgaaacaatccttcaatgatattcttaattacggttcacaaatcaagaatgaaagtattgaatttggaagttcaattggcgaagagtttaaaggattgattggtaattttaaatctgatattaatccaaacatcgaaaaattacaaagccacattgaaaatttacaaaatcgtggcgaagatattagtaataacctttcaaacgataagtag

SEQ ID NO: 999 - DNA, 186 bp, Staphylococcus epidermidis
gatttaatctctgttgaattatattattgtactttagaaaataaaaaaggagcctcattcaatgagactcctttttgttatagcgtcctgggagggattcgaacccccgaccgatggcttagaaggccattgctctatccagctgagctaccaggacattttcaacacaagaattattatatctaa

SEQ ID NO: 1000 - DNA, 183 bp, Staphylococcus epidermidis
atcaatgactccaataggtttattcatacttcttcacccttatttttacaattaccttacattgtatcacagtatcatataactgtagatatttacgtttatagttcttgtaaagtgatattcctatctttattctacaatcatcaaaaaatgaccaaggcaaggttgccttggtcactataa

SEQ ID NO: 1001 - DNA, 1374 bp, Staphylococcus epidermidis
gtttatggattggagtgcattaaattgctaaattacactgaattagaaaataaaaatgttttagtagtaggcttagcaaaaagtggatatgaagcggcgaaacttctccttaaattaggggctaacgttaaagtcaatgatggaaaggatctttcacaggatgcacatgctaaagatttagaatctatgggcattgaggtaattagcggtagtcatcctttttctttattagatgatgatcctatcattgtgaaaaacccaggtattccatatactgtatcaattattaaagaagcagcaaatagaggccttaaaatcttaacagaggttgaacttagctatttaatttctgaggcaccaatcatagcagttactggaactaacggtaaaactactgtcacttcactaatcggtgatatgttccaaaaaagcgtgttgactggacgactttctgggaatattggttatgtagcctcaaaagttgcacaagaagttaaatcagatgagtatttaataacagaattatcatcttttcaattattaggcattgaggaatataaaccacatatcgctatcattactaatatttattctgcacatttggattaccatgaaacgttagagaactatcaaaatgctaaaaagcaaatatataaaaatcaaactaaagacgattatctcatttgtaattatcatcaaaggcacctaattgaatcagaaaatctagaagcgaaaacattttatttttcaacacagcaagaagttgatgggatatacattaaagatggtttcattgtttttaacggcattcgcattattaacactaaagacttagtgctaccgggagaacataacctggaaaatattttagcagctgttctagcatcaatcattgctggagtgccagtcaaagctattgtagatagtcttgttactttttccggtattgatcatagacttcagtatattggtacaaatcgcacaaataaatattataatgattcaaaagcaactaatactttagctactcaatttgcgcttaactcttttgatcaaccaattatttggttgtgtggtggattagatcgtggtaatgaattcgatgaacttattccttatatggaaaatgtacgtgtgatggttgtttttggagaaacacaagataaatttgctaaattgggaaatagtcaaggtaagtatgtgattaaagcaacagatgtagaggatgctgttgataaaattcaagatatagtcgagcccaatgatgttgttctattatcaccagcttgtgcaagttgggatcagtatcatacatttgaagaacgtggtgagaagtttatcgatagattccgagcgcacttgccatcatactaa

SEQ ID NO: 1002 - DNA, 207 bp, Staphylococcus epidermidis
aatatgtctccatcttcaaaagtttataattctattgtaagtgaatatatatcattttcaaagtcaataatgatgtattctttaaaattgatatatcctttgaaaattaatcaaatttgtatttcttttatttcagcgattttaattttaaaacgtatgattattgttttgaaaacagaaaaaatattcaataattattttatatag

SEQ ID NO: 1003 - DNA, 2409 bp, Staphylococcus epidermidis
acaataatgttaatttcaaatgaatggctaaaagattatgtgaatgttgaccagtcagttcaagcgttagcagagagaattacaagaactggaattgaagtcgatgatattattgactatacaaaagatattaaaaaattagtagttggacatgtcttgtcgaagacgccacatccagatgctgataaattaaatatttgtcaagtagacttaggtgaagaagaaccagttcaaattgtttgtggtgcaccaaatgtagatgaagggcaacacgtgattgttgctaaagttggtggtcgtttacctggtggaattaaaattaaacgtgccaaattacgtggcgaacgctctgaaggtatgatttgctcattacaagaaataggtatttcaagtcatgtaactcctaaaaattatgagtcaggtatatatgtatttccagaagcagttaaacctggaacagatgcgttagaagcaatatatcttaatgaccaagtgatggaatttgatttaacacctaatcgtgctgatgcattaagcatggtaggtactgcgtatgaagtcgcagctttatatcaaactaaaatgaataaacctcagttaacaagcaatgaaagtcaagaatctgctaaagatgaactaacaatagaagttaaaaatgaagataaagtaccttactatagtacacgtgttgttcatgacgtgactattggtccttctccagtatggatgcagttccgattaattaaagcgggaatacgtccaattaataatgtggtagatatttcaaattatgtacttttagaatatggccaacctctacacatgtttgatcaagaacaaattggttcgcaatctatagaagttagacaagctaaaaaagatgagacaatgagaactttagatggtgaagaacgtcgattgttagatactgatattgtcattacaaatggcaaagaccctattgcattaggaggtgttatgggaggggatttctctgaagtcactgaacaaacacgacatgttgtagtagaaggggctatctttgatcctgtatctattcgacatacatcacgccgtttaaatttaagaagcgaatcatcgagtcgatttgaaaaggggattgcaactgaatttgtcgatgaagctgtagatagagcttgttatttacttgaaagatatgcttcaggaacagttttaaaagaccgagtttcgcatggagatttaggatcatttgtgaccccaatagaaatcactgctgacaaagttaaccgtacaattggttttaatttaactgatgaagaaatcattgatatttttgagcaattaggatttgacactgaaaataaaaatggtgaaattaccgtgaatgttccatcaagacgtaaagacatttctattaaagaagacttaatagaagaagtagcacgtatatatggatacgatgaaataccatcaacgctacctgtatttaaagatgttacaagtggagaactaacagatcgacagtttaaaacgcgtactgttaaagaaacgcttgagggcgctgggctagaccaagctattacttattcattggtatcaaaaaatcatgctaccgattttgcactacaaaatcgtcctacaattgaattacttatgcctatgagtgaagcacattccacattacgtcaaagtttattaccgcatttaattgatgcagtatcatacaatgttgctcgtaaaaatacaaatgttaagttatatgaaatcggacgtgtcttctttggtaacggtgaaggtgagttaccagatgaagtagaatatttgagtggtatattaactggagactttgtaaataacacttggcaaggtaagaaagagtcagttgatttctatttaactaagggtgttgttgaacgtattgctgaaaagcttaatcttcaattcgattttagagctggtcaaatagatgggttacatccaggaagaacagcaattgtgtcacttaatggtaaagatattggtttcataggtgagctacaccctacgttagctgcaaacaatgatttaaagcgtacgtatgtatttgaacttaattatgatgcaatgatggaagtttctgtgggatatattaattatgagcctatacctagatttccaggtgtaacacgtgatattgcattagaagttaatcatgaagttacttcatctgaattgttatccattattcatgagaatggtgaagatattttaaatgatacactcgtatttgacgtatacgagggtgaacatttagaaaaagggaaaaaatctattgcaattagacttagttatctagatacagaaaacacacttaccgatgaacgtgtaaatgctgtgcatgataaaattttagaagcacttaaaaagcatggtgcaattattagataa

SEQ ID NO: 1004 - DNA, 189 bp, Staphylococcus epidermidis
cgaatcaaaacgtatccgatcgttttggagttattaactcatttaggagtgttaataatgaaattatttaacgcttttaaagacatcttagaagcagccatcactaacgatggcactcaattaggggcaagtattgttaacatcatagaaagtagcgttgatatggtgaatcgatttttgggaaattag

SEQ ID NO: 1005 - DNA, 468 bp, Staphylococcus epidermidis
aataaagaaacaaagggggataacgttatgggtgaagttaaacatttacaaatcaattacaaaacagatgagcttttcgctgatttcagagaatttggtaacaagaacctatatatgattgaggagttaaagggacaaatgattgatgcaagttccgattctcctttttatggaatttttgttggtaataaattagttgcgagaatggcattacttgataaaggagaagtagaagaaacctatttccctaatagcaatgactatattcttctttggaaattagaagtattagatacgtaccaaagacgtggatatgctaagcaactattaaactttgctaaagaaaataaaaaaccaattaaagctattgctagaaataactcaaaagaattctttttaaaacagggttttaaagatgtagaaaccaaaaatcctgaggggcacgacatcttaatatggaatccataa

SEQ ID NO: 1006 - DNA, 1896 bp, Staphylococcus epidermidis
ataaacatctataagattaacataaataaagactggggcattacattgagtaattgctccagctttattttgttttcattaatcaatttgataatggaaaggaggagccctttggaggaatatcaaaagaaaattaaagaaaaattaaacgtagtccctttagagccgggttgttacttaatgaaagatagaaatgatcaggttatatatgtggggaaggcaaagcgtttaagaaatcgtctacgttcttattttacaggcgcacatgatgctaaaacaacccgtttggttggagaaatacgtaactttgaatttatcgtgacatcaagtgagacagaatcgctactgctagagcttaatcttataaaacagtatcaaccccgatataatattttattaaaagatgataaaagttacccttttattaaaattaccaaagaaaagcatccacgattacttgttactcgtactgtaaaaaagaattcaggcaaatactttggtccataccctaatgcatattctgcacaagaaacaaagaaattacttgatcgtatctatccatttagaaaatgcgataatatgccagataagctgtgtctttattaccatattggacaatgcatgggaccgtgtgtctatgatgttgatttagagaagtatgctcaaatgacaaaagaaattacggactttctaaatggggaagataaaacaattttgcatcatttagaagaccgcatgaataaagcgagtgaacagttagattttgaacaagcaaaagaatatagagatatgattcaacacattcacaatttaactaaaaaacaaaagattatgtcttcagataatacaattagagatgtttttggttatagtgtttctaaaggctggatgtgtgttcaagtcttcttcgttagacaaggtaatatgataaaacgtgatgctacaatgataccgttacaacaaacagaggaagaagaattttatacttttataggtcaattttatagtttaaatcagcatctattacctaaggaagttcatgtacctaaaaatcttgataaagacatcattcagtcagtggtagatactaagattgttcaaccagtacgaggagctaaaaaagacatgattaatttagcgaatcacaatgctgaagtacaactcgataataaatttgaattaattgctagagatgagtcaagaacaatcaaagcaattgaagaattaggagagcgtatgggtatccaaacaccaataagaattgaagcttttgataattcaaatattcaaggtgttgatccagtttcagcaatggttacatttgtagatggcaaacctcataaaaaagattatcgaaaatataagattaaaacagtggaaggacctgatgattataaatctatgagagaggtcgttcgtagacgctatacacgtgtactcaacgaggggctacctctaccagatttaataatagttgatggtgggaaaggtcatatgaatggtgtgatggatgtactcgaaaatgagcttgggctagatataccagttgctggtttacaaaaaaatgataaacaccaaacatctgaactactttatggagcaagtgctgaaatagtacctttaaaaaagaacagtcaagcattttatctattacaccgcatacaagatgaggttcatcgatttgcaattacattccaccgacaaacacgtcaaaaaacaggtctgaaatctgttctagatgacattgatggtattggaactaagagaaaaacttcattattacgtacatttggatcgattaagaaaatgaaagaagcatcctttgatgaattacgacaagcaggcttgcctgaaaaggttgctaaaaaccttcaaaacgcgttacaaaacaaataa

SEQ ID NO: 1007 - DNA, 1626 bp, Staphylococcus epidermidis
aggagtaaatacatgaagtgtaatacgttaaagttaactgaacaggatcagttcattaataaaataaaaaatagtgaatctcaaattacatctttttatgaatatgatgcagcgaaaaaggaaagcttttatagaagattaaaaacacctaataatggaagggaatttcatttatcacgagtgattaaatcttacatgaatgaattaaagttaacacatcagcagctgaataacatagatgctttagctgatggtgcaaaagtagtgattggtggacaacaagctggtctttttgggggtccactgtatacgtttcataagattttctcaattataactttaagtcgtcaactttctgaggaatatgatactcctattgtacctgtgttttggattgcaggtgaggaccatgattttgaagaggtgaatcatacgtatgcattcaataataaagaaactaccttgaaaaaagtaaagtatcatacgatgacaccaccagatagtaatgtttcaagatatactcctgataagaacgaattaaaagcatcattaaatcacttttttaaagaaatgaaggaaactgtacatactcaagatgtttatcaaatgtgcgtcaatattattaatcaatttgattcatggactgatatttttaagggattgatacatgaagtgtttaaggattatgggattttacttattgatgctcaataccctgaattaagacagatggagaaaccgttgtttaaagagatattagaaaagaggaatcaagtcgatcaatcttttcgtgaaactcagatacgaacaactcaacaacaacttccatcaatgatacaaacagagacaaacacacatttatttatccatgaagacggaatgagacagcttttaaattttgatggcacttattttaaactgaataaaactgagaaacgttacacgaaacaaaatttattagatattatagaaagagagcctgaaagaatttctaataatgttgttactcgtccagttgtagaggaatggttgtttaacacagtagcatttatcggaggtccaagcgaaatcaaatattgggcagaattaaaaggtgttttcgatacgttaaatgtagaaatgcctattgttatgccaagattaagaatcacgtatttgtatgctagaactaaaaagttattaaaacaatataatttatcgatagagtctgtcattgctaatggagtagaacaggaacgtcaacgttttgttcgtgaaaaagcatcaaataattttataaatgaagtagaagaaatgaaaattcagcaacaagaactttataacaatttattcacctatgtggaaaataaccatgacaaccaacttcttttagaaaaaaataatcaaattcatctcaatcagtacgattatttaatcaaacggtacttactgaatattgaaagagaaaatgatataagtatgcgacagtttagagaaattagtgaaacactccatccaatgggtggtctacaagaaagagtttggaatccacttcaaattatgaatgattttgggatagatgtgttcagtccctccacctatccaccactttcttactcgtttgatcatttgattataaatccttga

SEQ ID NO: 1008 - DNA, 702 bp, Staphylococcus epidermidis
ataggagatttgaatatgaaattcaaaaatatattatttgatttcgacgatacattagtggatttttatgacgctgagaaaaaagcgttttataatttagcacagaaatacaatcatcagccaactcaacaggatttcgaacattttaagaaagtgaaccaagcgcattgggaagcatttcaacaaaataaattgactaaagatgaagtgctgtcacaacgatttattaattattttaatgactatcaaattcatgtaaatggaaaagaagctgataagtgctttagagctgaattagcaatggcaccagttaaattatttgatcatacattagaagttatacaacaattaaaattaaatcattctctctatatagtaaccaatggtgtaacagaaacacagctacgacgaattgctcagacacaatttaatgaaatatttcaagatgtctttatatctgaaaaagctggatttcaaaagccgatgacagagttcttcgattttgtgtttgaacatatcggagagaataacaggaatcaaactctaattgtgggagattctttaacgtctgacatattaggtggtaaaaatgctaatatatcaacatgttggtttaatattagacaaaaagaaaaccatacgtctattcaaccggattatatcattaatgatttatcagaaatgattcgcattgttgagtga

SEQ ID NO: 1009 - DNA, 936 bp, Staphylococcus epidermidis
atgtttcatcatgtgagcgtcatgttaaacgaaaccattgattatttaaatattaaagaagatggtgtgtatgttgactgtacgttgggtggagcaggacatgccctctatttacttaatcaattaaatgataaaggtagacttattgcgattgatcaagatttaacagccatagaaaatgcgaaagaagttttaaaagaacatttgcacaaagtcacttttgttcataacaactttcgagaattaacaaatattttaaatgaattagaaattgaaaaagtagatggtatttattatgacttaggtgtttcaagcccgcaattggatgtgcctgaaagaggctttagttatcacaatgatgcgaaactagatatgcgaatggatcaaacacaatcactttctgcgtatgaagtagttaatcaatggtcttatgaagcattagttaggattttctttcgttacggcgaagagaaattttctaaacagattgcacgcagaattgaagcccatcgagaacaacaacctatagaaacaactttagaactagttgatgtcattaaagaaggcataccagcgaaagcaagacgaaaagggggacatcctgcgaaacgcgtgttccaagctattcgaattgctgtgaatgatgagttatcagcttttgaagattcagttgagcaagccattgaatgtgtgaaggtcggaggtagaatttcagttattactttccactctttggaagatcgtttgtgtaaacaaattttccaagagtttgagaaaggtccagacgtaccaagaggtctacccgttattcctgaagcatatacacctaagttaaaacgagtaaatcgtaaaccgattaccgctactgatgacgatttaaacgaaaacaatcgagcacgtagcgccaagttacgcgtagcagaaatattaaaataa

SEQ ID NO: 1010 - DNA, 759 bp, Staphylococcus epidermidis
agatggagacatattttaatggaacaaattacttctgctcaaaatagtaaaataaaaaatgcgaataaattaaaaaagaaacgtgagagggataaaacgggtcttgctttaatagaggggattcatctcatcgaagaagcttatcaaagtcaaattgaagtaatacaattgtttatcgttgattccgatagaatgtcatcttcaataattgattatgcgaaagaagtgtatcaaattaatctaaaagttgctgaagcactttctggaactgttacacctcaaggtttctttgccattataaaaaaaccaacctatgataagacactagccaaacaagtattattaattgaccgtattcaagatcctggtaatctaggaactttaattaggacagctgatgctgctggattagatttgatagttatggagaaggggacggctgatccttttcaagataaggtgatccgtgctagtcaaggaagcatttttcatataccagtcatttttgatgacatcaacaattatattcatcaatttaatggtccagtgtatggtacggcacttgaaaacgcagtgagcttcaatgatgttgaagcgcaagtcaattttgcgcttatattaggtaatgaaggagaaggtgttaacccagatttactaaaagaaacaacgcaaaatctcactattcctatttatggtaaagccgaaagtttaaatgttgctattgctggaagtatcttaatgtatcagctgaaaggttga

SEQ ID NO: 1011 - DNA, 300 bp, Staphylococcus epidermidis
aatcattttaatccaaggtcaggagaaattagtatgggtgaatttaaaaatagaataaatgttacgattaatgatcaacatttcacaatcattggcgaagatagccctgaacatattcgttatgtagcacatcttgttgatgaaaaaatgcaagaattaggtcaaaaatcagcaggtttagatacaactcgaaaagcgattttaacatctgtgaatattatgcatgagaaagttatattagaagaagagaacagacgattacaacaagaaataaatcaattaaaacaaagagatgaataa

SEQ ID NO: 1012 - DNA, 846 bp, Staphylococcus epidermidis
gtaatggctaatcaatcattaaaagaaactccaaaaactcaaagtaatccacaaactcaagtacaaggtcaaaatcaacaaccaaaacaaaaaacagtaaaattgataattaaacgtcaagataatagcgaatcaaaaccttatgaagaatcatttgaaattccttataaggaaaatttaaacgtaattgcatgtttaatggaaatcagacgaaatccagtcaactctaaaggcgaaaaaacgacaccagtcacatgggatatgaattgcctcgaagaagtatgtggcgcttgttcaatggttattaacggccgtgcaagacaatcatgttcagctattgttgatcaattagaacaaccaattcgtcttgaaccaatgagtactttccctgtcattcgagatttacaagttgatcgctcaagaatgttcgataacttaaaacgaatgaaagcatggattcctattgatggaacatatgacttaggacctggaccacgtatgccagagaaaaaacgccaaactgcatatgaattgtctaaatgtatgacttgtggtgtatgcttagaagtatgtccaaatgtcacaaaaaataataaatttgttggtgcacaagctatttctcaagtacgtttgttcgacttacatcctacaggttccatgactaaagatgagcgtttagatgcattgatgagtgcaggaggactgcaagaatgtggtaattctcaaaattgtgtgaatgcatgtcctaaaggtataccattgacaacgtcaattgccgcaatgaatagagaaacttctttccatatgtttaaatcattctttggttctgaccaccaagtagattaa

SEQ ID NO: 1013 - DNA, 522 bp, Staphylococcus epidermidis
agggtgaacaacatgtctaagtggattattcttagtgataatcacaaagaaacaggtatcttatatcatatttatgaactacataaagatgcagataaatttttacatttaggggattctgaatttagttataatgacacagaacttagtttgtatcagcgtgtgaaaggtaattgtgatttttatccagagtttttagaagaagaaatcactgaagaaaacggaatccgtgccttttatactcatggacatctttatcaagtaaaccaaacacgaatgaaactggctgaaaaggcaaaagaattaggatgtttgtttgccttttatggacatacacatgttgcaaaatatgagcaaataggtggtatccatgtaattaatcctggtagtatttctcaatcacgtagtcaaattgaagaaacttttgccgaactcgtatacaaggaagatgaaaataccatcattttgaattttagaaatagagaaaatcagatcattgaaacagttaagattgaattttag

SEQ ID NO: 1014 - DNA, 1005 bp, Staphylococcus epidermidis
aaagagctaaaattagaaagtgaagaaaaggagatttatatgatctttatatacgcaatcatcgcattactgataacatttattttagtccctatacttattccaacattgaaacgtatgaagtttggacaaagtatccgtgaggaagggcctcaaagccatatgaaaaaaacaggtactcctactatgggtgggcttacatttttaattagtattataattacctctatcattgcaattatctttgtagaccattcaaatccaattattttgttactatttgtaacaatcggttttggtcttattggatttattgatgattatattattgtagttaaaaagaataaccaaggattaactagtaaacaaaagtttctagcacaaataattattgcagttatattctttgtgctaagtgatgtatttcaccttgtgcattttacgacagatttgcatattccatttgtgaattttgatattccgttgtcatttgcttatgtgatatttatcgtcttttggcaagttggtttctcaaatgctgtaaacttaactgatggtttagatggattggcaaccggtttgtcaataataggttttgcaatgtatgctgtaatgagttacatgttagattcaccggctattggcatattttgtattataatgattttcgctttactaggtttcttaccttacaatttaaatccagcgaaagttttcatgggagacacaggaagtcttgctctaggtggtatttttgcaacgatttcaatcatgttgaatcaagaattatcattaatattaattggttttgtgtttgtagttgagacattatctgtaatgttacaagtagcctcatataaattaacgaagaaacgtattttcaagatgagtcctatacatcaccacttcgaattaagtggttggggtgaatggaaggtagtaacagtattttggacggtaggtttaattacaggattaataggtttatggattggagtgcattaa

SEQ ID NO: 1015 - DNA, 957 bp, Staphylococcus epidermidis
aagagtacaaaaaaagagaggattcaattaatgggaaatgtcgtatacaaactcacgtcaaaagaaattcaatcattgatggctcaaactacttttgagacgacgaagttacctcaaggtatgaaagctcgtacgagatatcaaaatactgttatcaacatctatagttctggcaaagtaatgtttcaaggtaagaatgctgatcaacttgcgagtcaattgctaccagataaacaatcaacaactggcaaacatacatcatcaaatacaactagtattcaatataatcgttttcattgtattggaagcgatgaagcaggcagtggcgactattttggtccattgactgtatgtgcagcttatgtgagccaatcacatatcaaaatcttaaaagaacttggtgtagatgattcaaaaaaactaaacgatactaaaatcgtcgatcttgcagaacagctcattacctttatcccgcattctttattaacattagataatgttaagtataacgaacgacaaagtataggatggtctcaagttaaaatgaaagctgtcttacataatgaagctatcaaaaatgtgcttcaaaaaattgagcaagatcaactggattatattgttattgatcaatttgcaaagcgagaagtttatcaacattatgcattatcagcattaccttttcctgacaaaacaaaatttgaaacaaaaggtgaatctaaatcactagcaatcgcggcagcaagcattatttctcgttatgcatttgttaaacacatggaccacatctctaaaaaactccatatggaaataccaaaaggagcaagtaacaaagtagatttaattgccgctaaagtcattcaaaaatatgatattcaacaacttgatactatttcaaaaaaacattttaaaaacagagataaggcaattcatctaatgaatcaaaaatacaataaataa

SEQ ID NO: 1016 - DNA, 810 bp, Staphylococcus epidermidis
agaagtatgaataaacctattggagtcattgattcaggtgttggtggtcttactgtagctaaagaaattatgagacagttaccaaatgaaactatttattatttaggtgatatagcacggtgtccatatggtccaagaccaggagaagaagttaaaaaattcacaacggaactagctcaaaaattgatggaatttgatataaaaatgctagttattgcttgcaatactgctacggcagttgcattaaattatttacaaaacatattacctattcctgtcattggtgttatcgaacctggagcaagaactgctataatgactacaaaaaatcaaaatgtattagttttaggaactgaaggaacaattaaatcagaagcgtatcgcacacatataaaaaagataaatccaaatgtgaatgtctatagtgttgcatgtccgggctttgttcctctagttgaacaaatgcgctataaagaccctacaattactaatattgtgattcatcaaacgttgaagcaatggagaaacagtgatgcggacacggttattttaggatgcacgcactatccgttgttatatcagcctatttatgaatattttagtggtactaaaacagttatctcatctggcttagaaacagcaagagaagtaagtgcattactcacgtttagcaatgagcatgccagttacacagaacatccccaacatagattttttgcgactggtgacaccacacatattaaaaatattattgatgaatggttaaatatgaaagttgaagttcaaagaataactgtagatgattcatag

SEQ ID NO: 1017 - DNA, 522 bp, Staphylococcus epidermidis
atgctcattgatatagttgttcttcttattatttgttactttatagtgatagggtttcgtagaggtatttggttatcgatattgcactttgcttcttcaattgtatctttatatattgcgtcacaacattatcaatcgattgcgcaacgtttagttgtatttgtgccatttccgaaaacggtggcgtttgatatggtctatactataccttatgatcatttgcaatacagatttgaaaaagtgatagcatttattataatatttggtatgtgtaagcttattttgtatctagttgttgttacatttgataatataataacgtataaaaagatacatttagtaagtcggatatcgagtgtcgttttgagtatcatatcggtttttatatatttacaaattggactttatttattatcgctatatccgcattcatttatacagtaccaattatctcaatcgctagtaagtcgagttgtgattgaacaaattccttatttatcacaatttattttaaatttataa

SEQ ID NO: 1018 - DNA, 1827 bp, Staphylococcus epidermidis
tttatatctgaaattaaaagtagggctttagatttaaatattcaggggagtgacatttctatggcagagaaaaaaattattgttgtcggtggaggactagctggtctgatgtcaacaattaaagcggcagaacaaggtgcacatgtagatttattttccattgtaccggtaaagcgttcgcactctgtttgtgcacaaggtggcataaatggtgctgttaatactaaaggtgagggagattcaccgtggattcactttgatgatactgtttatggtggagacttcctggctaatcaaccaccagtcaaagcaatggctgatgctgcacctaaaatcatccatctgttagatcgtatgggggttatgtttaacagaacgaaagaaggcttattagactttagacgttttggcggtacactacatcatagaacagcttttgctggcgcaacgacaggtcaacaattgctttatgcattagatgagcaagttcgttcatttgaggtagatggtttagtaactaaatacgaaggatgggaatttctaggtattgttaaagacgaagaagatgctgcaagaggtattgtcgctcaaaatatgacaacatcagaaattcaatcattcggttcagatgctgtcatcatggcaacaggtggtcctggtattatctttggtaaaacgacgaattcaatgattaatacaggttcagcggcgtcaatcgtttatcagcaaggtgcgatttatgcaaatggtgaattcatccaaatacatccgactgcgattcctggagatgacaaattacgtcttatgagtgaatcagctcgtggtgaaggtggacgtatttggacgtataaagatggtaaaccttggtacttcttagaagaaaaatatccagactatggtaacttggttccacgtgatatagcgacacgtgaaattttcgatgtttgtattaaccaaaagttaggtatcaatggagaaaacatggtataccttgatttatctcataaagatccacacgaattggatgttaaattaggtggtattattgaaatttatgaaaaattcacaggtgatgatccacgtaaagttccaatgaaaatcttcccagcagtgcattattcaatgggtggtttatacgtagactatgatcaaatgactaatatcaaagggttatttgcagctggagaatgtgatttctcacaacatggtggtaaccgtttaggtgccaattctttactttcagctatttatggaggtacagtagcaggtcctaacgctatcaaatatgttgaaaatgttgaaaaatcgtatacagatctagatgacagtattttcgaagctcgtgttaaagaagagaaagaaagatttgatcatttattaaatatgcgtggaactgaaaatgcttataaacttcaccgtgaattaggtgaaattatgacagctaacgtaactgtagttcgtgaaaatgaaaagttgcttgaaacagataaaaaaattcaagagcttatgaaacgttatgaagatatcgatatggaagatacgcaaacatggagcaaccaagcagtattcttcacacgacaattatggaatatgttggttcttgctcgtgtgattacgattggtgcatataatcgtaacgaatctagaggtgcacattacaaacctgaattcccagaacgtaatgatgaagaatggttaaaaacaaccatggctcgttataaaggtagaagtgaaaagccagaatttacttatgagccagtagatgtaagtttaattccacctcgtaagcgtgactacacaagtaagtctaaaggaggtaataagtaa

SEQ ID NO: 1019 - DNA, 1398 bp, Staphylococcus epidermidis
atgctcatggaagagaataaaaatcaacctaataaggagaatatgtcgaataaagacgataatgcaactcatttgaatgacagtcacagaaatgaagacttagagctttttagacggaataaaaacgctcgccaacgcagaagacgtcgtatagataaccaaagtaaagaaaaggatgctacgtctacacaatcacagttagaaactaaaccaatggataaatttatagataatcacaagtcgcataatcaaaacaaagaaataaaaagtgacttaattgaagaaaatgttaatgatgaaaacgacaatcaaaaaaatattaatgataaattaaatgaccgtattgtccaagaaacaaatgaaagtcgtcaaagtactgaagacgatgaggaatttccacttgatcatcggagtgaacaacaacctaaagcctctcgtcattctaaaaagcataaattactaagtaaatttacttctaaaaaagaaaaggaaacatctacatcgttcaatagtaatgagaaggtaactcaaattaaaccgcttagtttagaagaaaaaagagccataagacgtaaaaagcaaaaaagaatccaatataccattatcacactactcattcttatcattgttctcattttactctatatggttacaccactgagtaaaatatcaaatgtaaatgttaaaggtaataacaacgtaagtacgagtaaaataaagaaagaacttaacgttacttcgcgatcacgaatgtatacttttagtaaaaataaagcgattaggaacttaaaacagaatcctttaatcaaagaagttgatattcataaacaattaccaaacacgttaactgtcaacgtgactgagtaccaaattgtcggtttagaaaaaaataaagataaatatgtgccaattatagaagatggtaaagaattaacagaatacaaagatgaagtgtcacatgatgggcctatcattgatggtttcaaaggagacaaaaaaacacgaattataaaagctttatcagaaatgtcacctaaagtgagaaacttaattgcagaggtgagttacgcaccaactaaaaataaacaaagtcgcataaagatcttcaccaaagataatatgcaagttattggtgacattacaacgattgcagacaaaatgcaatattatcctcaaatgtcacaatcattaagcagagatgactctggcgaacttaagacaaatggctatattgatttatcggttggagcgtcatttattccttatcaaggttcatcaactgttcaatcgggtacagaacaaaatgtaaccaagtcaacacaagaagaaaatgatgcaaaagaagaacttcaaaatgtgttgaataaaataaataaacaatctaaagaaaataattaa

SEQ ID NO: 1020 - DNA, 1776 bp, Staphylococcus epidermidis
catgaggtcaggacaaattcgaacgttaatgttatgtcctggtcttctttttatggagtgatattgatgacaaaaaaagatgtaattcaattattagaaaaaatagctatatatatggagctaaaaggagaaaatacatttaaagtttcagcgtatagaaaagccgcacaaagtttagaggttgatgagcgtacattagaagagattgatgatgtaacagaacttaaaggcattggaaaaggcgtaggagaagttattaatgaatttaaaacacaaggtcaatcatcgacccttcaaacacttcaagatgaagtacctgaagggttagtgccacttttgaaaatacagggattaggcagtaaaaaaatagcaaaactatatcatgaacttcaaattacagataaagaaacacttcaacaagcctgtgaagaaggtaaggttagtactttaaaaggttttgcaaaaaagacagagcaaaacattttagaagcagtgaagtcgataggtgctaaaaaagatcgttatcctatagagctaatgagaggactcaaccaagaaattgtaaaatttattgaacagttagaaggagttgaacaatattcaactgctggtagttttcgaagatataaggaaatgagtaaagatttagatttcattattagtacatcggagcctaaaaaagttcaacaacaattacttcgtattccgaataaagtcaaagatgttgctgttggggatactaaaatttctctggaattagcttatgatgatgagacgattggcgttgattttagattgatagaacctgctgccttttaccataccttacaacacttcaccggttcgaaggatcataatattagaataagacaattagcaaaagcacgcgacgaaaaggttagtgagtatggtatcgaacaacaagatggtaagctattacaattacaaagtgaagaagcgatctatcatcattttggtgtagattggattgcgcctgccatgcgtgaagatggtagtgagtttgataaagatctgagtcaaatcattcaattagatgatatcaatggagatttgcatatgcacacaacatatagtgatggtgccttttcgattaaagaaatgattgaggcaaatattgaaaaaggttatgaatttatggtcattacagatcactcacaaagtttaaaagtagctcatggattacaagtcgaccgtctgctaagacaaaatgaagaaataaagcaattaaatgaagaatataaagaaatagacatatattcaggaacggaaatggacattttacctgatggaacattagattacgatgatgaagttttggcacagcttgattatgttatcgcagctattcatcaaaactttaatcaatctgaagacgaaatcatgaaacgtttagaaacagcatgtagaaatccatatgtgcgtcacattgctcatccaaccggtcgtattattggacgtagaaaaggttataaagctaatattgaaaagttaatgaatttagccgaagaaacaaatacaattttagagattaacgcaaatccgcatcgtttagatttaaatgcagaaatcgttcgtaaatatccaaaggttaagttgacaattaatacggatgctcatcatacaaatcatcttgatttcatgaaatatggtgttgctactgcacaaaaaggatttgtcaataaagagagggtcattaatacaatgacgaaggaagcctttcgctcatttgttgaaacgaataaatataagaaatag

SEQ ID NO: 1021 - DNA, 1170 bp, Staphylococcus epidermidis
tttgtcaggaggtgcctatctatggaggaacattactatgtgagcatagatataggttcatcaagcgtaaaaacaatagtaggcgaaaaatttcacaacggaattaatgtgataggtacagggcaaacctacacaagtggtatcaagaatggtttaattgatgattttgatattgcaagacaagcaattaaagatacaattaagaaggcttcaattgcctctggtgtagatataaaagatgtatttttaaaactacctatcatcggtaccgaagtatatgatgaatcaaatgaaattgaattttatgaggatactgaaattgatggcacgcatattgaatcagttttagaaggtatccgggataaaaatgatgtgcctgaaactgaagtgataaatgtattcccaattcgttttgtagttgacaaagacaatgaagtttcagatcctaaagaattaattgcaagacattcattaaaagtagatgcaggtgtcatcgcaatccaaaaatctattttaatcaatatgattaaatgtgttgaggcatgtggtgttgacgtgttagatgtttattctgatgcgtacaattatggttctattctcacaccaacggagaaagaattaggcgcttgtgttattgatatcggtgaagacttaacgcaagttgctttctatgaacgaggagaacttgtagatgctgaatctatagaaatggccggtcgagacattacggatgatattgctcaaggactaaatactacatatgacacagctgaaaaggtaaaacatcaatatggtcatgcattttatgactctgcttcagatcaagatgtcttttcagtagatcaagttgattcagatgaacatgttcaatatactcaaaaagatttaagtgactttattgaacaaagagtcgaagatatattcttcgaagtctttgacgttttacaagagctaggacttacaaaagtaaacggaggatttgtagttactggtggatctgcaaatttactaggtgtaaaagaattactacaagatatggttagtgaaaaagtgagaattcatacaccgtcacaaatgggtatcagaaaaccagaattttcttcggctatttctacgatttctagtagtatcgcttttgacgagttattagattatgttacaattagttat

SEQ ID NO: 1022 - DNA, 336 bp, Staphylococcus epidermidis
aaattaaggaggattggcattatggcaatcgtaaaagtaactgattctgattttgatagcaaaattgaatctggtgttaaattagttgatttctgggcgacttggtgtggaccttgtaaaatgattgcaccagttttagaagaactagcaggagactatgatggtaaagctgacatcttaaaattagatgttgacgaaaacccatcaactgcagcgaaatatgaagtaatgagtatcccaactttaattgtatttaaagatggcgaaccagttgataaagttgtaggtttccaacttaaagaaaacttagcagaagtattagataaacatctataa

SEQ ID NO: 1023 - DNA, 609 bp, Staphylococcus epidermidis
ttcatagaaggagagaatgatatggaagatattgttattgcaactaataatcaaggtaagataaacgattttaaagctatttttaaaaatcaacatgttattggaatttctgagttaattgaggattttgatgtagaagaaacaggtgccacatttgaagaaaacgctaggttaaaatccgaagcggcagcacatgcattaaataagcgtgtcattgcagatgatagtggacttgaagtgttcgcattaaatggagaaccaggcgtatattcagctcgctatgcaggattaggtaagaatgatgaagataatattgaaaagttgttaacgaacttagaagatgttcaagaccgtcgtgctcaatttgtttgtgtgattagtatgagtgcgcctaatgaaaaaacaaaaacatttaaaggaacagtttctggagtgataacaactgaacgacatggaaagaatggttttggttatgatccaatattttttgtcccagaattaaataaaacgatggcggaaattacaaatgatgaaaagggtaaaatcagtcatcgtggaaatgctattcgactgttaaaagaatatttagagggtgaacaacatgtctaa

SEQ ID NO: 1024 - DNA, 189 bp, Staphylococcus epidermidis
ataaacaagggcgtattaatattccgcaaaaatttaaggaaatatgccaatttaagtaaggaatgtacagtaattggtgtctcaaatcgtattgagatttgggacagagaaacttggaatgatttctatgatgaatctgaagaaagtttcgaagacattgctgaagatttaatagattttgatttttaa

SEQ ID NO: 1025 - DNA, 1086 bp, Staphylococcus epidermidis
agggactatataaggaggaattcagtcatgactcaaaatgatctaatgtctgagttgaagcaacaagctttagtggatataaacgaagcaaaagatgcgcaagcgttacaagaagtaaaagtgaaatatttaggtaaaaaaggttctgttagcggcttaatgaaaaatatgaaagatttgcctaatgaagacaaacctgcgtatggtcaaaaggtaaatgaattaagacaaactattcaaagtgaattagatgaaagacaaaagctaatcaaagaagagaaattaaatcaacagctttctgaagaaacaattgatgtcacattgccaagtcgtcatattgaaattggatcaaaacatcctttaacacgtacagttgaagagattgaagacttgttcttagggttaggttatgaaattgttgatggttatgaagttgaacaagattactataattttgaagctttaaacttacctaaatcgcatccagcacgtgatatgcaagatagcttttatatcacagaagaaattttaatgcgtacacatacttcaccagtacaagcacgtactatggaaaaacgtaaaggacaaggaccagtcaaaattatttgtcccggtaaagtttatcgacgtgactcagatgatgcaacacatagccaccaatttacacaaattgaaggtttagtagttgataaagatattaaaatgagcgatttaaaagggactttagagttagttgcaaaaaaattattcggtgcagatcgtgagattcgtttacgcccaagttatttcccgtttactgaaccatcagttgaagtagatgtatcatgtttcaaatgtaaaggacagggttgtaatgtttgtaaacatacaggttggattgaaattttaggagcgggcatggttcacccgaatgtattagaaatggccggattcgattctaaggaatattctggcttcgcatttggtatgggaccagatcgaattgcaatgttaaagtatggtattgaagatattcgtcacttttataccaatgatgtccgtttcttagatcaatttaaagctgtagaagatagaggtgaacaataa

SEQ ID NO: 1026 - DNA, 306 bp, Staphylococcus epidermidis
aaaatgttcatgggagaattcgatcatcaattggatacaaaaggacgtatgattataccgtccaagtttcgttatgatctaaatgaacgttttattatcacaagaggccttgataaatgtttatttggttacactctagaagagtggcagcaaattgaagagaagatgaaaaccttacctatgacaaaaaaagacgcgcgtaaatttatgcgtatgttctcctcaggtgctgtagaagtagaattagataaacaagggcgtattaatattccgcaaaaatttaaggaaatatgccaatttaagtaa

SEQ ID NO: 1027 - DNA, 297 bp, Staphylococcus epidermidis
ttcagtatcatttttaacatctgtttttgtttcatcatcattagtatttactttagcatctttatctgtaccgccagtattaccttgttcagcattttgattgttttgtttagtattaccttgttgcgtattttgattatcattatcatcttgtgtactttgatttgtttgatccccgtcttgaccattagttggtgtattattttgatctggattaggggttgcttcagcgtcttgatttggagcagatccaggtttaaccgtagcaccggcttgatcagttgttccaggtgctga

SEQ ID NO: 1028 - DNA, 1716 bp, Staphylococcus epidermidis
gacaactacattcaaaggagagattacattatgaaaaaatctagtaaattttcaaaagattttcctactagaaaaaatcattacgcaattagaaaattcacagttggcactgcttcgattatcgtaggatcattcttatttttcggacaaacacaagctcatgctgaacaggctgaagaattcgaaagagtaacaactggtacagttgatacaggtggacagcctgctagagcagatcaaggacaagaaggaccacaagcaggcgcggatacgcacaatacagcaagtcaacctggtgttacaggtcaagatgcaccaaatgaaaatcatgctggtgaccaaaatgctgcagtaacacatccggctaatcaagaaaataatgcacctcaagttggggctggtactcctggcgctgagaacacaccacaagccggtggcgaaaatcataatcaagatactgcagtaacttcagcaggtactaatggggaacaaaatggtggtaaaccagctacgtcaacaactggtcaagatgccgcgcaatccaatggacctcaaggtacttcagtagcccaacctggtaatgatgcttctagccaaggtcatgatacacctcaagctgatgctggtactcacaatacagaaggccaacctgctgtaactactggtgagcaaactggtggtaagcctgctgcaacgaaacctgaaggtgccagtgcagaaactgcgccagcgcctaataatgctgatgaaaatcacgctcaaccttcaccgcaaacaggaggtactacagcaacacaagctggacaagtaaaaccatccggtgattctacgcctaccggtgagccaaacaaagcagacgatcaagatacacaaattaaacctacaagtaaccaaggtactacagcaacaactaatgaaattggaaatcaaaaaccaagtggtcaaacaggtaatactgagaacacgcctaatgatggtactcaagtaaaacctaataatgacccagctgtgactggtacgccaaatactaatggagaacaaactggacaacctaatgcaacagtaacaccaggacaaggtaatgaagagattaacggagctagtaaacctggagaagtgtctccgaaacctgaagaaaacaatccaactgccactgaacctggtacaactgcacctggaaatactaatcaagacacacaagtaaaacctaatacagatcagactgctactggtactccagctggtactgataatcaaaatacgcaacaaggcaatactgaacaaaataaccaaaatgctcaaccatcagcacctggaacaactgatcaagccggtgctacggttaaacctggatctgctccaaatcaagacgctgaagcaacccctaatccagatcaaaataatacaccaactaatggtcaagacggggatcaaacaaatcaaagtacacaagatgataatgataatcaaaatacgcaacaaggtaatactaaacaaaacaatcaaaatgctgaacaaggtaatactggcggtacagataaagatgctaaagtaaatactaatgatgatgaaacaaaaacagatgttaaaaatgatactgaattacctgaaacaggactaagtaatgaatatgattatacaactacagtatttggttctatcgctttaatatcttcacttttattactaagacgacaaagaaaagaatctaaataa

SEQ ID NO: 1029 - DNA, 2358 bp, Staphylococcus epidermidis
agggattgcatgagacaaaaaacattagatgtcttggaatttgaaaagattaaatcatttgtggctgatgaaactataagtgatttaggtcgtgaaaaagtacaagagatggctcccgctagtaatttcgatacagtagaatttcaaatgaatgaaacagatgaaatttcacaaatctataacaagcatcgattaccaagcttaagtggtctagcaaaagtgtctccacttgttcatagggctagcataggaggcgttttaaatgtgggagaattaaacagaattaaacgcctagttcaagtgcaaaatcaatttaaaacattttacaatcaaatgctagaggaagatgaagaggttaagtatcctatactgcatgataaaatgaatcatctaccgatacttacagatttatttaaagaaattaatgaaaaatgtgatgcacacgatttatttgaccatgcgagttatactttacaaagtattagaagtaaaatttcaagaacaaatcaacggattcgtcaaaatttagatagaatagtgaaaaatcaagggaatcaaaaaaaactatctgatgcaattgtaacagtaagaaatgatcgcaatgttattccggtgaaagctgaatatagacaagatttcaatggtattgttcatgaccaatcggcatcaggacaaacactatatattgaaccgaattctgttgtagagatgaataatcaaattagtcgtttgcgtaatgatgaagcagttgaacgtgaacgtatattgactgaattgacgggattagtttcggcggaatctgatgcattactcgttgctgaatcggtcatgggtcaaatcgattttttaattgctaaagctcgttatgcgcgcactataaaaggaacaaaacctacatttaaagaggatcgaacgatatatttacccaatgcatttcaccctttattagacaaagatactgttgtagcaaatacaattgaatttattgacgatgtagaaactgtcattattactggaccaaacacgggtggtaagactgtcactttaaaaacgctaggtttgataattgtcatggcacagtcaggattgttaattcctacactggatggaagccaattaagtatctttgaaaatgtgtattgtgatattggagatgaacaatctatagaacaatcattatcaacgttttcatctcacatgaaaaatatagtggaaatattacaggatgcagatcaaaatagtctaattttatttgatgaactaggcgcaggtacagatccaagtgaaggtgcggcactcgcaatgagtatcttagattatgtacgtcgtttaggatctttagttatggcgacaacacattaccctgaattaaaagcttatagttataatcgtgaaggtgtcatgaatgcgaatgtggaatttgacgttgatactctgagtccgacttataaattattaatgggtgttccagggcgatctaatgccttcgatatttcaaaaaaacttggtctaagtctcaacatcattaataaagctaagacaatgatagggacagacgagcaagaaatcaatgccatgattgaatcattagaacacaattcaaaacgtgttgaccaacaacgaatagaattagatagacttgtgagagaagcacaggaaactcacgatgccttgtctaaacaatatcaacagtatcaaaattatgagaaatctttgatggaggaagctaaagaaaaagccaatcagcgtgtgaaatctgcgactaaagaagcggacgaaattcttaaagaacttagaaatctaagagatcataagggcgctgaagtaaaggaacatgaattaattgataaaaagaaacaacttgatgatcaatatgaggcaaaatcaattaagcaacatgttcaaaagaaaaagtatgatacgattcatgctggagatgaagtgaaagttctatcttacggtcaaaaaggtgaagtgcttgaacttgtaggtaacgaagaagcagttgtacaaatgggaattattaaaatgaaattacctattgaagatttagaaaaaacgaaaaagaaaaaagaaaaacctacaaaaatggtaacaagacaaaatagacaaactattaaaacagaacttgatttaagaggatatcgttacgaagaagctttaaatgaattagatcaatatcttgatcaggcggttttaagcaattacgaacaagtttatattattcatggtaaaggtacgggagcacttcaaaaaggtgttcaacaacatttgaaaaaacataaaagcgttagacaatttagaggaggtatgcctagtgaaggtggatttggtgtcactgtggcagaactcaagtaa

SEQ ID NO: 1030 - DNA, 186 bp, Staphylococcus epidermidis
ggaggattaatcatggcagtaccaaaaagaagaacgtctaaaacaagaaaaaataaacgccgtacacattttaaaatttcagtacctggtatgactgaatgccctaactgtggcgaatacaaattatctcaccgcgtatgtaaaaactgtggttcatacaatggtgaagaagtagtttctaaataa

SEQ ID NO: 1031 - DNA, 2337 bp, Staphylococcus epidermidis
tgcgtaataatggcgaagcgaaaaattaaaattaaaaaaaataaaataggagcagtcctacttgttggtttattcggactgctcttttttatattggtgctaaggttttcttatgtaatgattactggccactctaatggtcaagatttaattatgaaagcaaatgagaaatacttagtcaaaaattctcaacaaccagaacgaggtaagatttatgatcgtaatggtaaagttttagcagaagatgtagaaagatataaacttgttgcagttgtggataaaaaagcaagtaaagaaagtaaaaagccgcgacacgtggttgataaaaaaaagacagcaaaaaaattagctgaaatcatagatatggacgctgacgaaatagaaaaacgacttaataataagaaagcctttcaaatcgaatttggtcagaaaggtactaatttaacttatcaagaaaaagaaaaaatagagaaaatgaaattacctggtatagcactttacccagaaactgagcggttttatcctaatggtaattttgcctcccatttaataggcatggcacagaaagatcctgatactggtgaattaaatggtgcattaggtgttgaaaaaatattcaatagttatttaaatggatcaagaggtgcacttaaatatatacatgatatatggggctacatcgcacctaatacgaagaaagagcagcaacctaaacgtggagacgatgtacacttaacaattgattctaatatacaagtctttgtggaagaagctcttgatgacatggttgaacgctatgctccaaaagatttatttgcagtagtaatggacgcaaaaactggtgaaatacttgcatatagccaacgtccgacttttaaccctgaaacaggtaaagattttggcaaaaagtgggcaaacgatttatatcaaaatacatatgaaccgggctctacttttaaaacatacggcttagctgcagcaattcaagaaggtaaattcaaaccggatgaaaagtataaatcaggtcatagaaatattatgggctctgaaatttccgattggaataaaactggttggggacgtatacctatgtcgttaggttttacttattcatcaaatacgttgatgatgcacttacaagatttggttggtgccgataaaatgaaatcttggtatgaacgctttggatttggcaaaaaaacaggtggtatgtttgatggagaagctgcaggtaatattggttgggcaaatgaattacaacaaaaaacatcagcatttggtcaatccacaactgttacccctgctcaaatgattcaagcacaatcggctttctttaataaagggaatatgcttaaaccatggtttgtaagtagtattgataatccaataactaaaaagaattattactctggtaaaaaagagtttgccggtaaaccagtaacggaagaaacagccaataaagttgaagaagaacttgataaagtagtaaatagtaagaagagtcatgctatgaattatcgcgtaaaaggttatgatattgaaggtaagacaggaacagcacaagtagctgattcaaatggaggcggttatgttaaaggtgaaaatccttactttgtaagcttcattggggatgcacctaagaaaaaacctaaagtcattgtctatgcaggtatgagtcttgctcaaaaaaatgatcaagaagcatatgaaatgggtgtgagcaaagcatttaaaccaattatggagaatacgctgaaatatttaaatgttggaaaatctagtgatacttcatcaaaaactgactttagtaaagtgcctaacgtgcaaggagatgaagttcaaaaagcagaggatagcgtcaatgctcaatctcttaaacctattacgattggtaatggcaaacaaattaaacaacaatcagttaagtcaggtaccaaagtcctaccacacagtaaagtaatgttaatgacagacggggaattaacaatgccggatatgaccggatggacaaaggaagatgtacttgcttttgaagatttaacgaaaattaaagtttctactaaaggtaatggatttgtcacgaatcaaagtatctcaaaaggtcaaatcattaaaaataaagataagatagaagtgtcattatctgctgaagatacggatgatgaccaagagaaaactgatgaggactcttcggataacaaatcaaagaaagataaagctgatgaggatcattcaaatacatcttcgtcaactaagaatgataagtcaaacgccgactcgaaaaatgattctgatgacagcacaaatgaaacatcaggttctgagagaaataattaa

SEQ ID NO: 1032 - DNA, 414 bp, Staphylococcus epidermidis
ggagtaagtgtaatggctgtagaaaaaatttatcaaccttatgatgaagcgacacaaaccagtatcccacaaagacaaccacaatcgagtcctgaaaaacaaaccgttaaaagaaaagttgttgttcaacttactagatttgaaaaaattttatacatagctttaataactgtaattgctctaataagtatttatatgctatctttaaaaatggatgcgtacgatacgcgaggaaaaattgcagatttagatcaaaaaatagagaaacaatctagtgagaacagcgcattaaagtctgaaattaagaaaaattcttcatatgaacgcatttacgacaaggctaagaagcagggcatgagcctagagaacgacaatgtaaaggtagtgcgtaataatggcgaagcgaaaaattaa

SEQ ID NO: 1033 - DNA, 651 bp, Staphylococcus epidermidis
caatttaaattatatgtttcgcaggggggactctttttggctcaatcaaagaatgaattttaccttagaagattacattcgttattaggggttattccgataggtgcatttttaattgtacacttaatggtaaaccatcaagcaacgcaaggtgctgaagcttttaatagagcttcaggatttatggaatctttaccattccttattgtgatggaatttatacttatttatataccattgttataccatggtttgttcggtttacacatcgcattcactgctaaggagaacatcgggcattactcattatttagaaactggatgtttttcttccaacgtgtaagtggtattttagcatttgtttttattgcaatgcacttatggcaaacacgtttgcaaaaagctttttatggtaaatctgtggactataatctaatgcatgaaacattacaacatccgttatgggcaatcttttacattatttgtgtcattgctgttgttttccattttgctaatggtttatggtcattttgtgtaacatggggctttttacaatctaaaaaatcacaacgtgtttttacttggatttcactcatagtatttttagtgatttcttatattggtgttgcagccgttattgcgtttatataa

SEQ ID NO: 1034 - DNA, 237 bp, Staphylococcus epidermidis
ggaggtatatcaatggtacacgaattaggaacagtaggaatggtttgtccatttcctttaatagaagcacaaaagaaaatgaatcaattaaatcaaggggatgaattgaaaatcgattttgattgcacccaggctactgaagcattgcctaattgggctgcagaaaatggatatccagttacaaactatgagcaacttgatgatgcatcatggacgattactattcaaaaagcataa

SEQ ID NO: 1035 - DNA, 228 bp, Staphylococcus epidermidis
  unsure (25),(28),(46),(60): Identity of nucleotide at the above locations are unknown.
gaggagtggttagcttttgggaagntangaatggaagccccagtanacggcggccgtaantataacggtcctaaggtagcgaaattccttgtcggtaaagttcgaacccgcacgaaaggcgtaacgatttgggcactgtctcaacgagagatcggtgaaatcatagtacctgtgaagatgcaggttacccgcgacaggacggaaagaccccgtggagctttactgtag

SEQ ID NO: 1036 - DNA, 465 bp, Staphylococcus epidermidis
aaattgataactattcacaatttaaatgaaatggataaatttgctcaaatacttgtaaaacatttaagtgctaaggacttgattttattaaatggtgacctaggagcagggaaaactacattaacgcaatttataggaaaagcgttaggtgttaaaagaacgataaactcaccaacatttaatataatcaaatcttataaaggttctagcatacgattacatcatatggactgttatcgactagaaggtgaggaagatgatttaggtttcgatgaatattttgaagacaatgctatcatagttatagagtggagtaaatttatcaaagatttccttcctcctaatcacttaacgattaatataagtgtcaaaaatgcgaatgagagacaagtatccattgaaacacatgggcaacattatgcattagtaaaggaggcaattttgaatgaactatcttctaattga

SEQ ID NO: 1037 - DNA, 249 bp, Staphylococcus epidermidis
aatggagggttactaatggaacgaacaattcattttacattagttgatcaagtgagtactttgaacagaattactagcgccttcgttcgcttacaatgtaatattgatgaacttcatgttaaacattcagacaaagaaggaatttctaatatgaaacttaaagtcaatattaaagatgatgatacttttaaaattgttcttaaaaaactatcacaacaagtaaatgtactaagtgttaaaagtgaataa

SEQ ID NO: 1038 - DNA, 294 bp, Staphylococcus epidermidis; identical to SEQ ID NO: 235

SEQ ID NO: 1039 - DNA, 1275 bp, Staphylococcus epidermidis
aagacagtgacagtaagaactaaagtttcgacaaaagatatagatgaagcatatttacgtctgaaaaatatagtaaaagaaactcccttacaattcgaccattacttatctcaaaaatataattgtaatgtttatttaaaaagagaagatttacagtgggtacgatcctttaaattaagaggagcttataatgctatttcagtattatccaatgaagaaaaaaataaaggtattacttgcgcaagtgctggaaatcatgctcaaggtgttgcttatactgcaaaaaaactcaatttaaaagctgttattttcatgccagtaactacaccacgacaaaaaatcaatcaagtcaaattcttcggggatagtaacgtagaaatagtattaattggcgatacatttgatcactgcttagcacaagctttaaactatacgaagcaacataaaatgaattttattgacccatttaataatgtatatactattgcaggacaaggtactttagctaaggaaatattaaatcaagctgaaaaagaggataaaacatttgattatgtatttgctgctataggtggtggcggtcttatttcaggagtgagcacatattttaaagcacattccccccacactaaaattattggtgttgaaccaaccggtgccagtagtatgtatcaatcagtcgttatcaaccatagtatagttactttagaaaatattgataagtttgttgatggagcttcagtagcaagagttggtgatattacctttgatattgcgaaagataaagtggacgattatgttcaagttgacgaaggagctgtttgctccacaattctggatatgtactctaaacaagcgattgttgctgaaccagctggtgctttaagtgtaagtgccttagaacaatataaaaagcagattgaaaataaaactattgtatgcatagtaagtggaggcaacaatgatattaatcgaatgaaagaaattgaggagcgttcccttctatttgaagaaatgaaacattactttattttaaatttcccacaaagacctggtgctttaagagaatttgttaatgatgtcctcggacctcaagacgatattacaaaatttgaatatttaaagaaaacatcacaaaacactggaactgttattataggtatacagctgaaacatcatgatgatctcattcagttaaaagatcgtgtatgtcaatttgatccttctaatatttatatcaatgaaaataaaatgttatattcattacttatttaa

SEQ ID NO: 1040 - DNA, 339 bp, Staphylococcus epidermidis
gtgcttgtagccaagatgacactaaagaagatgaacataaaaaatcagaaaacactgctgaaaggaaagctgacgataaaaaagataagaaaactaaagaagataaaaaatctaaaaaagaaaagaaatctcaagaaaatgaagataataagtctacacaagaagataattctactgataatcaagaaacacaagatcctgcaactcaagggcaaaaacaaactcaacaagataatcaacaaaactatgatgaccaacaatcttaccacgaaccaacaaaagatgaggtatatgagtgggataaacaaaatatacctggaggtacagattatggtttga

SEQ ID NO: 1041 - DNA, 522 bp, Staphylococcus epidermidis
atggattttttacagcaaaattggactaatatattgaaaataattgtgtctttgatatcaatagtaacttttataagagtattcctttatgaaaggtctagactcaaagttaatattattggttatgatcaaatagaagaatatttagatgtttacatttctttttctaactcatcaaagttacccatttccattaatgagattcagatatttcataaaaacacaatgattggtgagatagaaaatttcacagaaaaaattctaggtcaaacagatggtaaaagtatagtctattctaacccaatgccattaaatttaaattcttattctagcgacaaagatttattcagaataaaactggtagaagaattacctttaaataaaactttaacttttaaatttataactacacgaaaaaatatcacttataagattaaagatttcaaattaccgcaatatagaaggtcattccatagaaaacttaaacatcacaaaaaggtttcaaataaaaacaaagattaa

SEQ ID NO: 1042 - DNA, 315 bp, Staphylococcus epidermidis
gttgatatttattgtaatgggagattgaaacaaatgactcaagaaataaattgtaatttcaaatcacatatccccagaataatgacagttcccggtatattgttaatacatgaaaataagttggagtttaaggcatatagtcaaaacaataatccattcaatatacaattcgaactctctagcattgtgcggtatagaacatctaaagggttattaggaaataaattgtttatttattattctgatcaggagtggtataaatttagtaacttatctaagagtgacttaaacaaactcacaaaatatttatattaa

SEQ ID NO: 1043 - DNA, 321 bp, Staphylococcus epidermidis
ttctgtatttacatcttctggatcaatcaaaccataatctgtacctccaggtatattttgtttatcccactcatatacctcatcttttgttggttcgtggtaagattgttggtcatcatagttttgttgattatcttgttgagtttgtttttgcccttgagttgcaggatcttgtgtttcttgattatcagtagaattatcttcttgtgtagacttattatcttcattttcttgagatttcttttcttttttagattttttatcttctttagttttcttatcttttttatcgtcagctttcctttcagcagtgttttctga

SEQ ID NO: 1044 - DNA, 417 bp, Staphylococcus epidermidis
ggagttacatataaaatgaaaaagatttttatattattattgagcagtttattagttctagctgcatgtgggaagaactatgaaatcagtgatattacaaacaaatttaaaaaagaaggtttaagtgtcgaaaacttacgaaaaatgaaacgtgaagattttggtatggcaccaatgaaaactgaaaatgctaaaatatttactgtttcagatgataagaatgcacgaatcttaaaatttaaaaatgaagatgacctaaaagaaatgaaaaagtattatgaagaattaggtaaatcaagtgcagcgttctattctcatgtatacactaaagatagattcttaattcaaatgaatggcgatattgacgatcatttatttgaaaaatataaaaaggctatgaatgaggcattagattaa

SEQ ID NO: 1045 - DNA, 1869 bp, Staphylococcus epidermidis
acctaccaacaactcaacaagctattatcattttattatactcgtaaggactcgaactttagaaaagttttaacttctaaatgtttaagtcctatttctagttggatgggacttaacaacgtcccaatattcattgggacgtttttttattttctaaataattatatgggggaacgatatatgcgaagtgatatgatcaaaaaaggagatcaccaagctcctgcaagaagtcttttacatgcgactggcgcttttaaacaacctacagatatgaataaacctttcgtagcaatttgtaactcttatattgatattgttcctgggcacgttcatttaagagaattagcagatatcgcaaaggaagctattagagaagcaggtgctatcccattcgaatttaatactattggtgttgacgatggaatagctatgggacatattggcatgagatattccttaccttcaagagaaattatcgcagatgcagctgaaacagttattaacgcacattggtttgatggtgtattttacattcctaattgcgataaaattacgccaggaatgttactcgcagctgttagaacaaatgtaccagctatcttttgctcaggaggcccaatgaaagcaggtctttccgctcaaggtaaggctttgacattatcttcaatgtttgaagcggttggagcttttaaagaaggaacaatctcaaaagaagcatttttagacatggagcaaaacgcttgtcctacatgtggttcatgcgccggtatgtttaccgcaaactcaatgaactgtttaatggaagttttaggtttagccctaccatataatggtacagctctagctgtgagtgaccaacgtcgtgaaatgattagacaagctgcattcaggttggttgaaaatattaaaaatgatattaaacctcgcgatattatcacacaagatgcgattgatgatgcttttgctcttgatatggccatgggaggttctactaatactgttcttcatactcttgcaattgcaaatgaagcaggtattgactacgatttagaacgtattaatgaaattgctaaaaaaacaccttacctttctaaaattgcacctagttcttcttattctatgcacgatgttcatgaagcaggtggcgtcccagctattataaatgaattgatgaaaaaggatggtactttacatccggatagattaacagttacgggtaaaaccttgagagaaaataatgaaggtaaaaacatcaaaaattttgaagttattcatcctcttgaaaacccttatgataagcaaggtggattatctgttttattcggaaacctcgcacctaaaggagcggtaatcaaggtcggtggagttgatccttcaattaaagtatttacaggaaaggcaatttgtttcaattctcatgatgaagctgttgaagccattgataatcatacagttagagaaggacatgttgttgttattagatatgagggacctaagggaggtcctggaatgccagaaatgctagcccctacgtcttccatagtgggcagaggattaggtaaagatgttgcattaattacggacggtagattttcgggagcaactagaggtattgcagttggacatatttcacctgaagccgcttcaggtggacccattggcttaataagagatggtgataaaattacgattgatttaatcaatagaactctaaacgtagatcaatctgaagaagaactatatcgccgtaaaaatcagcttgaaccattcagagcaaaggttaaaacaggctacttagctagatatactagtttagtcacaagcgctaatactggaggtattatgcaagttccggaaaaccttatttaa

SEQ ID NO: 1046 - DNA, 402 bp, Staphylococcus epidermidis
tcgagtgggcattacaacaaattgaaaataatttcgattttgaagaggagaaataataaaatgagtaatttagaacaaaatattaaacaaatgaaaaatgaagtgatagaggcagaattaaatacaaaaataaatacagttataacaatgattggtgaacacatggatagtaatgaacgatttaaatctcatttagatgcacaaggtaaagtaatggaatcatatatgttaaaagaatactatcagaactattatgtattgatggcagtgcttaactcgatattgaaagatgtaaattttatgaatgatgagattactacatttcatgatagagcattagacgaattagacaaaacaaaagcgtctagtgagaactttggcgaggaatcactaaacgcataa

SEQ ID NO: 1047 - DNA, 1755 bp, Staphylococcus epidermidis
gagatgattaaaatgtcaaatcaaaaatcaatggtttcgcctcacccttctgaacatcaaacaaaggaatcacaacccttaataacacgcagtggttcacaattattagttgaagcacttcagcaggaagatgtagattttatcttcggttatcccggtggagctgtcttacctttatacgatacattttatgacgggaaaatcaaacatattcttgctcgtcatgaacaaggtgctacacatgctgctgaaggatatgcgcgtgtctctggtaaaacaggagtcgttgttgtgacaagtggacccggtgcaacaaatgccattacaggtattactgatgcatatagcgactctttaccattagtcgtttttactggtcaagttgctacacctggtattggtaaagatgctttccaagaagctgatttactctcgatgaccacacctattacaaaacacaattatcaagttaaaaagattgaagacattccaagaattgttcatgaagcctttcatttagcgaacactggaagaaaaggtcctgtagtgattgatttccctaaagatatgggtgtgcttaaaactgatgttgaacttacaaaagatattaatattcctggttatgaagttaatagtagcccaaataaagaggatattaataagttaatatatatgattaaagaagctaagaaacctcttattcttgcaggtgctggtattaatcactctaaatctaatcatttattaacagaatttgtgacaagacatcaaatccctacagtcacaactctcctaggacttggagcagtaccttatcatcaccctttattcttaggtatggggggtatgcatggatcttatgcaagtaatatggctttaacaaattgtgatttacttatcaatttaggtagtcgattcgatgatcgtcttgcaagtaagcctgatgcgttcgcaccaaatgcaaaggttgtacatgtagatatcgacccttctgaaataaataaagttattaatacagatttaggtatagtcgctgattgcaagcatgtgcttgaaaacttatgccatgagcaagttttaacatcctcccacgaagaatggaacgattattgtattaataacaaaagtaactatccatttaaatatgatgaaaatgataaaaccttttgcaaaccacaaaaagcgattgaatatattggtaaagttaccaatggaaatgcaattgttacaactgacgtaggacaacaccaaatgtggacagcacaattctatccatttaaaaattatggacaatgggtaacaagtggtggtttaggtactatgggatttggaattccatcagcaataggagcacaattagctgaaccggagaaaacagttgtatgttttgtaggagatggcggttttcaaatgacgaaccaagaaatggctttacttccagaatatggacttaacgtcaaaatagtacttattaataacggaactttaggtatggtaaaacaatggcaagataaattctttaataaacgattttctcattctgtatttaacgatcaacctgattttatgaaaatggcggaagcatatggcattaagggattcttgatagattctccagataaattagaatcttcaattgatgaagcatttgcatatcatggaccggcactcattgaagttagaatctcacctatagaaccagttaatccaatggtacctagtggcaaatcaaatcatgaaatggagggttactaa

SEQ ID NO: 1048 - DNA, 210 bp, Staphylococcus epidermidis
atgaataataatcagtttaaagtaatcaaagaaatttataatactttacaaaaaacaattgaagataaatcaactgagtataaacacaaaataaaagatggtaacaatgaatggattgaaacagtaaatcgtgaagaacacttgcaagcgttaatcgagtgggcattacaacaaattgaaaataatttcgattttgaagaggagaaataa

SEQ ID NO: 1049 - DNA, 570 bp, Staphylococcus epidermidis
ttggaaatcaaaccaatcactatatataccggaaaaactgtaccccttttttatgacaatatagatactgaccaaatcattcccaaagtgcatcttaagcgggtctctaaatcaggctttggaccttttgcttttgatgaatggcgttacttacctgatggtagtgataatcctgattttaatcctaataaacccgaatatcatggtgcgtcaattctaattactggagataactttggttgtggttctagccgtgagcatgccgcgtgggccttaaaagattatggttttaacattattattgcaggaagttttagtgacatcttttacatgaattgtactaaaaacgcaatgttacctatatgtttaaatcagaaagaaagagaacatttagctcaatttgatgaaataactgttgatttacctaatcaaacagtgtctacggtgtctcagtcttttcattttgatatagatgaaacctggaaaaataaattaatccatggcttagacgatattgctattactttacaatttgaaaatttaatagaaaaatacgaaaaaactttttaa

SEQ ID NO: 1050 - DNA, 1119 bp, Staphylococcus epidermidis
gaatttgcaaaatatggtcctttttactataataccttagtatttatatcggaaaaaggtgataaaatggtgtggacaattataagcggactagtcgttggcatattgctaggatttgtaatgcagagaacaagattttgtttagctggtggatttagagatatgtacgttcagaagagtaacaaaatgttttatgcattgcttattgctattacagtccaaagtattggtttacttattctaaagcacttaaatattattgaggttccagcagaaacatttccagttataggaactattttgggatctttcatttttggaatagggatagtattagctggaggatgcgcgactggaacttggtatagggctggtgaagggttaattggaagttgggtggcattgattttttatgcattgacttcagccgtaactaaaactggggtacttcttccaataatgaatcaaataaataaaacgacacaagttaatacgagtatgacgagtacaactggtataccacaatggattctcgtcatgttattaattttaattacagtatttttagttgtaaaaacaattcgcaaacctaaaataatggtaccccaacttaaacaaaaatatagtggtattagacactatctatttgaaaaaagatatcatccatttgttgctggcattgcagtaggttttattgctctacttgcgtggcctatgagtgaatctactgggagaatgggtggcttaggtataacaacaccatctgcaaatcttgtgaattatcttatttcaggagatttaaaatttattgattggggtgtatttttagtactaggtatattcttaggttcttatatagctgcaaaagggtctaaagaatttagatggagattgccagatattaagacaatacgcaatagtgcgataggtggcatatttatggggtttggtgcttcagttgcaggtggttgctctatcggtaatggtctagtagagacagctacaatgagttggcaaggatggattgctttagcctctatgattattggtgtttggtttatgagttattttatttttgtacaacctatgaaaaagttacaacaagtaactcaaagctaa

SEQ ID NO: 1051 - DNA, 960 bp, Staphylococcus epidermidis
ttttttatgaaaaatatatcagatatagcaaaattagctggagtatcgaaaagtactgtttcacgctttttaaataatggatctgtgagtccagcaacgaaagaaaaaataactaaaataatagaagaaaataattatcagccaaatcaatttgcacaaagcttaagagctcgacgtaccaatttgattggagcaattattccgcgtatgaattcatacgctgttgacgaaacgattaagggtttggtacaccaatgtaatcaacatcgatatcagttattattaaattacacaggattagaaatagatggtgaaatttcggcactaaaaacactatcacgtagtaaagttgatggaatcgtgctaatggcaacacatattactgaagcgcatattgaagtcattgagaaaattgatgttcctgtcattatagtaggacaaaaacacgaccgattatatagtatttatcacgatgattatgaagctggatataaaattggagtactcattggtgaaaaaggttgtcgaaatgtacatttctttggtgttagtgaagaagatattgcagttggtattcaacgtaaactgggagttattcaagcgctgaaggactatcacataagtccgaaaatttatgaaacaacatttaagcatgaacaagcttttaaagatgtaagtcagcaacttgaaagagtacatcatgctgatgcgatagtcggagcaactgataccattgcttttgcaatccataaatactgctctgatcatcaacaaaggttttacaattgttcaatatatggatttggtggagaccctatgactcaaatagtatcacctgtcattcaaacggttagctataattactttgaagcaggagagcaagcattaaaagaaattaaccaactattaaaaggtgaacaaacagcattaaaaataaaaattcctatccaattgaattaa

SEQ ID NO: 1052 - DNA, 648 bp, Staphylococcus epidermidis
atgaatatgaatatagaaatcatcgcaaatcaatttgaaacaagagcagctacgttattaaggtactacacaggattgttagagagcagtagagataaccacttcgcttttaaaatatataatgatccatttgatatggtttatgtgatgatgaacgggaagttattcggtcatgtatatattaaagattgcaaagtaagaaattcattcgaattagcgtctagtaagcacacagagggtcaaataagaagtattgagggatattataacggttttgaaatacacgatgataagcacctatctattagtgatatgatggcaagacaattattcgaagatgaatatttcatgtatggattggagacattcgcagaaagtaataacacagatatgttcacttatattgagggtggattaaatgttgaagaacttgagggcgttcagtctagtaatgctgatgtgataggtaatatcgaaatattatatcaattagctactgggattaatgaacctgcaagtgagctagttgagagcttgaaattggttactgcatttgtacaagatgagaacgctacacaagacgattacaagacgttagagcgtaagttaagtgagttgaaaacatcctattacagtgtgagtaaatag

SEQ ID NO: 1053 - DNA, 210 bp, Staphylococcus epidermidis
aagttaatgaataaagttttaggttacaggaaaatgttaggcaagacacaacaacagatggctaaagaattaaatatttcggaacaatcttatagaaacagagagaaaggaaaaatcaattttaagaaaaatgaaatgattaaatttaaaattatgttattggaaaaaggtttaaaagatattacattagatgatattttttttagttaa

SEQ ID NO: 1054 - DNA, 1950 bp, Staphylococcus epidermidis
aaaggtgagaatcgaatgatacttttacaacttaatgacatctccaaatcgttcgatggtgaagatatcttcacagatgttaattttgaggtgaaaactggcgaaagaataggcgtagtaggccgtaatggagctggtaaatcgacattaatgaaaatcatagcaggtgtggaaaattacgatagtggtcatatatcaaaaatcaaaaatttaacaatgagttatttaactcaacaaatgacactcaattcagaagctactgtctttgaagaaatgtctaagccttttgaacatataaagaaaattgaaaatttaattaaggatgaaaccgattggcttgcacgaaatggacaagattataaatctgatgaatatcaatcacatattgaaaaatatgaaactttaacgaatcgttatgagcaattagatggttatcaatatgaaagtaaaattaaaacagtcctgcacggacttaactttacagaaagcgattttaacaaaccaattaatgattttagtggtggtcaaaaaacacgtctttctcttgctcaaatgttacttaaagaacccgatttactacttcttgatgaaccaactaaccatctagacatggaaacaaccaagtggttagaggattacttaaagtactttaaaggggcaattgtaattatcagtcatgatagatattttttagataaaattgtcactcaagtatatgatgttgctctaggaaatgtaaaacactatgtaggaaactatgagcaatttataaagcaacgtaatcagtattacgaaaaacgcatgcaagaatttgaaaagcaacaagaagaaatcaagcgtttagaaacctttgtagaaaaaaatattactcgtgcatctacaagtggcatggctaagagtagacgtaaaacattggaaaaaatggaacgtattgataaacctatgatagatgctagaagtgcaaatatacaatttggcttcgaccgtaatactggtaatgatgtgatgcacattcatgatttaaaaattggttacgactcacctattacactacctataaacctcgaagtctttaaaggggatcatatagctatcattggtccaaatggtgttggtaaaacaacattgataaaaacaattgctgaaaaacaaaataaactaggtggtcaaattatctttggtgctaatttacaaattggttactatgatcaaaaacaagctgaatttaaatcaaataaaaccattctcgattatgtttgggatcaatatccacacatgaatgaaaaagatgtacgtgcagtattaggacgtttcttgttcgttcaagaagacgtaaaaaaaattatcaatgacttatccggcggtgaaaaagcacgattacaattagcacttttaatgttgcaacgtgataatgttcttatcttagatgaaccgactaaccatttagatattgattctaaagaaatgcttgaacaagcattgaaagattttgaaggcacaattatttttgtatcacatgatcgttattttattaaccaacttgcaaataaagtttttgatttaaatattaatggtggccaaatgtttttgggagattatcagtattatattgagaaaactgaagaagctgcagctatcaaagcacatgaaacagtaactcaaaataattttgaaaataaagagattaatcaagacgcaaatacttcaacctacatcagtcaaaagcaacaaaaaagacaacaacgtaaattagaaagacaaattgaacattgtgaaagacaaatcgaagaattagaagcacaaatatcacatatcgaagaacagttaacacaacctgaagtatttaacgaccctctaaaagctagtaaatttgccaatcaaaaatccgatatcgaacaaaaattagaacaaataatgttggagtgggaaaaattacaagaaaagctctaa

SEQ ID NO: 1055 - DNA, 1386 bp, Staphylococcus epidermidis
gaggaggagaaaattatgggtcaaacactgtttgataaagtatggaaaaaacatgtgcttcatggaaaagaaggtgaaccacaattattatacattgatttacatctcattcatgaagtcacttctcctcaagcatttgaaggacttagaatacaaaatcgtaaactcagaagacctgatctaacctttgcaactttagatcataacgttcccacaattgatatttttaatataaaagatgaaattgcccataaacaaattacaactttacaacaaaatgctaaggactttggtgtacatatttttgatatgggttctgacgaacaaggtattgtacatatggttggaccagaaactggattaactcaaccaggaaaaactattgtatgtggagattcacatactgctacacatggcgcatttggtgctatcgcatttgggataggaacaagcgaggttgaacatgtatttgctacacaaacattatggcaaacaaaacctaaaaatttgaaaattaatataaatggttctttaccaactggagtttatgctaaagacattattttatatttaatcaatcaatatggtgtagatttcggtactggttatgctcttgaatttacaggggaaactataaaaaatttatccatggaagcacgtatgacgatttgtaatatggctattgaagccggagcaaagtatggtttaatgcaaccagatgaaacaacctttgattacgtaaaaggtcgtccttatgctactgattttgatagttctatggcgtggtggaaaaaactttattctgatgatgatgcctattttgataaagttattgaacttgatgtaacaaatttagaacctcaagtaacttggggaactaacccagaaatgggagttagttttagtaatccattcccagaaattaaaaatgcaaatgaccaacgtgcttatgactatatgggacttcacccaggtcaaaaagccgaagatataaaattaggttatgtttttttaggttcatgcacgaatgcaagattatctgatcttattgaagcaagtcatataattaaaggacaacaagtacatccaaatattactgctattgtggttccgggttcaagaactgttaagaaggaagctgaagctctgggactagataaattatttaaagatgctggatttgagtggcgtgaaccaggatgttctatgtgcttaggtatgaatccagatcaagttcctgaaggagtacattgtgcatccacgagtaatcgcaattttgaaggaagacaaggcaaaggcgctcgtacacatttggtatcccctgctatggctgctgctgctgcgattaatggtaaattcattgatgttagaaaggtggtagtataa

SEQ ID NO: 1056 - DNA, 876 bp, Staphylococcus epidermidis
aaattgagtgaaattaaattagaatatgatactcaagtttctgtaatttggtatggaactttggattcaagatcgtttaaacagttttcgcagcctaaatggagcgagttagttaatagattatctataccacaaaacaatactaacaaatatgctcgaggtgttgctgtttatggtgatatgaaagacgatactgacgaaaatggtaatgagtataaaaaatatcgtaaagacggaaacgtgatttatcgtgatgtcctagtgctggactacgacgacattcctaagttgagactactacacgatgcaattacggagactttaaaaggtgtttcctggatgtaccacactacatttaaccatcggacagaaagccctagaatacgtttgtatatcgctttgagtgagcgaataagtgcagatgattatcgcaaatatacaaaagtgttagcaaataagataggtcatctagtagatgaggggagttttcaacctagtagagcgatggctttgccagtttatataaaaggtaaacatccgttcttacatcaatataatgatgctcccattttgaatgttgaaatgcttgaaaaatggtcaaaagaaacaaatatacaaacagatcaaccaagtaaaactaactttaataagcgtgatgatacttattggcgtgatattagtttttcagttactaagggcaatcgtaataattctttagcaagtctaataggacatttgttcagccgacatgttaatgaatatattgtatactcgtatgctttgctatggggacaaaatgcgtgtaatccaccattaaacgaacgggaaataaacgctacatttcaatccattttaaagaagcatcgtaataagtag

SEQ ID NO: 1057 - DNA, 312 bp, Staphylococcus epidermidis
ttaatgaccgacgcaaaactacgcgaaaggagtgtttgtatgccatatgttaatttacaaaatctaccaactaaagcaaatgtagtgactgaacctaatcaagtagtagtaaagccaatcatggcaaaacctaatgttattgctaaactatttggtatttcatacagttcagttaatcgtatattgaaagaatgggagaaagattctaagggtattgatgatttatattactctctatcatcaacgatgacagttatcagtatttctcgatttgaacagtatatgaaaaaacgtcataaagattggatgtaa

SEQ ID NO: 1058 - DNA, 1479 bp, Staphylococcus epidermidis
aacatagtggagtggactcgtgaagagagataccaacgtattgaagatgttgatgaaacatatcttgagcaactgaaacaccaagtggatacatctttatatagacaaacatttcatattcaacctgaaatgggtttattgaatgatccaaacggactcatttattataatggacactactatatttcacatcaatggtttccgttaggtgctgtgcacggtttaaaatattggtttaattataaaagcaaagatttattacattttgaaccacaaggaacacttcttaaacctgatactaagtatgatagtcacggcgtatacagtggaagtgcttttgaatatcaaaatcatctttattatatgtatacaggcaatcatcgtgaccaacattggaatagaatttccagtcaaatgattgccagaatgaacaaagacggaaaaatagagaagtttcctaaacctgtgattcatggacaacctgaagggtatacaagtcatttcagggatccaaaggtatttgaaaaaaatagtcaactgtacgctattctaggtgctcaaaatgaaaatgagatggggcgtttacttttatatcgtagtcaagatgttgttgattggcattttgaaggtgagattaaaaccaatctgacacaatttggttatatgtgggagtgtcctgattattttagactaagcaataaagatgtcatactcatgtgtccacaaggcgttgaagctgaaggagataaatttagaaatatctatcaatcagggtatatgataggagatttaaactttaataatctattttttgaccatgaaagttttcaagaattggataatggttttgatttctacgcgccacaaacgtttgttgatgcagacgggcaacgcattttaattggatggatgggactaccagatacagagtatcctacagataaagaggggtgggcacattgccttactattcctcgagtgcttaccattgaaaatggaaaacttaagcagcgaccttttaagcagttagaagatttaagaacaaataaagaaacagctttgggatatgctaataaatttaaacgtaaattacatccatatgaaggtaaacagtatgagatgattatagatatattagaaaatgatgcttcagaaatatattttgaattgcgtagctctcgatctgaatctacactgattacttataataaacacgaaaataaactcactttagatcgtaccgatagtgggacactaccatcaaatgtcgatggaacaacacgttctaccattttagattcaccattaaaacagttacaaatttttgtggatacatctagcatcgaaatattttgtaatgatggtgagcgtgttttaacctcacgtattttcccaaatgaggatgctactggtataaaagcttcgactgaatctggtcaagtatatttaaaattcactaaatatgaattaaaagggtga

SEQ ID NO: 1059 - DNA, 1254 bp, Staphylococcus epidermidis
tgggtagcacttctaccctttttatttaggagagataaaatgtggcatgagaaatttactaacaaacatggtgatgtacaatatcgctattatgagaagtataaagatccactcacaaacaaatggcgacgtgttagcgtggtacttaataagaatggtaagcaatcacaaaaagaggctcagaaactcttaaataagcgtatagaggcgaagataaacgacaagacgccaattgacttaaaaacacttactttccatcaagcatgtgacgaatggctagatagatacataaaaacatcaggttcaaaacaatctacaattaaaactaaaaaatacaaaatcaagcatatcaaacgcaatataaattcagatattctagtcaaaaatatgaatagcgatgttgttcaaaagtcagtagacaatgctgttaaagataatctaagtcataaagttgttaaagatgctatgagcatcataagaaacattatgaagtacattcagcgcaaatataaacttacagatattagttatttagatgatattgttattcccaaaaaggctactacaagagaagaagtaaaagctaagcgtgaaaattatcttgaaatggatgaagtaaaagcaattgtagacaatttacatgaaatagctaattcaaagcgtgctgattatatgaaacgttctttcatcatgactgcttatattatggaatttcaagcacttaacggtatgcgtataggtgaattactagccatacaacctaataacattgatttcgacaaaaagacactagaaatagatggcactattcattggcgtaatgaaggtaacgcagtaggttttaaagatacaactaaaactgaatcatcttatagaacaatctctttaactacacgtagttgcgatatattaagaaaagttatgttagaaaacaaaaaggctattcaatgggaatctatgtatcaagatagaggcttcatattcactaactatcgtggcaatcctatgtcacttagcaccattaatagaaatatgcaacaatctgcaaacaatgtaggaattacaaagcacataacaagccatactatgcgtcatagccatatatctttattatcacaattaggcatatcacttaaagccattatgcaacgtgtaggacatacagaccataaaacgaccttgcagatatacagtcatgtaactgatcaaatggataaagatatgatgaataaattagaaaaggtaggtaactaa

SEQ ID NO: 1060 - DNA, 546 bp, Staphylococcus epidermidis
aggagaatccgtatgaaaagattattaggaacattatttgcagctacacttgtattaagtgcttgtagccaagatgacactaaagaagatgaacataaaaaatcagaaaacactgctgaaaggaaagctgacgataaaaaagataagaaaactaaagaagataaaaaatctaaaaaagaaaagaaatctcaagaaaatgaagataataagtctacacaagaagataattctactgataatcaagaaacacaagatcctgcaactcaagggcaaaaacaaactcaacaagataatcaacaaaactatgatgaccaacaatcttaccacgaaccaacaaaagatgaggtatatgagtgggataaacaaaatatacctggaggtacagattatggtttgattgatccagaagatgtaaatacagaatcagaagataatgctcgacaaaatagaatagatgaaattaacgaagaaatggaagatcctaatatttccgtcagtgattataacaaattagtagacgaatataatgaattaaataacgaataa

SEQ ID NO: 1061 - DNA, 207 bp, Staphylococcus epidermidis; identical to SEQ ID NO: 239

SEQ ID NO: 1062 - DNA, 1065 bp, Staphylococcus epidermidis
gttgaaagaaggtatacgtacatgagttataaaatagttgccttacctggagatggtataggaccagagattctatctggtacattagaacttttaaaattaataagtgaaaaatatcattttgaataccatttagaaagtcatcattttggaggcgtttcaatagattattatggtacacctttaactaatgaaacattacaatcatgtaaaaatgcagatgctattttattaggtgcgattggagggcctaaatggacagacccaaataatcgtccagaacacggtttgttaaaactgagaaaatccttaaatttatttgctaatattcgacgtacatttgtaactaaaggggctagtcatctttcaccactaaaacaagatattgtagaaggcacagatttagttatagtaagagaattaacgagcgggatttattttggtgaaccaagctatgttaaaaaaaccgaagctttagactcattaaaatattcaagtcaagaaattgaacgtattgtgagaatcgcttttaatcttgcaaatcgtagacgtaaaaaattaacttctgttgataaggaaaacgttctatcctccagtaagttatggcgacagatagtaaatgatgtaaaaaaggattatccagaagtagaagttaatcatatgctagttgatgcttgtagcatgcatctgattacccaacctacgcaatttgatgtgattgtaacagagaatcttttcggagatatcttaagtgatgaagcatctgttataccaggctctctaggtctttctccatcagctagttttggtcaaacaggtacacgtctttatgaaccaattcatggttcagcacctgatatagctaatgaagataaagcgaatccatttggtatggttctatctttagcactttgcttaagagaaagtttaaatcaaaatgatgctgctaacgaacttgagtcaattgtttactcatttattcaatctaataagacaactgcagatttaggtggacaatatcgaacttcagaaatttttaaattgcttaaagaaaaatatctataa

SEQ ID NO: 1063 - DNA, 966 bp, Staphylococcus epidermidis
tttataatgagacgtctatttgctattggagaggcattaattgatttcataccaaacgtaacacattcaaaattaaaagatgttgaacaatttagtcgacaagttggtggcgcaccgtgtaacgtagcggctacagtaagtaaattaggtggaaaatcagaaatgataacacaactaggaaatgatgcgtttggtgatatcattgtagaaacaattgaacaacttggcgtaggtacgcaatatattaagcgaactaataaagcaaatactgcattggcatttgtcagccttcaagatgatggtcaaagagatttctcattttatcgtaaaccttctacagatatgttatatcaacctgaaaatattgatgatattcaaatattccaagacgatattttacatttttgttctgtagatttaattgagagtgacatgaaaaatgcccatgagaaaatgattgaaaaattcgagtcagtaggtggtactattgtttttgaccctaatgtacgcttacctttatgggaagataaactcgaatgtcaacgtacaataaatgcgttcatacctaaagcacatattgttaaaatatctgatgaagaattattgtttattactggtaagaagaatgaagatgaagcgattcaatctttatttaggggtcaagttaatgtagtgatttatacacaaggagcgcaaggtgcaactatttataccaaagatgattatcgtattcatcatgaggggtatcaagtacaagcaattgatacaactggtgctggtgacgcatttataggtgctattatttattgcatactcgagtctcggcattctgaatgtaaagatttatttaaggaaaaggggaaagatatactagcgtttagtaatcgtgtcgcagcacttacaacaacgaaacatggtgctattgaaagtttgccgacaaaagaagatataaaagactattattga

SEQ ID NO: 1064 - DNA, 438 bp, Staphylococcus epidermidis
aaattaagtggggactcactggggactagtacccactttgaaaaaatattaaaaaagttttggaggttacacatggataaagagcaacttaaacagcatatgtacgattatgtaaaagaacataaggaaattcctatttatcagttagaagatttatttaaagagttagatcatgactataaaggtaaagcgagtgttacaaatgagcatgataaaaatatcgttttttggagtggttggaataagctcacaatgtatgcgttgattgagttagttaagggagaacatcttgatctaatttatagagctagctatgtcatgcgctatttgttagatggtagagttccaagtttaccattagctattacttacccagaatatggacaacaaactgaagtaccttcatgggtacctatgttactgagagtgactaaataa

SEQ ID NO: 1065 - DNA, 849 bp, Staphylococcus epidermidis
ttttgcgtcggtttacgtaagttttttgtgcattataatcattttaggaggaaaatgatggatatcgataagttagaagtaggaaaaaggattaaaaatattcgtttaaataaaagtaaaaatctaagagaatttggagaattaatatctaaaaatcttaaagaagataaaaatatatcagatagtatagttagtagatgggaaaaaggtgtatctattcctagtgcaaaacgcttaaaagaaatagctgatataggtaatgtgtctgtaaattatttattatatggagttaaagtaacttataaagatattcataataatattaatactgtaagtatgaaaaatgaaattatggacaacctcgaaaaatttttaaagtattatttactgtattctgaatacaataattactctataaaaaccgctgaattattagatttgttatttgaaaatgctggttacgatatcactactttaacaaaagatttatgcgccttagtgtctgataaaagattttcattttatcaacatggagtgtatttgttacttaatgaagatttttctaagttacatgttcaactttatctttctgagtttatttataatttattagtacaaatcactttagattatcctaatatttatattaagaatttggtattacaaattacagaaactaaagaaagaattaaagatatatcccataaaaaagacgcatatactgaatttgaaatagagacccatttagcagattttataaatcataaagaatacaaaaaactcctagataacttaagtcaattagagaaaaaaattacaaatgataattcattgatcgataataattag

SEQ ID NO: 1066 - DNA, 1641 bp, Staphylococcus epidermidis
aaagaaaaaggagaactaaacttcatgacgaacaatcaaaccttagtactaattatattaactttcatcatcctaattacacttgtaaatgtaattatctctattatagagagacgtaaacagattgctaaaataaatactttatgggataacaaattaaaattagaaagttttatacgtcctaattcacgattcgatgcccaatatcacgcttaccgtgatcattacaatgagcagtcatttatcgacgataagacttggtcagacctaaatatggatacgttatttcataaaattaattttaatttcactgcaattggtgaaatgcgactatatgcaactttaagaggtatgtttaaggtaaatcaaacctcattgataaacaagtttaaagataataaagtatttcgtttaaatgtatcttacattctttctaaaattggtaaaaatgtataccctttatttccagatcaaatgttacccactaagcgaaatattttattaatgttttgtccgttgttaccatttatcggggtcgcattcatttttttaattccttcaaaaggtatattaatatgtcttacttttatgattttaaatgcaatattatctttcaaactaaaaaaatcttatgaccaagatttaaaatcaattttttatactgctaatgttataaagcaaagtcaagctttaagtaagattgagagcacgcccgcgataagtgttgattttactcattttaaagcttcacgccgttttagtggtttattagttagagtagaatcacaagatatggcgagtagcataatcatgtttattaaattagtattcatgatagattattttttatttcatttaatacaacgcagctactttaagtatcaagaagaagttatggcatgttatgactatataagcatattagataatcattactctatagctatgtatcaacatactttgacacattattgttatcctaaaatcaatcacaatattaatgggcttcaaatgaaatcaatcattcatcctctactagatgaagaaaatgcgattgctaacacaattgacatttcaaatcatatattactcacaggctctaatgcatcaggaaaatctacatttatgaaagcagttgcactaaatttgattttagctcaatcgatacaaactgcaacagctcactcatttatttatcaacctggctatgtaatgacatcaatggcaaatgcggatgacgttttaagtggtgacagttatttcatgtcagaacttaagtctattcgtagattatttaacactcatcagtgcaataagatatattgttttatagatgaaatttttaaaggaacgaatacaactgaacgtattgcggcttctgaatcagttttatcgtatttagataatcaaaaagcatatcaggttatcgctgcgacacatgatgttgaattatcaacattattagaaaatacatataataattatcattttaatgaatctattcaagaaaatagcatatttttcgattacaaaattaaacctggtaaagccaatacacgtaatgcaattgaattactacgcattacgcagtttcctatcgatatttatcagcgtgctcaacaaaatattcgaaacctctag

SEQ ID NO: 1067 - DNA, 483 bp, Staphylococcus epidermidis
attatcagaggcggaacgaaattggttaaaccaacaagagaacaattgaatattaggaaaatgagtgtggaagatgttcctaaagtttttgatatagaaagaaatagtttctcacacagttcgtggtcaattgatgcattttatcatgaaatagaaaacaacgaatttgctacatattttgttatagaatttagtgacaaaataattggatatgttggtttatggttagtcgttgatcaagcacaaattacaacgatagctatatcaaaggcatttagaggctatggtcttggtcaacttttacttaaatatgcaatgaactatgcacgtttttcttgtgatgtgatgagtttagaggtaagaatagataatgatgttgcacaacatgtttataggaatttgggattccaaaatggtggcaaaagaaagaattattatggagaaggcgaggacgcattagtcatgtgggtgaatttgaaatga

SEQ ID NO: 1068 - DNA, 210 bp, Staphylococcus epidermidis
  unsure (160),(174),(192),(195): Identity of nucleotide at the above locations are unknown.
agctccacggggtctttccgtcctgtcgcgggtaacctgcatcttcacaggtactatgatttcaccgatctctcgttgagacagtgcccaaatcgttacgcctttcgtgcgggttcgaactttaccgacaaggaatttcgctaccttaggaccgttatanttacggccgccgtntactggggcttccattcntancttcccaaaagctaa

SEQ ID NO: 1069 - DNA, 1728 bp, Staphylococcus epidermidis
gtagaaagggggaagtatatggaattaactaaagatgatattcttcacgaaattgagaaaactaagcaagaaaaagatgctattcatgaagttattcccaaaggttatgaaattgagcaacatcaaaatggtgtggcactctatcaaattattcctagtaaaaaagatggagagccagataaaaagatattcattactaatacgattccccaaattactgaacgttttgaagatattgagagtaatgaagtaagttacaacatgcttttttatgataatcaaataccggtgaatctaggagtaagcgctgaagagatagctgatagtcgtcaattactgaagttggttaatagaaagtttgatgtaacttctaccacttcaactaggttggttgattatataaataaatctaaaaggcacaatccaccagtaaacattaaagtagctactcgattaggtcatgttaaagggtacttcatttatccttataaagaagaaatgaaaaatagaaatattaagttgtttaataatgacaaaggctttcaaaagttaattgattcttttcagagtaaaggaacactagaaagctattccgagcatgtattttcaaaaattaaaagtttgccaatggttatggtcatgttatatgcatcattaggttccgtactattgcgtgaatttgaattgcagccttttattgtagagatatcaggcagtacatctacgggaaaaacgttcacacttaatttagtttcaagtgtgtgggggacaagtaatcttattactacttggagttcaactaataatagtattgaggcaatggcatcattcttaaattcgtttccaatgtttaaagatgatacacgcaatacacaccccaaattcgtagctaatgcaacttacaatttctcgagtggtgaaagtaaatcaagaagtaatatcaatttaacacttaatgccaaaaaggaatggcggaacatcttactttctacaggcgaggcatctatttctaatatggcagatgaaaaagctggtgtttctgcccgtgtcgtaacgttacaggatcaaccatacccagataattttgatttcactacattagataaggcatttcgagataattatggaacgctaggaaaagtattcatcaaacaatatcaatctaagcaagaatcatataaaaatgcatttgaaagttatcaacgttactttaatcaaaaagggagtaacgaaatcatgcaacgactaggacatgcattcgcgttgttacaggttagtggtgaaatactaaatgatattgagggatttgaacacgatcattttaaaatcattgaacaagcttataatagcatggttagaaataataaaacgattgataaacctaagcaactgttagaggaattacttcaatatttagatgcgaatagaaataatattgccggtgaaggttatagttcagtcaaaaacggtgatatcaaagctatatataaacgtgattatttatgtatcttgggtgaaacagtaaaagagaagttgagatatgaaatgcagactattacagggcagtgggataaaaaaggttatttaataaaaggtgaaaaagatagattacaaaagcaggttaaacatgaaacagtgaagtataggggttttgctataagacaagaagtactagaagaattgggctttgatttttctaattcatataatcctaattctgattattga

SEQ ID NO: 1070 - DNA, 1314 bp, Staphylococcus epidermidis
ccttacctaattttgctttttaaaaaaacactcattatgatgtttttaaaggaagtggtaagtatgaatatgaatgatacaatatttctatttttatgtactctattagtatggttaatgacaccaggtttaagccttttttatgggggactcgtacaatcaaaaaatgctttaaatactgtaatgcaaagtatggttgccattgtcattgtcacatttgtatggataataattggtttctctttaagttttgatggaggtaatcaatggataggtggtttgaagtttttgggtcttcatcatgttggttttgaaacttcaaaaactttgagtcctcatatcccgctctcattatttatgttgtttcaaatgatgttttgtacaattgcggtatctattttatcaggttcgattgccgagaaaatgagattcattccttatctgatttttgtgagtttatgggttctattaatttatagccctgttgcccattgggtttggggtggtggttggattagtaaaattggagcaatagattatgcgggtggaacagtagttcatataacatcaggcgtatctggtttggttcttgggataatgataggtataggaaagaagaaagaaaaacatactccccataatctattaattacgcttattggtggtatattagtatggttaggatggtatggatttaatgtaggcagtgcatttacattcgatcacatagccatgatatcgtttgtgaacacagttattggtgcaagtgcaggtgctttcggttggttaatctttgaatatatcttgaaaaagactacaagtttactaggtcttttatctggagcactctctggtcttgtcgctattacaccagcagcaggatacgtcagctatatgagtgctatgattattgcaataattggtggcatatgttgctatatcgttataaatttaattaaagtaaaactccaatataatgatgcacttgatgcatttggtattcatggtgtaggtggtatcttaggagctgtgcttacaggagtttttcaatcacatcaaattaatagtgcggtgcagaatggttttatctatacagctgattttaaagtagtagtgattcaacttggcgcggcaattgcgactgtcgtttttagcgcaatagttacatttttgattgctagatttattaaaatttttactcctttagctacaactcaagaagaagataaaacaggtcttgatgctatagtacacggtgagaaagcatatttctatggagagctaaataagtttaatcgtcatatcaagttttaa

SEQ ID NO: 1071 - DNA, 537 bp, Staphylococcus epidermidis
aatagcagaattcttacagaaagtaaaataaataaaacagaaataactgatatcgtggtagcgaaaggtccaggttcatataccggtcttagaataggggttactgttgctaaaacattagcgtatgcattaaacactaacttatatggtgtctcatcacttaaagcacttgctagcacagtaaaagacagtacgaagttgttagtacccatttttgatgctagaagagaagcagtttatgcaggtgtttatcaatatcaggacaatgaattaataaccattattgatgacacttatatacctatttttgaacttattgaaaaacttcatcaattaaaccaaccatatgtgtttgtaggatatcataccgaaaaaataaaacatttattagacagtgacatcgtagaacagttaccacaagcttcaagtatgaagcaattaattcaaaaaccagaaaatatacattcatttactcctaaatatcataaattatcagaggcggaacgaaattggttaaaccaacaagagaacaattga

SEQ ID NO: 1072 - DNA, 1107 bp, Staphylococcus epidermidis
gaatttgggattccaaaatggtggcaaaagaaagaattattatggagaaggcgaggacgcattagtcatgtgggtgaatttgaaatgacaaataataaattaatcttagcaatagaaacaagttgtgatgaaacgagtgtaagtgtaataaagaatggcactgaactattatctaatactgttttaagtcaaatagatagtcacaaacgttttggtggtgttgtacctgaagttgctagtagacatcatgttgaaggaataacagcaactatagatgaatcgttagtgagtgcaaaagtgaaaatggaagacattgacgctattgcagtaacacaaggcccaggattaataggagctttattaattggtattaatgcggctaaagctttggcatttgcttatgataagcctattattccagtacatcatattgctggtcatatttatgctaatcacttagaacaaccattaacatttccacttatgtcattgattgtatctggtggtcatactgaactggtatatatgaaaaatcatttagatttcgaagtgattggtgaaacgagagatgatgcagtaggagaagcttatgataaagttgctcgaacaatcaatcttccttatcctggtggaccacatattgatcgattagcagctaaaggtaaagatgtatatgattttccaagagtttggctcgaaaaagatagttatgattttagttttagtggtcttaaaagtgctgtaataaataaactgcataatttaagacagaaaaatattgaaattgtagctgaagatgttgcaacgagtttccaaaatagtgttgtagaagttttaacctataaagctattcatgcttgtaaaacctatcatgttaatcgcttaattgttgctggtggtgttgctagtaataaaggattaagaactgcactaagtgaagcatgtaaaaaagagggcatacaccttactattccaagtcctgttctttgcactgataatgcagcgatgattggtgctgctggatattatttatatcaagctggtttgcgtggcgatttagctttaaatggacaaaataatattgatattgaaactttttctgtttaa

SEQ ID NO: 1073 - DNA, 750 bp, Staphylococcus epidermidis
gtattcgttgtagacaattatttgtattatgagatgacattcaacatatgttttaactcatttactgattttaatgatacatgcataatatacgcgaaaaagggggttagatatatgccagatgattttaaaattcctcgcgctacgttaaaacgtctacctttatattaccgatttgtcagtattttgaaaggtaaaggtatagatcgtgttaattctaaaacaataagtgaagcactacaaattgattcagctacaataagaagagacttttcatactttggtgaattaggaaaaaaaggatatggatataatatagatagtatgcttgaattctttaaatcggaattaagtgagagcgatcaaattaaaattgccattataggtatcggtaatttagggcgtgcattacttacatataacttttcaatacatgatgagatgacaattactgaagcttttgatattagaccagatattataggtgagaatatcggtgacgttgtggtaaaacatagcgatgatatcaaaatgacattagaatcagaagatattgatgtagtcattttaacaacaccagataatgtggcacaacaagtagctgatgaacttgttaaagccggtgttaaaggtatactaaactttacgccacgtcgaattaaaacgccccaagatgtccaagtacatcatattgattttggtatagagttacaatcattattgttcttcatgaaaaattatagtaaataa

SEQ ID NO: 1074 - DNA, 1593 bp, Staphylococcus epidermidis
tgccattcattaaatctaaaagtattgaaaaataacaacattagaggggtgtttttaatggaagaacatattcaaatttttgatacaacacttagagatggtgaacaaacgccaggagtcaattttacctttgatgaaagattgaaaattgccaagcaactagaaaaatggggagtagatgtactagaagcaggttttcctgcttctagtactggtagctttaaatcagtagaagctatagctaaaactttgactacaacagcagtgtgtggattagctagatgtaaaaaatctgatattgatgctgtatatgaagctactaaagaagctataaaacctcaagtacatgtattcattgcaacctcccctattcatttagaacataaattaaaaatgactcaagatgaagttttaacatcgataaaagaacacgtttcttatgcaaaacaattttttgaagtcgtacaattctctccagaggatgcaacaagaactgaaattccatttttaattgaatgtgttcaaactgcgataaacgcaggagccacaattattaacatccctgatacagttggatttagttatcctactgagtatggcgaaatttttaagcaattaacacaggccgttaagtcaaattctaaaattatctttagtgcacattgtcatgatgatcttggtatggcagttgctaatagtttagcagctattgaaggtggagctagacgtattgaaggtaccgtgaacggtattggtgaaagagcaggaaatgcctcacttgaagaagtcgctttggctttatatgtaagaaaggaccactatggtcttgaatctcaaattaaccttaaagaaactaagaaaacatctgacttaatttcaagatatgctggtatccgtgtacctagaaataaagctatagtcggtcaaaatgcatttagtcacgaatccggaattcaccaagacggtgtccttaaacatcgtgaaacctatgaaatcatgacacctcaacttgtaggtgtaaatacaacagaattgccactaggtaaattgtctggtaaacatgcatttgccgaaaagcttaaagctctagggtatgaaattaaattggaagatcaagttacattatttaaacaatttaaagaaattgctgataagaaaaaaaatgtatccgatagagatattcatgcgattatacatggctctgaacatgaacacaatgctatttttcaacttgataacttacaacttcaatacgtatctaaaggtctacaaagtgcagtagtagttataaaggaaagaaacggacaagttaaacaagattcaagtattggaacgggttcaattgttgcaatttataatgctgttgaccgaattttcaagaaagacgcagaattaattgattatcgtattgattctgtaacagaaggtactgatgctcaagcagaagtacatgtacgaatcattattaatcatattgaagtgacaggcataggtatagaccacgatatattaaaagcttcatgtaaagcatatatcgatgctcatgctaaatatatttcagaatatgagttgaaagaaggtatacgtacatga

SEQ ID NO: 1075 - DNA, 192 bp, Staphylococcus epidermidis
ttattttcttctattattttagttattttttctttcgttgctggactcacagatccattatttaaaaagcgtgaaacagtacttttcgatactccagctaattttgctatatctgatatatttttcataaaaaatcacctatcacgtcatcaatcattcttttttattttaccatatgaaccaacgctttaa

SEQ ID NO: 1076 - DNA, 1020 bp, Staphylococcus epidermidis
ctggaggaatttattatgacaaaagtatattacgacgaaacagtaactcaagatgcattacaaggtaaaaaaattgctgtcattggttatggctcacaaggacatgcacatgcacaaaatttaaaggacaatggttatgatgtagtcattggcctgcgtccaggacgatcatttaataaagctaaagaagatggatttgatgtttatacggtaagtgaagcaacacaacaagcagatgtagtgatggtactattgcctgatgaaattcaaggtgaagtatataacaaggaaatcaaaccatatttagaaaaaggaaatgctttagcattcgcacacggttttaatatccacttcagtgttatcgaaccacctagtgatgtcgatgtctttttagtagcacctaaaggacctggtcatttagttagacgtacatttgttgaaggaagtgccgtaccagcattatttggtgttcaacaagatgctacaggccaagctagaaacattgctttaagctacgcaaaaggcattggtgctactcgtgccggggtcattgaaacgacatttaaagaagaaactgaaacagatttattcggtgaacaagctgtactttgtggaggagtttccaaattaattcagagtggattcgaaacacttgtggaagcaggttaccaacctgaattagcttattttgaagtcttacacgaaatgaaattaattgttgatttaatgtatgaaggcggaatggaaaacgtccgttattctatctctaacactgctgaatttggcgactatgtttctggaccaagaataattacacctaatgttaaagaaaatatgaaaaaagtacttgaagatattcaaaatggtaactttagccgtagatttgttgaagataacaaaaatggctttaaagaattctatcaattacgtgaagatcaacatggtcatcaaattgaacaagttggacgtgaattaagagaaatgatgccattcattaaatctaaaagtattgaaaaataa

SEQ ID NO: 1077 - DNA, 330 bp, Staphylococcus epidermidis
  unsure (21),(23),(52),(53): Identity of nucleotide at the above locations are unknown.
gattaccgctccgtctataananactattggaggggcgggtacgaaaacctnnggtatctgtgagtattaaatcacagcgtattaatatcgatgatagacaagtaaatgaaccatatatgaaagacaggcatattaaagacattacattaagagaaattaaaaattctgatggtgatacgattccaccgggagcattttttgttttaaatgataataataacaaacattctgattcaagaacctatggtttaatagataagaaagatatcattggagatgtcagtttaaaatattatccatttaaagaatttaactatcaatttaaataa

SEQ ID NO: 1078 - DNA, 1221 bp, Staphylococcus epidermidis
ttgttaccatctttccagatggaagcgatcgatacatgtccaaacaaatattcaactataaggagagttttaataatgaataaaaaaacgcaaatgatacatgggggacatacgacagacaactatactggagcagtgacaacacctatttatcaaacaagtacttatttacaagatgatattggtgatttaagacaagggtacgaatattcacgtactgcaaatcctacacgtgcgtctcttgaaagtgttattgctaatttagaacatggtaagcatggttttgcttttggttcaggaatggcagcaattagtgcagttatcatgttattagataaaggagatcacttagttcttaattctgatgtttatggtggcacatatcgtgcattaactaaagtatttactcgctttggtatagacgtagattttgttgatacaactaaaattgaaaacattgaacaatatattaaacctgaaactaaaatgttatatgtagaaacaccttcaaatccattattgcgtgtgactgatattaaagcatcagcaaaaattgcaaaaaaatatgatttgatatctgtagtcgataatacatttatgacaccttactaccaaaaccctttagactttggtattgatatcgtattgcattcggctactaaatatattggaggccatagtgatgttgtagctggtcttgttgctactgctgatgatgatttagcagaacgtctaggctttatttcaaattctacaggtggtgtacttggacctcaagatagctatttattaatcagaggtattaaaacgctaggtctaagaatggagcaaataaaccgaaacgttgaaggtattgtgcaaatgttacaaaagcaccctaaagttcaacaagtattccatcctagtattaaggaacatatgaactatactatccatcaaaatcaagcaactgggcatacaggggtagtatcttttgaagttaaagatacagaagcggctaaacaagtgattcacgcaacaaactactttacactggcagagagtttaggggcagttgaaagtctaatttctgtaccggcacttatgacgcatgcgtccatcccatcagatgtaagagccaaggaaggtattacggatggtctcattcgtttatctattggtattgaagacacagaagacttagttaatgatttagaacaagccttaaatactttgagataa

SEQ ID NO: 1079 - DNA, 210 bp, Staphylococcus epidermidis
gttgcggaatcatggtactgttactttgttgttcaaatgtttgaattaggggaagaatcatttgagaggcatcactttcttcatatccaatataaattgtctgttggttatgtgatacgtgttgttgaaatgagtgaatggttttatccattaattctagtatttgagttgcctgtgagagtaactgtctaccttcaacagttaatatga

SEQ ID NO: 1080 - DNA, 822 bp, Staphylococcus epidermidis
aaggagttgtccacaatggatccgagtttgattttaccttatttatgggtacttttagtacttgtatttttagaaggattattagcagctgataatgcaattgtaatggcggtaatggttaaacatctaccacctaaacaacgtaaaaaagcacttttttatggcctattaggtgcattcatttttagatttattgctttatttttaataagtattattgcaaacttctggtggatacaagcagcaggtgctgtttacttaatctatatgtctattaaaaatttatggcaatttttccatcaatcaaatgaaaaacatcataaagaaacaggagacgaacatcatttcgatgaaacaggcaacgaaaaagaagtaggccctaaatctttttggggaacagtatttaaagttgaattcgctgatatcgcgtttgcaattgattcgatgcttgccgcattagccatagccgttacattaccaaaagttggcatacattttggtggtatggacttaggccaatttattgttatgttccttggtggaatgataggtgtcatcttgatgagatttgcagcaacttggtttgtagaattgttgaataaatatccaggacttgaaggtgctgcgtttgcaattgtaggttgggtaggtattaaacttattataatggtacttgcacatcctgatattggcgttttaccagaagcatttccacatagtgctttatggcaaacaatcttctgggtagtattagttggcttagttttaataggatggttaacttcagcaattggcaacaagaaaaaaggtaatcaaaaataa

SEQ ID NO: 1081 - DNA, 1128 bp, Staphylococcus epidermidis
aaagagtttttcatccaaaataataaaaatggttacaattatttactcaagtatttgaatgacttagaccacccacaactcatttttgaatctacaggtatctattcaagaggtatggaacgattttgttgtgtaaatcaaattaactatattcaaatgaatccgttagaagccaaatttaaaacgagcgctctaagatcatggaaaactgatcaggcagatgctcataagcttgcttgtttaggaccgacgcttaaacaaacagacaacttacctatacatgagttaatattctttgaattaagagaacgcgtccgttttcatctagaaatcgagaatgaacaaaatcgacttaaatttcagatccttgaattactccatcaaacattccctggtttagaaagattgtttagtagtcgatattcaatcattgcactcaacatcgcagaaatctttactcatccagacatggttcttgatatcgacaaggatgtactgattacacatatattcaattctacagataagggaatgtcaatggataaagctacaaaatatgcacttcaattaagagtgattgctcaagaaagctatcctaatgtcgatagacattcctttctagtcgaaaaattacgcttacttattcaacaattaaaacaatctattcatcatctcaaacaattagatgatgccatgattcaattagcacaacaactcgattattttgaaaatattcattcgatacctggtattggtaagctaagcacagctatgattattggggagattggtgatattaagcgatttaaatcaaataaacaactcaatgcttttgttggcattgatatcaaacgatatcaatcaggtcatacacactgtagagataccatcaacaagcgtggtaataaaaaagcgagaaaacttttattttgggtgattatgaatataataagagggcagcatcattatgacaatcatgtcgtcgattattactacaaactaagaaagcagcctaatgagaaacctcataagactgccatcattgcttgtataaatcgattattaaaaacaattcattatcttgtaatgaatcataaattgtacgattatcaaatgtcaccacattag

SEQ ID NO: 1082 - DNA, 261 bp, Staphylococcus epidermidis
agttttttgtttataacttttatcatcacgttgttgatgtatttcttcttgtgtcagcttctctattcttgcttttctcaaattatctttaacacgttcctcattgactttagtttgatgttgttctcttttagcttgattttccttctctattttctcacgtcttatgcgctcttctcgctctacgttatgaaagtattcacgtcttttacgtcgatattgactgcgtggtatgacttgttttttattgttatccactag

SEQ ID NO: 1083 - DNA, 939 bp, Staphylococcus epidermidis
tactcattgttgtcatctgaaccaaaaataatgattgcatacgatttgataggacaaactccattagttttattagaaagctttagtgacgagaatgttaaaatatacgccaaacttgagcaatttaatcctggtggtagcatcaaagaccgtctagggaagtacttaattgaaaaagcaatagatgaaggacgacttaaagaaggggatacaatagttgaagcgactgctggtaatacaggcattggacttgctattgcttctaatcggcacaaagtaaaatgtatcatctttgctccagaaggatttgcagaagaaaaaatttcaattatgaaagcattgggtgcagatgttagacgtacccccaaagctgagggaatgactggcgcacagcaagaggcgttggcatacgcaacacgatatggatatttatatatgaatcaattcgaaactaaagataatcctggggcatatacacaaacacttgccaaacaactcacagatgaactttcacatattgattattttgtggcaggtgttgggtccggtggtacgtttacaggagttgcacaacacttaaaaacgtatgatgtaaaaaattatattgtagaaccagaaggctctgtcttaaatggtggtgtcagtcatcctcatgcaactgaagggattggttctgaaaagtggccatcatttttagaaaaagaattagtagatggtatttttactgttgccgataaagatgcttttaataatgttaaacttgtcgcgaataaagaaggattgttagttggtagttcttcgggagcggcattacaaggagcgttggaattaaaaaaaagcattcaaaatggtgtgattgttaccatctttccagatggaagcgatcgatacatgtccaaacaaatattcaactataaggagagttttaataatgaataa

SEQ ID NO: 1084 - DNA, 825 bp, Staphylococcus epidermidis
tgcatggatccgtataaggtattaattgaagtaatgaaaacagaaagttttactagagcagcagaaaatttatatacttcgcagccttctgtgagtcgtgatattaaacgtttagaattaaaatataatgttaaaatatttgaatttaaatctccatatttaaaactaactagagatggcgaaaagctattacaatacgcattgcaacgggaaagtattgaacaagaattatggcaaaacttaacatcggaatctgaaatcatctcaggcaccttaacaattggaagcagttatacatatggtgaatatttattatcagaacagcttaccagtcttatgcaacaataccctaagttacatattcatttacgtgttaataattcagattctgttataaatgatattaaacacaacagagtagatataggtattgtagaaaaggaaattcaagacaatgcaataaaatgtaaggaaataatggaagacgaaatggtgtatatttacaaaaaatcgattcaacctagaatggatatatgtttcgttagagaaaaagggtctggaacaaggttttatcaggaagtaggtctttctgagttgaaattaaatccatatttgatagaaattaacaatattaagattattaaacaaatggtagaggctggaaatgggtttgcaattatttcaaaatcagcacttcatccagaagattatgaaaaattaatgataacaactttaaatgtgaaacgtcactattaccttgctcaacatgttgataaatatataggtgaaaatattagagctgtcattgaaatgattatgaagtag

SEQ ID NO: 1085 - DNA, 303 bp, Staphylococcus epidermidis; identical to SEQ ID NO: 234

SEQ ID NO: 1086 - DNA, 555 bp, Staphylococcus epidermidis
ggagctgctttaattatgacgaaacaagatttatctttatctgtatttaccaatgaaaattataagaatcttcattacacatcatctagttttagaaattctatgtatgatgaattagaggttaataaaagtcgctttaaaaactgtaattttaatgaaggtatttttaagaatatagaagcaatttgtaattgtaaatttacaacgtgcgggtttaataattgtattttcgaagatgttcatttttacaaaaaccaatttaaagattcaacatttgtgaatacaccatttgatcaatccgtatttaatagcactttattccaaaatgcaatgttcgatagcaatctcattcgtagcgtaaaatggactgatatcatttttaaaaacgtttctttcaaaaatgtagaaattgaaggaacaacatttaaagatgtaaaattcaaaaattgtgagttcaaaaatgtaattattactaattcaactatgtcgcaaaagttaatgaatgaattacaaaaacaagatgttactttagaaaatatagacacttctatttaa

SEQ ID NO: 1087 - DNA, 825 bp, Staphylococcus epidermidis
tatatgcaaccttatttaatttgtctagatctagatggtacattattaaatgacaataaagaaatctcaccttacactaaacaagtattaaccgaattacaacaatgtggacactacgttatgattgctactggaagaccttatcgcgcaagccagatgtattatcatgaactaaatatgagcacacctgttgttaactttaatggagcatttgtacatcatccaaaagcaaacgatttcaaagtgatacatgaagtacttgatgtagaaatttctaaaaatattattacagcacttcaacaatctcatattacaaatatcattgctgaagtaaaagactacgtctttataaatagttatgatccaagacttttcgaaggtttttcaatgggaaatcctaaaattcaaacgggtaatttacttgaaaatcttaatgaagcacctacgtcattacttgttgaagcagaagaagaaaatattcctgaaattaaagatatgttaacacatttttatgcagaaaatattgaacatcgtcgttggggcgcaccgtttccagtaatagaaattgtgaaacgtgggattaacaaagcacgtggaatcaagcatgttcaaaactatttaaacatcgccgacgatcatatcattgcgtttggtgatgaggacaatgatatagaaatgataaagtttgcgacccatggcattgcaatggccaatggcttgaaagatttaaaagaaatagcaaatgagactaagtttagtaataatgaagacggaataggtcgttatttaaatgacttttttaatttgaaaatgcgttattattaa

SEQ ID NO: 1088 - DNA, 1122 bp, Staphylococcus epidermidis
tgcattcgacccaaaaatgcgaaaataaaggaggtaaaagtaatgacagaaacggtattagaagtaaatgatttgcacgtttcctttgatattgctgcaggagaagtgcaagctgtcagaggcgtggattttcatttaaataaaggggaaacgttagccattgttggagaatctggatctggaaaatctgtaacaactaaggcaattacaaaactttttcaaaaggatacaggaagaataaaaaagggagaaatcttatttttaggtgaggacttagctcagaaaagtgaaaaagaactgatacagctaagaggtcgagatatttcaatgatatttcaggatcctatgacttctttaaatccaacaatgcaaatcggaaagcaagtcatggaacctttgattaaacataagaaattaagtaaagcaaaggccaagcaaagagcattggaaattttgaatttagttgggttacctcgtgctgaaaaacgatttaaagcttatccacatcaattttcaggaggacaacgtcagagaatagttattgcaatagcattggcatgtgagcctaaaatattaattgctgatgagcctacaactgctttagatgtgacaatgcaggctcaaattttagatcttatgaaagaactacaaaataagattgaaacttcaattatctttattacgcatgatttaggcgttgtagcaaatattgcggacaaagtagccgtaatgtatgggggacagatggttgaaacaggggatgtgaatgaaatattttatgatcctaaacatccctatacctggggattgctttcttcaatgcctgatttaacaaccagtaatgacacggacttaattgcaattccaggtacaccaccagatttacttcatccaccaattggtgatgctttcgcacgtagaagtcgatatgctttagatattgattttaaagaagaaccaccttggttcaaaatttcacccacacattttgttaaatcttggttattagatgcaagagctccaaaagttacgccaccttcaatggttcaaaaacgattaagaacaatgccaagtaattatgaacaaccacatagagtagagagggtggcttttaatgagtaa

SEQ ID NO: 1089 - DNA, 240 bp, Staphylococcus epidermidis
ataaagaagccagtaaatgaatttatgaaaactcatttactgtctattttgataggaattatgtcccaggctcatcgcagtgtggagaaaccttcagtattatcgttaatacttttacgtggtgataataataaacatacacatttgtttgtagaatttgaggagttcgacagagcaaatgaagaaaaacacgcaaaagttgaatatcatagttctaaaaataaaacagatacattataa

SEQ ID NO: 1090 - DNA, 1233 bp, Staphylococcus epidermidis
ttactatttacaaaagagagggttcttgaaatggcgaaaatacctgtaactgtattaagtggatatttagggtcgggcaaaacgacattgcttaatcatatattaaaaaatagagaagggcgtcgcattgctgtcatagtcaatgatatgagtgaagttaatattgataaggatttagtagcacaaggtggcggcttatctagaacagatgagaaattagtagaactttctaatggatgcatatgttgtactttaagagacgatttgttacgagaagtcgagcgcttagttcacaaaggaggaatcgatcaaattgtaattgaatcaactgggatatctgagcctgtgccggtagctcaaacgttctcatacatagatgaagaattaggtattgatttaacctctatatgtcgattagatacaatggtgacggttgtagatgcgaatcgctttgttaatgatatacgtagtgaagatttattggcagaccgtgatgaaagtgttgatgatgaagatgagcgtactattgctgacttactcattgatcaagtagaattttgtgatgtgatgattatcaataaaatcgatttgattagcgacgaagctctagaaaaattagaaaatgtattacgtgcattgcaacccgaagctaaaattattaaaacagtaaatgctaaagtggaattatcagatgtacttaatacgcaattatttgattttgagaaggcaagtgaatcagctggatggatcaaagaattaacagctggaggacatgcgacacatacgccggaaacagaagagtatgggattacatcatttgcttatactagacgattaccatttcatgcaaaaagatttcatcaatggctagaacaaatgccagaaaatattgtaagaacaaaagggattgtatggttagcgcagtataatgatgtagcgtgtttgttatcacaggctggttcatcttgtaatattcaccccgttacatactgggttgcaacaatgagtgaaagtcaacagcaagctattttggaggcacgtcaagatgtagtagaagattgggatatcgaatatggagatcgtcaaacgcaatttgtaattattggtacggatttagatcaagaaaaaatttcccgggaattagatgcatgcttaattcatagtagtgagattgatgaagattggcgattactagatagtccgtaccaatggacttatgatcgacgaatgtaa

SEQ ID NO: 1091 - DNA, 261 bp, Staphylococcus epidermidis
ggaggcgacacattgtttactaaaaaaatattgatttatattgcgctccttattaccttaattcgtttttttattccattacatccagactttgatacgttgttagtatggttgtttattctttacataattccaattattttatgtatcattggctttaaatcagataaactcatcgctactatgattatgattccaaatttaatgggtataggttatcgtatattcatcttctttaatgactttttgcatttaaaataa

SEQ ID NO: 1092 - DNA, 621 bp, Staphylococcus epidermidis
tcaagaaggttaattaaaatgaaaaatgtttctaaagctttgatttggtttgttataagcttcatcatctttcacgcaatattatttgtgatgtggggagaacatcaagaatactggtatttatatactggcattatgttaatagctggaataagttatgttttttaccaaagagacattgcatctaaacgattattaacttccataggcatgggtataataacgagtgtcgcacttattattatacaattaattttttcacttatttcatcagaattatcatacgcatctttaatcaaagaattatcacgaacgggtgtctactttaaatggcaaatgctcgttactttattatttgtgataccttgtcatgaattatatatgagaactgttttacaaaaggaattaataaaatataacttaccgaaatgggctagcattttaattgttgcaatatgttcaagttcattatttatatacttagataattggtggattgtattctttatttttgtagctcaattcattctatctcttagctatgaatatacgagacgtattgctacgactacaattggtcaaattgtggctatcattttattattgatattccacggataa

SEQ ID NO: 1093 - DNA, 1695 bp, Staphylococcus epidermidis
actaaattaacgaggtgccttatgtataaagattataacatgactcaacttactctaccaatggaaacttcagttcttatccccacaaatgatatttcacgacatgtaaatgatattgtagaaacaattcccgagactgaattcgatgaattcagacatcatcgaggtgcaacatcataccatccaaaaatgatgttaaaagtagttttatatgcctacacccaatctgtgttttcaggacgtaagatagaaaaattactcaatgatagtatccgaatgatgtggctatcacaaaatcaaaagccttcttataaaacgattaatcgatttagagtaaatcccaaagtagacgctttattagaatcattatttattcaatttcatagtcagtgtttgaaacaaaatcttattgatgatcaggccatttttattgatggtacgaaagttgaggcaaatgccaatcgatatacatttgtatggaaaaagagtattcaaaaccatgagtcaagaatgaatgaaaactctaaagcactctatcatgaattggtgataaataaaatcatacctgagattaaaaaagatcatgataatgacttaacaaaagaagaaatagatttgattggtagtcatttagataaagaaatcgaagatttaaaccaacatatcgataatgaaaaatgtactaaaataagaaaacaaatacggctcaaaagaactaaaattaaaaaatacaaaaagcaaattaatgattactctcagcgaaagcataaatacgaagtccaaaaatctattttaaaggatagaaatagttattctaaaacagatcacgatgccacatttatgagaatgaaagaagatcatatgaaaaatggacaacttaaaccggggtataatttacaaatagcgacaaattctcaatttgttttattttatgatgtgtatcaaaatccgactgatacaagaacaatgataccttttttaaatacaatacaagagacctacggtcatttacctgaatatattgtagctgacgcaggttatggtagcgaagccaattatatggcaattatagataattttaatcgaacgccactcataacttatggaatgtttataaaagataaaactaaaaaatataaaagtgacatctttaatactcaaaattgggattatgacgaaattaacgatgaattcatttgtccgaataataaaagactaggatttaaaagatatgcctatcgtcatgataaatatggttttaaacgagactttaaattatatgaatgtgatgattgttcagaatgccctctgaaacaacaatgtatgaacttcaattcaaaaacaaataaaaaaataatgaaaaattataattgggaatattttaaagcccaaattaataaaaagctttcagaaccaaaaacaaaaaccatctacagtcaaagaaaaattgatgtggagcctgtttttggatttatgaaggctattttgggtttcactagaatgtccgttcgagggatagataaagccaaaagagaattaggatttgtgctaatggcacttaatataagaaaagtaacagctcaacgagctgaaaataatcaaaaaaataataaaaaagacaatttctatattatttcaatagaaattgtctttttttacttatcctgggactttatgtcccacactcatttttga

SEQ ID NO: 1094 - DNA, 189 bp, Staphylococcus epidermidis
gtcatacagaccataaaactatcctacaaatatataggcatgttactgaataaattagaaaagatacataataacttattaataaagataggatttttaaataaattttgttatatatcctttattatgtggtttattttgtgctttactagaagtaatcgatttatggtatgcaaagaaaataactaa

SEQ ID NO: 1095 - DNA, 789 bp, Staphylococcus epidermidis
tcaatgagtgcaattactattttaggtttcttattattgttgataatggttattttcggaggtaaaaaaggactcatttcttttttcactttgtttttaaattttatcattcttgtaataagtattcttttaattatatatggtgtgtcaatctatcttgtcacatttatattttgctttatcatagccgcaattaatttatttgtattaaatagttacaatgtaaaaacacaagcggcttttctaggtactttagtaacaatacttatattaatactcatgatatacttttcagttgagatgggtcacttacaaggttttgccaccgaacagcaggatgaaacatatgtgtattcaatgaatattggtattaatatggtacaatttatggtatttacaattgttcttgcagtgatagctgcagtcattgatttagcaataacaattagttcccctatgtatgaactaaatgagactaatccaaatttaaatcagcatcaattatttcagtctggtatgcgtgtgggtagagagatattagcaacttctgccaacaccatttatttagcatttttcggaggacaattaactttattcttctggttctttaaattaaaatattcatttggacacatcattaattcgaagatattcacacaggaatttatagctattttacttggtggtatcgccgttgcaattagcattcccattactgcatggattacagcatttatgattaaacatttcagtcagaagaagactcttacgaatcaacaaaataaataa

SEQ ID NO: 1096 - DNA, 192 bp, Staphylococcus epidermidis
gagttgcacgcatacatattaacaaaaatattttctccaactttgaatagaaaatattctgttcattttatgtattcacataatcgtgaaatcatttatgactttgatcaattttcaaatcgcctagtcctagcgctcatcattgtatactcagttatgtcgttgtgtcccgttctaacatttgctttttag

SEQ ID NO: 1097 - DNA, 192 bp, Staphylococcus epidermidis
tgccaatgcgctaagggcagttgttccaataatggcagtaatatattttttttgcacttgaaatcctcctctactttaggttttgtttattcgcgttttaacaatacaaagatattatactctttaattatgtatagcatgtttgctttagatgacattctgattacaaatattattttaaataaaaaatag

SEQ ID NO: 1098 - DNA, 1359 bp, Staphylococcus epidermidis
cactttagcgctttaaagggagttggtaatttgagtggtcattcacaatggaagacgtctaccggttttatattagctagcgcaggttctgcaataggattgggtgcaatgtggaagttcccatatatggcaggtatatacggcggtggcgcttttctattaatgtttttaatttttactatatttgtaggactaccactgttaattatggaatttacggtaggtaaaatgggtcgtacatatacaacgcaaatatataagaaattaacgggaaagaaatggcttaatattatcggatggaatggtaatttagccgtatttatactatttggtttttatagtgttattggtggttggattattatatatataggttatgtcatagcacaaatcatggtttttaaatcaagtacgctgacaaatattcaatttgaaacaatcattagtaatccatggttgactgttttaggtcaaggcatatttattttgataacaatggtaattgttatgttaggtgttgaaaaaggtttagaaaaagcttctaaaataatgatgcctctattatttatctttttaattatcgttgtagcacaatctttaactttagaaggtgctttagaaggtgtacgttatatactgcaacctcgagttgaagatatgtctattcaaggtgtactatttgcgttagggcaatcgttttttacgctgtccctaggtacaaccggaatgattacttatgcaagctatgcacctaaaaatatgacgataaagtcttcagcactttcaattgtcgtaatgaatattttaatttctgtcttggctggattagctatatttcctgcgcttaaaacatttggttaccaaccccaagaaggccctggcttattatttaaggtcttaccactagtatttagcgaaatgacttttggtacattcttttactttatatttttactattattcttatttgcggcattaacgtcttctatatcattattagagttaaatgtatctaattttactaaaaatgataatagtaaaagacaaaaagtggcaatcataggtagtatacttgtatttatcattagtatcccagcaacattatcttttagtagtctaagtcatttgcgttttggcgctggtacgatatttgataatatggattttattgtatctaatattcttatgccattaggggcactaggaacaacattagtggttggccaattactagataaaaaattattaaaagaaagctttgggaaagacaaattcaacctatttttaccgtggtattatttaattaagttcatcatgcctattgttattattttagtatttatagttcaattattttaa

SEQ ID NO: 1099 - DNA, 804 bp, Staphylococcus epidermidis
aaatacatggctgaagaattaagaatcatggagaataagagtcgtgaagatactaatctatcacctgttagcaaaatagaaatctattctttttttgatccttttagcaaagattgttttaaattatctgcaatcttatcaaaattaagaattgaatataataaatatataaagataagacatattttaaacccttctttaaaggtattaactaagtgtcaagctcaaagtacttcagattttgacaatattgcacttgcctataaagccgctgaacttcaaggtcgtatcagagcagaaagatttatacatttaatgcaaaatgaaatcattccaaaacgtgatattattaccgaagatatgatttctgattgtattaataatgccggcattgactatcaagtttttaaagaagacttgcaaaaggacaagttgactgacagcttgaaagttgatcttcacattgcaagagaaatggaaatagaacaagctccctcacttgtttttttcagcgaaaatgttcatgaagaaggtttaaaagtcgaaggattatatccttatcatatttatacttacattattaatgagttaatgggacaacctatagagaaaaatcttcctccaaaattagaatactacattcaaaagaaacaactagtaacaatggaagaacttttaacgatctatgaatggcctgaaaaattgctaaataaagaattaaagaaactcacacttcaacaaaaagttgaaaagttgcaatatccagagggagaattttggaaatctaaaatgcctcagtgttaa

SEQ ID NO: 1100 - DNA, 228 bp, Staphylococcus epidermidis
gcacttaattttgtgagaaagggagatagatttgttgtagagtctattgaccgtttgggacggaattatgatgaagtgattcataccgttaattatttaaaagacaaagaggttcaattgatgattaccagcttccctaggatggatgaagtcattggcaagccattactgtatatagaaagccatgcgctatgtgtatggttcagaaaaggttttaccgttatctaa

SEQ ID NO: 1101 - DNA, 372 bp, Staphylococcus epidermidis
gaagctctttattttggagcaacaggtgttttaagctatcgaaaatttttcccatttatttataatttgtttcaaaaaggatactttgaaaattcactaacaattattggcagtggtttaaatgagttaactactgatgaatttagagaaaaagtcaaaaatgctattcaaaataatattgaaaactcaaaggaaattggtgcgtttttaaaacgtttattttataaacaacaggacgctaatagtaaagatagctaccaaaaatttttggaaatgagtttagaactagatgataagtttgacctaaaagaaaatcgattgttctatcttgcaatgtcccctaaatttttggagttgcaacaaaccacttga

SEQ ID NO: 1102 - DNA, 906 bp, Staphylococcus epidermidis
atgaaatttctatcattcaaacataatgacagaacttcatatggtgttaaagtaaaacgtgaagatgctgtttgggatttaccaatggtttttgctgagtttggggacaaagactttaatcctaaaactttaattgcaggtttacagcaaaatcaaactttagactttcaagagcaagttcgaaaagcagttgtcgcagcagaagaaagtggaagagatgaggaatttaaacttttattcactgatattgattttctaccaccagtgacacctcctaataatgtgattgcatttggtagaaattatgaagatcatgctagtgaattaaatcatgaagttgatagtttatacgtatttactaaagcggcttcatctttaactggtgatgaagcaacaattcctaatcataaagatattacagaacaattggactatgaaggcgaacttggaattgtaattggaaaatcaggcgaaaagattcctagaggattagctttagattatatttatgggtacacaattatcaatgatattacagatcgtactgcgcaaagttcacatgatcaagcattcttatcaaaaagtttaactggggcatgcccaatgggcccttatatagtaaccaaagacgaattacctgcgccagagaatgtaaatatcgtaacaaaagtgaataacgaaattcgacaagatggcaacactggtgagatgattttaaaaatagatgaactcatcgaaaagatttcaaaatatgtagctttacatccaggcgatatcattgcaactggtacacccgctggtgtgggtgctggtttacaaccaccacaatttttacaaccaggtgatgaagtcaaagtaactatagataatattggcactttaacaacatatatatctaaaaattaa

SEQ ID NO: 1103 - DNA, 246 bp, Staphylococcus epidermidis
agagcttcttattcagtagaaacaaagtataaagccgttgaaatgaaagcagcagaattttcaacaaaagaaattatgaaagaattaaatattagaaatagaacacaagtaaaaagttggtggctatggtatcaaaatgaggaaagtatgtttgttttatatctttatcctcagtcattaattatttgtctatctttgcatttctctactaaccagtgttataatctagataatgaaaatgattag

SEQ ID NO: 1104 - DNA, 600 bp, Staphylococcus epidermidis
aatatgcattatccagaacctatatcaaagcttatcgatagttttatgaaactgccaggcattggaccaaagacggctcaacgtctggcttttcatactttagatatgaaagaagacgatgttgttaagtttgctaaagcactagttgatgttaaaagagaacttacctattgtagtgtttgtgggcatattacagaaaatgatccttgttatatatgtgaagataaacagcgagatcgttctgtcatatgtgtagttgaagatgacaaggatgtcatagcaatggaaaaaatgcgtgaatataaaggtttatatcacgtgcttcatggttcgatttcaccaatggatggtattgggcctgaagacatcaatatacctgcattagttgaacgcctcaaaaacgatgaggtgaaagagcttatattagctatgaatcctaacctagaaggcgagtctactgcaatgtatatatctaggttggttaaaccaattgggattaaagtcacaagactggcacaaggtttatctgtaggcggcgatttagaatatgctgatgaagtgactttatctaaagcaattgcaggtagaacggaaatgtaa

SEQ ID NO: 1105 - DNA, 813 bp, Staphylococcus epidermidis
atcatgcgttatacaatccttactaaaggtgattcaaaatcgaatgcattaaagcataaaatgatcaatcatatgaaagattttcaaatggtagaagatagcgaaaatcctgaaattgtcatttcagttgggggagatggaacgttactacaagctttccatcaatatagtcatatgttatccaaagttgcttttgtcgggatacacaccggtcatttaggattttatgcagattggttacctcatgaagttgaaaagcttattattgaaattaataattcggagtttcaagttattgaatatccacttttagaattaatagtcaggtataacgataatggttatgaaacgagataccttgctttaaatgaagcaacaatgaaaactgaaaatggctcaacattggttgtagacgtcaatataagaggtaaacatttcgaacgatttagaggagatgggttgtgtatatctacaccttcgggttcgacagcttataataaagctttaggtggtgcgctcatacatccatcacttgaagcgatgcaaattgctgaaattgcatctattaataatagagtgtttagaacagtaggctcgccattagtacttcctaaacatcatacgtgtttaattacgccggtaaatcacgatacgattagaaccacaatcgatcatgttagcattaagcacaaaaacgtcaatgcaatacagtatagagttgctaatgagaaagtgcgttttgccagatttcgtccatttccgttttggaaaagggtacatgactcatttatttctagtgatgatgaacgatga

SEQ ID NO: 1106 - DNA, 2631 bp, Staphylococcus epidermidis
aacccaatctatagaaagtcatccatcatatttaaaacgattttagtaaaggaggatagaattatgcttcaatcagatatcaatgaattagtcaatcaggctaaacgtgtaattacacctttatcaccgatttcaacatttgctgcccgtaatccgtgggaggggctagaagatgcttcgtttgatcaagtggcacgttggttaaaaagtgtgagggatattgacatttatcctaatgcgtctactattcacagagcgattagtaataaagaaatagatttaaaagtatttgaagaacggttggatgaaaatcgtgcgcattataataataggtcactatctgacagtgatatcaacacatatattcaaagagcgaaaaatttaaaaacgattgaagaaggttactttaatacaaaagataacgagaaactggaaaaatgggtacaaactaattttaaggattataagaaaaaagaagatgtgatagcgcaaagtgctagtgttttcacaaaggaaggtacacgacttattgatattttaaatgctcatatgattaagtggtctaaattatatgttgatgactttcaatcaagttggactatgccaaaaagagaaaaaggattctatcatgcctggcaacgtttagttaaacatgatccattattcacaaaaaaacaacgacttactttaacacatttgccaaatcaagcaaccgaagcaatagagtacgcctttcaagaattaggagtaaaagaagaacatcgacaatcatatattgagagtcatttattatctttaccaggttgggcaggaatcatgtatcatcggtcacagacacaaagtaatgatgcgtacttattaacagactatgttgcgattcgtctatcaattgagatggtacttttaaatgaccaccatacaacattattaaaaaaatctatatatcttcaaaaaaagttagagcaaatacgttatttgctatttaacatacaaatgaatgttgagcagtggttaaatctatcatctaaaaagcaacaagcatacattgaattggggacacgattcagcccgttttattttaaaaagttatggttagatgcatgggaagaaacgcatgaacgtcgattggttgatgaaatttatcgtgttccaaccgaagatactgatcaagcaaaagcaaaagtacaacttgcgttttgtattgatgtacgatccgaaccgtttagaagacatttagaaagtgaagggccttttgaaacaatagggattgctgggttctttggtctgccaattcaaaaagaagtacttgatgaacaatttgcacatccatctttaccagtgatggtagaacctgcatatcgtattaaagaatatgctgatcaacatgaaatgaaaatttataatcaacaacaacatacacttacatctatgttttacaactttaaattaatgaaaaacaacgtgttgccaagtttgcttttaccagaattaagtggtccttttttaagtattgcgactatagctaacacaattttccctaaaaaagcaaaacgtattgttcatcgattctcacaaaaatggctacgtaaaccaacaggtaaattaactattcagcgtgagcaagatgcgtattcaaaactaccaatcggctttactttagaagaacagattcaattttccaaaaaagcattacaattaatggacttaacagatgattttgcaccacttattgttctatgcggacacggtagtgaatcacataataatccctatcatgcttcattagagtgtggggcttgcggcggtgcctcgagtgggttcaatgcgaaattattagcagtaatgtgtaatcaagaaaatgttagacgtggattattgatggaaggaatcgacattccaagacatacagtgtttatagctgctgaacatcaaacgtcagttgatgagttagagtatatttatgttccacctttaactacagaagctcaaaatgcctttgacgaacttaagcatgtgatgccaaaagtatgttataaaaccaatttagaacgtttggcatcgttgccaaatataaataacactgaccataatcctaatgctgaagcgcatcgtcacgctagcgattggagtgaagttcgtccagaatggggtctagcacgaaatgctgaattcattattgggaaacgtcaaatcacccaaaatagtaatctagagggacgggcatttcttcataattatgattggacaaaggatgaagacggtgagattttaaatacaattatttctgggccagcactagtagcacaatggattaatttacaatactacgcctcaaccgtggcacctcactattatggaagcggtagtaaaacaacgcaaactgtaacaagtggtgtaggtgtcatgcaaggaaatgctagtgatttaatgtatggcttaccatggcagtcagtaatgatgaatgacaaagaggcgtatcacgcacctattaggcttttaattgttattcaagcgccagatgcatatattcaacgtttgttaaaacatcataatcactttagacaaaaggttgatcatcaatggataagacttgccagtattgatgaaaataatagttggaaagactggtag

SEQ ID NO: 1107 - DNA, 306 bp, Staphylococcus epidermidis
gggtacctttttgtgtataaccgaacccaatgtggtttcgttaaatgtgtccgtaagtggacgtattatctacttagcttaatatcctcaaatttggggatattgatttatacacagccccaatgtgggttcagtaatagactgaataactctatatatttactcagctcaaatgtgagcgtattaattaataatacaaatgctgacgcactaagtcagtgcattagaaaacgaaaatattcgttctctaaaattaagctgaatacagccgaaatgtcggcactagtagatatatcacaacggtaa

SEQ ID NO: 1108 - DNA, 4590 bp, Staphylococcus epidermidis
tctaatttatatattgaacagataaataaattacattatagtaattactatcaaacaaaattgtcagaaaattctaataagggagtgtgcatcatgtacaatgagaaattaaaaaagggactatacgattatcgtgaagagcatgatgcgtgtggtattggattttatgccaatatggataataaaagatctcacgatattatagaaaaatctttagaaatgttaagacggttagatcatcgtggtggagtaggtgccgatggtattactggtgatggtgcaggaattatgacggagataccataccaattgttcgaacaattaacagaattcaaagttcccggcgaaggatattatgccgtgggattatttttttctaaagagaaagttagagattcaattcacgaagagatgtttaatcaatattttgaaagtgaaggttttaaagtcattggatatagagatgtgccagtagatactcgcgctattgctcaacatgttgcagatactatgccttatattcaacaagtatttgttgacatcacaggtgtaaaagaagttgaaaaacgattgtttttagcaagaaagcaaattgaaaaatatagtgaaacacaatccatagatttatattttacaagtctctctcatagaacgattgtttataaaggttggttacgttcggatcaaattaaaggcttatatttagacctacaaaatgaggcatatcaatcaaaattaggacttgtacactcccgctttagtactaatacatttccaagttggaaacgtgcacatcccaatcgcatgcttatgcacaatggtgaaattaataccattaagggtaacgtaaactggatgcgagcacgccaaaataaactagttgaaacattatttgaagatgagaaagataaggtgcattttattgttgatgaagatggtagtgactcatcaatagttgataatgcgttagagttcttatcattagcaatggagcctgaaaaagcagcgatgttattaattccagagccatggttatacaatgaatctaacgataaaaaagttcgctctttctatgaattttatagttatttaatggagccatgggatggaccaactatgatttccttttgcaatggagataagataggtgcattgactgatagaaatggattaagacctgggcgttatacaataactaaagacaattttattgttttttcttccgaagtaggtgtcattgatgttccagaagaaaatgtagcatttaaaggacaacttaatcctggaaagttattacttgtagactttttgcaaaataaggttgtagaaaataatgagctaaaaactaatattgctaatgagttgccctacgaacaatggctaaaagattataaaaataaaaatgatttagataatatttattaccaatcttccgactgggatgatcaaacactcttccgcttacagaaacaatttgcttacactaaagaagatatcaataaatatatgacagatttagtcatcaataaaaaagatcccatcggagcgatgggatatgatgcacctattgcagttcttaatgataagcctgagtcactatttaattattttaaacaattatttgcacaagttaccaatccacccatcgatgcttatcgagaaaagattgtaactagtgaactttcatatttaggttcagaagggaacctcttatgtcctgatgaatcagttttagaaagaattcaattaaaaaaaccagttttaaatgaagcgcaattatcatcaatcgatcattcgtattttaatgtaacgtatttatctacactttatacaggtgatttggaaagtagcttaaatgaactagggaaccgagcaatacaggctgtacatgaaggtgcgaaaattttggtgttagacgatacgtctttaactcacgaaaatagttatgcaatgccaattttattagcgttaagtcacgtgcatcaattattaattcgagaaggattaagaatggagaccagcctcattgcgcagtccggtgaaacacgagaagttcatcacgttgcatgtttacttggttatggtgcaaacgctgtagttccatatttagcgcaacgaacgattgaacaattaacgcgtcaaggtcaactttcaggaactgtcgctgaaaatgttgctacgtataccaatgtattgtcagaaggcgttattaaagtgatggctaaaatgggcatttctactgtacaaagttatcaaggagcacagatatttgaagcggtaggtttatcgaatagcgtcattgaaaaatattttacaggtacacagtcaaaattatctggtataagtattgaacaaatagacaaagagaataaagcgagacaaagtgatgattctgattatcttgaatccggaagtgtattccaatggagacagcaaggtcagcatcatgcatttaatcctcgtacgatttttttattgcagcatgcatgtagagaaaatgattacgagttatttaaaaaattctccaaaactgtaaatttaaaacgtacggatcatattagacatttattagaattcaagacacgccaatctattgatattagtcgtgttgaaccagcaagtgaaatcgtaaaacgttttaatacaggagcaatgagttacggctctatctcagcagaggcacatgagacgttggctcaagctatgaatcaaattggaggtaaaagtaatagtggagaaggtggtgaagattcttcacgttacgaaattcaaaaggatggaagtaataagataagtgcgattaagcaagttgcatcaggtcgttttggggtgacgagtgattacttgcaacatgcaaaagaaattcaaattaaagtcgcacaaggcgctaaaccaggggaaggtggacaactaccaggttcaaaagtatatccatggattgctgagactagaggttcgacaccaggtataggattaatttcaccaccaccacaccatgatatttattcaattgaggacttagcacagctcattcatgatttaaaaaatgcaaatagaagagctgatattgcagttaagcttgtatcaaaaactggcgttggaactatagcttcaggggtagctaaagctttcgccgataaaattgttataagtggttatgatggaggtacaggtgcatcgcctaaaacaagtattcaacatgcaggtttgccatgggagataggccttgccgaaacacatcaaacacttaaattaaatgatttgcgtagtcgcgtaaaattagaaacggatggtaagttactgacgggtaaagatgtagcttatgcttgtgcgcttggtgcagaagaatttggtttcgcaacagcaccacttgttgttttggggtgtattatgatgagggtttgtcataacgatacgtgtccagtaggggttgcaacacaaaacaaagatttaagagctttgtttagaggtaaggcacagcatgtagttaactttatgtattttatagctgaagaattacgtgaaattttggcttcacttggtttagaaacagtagaagagttagtaggaagaacagatcttcttcaacgttcgacgcaattgaaaccaaatagtaaagcagcttcgcttcaaatagaacgtttaatagaacaatttgacggggttaatacgaaagagatatcacaaaaccatcatcttgatgaaggattcgatttgaattatctgtacccagacgcacgctatagtattgaaaacgggcactcttttaccggaaattatgttgttaataatgaacagcgagatgtaggtgtaattacaggtagtgcgatagctaaacaatatggagaagaaggattacctgaagatacgatacttgcttacactgaaggtcatgcaggtcaaagcttagctgcatatgcaccacgcggattaacaatccatcataccggtgatgctaatgactacgtaggtaaaggattgtccggtggaactgtcatcgtaaatgctccaaatagtcaacgtgaaaatgaaattatagcaggaaatgtaaacttttacggggcttctagaggtaaagcgtttatcaatggtaaagctggtgagcgtttctgtatcagaaatagtggtgcagatgttgtagtagaaggtattggtgatcatggacttgaatatatgacagggggacatgtcattatcttaggagatgttggaaagaactttggccaaggcatgagcgggggcgtaagttatattttcccttctgacgtggagaaatttaaaaaggttaatgcgcttgaaactttagaattcagtagcatacgttttgatgaggaaaaatctcttatcaaagacatgcttgaagcacattttaagcatacacgtagtaacaaagcacgccaattacttgaccaatttgacaatattgaaaagttagcaattaaagttattccgaaagattacaaattaatgatgcaaaaaattgatttgaaaaaacgtcaaatggaacgtgaagatgaagcaacactggcagcgttttatgatgacagagaaacaattgaacaagagctacagccagcagtcatttattaa

SEQ ID NO: 1109 - DNA, 1002 bp, Staphylococcus epidermidis
aaacatgaatatgttaaattaatacctggtattaaaaattttttaagaaggtgtacaaccatgaatgtgggtattaaaggttttggtgcatatgcacctaaaaatattatagacaatgcctattttgagcagtttttagaaacttcagatgaatggatttctaaaatgactggtattaaagaaagacattgggcagacgaagatcaagacacatctgatttagcatacaatgcaagtattaaagcgatagaggatgccggcattcagccagtagatatagacatgattatcgttgctacagctactggggatatgcctttcccaagcgtggctaacatcttacaagaaagactaggaacaggtaaggttgctactatggatcaacttgctgcatgttctggctttatgtattcaatgattactgctaaacaatatatacaatctggtgattacaaacatattttagttgtgggtgctgataaattatctaagattaccgatatgactgaccgttctactgctgtattatttggagacggtgctggagctgttgtcatgggagaagttgctgaaggtcgtggtatcattagctatgaaatgggttcagacggtagtggtggtaaatacttgtacttagatagagaaactggcaaactcaaaatgaatggtagagaagtatttaaatttgctgtgagaattatgggtgatgcatctacgcgtgtagttgagaaagctggtttatcgtctgaagacatagacttatttgttccacatcaggctaatattagaattatggaatctgcgagagagagattaggaatagaaagagaaaaaatgagtgtctcagtaaataaatatggtaatacttcggctgcctcaataccattaagtattaatcaagaattgcaaaatggaaaaatcaaagatgacgatactttagtcttagttggcttcggtggaggtctaacttggggcgcaatcgttattaaatggggaaaatag

SEQ ID NO: 1110 - DNA, 543 bp, Staphylococcus epidermidis
aatggaggatacatgcatatttatttaagtactttaacagaggtcgattatgaaacgtcactaaatagtatagaaaataattataatctaaatccagaatccagttggcaagatcgagcgcgcgttaaaaatctaagaaaacttgaaagctacaattatgaattagaagttatagctaagaatgaattgaatgaagttataggtcacgttgtgttagcagaggttaagttgtcgtctaaaaacaaaaaagcgatagcgttagccattggtgcactgtcagtagataaatctattcgaaaccaaggtttaggtcaagccctgttaaaagctgtagaagaacgtgctaaagaacaaggctattgtgctatttttgtaaataatcatcctcagtactttgagaaatctgattatgaagcagcccatttatataatatacatatagaagaaaaacgaaatcatcaatcattattagtaaaatttctaaaaccagttcaaaatgaatggtctggaatgacggtgtattatccggaagtactggattga

SEQ ID NO: 1111 - DNA, 1512 bp, Staphylococcus epidermidis
gatggaggatacgcaatgttaagttcagagttaattttgtttatgttttttattacacttgtcattgctatactgagtggattaatatttttgaatcatcgagttcccattcaatatattaaatttcatatatatttacttgttttacctatcattacgggattaagtggattaatatttttcggtgaaagggcgaatgttggaccttttgtagttgatcatcttacttggttaatgatgacatttattttgactttaggctttatcattcaaaagttttctatgcgttatttaattggcgacatgcattaccgtaaatattttccgttttttacattaattactgcatttgcttcattggcatggttaagtggagacttaaggttaatgaccatgttttggggtgcaacattatttgtgttaacacggctcattaaagttaacaaattatggaaggtgcctagggaagcagcaagaatttcagcttggtcatttatattggcatggttgtcgttattgattgctgtcattttattgtatatcgctacaggagattggtatatttattcgaatatgtcagatgataatgcaatcaattatggaatgcgtctctgtatcaatttacttattgttttagctgtgattattccggcggcacaatttccatttcaaggctggcttattgaatctgtagctgcgcctacgccagtttcagctattatgcacgctggtattgttaatgctggtggcgttattcttacacgcttttctccggtatttaatgacgaaatagccatttcactgttattaattattgcaagtatttcagtattgtcgggttctggaatcactcttgtgcatgtagattacaagagacaacttgtacgttctacgataagtcaaatgggttttatgttagtacaatgtgcgcttggggcatattctgcggcgatagtacatttaatattgcatggtgtgtttaaagcgacattatttctacaatcgggttctgttgttaaaagatttaacattcctacgtctccatctgttaaaaaatcatatggctggcttgtatttggtcgtctactagctattcttatagcgataatattttggttgaatagtgatagacatgcatatgatgtattaagcgctcttatattagcttggtcgttaatggtgtcatggaatcaattagttgcttttagtcatggactcatcggaagagtcatcggagtatgtatgattattgttgtagcaattgtttatattattacgcatcattatttcttcacgacattaagtaacgttgatattcatattgtttcaccaccactcataagtattattctatcgattgctattatagttttcggcagtatgttaagcatatgggtatcacggcgaagagaatcaaaggcatttgcgaagttatacttgtggcttattaaagtaggagaggctaaaacccaatctatagaaagtcatccatcatatttaaaacgattttag

SEQ ID NO: 1112 - DNA, 1239 bp, Staphylococcus epidermidis
gtcactcatctcaaccggatgaaatctatggaaaggttcctttgtatgcaagattcttcgtcaagtaattactcaagtaacagaaactttgttatgatgttggtaattctgtttctgatggaatttgcaagaggtatgtacatactaagttatataaactttttacctacagtgacctctatcgcaatagcaatcacatcatttgctttttccattcactttatcgcagatgctgcaacaaattttgtcatcggctttttacttaaaaaatttggttcaaaattagtacttacatctggattcttacttgcttttataagcttgtttttagtgatatggttcccggcatcaccattcataattattttcagtgctattatgttaggaattgctgtgagtccgatttgggttatcatgttatctagtgtagatgaaagaaatcgcggcaaacaaatgggttatgtctacttttcatggttgctaggtttattggtgggtatggttatcatgaacttgcttattaaattccatcctactcgttttgcatttttaatggccttggttgtgcttattgcctgggtactatactattttgttaatatcaacttaacaaattacaatactaaacctgtgaaagcacaattaaagcaaattgtagatgttacacaacgtcatcttattctatttccgggtatcttgttacaaggagcagctatagcagcacttgtacctattcttccaaaatatgcaacgcaagttgtgaaagtatcaaccgttggatatacagtagcaatcattattggtggcataggctgtgctttctctatgttatttttatcaaaaatcatcgacaataatagcaaagggtttatgtatggagttatttttagtggctttatactatatacaattcttatattcgggctatctacaattacaaatatatatatagtttgggccataggactttttattgggctaatgtacggtatcctcttaccggcttggaatacctttatggctgggcatattaatcctaacgaacaggaagaaacatggggcgtgttcaacagtgttcaaggcttcggttcaatgataggcccactagtcggaggtctaattactcaatttactaataatttaaataataccttttacttttcagcgatgatttttcttgcacttgcagtattttacggatattactttattaaaacaaacagaagggttaaaccttaa

SEQ ID NO: 1113 - DNA, 213 bp, Staphylococcus epidermidis
cgagataatctatatggttatctctattttttgcgttcaaataaaaacaaacttcacacaccgtcttttccaacttcagaagtacaaaaacaaccccttaagcctatgcctaagggttttcattattctatgctattattcccactcgatgatatgtatttttcacatgtgttttcgactattgatatacgttgtcatattagagttttatag

SEQ ID NO: 1114 - DNA, 309 bp, Staphylococcus epidermidis
ctattgattcatttgataaataacgacatcgaaaggaaggacaaaatgaagaagtgttcaatttccagtttatcatcaattattgtcacactcattagcatttttatatgttttacaaccatgtttacgaacatctataacaacactgactttaacttttggtatttcccaggagcaattatctttgttatctcaattattattaatattatagcaatgtttaaaggtaataagacgttaaacatcatcctattttttattaacttttttgccttacttatctttaccacaccatttgcaatcgtttaa

SEQ ID NO: 1115 - DNA, 1176 bp, Staphylococcus epidermidis
atggttactcaaaataaaaagatattgattattactggatcatttggtaacggtcatatgcaagtcacgcaaagtattgtcaaccaattgaatgagatgaatctcaatcatttatcagtcattcaacatgatttgtttatggaagctcatccaattatgacttctatatgtaagaaatggtatatcaatagctttaaatattttagaaatacatataaacgattttattatagtcgccctaatgagctcgataaatgtttttataaatattatggattaaataaactcatcaacttacttattaaagaaaagcctgatctcatattattaacatttccaacacctgtgatgtcagtattgaccgaacaatttaatataaatatccctattgcgacagttatgacagattatcgcatgcataaaaattggattacaccatattcacaaagatattatgtagcaacaaaagatactaaagatgatttcattgaagctggtgttcctgcttcatatattaaagtgacgggcattcctattgctgataaatttgaagaatctattgataaagaagaatggttatcgcaacaacatttagacccttcaaaacctactatattaatgtcagcaggtgcatttggtgtttcaaaaggctttgactatatgattaataatattttagaaaaaagtccaaattcgcaagtggtcatgatttgtggacgtagtaaggaacttaaacgttcattaaaagctaagttcaaagataatccaagtgtaataatattaggatatacaaatcacatgaatgagtggatggcatcaagccaactaatgattacaaaacctggtggtatcacaatttccgaaggacttagtcgttgtattcctatgatttttttaaaccctgcacccggtcaagaacttgaaaatgcatattactttgaaagtaaaggatttggaaaaatagcagacactccaaatgaggcaattgatattgtttctgacttaacaaataacgaagagactttaaaggttatgtcatctaaaatgctagaatcaaaggtaggatattctactagaaagatttgtaaagatttattagatttaataggtcactcatctcaaccggatgaaatctatggaaaggttcctttgtatgcaagattcttcgtcaagtaa

SEQ ID NO: 1116 - DNA, 1194 bp, Staphylococcus epidermidis
tttttcagtcatcatggctacaacgatattattcagtactttatttattgtttcgatctttattgtagacattttatatggtgttatcgatccaagaattcgtgtacaagggggcaagaaataatgagtaataaagaagatgttacaaacattaatggcgatatttctaatgcaacgatgtcacatacaagtaatgatatttcgaatacagattttattattagagatttagacttgaatcaagagccagaaatgccacgtcaaagtaagaatttttggcaagatgcttggtcacaattgaaacgtaataaattagcagtaatcggaatgataggtttgttgcttatagttattatggcatttataggaccattaatgaataaacacgattttgctgagcagaatgttgatcatcgtaatctcccagcaaaaataccattattagatcatgtttcatttttaccttttgacggtaaaggtacggacggtaaaaatgcttacaaagaagcaggtgcgaaagaaaactattggtttggtactgatcaacttggacgtgatttatggacacgtacttggaaaggtgctcaaatttcactttatattggtgtagttgctgcattattagatatttgtattggcgttgtatatggagccgtttctggtttctttggaggcagggtagatgatgtgatgcaaaggattttagaaattattgcttctatacccaatttaattgtcgttattttattcgtacttatttttgaaccatcaatttggactattatattagctatgtcaattactggctggctggggatgagtagagtggtacgtggagaatttttaaaattgaaaaatcaagaatttgttttggcatctcaaacattgggtgcttctaaattcaagttaatctttaaacatatattacctaacacattaggagcaattgtcgttacatcaatgtttactgttccaagtgcaatatttttcgaagcatttttaagctttattggaataggggtgcctgcgcctaagacgtcattaggatctcttgtcaatgatgggcgtgcaatgttgttgatacatcctcatgaattatttattccagcaatcattttaagtttattgattttattcttctatctatttagtgatggactacgtgatgcattcgacccaaaaatgcgaaaataa

SEQ ID NO: 1117 - DNA, 543 bp, Staphylococcus epidermidis
aggagaatacatatgaaaaaattattatgtacattatttgctgctgcactagtgttaagtgcttgtggccaagacgacactaaggaagatgaaaataaaaagtcagaaattactactgaaaagaaatctgacgataaaaaagacaaaaaaactaatgaggataaaaagtctggagaacaaaagaaatctcaagaaaaaaagaataacaagtcaatgcaagaatctgctacaaatgaacaggttcaatctcaacaacaaacgcaacaagctaatcaacaagcacaacagtctgataatcatgaacctacaaaagaagagatatatgaatgggataaacaaaacattcccggaggtacagattttggtttgattgatccagaagatgtaaatgaagcttcggaatctcaaaacgaagaaccagatgaatggattaaaggacaagaggaatggaataacgctactcaatcagaaaaagaggagctacgtaaacagaacgcgcaaaagtatggttatgagtatgatcctaaagattatgaagaataa

SEQ ID NO: 1118 - DNA, 1731 bp, Staphylococcus epidermidis
gtaattgttaatggaggtgctacggtggattaccaagctttgtatcgtatgtatagaccgcaaagttttgatgatgtggttggacaaacgcatgtaactaaaacgctgcgtaatgcaatttcaaaaggtaaacaatcccatgcatatatttttagtggtccgagaggtacgggtaaaactagtattgcaaaggtttttgccaaagctattaattgtcttaatagtgacgatggtgaaccttgtaatgaatgtgcgatttgtaaaggaatcacacaaggtacgaataacgatgtaattgaaattgatgctgcaagtaataacggtgtagatgaaataaggaatattagagataaagttaagtacgcacctagtgaatctaagtataaagtatatattattgatgaggttcatatgttaactactggtgctttcaatgctttgcttaaaacattagaagaaccaccagcgcatgctatatttatcttggcaacaacagaaccacataaaattccacccactattatttcgagagcgcaacgatttgactttaaagcaattagcagtgaccaaattatagatagacttaagtatgtagctaattctcaatctttggattacgatgacgcagcattagaatttattgctaaagcatcagaaggtggtatgcgagatgcattaagcattatggatcaagcaatagcgtttggagacgaacgacttactttacaagatgctttaaatgttacaggtagtgttgatgaagcggcattaaatgagttatttaatgacattgtaaaaagtgatgttaaagccgcatttaatagatatcatcattttatttcagaaggtaaagaagtcaacagactcattaatgatatgatttactttgttagagatacaattatgaataaaacgtctaacgaatccgttcattttgaatcacttattcatttcgacttagatatgttatacaggatgatagatatcatcaatgatacactagtatccattaggttcagtgtaaatcaaagtgttcattttgaagtgttgctagttaaacttgcagaaatgattaagacacagcctcaaactgtacaaaatgtagcaacagcatcggtagctaatgaaccagataatgagatgttattacaacgtttagaacaacttgaaaatgagcttaaaaccttaaaagaacaagggatcaaaactaataaagttagtcaacaacctaagaaaccaacacgtacgattcaacgatctaaaaatacgttttctatgcaacaaatagcgaaagtattagacaaagcaaacaaagatgatatcaaattgttgaagaaccattggcaagaagtgattgatcatgcaaaaagtaatgataaaaagtctttagtaagtttgctactgaattcagaaccagtagcagctagtgaagatcatgtgttagttaaatttgatgaagaaattcattgtgaaatagtaaataaagatgatgaaaagagaaacaatattgaaagtgtagtttgtaatatagttaataaaactgtcaaagtagttggagtgccggctgaccaatggctgagagtgagagcagagtacttacaaaatcgtaacaccaatgaaacacatcaaagcgaaaaacaaagcacacaacagtctcaacaaatagatattgctcaaaaagctaaagacttatttggtgaggaaactgtacacttagttgatgaagactga

SEQ ID NO: 1119 - DNA, 282 bp, Staphylococcus epidermidis
tttatgactaaacaagcaaacgcttcacgtttatcaagattattcaatgtagcaggattcattgtagatggttataacggaattcgctataatgctaagaataaacaacttgtctatttatcattaggtctaagcgcacttggaacaatcattgatttttacatttctattaaatctgcatctaaacttcgtaagttaagtgcacttggatcatttgcaatcaatggggtacgcttattcacaagttttaaaaaagttagagatgaatatgactatcactaa

SEQ ID NO: 1120 - DNA, 1248 bp, Staphylococcus epidermidis
cgtatgaataaaaataatagagttgttataacgggtatcggagccttatctccaattggtaacgatgctaaaacaacatgggacaatgcactaaaaggtgttaacggtatagataaaatcacaagaatagatactgatgattataatgtacatcttgctggtgaattgaaagattttaatatagaagaccacattgatagaaaagaagctcgccgtatggatcggtttacacaatacgcggtggttgctgcaagagaagcggttaaagatgcacaattaaatattaatgaaaaaaatgccgaccgtattggtgtatggattggttctggtatcggtggtatggaaactttcgaagttgcacatacaacacttgtagaaagaggaccacgtcgagtaagtccatttttcgttccaatgttaattcctgatatggctactggtcaagtttctattgatttaggtgccaaagggcccaatggttctacagtaacagcttgtgctacggggactaattcaataggtgaggcatttaaaattattcaacgtggtgatgcagatgcaatggtgactggtggaacagaggcacctattacacatatggcaatcgcagggtttagtgcaagtcgtgcattatctacaaacaatgaccctgaaacagcttgtcgaccattccaagaaggccgtgatggctttgttatgggtgaaggggcaggtattgttgtacttgaatcattagattcagctaaagagagaggcgctgaaatttacgctgaagttgtaggttatggttcctctggcgatgcacatcatattacagcacctgcgcctgaaggtgaaggtggctcacgagctatgcaagctgctttagatgatgctggaatcaaagctcaagatgtacagtatttaaatgcacatggcacaagtacacctgttggagatttatatgaggttcaagcgattaaaaatacattcggtgatgctgcgaagtcattaaaagtaagttcaactaaatcaatgactggacatttattaggtgctacaggtggaattgaagctattttttctgcgctatcaattcgtgattcaaaggtagcccctacaatacatgcaatcacaccagacgaagaatgtgatttggacattgttctgaatgtagcccaagacttagacattacctatgcaatgagtaatagtttaggatttggtggacataatgcagtgttagtatttaaaaaatttgaagactaa

SEQ ID NO: 1121 - DNA, 399 bp, Staphylococcus epidermidis
ttatcatgtaacagtatcatagcattttattggcgttttgtcggatatttgatatattggtgtaaagaaaattttaaagaggtgatactgatggaagaagcactaaaagatagtatcttaggcgctcttgaaatggtaatagatcctgagttagggatagatatcgttaatttaggtttagtatataaagttgatgttgatgatgaaggtttatgtacagttgaaatgacattgacttcgatgggatgtccattaggaccacaaattattgaacaagttaagagtgttttggctgagattcctgaaatttctgatacagaagtgatgattgtatggagtccaccttggaataaagatatgatgtcacgatatgccaaaatagctttaggcatcggataa

SEQ ID NO: 1122 - DNA, 210 bp, Staphylococcus epidermidis
ggatgtatcaacaacattgcacgcccatcattgacaagagatcctaatgacgtcttaggcgcaggcacccctattccaataaagcttaaaaatgcttcgaaaaatattgcacttggaacagtaaacattgatgtaacgacaattgctcctaatgtgttaggtaatatatgtttaaagattaacttgaatttagaagcacccaatgtttga

SEQ ID NO: 1123 - DNA, 1044 bp, Staphylococcus epidermidis
cgctataacaataacgtgctaagatttcatatcgaggtgaaagtacatatgaaatcaataacgcaggcttcatttatgaaaggtattatgtttacatttacgattgcaataatcagttatatattagctaaatttcctattttacatacgattggggcgttagctattgccatcatttttgcgatgatataccgccaagtcataggttatcctgagcatattcgtccaggtattacgtttgcatcgaaacgtttattaaaatttgcgattatcttatatgggttaaaattaaatatgggagatattctaggtaaaggttggaaattactacttattgatattatcgtaattatcttttcaataagtttaactttacttttgaatcaaattattaaaggaaataaagatatctctatactacttggtattggtacaggagtatgtggagctgcagctattgcagctacagcaccaatcttaaaatctaaagaaaaagacattgcaataagtgtaggtattattgcactagttggaactatatttgcacttatttatacagctatcgaggctatttttaacatacctactataacttatggtgcttggacaggtatcagtctacatgaaatcgctcaagtcgttttagcagcaggtattggcgggtcggaggcaatgacatttgctttacttggaaaattaggccgtgtgtttttacttattccattaagtattgtcttaattttgtatatgcgttataagtcacactcaagtcaagtacaacaaaaaatcgatattccttactttctaattggatttattataatggcttgtatcaatacatttgttcctattccttcattacttatgaatattataaatgttattacaacgttatgtatgttaatggcgatggttgctctaggattgaatatcgttttaaaagaagttatttcaaaagcacttaaaccattcattgtgatctgtataacttcaatttgtctgtctggtgtgactctcttagttacgtctataatgtttaaataa

SEQ ID NO: 1124 - DNA, 222 bp, Staphylococcus epidermidis
cgaataaacaagtggaggttatataatatgagatacctcatgacattcatttgggcagtattgttacttcaaatggttaatttcgtattgaatagcttaaatagtggaccagaactaaatgtaattaatccaattattattgctgtcatcttcactattgttgtagctattttagatccaattcttaagccgtctaaaggttcaaatcaatacgaatcttaa

SEQ ID NO: 1125 - DNA, 315 bp, Staphylococcus epidermidis
agtggaaacaataggagtatcatatatttaaaagaaggttcccaaaagttaatgattatcaatcgaggacctattgtagatatagataatcaaaaatatatatttgattattcagcatgtaattatcctgtcggtgtcgtagaagatcaaatatactattttaacgaagacaatatcgataaagtcgtttttgaaggttattctgatcaagatgagatgagatttcaagaattatttaaagaaatgaaaaataatttagatgatgatattcaacaaggtattgttcaaaagcaagataatttaggtttaatttaa

SEQ ID NO: 1126 - DNA, 432 bp, Staphylococcus epidermidis
aaggtagtaaaaaaaggagttacttataaaatgaaaaagttttttatatttttattaagtagtttattagtgctagctgcatgtggtaagaattatgaaatcagtgatattacaagcaaatttaaaaaagaaggtttaagtgtcgaaaacttacgaaaaatggaccgtgaagattttggtatggcaccaatgaaaactgaaaatgctaaaatatttactgtttcagaagataagaatgcacgtattttaaaatttaaaaatgaagatgacctaaaagaaatgaaaaagtattatgaagaattgggtaaatccagtgctacgttctattcacatgtatacactaaagataaatttttaattcaaatgaatggcgacattgacgatcatgtatttgaaaagtataaaaaagctatgaatgaggcattaaattaa

SEQ ID NO: 1127 - DNA, 183 bp, Staphylococcus epidermidis
tattatcaaaacttcacatcaatagaaattgagttgcgtaatatgatgttaatatttaaaccctatctattaatcattgataaattccttaatccacgtattcactgcaggcgctatattttcactgtcattgatatcgaaccatttcatgtcagtaatttcatgatcggtttcaacttttga

SEQ ID NO: 1128 - DNA, 258 bp, Staphylococcus epidermidis
gtattcaaaaatcatgttcaaagagaaaatattaattatgaaaatgaagatatagaccattcaaaaaaacatctaaattatgatttgataaatgacggaaaacaaaattttaatgatttgattgatgaaaaaattgagcggaactatacaggcaaaagaaaaattagaaaagacgcagtaaaacatatagacggaatgattacatcagataatgaattttttagtaatcagacaccagtaaatacaaaatttttttga

SEQ ID NO: 1129 - DNA, 393 bp, Staphylococcus epidermidis
agtttaaaaaatccaatgcaattttattatagtaattgtgaacagaatgcatcaaacttattagtcatcaacgtacaacctaatgaaggattttctttatgtgtgaatggtaagaaaagtaatcaaaataatgaaatgcaaaaagtgaagctttcttatactatgccgattaaagataaaatgaacacagttgatgcatatgaaaatcttatttacgatacattaattggagaacaaacaaactttactcattgggaagaattaaaaattcttggaaatttattgatgatattgaaaatgtatggaaacaagaatagccacagtttcctaattatgcctttggatgctatgggcctaaagaaagtgaaaaattacttagtgaagacggattga

SEQ ID NO: 1130 - DNA, 579 bp, Staphylococcus epidermidis
actttgaaaaaagaaattttagagtggattgttgccatagccgttgccattgcacttattgccataatcactaaatttgtcggaaaatcatattctattaaaggtgattcaatggatcctacattaaaagatggggagcgtgtagtggtaaatattattggctataaattaggtggcgttgaaaaaggaaatgtcattgtatttcatgctaataaaaaagatgattatgttaaaagagttattggaactccaggagatagtgttgaatataaaaatgatacactctatgttaatggtaaaaagcaatcagaaccatacttgaactataatgaaaaacgtaagcaaactgagtatatcacaggtagtttcaaaacaaaaaatttaccaaatgctaatcctcaatctaatgttattcctaaaggtaaatatttagttttgggggataaccgtgaggtaagtaaagatagtcgttcattcggtttaattgacaaagaccaaattgttggaaaggtatcgctcagatattggcctttcagtgaatttaaatctaactttaatccaaataacactaaaaattaa

SEQ ID NO: 1131 - DNA, 1557 bp, Staphylococcus epidermidis
catttaatgaatggtacatgttacactaaattcaaggagaggagtggctctatggaaaaaaatgaaaataaaatagttgatgtgattgcaacttctgatatgcatagtcacttcttaaatggtgattatggctcaaacatttatcgggctggtacttatgttaatgaagctcgaaaaaataatgaaaatgtcatattactagatagtgggggaagtttggcgggatcacttgcagcattttattacgccgttgtagcaccatataaacgtcatcctatgattaagttgatgaatgcaatgcagtatgatgctagtggaattagccctaatgaatttaaatttggattatcttttttgacacgttcagttgcactctcaaggtttccttggctatcagcaaatatagagtatactgttactagagagccatatttttctacgccttatacaatcaaaatgtattcagatttgaaaattgctatcgtaggtttaacatcagatggattaatgaagaacgagtacgcagaaatggaagaagatgtctgtattgagaagactttggtttcagctaaacgttggattagatacatacatgaagttgaagaaccagacttccttattgttatttatcatggtgggttaaataaaattagtagtgccaataaaagaaatgaaaaaaatgcaaacgaagctgaaaaaattatggaagaacttggtgttattgatgtaattattaccgctcatcaacatcaaacagtagttggaaaagatcatggaactatatatgttcaagcaggtcaaaatgctgaggaattagtacatctttcaattaaatttaagaaacgtacaacttcttatgagattgagcacatcgactcaaaagttattgacttaaatgattaccatgaagatgagcaattattaaaagaaacatattatgatcgtaaggcagtcaaacactgggcaaattcagtagtttcaaacaaaaacaatggcttaacagttcaatgtattgaagatattatttgtaagccgcatccttttactcaattattacatgatgcaattagattagcctataattatgatatttcttgtgtgcatatacctaagaatggtgaggaagggttaaaaggaactataagaaatagagatatatacgatgcataccctcatccagataaacctatagatatcactgtcaaaggtaaaaatatcaaagatatacttgaatacagttatgcgcatattgattttaataagcgacaattaagtatgacaatgatagatgaaacgttatttacagtttggcaagggtttgattattgtatagacatgtcacaatcaccgtttaatagagttaaattaaatggtctaaatgaagaagattcgtatagaataacaatgacagattattgttatagaaactacaaaatgtatttacaagaagctatcgttcacgacacatattcggaaacgatgggtggattgattagaaaaaatttaaaatgtgacatgtattctgtgaaattaaatcataattttaaagtttattaa

SEQ ID NO: 1132 - DNA, 642 bp, Staphylococcus epidermidis
aacaaaatgaaccagtgggatcaatttttaacgccatataagcaagctgttgatgagttaaaagtaaaacttaaaggattaagaaaacaatatgaagtgggagaacataattcaccaattgaatttgtgactggaagggtaaaacctatttcaagcgttatagacaaagcgaacaaaaggggtatcccttttgattgtttacatgaagaaatgtacgatatagctggtcttagaattatgtgtcaattcgtggatgatattgacatagttgttgatatattaagacaacgtcaagatttcaaggttatagaagaaagagattacattcgaaatacaaaagcaagtggctatcgttcttatcacgtgattattaaatatcctattgaaacactaagtggacaaaagcacatcttggctgaaattcaaatcagaaccttagcaatgaacttctgggctacaatcgaacatacattaaggtataaatatgatggggcatacccagatgagattcaacatcgtttagaaagagcagcagaagcggcatatttattagatgaagaaatgtccgaaattaaagatgaaattcaagaagctcaaaagtattacacgcaaaaacgtgctaagaaacatgaaaatgattaa

SEQ ID NO: 1133 - DNA, 747 bp, Staphylococcus epidermidis
ataggagtgaatgtaaaaatgaaagttaaatcaccacaatcaatctacttaaaaggacatcgtcaacaagctgtattgttattacattcttttacgggaactgtacgtgatgtaaaacatttagcacaacagttgaatgaagagggatttacttgttacgtgcctagttatccaggccacggtttgccgcttaaggaatttacccaacacaatatcaatgattggtgggaacaagttaccgcagcatatcaatttttaagaaatgaaggatacagtagaattaatgtgacaggcgtatcattaggcggattatttactttaaggttagctgaacattttgatttagaacgtatagctgtgatgtcagccccacataaaaagcgtgaaagcgagattgcgtggcgtcttgaaaggtatgggcatcgaatgaatgaaattttgagtttaagcgaagaagagcgtcgtcaccaaatggaaaccatcttgtcctatgataaagaaattgaagtgtttcaaggtgtaattgatgaaattatggcttatcttgcaaatattacagtaccagtgaatattatgtatggcgaagaagatgacccattatatgctcaaagtgcgcaatacatttatgataatgtaaatagtcaagataaagaactgctcaaatttgaaaaaagcggtcatcttatgacgtatggcgatcatgcatacagagtagaacaatctattattcaatttttcagtaaataa

SEQ ID NO: 1134 - DNA, 366 bp, Staphylococcus epidermidis
ataaaaaagaacatttataataacgtgattgcgttattatttgattggtttgttatttttagtagtattttaatttctgtaacttttaataacattttgatctatcttgtagctattatattaattggtagtagaatgagagcatttgataatttaatgcatgaagcttgtcatcgatctttatttacaaataagttttggaataaatggataacttgtttatttgttgcatttccagtatttactagttatacagcatatcgaaatgctcatcattgtactggattttttaaaactacattgcctggcttttatagtgtagttaaagatatttttacaccgaactatgaaaggaaagagagttag

SEQ ID NO: 1135 - DNA, 1146 bp, Staphylococcus epidermidis
ctgagttttgatatatacttattgagtatgaaaaagaataaaataggaggatcacaatctatgttcaataaggtttggtttagaacaggaatattttttattatgctgttcatactcatcaaactatttatggaagtgcatgaagtatttgctccaatagctactatcattggttcagtcttccttccatttttaattagtggatttctcttttacatatgtttaccttttcaaaacatattagaaaagtggggctttccacgttgggctagtataacaacaatattcataggattaatagctatcatcgctattgtggtatcatttatagcacctatcattatttccaatattaataacttaattaaacaaacaccatcattacaaaaagaagccgaacaattaattaatttctcgttaagacaaatggataaattaccagatgatgtcacacatcgtattaataaagcggttaaatccatgggagatggcgcaacgtctattttatctaattcagtgtcatatattacgtctttcatctcaactgtatttttattaataatggtgcctttcttcctgatatatatgctaaaagatcatgaaaaatttatcccagcaatcggtaaatttttcaaaggagaacgtaaagtttttgttgtagatttattaaaagacttaaacttcactttaaaatcatatattcaaggtcaagtgacagttagtatcatcttaggtattattttatatataggttatacgattataggattaccatatacacctttattagtattattcgccggcgtagctaacttaataccatttttaggtccatggttatcttttgcaccggcagcgatactaggtattattgatggcccttcaacttttatttgggtatgtgtcgtaacattaatcgcacaacaacttgaaggtaacgtgataactcctaacgtaatgggtaaatcattaagcattcatccattaactattattgttgtcatacttgcagctggagatttgggtggtttcacactcattcttgttgcagttccattatacgctgtaatcaaaacattagtgagcaacatttttaaatatcgtcaacgtattgtcgataaagcaaacagtaatgttaaagattaa

SEQ ID NO: 1136 - DNA, 1392 bp, Staphylococcus epidermidis
aatcaaattgaaataaatgttgaggtgaaaatcatgtcagttttaagtcagctgcttaaaaaatctagccctcaacaagggattatactctattatctatttgccatcgtcgttgcatttttattattaaatttgccatatgttcataaacaaggggttgaggttaatccaattgatacactttttgtagctgtatcaggtattagtgttacaggattatcaccaattactatagtcgacacatactcaacctttggtcaaattatcatacttattattttgaacatcggtggtataggtgttatggctattggaaccatgctttgggttgttttaggcaaacatattggaattagagaacgacaactcattatgttagataataatagagatactatgagtggaacggttaaactgattttagaaattgtaagaacaatttttattattgagtttataggtgcactcttactcgcgttctatttttatcgggataatcctgatttaaaaaacgcattaatgcaaggcatttttgtgtcagtatctgctacgactaacggtggtcttgatattactggtgaatctttagttccctatgcaaaagactattttgtacaaacaatagtaatgttcttaattgtgttaggatctataggctttccagttttgttggagttaaaagcatatataaagaatcgagtaactaattttaggttctcattattcacaaaaataacgacaacaacgtatttattcttatttttattcggcgttattgttgtattaatattagaacatagcaatgcatttaaaggattgagttggcatcaatcattattttatgcattgttccaatcatcaacgaccagaagtgcaggtttgcaaacgatagatgtgtcacatttcagcgacgcaacaaatattgtaatgggattattgatgtttataggatcatctcccagttctgtaggaggtggaatcagaacaacaacatttgctattttaattttgtttgttattaattttaataatactggtgacaaaacaggtattaaaattttcaacagagaagtacatattatggatgtacaaagatcatttgccgtatttactatggcgtcattaattacatttattagcatgattattatatctgccactgaacaaggcaagttgtcctttttacaaattttctttgaagtaatgtctgcgtttggtacatgtggtttaagcttaggtgtgacaagcgatgtcaacgacattaccaaggctgtattaatgatattaatgtttataggtcgtgtaggacttatttcattcattattatgttagctggacgtaaagaacccgaaaaatatagctatcctaaagaacgtatacaaattggatag

SEQ ID NO: 1137 - DNA, 333 bp, Staphylococcus epidermidis
ggaggaaatgaaattatgcgcggtggcggaaatatgcaacaaatgatgaaacaaatgcagaaaatgcaaaagaaaatggctcaagaacaagagaaattaaaagaagaacgcgttgctggaacagcaggcggaggtatggtgactgttactgtaacaggtcataaagaagttgtggatgtagaaattaaagaagaagctgttgatccagaagatattgagatgcttcaagatttagtattggcggctacaaatgaagcgatgaataaagcagatgagttaacacaacaacgtttaggtaagcatactcaaggcttaaacatccctggaatgtga

SEQ ID NO: 1138 - DNA, 330 bp, Staphylococcus epidermidis
gggctacgttttaaaatttcgtacatcccacttgcaatagtaatagaaacatccatcactgctccaagtgtacctattagtacggaagctagaaagacatccttaggagggagagtaaggaaagtgattgtttcgtattttattccatttcccccggtaaatttgatgatgacttcggtaattccaacacataagaacgtaccaatcagcgtacttacaatagtaattaaggttcggctatgccaacctgttacaagtagtaaagtgaaagaagtggaaatgataatagcacaagtcatcaaaaagaataaacttatagccccatattga

SEQ ID NO: 1139 - DNA, 612 bp, Staphylococcus epidermidis
aacatgatagaggtgacttttatgtctacgaataatgagattgaatttaaacaaatactaaatcaagatacttactcaaaaatctatgaactctatttcaaaaatcaatcaccttttaagcaaactaatttctatatcgacacagagaattttaaattaaaacagcatcaggctgctttgcgtataagggtcaaagattatatgtatgaaatgactttaaaagttcctgctgaagttggattgacagaatataatcactcagtaaatatagaacctaaacttgatatgtcacttcaactttcccaattacccaatgatattagaaatattttagaacaggactttaatattttagaaaatgagcttaaagtgctaggaaacttaactacctatcgtttagaaaccgaatatcaaaatgaattactagtattagataagagtgaatatctcggcaaaactgattatgaattagagtttgaagttcattcttatgatgaagggtattcaaaatttaaaagtttacttcaacattttaatcttcaacatcaaaaacccttgaataaagtgcaacgtttttttcaagaaaaacaaaatgcaagtgataaagattaa

SEQ ID NO: 1140 - DNA, 999 bp, Staphylococcus epidermidis
tggggtgaagagatgttaatggcaatcaatcagcaaggtcagaaaattttagcgcaacatgcaaacaaatttgataaatatcaatgtcctcactgtaagtctgaggtgatactcaaacaagggatgactttaatagctcactttgcgcataaaacacgttttaatcaccgctgttcaaagtcagaatcagttgaacattatgaagcaaagttatatttagcaagaatttataaagcattgaattttaacgtggaaattgaaccttattacaaagaagttttgcaatatccagatattgtgatcaatcaagaaaatgcaattgaagttcaattttctaaaataagtatcagtaaaattattcgccgaacaactggtttaaagcgaataggtttgaatgtgatttggattattaaagatgttcctttgaaatataaatacgttaaattatcaccatttcaaagtgcttttattcatccaattaatagaacattagtaacatgggattccaaaaagtttgtattaatattatatagtcaacttcaacatgtaggcggtaaaaattttgttgctcaaagaaaagttttaaaatttgaggatataataaatatgacttttcaatcaaataatgttcccaattttaggttatctgcttctaatatacaacgttatataaactattgtagaaagcgccacagtgttttagaacctacactcagtgccatgtatcaattaaatatgtatgattctgatgtaatttgtaaattaggatatgttgtaccacatcaaatatatttaataacgcatccaatagaatggcaattaaaatatttgttgctaagaagaacattaaatgacaacgaattatgtaaacaacttcttagtcaagtgaagtttagggtgtttgcaacgtttcaatacgacaaacgtcaaatattaagtactattttgcgtgaatttgattatttatatgaacacgaaagcttaaacgtgcaaaagtag

SEQ ID NO: 1141 - DNA, 1524 bp, Staphylococcus epidermidis
aataaaggagaattaattatgatatacacagtaacaaccacccttccattatcccatggtggtagaactcaagctttactcagacgaattaaactgttagatgaagaatttaaaattccaagtaaaattctcaccactaattatcatggtaattatcctagtatttataaaaaatacagacaagaaaacaaagttacagaaaatatacaattcgagaatatgtatgaatggttatcaaatttcaaactttttaaagtcccaaaaacattgattactaggaatccaaaatacattaaaacacctagaaagattaaaggacttattgataagcaaggaaaaaagagtggtcttattcattattataataatgaatgtcatgtgagatctcgaaagtattatggacagtctaatgttcttgaatatgaggacttcatttctcccacatcaggattgaaatatgagcgccatcaatataacttatacggccaacttcatagaaaagaatattattatgatgactcttctttaaaacatagcgacgaattatttgatactgagggctctatgtactgcaagagatatttcaaaactaaaccaaacagcaaaattaatggcgtagaaatatatagaaataaaaaactttataagacctttaaaaatgataaattattagctcagttttattttcagaatagattcaaaaatcaagatatcgtctttaatgatgctcgatttttagataaaccattacttaaacaaacgcaccaaacaaaaaatattcttgttttacatagctcgcatttatcaggggaccaaataaaaaaatcatatcgatttgctttaaatcaatcaaaaaatgtttataagtatattgttctcactcaccaacaaaagcacgatatacagcaacatttccatataagtgacgaccaattccaactagtaccacattttatcgaattagatacggaggtagaacaagattcctcaaacaatcaaaatcgctttatatatataggccgttttagcacagagaaacagattgatcatattattagagcttatcacaagtttttgcaaagtggttaccaaacagaattacatttatttggtagagatgaagataatcaaattccattgatgaatactttgatttcagaattaaaattatcggataaagttaaaatatttaaatataccaatcaacctttacaaaaatttaagaattctaaagcctctctacttacaagtcaatatgagggatttggcttaacacttatggaaagtatagaaatggggtgtccagtcctatcttataacgttcgttacggtccaagtgaaattattcaaaacgggataaatggctatctcattgaaaaaaatgatattgatagtttatcaaaacatatgattaacatcattgagcacccactacaaaaagtgaaaaataaagacactttaaaatataacgccgcagtgaataattacaaacaacttatgcaaagcttagacttattaaaatag

SEQ ID NO: 1142 - DNA, 2616 bp, Staphylococcus epidermidis
aataatttggatattaatcaaatgacatatgctgtacaaggtgccttacaaaaagcagtcgcgtacagtaaagaatatgaattacaaaacattgaagttgaagcattgttaaaagctgcaatgaatgaaaatgatagtttatttaaaagtatattagaacgagcaaatattgatgttgatcaattaataaaagcatacgataatcaattaagtcattatccaactgtacaaggtgacaatgttcagtatggacagtatattagtgctaaaacaaatgaattattagacaaagccgagaaatatatgaagtcctatgaagatgagtttatttctatggagcatatattacgtgcagccatagatactgatgaaactactcaaaaatgggtcggcaataaagtagaagtgataaaagaaattataactaaagttagagggggaaatcatgtgacatctcaaaatccagaagtaaactatgaagctttagaaaaatatggtcgtgatcttgtagaagaagtacgtcaaggtaaaatggaccctgtcatcggtagagatgaagaaatacgtaatacaattcgtatattaagtcgaaaaacaaaaaataatccggttttaatcggtgaaccaggtgtaggtaaaactgcaattgttgaaggtttagcacaacgaattgtacgtaaagacgttccagaatcattactcgataaaacgattttcgagcttgatttaagtgccttagttgcaggtgcaaaatatagaggtgaatttgaagaacgtttaaaagcagtattgaaagaagtaaaagaatctgaaggtcgaatcatcttattcattgatgaaattcatatgttagtaggcgctggtaaaactgatggtgctatggacgcaggaaacatgttgaaaccaatgcttgcgcgtggtgaattgcattgtataggtgctacgacattaaatgaatatcgtgaatatattgaaaaagattcagcattagaacgtcgtttccaaaaagttggggtcagtgaacctgatgttgagaatacaatatcaattttacgtggtctaaaagaacgttatgaggtctaccatggtgtacgtatacaagaccgtgcacttgttgcagcggctgagctatctgatagatatattaccgatagatttttgccagataaagctatagatttagtcgaccaagcttgtgcgacaatacgtacagaaatgggatcaaatccaacagagttagaccaagtaaatcgtcgagtaatgcaattagaaattgaagaaagcgccttgaaaaatgaatctgataacgcaagtaaacatcgtttagaagagcttcaagaggaattatctaatgaaaaagaaaaacaatcctctttaaaatcacgtgttgaacaagaaaaagaaaaaattgctaaagtacaagaaaaacgtgctgaacttgatagtagtcgtcaagctcttgaagatgcacaaacagaaggtaatcttgaaaaagcagcagaattacaatatggtacaattccgcaattagaaaaagaattgcaagaatttgaggaagcctttcaagatgaaactggcgaagatagtgaaagaatgattcgtgaagtcgtttcagatgaagaaataggcgacatagttagtcaatggacaggtatacctgtatctaaacttgtggaaacagaaagagaaaagctattaagtttaagtgacatcttacacaaacgtgtagtaggtcaagataaagcagttgatttagtatcagacgcagtagttagagcacgtgctggaattaaagatccgaatagaccaatcggaagtttcttattcttaggacctactggagtaggtaaaactgaattagcaaaatcgcttgcttcatcacttttcgattctgaaaaacatatgattagaattgatatgagcgaatatatggaaaaacatgctgtatcacgtttaattggtgcacctccaggttatgtaggtcacgatgaaggtggtcaattaactgaagcagttagacgtaatccatactcagttattttgttagacgaagttgaaaaagcacatagcgatgtttttaatgtattacttcaaatactagatgaaggtcgtcttacggattctaaaggtagaagtgttgactttaaaaataccattatcatcatgactagtaatattggttcacaagtattacttgaaaatgtaaaagatgctggtgaaattagtgatgatacagagaaagcagttatggacagtctacatgcatacttcaaacctgaaatattaaatcgtatggatgacatcgtgttatttaaaccattatcagttgatgatatgagtatgattgtagataaaattttaacacaattaaatatgagattattagatcaacatatctcaattgaagtgacagaagaagcgaaaaaatggctaggtgaagaagcgtatgaaccacaatttggtgcaagaccattaaaacgctttgttcaacgacaaatagaaactccaattgcacgtatgatgattaaagaaagtctacctgaaggtacaataattaaagtagatttaaatgacaataaagaacttgattttaaggttgttaaacctacgtcttaa

SEQ ID NO: 1143 - DNA, 630 bp, Staphylococcus epidermidis
aacaagatggattatgtatacacaatttataaaaatcctagatataacatcattcaaaaagataatcgctatttaatggtcgatttagaacaaaattggtattcatatttatgtccaatgctgaattggtttatacctattaaattcacagaattaacttatcaagaattcaataatataaacatatttcataatggaggacaaaagagtcatggtatgatggctgctggcgttggcgtcactatcagtgtgctattaagaagtcttgtgggttatatagatattaatattagtcgaatttggatagtttttatgtttttaattggatttgttgctgtgatcacacttcgtttatctataagaaagaagttaaatcatccagcatttaataaaaagagtaaacaaaaagtaatattgataccatcatttaaaaatatgatattggtggtgttttgctattttatgatgctgtttttctcaattgcaccttttcaaatgatttttgaggaaaagaaaaacatcttaggatatatactttgggtaggtgtattatttatatttactactttgaatatggcttcaatttctgatagaaaagtacatgccaaaattaaaaatataagaagatag

SEQ ID NO: 1144 - DNA, 399 bp, Staphylococcus epidermidis
aaaaaggaggaaattatgaagaatgtaagcccgtttatttacgttaaggacgtagataaatctttatgttattacaaagatgtatttaatgctcaaacagaaatacttatgggtaaagatggtcgaacttatcatgcccaacttattattggtgatgaaacgttcgtacatttctccgatacgtttcataagcatcccgtttctaaaaatcctcatcttattattgaatgtgattcattagaagagttggagcgtgtctataaaaggttaattgatgatggtggtcatgctaaagtaaaactcaataaaactttttttaatgcctatcatgcagaggtaaaagaccgtctcaatggtatcatttgggtatttaattactttttagatgaacatatataa

SEQ ID NO: 1145 - DNA, 189 bp, Staphylococcus epidermidis
ataggaggtttcattaatgtccataaattcttatttgatttcgtcattatttacgccagttttatcaataattatatggttattttattcaaatcactttataaatttaatcaatatcttattttatacatcattcattatttttatagttgctttccttattttactcattcaagaaggaatatttga

SEQ ID NO: 1146 - DNA, 384 bp, Staphylococcus epidermidis
tatgttaaactagtatggaataaggaggaaacaagcatgcgtatttacataaatgaaattaaattaaaagatgatggcgtttattgcttctcagaagaatctacagagggactagaagaggtaggtcaaatgcttgttgatagtgataattatggttttgcttatcttttagatgatggacaatcatattcatatttgatttttgttcaggaaacatggtcgatgttgcatgagaatagagataaacgaatcattattaataatcatttagaactaaagcatttccaagaagaattagattatgttttgaataacatagaaggaaacaataactatggtaaggagtttgtttcagctgttgaaaaaactttcgaactagagtga

SEQ ID NO: 1147 - DNA, 387 bp, Staphylococcus epidermidis
atgattaaatgtgtttgcttggttgaagaaaagaatcatcagttactacttgtacaagttcgacatagagataagtattatttcccgggtggtaaaattgatgagggtgagagccttgtggaagctttacagagagaattgaaggaagaattgcgcttagaattagctaaagatgaattagaatttattggaactattgtcggagaagcctatccacaacctaatatgttgactgaacttaatggatttaaagttaatcgagctatagattggtcaaaagttgaaaccgatcatgaaattactgacatgaaatggttcgatatcaatgacagtgaaaatatagcgcctgcagtgaatacgtggattaaggaatttatcaatgattaa

SEQ ID NO: 1148 - DNA, 258 bp, Staphylococcus epidermidis
tctgaaaagtgcttgatttctaaatcaatatcatcttttttagctaattctttaactttttcccaagccttcgtgtcgttggatgcaacacctatggttacctttttaccattattaccgccacatgctgataaaactaaaattgcaacgattaaaaaacttaaaatctttttcataaatgaattccccctaaatatttataaaacacttactagtattttaatttctacggataaccctagcgataaagttacctaa

SEQ ID NO: 1149 - DNA, 261 bp, Staphylococcus epidermidis
ataaaggagtgtagaaatatgaaacgtacatttttattaacttatacaaccgtatcaggaaaaacatatacggaatttaaaacatttgaaaatggtcccgattacgatacatgtgtatcacgaattatagatgaatttgatgaattggcatacttatatattaaaaaagatgttgtacattatattaatgttgatcacattgaaagtctagacattgaagaagtgacagagggacaacacattacttatgattttgaataa

SEQ ID NO: 1150 - DNA, 291 bp, Staphylococcus epidermidis
tttgttatacgcaaagcttcatatggacaaacgcctcacgtgcactttgaaattgtaccaattacagaagatggacgattaagtgctaaagatgttgtaggtaataaaaaagcattagcaagctttcaagataaatttaatgagtatgtaaatgaacgtggttatgaattagaacaaggaacttcaagagaattaacaaatagacaacacgatcaagttaatagttataaacaaaaaacagaatatcataagaaagaatatgaacgtaggtataaaattcagcccatataa

SEQ ID NO: 1151 - DNA, 1365 bp, Staphylococcus epidermidis
aaaggcatacgtgtttcaatatcatacatatataaaggagagacagctatgaataaaattataatagtcggtgcagttgctggtggtgcgacttgtgcaagtcaaattcgaagattagataaagagagtgaaatcattgtttttgaaaaagatagagacatgagctttgctaattgtgcattaccttattatattggcaacgttatcgaggaccgtcgtaaagttttagcatacacgcccaatcaattttatgacaaaaagcaaatcactgtaaaaacataccatgaagttatacaaatcaatgatgagagacaaaaagttactgtcttaaatcatcaaactaatcaaacttttgaagaaagctacgatacattgattttaagtcctggcgcatctgcaaatcgattaaacactcatagtgatatctcatttactgtgcgaaatctcgaagatactgaaacaattgatacctttattacgaataccaaagcacaacgtgcacttgttgttggcgcgggttacatctctttagaagtccttgaaaatttacatcatagaggtttggatgtcacatggattcatcgctctacaaatattaataaactgatggatcaagatatgaatcaacccatcatcgacgaaatagaaaaaagaaatatcacttatagatttaacgaagaaattagtcacgtcaatggacatgaagttacattcacatctggtaaagttgaaaactttgatcttattatcgaaggtgtaggtactcatccaaattcacaatttattaaatcatctaacgtcatactgaatgataaaggatatatcccagtaaatcataatttccaaacaaatataccaaatatttatgcattaggtgatgttattacttcacattatcgtcatgtgaatttaccggcacaggttccacttgcttggggagcacaccgtggtgcaagtattatagctgaacaactttctggaaattcgtctattcactttaaaggttatctaggaaataatatagtgaaattttttgactatacattagcaagtgttggcatcaaaccaaatgaacttaaaaatttcgattatgatatggttgaagttaagcaaggagctcatgcaggatattacccaggaaattcaccactacatttacgtgtttattttgaaaaagactcgagaaaacttatacgcgcagcagcagttggtaaacaaggtgccgataaaagaatagacgtattatcaatggcaatgatgaataatgctactgtggatgatttaacagaatttgaagtagcatatgcacctccttatagtcatccaaaagatttaattaatttaattgggtataaagcgcaataa

SEQ ID NO: 1152 - DNA, 495 bp, Staphylococcus epidermidis
aaagccatgcgctatgtgtatggttcagaaaaggttttaccgttatctaaaaaaacatctcatcatgctagaatatatattggccagccaaccaaaatattcaacacgaggagatgctttttaatgtcatctgacacaaacggtttagcacatacaaaatggaattgtaagtatcacatagtctttgcaccaaaatatagaagacaagtgatatatggaaaaatcaaaagagatattggagtgattttacgtcaactatgtgaaagaaaaggcgtagaaataatagaagcagaagcatgtaaatacccagttggtgttgttgaagatcaaatatactatttcaatgaagataatattgataacgttatatttgagggctattctgatcaagatgaaacaagatttcaagaattatttaaagagatgatgggtaatttggatgaagatattaaacgtgggactgttcaacaaaaagatagttacggattgatttaa

SEQ ID NO: 1153 - DNA, 1503 bp, Staphylococcus epidermidis
aaaaaggagcgatacattttgaatgcaagtgcgttgttcaaaaaaattagagtaaaaaatgtaattggtacattagatatacaggtggacgatattaccactgactcacgtacagctaaagagggaagtctatttgtagcatctaaaggatatacggtagatagtcataagttttgtcaaaatgtagtagatcaaggttgtggtattgttgttgtcaatagagaactcgaacttaaaggtaatgtgacgcaagtcgttgttcccgatactttacgtgttgcaagtctattggcacatgaattatacgagtttcctagtcatcaactgacgacatatggtgttacggggacgaacggtaagacatcgattgcaactatgattcatttaatttatagaaaattgaataaaaatagtgcatatctaggtacgaatggatttcaagttaatgaaacaaaaacaaaaggtgcgaatacaacaccagaaacagtagcattaacaaaaaagatcaaagaagcagttgatgccaatgcagaagcaatgacgatggaagtttctagtcatggattggccttaggtcgacttagaggcgtagagtttgacgttgctatcttttcaaacttgactcaagatcatttagactttcatggaactatggaagcatatggacatgctaaatcgttattatttagccagttaggtgaagatttgtctaaagaaaaatatgttgtattaaataatgatgatgacttctccgattatttagcaagtgtgacaccctatgaagtatttacatatggtattactcacgaagcacaatttatggctaaaaacattaaagaatcattgcaaggtgtagaatttgaattttgtactccatttggaagttttccagttaaatctccttatgtaggtaggtttaacatttcaaatattatggctgctatgattgcggtttggagtaagggaacaaatttaaatgaaattattaatgctgttactgagcttgaacctgtagaggggcgcttagaagtacttgatccatcacttcctatagatttgattatagattatgcacatacagctgatggtatgaataaactgattgatgctgtacaaccatttgttaaacaaaagctaatctttttagtaggtatggctggggaaagagatttaacgaaaacacctgagatggggagagtagcatgtcgagcagattatgttatttttactccagataatcctgctaacgatgatcctaaaatgttgacagctgaattagctaaaggtgcaacgcataacaattatatagagtttgatgaccgtgcagaaggtattagacacgcgattgatattgctgaaccaggtgatacagttgttttggcctcaaaaggtcgagagccttatcaaattatgcctggtcatgttaaagtcccacatcgcgatgacttaattggcttaaaagcagcatatcaaaaatttggtggtggacctcttgaggattaa

SEQ ID NO: 1154 - DNA, 1782 bp, Staphylococcus epidermidis
agaaactataggagtggtcttctagtggataacaataaaaaacaagtcataccacgcagtcaatatcgacgtaaaagacgtgaatactttcataacgtagagcgagaagagcgcataagacgtgagaaaatagagaaggaaaatcaagctaaaagagaacaacatcaaactaaagtcaatgaggaacgtgttaaagataatttgagaaaagcaagaatagagaagctgacacaagaagaaatacatcaacaacgtgatgataaaagttataaacaaaaaactttaaatcaaaataatcaaatgaataaatctaaagacgacgataataaaattggagaagaaagtctacatgatgtgcgagtttcaagtgatacctccactttaccgcatcaaaataagtcaataaaagactatgatgattctggaaacgaaagtaaacaacatactaaattgacttcaaaggaatctatgctaggcgtaaattctaatcatactgagcaagattcaagaagtacacaaccatattcttcaaaacatagctattcacaaccaaaagataaagacaacgataatactcaacaagcgcaatttcttaaaaaagaagacaaacaacgtaacagagccgaaaatataaaaaaagttaatgaatttaaacaattggtggtagctttctttaaagaacactggcctaaaatgttaattattatcggtattatagtattacttttaatattaaatgccatattcactacagttaataaaaatgatcatacaaatgatagtgcatttaacggtacagctaaagatgaaacaacagcgatgaaaattgctgaaaactctgttaagtcagttgtaactgtcgagaatgatttgtctaatgacacgactgtgtctgataacaaaaatgaatctgataatgagataggatcaggtgtcgtctacaaaaaagtgggcgactctatttatatttttactaatgcacacgttgtcggtgatcaagaaaaacaaaaagtaacatatggtaatgataaatctgtgacaggtaaggtaattggtaaagataaatggtctgatttagcagttgtaaaagctaaagttgctgacgaaaatattaaaccaatgactatgggggattctaataatattaaattggctgaacctattttagttataggcaatcctctaggcacagactttaaaggaagtgtttctcaaggtattgtgtctggactcaatcgtcatgtacctgtggacattgataaaaatgataattatgatgctttgatgaaagcttttcaaattgatgcgcctgtgaacccaggaaattcaggtggtgctgtggtcgatagagacggtagactcataggtatagtttctttaaaaattgatatgcataatgtagaaggaatggcttttgcgatacctattaatgatgtacgtaagattgcgaaagaattagagcataaaggtaaagtgaactaccccaatactgaaatcaaaatcaaaaatgttggtgaccttgacgattctgaacgtaatgcaatcaacttaccagctaaagtgaatcatggtgtattaatcggtgaagtgaaagaaaatggtttaggagacaaagcaggtttaaaaaaaggtgatgtaatagtagaattagatggtaagaagattgaagataacttacgatatagacaagtcatatatagtcattatgatgatcaaaaaacaattactgctaaaatttatcgaaatggtgcggagaaaaatattaaaatcaaattgaaataa

SEQ ID NO: 1155 - DNA, 393 bp, Staphylococcus epidermidis
tcaagaaataggagtcgtccagttatgaaaaagacgaaaggtatttatgaatctgaaattagtaaagccattacacaatgggagaaagattttttaggaagaggttctttgtctgtaaaaacagatattcttcgtgatatggttattgttagtttacaaggtattttgacacctgctgaatatcgcgtgtgtaaaacgaatgaagggcttttaaatattaaacgtacacgttctgaacttgtagagtctggtgaagaggacttgagtcgcattattaaagatttgactggacttaatgtgaaaagttttcatagtgatttaagtactattaccggtgaacgcgtaatgatttttaagttggaagatcgttttgataaagcattacatgagtaa

SEQ ID NO: 1156 - DNA, 954 bp, Staphylococcus epidermidis
agagggtggcttttaatgagtaatgaaaatgtattattacaagttaaaaatttaaaacagtattttaatcaaggtaaacataatgaagttaaagcgattgataatataagttttgatgtttataaaggggaaactttaggcctagtaggagagtctggatgtggtaaatcaacgactggaaaagccattatcaaattaaatgatattactgatggcgcaatcgagtatgatggtaaagatattcatcaaattagaaaacgtaaagagcgattgaagtttaataagaaaattcaaatgatatttcaagatccttatgcatctctaaatcctcggttaaaggtaatggatatcgtagctgaaggaatagatattcacaaacttgctagtagtcagcgtgatcgaaagaaacgtgtatacgaccttttagaaacagttggtttaggtaaagaacacgcgaatcgttacccacatgagttttcaggcggacaaagacaacgtattggtatcgcacgtgcattagctgtagagccagaatttattattgcagatgaaccgatatcagcattagatgtatcgattcaagctcaagtcgttaatcttttattaaagctacaacgtgaacgtgatattactttattgtttattgctcatgatttatcaatggtgaaatatatttccgatagaattgcagtgatgcacttcggtaaaattgtagaaattggaccggctgatgatatttataattatccattacatgattatactaagtcattattaagtgccattccacagcctgatcctgatgttgagagaaatcgtcaacgtgttttatatcatgaagatgcaacgcttaatgaagaacgtcaattaaatgaaattagaccacaacattatgtattttctactcaaaacgaagcagttaaattgaaacaaaagtatggtttgtctgtttaa

SEQ ID NO: 1157 - DNA, 273 bp, Staphylococcus epidermidis
tcagtttcaagagtaataaaaatagcacaaagaattatggaggattacgaatgtataaaatctgttagcgccttagaagataaagagaaggaaatacgagagaaagatgatttattaaataaagcagttgggcgtattgaaaatacatacgataatttcaatcgactttacgaaatggcaaagccatttaaagagaatgtagaaatagctttaaagcttttaaaaattttactaaaagagctaatgaagaaacacatttgcggaaagagttaa

SEQ ID NO: 1158 - DNA, 1545 bp, Staphylococcus epidermidis
atagagtcaagaaagacatttgccatcatttcacaccccgatgctggtaaaacaactttaactgaaaaattgttgtatttcagtggagcgattcgtgaagctgggacagttaaagggaaaaagacgggtaaatttgcaacaagtgattggatgaaggtaaaacaagaacgtggtatctcagttacaagctctgtaatgcaatttgattatgatgattataagataaatattttagatacgcccgggcatgaagatttttcagaggatacgtatcgtacattaatggcagtagatagtgcagttatggttattgactgtgcaaaaggtatagaaccacaaacattaaaattatttaaagtttgtaaaatgcgaggtatccctatttttacattcatcaataaattggatagagtagggaaagagccatttgaattacttgatgaaatagaagaaacacttaatattgacacttatccaatgaattggcctgttggtatgggacaaaatttctttggtattattgatagacactctaaaacgattgaaccatttagagatgaagaaaatttattacatttaaacgaagattacgaacttaaagaagaacacgcgataaaaaatgatagtgcatttgaacaagcaattgaagaaatgatgcttgtcgatgaagcgggtgaagcatttgataatgaagcgttactgaacggtgaattaacacctgttttctttggatcggcattagcaaacttcggcgtacaaaatttcttaaatgcatacgttgatcatgcgccaatgcctaatgcgagacaaactaaagaagaggttgatgttagtccattcgacatagatttttctgggtttatctttaaaattcaagccaatatggatccaaagcatcgtgacagaattgcatttatgcgcgtggtaagtggtgcgtttgaaagaggaatggatgtaaccttacaaagaactaataaaaaacaaaaaataactcgttccacatcatttatggctgatgataaagaaactgttaatcatgctgtagcaggcgatattattggtttgtatgatacaggtaactatcaaataggcgatactttagttggtggtaagcagaaatatagtttccaagagttaccacaatttactccagaaatatttatgaaggtttctgccaaaaatgtaatgaaacaaaagcattttcataaagggattgaacagcttgttcaagaaggtgcaattcaatattataaaacgttgcacacaaatcaaattatcttaggtgctgtgggtcaattacaatttgaggtgtttgaacaccgcatgaataatgaatataatgtagatgtggttatggaaccagttggacgtaaaattgcgcgttggattgaaaatgaagaagatattaaagataatatgaatacttctagatcaattttagtaaaagatagatacgacaattatgtattcctatttgaaaatgaatttgcaacgcgttggtttgaagaaaaattctctgatattaaactgtatagtttattataa

SEQ ID NO: 1159 - DNA, 486 bp, Staphylococcus epidermidis
aaagcacaaaggtttgcaaaattaaaaagtgccagacgtgtcattgccattgatcatgttgagcatagattagctcataccgagaaatataacggtgctgaggtttataattttttaaaagaagatgacgtaggaaaactattacatgaaacaacacgcggtggtgcagatgttgttatagattgtgtcggaatagatgaacaagtagttcaagatgacttagaagttagctcaaattcaatacagagaggaaatatcagcccaattgttacggcaacagaatcagtgagaaaatatggaacaatccaattgataggtgtctatggaactgcagctgataactcccaattagacttaatatttaatagaaatgttcaagtgaaaagtggacaagcgccagttattcatatgatgccaaaactttatgacatgattaaaataaagtctttgatccaacagaaattatcactcatactatgcctttaa

SEQ ID NO: 1160 - DNA, 354 bp, Staphylococcus epidermidis
tttcatatgagttatgaaaatgcttgtgatgtgatctgtgtacatgaggataaagttaacaatgctttaagttttttagaagatgataaatctaagaaattacttaacattttagaaaaaatttgtgatgagaagaaattgaaaattatattatctttgattaaagaagatgagttgtgtgtttgtgatatttctttgatattgaaaatgagtgttgcttcaacttcacatcatttaagacttttatataaaaatgaggtacttgatttttataaagagggaaagatggcatattattttattaaagacgatgaaataagagaatttttctctaaaaatcaggagggtttttga

SEQ ID NO: 1161 - DNA, 729 bp, Staphylococcus epidermidis
gatgatatgagaatagaacgtgttgatgatacaacagtaaaattgtttataacatatagtgacattgaagcacgtggttttagtcgtgaagacctatggagtaaccgtaaacgtggtgaagaatttttctggtcaatgatggatgaaattaatgaagaagaggattttgtagttgaaggtccactttggattcaagtacacgcttttgaaaagggcgtggaagtaacaatttctaaatcaaaaaatgaagatgctatgaatatgtcagatgatgatacaaatcatcaatttgatgatcaggtaaatgaattattggctcaaacacttgaaggtgaagaaagtttagaagatttatttgaacaacgtaaacaacaaaagaaaaaccatcaagataaacaacaaagacgtgcgcataagccatcaaatgtgagaaatattatagtgaagtttgacgatttagagcaagttatcgactatgcttatcataataatcaaaacactgatgaatttgaagatttattatatatgattgataataaatattattactcaattcattttgatgattcagtttcacaagagatgattaacgatagttatagtcagttattggagtttgcatatccaactgataaaacaaatatttatttaaacgactacgctaagattattatgagtcacaatgttacttctcaagtacgtaaatactttactgatacaaacgaataa

SEQ ID NO: 1162 - DNA, 1407 bp, Staphylococcus epidermidis
atatgttttggaggtgttaacatgtctaacgaaactgaaatgaaagacaacgttcgtgaagacgtatatgataaagaattatttgatcgattattagatcaaaatgatatagatgaattcagaaaagaatttttagaattacataactatgaacaaagtgaatactttgaagatacggatgatgaaaatagacaaaaaatatttgagtttttatcacccaaagaagtagcaaatttctttgatcaattagactttgatgacgatgattatgagagcctttttgataatatggacgctacctatgctagtcatgtcttagaggaaatgtcttacgataatgcagtagatattttaaatgagttatctaaacctaaagtggcgagtttgctaacattaatgaacaaagataaagctaatgaaatcaaagctttattacattatgaagaagatactgccggcggtataatgactacggagtttatctctttaaaatcaactacacctgttaaagaagcgttaattcacgtaaaagaacaagcgcctgatgctgaaacaatatatgtcatattcgcagtaaatgaagatgaacaacttgttggtgttctatcacttagagatcttattgtagctgagaatgatgcatacattgaagatgttatgagtgaacgtgtcatcagtgctaatgtcggtgatgaccaagaagatattgctcaattaatgagagactatgattttatagctgttccagttgtagattatcaaaatcatttactaggtattattactattgatgatatcctggatgttatggatgaagaagcaagtgaagactactcacgattagctggggtatctgacatagattctacaagtgactcagtgtttaaaacggcgagtaaaaggttaccatggctcattgtattaacatttttgggtatgattactgctacaatattaggtagttttgaagatactttatctcaagtggcattacttgcagcatttattccaattataagtggtatgtcaggaaattctggtacacaatcattagccgtttctgtccgtaatatatctactggggaaataaatgaacagagtaaatttaagattgcattgcgagaagcgggaagtggtttattatctggtattgtatgtgcagttatccttttcctaattattgtcgtcatattcagacaaccgttattagctttaatagtaggtggaagtttgacatgcgcaatgacagtaggtacattagttggttcaatgattcctttagtaatgaacaaatgtaaaattgatcctgctgttgcaagtggtccttttattacaacaattaatgacattgtgagtatgcttatttatttcggattagctacatcattcatgtcatacctaacataa

SEQ ID NO: 1163 - DNA, 510 bp, Staphylococcus epidermidis
atgattttaggattagcattggttccgtcaaagtcatttcaagatgaggtgaatgcttatcgcaagcgatatgacaatcattatgctcaaataatgcctcatatcacgattaaacctcaatttgaaatcgatgatcatgattttaatttatttaaaaatgaagtgaaaaatcgaatttctagtattaaaccagtagaagtgcatgctacaaaggcatctaatttcgctccagtcagtaatgttatatacttcaaagttgctaaaacagagtcattagagcaattatttaatcaatttaatacagaagatttttacggtatagctgaacatccttttgtacctcattttacaattgcccaaggtctaacaagtcaagaatttgaagatatatatggtcaagtaaaattagcaggggtagaccatagagaaataattgaagaactatcgttacttcaatatagtgaagaagaggacaaatggactattattgaaacttttacattagggtaa

SEQ ID NO: 1164 - DNA, 1647 bp, Staphylococcus epidermidis
aggatgaaaggttttaaagtcttaattattttattaagtgtatgcataattttatctgcttgtagtaataagcagagtttatattcagaccaggggcaagtttttaggaaggtaatcacacaagatatgactacactagatacagctttaattacagatgctgtttctggtgatatagcagctcaagcttttgaaggattatatactttaaataaagaagacaaagctgaaccagctattgctaaatcttttccaaagaaaagtaatggtggcaaaacacttacgattaatttaagaaaaaatgcaaaatggtccaatggagattcggtaactgcatatgacttcgtatatgcgtggagaaaggtagttaatcctaagacggcttctgagtttgcatacataatgagcgatataaaaaatgcagatgaagttaatgcaggtaaaaaatcagtcaaggatttgggtatcacggctataggtaaatataaattacaagtagatttagaaagacctgtaccttatattaatgaactattagcacttaatacatttaatcctcaaaatgagaaagttgctaaaaagtttggagaacaatatggtacaactgctgaaaaagcagtgtacaatggaccatttgaagtaacaaattggaaagtggaagataaaattcaattagttaaaaatgaacaatattgggataagaagaatgtaaaattagataaagtgaactataaagtattaaaagatcaacaagcaggtgcatcgttatatgatactggctcggtcgatgatactattataacttctgaacaagttgataaatatagaggagaatctgctttgaattatcgtttaacagcagcaacattctttattaaaatgaatcaaaaaacagttcctgaatttaaaaataagcatttaagattggctatatctcaagcaataaataaaaaagggtatgtcaattctgttttaaatgatggttcgctaccatcaaataattttactggagtaggaactgccgatacaccggatggcaaagattttgcaagaaccatcaaatcaccattaaaattcaaccctgatttagcgaaaaagaattggagagaagcacaaaaagaattaggaaaaaataaatttacttttacgatgaacacacaggatacacctgcttcaaaaattgctgccgaatatataaaatctcaaattgaaagtcatttgccaggtgtgacactcaaaattaaacaaatgccatttaaacaaaaaactactttagaattagcaaataactatgaagcaagttattcagggtggagtcctgattatcctgacccaacagcatttcttcaaacaatgacaaaaaataatgcacagaataatacagattggagtaataaagaatacgatcaattactcaaagatgctaacagcaagtttttacgaaagccaggtgaacgtaatacctcattacaaaaagcggaatatatcttattacatgaagcgccagtcgctcctgtttatcaaaaaggagaagcacacttaacgaatccgcaagtaaaaggattacaatatcacaaagtagggcctgaaacgacgcttaaacatgtctatattgataaatcaatcaatagggagacaggtaaatag

SEQ ID NO: 1165 - DNA, 993 bp, Staphylococcus epidermidis
agtagaggaggatttcaagtgcaaaaaaaatatattactgccattattggaacaactgcccttagcgcattggcatcaactcatgcacaagctgcaacaacgcatacagtaaaaagtggagaatctgtatggtcaatttctcacaaatatgggattagtattgctaaattaaaatcacttaatggattgacttccaatttaatattccctaatcaagtattgaaagtatcaggctcatcttcaagagcaacgtcaacaaatagtggcacagtttatacagttaaagctggagattcattatcttctattgctgcaaaatacggtacaacttatcaaaaaatcatgcaacttaatgggttaaataactatcttattttccctggacaaaagttgaaagtttctggtaaagcgacgagttccagtcgtgcaaaagctagtgggtctagtggtcgtactgcaatatatactgttaagtatggagactcactatctgcaattgctagtaaatatgggacaacgtatcaaaaaattatgcaattaaatggattaactaatttctttatctatcctggacagaagttaaaagtgcctggaggtagttctagtagctcatcttctaataatactagatcaaacggtggctattattcaccaacttttaaccatcaaaacttgtatacttggggacaatgcacatggcacgtatttaatagacgtgctgaaataggaaaaggtatcagtacatactggtggaatgcaaataattgggacaatgcatcagctgctgatggatatactattgattatcgtcctacagtaggctcaattgcacaaactgacgctggttactatggtcacgtagcgtttgtagagcgcgtgaatagcgatggaagtattttagtttcagaaatgaactggagtgcagctcctggaaatatgacatatagaacaattccagcttatcaagtgagaaattacaaatttattcattaa

SEQ ID NO: 1166 - DNA, 204 bp, Staphylococcus epidermidis
tttaagggaggactcgtaatgactgttgcagaagtaggtaatatagtagaattttatgacggtttaagaggccgtgtcgagaagattaatgataactctgttattgtagatttaactattatggataattttaatgaattagatttaccggaaaagacagttatcaatcataagcgatacaaaatcgttgatcaagaaggttaa

SEQ ID NO: 1167 - DNA, 1050 bp, Staphylococcus epidermidis
gtgttatggggagtgtttgatatggatttgcttataggtactttatttttaattttagttttagttatttttactctatttacatacaaagcacctagtgggatgagggcgatgggagctttagcgaatgcggcgattgcatcgtttttagttgaagctttcaataaatatgtgggtggtcaagtatttgggattaaattcttagaagaactgggagatgctgctggaggtttaggtggtgtggctgcggctggattaactgcattagcgattggggtatctccagtttatgcactagttattggggcagcttgtggaggtatggacttgttaccaggatttttcgctgggtatattgtaggctacatgatgaagtataccgagaaatatgtgccagacggtattgatttaattggttcaatcattcttctcgcacctatagctaggttaattgctactggattgacgccagtggttaataacacgttaattaaaattggggatattatacaaagtagtacagatgctaacccgttgattatgggaattgtattgggaggtattattacagtagtaggtactgctccattaagttcaatggctctcactgcattgcttggtttaacgggtgcgcctatggctataggtgccatggccgcatttagttccgcgtttatgaatagtgcattgttccatcgtttgaaattgggagaccgtaaatcaaccatttcagtcggaatcgaaccgctttctcaagctgatattgtttccgctaatcctattcctatttatgtcactaatttctttggtggggcaattgccggtattataattgcttggtcaggtatgattaataatgcaactggcactgctacacctattgcaggttttttagtgatgtttggttttaatagtttaacgaaagtgattatctatggtgtggttatggcgattataggaactattgctggtattgtagggtctattgttttcaaaaagtaccccattattactaaaaagcaaatgttagaacgggacacaacgacataa

SEQ ID NO: 1168 - DNA, 867 bp, Staphylococcus epidermidis
atatttagggggaattcatttatgaaaaagattttaagttttttaatcgttgcaattttagttttatcagcatgtggcggtaataatggtaaaaaggtaaccataggtgttgcatccaacgacacgaaggcttgggaaaaagttaaagaattagctaaaaaagatgatattgatttagaaatcaagcacttttcagattacaatgttccaaacaaagcacttagtgacggggatattgatttaaatgccttccaacactttgcttttttagatcaatataaaaaagctcataaagataccaatattgaagcacttagcactacagtattagctccattaggtatttattcagataaagttaagaacattaaagatgttaaaaaaggtgcgcaagttgctattccgaatgatgtatctaaccaagctcgagcacttaagttattagaatctgcaggtttaattaagcttaagaagaactttggattaaacggaacaacaaaagatattgaaagtaatcctaaagatttaaaaattaaagctgttgatgcacaacaaacagcgcgtgcactttctgatgtggatatatcagttatcaataacggtgttgcaacaaaagcaggaaaagacgctaaaaaggatcctatttatttagaaaaagcaagttcagatgcagtaaaaccatatattaatgttgtagctgtcaactctaaagacaaagataataaaacctacaaaaaaattatagaactttatcattcaaaagaagctcaaaaagcattaaaagaagacactaaagacggtgaaaaaccagtagatctttctaaaaaggaaatcgaagaaatcgaaaatgagttggcaaaaaaataa

SEQ ID NO: 1169 - DNA, 420 bp, Staphylococcus epidermidis
aaagatggggggacaaacatgttacatgtccatattttaagttgggtattagcaattattttatttatcgcaacttatttaaattattcacaaacgcaaggtgcatcaccttattataagcctttgcatatggcattaagattattcatgctattaacattaatttctggtttttgggaattaatcgaagagtttatggctgcctctaatggtgaaggtggaaatcatatgctacttactttaaaaatgttatgtggtttagctgttatcgcatttatggaaatttctattgctaaaagaaaaaaacaacagactagccataaattcttttggattactattattttaatcataattacaatggctattggtgttattttaccttggggcccaatttctaaaatatttggaataagttaa

SEQ ID NO: 1170 - DNA, 627 bp, Staphylococcus epidermidis
ggtgtaattatgattcagactattgtaactgctgctattctgtatattgcgacagcagtagatttattagtgattttgttaatattttttgctaaagcaaagactaaaaaggaatatcgagatatttatattggtcaatatgtaggatctgtgacattgattgtcgtaagtttattctttgcctttgtcttaaattatgttcctgaaaaatggatattaggattattagggttaataccgatttatttaggaattaaagtggctatttatgatgattgtgaaggagaaaagagagctaaaaaagaattgaatgaaaaaggattgtctaaattagttggtacggttgcaattgttacgatagcaagttgtggtgctgataatattggtttatttgttccgtattttgtgacattaagtgttactaatttattcattactttgtttgtctttttaattttaattttcttcttggtatttactgcacaaaaattagctaatattccaggagttggagaaattgttgagaaatttagccgttggattatggctgttatttatatagctttaggtttatttattattatagaaaatgacactattcaaacaattttaggatttatattttaa

SEQ ID NO: 1171 - DNA, 3489 bp, Staphylococcus epidermidis
gggaatgttatggaatttaatacatatattggtcgagcaggtacaggaaagtcaacagccatgcttaatcaaataaaaaataaaatgaagcaagacccgctgggtgatcctatagtattaattgcacctactcagagtacttttcaattagagcaagcatttgtaaatgattccgaacttcatggtagtttgagaactgaagtacttcactttgaaagattgagtcatcgtgtatttcaagaagttggtggtttgacagagcaacgattatctaaggacgctttagaaatgatgattttccatattgttcaacaacatgagtctgatttgaaattgtatggttcacaagctcaatactatggtttaagcgaaaagttagctgagcaaattcaagattttaaaaaatataatgtcactcctgaacacttaaatcaattgatagaaaatcattcaatacaaacgagaacaaaacataaattagaagatatttctcttatttataaacaattagaatcacgaatgaatggtgaatttataacaacagaggatagtttgcaacaattcattgaaatactatctcaatctcagtggataaaaaaggctgaagtatttattgatggattccataatttttctacattggaatatagaattatagaagcacttgttcaacacgccaaacaggtgactgtattattaacgaccgatggcagccatcatccatttagtttatttagaaagccatctgaagttttatcacatttggaggatatcgctaatcgtttaaatataaatctaaataaaacatattttaatacattttatcgctataacaatgatgatttaaagaatcttgaaaatgggtttgatgcattacaatttacgcctaaacatcatcaaaatcatgttaaaatatttgaatcttcaagcatgagagaagaaataaatgaagtagctcgacgtattttaaaagatgtcagagaagcagattataaattcagggacattgctatattataccgtgatgaatcgtatgcatatctattcgagtcaatacttccttcatatgatataccatttaacattgatactaaaaagtctatgacacatcatcctatcatggaaatgttacgttctttattggaagttatacgttcaaattggcatattaatgcaatgttacgattatttaaaacgaatgttttaacgtctcaatttaaaagaagtagctatttaattgatttactggagaatttcgttttagaacgtggtatttatggtaaacgttggttagatgaagatatctttagtattgatcagtttagtagaatgggacgtaaatcacatcaactaactgaaggacatcaagcattatacaaagaagtaattaaacttaaaaagaatgttataaataaagtgttatatttcgagcaagctatgaatgaagcgcatactgttaaagattatgctacgtcattttatgaaagtttggagtattttgaactaccgagtcagttaatgactcaacgtgatgaattagagttagcgggtctaacagaaaaagccgaagaaattgaccaagtatggaatggtttaatacaaattttagatgatttagttactgtatttgatgatcaggaaatgacacttcaacaatttttagatgtttttgatataggtttagagcaattagagtttgttatgatacctcaaactttggatcaagttagtatcggtacaatggatttagcgaaagttgataataaaaaacatatttatatggttgggatgaatgatggtatattaccacagactgtatcttcatcaagtttgattacagatgaagagaagaaatatgttgaggacaatgcacatgttgagttaagtccaacttcagatatactgcaaatggatgaagcgtttgtatgttacatcgctatgacaaggagtcaacaaagcgttactttttcatatagtttaatggggaattctggagatgagaaggaaattagtccttttttaacgcaaattaaagaattattttatgatttagaaatcatcaatctacaagatttacataaagcgcaaccattattaatgatgcaacattcacatcaaactaaaattcagctttttgaatatttaagaggttggttagaccatgaagacatcgattatcgttggttggatgcatatttagctattcgagacgatgatcaattaaatcaaggtttagattatcttactacgtcattgacatatgataacgagactgtccaattaaatgaaattttatcacaacaactttatggtaaaactatcaacgctagtgtgtctcgttttgaaggttatcaacaatgtccttttaaacattatgcctcgcatggtttaagattaaatgaacgcactaaatatgaattacaaaattttgacttaggagatatttttcattcagttttaaaatacatttccgatcgaatttatggtgacttcaagaatttagatacaaagaatattcaatcacttactaaagaagcattagagcttattttacctaaagtacagtttaatttgttaaattcgtctgcgtattataaatatttatctaaaaagattggatcaatcgttgaaacaactttaaaggcacttaaatatcaaggggagtactctaaatttgtacctcaacgatttgaaacaggatttagaaaatcacctaaaaacaaaggtgaacttgttgcacaaccactgattaccaatcagggaattccgattaatataagaggtcaaatcgatcgtattgatacatatacaaaaggtgatcatagttatgtcaatatcattgattataaatcttcagaaagtagtgcaacactcgatttaacaaaagtttattatggtttgcaaatgcaaatgatgacctacatggatattgtattacaaaacaaggagcgtttaggtcttacagatattgtgaaaccagggggtctactttatttccatgtccatgaaccgcgtattaaatttaaaagttgggcagatatagatgaagaccaatttcaaaaagactatatcaaaaactttaaaatgagtggtttgcttaatcgtgaccaagaagtgttagacgctttagatattagacttgaaccaaagtataattcggatattgttccaatagcattaacagctaaaggcgctataaatcaacgtagtagtaaagtagctgatgaaaacatcatttatcaattaatagaacataataagaagaattttatcgagacagccagccacattatggatggacatacggaagtggcacccttgaagtacaaacaagtattaccttgtcaattttgtaattataaatcagtttgtcatgtagacggattaatagatagtaagcgttatagaacagtagatgaatcgataaaaccattagatttaattcaacaattaagaaatgaaggtggtgaaagacatgattccaactaa

SEQ ID NO: 1172 - DNA, 783 bp, Staphylococcus epidermidis
ggagtcactatcatgttaaatctagaaaataaaacctacgtcattatgggtattgcgaataaacgtagtatcgcatttggcgtcgctaaagtattagatcgattaggtgctaaactggtatttacatatcgtaaagaacgcagtcgtaaagaattagagaaattattagaacaattaaatcaatctgaacatcatctctatgaaattgatgtgcagaatgatgaggatatcattaatggtttttctcaaatcggaaaagatgtaggccagattgatggtgtttatcactcaatcgcatttgccaatatggaagatttacgaggtcgattttcagaaacatctcgcgaaggtttcttacttgcacaagaaattagttcatattcacttactctcgtagctcatgaagccaaaaaacttatgcctgaaggtggaagtattgttgcgacgacttatattggtggtgaggcagcagttcaaaactataatgttatgggtgtagctaaagcaagtttagaggcgaatgttaaatatttagctttagacttaggtgaagataatattcgtgtcaatgctatttctgcagggccaattcgtactttaagtgctaaaggtgtaggtggatttaatacaattcttaaagaaattgaagcgagagcgccgttaaaacgcaacgttgatcaagaagaagtaggtaagacggctgcgtatttattaagtgatctttcaagtggtgtaactggagagaacatccacgttgatggtggattccacgcaattaaataa

SEQ ID NO: 1173 - DNA, 675 bp, Staphylococcus epidermidis
ggaggttatataaatatgtttggttcaagtttagattcatctcaattattacaagctctatacgaaacattgtatatggtgactgtatcacttgtaatcggtgctttaataggtatacctcttggcatcttgttagtggtaactagaaaaaacggtatatggtcgaatacaatattgcatcaagtattaaatcctatcattaatattttaagatcaattccgttcattattttattaatagccatagtgccttttactaaattgctagttggcacatctatcggcacaacagcagccatagtaccactcacggtttatgtagcaccttatatcgcacgcttagtagaaaactcattactggaagtcgatgacgggattattgaggcagctaaagcaatgggtgcatcacctcttcaaattatacgttattttttattgccagaagcacttggttcattaattctagctataactacagctattattggtctcataggtagtacagcaatggctggtgctgttggtggtggcggtataggtgatttggctttagtgtatggttatcaacgattcgatacaattgtaattgtgattacagtcattgtacttattattattgttcaaattatacaaacgttaggtaactttatcgctagggttatccgtagaaattaa

SEQ ID NO: 1174 - DNA, 447 bp, Staphylococcus epidermidis
ctccaatatatcgatggattgattgacaaacaactgattgatgaagatgcaaaagaggatgtgagaagagatgagattatgcatttcattgatggccctctctatatggaaatagctcaagctgacaatgtttatactgaattaccttttgtggtaaatcaaattaaagttgatggacttacaagtgaagatgaagatgtatccattattcaaggtatgattgatttaatatatgaaagtgacggacaattttactttgttgattacaaaacagatgcttttaatagaagaaaaggtatgagtgatgaagaaatagggaatcagctcaaagaaaaatatcagatacaaatgacgtattatcgaaatactttagaaaccatacttaaacgacctgtaaagggttacttatattttttcaaatttggtacattagaaatagatgattaa

SEQ ID NO: 1175 - DNA, 1854 bp, Staphylococcus epidermidis
ggaggtcatatggaattcttatctttagttatagtcgtcgtagctgcatttatgactccgatcattgtgcatcgttttaatataaactttcttcctgttgttgtagctgaaatattgatggggatagtgataggtcactcttttctcaatttagtggaaagagatgcattccttaatattttatctacgcttgggtttatctttttaatgtttttaagtggtctagaaattgactttaatgcatttaaaaaggattcacgtccaagacaaggagaagataaacatgaaaaggatgtacctgggcatcttaaactggcactgacagtatttgcatttattatgatgatttcggttgttttagcttttgcatttaaatggttaggattagttaatgatgtccttttaatggtgatcatcatttcaacaatttctttaggagttgtagtaccaacccttaaagaaatgaacattatgcgtacaacgataggacaatttattttactagtagctgtattagcagatttatttaccatgattttactaactgtttatggtgctatttatggtgaaggtggtagtacaatatggcttacaggtattttagtcgtatttacagttgtcttttatgtaatcggtgtgttatttaaacgtatgtccttcttacaaaagttaatggatggtacaacgcaaataggtataagagcagtatttgcacttattattttattagtagcacttgctgaaggtgttggtgctgaatacatattaggtgcatttcttgccggtgtcgttgtttctttacttaaacctaatgaagagatggtcgaaaaattagattcctttggttatggtttctttattccaattttctttatcatggtaggtgtcgatttagatatcccaagtttaattaaagaaccatcgttgttacttattatacctgtactcattttttcatttattatttcaaaattgataccagtattttacattagacgctggtttgacactaaaactaccattgcatctgctttcttacttacatcaactttatcacttgttatagctgcggctaaaattgctgaaaaattaaaagcgatttctccggaaacttcaggcattttaattcttagtgctgtgattacatgtgtcttcgtacccgtgatattcaagaagatgttcccaattcctaatgaagtgggacgccgcatagaagtaagtatgattggaaagaatcaattaactattccaatagcacaaaatttaacttctcaattatatgatatttctttatactatcgaaaagatttgagtgatagtagaaagctctctgacgatattactatgatagaaatagcagattacgaagaagatttattagaacgcttgggacttttcgagcgagatattgttgtatgttctacaaatgatgaccatataaataaaagcgttgcgttaatggctaaaaaacatggtgttaaacgtgttatatgtcgactcgaaagcacaaacgaagatccgacattgaaacatcaaggtatagaggtgtttagtaattatttaagtaataaaatcttactaaaaagtttaatagaaacacctaatatgctgaatttattaagtaatgtagaaacatctctatatgaaattcaaatgttaaattatcagtatgaaaatattcaattacgtaatttcccatttggtggcgatattatttttgttcgtattataagagataacgattcaatcgtacctcatggtgatacacagttacgatataaagatcgtttgattgtgacgggaactaaagaatatgtagatgaattaaagcaagaattggaattttattattaa

SEQ ID NO: 1176 - DNA, 702 bp, Staphylococcus epidermidis
gtgaaccatattaaagaaataggtgttgatatgaattttaaatatatgaatatagcaaaagggataattccaattttaataagcatgattattcttttaagctttatctctactcatgtgttagcgcaaaatcagtggttgagaatggttgatcttagcgtacaagagtggtttagtaatcaatttggggatcccaatagagtgtttggacatggtttcatcaacaatataatgacgttttgcgctacctttggtgatgttaagaccattttaattgtggctaccattattgcagtgctactcatgttttacaagaaggttccacaagcaatatggctaatcataacgatgactagtggcgcattgattaattatttaattaagcaaacgattgaaaggtcaaggcccgagaatcatttaattgttgatacaggatggtcttttcctagtgggcattctaatattaatacattattctttttaatgattatgatcattattatcccgttaatccgacagcgtgcttttaaatttataatcacaattttaagtattgtattttggattagcgttttaataagtagactgtattttcatgcacactacttttctgacgttgtaggaggcgtaagtttagctattatttgggtgtcgttatttatattagtgtcacctttattaaatttttggggagaaaagtaa

SEQ ID NO: 1177 - DNA, 279 bp, Staphylococcus epidermidis
aagcagcatatcaaaaatttggtggtggacctcttgaggattaaatcacttcagtttcatggaatgatgataaacgtatatcattatcattctaatgatttaatcatgttagctattccagaacttttttggtccattgagttatccaaagagttagatgcaaatcagctatatgaggaattagtgatgcaattattcaatttgttgactgaagttgaagcagatacattggcaagtaatataactgatttgattagaaatgaatccaaaggagaatga

SEQ ID NO: 1178 - DNA, 999 bp, Staphylococcus epidermidis
gcatctaatatggaaactttattctcaggaattcagccaagtggtattccaacaattggtaactacattggtgcattaaaacaatttgtagatgttcaagatgactatgaatgttttttctgtatcgtagaccaacatgcaataacggtaccacaagaccgcttaaaattacgcaaacaaatacgtcaactcgcagcaatttatttggcaacaggtattgatccagataaatcgactttatttattcaatctgaagtccctgcacacgtgcaagctggttggatgcttacaacaatagcttctattggtgaattggaacgtatgactcagtttaaagacaaagctcagaaacgcgcagatggagtgcctgctggtctactcacttatccaccattgatggcggctgatatcgtgatttacaacactaacattgtccctgttggtgatgatcaaaaacagcatatggaactgacacgtaatttagtagatcgtttcaatagtagatataacgatgtattagtaaaaccagaggtacgaatgcctaaagttggtgggcgtgtgatgagtttacaagatcctactaaaaaaatgagtaaaagtgatgataatcagaagaatttcatttctttattggatgaacctcatgtagctgccaaaaaaattaaaagcgctgtaacagactctgacggtataataaaatttgatcgtgagaataaaccaggcatttcaaatttactttcaatatattctggtctaactaatgaatctattaagaatattgaatctaaatatgaaggtgaaggttacggtaaatttaaaggtgatttatcggaaatcgttaaagattttcttattaatttccaagaaaaatatgcaagcttttataattctgatgacctagatgatattctagataaaggtaaagaaaaagctcaaaaagcttcatttaaaacattgaaaaaaatggaaaaagcaatgggcttaggtcgaaaaagataa

SEQ ID NO: 1179 - DNA, 858 bp, Staphylococcus epidermidis
acgatgattttaacatatcaaattgtacagtcagaaccagtgaaaacttttttgaaaaatcaagattattctaaacgcacgttgagcgccattaaattaaatggcgctttactattaaacggttcacctgtaactgtcagacatgttatgaacaaaggtgatagattagaagttcattttccatgtgaaacaccaagtgagaatttgattccatacgataaggaattagaagtcatttatgaggatgcgtatttgataattgtaaacaagccacaaatgcaaaattgtgcaccttctagagaacatccccatggcagtttagtagaacaagtgcttgcttattatacaaaaaaaggcgaaaaaataaatcctcatattgtgactcgacttgatcgaaatacttcaggtttagttgtatttgctaaatttgggcatgtacatcatttgttttcaaaggtgaaatttaaaaaagaatatgtcgccttagcctatggccatacacaatcttcaggtgttattgaagcgccaattgcaaggcggagtgatagtatcattaaacgagaagttaatgataaggggaagtatgcaaaaacagtctatcaaaggcttatgcaaaatgagactgctagtttatgtaaggttaaattgcttactggaagaacgcatcaaattcgagttcactttgagtatattggacatccattaattggtgatgatttgtacggtggaaatcatccttgcgttcatggacaagcgttacattgctgttcagttgaatttatccaccccatatatagatctcattacctaataaatgttgactacaaacaattaattaaattattcaacatggtataa

SEQ ID NO: 1180 - DNA, 792 bp, Staphylococcus epidermidis
tacaatagtattaacattacaagggagcatcggtttatgtcggagtttaaagtaggtaagattaataaaaaaataatacatagtgatattttaaatagagatgtaacattatcggtttatttacctgaggattatacaaacttatttaaatatcagttgattttttgctttgatggtttagatttttttagatttggtagaatacaacgcatatatgaacagttacgtgaagaacaatcaatacaacgtgcaattatagtaggattccattacgaagatgttgaaaaacgtagggaagaatttcatccttcaggaagtcgttctaatttaaccattaaagcaatgggaaaagaaattcttccttatatcgatgcgacatttccaacttataaagtaggtaatacaaggttacttattggagatagtttagcaggaagtatcgctttaatgactgcaatgacttacccaactatttttagtcgagttgcgttattgagcccaatgtataatgaaaatattaagaaaaaaattgatacatgtatgaataaaggtcaattgacgatatggcatgccattggtttagaagaagcagattttattttaccaactaatggtaaaagagctaactttttaacacctaaccgcgaattaaatcaactgattaaagaagataatattgaatatttctataaagaatttaacggtggacatcattggaaatcatggaaaccattgctaggagatattctcttacaatttttaggtgatccaataaatggaaaatatgtttaa

SEQ ID NO: 1181 - DNA, 207 bp, Staphylococcus epidermidis
attacgctcatttcatgtgtaatcatcataatcgtcacaccaaatgttcgattcacattacttaataaatttaaaattgagcttgtagtagctggatccagagcacttgtcgcttcatcacataataatattttaggatgcgttactaatgctcttgcgatggcaacacgttgtttttgtccacctgataattcatctggaaattga

SEQ ID NO: 1182 - DNA, 1473 bp, Staphylococcus epidermidis
gggattatcatgggcgaatttaaaggatttatgaaatatgataaacagtcgctatcagaattgtctttggtagaccgtctttcgaatcatgaagcgtttcaacaacgcttcactaaagaagatgcttcgattcagggtgcgcgctgtatggattgtggaacacctttttgtcaaactgggcaatcttatggaagagaaacaataggatgccctattggtaattatatacctgagtggaacgacttagtctatcatcaagattttaaagctgcttacgaaagattgagagagacgaataattttcctgaatttacaggaagagtttgtcctgcaccatgtgagcaatcatgtgttatgaaaattaatagagaatccgtggcgattaaaggtattgaacgtacaattattgatgaagcatatgagaatgagtgggttcatcccgcatatcctgaagatcataaagaccaacgagttgctatcgtaggtagtggtccagcgggacttacagcagctgaagaattaaactttaaaggctataaagttactgtttatgaaaaggcgcatgaaccaggcggcttgctaatgtatggtataccaaatatgaaactagataaagacgtaatacgtcgacgtgtatcacttatgaaagatgctggggttttatttaaaacaggtgttgaaattggcgtcgatgtgagccgtgaaacacttgaagaaaattatgatgctattattttatgcacaggtgctcaaaatgcgagagatttaccattggaaggacgaatgggctctggtattcattttgcaatggactatcttactgaacaaacacagtatctaaatggtgagattgaaagtttgagcattactgctaaagataagaatgtaattattataggtgctggtgatactggtgcagactgtgtagcgacagcattacgtgaaaactgtaaatctattgttcaatttaataaatatacgaaacagcctgaagagattacttttgaaagtaatacttcctggccattagcaatgcctgttttcaaaatggattatgcgcataaggaatatgaagctaaatttggtcaagaaccaagagcctatggtgtacaaacaatgcgctatgatgttgacgagttaggaaatgttaaaggcttatatacacaaatattaaaagaaacgcctgatggcatggtgatggaagatggaccagaacgattttggccggctgatttagtcttattatctatagggtttgttggtactgaaaccactgttccgcatgcgtttgatatacacaccgagcgtaataaaattgtagctaatgatacaaattatcaaactaatcacgctaaaatatttgctgcaggagatgcaagacgaggtcagagtttggttgtttgggcaataaaagaaggtcgtgaagtagcacattctgttgatcaatacttaagtaaagaagttctagtgtaa

SEQ ID NO: 1183 - DNA, 252 bp, Staphylococcus epidermidis
catattgtcattcagttttcaatgttcattttcttaccgacaagaattaattatactcttcatggttgtttaagtcaacaactttttgaaattaattttagtcgtttgtttaatgattcgttaagttgtttcgctcaacaaataaacactatacagacttattctcgttttaacaacagtaaaaattacactatcaaaaacaattcaaattactccggaggaaaaaccgaactttttttgtatgaaatttaa

SEQ ID NO: 1184 - DNA, 585 bp, Staphylococcus epidermidis
ggttttttaatgacacatttacccgaaacgatttatgttatacgaaaaggtgatatggtaatacgacctaaatatgatgaatatcagcaaacaaatggtactgaaattatcagatttgatcaaactcgcaaagaaagtccatttaaagtacagagaattatcgaaagatcatgtaaattttatggtaataattatattagtaaaaaagcagaaacgaatcgtattactggaatctctagtaaaccacctattttacttacgcctctttttcctacttacttttttccaactcactcagaccgtcaagaagaaaatatatggattaatatgcattatattgaaaatgttaaagaacttaaaaatcgtaagagtaaaataatttttgcgaatggtgattcgttaacgctcaatgtatcatttcatagcttgtggcatcaatatacgaatgcaatcatctattattacatggtagataagcaatcacgaatgaaatctaacaaccctgaacaacccattgactataatcagtcttctctaaatattttcgaggcgctctcacgctactccctttttgaagaaaattag

SEQ ID NO: 1185 - DNA, 486 bp, Staphylococcus epidermidis
aatgttctaattgatggaaagtttataaatttataccaaagtaacattgaaaaggttaatgataatcgtcatagcaatgaaactagcattcataatgatgattataaaaaaattttaaataaagttttaaaatcagatattataattttctcaacgcctctctattggtattccatgagtgcgtctttaaaactctttattgatagatggactgaatcattgcgagatacgcaaatagataacttcaaagaaattatgtcacaaaaaaagtacttaattttaatcataggcggtgacagtccacgtattaaagcacaacctttagtccaccaatttaaattaatatttgaatttatgaatattactcattttagatttttaataggcgaaggtaataaaccattcgatgttttaaatgactcacaatttatggaagaactcgcaaatacaaatcttgctttgaaaaaaggtgatatttatgattga

SEQ ID NO: 1186 - DNA, 2304 bp, Staphylococcus epidermidis
tatgcaataatcaatgttataaagtttataaagggaggacaattaatggattttattaatattacaggtgcttcacaaaataacttgaaaaacatagatgtaaatatcccaaaacacttagtaacggtatttacaggtcgttctggttcagggaaatcatctttagtgtttaatactgttgctgcggagtctgaacagctactaaatgaaagttattctagttatattcaatttcatttaaatcaacaacccagaccgaaagtaaagaaaattaaaaatcttcctgtagcaatgacgattaatcagaaaagattcaatgggaattctcgctccacggtaggaacagtttcagatatatatgcttctgttagattactgtggtctagaataggcgaaccgtttgttggttattcagatgcatattccttcaatagtcctaagggcatgtgtaaaacttgtgagggattaggatatattgaagacattaacttagatgaattgctagattgggataagtctttaaatgaaggtgcaatagactttccttcttttggaccagacaaagagcgtggtaaagcctatcgagatagtggtttatttgataataataaaaaattgaaagattatacaaaagatgaattagaattgtttttatatcaagagccaatgacattaaaaaatcctcctaaagaatggagaaagtcagctaaatatgtaggactaatacctagattcagtagaatatttttaggtgataaagaatttaataagaaacgctacgccaaacatcttaaaaatgtagtaaataataaaatctgttcaacatgtaaaggtcaacgtctaaactcgaaaatattaagttctaaaattatgagtaaaaatatttctgatttcacacaaatgacaattaaggaaaatttagagtttcttaataaattagaggatccaacagccaaatatattattgatcctctcaaaaagcagttagaagcactagaatatattggattaagttatttaacgcttaaccgtgtaacaacgacattatcaggcggtgaagcgcaacggcttaaattaatacgtcatttaaatagttctttatcggatttagtttacattatagatgaaccaagtgttggcttgcatccggaagatatagctaaaatcaatgaaattttaaaatcattaaaagaaaaaggtaatactgtgttaattgttgaacatgatcccgatgtcattaaagaaggagactatatcatagatatggggccaggttcaggaaaaaacggcggtgaaatcacatttgaaggaacatataatgaattactatcttcaaatacttcgacaggtaacgcattacgtaacaaacataatttaaaagagaatattcgtgaagctaaccacttttataatatcggtcctgtgacacaaaacaatttaaataacgtaaaaacgtctatacctaaacacgtattaacagtcttaacaggtgttgctggttcaggtaagagtacccttgttaaagcaggttttgaaaataatgaccataccatctttattgatcaaaaagcagttcaaggatctaatagatctaatctattaacgtatttaggtgtttttgatagtgtaagaagctatttcagtaaagaaacaggcttaaataaagctatgtttagttataattcaaaaggtgcctgtccaaattgtggtggaaagggctatattaaaacggaacttgcttttatgggtgatttttcacagacatgtgaagtttgtcatggcaaacgttataaacaagaagtattagatgctaccatagacgggtattcaattgccgatgttctcaatttgacggttgacgaaggtatcattttctttgataaaaagaatgatattaagtcaaaattacaatctgtaagtaagacaggtttgaattatatgtcactaggacaacctttgtccactttgtctggtggagagattcaacgcgtgaaactaggacaacatttagatgaagagataaagaatagtatttttatttttgacgaaccaactacaggcctacatgaatcggatatccctatattgatggagtgttttgatgatttaattgatcaaaacaatactgttattttgattgaacataatttatcgattatgtgtgaagcagattggatcatcgatgtcggcccaggcccagggttggatggcggaaaggtccaatttagtggaacacctaaaaacttcattgatagttcagaaacattgacatctaaacacttgaaacgctatatcaaacagtaa

SEQ ID NO: 1187 - DNA, 249 bp, Staphylococcus epidermidis
ttctttccaatcatacttacttctatgcggcgtcccacttcattaggaattgggaacatcttcttgaatatcacgggtacgaagacacatgtaatcacagcactaagaattaaaatgcctgaagtttccggagaaatcgcttttaatttttcagcaattttagccgcagctataacaagtgataaagttgatgtaagtaagaaagcagatgcaatggtagttttagtgtcaaaccagcgtctaatgtaa

SEQ ID NO: 1188 - DNA, 321 bp, Staphylococcus epidermidis
ttacttgcaatagaacctccaattagtagaaaaagtagtgatataagaaaagaaaaagttcaagtcttaagatccttgaaatgttttaatccaaatgaaattaaagaaagtttcgtacgtggtcaatatgatgggggaatgatgaataatgagttcgttcctgcatatagaaatgaacctaatgtaaattcacaatctaatactgaaacttttgtagcaggtaaaatagaaattgaaaactctaaatgggctagtgttacattttatattcgtacagaaaaaagaatgaaaaaaatctatccaaatcgttatagagtttaa

SEQ ID NO: 1189 - DNA, 522 bp, Staphylococcus epidermidis
ccaaaaaaaattagtaaagcattacctgtaattataacagctggactgtgtgatacttttttaattgtaatagctattttaggagtatctttaatactaatatctatgccaactttacaactttttatttacatcatcgggtttttgtttttgatgtatatggcatggtctttatggacggaaaagccttcaaatatcgaagaaatagaacctatgtcagctaaaaagcagattttatttgctttatctgtttctttattaaatcctcatgcaataatggatactgttggtgttatcggaacgagtgcttcagtttatgatggttatgacaaagttgttttttcattggctacaatttctgtatcttggatttggtttgtctttttagctattttaggaagaattacaggaaaaattgataaaagtggtaagtatatcgttattttaaataaagtttctagcgttattgttattattgtaggattaattatattaaaaaatattgttggaattttaagttag

SEQ ID NO: 1190 - DNA, 447 bp, Staphylococcus epidermidis
cagttgtcgataaggcaaattacttttaaatgtaaaaattcatgttatattagatatatattaatggaacacggtgatattatgtctaaaacaccatatgagttgattggtcaaaaagccttgtatcaaatgattgatcatttctatcaacttgtcgagaaagattctcgtatcaatcatttattcccaggcgatttcaaggaaaccagtcgaaagcagaaacaatttttgacacagtttcttggaggtcctgacttatatacacaagaacatggtcatcccatgttaaaacgaagacatatggaatttacaattagcgagtatgaacgtgatgcatggcttgagaacatgcatactgctattcaacacgcccaacttcctgcgggtgtaggcgattacttgtttgagcgattaagacttactgcaaatcacatggtaaattcctaa

SEQ ID NO: 1191 - DNA, 1839 bp, Staphylococcus epidermidis
gctattcagattattaaggaggtttacattatgagtcaacaattaacaagagaagaacaggaacgtaaatatcctgaatatacatgggatttaacaactatttttaaaagtgatgaagcatttgaagaagcttttaaaagtattgaagctaaaataggtgaagaagaaaaatttaaaggtcatcttggagaaagtgctgaaacattatatgaagcgctaagtcttgaagacgagttaggtacaaaattagaaaaggtatatgtatacgcacatttaaaacaagatcaagatactgcaaatgataaatataccggtttagaagcgcgtgcacatcaacttgttattaaatatagctctgcatggagttttttagtacctgaaattttacaactagatgaagctactattcaatcttttatcgattctaataatgatttaaaacgatatgaatttgatttgaaattgattaatgagaaacgtccacatatattagatgcgaatacagaaaagttattaacagaagcacaagacgcactttcaacgccttctaatgtatatggaatgttcagcaatgcagatttagaatttgaagatgctatagataaagatggtcaagcttatcctttaacacaaggtacatttatcaagtatttagagtctgatgatcgtgagttaagagcttctgcttttagaaatgtttataaagcatacggtgcgcataataacacgctaggtgctactttagctggtgaggttaagaaaaatgtatttaatgctagaactcatcattatcgttcagcacgtgaaagagctttaagtaataatcatattccagaagctgtttacgataacttaatcaaaacggtccataaatacttacctttattacacagatacacgaagcttagacaagagttactaggtttagacgatttaaaaatgtatgatctttatacacctcttgttaaagatgtcaaatttgaaatgccatatgaagaggcaaaatcctggatgttaaaagcacttgaaccaatgggagaagaatacttaaacgtggttaagaaaggtctagataaccgttgggtcgatgtatatgaaaataaaggtaaacgttcaggtggatattcatccggtggacatttaactaatcctttcattttacttaactggtcagacactgtttctgatttatatactttagtacatgaatttggtcactctgcacatagttactttagtagacagaatcaaccatcaaatttaagcgattatacaatctttgtcgctgaggtagcatcaacttgtaatgaggctttacttagtgactacatggacaaacatttagatgatgaacgacgtctattgttacttaaccaagaattagaacgatttagagcaacactattccgtcaaacaatgtttgctgaatttgaacataaaatacatcaaatagaagaagctggggagccgttaacgccaaatcgtatgaatgaagaatatgctaaactgaacaaactatattttggtgaagcagtagaaactgacgatgatattagtaaagaatggtcacgtattcctcatttctatatgaattattatgtatatcaatacgcaactggttatagtgcagcacaaagtttaagtcatcaaattttaactgagggtcaacctgctgttgaacgatatatcaatgaattcttaaaaaagggtagctcaaactatccgattgaaatattaaaaaatgcaggtgttgacatgacaacacctcaaccaatagaggaagcttgtgaagtattcgaacaaaaattagatgcttttgaaaagttaatgaaagcttag

SEQ ID NO: 1192 - DNA, 1122 bp, Staphylococcus epidermidis
ggttttaagatgcaatccaagaatttttttaaaacaccttttacttggatgatgataatctttagttgcctgtttttaggtacgttaatattcacgttttttaacgatagattttataatatgcctataggacaaatcactcaaattactgatatccaatcacaaaaggtaacagacgagcacaaaaataaagatattaagtacaaagagaagataacattcaagattctaaatggtgaattcaaggggcaaacaacgacgattccccaccaatatgtgaaatctcaagctgattcagaatcattttccaaaaatgacaaggttcttttacatatttctaaaaatcctaaagacgcaactattatagagaaaaaacgagatactattgttgtcataataaccggcttatttttacttactgttttagttgtaggaaaaaaagtaggacttcaatctatattatctcttatcgttaataccattgccgttatgggagctattttaatacatgatcaatatggggctataagtttattctttttgatgacttgtgctattatcatttccacttctttcactttactacttgtaacaggttggcatagccgaaccttaattactattgtaagtacgctgattggtacgttcttatgtgttggaattaccgaagtcatcatcaaatttaccgggggaaatggaataaaatacgaaacaatcactttccttactctccctcctaaggatgtctttctagcttccgtactaataggtacacttggagcagtgatggatgtttctattactattgcaagtgggatgtacgaaattttaaaacgtagccctcaaatttccatgaaacgttgggctcttgccggaagacatatcggtcaggatataatgggaacaatgactaatatacttctcttttcatatctatctggtagcttacctatgtttctaatttatttaaaaaatgctaacactattacttatactatttcgatgaattggtcattagaagttgctcgagcattaactggtgggataggtatcgttttaactattcctataacaattgctttaatggaactatggtttaaactgcgaggtgttaatcaatga

SEQ ID NO: 1193 - DNA, 267 bp, Staphylococcus epidermidis
tattttaggattcaatatttaagcgggcaagcgtctctgaattcagaggcacttgcctattttatttttcacgtgaaacagcacagtatattcattcatattacattttcatttaaagtactgaatcaaacaattacattcgtcgatcataagtccattggtacggactatctagtaatcgccaatcttcatcaatctcactactatgaattaagcatgcatctaattcccgggaaattttttcttgatctaaatccgtaccaataa

SEQ ID NO: 1194 - DNA, 189 bp, Staphylococcus epidermidis
ataaattttgttatatatcctttattatgtggtttattttgtgctttactagaagtaatcgatttatggtatgcaaagaaaataactaaaactcattcaaaagattggagatttaatccacatttaatttggatgatgtttatattcagtgcagttatggggattatctatgttttattatttaaatga

SEQ ID NO: 1195 - DNA, 999 bp, Staphylococcus epidermidis
ggagagaatgttatgaaatttattagcaacaataatattaatgatccttccctcaatttagcaatggaagagtatgttcttaagaatttaccttctgaagaaagttattttttattttatattaacagaccttcaattattgttggaaagaatcagaatacaattgaagaagttaatcaagcgtatattgataaacatcaaatagatgtagtgagacgtatttctggtggtggggctgtttatcatgatactggaaacttaaattttagctttatcacagatgatgatggccatagctttcataattttaaaaagtttacgatgcccattgtacaggccttacaatcaatgggagttaatgctgaaatgactggaaggaatgatatacaagtagggcaagctaaaatatctggaaatgctatggttaaagtaaaaaatagaatgtttagtcatggtacattaatgctgaattgtgatttaaatgaagttcaaaaggcattaaaagtgaatccagctaaaattaaatctaaaggcgttaaatctgttagaaaaagagttgccaatattgaggaatttctagaacagccaatagatatagaagaattcaaaaaaattattcttaaaactatttttggtgaaaatgaagttgaagaatatatattaacagaagaagattggaaaaatattaagcaattaagtgatgaaaagtatcgtacgtgggaatggaactatggcagcaatccaaaatataatattgagcgtgaagagaaatttgaaaaaggttttattcaaataaaattagatgtaaaaaaaggaagaattgaacgggcaaaactatttggagatttcttcggcgaaggagatgtaaccgaacttgaacatgcgttagtaggttgcttacatgattttgaacatatagaagaggcacttcaaaattatgatttctatcactactttggggatatagataagtatgaaattataagattgatgtcctaa

SEQ ID NO: 1196 - DNA, 924 bp, Staphylococcus epidermidis
aataagacagtatttattttattgaatggagggaaatcaactatggatataaaacaacttagatactttgtagaggttgcacgtcgagagcatatttcagatgcggcattagaactaaacattgcacagtctgcgattagtcgtcaaatcactcaacttgaaaaagaattgggggtgacattatttaaaagaagtgggagaaatatcatattaactgttgaaggtagacagttactctcacaggcaactcaaatactagaattaatggataaaaccattcactcatttcaacaacacgtatcacataaccaacagacaatttatattggatatgaagaaagtgatgcctctcaaatgattcttcccctaattcaaacatttgaacaacaaagtaacagtaccatgattccgcaacttacaaaacatgataaattattagatcaaatcctttccaatcaattggatcttgcaatcactgaatttactcctgtgttagaacgggaaacacatttacgcgtcatgcctttatttgaagaaaattattatatgtatgtgcccaaatcacatccactagctatgactgtacatcccccgctatctcaatttacaaatcaatcactatactgtctcgaaccaatgacaagctcaataaaaagtaaattgattgaaaagactaaggcacaagtacgaatgatttcagatatgaaactcgctcaacatattttgagtcataataagggatttattatttctagtcaaaattctttactatatgatcacgtaaattggactaaaatccctttaaatcatacagaattaaaacgaatgctatgtgtagttatgcgaaaagataacaagaaaaacgacattaatatagcatggaatttaatttgcacattattaaataaatcgactatatattaa

SEQ ID NO: 1197 - DNA, 219 bp, Staphylococcus epidermidis
atttttggagttgcaacaaaccacttgaaagagtctggattaacgaacgtaaaagggttaatgcgaataattatagaaaaaccatttggtgatgatttaaaatctgcaaaaaaattaaataatcaaataagtaagtcttttaaagaagaagaaatatttggaattggtcactatttaagtaaagaaatgattcaaaatattgaacgtctacgattttga

SEQ ID NO: 1198 - DNA, 234 bp, Staphylococcus epidermidis
aaggtcgtggtctttatgaatcacaatactgaggtcaagtacactacattagaagattttgtaatgacagtgaacgatttaggcgttgaactcgtcattgaagaagcactcagaaatgcaagaaaagctaaacttaaactcttaattgacgaagcgctcatcaataaaaacgagaacgattttattcaatatactaacgaatttaaacaattggaggcatttttaagtgaataa

SEQ ID NO: 1199 - DNA, 243 bp, Staphylococcus epidermidis
tataacacggtaaaatatccttttcaacccttgtttattcataaaaccaaattgtcacaatctgttcatattgtaagcgaattcaattctactaagctttcattaacttttcaaaagcatctaatttttgttcgaatacttcacaagcttcctctattggttgaggtgttgtcatgtcaacacctgcattttttaatatttcaatcggatagtttgagctacccttttttaagaattcattga

SEQ ID NO: 1200 - DNA, 3231 bp, Staphylococcus epidermidis
gaaatgaaggtggtgaaagacatgattccaactaaacctcatgatgtgatttggacagatgcacaatggcaaagtatttatgcgaaaggacaggacatacttgttgctgctgcagcaggttccggaaaaacagccgttctagttgagcgtattatacaacgtatactaagagatgaggtagatgtagatcggttactagttgtaacatttacgaatttaagcgcacgtgagatgaagcatcgagttgataaacgtatacaagaagcatcttttaaggatcctaacaatgaacatttaaagaatcagcgaatcaaaattcatcaagcacagatttctactttacacagtttctgtttgaaattgattcagcagcattatgacgtattagatatcgatcctcattttagaacaagtagtgaagcggaaaatatattattattagaacaaactattgatgatgttttagaacaacactatgataaattagatcctcactttatagaattaaccgaacaactatcatcagataggaatgatgatcaatttagaagtattattaagcagttatattttttcagtattgctaatcctcaaccatttgaatggctcaatcaattagcgcaaccatacaaagaagaaaataaacagcgagaattaatgcagcttatcaatgatttagcaatgatttttatgaaagcaggatatgaggaattacaaaaaagttatgacttattctcaatgatggaaagtgttgataagcagcttgaagttattgaaaccgaacgcatgtttattactaaagccattgaaggtaaagtattaaatacagatgttatcacacaacatgaatttatgagtcgttttccggcaataaatagcaagataaaagaagcaaatgaaggcatggaagatgctttaaatgaagcaaaacaacattatgataaatataaatctttagttatgaaagtaaaaaatgattatttttctagaaatgcagaagatttgcaaagagatatgcaacaactcgcacatcgagtggcttatttagctcaaatagttcaagacgtgattcaatcatttggtgttcaaaaacgaagtcgtaatattttggatttctcagattatgaacattttgcattacgcattcttactaacgaagatggctcgccttcgcgtatcgctgaaacgtatcgtgaacattttaaagaaatcctagttgatgagtatcaagatactaatagagtgcaagaaaaaatattatcttgtattaaaactggtgaagaacacgatggtaatttgttcatggttggggatgtgaagcagtctatttataaatttagacaagctgatcccagtttatttattgaaaaatataatcgcttttctagtagtggaactgaaagtggcttacgcattgacttatcgcaaaactttcgttcgagacaggaagtgttatctacaaccaattatttgttcaaacatatgatggatgaacaagtaggagaaatttcatatgatgatgcagcgcaattgtattttggtgcaccatatgacgaagtttcacatcctgttcaattacgggcacttattgaggcaagttcagaaaatagtgacttaactggaagtgaacaagaagcgaattacattgttgagcaagttaaagatattattaatcatcaaaacgtatacgatatgaaaacaggtcaatacagaaaagcaacatataaagatatcgtaattttagagcgaagttttggtcaagctcgtaatcttcaacaagcttttaaaaataatgatatcccttttcacgtaaatagtaaggaaggatattttgagcaaactgaagtacgtcttgttctttcatttttaagaacaatagataatccacttcaagacatttatttagtgggtttgatgcgttctgtaatatatcaatttactgaagaagaattagctaaaataagagttgtaagccctcatgatgattacttttatcaatctataaaaaattatatgattgatgaaaaagctgattctagattggttgacaagttaaatcgttttattcaggatatacaaaaatatcaaaattatagtcaaagtcaaccggtttaccaattaattgataaattttataatgatcattttgtaattcagtactttagcggtcttattggaggtaaaggtagaagagcgaatctgtatgggctatttaataaagctgttgaatttgaaaattcaagtttcagaggtttattccaatttattcgttttattgatgagcttattgatcgtaaaaaagattttggtgaagaaaatgtcgtaggtcctaacgataatgtggttagaatgatgacgattcacagtagtaaaggattagaatttccatttgtaatttactcaggattatctaaaaaattcaacaaaggtgacctgaatgcaccagttattctaaatcaacaatatggtttaggtatggattattttgatgtaaataaagatatggcttttccttcgcttgcctctgtggcatatagagcaataaatgaaaaagaacttatatcagaagagatgcgtttaatctatgttgcgttgacacgagcaaaagagcaacttattttagttggaagagtcaaagatgaaaaatcgttaattaaatatgaaaaattagctgtttcagacacacatatagcagttaatgaacgccttactgccacaaatccatttgttctaatttatggtattttggctaagcatcaatcgccttcattgccaaatgatcaaagatttgaaagagatattgatcaattaaattctgaagtgaagccacgcgtatcaatagtgattgatcattacgaggatgtttcaactgaagaagtggtcaatgataatgaaataagaacaatcgaagaattaaaggccataaatactggtaatgaagatgtgaaaattaaaattcatcaacagctttcttatgactatccttttaaagttaacacgatgaaaccatctaaacagtcggtatcagagttaaaacgccaattagaaactgaagaaagtaatacaaattatgatagagtacgtcaatatcgtattggtgttgcatcatatgaaagacccaagtttcttacccaaacaaaaaaaagaaaagcaaatgaaatagggactttaatgcatacagtcatgcaacacttaccttttagagaacaacgtttaacaaaagacgaatga

SEQ ID NO: 1201 - DNA, 942 bp, Staphylococcus epidermidis
tttaggagggtgtatatgactaaatatgtgttgaaacgattgtgttatatgtttgtgtcgttatttattgttataacaattacatttttcttaatgaaattaatgccaggatctccgtttaatgacacaaaacttaatgcgcaacaaaaagaaatattaaatgaaaagtacggtttgaatgatccagtagcattacaatatgttaattatttgaaaaatgtagtaacaggtgattttggcaactcatttcaatatcataatatgccagtgtgggatttagttaaaccacgattgataccttcaatggagatgggaataacagctatggttattggtgttgttttaggtttagtattaggtgttgctgctgctactaaacaaaatacatgggtagactatacaacaacaattatctctgttatcgcagtatcagtgccgtcatttgtcttagcagttttattgcagtatgtatttgcagttaagttagaatggtttccagttgcaggatgggaaggtttttctacagctattttaccttctctagcactatcagctacagttttagcaactgttgcaagatatattagagctgaaatgattgaagtactcagttcagattacatacttttagctcgagctaaaggaaattctactttaaaagtgctctttggacatgcattacgaaatgcattaattcctattattacaatcattgtacctatgttagcaggtatattaacaggaacattaacaattgaaaatatctttggtgttccaggattaggtgatcaatttgttcgttctataactacaaatgatttttcagtcatcatggctacaacgatattattcagtactttatttattgtttcgatctttattgtagacattttatatggtgttatcgatccaagaattcgtgtacaagggggcaagaaataa

SEQ ID NO: 1202 - DNA, 1857 bp, Staphylococcus epidermidis
cgaaatttattattaatagggaagaatgtaacaatgagaaaaaaattaaataatgaatatcgctctgctaaaaaaatacgatatatgcctggattagatggtttgcgagcaattgcagtcattggtattattatttatcacttgaataaacaatggttaacaggtggttttttaggcgtagatactttttttgttatttcaggttatttgattacgagcttattacttaaagagtatgaagatactggaacaataaatcttaaaaatttttggattcgtcgtattaaaaggttattaccagcggtatttgcattaatagtagtagttggaattgcaactttattattgcaccccgagcatattgtaagagttaaacatgatatgatagcagcaatattttacgtatctaattggtggtatattgctaaagatgtcaattatttcgagcaattttcttttatgcctttaaagcacctatggtcactagccattgaagagcagttttacctttttttcccagcagtactcttattatttatggcaatagttaagaaaaagaaaaatgtcatactgatgttttggatcatatccctggtttcattattaatgatggttgttatttctcaacctcacttgaaccattctagagtatattttggaactgatacaagattgcagacactgcttttaggtgtacttctagcatttatctggccaccttttaaattaaatcccaatccacctaaaggattaaaaactgtgattaatagtgcgggtatcataggacttacatttgtaattctattattctttaatgttagtgatgaaagtgattggatttataacggtggattttatcttatttcaacaatgactttgctaattattgcaagtgttgttcatccaacgacaattttagctaagttattaggaaatcctttatttgtctacattggaaagcgttcatacagtttatacttatggcattttcctgtaattagctttattcatagttattttattgatggtcaattaccaacttatgtttatattatggatatcgtaattactgtattattagccgaattatcatttagatatgttgaaacgccattaagaaaggaaggtctaaaggcttttacatttaaaaaaacttacaaacctcagtttattagaacaattgtaacgttaattatgttgttaccttttatttttatactagttggagctttcgataaattcggaaaagatacaatttcaaataaagcacaaacatttaatacaaacgaggctgatcaatatcttattcatatgataccgattgataatatttcgttaactagcgatggtaaaaccaaagagaataagaaagacaatgatgtatatacacaaattaagccattattaattggtgattcagttatggtagatataggggaacaatttaaaacgaaagtacccaaagctaaaatcgatggcaaagtcggtcgtcaactctatcaggccgagagcctcgttaaaaatcaatatagacattataataaaccatcagaccaaatcatacttgagttaggtacaaatggtgattttacaaaagaacaattagataatttaattgacaaatttggcaaagcacaagtgtatcttgtgaatacaagagtgccaagatcatatgaaagtcatgttaatgagttgatggcaaaagcagctaaaaataaaaagaatgtaaccctaattgattggtatagtcgctcaaaagggcatacagagtattttgctccagacggaatccatcttgaaaatgatggcgtagaggcattgacagatgagatattaaaaaatataaagaagaaataa

SEQ ID NO: 1203 - DNA, 189 bp, Staphylococcus epidermidis
ccaataatatttaccactacacgctccccatcttttaatgtaggatccattgaatcacctttaatagaatatgattttccgacaaatttagtgattatggcaataagtgcaatggcaacggctatggcaacaatccactctaaaatttcttttttcaaagtctacacctcttctggttatttaaattga

SEQ ID NO: 1204 - DNA, 384 bp, Staphylococcus epidermidis
gaggtttcattaatgtccataaattcttatttgatttcgtcattatttacgccagttttatcaataattatatggttattttattcaaatcactttataaatttaatcaatatcttattttatacatcattcattatttttatagttgctttccttattttactcattcaagaaggaatatttgatgctacaagttttggatttcgtcgtttaaagtatcaactttcctcaactaagagaaaacgtatgatgaaaaatgaccactttttcaatccacaaaaagttaaaaaagaaagttatattatttccccatgggtagttccaacattgattattaacctcacttatataattgtgagtatcggagtatctttattaatataa

SEQ ID NO: 1205 - DNA, 1026 bp, Staphylococcus epidermidis
gtgattgaattcaaaaatgttaacaaagtttttcgcaaaaaaagagaaactattcaagctttgaaaaatgtatcatttaagattgaccaacatgatatttttggtgttattggttatagtggtgctggtaaaagtacattagttcggttagtcaatcaacttgagacagtatcagatggtcaagttattgttgatggtcatgagattgatacatataaagaaaaagatttacgtgatattaaaaaagatatcggtatgatctttcaacatttcaatttgcttaattctaaatcagtctataaaaatgttgcaatgccacttattttaagtaagacaaataagaaagaaattaaggaaaaagttgacgaaatgttagaatttgtggggcttgctgataaaaaagatcaatttccagatgaattatcaggtggacaaaaacaacgtgttgccatcgcaagagcattagtaacgcatcctaaaatattattatgtgatgaagcgacaagtgctctggatccagctactacaagctcaattttaaatttattaagtaatgtgaatcgaacatttggtgtgacgattatgatgattacacatgaaatgagcgtaattcaaaaaatttgtcatcgtgtagctgtcatggaaaatggcgaagtgatagaaatggggacagttaaagatgtctttagtcatccacaaacgaacactgcaaaaaatttcgtttcgacggtgattaacactgagccttcaaaagagttacgggcctcttttaactcgagaaaagattcaaatttcacagattataaactgtttttagactctgaacaaattcaattgccaatattgaacgagcttatcaacgagcatcatcttaacgttaacgtattattttcttctatgtcagaaattcaagatgaaacggtttgttatttgtggttgagatttgagcatgatgagtcatttaatgattttaaacttactgattacctttcaaaacgacatattcggtatgaggaggttatataa

SEQ ID NO: 1206 - DNA, 435 bp, Staphylococcus epidermidis
aataatgaattaaattcattctataggagagtgagatgtatggtaacattatttacttcaccaagttgcacatcttgccgtaaagcgaaagcatggttacaagaacatgatattccgtatacggagcgtaacattttttctgaacatttaacaattgatgaaattaaacaaattttaaaaatgactgaagatggaactgacgaaattatttcaacacgttctaagacatatcaaaaattgaatgtagatatagattcattaccattacaagatttatactcaatcattcaagataatcctggcttgttacgtcgtccaattattttagatgataaacgtttacaagttggatacaacgaagatgaaattcgtcgtttcctaccacgaaaagtacgtacgttccaattacaagaagcgcaacgtttagttgattaa

SEQ ID NO: 1207 - DNA, 873 bp, Staphylococcus epidermidis
catatgaaacctttcaaattaatctttattagcgcattgatgatattaataatgacgaatgcaacaccaatatcacacctgaatgctcaagctaatgaagaaaacaagaagttaaagtacgaaaaaaatagcgcactcgcgttaaactatcacagagtaagaaaaaaggatcctttgaatgactttatatcattactatctgggagtaaggaaattaaaaattatagtgtcactgatcaagaatttaaatcacaaattcaatggcttaaagcacacgacgcaaagtttttaactttgaaagaatttattaaatataaagaaaaaggtaaatttcctaaaagaagtgtttggattaactttgatgatatggatcaaacgatttatgacaatgcctttcctgttttgaaaaaatatcatattccagcaacaggttttcttattacgaaccacattggttctaccaattttcataatttaaatttactttcaaaaaagcaattagatgaaatgtatgaaacaggcttatgggactttgaatctcatactcatgatttacacgctcttaagaaaggcaataaatcgaagtttttagattcgtctcaatctgttgctagtaaagatattaaaaaaagcgaacactatttaaataaaaactacccaaaaaatgaacgcgcacttgcttacccatacggattaattaatgacgacaaaataaaagctatgaaaaaaaatggaattcaatatgggtttacacttcaggaaaaagctgtcacaccagatgccgataactatagaattccacgtattttagtaagtaatgatgcatttgaaacgctaataaaggaatgggacggattcgatgaagaaaaataa

SEQ ID NO: 1208 - DNA, 1086 bp, Staphylococcus epidermidis
aggaatgggacggattcgatgaagaaaaataaacttgaattagtgtatttacgtgcgtttatttgtgtcataatcatcgtgacacacttactaacgcaaatcactttagaaaatgaacagatgtctgatagttcactcatattgcaatattatatacgcaatatttttattttcggcacccctagttttataatattgtctcaattattaacaacattaaattacgaatcagtaactataaattatcttttttcaagatttaagtatatttttattccatatcttttaatcggcttgttctatagttatagtgaatcacttatcaccgcttcttcttttaaaaagcagtttatcgaaaatgttgttttaggacaatggtatggctatttcattatcataattatgcagttctttgttctatcttatatcatttacaaaattaattttagattgttcaatagtaaaattttgctgcttttagcatttatagtccaacaatcttatctacattattttttgaataatgacacttttcatcaattcatgactcattattatccattaagcgaaaatacaatgatattaggatggatattctactttttcttaggtggttacattggctataattatgaaaaaatattatctttcttagaaaaatatttaattatagttattatgttaactttaggcgcatatgttttatttatcgctgtttccggtagtgattattggaatgtcacaagctttacttatacgttaacattatataatagtgtcatgttcttcttattactaggagtctgtatgcactttaaaactatgttattaaatactattaaagctattagtgcattttcctttttcatttatttgttgcacccaattatcttagattctctttttgcttacaccaacatatttgaagataatacaattgttttcttggcgatttcacttttaatgattctaggaatttgtataggcgtcggaatgatgttaagagagttttatatattcagatttgtaattggaaaacaaccgtacaagttacaatttgaccaataccagcctaactggaattaa

SEQ ID NO: 1209 - DNA, 195 bp, Staphylococcus epidermidis
aatgaatttaaagataattattgtcgagttattaaaaaatcatttaattatgatcaaacagggaaaagaagacgtattataagagagttcgtcaaaaaattgacattatttcatgaatattcaattttatttatcaaaattaaatcaattcaatcagacatatttaaacatatgctttatatcaagtcatcataa

SEQ ID NO: 1210 - DNA, 339 bp, Staphylococcus epidermidis
agcattaaaaagaaagaaaggtggctatgctacatggtcaagcccagacagaggcaatatccaacggtaacctcttatttaaatatagttagggagagcttatttattactatatccggagtattttggatgtattgtatcgttgtgatgattgtttatataggaactcttatcaattctcaaatggaaagtgttataacaatacgtattgcattaaatgttgaaaacacggaaatttacaaattattcggatggatgagtttgtttgtacttattatatttatcttttttacatttagtctcgcgtttcaaaaatataagaaaggtcgtgacatatga

SEQ ID NO: 1211 - DNA, 1269 bp, Staphylococcus epidermidis
aaatttgaaaacttactcttcacattgagacgatttttttataatatatcactcatattgatttttgatattaagaaaagggaggaaacactcatgaaagataataaaatgttgttcattatttttatgataggaacatttacagtaggaatggctgaatatgtagtgacaggattacttacacaaatcgctgacgatatgaaggtttctatttcgagtgcaggtttattaattagtgtttatgctattagtgttgcattgatagggcctttaatgcgaatcataacattgaaagttcacgcccaccgtctgttaccaattttagtagcgatttttataataagtaatttagtgggaatgttagcaccgaattttaatgtattgttattatcaagactcatgtctgcggcaatgcatgcgccattcttcggtgtgtgtatgagtgttgctgcgacagtcgcacctcctgctaaaaaaacacaggccattgcacttgttcaggcaggtttaactattgctgtaatgttaggtgtaccattcggatcatttttaggtggctttgcaaattggagagttgtttttggatttatgattgtgttggcaatcattactatgttaggaatgattaaatttgttccaaatgtttctttaagtgcagaagcaaatattagcaaagaattaacagtgtttaagaatccacacattttaattgtgattgcaattattgtgtttggttactctggtgtgtttactacttatacatttatggagccaatgatacgagatttttctccatttaaaattgtaggtttaactgtttgtttatttatgtttggtctaggcggtgtgatagggaatttaattactggtaatgtaccggaagataaattaacaaaaaatttatacctcacatttcttttactatttgtaacaatcatactatttgttactgttattcaaaattcaatattagcattaatcatttgcttcttattcggttttggtacatttggtacaacaccgttacttaatagcaaaattatcttaagtgcaaaagaagcaccacttcttgcaagtacgttagcagcttctattttcaatgttgctaattttcttggtgcaatcattggatctatattattatcaatagggttaccttacattcaaattactttgatatctggtggaattatagtgttgggtatgcttcttaatcttgttaatcaactttatgaaaagaaacatatcacatttaatgaatattcatga

SEQ ID NO: 1212 - DNA, 1521 bp, Staphylococcus epidermidis
tccctcggtgaggcaccgtctgtgactgtgattcccgcaacatttgcatcaacagaatctactgctacaaatcagacacaacaaacagtactttttgataattctcatgctcaaactgcgggcgctgccgattgggtgattgatggcgctttctcagattatgcagattcaatgagaaagcaaggttaccaagttaaagaactacaaggagaatcaaacatttctgatcaatctttacagcaggcgcatgtattagttattcccgaaactaacaatccatttaaagaaaatgagcagaaagcaatcattaattttgttaaaaatggtggtagcgtcattttcatctcagaccactataatgccgatcgtaatttaaatcgtattgattcttcagaatcaatgaatggttatcgacgtggcgcatacgaaaatataactaaagatatgaataatgaagaaaagaattctaacgttatgcataacgttaagagttctgattggctctcacaaaacttcggtgttcgctttagatataatgcacttggagatatcaatactcaaaatatcgtttcaagcaaagatagttttggtattactaaaggtgtacaatcagtttcgatgcacgcaggttcaacattagcaataactgatcctaataaagctaaaggtattatttatatgccggaacatttaacgcatagtcaaaaatggtctcacgcagttgatcaaggtatttacaatgggggtggcatcaacgaaggaccttatgtagccatttcaaaaatcggtaaaggtaaagctgcatttattggcgatagctctctcgtagaagatcgttcacctaaatatcttcgtgaagataatgggaaacctaaaaaaacgtacgatggttttaaagaacaagataatggaaaattattaaataatttaacaacgtggctaggcaaaaaagaatctcaaccttctatgaaagatatgggtattaaacttgataataaaacaccgctacttaactttgagcaacctgagaattcaattgaacctcaaaaagaaccttggactaccccaatagaaggttacaaatggtatgatcgttcaacatttaaaaaaggtagttatggaagtaatcaacggggtgctgacgatggagtagatgacaaaagctcttctcatcaaaatcaaaatgccaaagttgaattaactttacctcaaaatatccaaccgcatcatccatttcaatttacaatcaaactcacgggatatgagcctaatagcacaattaacgatgtaagagttggactttataaagatggaggtaagcaaatcggtagcttttcttctaaccgtaaccaattcaatactcccggctatagtcctagccaatcaattaaaacaaatggagcgggtgaagcctcattcacactcacagctaaagtgacagatgaaattaaagatgctaatattcgtgttaaacaagggaaaaaaattctattaactcaaaaaatgaatgaaaatttttaa

SEQ ID NO: 1213 - DNA, 597 bp, Staphylococcus epidermidis
tatatttttagaaaattgaataagggggagattttagaattgaaagataagattattgataacgcaataaccttattttccgaaaaggggtacgatggtactacacttgatgatatttctaaaagtgtaaatataaaaaaggctagtctatattatcattacgataataaggaagaaatatatcgaaaaagtgttgagaattgtttcaattactttatagattttttgcttaggaaccatgatgataattattccattgacggactttaccagtttttattcaaatttatattcgacgttgatgagagatatattaaattatatgttcaattatctagtgctccagaagcactgaattcagaaatcaaacaccatcttcaagaaattaatactaccttacatgatgaattgataaagtattatgatcctacgcacatcgctttggataaagaggactttataaacttaattcttctttttcttgagacttggtattttagagcctccttttcacaaaaattcgggattattgaggacagtaaaaaccgttttaaagaccaagtatattcactgttaaatgtatttttaaaaaaataa

SEQ ID NO: 1214 - DNA, 1257 bp, Staphylococcus epidermidis
cgaaaggtaggtgaaaaaatgcatgtatttaactttttacttttctatccaatttttatgtcaatttactggatagtaggatcgatttactatttttttattaaagaaaaaccctttaatcgatcattgttagtaaaatctgaacatcaacaagttgaaggcatctcctttttattagcttgctacaatgaaagtgaaacagttcaagacacgctttctagtgttttatctctagaatatcctgaaaaagaaattatcattatcaatgatggaagttctgataatactgctgaaatcatctatgacttcaagaaaaatcatgattttaaatttgttgacctcgaagtcaatagaggtaaagctaatgcactcaatgagggaatcaaacaagcatcttacgaatatgttatgtgtttagatgctgacactgtcattgatgacgatgcgcctttttatatgattgaagactttaaaaagaatccaaaattaggcgcagttacaggtaatccacgtattcgtaataaaagttctattttaggaaaaatacagaccattgaatatgcaagtattattggttgtatcaagcgaagtcaatctcttgcaggagcaatcaatactatttcaggtgttttcacactatttaaaaaaagtgcactcaaagatgtaggttattgggatactgacatgattactgaggatattgctgtttcatggaaactccatctttttgattacgaaattaagtacgaaccacgtgctctatgctggatgttagtgcctgaaactataggtggtttatggaaacaaagggttcgatgggctcaaggcgggcatgaagtacttttaagagacttttggccaacaattaaaactaagaaattatcactatatattttaatgtttgaacaaatcgcatcgattacatgggtctacatcgtactatgttatttatcttttttagtaatcacagccaacatcttagattacacatatttaaaatatagtttttcaatctttttcttttcatcctttacgatgacctttatcaatatcatccaatttacagttgccttatttattgacagtcgctacgaaaagaaaaatatagttggcctgatatttttaagttggtatccaacgttatactgggttatcaatgccgcagttgtcattatggcatttcctaaagcattaaaaagaaagaaaggtggctatgctacatggtcaagcccagacagaggcaatatccaacggtaa

SEQ ID NO: 1215 - DNA, 201 bp, Staphylococcus epidermidis
ggtaaccctattgataataatatagatccaatgattgcaccaagaaaattagcaacattgaaaatagaagctgctaacgtacttgcaagaagtggtgcttcttttgcacttaagataattttgctattaagtaacggtgttgtaccaaatgtaccaaaaccgaataagaagcaaatgattaatgctaatattgaattttga

SEQ ID NO: 1216 - DNA, 1602 bp, Staphylococcus epidermidis
gacatagtttttaatttatatatcataaaactatgtctcttccccgtacttgaggaggttaattcaatgtcccaaattgctttctatatccttagtgatgtccacggttttatattcccaacagatttttcatcaagagaaaaagatttacctatgggtttgttaaaagctaatcatctaatcgaacaagactgcgtgcactatgacggcagtgtaaagattgataatggagacttcttacaaggttctccattatgtaactacttagtatccaaattaaagagtagtctcccattaacatcaatatataatcgtttagggtttgattttggaactgttggcaatcatgaatttaattatgatttaccttatctaaagcaggccatcaatcaacttcattaccctgttttgtgtgcaaatataattgaaaatacacaaccattcactggccaaggtattcattattttaaagtaaatggtttaactataggaactattggattaaccactcagtatatccctcactgggaacaacctgattacattaaaacactcaattttaacagtgctatccacacattaaaatctgagttacctacacttagggaaaagagtgatattgtagtagtaagttatcatggtggttttgaacgtgatttagatagtggcctcccgactgaggcgcttactggggaaaacgaagggtatgatattctaagacagtttagcgatagtatcgatgtgttgataaccggccatcaacatcgtgatattgcgacaatcaagaaccaaacagccatcattcaaccaggttcaaaaggtacaaaagttggaaaaatagttattgaatatacacatgataaaaaagtattaattaaagaatgtaacttaatgaatgttcataacagtacctcctttaagccgaatgacgaagatatcgctttacgtaatcaattggaagattggcttgatactcaaatcgcagaactcccctacgctatgagaataaacaattcatttgaggcaagaaaatcaccgcatgcatttgttaaccttcttaattatattttattagaaaaaagtggtgcagatattgcatgtacagcactatttgattccgcaaatggctttgatgagaaagtaaccatgcgcgatatcatcaataattatccttttcctaatacttttaaagtgatagaacttagtggaaaagatattaaacttgcaattgaacgaagcgcaagttattttgacattgttaatcataaaatcacagttaataaagagtttctagaacctaaacctcagcatttcaactatgacatatttgcaggtatccaatatacaattcatgttagtcatccttacggtgaacgtgttagtgatttactaattaatgatgcaccactacaaagtgatcaaatatatacaatatgcgtaaataattatagagctgttggtggcgggaattatgatatgtacgttaacaaacctgtgataaaagatattcaaatcgaaggtgctcaattgttaatagattacttgtctcacaatgatttatctcaaatcccacaagtgattgatttcaatgttgttaagtaa

SEQ ID NO: 1217 - DNA, 2100 bp, Staphylococcus epidermidis
cccttacccgtggtgtgcacagatgtgctgactgtgaagacaagacaaaataaatacagtattcgtaaatttagcgtaggtgcatcatccattctgattgcagcattattatttatgggtggaggatcagctcaggcagctgagcaacaacaggataagggaactgttgaaaatagcacaacacaatctattggggatgaaaatgaaaagttaagtgaacaacaatcaacgcaaaataagaatgttaatgagaaaagtaatgttgattctattactgaaaatgaaagcttacataacgaaacaccaaaaaatgaggatttgattcagcaacaaaaagattctcaaaacgacaataaatctgaatctgtagttgaacaaaataaagagaatgaagcatttgttaaaaaacattccgaagagaaaccacaacaagaacaagttgaactggaaaagcatgctagtgaaaacaatcaaactttacactcaaaagcagcacagtccaatgaagatgtgaaaactaaaccttcacaacttgataatacaactgcccaacaagaagactctcaaaaagagaatttgagtaaacaagatacacaatcatctaaaactactgatttactacgagcaacaggtcaaaatcaatcaaaagatagccaatcaacagaagaggtaaacaaagaagtaaaaaacgacactcaacaagtgactgctaagaacgatgacgacaaagttgaaacatttaatttaaatagtaaagaggaacctcttaaagttgacaagcaagcgaatccaactacagataaagataaatcttctaaaaatgataaagggtctcatgatggtctcgctaatttagaaagtaatgctgttgctacaactaataaacagtctaagcaacaagtaagtgaaaaaaatgaggatcaaacaaataaatcagcaaaacaaaaacaatataaaaataatgatccaattattttagtacatggtttcaatggatttacagacgatatcaacccatcagtgctaacgcattattgggggggcgataaaatgaatattcgccaagatttagaagaaaatggatatgaggcttatgaagcaagtataagtgcatttggtagtaactatgaccgtgctgttgagttatactactacatcaaaggtggacgtgttgactatggtgcagcacacgcagctaaatatggtcatgagcgttacggtaaaacctatgaaggtgtgtataaagattggaaaccaggtcaaaaaatacatttagttggtcatagtatgggtggtcaaacaattcgccaattagaagagctattgagacatggtaatccagaagaagttgaatatcaaaaacaacatggtggggaaatttctccattattccaaggtggccacgacaatatggtgtcatctattacaacactcggtacaccacataatggtacgcatgcgtcagacttattaggtaacgaagcaattgtacgtcaacttgcatatgatgtaggtaaaatgtatggtaataaagattcacgtgtagactttgggttagaacactggggattaaaacaaaaaccaaacgaatcatatattcaatatgttaaacgtgttcaaaattcaaaactatggaaatcaaaagatagtggtttacacgatttaacacgcgatggcgcaacagatttaaaccgaaaaacatcattaaatcctaatattgtatataaaacttatactggcgagtcaacgcataaaacattggcaggaaaacaaaaagctgatcttaacatgttcttaccatttacaattactggtaatttaattggaaaagctaaagagaaagaatggagagaaaatgatggacttgtttcagtcatttcttcacaacatccatttaatcaaaaatatgttgaagctacagataaaaatcaaaaaggtgtatggcaagtaactccaacaaaacatgactgggatcatgtagactttgtaggacaagacagtacagatacaaaacgtactagagatgaattgcaacagttttggcatggtcttgctgatgatttagtacaaagtgaacaattaacatcaacaaataaataa

SEQ ID NO: 1218 - DNA, 267 bp, Staphylococcus epidermidis
acagactactcatcaattatttttgatgctttaaccgtagataaaaaaggttgcttatacacacccaatcactctcaatatgtcgaagaacgtggcgtctatcaagacgtaatggacaccttaaaacctatttggtataccgatgctgaactattaataaatgatttaattactgatagcatcccacaattaaacaataaatatacaaataaaaataatcagtcatttgaatatattagtaaacttatttcaaatcaattgaaataa

SEQ ID NO: 1219 - DNA, 1023 bp, Staphylococcus epidermidis
ttcaattcatcattagaggagtgtagaaatatggtagaaaaattcaaagcttttgtagtcgatcaagatgacaacggtattgtttcaaatagttataaagaactaactaaagatgacttacctgagggtgacgttttaataaaagtacattattctggcataaattataaagacgcactagccactcaggaccataacaaaatagtaaaacaatatccgatggtccctggtatagatttagcaggtaccattgaggaaacaaatgctccaggctttgaggttggagataaagtcatcgtaacaagctatgatttaggtgtaagtcattacggaggcttcagtgaatacgcacgtgttaaatcagaatgggtgattgaattacctgaagatttaacattggaagaagctatgatttacggtactgctggctatacagcaggtttagctatagaacaacttgaaaaatcaggtatgtctattgaaggtaaagaagtgcttgtacgaggtgccactggaggcgtcggaacgatttcattactcatgttaaataacttagggtatgatgttattgcaagtacgggtagagatgacgccgaagaaaaacttaaaaagcttggtgctaaagaagtaattggccgtttaccagaagataatagtaaaccattagagaagagaacatggcaggcagccattgatccagttggtggtgaaaacttaccgtacatcgtcaaacgattggataacaacggaagtgttgcattaattggcatgactggtggtaacaattttgaaacaaccgtctttcctttcattttaagaggagcaagtataattggtatcgattcagtatttactccaattaaactaagaaaacgtgtttggagaagacttgcaaaagacttaaaaccacaacaattacatgacatcaaacatgttatttcattcgatgaaatcccaaaagccatcgatcaagtcatcaatcataataatactggacgtattgtcattgatttcaatgtttaa

SEQ ID NO: 1220 - DNA, 1089 bp, Staphylococcus epidermidis
gatataacatcaatggaaggaggctataaattgaatataacaaaagcaattgttgtagcaatctatatcattgttggtgcagcacttggtgttataattatacccgaagttgttacagatcttggcattcatcaccatgcggttatcactaattattatgtagatggtttcatagggatcattatattttttataatatttggattgttcattaataaagtaacatatacttttaaacaatttgaacaattaatcatgagacgtagtgcggtagaaatattatttgctacaattggtttaattattggtttatttatttcagtgatggtttcttttatcttagaaatgataggtaattccatattaaatcactttgtacctatgataatcactattattttatgttatttagggtttcaatttggtctgaaaaaaagagatgaaatgcttatgtttttaccagagaatatggcacgttccatgtctaataatatacgaagagcgacacctaagattgtagatacaagtgccattatcgatggaaggatattagatattatacgttgcggatttatcgatggtgatatattgataccacaaggcgttataaatgaattacaggttatagcggatgctaaagatagcgtgaaacgtgaaaaaggtcaaagaggattagatattttgaatcaactttatgatttagattatcctacacgcgttatacatccaactcaatcccatagtgatatagatacattattaattaaattagcacaacagtatcatgcacatgtgattacgactgattttaatttaaataaagtatgtcacgttcaaggaattacagcactcaacgttaatgatttatcggaagcaatcaaacctaatgtacatcaaggcgaccagttaagtattttattaacgaagataggtaaagagccaggacaaggcgtaggatatttagatgatggtacaatggtggttgttgataacgcgaagagttacattggtcaacaagttaatttagaggttgtaagtttgttacaaacatcatcaggaagaattgtttttgcgaaatttgttgactga

SEQ ID NO: 1221 - DNA, 1242 bp, Staphylococcus epidermidis
gtaaagtttttagcttctcaattattcaaaggaggtttttttatcgattacttaggtgttgatattagtaaaagaagtagtgtagttgcacattataaaaatgaaaaattccaaaaagagtttttcatccaaaataataaaaatggttacaactatttactcaagtatttgaatgacttagaccacccacaactcatttttgaatctacaggtatctattcaagaagtatggaacgattttgttgtgtaaatcaaattaactatattcaaatgaatccgttagaagccaaatttaaaacgagcgctctaagatcatggaaaactgatcaggcagatgctcataagcttgcttgtttaggaccgacgcttaaacaaacagacaacttacctatacatgagttaatattctttgaattaagagaacgcgtccgttttcatctagaaatcgagaatgaacaaaatcgacttaaatttcagatccttgaattactccatcaaacattccctggtttagaaagattatttagtagtcgatattcaatcattgcactcaacatagcagaaatctttactcatccagacatggttcttgatatcgacaaggaggtactgattacacatatattcaattctacagataagggaatgtcaatggataaagctacaaaatatgcacttcaattaagggtgattgctcaagaaagctatcctaatgtcgatagacattcctttctagtcgaaaaattacgcttacttattcaacaattaaaacaatctattcatcatctcaaacaattagatgatgccatgattcaattagcacaacaactcgattattttgaaaatattcattcgatacctggtattggtaagctaagcacagctatgattattggggggattggtgatattaagcgatttaaatcaaataaacaactcaatgcttttgttggcattgatatcaaacgatatcaatcaggtcatacacactgtagagataccatcaacaagcgtggtaataaaaaagcgagaaaacttttattttgggtgattatgaatataataagagggcagcatcattatgacaatcatgtcgtcgattattactacaaactaagaaagcagcctaatgagaaacctcataagactgccatcattgcttgtataaatcgattattaaaaacaattcattatcttgtaatgaatcataaattgtacgattatcaaatgtcaccacattag

SEQ ID NO: 1222 - DNA, 888 bp, Staphylococcus epidermidis
tttgaaatgtcagctcaagatccgcgcaataaatttaaaactgataattatgaaaaacaagaacaagaagttccaggtatacaagctaaaatgtcaccacaaccagattgtggggaagattcttatcatggccaccatcgattagatggctttaaaatactagtgactggtggcgattcagcaattggacgtgcggcagcaattgcttatgctaaagaaggtgcagatgtagcgattaattatttaccaagtgaacaacaagatgccgatgatgtaaaacagattattgaaaatgttgggcaaaaagctatcttaattcctggtgatattagagatgaacaattcaactatgacatggttgaaaaggcttatcagcaattaggtggtttagacaatgtaacgttggttgctggtcatcaactttatcaagatgaattatcggagtttaaaactcaagattttaccgaaacgtttgaaacgaatgtctatccggtattttggacagtccaaaaagcgcttgagtatttacaaccaggaggctcgattacaacaacatcttcagttcaaggttataatcctagtccaattcttcatgattatgctgcaacgaaagctgcaattatatctttaacaaagagtttttcagccgaacttggccctaaaggtattcgtgttaactgtgttgcacctggaccgttttggtcaccacttcaaattgtcggtggacaaccacaaagcgctatacctacttttggacaaaacacaccgttaggacgtgccggccagccagttgaatgtgctgggacatatgtgttattagcctctgatgatgcaagttatattaccggtcaagtatatggtgtgactggtgggactcaaatagattaa

SEQ ID NO: 1223 - DNA, 204 bp, Staphylococcus epidermidis
ataagccagtccagtgattacgttcgacaccttaatcattggactggctttttcatatctatcaatttaaataataatcaatataaattcgctatattgattaaaaataatttattgcgtttcattagaactattgagatgataactgcttttgcatttaaaatcttaatttacttattagggtttgcattaacaggatattaa

SEQ ID NO: 1224 - DNA, 216 bp, Staphylococcus epidermidis
gtcctacttcctttctctaaatttattcaaattaaaatctgcaaaaaagtgcatattaaaatacaccattcattatttattgaaaatacttctttcctcaattttaagctaatgttagaaaaatacctttattttactttaatatctccattttcattgattaatttcactttattatttccattttcaactttactattatataacacacgatga

SEQ ID NO: 1225 - DNA, 480 bp, Staphylococcus epidermidis
tttgccatgttatggcatttaatttttatgattcctacaattattggttactcttttggaatgttctgtttaatatcaagtgaaacttttaaaagtaaaggatttctcttgttgggggtaggaatttttatcttttctttaatttatattttgatttatagtttagttacattaatacctaatgttgcgatattatcaagaagattccatgatcgctcaatgacgatgactcttccgattattttttatgttttcactgtcattgtatcaggttttaattatttaccaaatatagataattcagcggtattaatatttatgggaattatctgcttaatctactggattgggtcgatattaatattagtattgacttgcttagatagtaaaacagagtctaataaatatggaccaagtccaaagtacaatcgtaacgagacaaatttccatggtgataatgctaatccagttgataaataa

SEQ ID NO: 1226 - DNA, 603 bp, Staphylococcus epidermidis
tttcaacttactcgaaaggttagatatatgaatctgaataaacagcaacatgaatatacagcactgtgtctatcgcaaacagaaaataaatcttctgaagaactatttgagtctttaatagaagagctaaagccactgatttacaataaaataaggtatatctcccataataagtatgacattgaagacatgtatcaagagattgttattaaattctaccgtgccttgcaaaaattcgactatcaacaaggtgtaccaatagaacactatatttactttttaattcgttcggttaaatatgactatcttagaaaagtaaaagcgaattataaacgtcaacctctacttgttaatgaatacattgttgaatataacgctactttggcattaaacgatatagaaagatcgataattagaaaagaattaacattagcttttaaaagaagcgaagtcaaactcagtcgaatggaaagacgtatcattcgattactacttaatgattacaagccaaaggagattgctatggttttaaatttggaatccaaagttgtttataatgcgattcaacgtagtaaatgtaaacttaaaagaagttttgaataa

SEQ ID NO: 1227 - DNA, 969 bp, Staphylococcus epidermidis
ggtatcaaaacaatgttactttttttatgttttctaatcgaattattacttattgttttattatatacgaagcaatcgtttactcttaatttatttagtttcatcttatataacatcattggttttgttatgatgacttatcatatggtaactgtatcaataccatatgatatgtttatcattgtaattgtagcaatgatactgttgttgattaaacatcgttatattttcaagttgcaaacaggacgtttttttattttacaacttagtcatcatttttatactgtggggctatttgctgtgagttgtttatatataagtactattcccctaattatcattaatagcttagctttatgggccgctaccattgcatttagtacaatttattcatttatcggatacttatcttggtctacagcttttgaaaatcatcaatattataaacacgtaaagttaattatggtgcttggagctggaattttctctgaagaagtgactacgcttcttgctgcaagacttgataaagctttatctgtttatcattcacaacggactaaacctatcatcattgtaagtggtggccaaggtcctgacgaaccaatttcagaagcacttgcgatgaaaagataccttatagctcacaacgttccggaaaaccatatatttatggagaatcaatccacgaatacacgaaccaatttcttatactctaaatctatcattcattcgatgatgcctacttcaagtcagatgttgtgtgtaacaagtcaatttcatgttttaagagcgcttaaatttgctaaaaaagctcatctttctttcgatggtattggaagtcgtacaccataccactttttggcacaatctatgattatagactttttgggtttaatgtatcaatataaaacaatacttactatttatttcgctatgttgttttggcttgcaatactacaaaccatataa

SEQ ID NO: 1228 - DNA, 633 bp, Staphylococcus epidermidis
atgtctgaaacattacaaaaccaaagacaattcaactctcaatttgaacatcaagagatccatcgtggaaaaagatatggtaaaaagaaacgctcatgggtaagtctcattattcaagttttcgttttagtattaactgctattactggctatagtatgcttaaacaacctatatttaaaatttcatttgtaaatgaaactataaatttccatcaattaagaaattttcaagatacagttacgcaaatcggtaatttgaatttaggtaatattgatcaattacaacagtctgtcgataatctcatcattatatttaatattttctttgtcctatgtctgattagtttgtttataaccgtaattacaattatttttaatcgcacagcactcaaagtagtcaatatattacttttagctattatgctagtcattacattgtatttcagttatatcatacatacaattgctcagaaaatttccgaatctctaaaacaatattatttaacagtatcaccagaacaagtattaactgaagcagatgcgattcacaatgcactgatactcattggatgtagtattgcgttattgattgtaagtttgtttttccgtaatcgtttaccacgtattaaataa

SEQ ID NO: 1229 - DNA, 477 bp, Staphylococcus epidermidis
atgaacaagacatttaccgtaacccgaactgtgacagaagatgctatagataataataatcatatgcatgacgcatattataatattatttttagcgaggtcattaataaattcaatgaggttcatggtttatcatggtcagagagagaccgtctacaatatacagtttttactgttgaaacacacactacttttttacatgaattaacacttggtcaagaattcaatatagagctattcctttataattacgatgacaaacgaactcatttctttctgagaatgttaattgataatcaagaagttgttgcaaccaatgaggtcatgatgttaggaatagataggacacaacgtcgtgctgcaccatttccaaaacattatctgaatgctatacaagattatgctcataagcaagaaaaaattgaatggccaccacaattaggccactcaattggaataccatataaaggagaataa

SEQ ID NO: 1230 - DNA, 2184 bp, Staphylococcus epidermidis
agagaaaggacgtatagtatgaataaactgacaattattgtcacgtattataatgcggaggaatacatcacaggttgcttagagagtattaagcaacaacgtacacaagattttaatttgattattgtgaatgatgggtcgacagaccaaagtaaaaaattaatggatgaagctattaaagactatgataaaaacattcgatttatcgatttagatgaaaatagtggtcatgcacatgcgcgtaatattgcattagaagaagtagaaacaccttactttatgtttttagatgcagatgatgaattagcttcttatgcaatcacgttttacttagaaaagtttaataatactgatggtttaattgctccaatacattcttttactacacaacgtccgcaatttgttgatttagatcgagtaagggttgaatactttaatgccaaagagaatattaattcatttttaagaaaacagtcagcttgtaacattatttttagaacagctattgtcagggcgcatcatattcgatttaatgaaaatttaaatacatatgtggattggtcatttgttcttgaatatatgaagtatgtaaataagtttgtacgtatttttaacttcccattttatttccgtggggaagtctatgatccatttgaaacacttacattaagtgaacaaaattttgatattttatttaaagattacgtcaacagcttttatgatgccattaaacgagcaacaaatccaaaagttagagaatttattgtcactaaaatgggaaataaaattgctaatgaatttgaaccaactcgatatgatattaatgaacgctatcaaacacataaggatacgcttgttgaattatcgaaatttttacatgtacatttagttaaaaaccaaaagctaataaataaaattgaaacaattttgttaatgaataatgaaactgataaagcttttaaagttaatcaatttagaaaaacgttgcgacatgttaaaaatattgttctaagaagaaaaaataaagaacgttcattgtatgatttaacagataaagaagataatgttaaaccgaaaacgattgtctttgaatcgttcggtggtaagaattacagtgatagtccaaagtatatttatgaatatatgcaaaagtattatcctaattatcgctatatatggtcatttaagaatcccgataaaaatgtcgtaccgggtagtgctgaaaaggttaagcgtaattcagcagagtattatcaagcatactcggaagcaagtcattgggtatcaaatgcgcgtacaccactttatttaaataaaaaagaaaatcaaacgtacattcaaacttggcacggtacaccattaaaacgtttagcgaatgatatgaaagtggtacgtatgccgggtactacgacaccaaagtataagcgtaattttaatcgtgaaacatcacgttgggattatttaatttcgccaaatagatattcaactgaaatatttagaagtgctttttggatggatgaagaaagaatattagagataggttatccaagaaatgatgtattagttaatagagccaatgatcaagagtatttagatgaaattagaactcacttaaatttacctagtgataaaaaggttattatgtatgctccgacatggagagacgatgaatttgtgagtaaaggaaaatatttgtttgaattaaaaattgatttagacaacctttataaagaactcggagatgattatgtgattttattacgcatgcattatctcatttctaacgcacttgatttatctggttatgaaaattttgcaattgatgtttcaaactataatgacgtctctgaattatttttaataagtgattgtttaattacagactattcatcagtaatgtttgattatggtattttaaaacgccctcaatttttctttgcatatgatatagacaaatatgataagggattacgaggattctatatgaattatatggaagatttaccaggacctatttatacagaaccatatggcctagctaaagaactaaagaatttagataaagtgcaacagcaatatcaagaaaaaatagatgcattttatgatagattttgctctgtagataatggtaaggcatctcaatatattggggatttaattcataaggatatcaaggaacaatga

SEQ ID NO: 1231 - DNA, 1500 bp, Staphylococcus epidermidis
aaaagggggactgtgtttgttatgaatactcaacatagcaaaacagatgtcatcttaataggtggcggaattatgagcgcaacattaggaactttactaaaagaattaacaccagaaaaagatatccaattgttcgaaagattgagtcaacccggcgaagaaagttcaaatgtttggaataatgcgggaacaggtcattcagcattgtgtgaattgaactatacgaaagaaggtaaagatggttcagtagatattactaaagcaattcatattaacgagcaatttcaaatatctaaacagttttgggcttatttaatacgtgaaggtcatattgaaagtccagataaatttattcaatcagtgccacatatgagctttgttaaaggggaagaaaatgttaaatttttaaaaagtcgagtggcgagtttacagaaaaatgtattatttgaaaaaatgaaaatttctcaagatccagaaaaaattaactcatgggttcctttaatgatggaaggacgccaatcagatgaagcaattgccatcacgtatgacgagacaggtacagatgttaactttggtgctttgactaaaaagttaatagctaatttacaacaaaaaaatgttggcattaattataaacatgaagttttagatataaaaaaattaaataatggtaactggcaagttgtggttaaagatttaaatacatcaaatgtaatgaattatgaatctaagttcgtcttcatcggagctggtggtgcaagtttacctttattacaaaaaacaaagattaaggaatctaaacacattggtggtttcccagtaagtggattatttttacgatgtaaaaatccagatgtcatacatagacatcatgcaaaagtctacggtaaagccgaggttggtgcacctccaatgtcagttccacatttagatacacgatttgttaatggtgaaaaatcattactatttggaccttttgcagggttttcgccaaaattcttaaaaaacggttcatatttagatttagttaaatctgtgaaacccaataatatgataacaatgttaagtgctggcgtaaaagaatttaatttgacgaaatatttagtttctcaattaatgctttcaaatgaagaacggatcaatgatttgcgtgtattcttaccagaagcgaaagatgaagattgggaagtaattactgcaggtcaacgtgttcaagtaattaaagatacagataagtctaaaggtcaattacaatttggtacggaagtaataacatcagaagatggttcacttgctgcattattaggtgcttcacctggtgcttcgactgctgttgatatcatgtttgatgtcttgcaacgttgttacaaatcagagtttaagtcatgggaaccaaaaattaaagaaatggtcccatcatttggtttaaaattgtcagagcatgaagatatgtaccattcaataaacgaagaagtaaaaaaatacttgaatgtaaagtag

SEQ ID NO: 1232 - DNA, 1557 bp, Staphylococcus epidermidis
  unsure (16): Identity of nucleotide at the above locations are unknown.
ctgacacatgccggcngacatatcatatcaagatatgaggaagactatgcgaacggaacttatatgaactcattatatgataaaccgttacctggaaactacttcttacaaaatgctgacgactatttacaaattcttgaacaaggcgttcaatttgtattagaagatagtaaagttaataaaaacgatgtggttggaattggagtcgactttacaagcagtacaattatctttctcgatgaacaatttgaaccgcttcatcgtcatgaagatttaaagacaaatccacacgcgtacgtaaaattatggaaacatcatggagctcaagatgaggcaaactatatgattcagatgagtaagaataaaaattggttagattattatggctcaagcgtaaatagcgaatggatgataccgaaaatcctggaagttaaacatgaagcaccagaaatacttagaagagcacggtatataatggaagctggagattacatcactagtatactaacaaattcaaatatacgatcaaattgtggtattggttttaaaggtttttgggacaatgaagctggatttaattacgacttcttccatagcgtggatcctgatttacctaaaatcgtcaaagaaaaatgtgaagcgccaatcatatcaattggagaaagtgcaggtcgtttatgtaaagactatcaacaaatatgggggctttctcaagatgtccaggtttcaccttttatcatagatgcacattctggcgtcttaggtgttggggcaatagaagctggagaattcactgcagtcattggtacaagtacttgtcatctcatgctagattcaagacaagtacccatttcttcaataactggctcagttaaaaatgctattatacctggattatatgcctatgaagctggtcaaccagctgtcggtgatttgtttgaatactcaaagaaccaagcacctaaacatattgtagatcaagcaaatgaacatcatatgcctgtgcttaactatttagaggaattagcaagtcacattagaatagaagaacaacatgttgttgttttagattggttgaatggaaatcgtagtatacttagtaatagtcatctaactggaagtatctttggtcttacacttcaaacaccgtatgaaatgattcatcgagcatatattgaagctacagcatttggaacaaaattaattatgaaacaatttgaagataatcatattcctgttcatacagtgtatgcgtctggtggtatcccacaaaagagtaaattactcgttgaaatttatgcaaatgttttaaataaaagggttgtcgtcatagattcatctaatgcttcagcattaggtgcagcgatgttaggtgcaaatgttgggaatgcatatagtacattaaaagaggcggcattatctatgaagcaacctatagcttatatacaagaacctgaaatccaaaaagttcaagcttataaaccactctaccataaatattgtgaactacatgatttattaggtcgtcaatatcctgaattatcatatttgatttaa

SEQ ID NO: 1233 - DNA, 204 bp, Staphylococcus epidermidis
tatgctgatgcacatgtcacacttaatcctaatgaaagtgaacctgaatcatatgataagtatgatgtaagggtgcctgttgagcaaaatgatcatacaatgaaagtagaattagatgtgccaaagggattaaacgttgagagtgttaaaactattgaaggttttaaacatcattttttaaagataaaaagggaacattactaa

SEQ ID NO: 1234 - DNA, 1029 bp, Staphylococcus epidermidis
aaagtgagagcgaggtgtctcatgatgagtaatatccatactaatattagtgagtggatgaagatgtctgaggagacacctgttattatttcttccagaattcgattagctagaaatcttgaaaaccatgtccacccacttatgttcccttcagagcaagaaggatatcgagtgataaatgaagttcaagatgcgctttccaacttaactttaaatcgattagatacgatggatcaacaaagtaaaatgaaattggttgcgaaacatcttgtgagtcctgaactagtgaaacaacctgcttcagcagtaatgttaaatgatgatgaatcggtaagtgttatgataaacgaagaagatcatatacgaatacaggctctaggaactgatttatcgctaaaggatttatatcaacgcgcttctaaaattgatgatgaattagataaagcgttagacattagttatgatgagcatttaggatatttaactacctgtcctactaatattggtacaggaatgcgtgcaagtgtgatgttacatttacctggactctccattatgaaaagaatgaacagaattgcacaaacaattaatcgttttggatttacaattcgaggtatatacggagaagggtcacaagtatatggtcacatttatcaggtttcaaaccaacttacactagggaaaacagaagaagacattatcgataacttaactgaagttgtaaatcaaattataaatgaagaaaagcaaataagagaaagacttgataaacacaattctgtagagacactggatagagtttatcgatcattaggtgtactacaaaacagtagaattatttctatggaagaagcctcatatcgtttgagcgaagtgaaactaggtattgatttgaattatattttgcttgaaaattttaaatttaatgaattaatggtagcaatacagtcaccatttttaatagatgacgatgataatagaacagtaaatgaaaaaagagctgatttattaagagaacatataaaatag

SEQ ID NO: 1235 - DNA, 519 bp, Staphylococcus epidermidis
aatgaaatggcaaaatataatgtggaaaatgaatatgtagaaatcgacattgagagattactcaaatatacaccagaggtcgtttatgaggcatggacaaaaacagatatcttaaaaaaatggtttatgaccactcaacgcacgaataaatcatttgatgcagatattcaagagggaggaaagtatcgcatcattgatagtagaaacggtaaacaaaacatcattgaaggtacatatgaagagttagttttagatgaatatatcaagatgacgattggaatgccaggactaagtgaggaagaggatgtcattgaagtagagttctttgaaagagagaatggcggaactcaaatgttcttttactatcgctcttttgttgaaaaggaaagacgtttaacaacattagaatataagcaaaagaaaaaagaatatcatgattcaacagcacatggatttgaattgatgattgatcaaatgcaaaatgtgatagatgaaattgaggaacagcgtcataactaa

SEQ ID NO: 1236 - DNA, 186 bp, Staphylococcus epidermidis
ttgtcccaggcattttatttattggcaattgacaaccgagttgaacttgggctaatctcaattttcaactctagtcctcattaccaagtgagacagcgaattacttacgctttctatctcactcttcttaatttaatatttaacgttataattgtagtaactcaatatgcgaaattaaagttataa

SEQ ID NO: 1237 - DNA, 1989 bp, Staphylococcus epidermidis
gggggtcattttatgacagcgaccttcattattatatatattgtagtagcgctcatactcattggttttattaatttctttttaattaagcgtaaaagaaaaaataaagacaaaagagtggaacaacgttcgacaatagattctaagagagaaagcaatcaatctaaatttaaagcaagcgatttagaacaaacaactaagtcaaatactgatccaacgcaatcaaacgatattgaagatgaaaaacgaaaaaatcactttgactcagaaatagataatgcatctcaatttatcaatacagatagtaaagaggatagaaacgcgttaagccataagaaccaagaggaagatgacgcatcgaacgatgtgttgaaccctatcgatccaaattctactgaaggtagagttaatgaaagaattaaaaatcaagagtctaactttatttttggtaaaggtataactagaggtaaaattttagcggcaatgttatttggtatgtttatcgcgattctaaaccaaactctattaaatgtggcattgcctaaaataaatacagagtttaatatttctgcttcaactggtcaatggttaatgactggttttatgttagtgaacggtatattaatacctattagtgcttttttatttaataaatattcttatagaaaattatttattataggtttagcactatttacattaggttccttagtttgtgcaatctcatttaatttcccaattatgatgagtggacgtgtattacaagccataggcgcaggtatattgatgccgttaggttctaacgttattgttaccattttcccacctgaaaaacgcggtgtggcaatggggacaatgggtattgcaatgatattagcacctgcaatcggtccaacactttcaggttatattgtgcaaaattatgattggaatgtaatgttttacggtatgttctttataggtattattgctatcgtaattggtctattttggtttaagttgtatcaaagtacaacaaatccgaaagcagatattcctggaattatttatagtacgattggattcggttccttattatatggtttctcagaagctggtaataaaggatggggctcaactgagattgtaacaatgtttattgttggtacggttttcattattttctttattttaagagaactaagaatgaaagcgccaatgttgagcttggaagtattaaaatatccaacttatacacttacaactattatcaatatgattgtgatgatgagtttatacggaggaatgattttacttccattatatttacaaaatcttagaggattttcagcattagactctggattattactattgccaggtgcattagtcatgggagcattaggtccggtggcaggtaaattgttagatacaatcggtattaaaccattagcaatatttggtattggcattatgacatatgcgacatgggaattaagtaaattaaacatggatacaacatatctccatattatgtggatatatattgtgcgttcatttggtatggcatttgtaatgatgccgattataactgcaggtatgaacgctttaccaccacgtttaatttctcatggtaatgcgtttgttaatacaatgagacaattagctggttcaattggtacagctattttggttacggtcatgacgacacaacaaacaaatcatctttctgcttttggtgaagagttagataaaacgaatcctgtcattcaagaccatatgcgtgaacttgcccaacagtatggtggtgagtcagcagcaatgaaattattactcgaacatgtcaataaacttgcatctgtagaaggtgtaaatgatgcatttattgttgctacaattattagtgcgattgcactgatattaagcttgttcttacagggcaagaaaaaggctcaattatcagctgaaaaagcaaatgctgaagattatccttcgcaacaagataaataa

SEQ ID NO: 1238 - DNA, 666 bp, Staphylococcus epidermidis
gtcaaacatttacggttaatcggcctacctcataaaaataaaaatacatatgtaaatctcattttaagggtgtcattgatgaaagcatatctatataaattcatgccattgctcattttcgtcataggactgattatcttttacgtttttaatgattatcccacattgatacatgtcatagtgattattgcttttataacgaatggattgaaaaatgtatattttgttaataataatattagaaatcatatgatatgggtgagccctaaactcgatcgtatccttggtatgatttcgggcatactatattttggtatttacgtggttggctttataaagcaacagcctttatggatagtgatgcttattctagtatcaacagtgggtactgcggttttattagaaacaaaattacatattacatcacttcaattagaggagacgttatcatctgaacggataaaacgtaaagtaatatcaagacataaagcacaacgtcttaagtgtatattttttactgtgattgttgtagtaatcatttcaatgctcatatcattatatttaaagttgatggttatttttggacttgcagtaacgatttttatcttagcatcaataagtgtggctattttcgaaaaatactttactattattgaaaatatgtaa

SEQ ID NO: 1239 - DNA, 219 bp, Staphylococcus epidermidis
gtacatcttctaaggtcatcaattttagctcttttgcatctttcatgtgtcgttgctctcctcttcataaaagtatctaattatattctacatgagattcaaatttttaacatacctcattttttatttcatattaatcatttcattttattgttaaactatttatatcaacacttgataataacttataaattaaaaggtcgtgatatacatgattaa

SEQ ID NO: 1240 - DNA, 1026 bp, Staphylococcus epidermidis
aagggagattatgtaatgatatctaaagttgaacatcaaagacacggtttagatttaattaaaattgataatgacgatacgaaaattgtatttacaaactatggtgcaagaattgtttcttggaaataccatgataacaatatcgttttagggaatgtagtagaagcggatgaattttattttgaagaaccttttaattttggtgctacgataggtcgctatgcgggtagaattgaaaatgcatcatttaaattagatgatgatacttttcaattagaatcaaatgatggtcaacatcatttgcatgggggcagtcatggattaaatagacgtatttttgattatgaaatagttgatgatattggacaagtaaagattatattcacaacaacgattaaagaagaagaggacaattatcctggagatatgatggtaaaggttattcacacttatgatgccaatcatcgatggtccgtacaatatgaggcaaaatcaacaaaaaaaacagtatttaatccttcaaatcatgtttattttaatttgaatcgtgataacaatgttgtctataaccactgtataaatagttcagcattaaaaatgtatatgttaaataataaacatattgttaaagaggggcaatctcttgatttacatcgattattggatacaaataaagtctatttaaaagatatttttgaaagtgacaatgaaactttgcaacaacaaattaatcattataatggcattgatcatcctttcgaatttggaggaaatgagcttaccattgataattctgaatttgaacttaatattaagactgatatgcctcattttgtaatgtttacgtttaatgatccacaagtttggaacaatgattttaatatttataaggcgcattctggattttccatcgaaactcaatatatgcctaatgatataaatatgtacggcgccaaagctcagtctattttagaggcagatacattatttacatctaaaacaagttttcaaattcatgaaaagtag

SEQ ID NO: 1241 - DNA, 228 bp, Staphylococcus epidermidis
gaaactaaatatttcgtcaaattaaattcttttacgccagcacttaacattgttatcatattattgggtttcacagatttaactaaatctaaatatgaaccgttttttaagaattttggcgaaaaccctgcaaaaggtccaaatagtaatgatttttcaccattaacaaatcgtgtatctaaatgtggaactgacattggaggtgcaccaacctcggctttaccgtag

SEQ ID NO: 1242 - DNA, 333 bp, Staphylococcus epidermidis
ggaggtagatatatgaatgtacagtttaagaaaggtgctttagaattaattgttctgctaattattaaaaaagaagatcagtatggttattcacttgtacaaaatatctccagatatatgaccatagctgaaggtacagtttatcctctgctaaggcgtttggttaaaagtggggaactgagtacgtattatcaaccttcaactgaaggtccgtctcgaaagtattatcaattaactcaacagggggctgcgagagttaatcaattagaggaggattggaaattgtttacggaagctgtagaacatttcattgaggagagtgagaatgaatga

SEQ ID NO: 1243 - DNA, 975 bp, Staphylococcus epidermidis
tttataaagtatgagggggtaagaaagatgacggtgaccgttagatttcaatctttatcgcaacctcttacattagtttcaaatgtgaaagagattcctaaagatgcaacgattatatggtatgattttgaaaatgccactgatgaagaaaatgagtatttaaaaaatcattttgatttcaattacttagaaatagatgatgctatcaatggtgacccacgagttaaatatatagaatatgacgcgtatcaatatatgatatttcatagtattattaatgatgattactcaccaatctcactaagtgtatttttagaaggtaatgttttagtgacataccatcacaaacattttccatcattaaagcgtgtggctcaatacaatgcagaaaatcatgatagtgaattagattgtgcagacatcgtcattcatattctggattgtatggtggataaatattttaactttgtttatggtattgaagataaagtgtataattttgaagctaagcatgtcgatgaccgctatagtaagagcgttatggaaaatgtctttcaattacgttcggatttaattaaaatcaaacgcgtattatttccgatgcaagaagttgtagatacaatgaaacaagaaggaaatataattaaagatgccaaacatagaatgtatattcaacatattgatgatcatcttattaaacaaagaagtgttattcggacttctcaagaaatgacgaatgagattcgtgaaaattatgaatcattcacctcatttaggatgaatagtataatgcagatacttacgcttgtatctgttatattctcaccactcacttttattgctggtgtatatggaatgaactttgaatttatgcctgagttgaaatggcattatgcttatttcgtgtgcttaactttaatgctaattataacaataatattaatcatattctttaaaaagaaaaaatggttttaa

SEQ ID NO: 1244 - DNA, 2472 bp, Staphylococcus epidermidis
aataggaggtatttatacatgttatttggtagattgacagagcgtgcacaacgtgtgttggcacatgcacaagaggaagcaattcgtttgaaccattctaatattggaacagaacatcttttgcttggtttaatgaaagagccagaaggtatagcagcaaaggtattagaaagttttaatattactgaagataaagtcatcgaagaagttgaaaaacttatcggtcacggtcaagagcaaatgggcacactacattatacaccgagagcaaaaaaagtaattgaactgtctatggatgaagctcgaaagctacatcataactttgtaggaacagagcatatactattaggtttaattagagaaaatgaaggtgttgcagcacgtgtatttgcaaacctagatttaaatattactaaagcacgtgcccaagttgtaaaagctttaggaagtccagaaatgagtaataaaaatgcgcaagctaataagtctaataacacgcctactttagatggattagctagagatttaactgttattgctaaagatggaacgttagatccagtcgtaggacgagataaagaaattactcgtgtaattgaagttttaagtcgtcgtactaaaaataatcctgtgctaattggtgaacccggtgttggtaaaacagcaattgctgaagggcttgcgcaagcaattgttaaaaatgaagtaccagaaactttaaaagacaaacgtgtaatgtcattagatatgggtacagtcgtagctggcactaaatatcgtggtgaatttgaagaaagattgaaaaaagttatggaggaaatccatcaagctggtaatgttattctatttatcgatgaacttcatactttagttggcgctggtggcgcagaaggagcaattgatgcatctaatattttaaaacctgctttagctcgtggagaattgcaatgtataggtgccacaacattagatgaatatcgtaaaaatatagaaaaagacgctgcattagaacgtcgttttcaaccaattcaagtggatgaacctacagttgaagacacgattgaaatcttaaaaggattacgtgaccgttatgaggctcatcacagaattaatatctcagatgaagctttagaagcggctgctaaattgagtgatcgctatgtttcagatcgtttcttgccagataaagccattgacttaattgatgaggcaagttcaaaagttagacttaaaagtcatacaacgccaagtaatttaaaagagattgaacaagaaattgataaagtaaaaaatgaaaaagatgctgcagttcatgctcaagaatttgaaaatgccgctaatttaagagataagcaatctaaacttgaaaagcaatatgaagatgctaaaaatgaatggaaaaatgcacaaggtggtttagatactgccttatctgaagaaaatatcgctgaagtaatagctggttggacaggtattcctttaactaaaattaatgaaactgaatcagatcgtttattgaatcttgaagatacacttcataaacgtgtcattggacaaaacgatgctgtcaattcaattagtaaagctgttagaagagctcgtgctggtcttaaagatccaaaacgtccaatcggtagttttattttcttaggacctacaggtgtgggtaaaactgaattggctcgtgctttagctgaatctatgtttggtgaagacgatgcaatgattcgcgtagatatgagtgaatttatggagaaacatgctgtcagtcgattagttggtgcacctccaggatatgtaggacatgatgacggcggtcaattgactgaaaaagttagacgtaaaccatactctgtgattttatttgatgaaattgagaaagcacatcctgacgtatttaatattcttctacaagttttagatgatggtcatttaacagatactaaaggtcgtactgtggacttccgtaatactgtgattattatgacttctaatgtgggagctcaagaattacaggaccaacgctttgctggttttggaggtgcttcagaaggtagtgactacgaaactgtcagaaaaacaatgatgaaagaattaaaaaattcattccgaccagaattcttaaaccgtgttgatgacattattgtcttccacaaacttacaaaagatgaattaaaagaaattgttacaatgatggtaaataaacttactcaccgtctttcagagcaaaatattaatattgttgttactgataaagcgaaagaaaaaattgcagaagaaggatatgatcctgaatatggtgctagaccactcattagagcaattcaaaaaacggttgaagataatttaagcgaattgattttagatggaaataaaattgaaggtaaagaagtaacaattgatcatgatggtaaagaatttaagtatgatattcatgaaattacagctaaaaaagaaacaacagaatcataa

SEQ ID NO: 1245 - DNA, 1164 bp, Staphylococcus epidermidis
tggaggttacatacaatgaaaaactctagattttctgggttccaatgggctatgatggtctttgtatttttcgttatcacaatggcattgtccgtgatactcagagattttcaagcgactatcggagtgaaacgttttgtctttagtattaaagatttagctcctttcatagctgcaattgtgtgcatattagtatttaagcacagaaaagaacaattagcaggattgaaattttctatcagtttaaaagtgattgagcgtctacttttagcactcattctaccacttatcattttaatgattggcttgtttagctttaatacttatgctgatagtttcatcctattacaaacttcagatttatcagtatcattattaactatattaattggtcatattttaatggcttttgtagtggagtttggtttccgttcttacttacaaaatattcttgaaacaagaatgaacacattttttgcgagtattgtcgttggtcttatttattcagtatttacagctaacacgacatatggtgtagaatacgccggataccatttcttatatacattcatgttttcaatgattattggtgaattaattagagctactaatggtcgtacaatttatattgcaactgcttttcacgcatccatgacttttgctctcgtctttttatttagtgaagaaacaggcgaccttttctcaatgaaagtcatcgcactttctacaacaattgtgggtgtttcatttattattattagtctaatcattcgtgctattgtttataaaacgacgaaacaaagtttagacgaagttgatcctaataattatttatctcatattcaagatgaagaaccaagtcaagaagacgcctcttcaacttcaaatcatgatgtatcatctaaagatgaaacaaagcaacaagatattgataatgacaaacatcaatcaaagaaacctaataagagtgacgatgcacttactacttctaattataaagaagacgcctcttcagttaataaagaaacggatacaactcacaatgataacattaaagatcattcaacttataccgaagatagacactcatctgttgtcaacgatgttaaagatgaaattcacgaagttgaagatcataaagccgacacagataaatcacattaa

SEQ ID NO: 1246 - DNA, 687 bp, Staphylococcus epidermidis
gagcgtaaacatatgattaattgcttaatcgtagacgatgataaaaagttattgcaatatgtttcaagtcatttagaaagagaaagtattcaaacacatactttcacaagtggagaagcatcactagattttcttgaaaataaaaatgttgatattgcgatagtagatattatgatgagtggaatggatggttttgagctttgtcagactttgaaagatgattatcatattcctgtcataatgttaacagctagagatgcattaagtgataaagaacgtgcatttctaagtgggactgacgattatgtcactaaaccttttgaggttaaagaattattatttagaattaaagctgtcttaagacgatatcaaattaatgctgataacgagttacaacttggcaacttaatattaaatcagtcttacatggaaattactgtgggttcaaaaacgatgaatcttccaaacaaagaatttcagttgttatttttattagcctctaatcctaaacatattttcactcgagatgatattattgaaaaaatttggggcttcgattatgaaggagatgatcgtactgttgatgttcatattaaaagattacgtcaacgtttatctaaattgaaatcatcagtatcaattcaaactgtaagaggtcaaggatatagggtggaccaaaatgtttaa

SEQ ID NO: 1247 - DNA, 1221 bp, Staphylococcus epidermidis
agaaatatgcatattgtgattgggatattaggaatcattttctttttagcactcgcagttttatttagttcagacagaaaaaatattcgctggcgatatgttggattgctattagtaattcaactaatatttgcatttatattacttaaaactaatttgggaatttcagttattgggagtatttcagatggttttaattatttattagctaaagcagcggtcggtgtcaattttgtatttggtggctttaaatttattgatcctaaacaaccaccattcttctttagcgttttgttacctattgtttttatttcagcattgattggtatattacaatatacacgaatacttccactaattattaacttactgggatttttaatttcaaaaattaatggaatgggccgtttagaatcttacaatgcggtcgcggcagcaattctaggacaatctgaagtctttatctcattaaaaaaacaattaccttacatacctaaacaacgcttatatacattaactgcttcagcgatgtcaacggtatcagcatcaattataggcgcttattttacacttattgaaccaaaatatgttgttactgcagtagtgcttaacttgtttggtggttttatcattgcatctatcattaatccttataaagtcaatgaggaagacgacaaattattaattgatgagaacgaaacaaaaaaacaatctttctttgaaatgcttggggagtatatactagatggatttaaagtagcagttattgtaggcgctatgctgataggttatattgcaattattgctttattaaatggaatggtgagtggaatcttaagctttatgtctggcggtgctattcaatggaacttccaaacgcttattggatttatttttgcacctttcgctttcctaactggaataccgtggcaagatgcagttcaatctggttcagtaatggctacaaaattactatctaatgaatttgtagcaatgcaagatttaggtaaagcgactggattatcggaacatgctaaaggaattacctctgtcttcttagtatcattcgcaaactttagttcaattggtattatttcaggagctattaaatcattgaatgatgaaaaaggtgacgttgttgctcgtttcggaataaaattattatttggtgcaacacttgtttcgtttatatcagcggctattgcaggattctttatctaa

SEQ ID NO: 1248 - DNA, 711 bp, Staphylococcus epidermidis
agaggagagcaacgacacatgaaagatgcaaaagagctaaaattgatgaccttagaagatgtacttagtcaaattgaaaatggtatgacaatcggaataggaacagggagcacaattgaattattaattccccaaattgctgaattaattcagcaaaagaattatacaattaccggcgtctgtacttctaataaaacagcatttttagctaaagaattagctatgaatatagttgatgtaaatgatgttgagaaaatcgacttagcaatagatggcgctgatgaagtagacagtgcgcttaaccttattaaaggcggtggtggagccttatttagggaaaaggtcatagatgaaatggctgaccgatttgtcgttgttgtagatgaaagtaaactcgtcaactatttaggagaaacatttgcattaccagttgaagtcgataaatttaattggtaccaagttgccaaaaaaattgagcgtacttatgatattcatgtaagcagaagagttaatgaagatgtaccgtttataaccgacaatggtaattacatattagattgttcattgcaaaatagaattcctgcttatgagctacacgaatttttaattcatttaactggcgttcttgaaacaggatatttcctcgatattgccgatcaagtaatagtaggaacacaagaaggcgtaaaaatattaaataaagaaacttag

SEQ ID NO: 1249 - DNA, 438 bp, Staphylococcus epidermidis
aaaacggagcaaaatttttatatgaaaggaggggtgttggttttaaaaataatgtctaaacatagtgctacgttagttattatgtttttaataactttattgcctatttttcaatatcaagcttctgcacatgcgactttagaaaaatcaacaccacaacagcaaggggttattaaagacaaaccagaagcaatcaagttagagtttaatgaacctgtgaacaccaaatactcgagtgtgaccttatttgatgataaaggtaaaaagattaaagaccttaaaccaataacaactggatggtctcagacagttgtattttcatctgagcaaattgttaatggcacgaatactattgaatggcatacggtatctgcggatggacatgaagtcggagatacgtttgaattttcagttggaaaagtgaggctaaagatgtag

SEQ ID NO: 1250 - DNA, 405 bp, Staphylococcus epidermidis
ataatgactaagattcactttgaagcacccagtcccgaagattactgtaatttaagagctaatgctggaatgagtagtaaatcgattgaagcggcaataaaggggcttcctcatgcatgttttaatgtgaccctttatgagaatgatatgttgattggtatggggcgagtgattggggatggtggtacagttttccaaatcgtcgatattgctgtgaaagatatatatcaaggtttgggtcatggaatgacaattatgcatgaaataatgaagtatattgagagtgttgctgaagaaggtacatatgtgagcttgatagcagattatccggcagatcaattatacgagaagtttgggtttaaaagtactgagccttattcaaaaggtatgtatatcaaatattaa

SEQ ID NO: 1251 - DNA, 201 bp, Staphylococcus epidermidis
acaaaatataaatgcttgcctcaatcaataacacagaaaacaaaaattaacatacaatcttacattttcggagttcagcacaaatcagttattgaactaactttattacaaattggaggactcaatgaatatgataagattgtatgtcattcatgtctttacaactctaatatgtattgtttgtgtaacttaatcacttaa

SEQ ID NO: 1252 - DNA, 186 bp, Staphylococcus epidermidis
atgaaatataaaacaactttcaaaataaaacctccttttaccccagctaaagacctagctattttttcaaaaattattactaaaacactaagtaaacttttgcttaaaaaattagttaatgtcttacatcaattagataaattgatattaacgtttataacaaaattgaatttaaacaaaatataa

SEQ ID NO: 1253 - DNA, 216 bp, Staphylococcus epidermidis
gtaaatagtaatacaaatgacaccccttgtatcaacatgggtaatacaaaacggggtgttttaaaaagttctttgaaattaattagcatcgtacctatgttactactttcccttaggctcttttcaagcgactcaggaactttaaataaagttcctattaacatgacaatcccaaacattgttagtattacaaatacaattcgccatggcccataa

SEQ ID NO: 1254 - DNA, 1614 bp, Staphylococcus epidermidis
ggagagttcaatatgttagtagaatcttttaatccatttggtaatttactattatcatctttaattgcggcaatccctatcattttatttttactgtgtcttacagtatttaaaatgaaaggaatttatgctgctatcacaacccttgtggttacattattaattgcaattccattctttaaattaccagtaggaattgcctctggagcagttgttgaaggtttcttccaaggtatcttcccaatcggatatattgttattatggcagtattattatataagattactttgaaatcggggcaattcgcaactattcaagacagtattacaagtatttcacaagaccaaagaattcagcttcttttaattggtttttcatttaatgcattcttagaaggcgctgcaggatttggtgttccaattgcaatttgtgcacttttattagcgcaacttggctttagaccattacaagcagctatgttatgtttagtagctaacgctgcatctggtgcatttggtgcaattggtattccggttggtgttgtaaatacacttaacttacctggtcatgtagaagcgatgggagtttcacaaacatcaacattaactttagcaattattaacttctttattcctttcttacttatctttatcgtagatggtttcaaaggaattaaagaaactttaccttcaattcttgttgtttctgtcacttatacagttttacaaggattacttacagtgtttaatggtccagaattagctgatatcattccatcacttgcttctatgttagcattagctttattctctaagaaattccaacctaagaatatctttagagttcaaaaagatgttaaaccagaagcaccgaaaaaacttaaaggtaaagaaatcttatttgcttggagtccattcattatcttaactgtcattgttatgatttggagtgcaccttcatttaaagcattatttgcaccaaaaggtaaattatctgctttagttgcaaactttgacttacctggtactttcagtaatatttcacacaaaccaattactttatcattaaacttaattggtcaaacaggtacagcaattctaattacaattattattactgttttaatggctaaaaaagtcaactttggtgatgctggtcgcttatttgttgaagcatttaaagaattatggttaccaatcataacaatttgtttcatcttagcaatttcaaaaatcacaacatatggtggtttaagtaatgctatgggacaaggcatctcaaaagcaggaagcgtattcccaatattatcaccaatccttggttggatcggcgtatttatgactggttcagttgttaataacaactctttattcgcgccaattcaagcttctgtagcacaacaaattggtacaagtggttcactacttgtagcttcaaatacagcaggtggggttgcggcgaaacttatttctccacaatctattgccattgcaacagcagctgttaaagaagtaggtaaagaatctgaactacttaaaatgacattacgttatagtattggattacttgtatttatctgtatctggacatttatcttgtcattcattctgtaa

SEQ ID NO: 1255 - DNA, 225 bp, Staphylococcus epidermidis
aacaatcccaacaaacttgaagaactacctttggcccctttactctcatccattgctatcgaaaatcctaacgttgcaatccctgtaactggtgccactaaaatcacaaagccacaagaaagtatccaaaaagtccaatggttgagtaaagttagtgatacgattataacaccaataacttgtatagtagacatgattctcagcaacagtaatctatctatatag

SEQ ID NO: 1256 - DNA, 645 bp, Staphylococcus epidermidis
agatgtgtaaataaaaaatacaccaacatttttaataattgtgttggtttacagtttatttatttaaattttctttttgatttaggtgaatatatgaaacaacgtgcgaaatataaaataataaaaagtttaatcgaacttttagaatactatccttttgatgaaataaccattaaaatgatatgtgcatatagtggcgtgaatcgctctactttttatgatcattttcaagataaatatcaattactagataagatccaaaattatcatttaaacaaatatatatctttactacaatctttctataacgattttcatcatattaaaacagatcaaaaaaaattatataaatttttcttattgatagccaaatatattaaacgtaaagaagcgttctacagagcaacacttgtaacatatcctaataaagatattgcattagattacattaacgccactaaaacatgttatgaaaaagtcatgaatagatatgaaacctcaataaataataaacgtatgtttatcatttattcagtcggtggtcaagcaggtgtatttatcgattggttacgtaatggatgcatcgaatctcctcaagaggtcgctcaagttcttttagctaatacaattaaattacaacgataa

SEQ ID NO: 1257 - DNA, 696 bp, Staphylococcus epidermidis
atggctaaaaaaggtaaaaagtatcaagaagcagctagtaaagttgaccgcactcaatactatagtgttgaagaagcaatcaaattagctaaagaaactagcgttgctaatttcgacgcttctgttgaagttgcattccgtttaggaattgatacacgtaaaaatgaccaacaaatccgtggtgcagtagtattaccacacggtactggtaaatcacaacgtgtactcgttttcgctaaaggcgataaaatcactgaagctgaagaagcaggtgcagattatgtaggtgaagcagattacgtacaaaaaatccaacaaggttggtttgatttcgacgtagttgtagctacacctgatatgatgggtgaagttggtaaacttggtcgagtattaggacctaaaggtttaatgcctaaccctaaaactggcactgtaacaatggatgttaaaaaagcagttgaagaaatcaaagctggtaaggtagaataccgtgctgaaaaagcaggtattgtacatgcgtcaattggtaaagtgtcattcgatgaagaaaaattagttgataacttcagaactttacaagatgtattagcgaaagctaaaccagcttctgctaagggtacttacttcaaatctgttgctgttacaacaacaatgggtcctggagtaaaagttgatacttcatctttcaaactataa

SEQ ID NO: 1258 - DNA, 561 bp, Staphylococcus epidermidis
atgaataaaaatgattatttaaaagaacttaaaaagcatttgaaacatatgaataaagaagaaaaagaagatattttgaatgaatacgatacgcatttttatagcggacagcaagagggaaagtctgaatcagacgtgtgtaaagaattaggtaatccaaaattaataggtaaggaacttacagctacttccagtgtagaaaatgcacatcaaaaagtgtcgttaatgaatatttcatccgcaattgtagcagtaatggggctaagtttgcttaacttttttattgttataataccagcttttttatgcattttgctcgtattaaccttcatcatttttactctagcttcactagctgcaccattgatgttgctcattaaaggaattatggatggttttcattccattatcttatatgacgcatttatgactggtttaatgtttggtgttggactcgtacttgcagtggtgacttactatctcattaagtggctatttgatgtgactatgaaatatctaaaatggaatatctctattgtcaaaggaagtgtacaatcatga

SEQ ID NO: 1259 - DNA, 963 bp, Staphylococcus epidermidis
ctgataaaaaatcaagggggatatatcatgtatcaacttgcacaatctaatctatggacaggtcgtttagatagtgaaactgatcctacacaatttagacacttccaaactgttaaattcggtgatttaagtcaattagatttttcggatgaacacaaaggcgtgggcttattaggatatgcaattgataaaggagtagaattaaacaaaggacgtgtaggtgcaaaagaaggtcccaatgccattaagcgagcttttgctggattgccagatttgaatcaatgtgaagagattatagattatggtaatgtagaacacaatcatgagttgctaatagatacacagcgcgaattcgcagatcttgctgctaagtctatcaaacgacataaacaaacatttttacttggtggcggtcatgatatagcatatgcacaatatttagctactcgtaaagtttatcctgagtcgtcaataggtgtgattaatatagatgcgcactttgacacacgcgatgagggttattcaacctctggtactagttttagacagattctagaagaagatgataatgcagattatttagtgttaggtatatctcaaggtggtaatacacaagctttatttaattatgctaaagaaaaagatattcaatttgtatatgcagatgaattactacatcaggtatctccccccattaaagatatgatagaacgttttatccataatcatgatacggttatgttcacaatttgcatggatgtagtagatagtgcatttgcaccaggagtcagtgcaccagctgtcctaggaatatatccacatacagttttcgaacttgctaaacgggtcattccaagtgaaaaagtaaaatctataagtatagctgaaatgaatccgacgtatgattcagatcaaagaactgctaaattagttgctaatttagtacatcattgtttaatttaa

SEQ ID NO: 1260 - DNA, 903 bp, Staphylococcus epidermidis
ttaatgaaaaatagaatgatgaatcgcgtggttaataaatatatacttcacaatagatcgatattttttagtaatgatgatgaagttaaacattttttagaaaagagaagtatcgaaaatagtaaaaaacatcagcaacctgcgacacttaatgtaaagtcaaatttagataaacttactcttaatgatatgcaagtgtttagatttaattttagacatgagaaaaatcaaaagatactctatctgcatggtggatataatactttgcaaccttctccatttcattggagacttttagataaactaactttaaatacattgcatgaggtcgttttacctatctatccaaagtcaccagattatcactacttagaaacgttcaaagcgattcgtgacgtttataatcaattagttgaagaagttggtgcgaacaacattgttatgatgggggatggttctggtggaggactagcattaagttttgttcaatcacttatcaatgataatcaagaagtgcctagaaagttatttttactttcaccgcttttagatgccactttgactaatcctaatattacgaaaacgttggaagaaaatgatatcttagttagtcgatttggtgttcatcaactcatgaaatcttggacgaatgatttacctttatcagacgcgcgtatatcaccattatacggtactctaaaagggttgccacctatatatatgtatggaggtggcagagaaatattaagcccagacatgcatgcatttactcatgctctagaggaatgtgggaacgatgttgagtttaaagagtatcctaaaatggtgcatgattttcctatctatcccatacgccaatctcacaaggtgttaaaacacatcactaaatcaatcttagagtaa

SEQ ID NO: 1261 - DNA, 579 bp, Staphylococcus epidermidis
gtgaggtgtttaaaattgctttgtgaaaattgccattttaatgaagcggaagttaaacttactgttaaaggtatagatagtacgcatgaaaaatgggtatgttcagtatgtgcccaaggagaaaacccctggttacattctaacgatgataatacgtatcatacacaccaagacgatatagaagaagcatttgtagtgaaacagatacttcaacaccttgctgcaaaacatggtattaattttcatgagatggcatttaaagaagaaaaaaaatgcccaacgtgtcagatgacacttaaggatattgcacatgttggtaagcttgggtgtgctgattgttatgctacgtttaaagaagacatcattgatatagttcaacgtgttcaaggtggtcaatttgaacatgtaggaaaaacaccacaatcatcgtataagaaacttgcaataaaaaagcaaattgaagaaaaatcaaaatatctaaataaattgatagatggtcaagagtttgaagaggcagcgattgttcgtgatgaaattaaagctttaaaaagtgagagcgaggtgtctcatgatgagtaa

SEQ ID NO: 1262 - DNA, 618 bp, Staphylococcus epidermidis
ttgatagtgaaaaaaataaaagctgaaacactttcagatatgcaaaattataaattacttagtggaagtattatacctaggccgatagcatttgtaactactcaaaatttaaaaggggatatcaacgcagccccgtttagtttttttaatgtagttaatcatacaccacctatgattgcaattgctgttcaacgtacaaagggaaatagaaaagacacctcaataaatatagaacaatcaggtgagtttgtagtgcatattactgatgaggctattgttaatgatgtgaatgaaactgctgccccgttagaatatggtgttaatgaacttaaaagaacctctctaagtatgattgattcagatttaattaaagttccagcaatcaaagaagcaaaagtaaggtttgagtgtaagcttcatcaaatagtacaattgggcaacaaagataacgggagtgatttgataattggtgaaattgtcgtgtaccatatcgatgaagaagtttattttgaagatagtaaaattgatgcaaatcaattaaatccggtagctaggttagctggaaatgattactctttgttaggtcaaacatttacggttaatcggcctacctcataa

SEQ ID NO: 1263 - DNA, 723 bp, Staphylococcus epidermidis
tattatgccctttttaatattttaattgaaattcaattcaacatgataaagagacaaagtaggaggcggtttcaaatgaaaaaagtattagcaagtgcaacgattttatcattaatgttagtaggttgttccaatggtggaaatgatgaatcaagtcataaagatgatagttctaaaacagaacaaaaggataaatcatcatctcaacatgactcaaaaaaagattcgaaacgtaatgatacaaataataagcaagacaatcaggaaaataacactaataaagaacaaacaaataatcaaaatccaaatgatggagaacaacgaacaagcgaaagaccaacaacaaattcaaacggaaattcatcggataatcaaaataaacaacagcaatcagtacaagataaccagaataaatatgtagcaccataccaaagtgaaaatgcgacacgtgttgctcgatgtctttctccatttgagggcgaccgcagtcaagctttgcaacaattaccaaattttgaaactgcactttccattgctaaaaacgaagctaatatgtatggaagcgaaaataaatcatataatgattattcaatagaacaaacagaagatggatttagatatgtgtttagctttaaagatccatcaaaaagtaatacttactcaattgtaacgcttaatcgacaaggtcaacctactgttgtagatcctaacttccaaccttaa

SEQ ID NO: 1264 - DNA, 1080 bp, Staphylococcus epidermidis
catataaagaaatgggagaggatatcaatgaatctagcttggaaagagattaaattttataagttcagatttatattaatcatgttcattatttttctaatggcgattatggttttatttatcagtggacttgctcaaggcctagcacgagaaaatatatcaatatttgatcaaattaaaggtaatcaatttgttgttcaaaaaatgaaagaaccacaattagaaaaatctattctatcacgaagtaaacaagacaatatttcaaaaattattgatgaaaaaccttttaaaatggcaggtaaaactttcaaaatcaatggaaacgaagaaaacgtgatggctataaatagcgtgaaaaatcatcagccaaatttgaaatctggtcattatcctaaaaatggaaatcagatagcaataaatgaaaaactaactgcagaaggtctttatttagacgataaagttaaagtcaaaggtgacgatacaacttataaagttgtaggtatattaaaaaacacgatgtattctcatagtaacattgttatgatggaccaatccaaaatagaacaaagtagtaatgtcgcaacattttatgttacgaaccaattatctaaatcggataaaaataaaataaatcacatcaaaggcgttcaaacagcaactacagacaatataacaagtaatatcgcaagttataaagcagagcaaacaccattggatatgatgattattagtttatatattataactgcaattgtattgagtgcattcttttatgtaatgacgatacaaaagacatctgaaatcggtattttaaaagcaattggtataactacaaagcacttattgacatcattgattttacaaatttcaatgattacatttataggtgtagctatagcagaagtagttattttgctcatcagtcaaattttacctgtatctatgccattccatatagatatgcataatataatcattgtacttgtcatatttatgatagttggattaatcggtacatcattatcatttattaagttaattaaaattgatcctattgaagctattggaggtggccaataa

SEQ ID NO: 1265 - DNA, 1137 bp, Staphylococcus epidermidis
gaaagggctgagcgatatatgacaaattattctacttatgtagattggagaagaacgtttcatcaatatcctgaactttcagatgaagaatatgaaactacagacaagttacgaaaaatactcaaaagttatggtatacgtatactggaggtacctttaaaaacaggtttagtagcagaaattgggcaaggagaggaaatgatagcagtaagaacagatattgatgctttgcctatagaagaacaagtgaagcatgaatttacatcaaagtatcaaggtgcaatgcatgcatgtggtcatgatattcatatggcaagtatattagctactggtattcaactaaaagagattgaagatgaattaaatggacgcgttcgattaatatttcaacctgctgaagaattaggacatggtgcatttgaaatcataaatactggagtacttaaaggagctaaagcagtacttggttttcataattatcccactttaaaagttggtgaatttgctattaaatcgggtgcaattacctctgctgtcgatcgttttgagtttaatgttaaaggtaaaggtgcgcatgctgcaaaacctgagcaaggaaatgatccagtcatcgtcgtaggacaacttatcaatagtttacaaactattgtgagtcgaaatttatcagcttttgatagtgcagttgtaacaatcggtgaaatttcttgtggtaacacatggaatgttatagctgacaaagcttatatacagggcactgttcgttcattcgatgaggatatacgtcattatattgaaaataggatgaaaaatattgctgatggtttaagtcgtgtttttaatgtggatattgatttaacttattcaagactacctggtgcagtagtaaatgatgcacatctaacacaagaagcaatcgaggtcgctaaaaatgttggctatcatgtatcaatgctcgatgaaccggttactattggagaggatttttcaggttatacagaagaataccccggtgttttcgcatttattggctccgacagtaaatatgatttacatcatcctaaatatcatccagatgagcgtattttggaaaaagttcctcaatatttcgttcagctcgttcaacgtttattgacataa

SEQ ID NO: 1266 - DNA, 861 bp, Staphylococcus epidermidis
tgtgactatgaaatatctaaaatggaatatctctattgtcaaaggaagtgtacaatcatgaaaaaaattgcagcgataatatttttaataggcttgtcactaattattatttgtagcgtgggagtttatgcacaaaataaaaaattgagtaaagacaatcaatataataatcaaacaacaaatttaatgaaaaactatgatgataatactgtgaaaagtatttacattgatggaaaagtaagtgatataactgtgaaaaaaggtaaacatttttcggttaagtccaaagggaatgacaaaaatttaaacgtaactagcaaggtgaacaatcaacgttgggtaattacagagcgtcaaacaagtccacatattaattttagaatacaaggtaaagttagtaatcacattacgattacagtacctaaatatattaaaaacatagatattaaaactaatgccggggatttaaatattgttggagtaaatagtggcacaggaagatttgatgctgaatctggagacattaaagttcaaaaaggacgatataaaaaggtgacacttcataatgaggatggggatattcatacgaaagatattcattttaatcaagctaatattcaaaatgacaatggggatattcaaatgaaacaattagaccctgatattcctttacgtattaaaaatgaagaaggggatataaacttgaattataaaaaagaacttcatcacacccaaatcatcactcgtaatgaagaaggggaaacagacatcgatcatcgtgtgttatataatagtaaagttgaaaatggaaataataaagtgaaattaatcaatgaaaatggagatattaaagtaaaataa

SEQ ID NO: 1267 - DNA, 1194 bp, Staphylococcus epidermidis
tgttataatgacttaaatatcatagaaaacaatgaggtgttttacgcaatgaagtcgttcacattttttatgcataatatttatgcaatgggcggaacggtaaagtcggtgacacaacttgcaaatacactggcagaaaaaggacatcctgtaacaattatttcagtttttagaggcgcagactctccatattttgaattacattcagcaataaaagttaaagtcgtagtggactatcgcttaaagcttaaaaatactagagctattacggcaaatcgtatcaaaaagtataccccctttttaaatacaaaagtgatttctcaatttgagccaggtaaaagtcagttttcgagttatgtagagaaaaaaatgattaaagcaatcaggcatactaaaactgatgtactcgttggaacaagagctagctttaatattctcatttctaaatatgctaaagctgaaatagtgaccatcgcaatggaacatatgaattttgatgctcaccctgatcagtatcaaaaggaaattattgctgcgtaccgtaatatcaataagattacaacgttaactgtcgcagaccagcaaaaatatcaatcacaacttaaaactcctgtatacgttatacctaatatggttaccgaaaaaagaattgctgctccaaagaaaaatcgtattattagcgccggacgtttagaatatgaaaaagggtatgatttattattagagagtattcgtttaatacaagaagacttgcgtcaattgaattatgacgttcacatctatggttctggtagtaagaaaacatcacttgttgactttattaatcaatatcatttaaatgatttgattaaaatatatgagccaacgcaagaattaaataataaacttgcacaaagtaaaatcgttgttgtaccttcacgcaatgaaggtttcggaatgattattttagaggcaatggtgcaagataatatagtaataagttttgaaggcaatgtagggccagattcaatcattaacaacggagataatggttatttagtaaactatgaaaatgtgtctgaacttgcaaaacgtatcgatttaacaacacaacattataatgagttagatcacatcattgaaaatagtaaagatacgttgaaacaatttagtccggatcatatatatcaattatttatgtctatgtttaaataa

SEQ ID NO: 1268 - DNA, 564 bp, Staphylococcus epidermidis
gttaggagtgaagacatgtctgaagaagtaggcgctaagcgttggtatgctgtacatacctattctggatatgaaaataaagttaaaaagaatttagaaaaaagagtagaatctatgaatatgactgaacaaattttcagagttgtcataccagaagaggaagaaactcaagttaaggatgggaaagctaaaaagcttgtgaagaaaacatttcctggatatgtattagttgagttaatcatgacagatgagtcgtggtatgtagttagaaatactcctggagtaacaggatttgtcggatctgcaggtgcaggatcaaaacctaaccctctacttcctgaagaagtacgcttcattcttaagcaaatgggtcttaaagagaaaacaatagatgttgaactcgatgttggagaacaagttcgtatccaatcaggtccttttgctaatcaaattggagaagtacaagagattgaagcggataaattcaagcttactgtacttgttgatatgtttggtcgtgaaacacctgtagaagttgaatttgaccaaattgaaaaattataa

SEQ ID NO: 1269 - DNA, 210 bp, Staphylococcus epidermidis
aaagtcatagagtgtggaggtcttatgatggctaaaaaagaaagtttctttaaaggcgttaagtcagaaatggaaaagacgagttggccaactaaggaagaattatttaaatatacaataatagttgtatcaacagtgatattcttcttagtctttttctatgccttagacataggaattaatgcattaaaacaattatttttaggttag

SEQ ID NO: 1270 - DNA, 1383 bp, Staphylococcus epidermidis
gaggtcaaggatatagggtggaccaaaatgtttaaaacattatattcgagaattgctatatatgcaattacagtcattttgtttagtgcattaatgagttttctttttacgaatatttattatcactttcatttgaaagcttctaatgatgcaaaaattatgcgcacactcaaagaagctcgtgaatatgaaagaacacaaaaacctaaacctctagatacgtatttgaaacatttaggtcaaatgaattatcaaattatgactgtcaacgaacatggaaccaaacatttttatggggaaacttttcgtaaaaatactataagtcagtctgcaatcaaaaaagtgctcaacggtgaagattatcatggtattaaaaataaaccttatgcattttttgtaacagggttcttcgataatgaaacggataatacagtaggtattcaatttaaaacagatgatggggcattagcagtttttatgcgcccagatatcggggaaacttttagcgaatttagaattttcttagctgtgttgataacacttttacttattatttcaatttcactagtcattgcatcaacatattctattattaaaccagtgaccgcattaaaaaatgcaacaactcgaattatgaaaggtgatttcagtacgcctatcaaacaaacacgtcacgatgaaatcggaacactgcaatcacgtttcaatacaatgcgtcaaaatttaggacaagtagatcaaatgagacaacattttgtccaaaatgtatctcatgaagttaaaacaccgcttacacatttacaacgattgcttacacaacttgaattgacgcaaaatgaagaagagaaacaactatgtatcaatgaaatgtttgaaatcactaatcaagtaagtgaactaactaaggaattgctacttttatctgaattagataatgcttcccaccttacttttaacgataatgttcatttaaatactttaataaaggatattattagacatgaacaatttcgaactgatgaaaaagatttagttatgtttactgaattagaagatttgtatttccgaggaaatgaaagactattacatcaagctttcaataacctcatcattaatgcaatgaattatgctcctcaaaatagcatgattaatatcactctaactagtacaaatcacttgattatatttaatattgaaaatgatggatcgattgcagaagaagatgcgaaacatatcttcgatcgtttttataaactgagtgacgaatctagtagtaatggtctaggtctagccattacccaatcaatcattcatcttcatcatggtagcattactctcacttcagatgataaaacacaatttattgtaaaactatttatttag

SEQ ID NO: 1271 - DNA, 660 bp, Staphylococcus epidermidis
actgagggggagacgttcgtgttaaaaagaatgagagacgatataaagatggtgtttgaacaggatcctgcagcgcgctcgactttagaagtaataactacttacgctggattacatgcagtttggagtcacttaattgcccataaattatataaaaatagacgctatgtagcagccagaatgatttctcaactatcacgtttttttaccggaattgaaatacatccaggtgcaaaaatcggtaagcgtttatttatcgaccatggcatgggtgtagttattggagaaacatgtacaattggtgataatgttactatttatcaaggagttactttaggtggtacaggcaaagaaaaaggaaaacgccatcctgatattggtgataatgttttgatagcagctggatctaagatattaggtaatataaaaattgaatcaaatgtgaatattggagctaattccgtagtattacagtctgttcctagttatacaactgtagtaggtataccaggtcacattgttaaacaagaaggtagacgtattggtaaaacatttgatcaccgtaacttacctgatccactttacgaacaaattaaacacttagaaagacagcttgaaaaagctaagaatggagagattcaagatgattacattatataa

SEQ ID NO: 1272 - DNA, 879 bp, Staphylococcus epidermidis
attttcagttggaaaagtgaggctaaagatgtagatacatcttcacctttttatgaaaagtctaaattttggtttggattattaagatatgttactgaaggtgcaaactttctacttattggcttgttttggttaaatggtattgctaggaaacgaggattaagacaatttaatgtgttacccaagcaatcaggaattgcatggattatggctatgtcattactcgtgagtcttgtggtttatatgatgacactcacatctgatatattagaagatattctatcatttaaattagaagtgataatgcaatttccgtatatattaagctctatttcactaatcattttgtttatacttttcattttaaaagatatggaaaaaatatggtactggctcatttcaatagttatgattgctgtgataagtatgtctggacacgtgtggtcacaacaagtgccattatggtcaattatcataagaacaattcatcttatagggctaacgttatggttaggttcactcgtttatctcatttgttatgctattaaagtgaaaattaatcagttgacgagtgtaagacgtatgcttttaaaagttaatatcattgctgtgattatgctcgtttttacagggattttaatggctattgatgaaacgaatactttaacactttggaataatgtgagcgcttggtctatttatcttgtcataaaaatcgcaggaattattgctatgatgctattaggtttctatcaaacgatgcgtgctttgagacaacgacaacaggtccatcgttttgcactgatgactgaattgttaattggtatgatattaatttttgcaggtatcatgatgagtcaaataaatatacctagttga

SEQ ID NO: 1273 - DNA, 507 bp, Staphylococcus epidermidis
cgctcatttcgtcacgaaatgtttaagagtgggagggcaaaactaagccctgtgaccacatcacgatatcaaggagtgcacatcgtggctaaaaaagtagaaaaagtagttaaattgcaaattcctgcaggtaaagcgaatccagcaccaccagttggtccagcattaggtcaagcaggtgtgaacattatgggattctgtaaagaattcaatgctcgtacgcaagaacaagcaggtttaatcattccggtagaaatcagtgtttatgaagaccgttcatttacattcattacaaaaactccgccggctccagtactacttaaaaaagcagctggtgttgaaaaaggttctggtgaacctaataaaactaaagttgcaacagtaactaaagatcaagtacgcgaaattgctcaaacaaaaatgcaagacttaaatgctgcagacgaagaagcggcaatgcgtattattgaaggtactgcacgtagcatgggtatcactgtacaataa

SEQ ID NO: 1274 - DNA, 228 bp, Staphylococcus epidermidis
catttgttgctagaggcgctctcgcacggttccactcttcatttaatagcaatactcatatttgatttattactattctcatctcaattatttatttttattaacaaaggtgcattcattaatatttatgatgtgctcacagctaccgcacactctctgacacataaacatttaactactaatcctttgaatcactttatatttataatcatatgttgtcacttgtaa

SEQ ID NO: 1275 - DNA, 540 bp, Staphylococcus epidermidis
atgggggaaaggataagaagtgttcaaataactgaggtagagcaactacaactaattgctaaaagaacattttttacaacgtttagagaatcttatagtgatgaggacttcaagcaattttttagtgatgcatatgatatagatgtgttgagaaaagaattggaacaaagtaattcttttcattatttttatgaagttgatcaaaatatagtaggtttcttgaaattgaacattaatgatgctcagactgaaaacaaaggtcatgcatatttggaaatacaacgcatttactttgatgaagcatttcaagggagtggaagaggacaattatttatcaatctagctattgatcaagctatcaaatttgggaaatcgaaaatatggcttggtgtttgggagcataatcctaaagcgcttagcttttataaaaacagaggatttagagttacagggtcgcatcaattttatactggaagtgtagtagataatgatttgattatggagttggatcttacaacaaactataaacaaagtttatag

SEQ ID NO: 1276 - DNA, 690 bp, Staphylococcus epidermidis
agctattggaggtggccaataatgggtttagttgttaaagatataagtaaaacttttggagaaaaaacctcaaaaacagaggtgttaaaagatattaactttgaagtgaaagatggagaattcatcattttaaatggtgcttcaggatcaggaaaaacaaccttattaactattttaggtggtttgttatctcaaacatcaggtgatgtagtatacgaggggaaatccttatttgaacgacatactaataaagcgcacttaagactaaatgatattggttttatctttcaagcctctcatttagttccatacttaaaagttttagaccaacttaccttaataggtaaagaaactggaatgtctagcaaagaagctcaagcaagagctaaagaattattaaaaaaaattggattagaagagcaacttaatagctacccacatatgctttcaggtggacaacaacaacgtgtagcgattatgagagcacttatgaatcatccgaaaattgttttagcagatgaacccacagcaagtcttgatgctagtcgtgctcaagaggttgttgaaatgatcagaaaacaaataaaagctaaccaaatgataggtatcatgattactcatgatgaaagcttgttcaaatacgctgatcgtattgttcaattgtacgatggtaaaataaaaaacagttaa

SEQ ID NO: 1277 - DNA, 732 bp, Staphylococcus epidermidis
  unsure (20),(22),(32): Identity of nucleotide at the above locations are unknown.
gtcctctttggtcacattananaacaacgagngccaaaggggctacataaagttattctaactgttttagataatttattgacgccattattatcaatttttattacagcatttataacatttttatttgtagggcctgtcactcgtcaattaggttattggttatctgatggattgacttggttatatgaatttggtggagctattggtggacttatatttggtttattatatgcgccaatcgtcattacaggaatgcaccatatctttattgcagttgaaacgacattaattgctgatgcgactaaaacaggtggttcatttatcttcccaatcgcaacgatgtcaaatattgcacaaggtggtgcagctttagctgcattctttatcattaagcaaaataaaaaattaaaaggtgttgcttccgcggcgggtatttcagctttactaggaattacagaaccagcaatgtttggtgtcaatcttaaattgagatatccatttataggtgctgttgcaggatcaggtataggtgcggcttatatttcattcttcaaagtaaaagcgatagcgcttggtacagctggattacctggatttatatctataaatcctacacacgctggttggttacattacttaataggaatgctaattgcatttgttgtttcagttgtcgtcactttagtactttctcgaagaaaaacaaataagacagctgttgaatcatag

SEQ ID NO: 1278 - DNA, 1506 bp, Staphylococcus epidermidis
ttaatatttggctatttattatccacacaattaatagtaggagtgaaaataatgagtgaacgtatcagagtaagatatgcgccaagtccaacaggatatttgcatattggtaatgcaagaacagcattattcaattatttatttgctaaacattataatggtgattttgttgttcgcatcgaagatacagatagtaaacgtaatttagaagatggtgaatcttcacaattcgataatctaaaatggttaggtttggattgggatgaatctgtcgataaagataaaggttttggaccttatcgtcaatctgaacgtgcagaaatctataatccactaattcaacagctattagaggaagacaaagcatataaatgttatatgactgaagaagagttagaagcagagcgtgaagctcaaattgctcgtggagagatgccaagatatggtggacaacatgcgcacttaacagaagaacagcgtcaacagtacgaagcggaggggcgtaaaccatcaattcgtttccgtgtgcctaaagatcaaacatatactttcaatgacatggttaaaggagaaatttcctttgaatctgacaatatcggagactgggtaattgtaaaaaaagatggtgttccgacttataattttgcagttgccgtagatgatcattatatgcaaatatcagatgttatacgtggtgatgaccatgtttcaaatacacctaagcagttaatgatatatgaagcatttggatgggaagcacctcgttttggtcatatgtcactcattgttaatgaagagcgtaaaaaattaagcaagcgagatggtcaaatcctacaatttatcgagcaatatcgtgacttaggatatcttccagaagcattatttaactttattacattgttaggttggtcacctgaaggtgaagaggaaatcttttctaaagaagaatttataaagatttttgatgaaaaacgcttgtctaagtctccagctatgttcgatagacaaaaacttgcttgggttaacaatcagtatatgaaaacaaaagatacagaaacagtattcgaacttgcattacctcatttaatcaaggctaatcttatacctgaaaacccatcagaaaaggatagagaatggggacgtaaattaatagcgttgtatcaaaaagaaatgagttacgctggtgaaattgttccattatcagaaatgttcttccatgaaatgccggaacttggaaaagatgaacaagaggtattacaaggagaacaagtgccagaactaatgaaccatttatatggtaaattagaatctttagaatcgtttgaggcaactgaaattaagaaaatgattaaagaagttcaaaaagaaactggtattaaaggtaaacaattatttatgcctattcgtgttgctgttactggacaaatgcatggtcctgaattacctaacacaattgaagtattaggcaaagataaagtattgtcacgcttaaaaaaccttgtttaa

SEQ ID NO: 1279 - DNA, 771 bp, Staphylococcus epidermidis
tggatgaaaggtagtgtgaatgtggaagatatagtgatagtaggtagacacgcagttaaagaagcaattatatcaggtcacgccataaataagattttgattcaagacggtataaaaaagcaacaaattaacgacattttaaaaaatgcaaaatcacaaaaattaattgtacaaacggtaccaaaatctaaattagattttttagcaaatgcacctcaccagggtgtggctgctttagtagccccatatgaatatgcaaacttcgatgaatttttacaaaaacaaaagaaaaaagcccgttattcaactgttatcattttagatggtttagaagacccgcataatcttggctctatattaagaacagcagatgcttctggtgttgatgcggttattatacctaaaagacgatcagttgcgctaacacagaccgttgcaaaagcttctacaggagcgattcagcatgttccggttataagggttactaatctttcgaaaactatcgacgaattaaaagacaacggcttttggattgcggggacagaagctaataatgcaacggattatagagatttacaagcagatatgtcactaggtattgtaataggtagtgaggggcaaggtatgagtcgtttagtgagtgataagtgtgattttcatattaagattccaatggttggacatgtcaatagcttgaacgcgtctgtggctgcaagtttaatgatgtatgaagtatatcgtaaacgtcatcagttagaggaaaagtcatga

SEQ ID NO: 1280 - DNA, 1431 bp, Staphylococcus epidermidis
gagattgaaggaagatttatgataaagcaaataaatatttcaaatatggacaaattaaaagagcaaatggaacgtgcacttagcgacggctatacgcatgtcatcccctattcaaatgaaattcaaattcatcagtccatgattaaagctatcactttacctaagacttcatttatagttgactatacaattaacaattattatttaaacgattgtaaatacttcgggttggactttgttgattttgaggactgggttaaaaatattaatttatatccaaatgttatttatgaaattaattcaacattagaacttattgataaatttgaagttgaaaatatctttgatttagcattattaacaattcttaaagggcatatcgcagttgaaggtcatgtcgtattagactttaaaggaccattaaaaacgagcaagggattttggcgctcatttgaccgtaatgatttaacttatagagataaattcttcttaaacaccatcgcttatgcacataaacaaagaatcccatttacgcgtgtaccatttaacgatcacgatagtattagatattatgattcagtactacttagtactaaatttaaagctccaagatggttagtgactcctattaagaattattcagttaaaaaacacaaagagattagctatatttataaaaaggattcatcaaaacttaagaaccacgtcgtttttctaggatttgatttcggctatcgaggaaactctaagtatttatttaattactttgttaaacacaatcctatgatagagtcttactttataacagatgagagaacaggaccacattttatttcaactaacgatgaaaatgtgaagaatttgattgaaacagctacttttgtcattacggaaagctatattcctgacgacattcaccctaatggtaaaatcatccaattatggcatgggacacctattaaaaaactatttttagatagtaaagagccacaccaaaatttaaatatatataactaccgagctcgaaaatataataaatggacacaacaagattatttaattgtagattcagaagaatcaaaaacatactttgaatcagcgtttcctagtcaaaaaattgatatattacctgtaggatatcctagaaataattatttattaaatcgtatcaatgatgtaggtttacataaacgtatatttagtgagataaatatagatcctactaagcgagtattattatatgcccccacctggaaaacaaattcatctgatgatgatatatttcctattaatgaacagttattaacacattataatgtgatctataaaggacacgtcgagagtaaaaatgacttggttcctgaaggcgtaataaatccgcctaataatattgaaacgcaagacttaattattatttcagatgttgtttaa

SEQ ID NO: 1281 - DNA, 183 bp, Staphylococcus epidermidis
aaattttatatgttagcacctacgttaataattatctcaatgattcatatcactgtggaacttcatatgcagcgatgtacgattgtatcaacgctgacatgtttattcatttcaactttaatcacggtatcgttgattcaaattaaacgtcttaaaaaggataacaacttaaatcaaatatga

SEQ ID NO: 1282 - DNA, 189 bp, Staphylococcus epidermidis
aaaccatccataattcctttaatgagcaacatcaatggtgcagctagtgaagctagagtaaaaatgatgaaggttaatacgagcaaaatgcataaaaaagctggtattataacaataaaaaagttaagcaaacttagccccattactgctacaattgcggatgaaatattcattaacgacactttttga

SEQ ID NO: 1283 - DNA, 345 bp, Staphylococcus epidermidis
aaagggaacattactaaaataacatggactgctacagataaaggtattggtccccatgagtttattgaatttcctattgtagtggctaatcctaaaaaggaaggcacattcaaatggaacactactcaaacttatgataatggagatgttgttaagtggactgggaaggaagatagtgcgcaccctgcaccaactacaactgtaaaaaaaggtgcaaatccaaatgacactcattctgactcgagtcaaggtgattcaatcgctttatggatagttgctatcgtggcaattgtgatttcgttgattgctctttttaaacaagcgcatccaaaaaaatttaattga

SEQ ID NO: 1284 - DNA, 1059 bp, Staphylococcus epidermidis
ggtgttttaatgagtgactcacaaagagaacagaggaaaaatgaacatgtagaaatcgcaatgtcacaaaaagatgcgctggtttcagattttgataaagtgagatttgttcatcattccatccccagtattgatgttagtcaagtcgatatgacaagtcatactacgaaattcgatttggcatatccaatctatataaatgcaatgactggtggaagtgattggacaaaacaaattaatgaaaaattagcaattgttgctagagaaactggaattgcaatggcggtgggatcaacacatgcagctttgcgcaatcctaatatgattgaaacatttagcattgtgcgtaaaacaaatcccaaaggaacaattttcagcaatgtgggtgccgatgtaccagtggataaagctctacaagcggttgaattattagatgctcaagcgctacaaattcatgtgaactcacctcaagaattagtcatgcctgaagggaaccgtgaatttgcttcatggatgtcaaatattgaatctattgttaaacgcgttgatgttccagttattattaaagaagttggtttcggaatgagtaaagaaacattacaagcgttatatgatattggtgttaactatgttgatgtcagtgggcgcggtggaactaatttcgttgatattgaaaatgaaagacgttcgaataaagatatgaattatttatctcagtggggacaatctaccgtagaatccttacttgagagtactgaatttcaagatcgattaaatatttttgctagcggtggcttacgtacaccactcgatgctgtaaaatgtttagcattaggtgcaaaagcaatagggatgtctcgaccgtttttaaatcaagtagaacaatcaggtatcacaaataccgtagactatgtagagtcttttattcaacatatgaaaaaaattatgacgatgttagatgcgccgaacattgagcgtttacgacaagcagatatcgtaatgagcccggagttaatatcatggatcaatcaacgtggccttcatttaaatagaaaataa

SEQ ID NO: 1285 - DNA, 402 bp, Staphylococcus epidermidis
aggagaataataatgtctataaaagaaaaattagtaatagagctcatgaatttaaaagacactgtaaaatacgaattgtcagaattaaatgaacaacaatatttgtttatgaacggcccagcacctcagttgatgaagcgtgccatgaaaatgagctatattctaggccaaaaagaagcgattgatcactttctattactcatcgacacttgccatgagaatgtcttactagataactgccaagactatcaaaaacaaattcaacataaacaattctctttacaagaagatattattcaccaaataaatcagtcaaaggaattcgaatcatttttatcaacttattatgtaaataaaggtaaatatgatatcaccagcaaaataaaaacattacttgaataa

SEQ ID NO: 1286 - DNA, 465 bp, Staphylococcus epidermidis
gagataaaaatggtaagaagaatagaagatcacatctcatttttagaaaaatttattaatgatgttaatacattaacggcaaagttacttaaagacttgcaaactgagtatggcatatcagctgagcaatctcatgtgttaaatatgcttagtatagaggcgttaactgtggggcaaattacagagaaacaaggtgttaataaagctgctgttagtcgaagagtcaaaaagttgctcaatgctgaattagttaaattagaaaaacctgattccaatactgaccaacgtcttaaaataattaaattatctaataaaggaaaaaaatatattaaagagagaaaagcgattatgagccatattgctagtgatatgacgagtgactttgacagtaaggaaattgaaaaagttagacaggttttagaaattatcgactatcgtatacaatcttatacttctaaactttga

SEQ ID NO: 1287 - DNA, 696 bp, Staphylococcus epidermidis
aaggtcgtgatatacatgattaaagtgaatgccatatctattggcaaaatagaaacattgtcttatggaaactataaaccaatgcaatcagcgttaaacaaaattccttttaaaggtcaaatgtggctcaatcgacttgggttcgtggacgatgaacaagcctatcataaccatggtggtatacataaagcgatatgttgttttagtaaatctaattatcaattatttaaagatgacttagatcaattacctgaatttgcaatgtttggagagaatttgacagttgaacatctagatgaagcagatgtttattttggtaatcagtatcaactaggcgatacaatcatagaagtatcagatatacgagaaccttgttggaaaattcaagctaaatatgcaatacctaatttagttcaaaaaatgtcgcaatctggtaaaactggattttattttagagttataaaagaaggatatgtacatcagagtgataatttaaaactcattaaaaaggcagaatcaaacacacgtctatctgtgaaagacttaaatcatctattctataatgagcgaaataatttaagattaatctatcatgcacttcgaaatccttatctttcacctgatcgaaagaaaaaactacagaaaatgaaaacgcgtgccgaaaatagaaaattcattaaatctgacgataaatag

SEQ ID NO: 1288 - DNA, 1416 bp, Staphylococcus epidermidis
tgtagtgagatgagtagaggtgataaaatgagtcaatgcccaaattgtggtcatcaagtgaaagatgatacatcgcaatgtccaaactgtgggcaactgttaactaagaagaaaaaaagaaagattaaagaccaatcatctcaatcgagtaatgagaattctaccaatatacgtcttcgtaaaattgtgccgataggtattagtgtatttatcttaatacttattatcgtgttatttttccttttaagaaattataattcgcctaatgcacaagctaagatattagttaatgctgtagataataatgattcacaaaaagttgctacattattgagtactaaaaataaaaaagtagacgatgttgaagcgcaacaatatattaattatgtaaaaaaagaagtaggtattaagaagtatattcaagatatcaataatactgtagataaattgaataaaagtaattcaagcgtggcatcttatatacaaacgaaaagtggacaagatgtacttaagataagtaaaaatggtacaaagtatttaatttttgataatatgagtttcacagctccgactaaaaagccaattattaaacctaaagtagaaactaaatatgaatttagaacaagtggtaaaaagaaaactgtcattgctgaagcaaataaaaatacacctttgggtgaatttattcctggtacatatcatttaccagctaagaaaattacagaaaacggtacattcaatgggcatttaaattttgactttagagaaagccactctgaaaccgtagatgtagctgaagattatgatcaatcatttatcaatatcaaatttaagggtgcgaataaattaagtgataaatcagaaaaagttcaaatcaatgaccgtacattcacttattctcattctaaagaatttggtccttatccaaaaacaaaagatataacgatttctgcaactggtaaggcaaaaggtaagacgtttagttctgagacgaaaacaattagtgcagacgatttgaaagataatacgaaagttacattggaatttgatagtgataaaataaatagctatgttgagaagaaagaaaaagaagaaaatagtttgaaaaataaattaactgaattttttactggttatgcaacggctatgaattcagcatttaatatgaatgattttaactttatatcgagttattttaaaaagaattcgtctatatacacatcaatgaaaagtaatttccaaaatcgaacgaacgtgactatgatatctccgcaagtgttaagtgttcatcgaaacggacatactgtaagaacaactattcaacatatcgatcatattggtaattatataaataaagattatgaattagaaatagataatgatgatagtaatatgcagttggttaaagaattataa

SEQ ID NO: 1289 - DNA, 1389 bp, Staphylococcus epidermidis
atcggaggtgtctcaatggccaagaaaaaagtaatattcgaatgtatggcatgtggctatcaatctcctaagtggatgggcaagtgccctaactgcggtgcgtggaatcaaatggaagaaatagtagaaaaggttgctcatcctaaacatggtgtaaaaacaaaagaaacagcaggtaaggtacaaaagttaaatagtgttaagcatgaagctacccctagattacttacagaatcaaaggaatttaaccgtgttttaggtggaggtattgtaagtggttcgttagtactaataggtggagacccaggtattggtaagtcgactttattgctacaaatttgtgctgcgctgtcacaaaataagaatgttttatatattactggtgaggaatctattaatcaaactaagttgcgcgctgatcgtttagaagaagattctagtcatcttaatgttttagctgaaactgatttagaagtgatacatcaaactgtaaaagaagagagacctgacttacttgttgttgattcgattcaaacaatctatcatccggaaattagttccgcacctggatcggtatcacaagtaagagagagtacgcagagtttaatgaacattgctaaacaaatgaatattgccacatttattgtgggacacgtaacaaaagaaggacaaatcgccggaccaagattattggaacatatggttgatacagttctttattttgaaggagatgagcatcacgcatatcgtatccttagagcagtaaaaaatagatttggttctacaaatgagatggggattttcgaaatgaagcaaagtggattaaaaggcgtacttaatccttctgaaatgtttttagaagaacgttctacaaatgttccgggctctacaatcgtccccactatggaaggaacaagaccactactcattgaagtccaagcgcttgttacaccaacaacatttaataatcctagacgaatggctacaggtatagatcataatcgattaagtttacttatggcggttctagaaaaaaaggaaaactatttactccaacaacaagatgcctatattaaagtagcaggtggcgtcaaattaacagaacctgctgttgatttaagcattattgttgcgacagcttcaagttttaaagatcaagctgttgatggattagattgttttgtgggtgaagttggattaacaggtgaagtacgcagagtatctcgcatagagcaacgtgttcaagaagcggccaaactagggtttaaaagagctattattccacagacaaatattggaggttggacattcccagaaggcatccaagtcgttggtgtttcatcagtacatgaagctttgaaatatgcattacattcaaaacagcgataa

SEQ ID NO: 1290 - DNA, 408 bp, Staphylococcus epidermidis
gatttaaacgtggctaaacatatgaacgtaaaacttcttaatcctttaacattggcatatatgggtgatgcagtacttgatcaacatgtgcgtgaatatatcgtgctaaaattacaaagtaaacctcatcgtttgcaccaagtatcgaaaagttacgtttcagcgaaaagtcaagctaagactttagagtatttgttagatattgactggtttacagaggaagagctaagtgttttaaaacgaggacgtaacgctaaaagttatacaaaagctaaaaatactgacattcaaacttatcgtaaaagttcagcgttagaagctgttatcggatttttatatttagaccatcaatcagaacgattagaaaacttattagaaacaattgttaggatagtggatgaaaggtag

SEQ ID NO: 1291 - DNA, 1440 bp, Staphylococcus epidermidis
aaagacagcttgaaaaagctaagaatggagagattcaagatgattacattatataataccttaacacgtcggaaagagacgtttgagcccattgaaccaggtaaggtcaaaatgtatgtatgtgggccaacagtttacaattatattcatattggaaatgcacgaccagctattaattatgatgtagtcagaagatatttcgaatataagggatatgaagtcatctatgtttctaatttcacagacgttgatgataaactcattaatcgctctaaagaacttaatgaaagtgttcctgaaattgctgaaaagtatattaaagctttttatgaggacgttggtgctttgaatgtgaaaaaggctacatctaatccgcgtgtgatgcatcatatgggtgaaattattgattttattaaagaattagtagatgaaggttatgcatatgaaagtgacggtgatgtctattttagaacacgtcaatttgatggatatggtaaattaagtcatcaatcattagatgatttgaaagttggcgctcgtattgaagctggagaacaaaaagaagatgcgctagattttactttatggaagaaagctaaaccaggtgaaattagttggaatagtccatttggtaaaggtagaccaggttggcacattgaatgttcagtaatggcttatcatgaactagggtctacaatagatattcacgcaggtggttcagatttacaatttccgcatcatgaaaatgaaattgctcaatcagaggctcataatcatgcacctttcgcaaattattggatgcataatggttttattaatattgataatgagaaaatgagtaagtctctaggaaatttcattttagttcacgatatcattaaagaagtcgatccagacgtattacgattctttatgattagtgtgcattatcgtagcccaataaactacaatttagaattagtaggtgcggcgcgaagtggtcttgaacgtatacgtaatagctacaagttaattgaggaaagagaacaaattgcctcagatttggaagaacaatcagaatatatacaacaaatagataaaatactaaatcaatttgaaacggtaatggatgatgactttaatactgctaatgcagtaactgcatggtatgacttagctaaacttgcaaataaatatgtattagaaaatacaacttcaacaaaagttttaaatagatttaaagaagtgtacagcatttttagtgacgtccttggtgtaccacttaagagtaaagaaactgaagagttactagatgaagacattgaacaattgattgaggagcgtaatgaagcacgtaaaaataaagatttcgctcgagcagatgaaattagagatatgttaaaagcacgtcatatcattttagaagataccccccaaggtgtaagatttaaacgtggctaa

SEQ ID NO: 1292 - DNA, 552 bp, Staphylococcus epidermidis
acgtcatcagttagaggaaaagtcatgaagaaaagatacttaattatagatggttacaatatgattggccaatcctcaacacttagcactgttgctaaagagaatttagaagaagctagagagcaattattagacacaattgccaactacaatgcattaatagcagatgaaattgtctgtgtatttgatgcctatgaacagtcagggatagaaagggaatacttctatcatggtgtcaaaacaatctttactaaagaaaaagaaactgcagatagttttatagaacgctacgtgtatgaattatataataaacacacgacacacattaccgttgtaacaagtgatatgagtgaacaacatgctatttttggttcaggtgcatatcgtatttcttcaagagaaatgtggcgtgaattaaaagaaaatgaggttgttgttaacaagtcacttgatgattttagcgaaaagaaaccaagaattagaattccgttatctaatgagatacttgaagaatttgaaaagattagacgtggcaatcagaaaaaagactaa

SEQ ID NO: 1293 - DNA, 1227 bp, Staphylococcus epidermidis
aagggaggagtaagcttgaaaagagtgtatcagtcagaaaatcaatcattactttttattgttattttaggttcattaacagcatttggcccattggctattgatatgtttttacctggactacctaatattagtcatgattttgatatttctgcatctacaactcagcttactatctccttttttatgattggattagcgttaggaaattttttggctggccccatatctgatattactggtagaaaaaaaccattaattttctcactgattatttttactattgcgagtttaggtattatattcgtcacaaatatatggattatgattattttacgatttattcaaggattaactggtggtgcaggtgcagtcatctcaagagccattgctagtgatatgtactcaggtaatgcgctaactaaatttttatcattattaatgcttgtcaatggcattgcgccaattatcgcacctgcgcttggcggtatcattttaaattatgggccatggcgaattgtatttgtaatactaacaatgtttgggattgtcatgttaataggaactttatttaaagttcctgagtcgcttgaaaagagcctaagggaaagtagtaacataggtacgatgctaattaatttcaaagaactttttaaaacaccccgttttgtattacccatgttgatacaaggggtgtcatttgtattactatttacttatatttctgcatctccttttatagttcaaacaatttatggtttaacgccattaaacttcagtattatgtttgcttttataggcgttacactcattatttcaagccaattaaccggaaaacttgttgactatatagatagattactgttgctgagaatcatgtctactatacaagttattggtgttataatcgtatcactaactttactcaaccattggactttttggatactttcttgtggctttgtgattttagtggcaccagttacagggattgcaacgttaggattttcgatagcaatggatgagagtaaaggggccaaaggtagttcttcaagtttgttgggattgtttcaaactttacttggtggcgtcatctctccacttgttggtattaagggagacagtaatgcgataccttatataatcgttatcgttattacagcaataattcttatggttttacagttgattaatgtgaagatatttaaaaaagctaaaattcattga

SEQ ID NO: 1294 - DNA, 492 bp, Staphylococcus epidermidis
tcaaagaaggtcaaaaaagaggtgatatctatgcacaatatgtccgacatcatagaacaatacattaagcggttatttgaagaagcagatgaagatgttgtagaaatacaacgcgctcatattgctcaacgtttcgattgtgttccttctcaacttaactatgttattaagacacgttttactaatgaacatggttatgaaatagaaagtaaacgtggtggcggtggttacattcgaatcactaaaattgaaaataaagatgctacaggttatattaatcacttactacaattaataggtccatctatttctcaacaacaagggtattatgtcatagatggtttgttagataaaggtttgatcaatgaaagagaagctaaaatgatacagaccattattgatagagaaactttaaaaatggatgttgttgcacgcgatattattagagctaatatcttaaaacgattactaccagttattaattattactag

SEQ ID NO: 1295 - DNA, 627 bp, Staphylococcus epidermidis
aaaagagaggtgatatatttggactttataaatcagcagacaacccaaactgcaaaagctttattaggtgttaaaattatttaccaagatgactatcaaacatatactggatatattgtagaaactgaagcttatttaggtatacaagataaagctgcacatggttttggtggcaaaataacaccaaaagtgacttctttatataaaaaaggtggcacgatatatgcacatgtgatgcatacccacttattaatcaattttgttacacggactgagggcataccagaaggtgtacttattcgtgctattgaaccagatgaaggtatcggcgctatgaacgtcaatcgtggaaaatctggatacgagctcactaatggtccaggaaagtggactaaagctttcaatattccacgatcaattgatggctcaaccttaaatgactgcaaattatctatagataccaatcatcgcaaatatccaaaaactattatagaaagtggtcgtatcggtattcctaataaaggagaatggacaaataaaccactacgtttcactgttaaaggcaatccatatgtctctagaatgcgcaaatcagattttcaaaatcccgacgatacatggaaataa

SEQ ID NO: 1296 - DNA, 963 bp, Staphylococcus epidermidis
aaggaactattaattatgattacagcttataaacacgcacttcatcatccttcacaaattattgaaactgaaatcaatcatagtgcttcatggataaatgtagtagaaccagatagagaagaaattgaaggtttgatggaattttacaatatacctgaggattttattcgagatccgttagactctgaagagagtgcacgtattgaatatgacgaagatacgggatactcgctaattattattgacttacctatcgtcaattctaccaatcggcgtgtcttgtcgtttgtgaccatcccattaggcattattattggaaatggtatcgttatgactgtttgcgatgctgaaaatgaatttttagaaaactttgctaaacaagaagatattaacttgaaatttcacagtcgatttgcacttgaaatactaacaacaatagcaaatcactacaatagaaatttaagattgcttaataaatctaggattcgtattgaaagagaactcaaaaataacattactaacaagcagctttttaaactaatggaagtagaaaaaagtttagtatacttcttagctgcactaaaaggtaacgacacaattattaaaaaactctttcgtcttcctgcaatcaaacgttttgaagaggatgaagagctacttgaagacttggtgatagaaaacaaccaagctattgaaacgactgaattacatcaacgaatacttgagagtatcacttcttcgtatgcttcattattatctaatgatatgaataacatcatgaaaacattaacgttgtttacggttcttttgacccttcctacactcgtctttagtttctttggtatgaatgtacccttaccaattgatgatcatagttacgtgtcttggattattgttgtgggaatttcacttattctagtagctatcgttagtatctttttatggaaaaaacaaaaattataa

SEQ ID NO: 1297 - DNA, 660 bp, Staphylococcus epidermidis
gagggtatattcatgaaaaaaatgatattaatcaatgtgattactatcattgtcctagttgttattggtgtgttaggcttttggttctggcataacacaacaagttatgtgacaactgacaatgcaaaagttgatggagatcaaataaaaatctcaagtcctgcatctggacaaattaaatctcttaatgttaagcaaggagacaaacttgataaaggtgataaagtagcagaagttttagcacaaggccaagatgggcaatcaaaagatatgaacatcaaaatgccacaaaaaggtactattgttaaaacagatggtatcgaaggttctatgactcaagcagggaacccaattgcatatgcatataatttagatgatctatatataactgctaatgtagatgaaaaagatatttctgacgtggaaaaaggcaacgacgttgatgtagatatcgacggtcaaaaagcatcaatcaaaggtaaggttgaagaagtaggccaagcaactgcagctagcttttcattgatgccttcatcaaatagcgacggtaactatacgaaagtttctcaggtagtacccgtaaaaatctctttagattctaatccatctaaaaatgttgtcccaggtatgaacgctgaagttaaaattcataaaaattaa

SEQ ID NO: 1298 - DNA, 1233 bp, Staphylococcus epidermidis
gtgttggtattattttctggtgattttaccactatgccattaaatgttgctattacaattactgttattgttgccttacttatgaaccgcaaggaaacttttgcaaaaaaagtagaggtatttacaaaaggtgcaggtcactctaatatcattttgatgatgcttatttttatccttgctggagctttttcgacgactgctgaaaaaatgggaggcgtgtcatctacagttaatttaggcttatcacttattcctcaaaatctaataattgttgggctatttattatttgtatgtttgtatcaatttcaatggggacttctgttggcacagttgcagctattgcaccagtaggttttggatttgcacaagcaacagatgtaccagctgcattagccatggcaacagttgttgggggagcgatgtttggtgataatctatctatgatttctgataccactattgcagcagtaagaacacaaaaaacaaaaatgagtgataaatttaaagtcaattttaaaattgtactaccaggtgcgattattacaatcatcattttattctttttaacaaatggtatttctatagatcatactaaaaactatgattataatttaattaaagtcataccatacttattagttttgattcttgcgttagttggtattaatgtaattattgtattaataggaggtactgtattagccggtataattggactgattgatggttcttttggttggaatggccttttaaatgctatttctaaaggtattatcggaatggaagatattgctatgattgcattgcttataggtggtctagtaggaattatccaacataatggtggtattgattggttgcttaattttgtaaggtcaaaagtaaaatcaaagcgtggtgcagaactaggtatagcgagtttagtgagtgcagctgacatttcaacagcaaataatacaatttctattattatggctggaccattagctaaaaatattgctgatgaatatgatgtcgatccaaggaaatcagcaagtatattagatatctttggtgggtgttttcaaggattattaccatacagtccacaagtgatttcagcagcaggtgtagccggaatttccccattcctaatgttacaatatagtatttatccaatattattaggtgtttgtggattagtagcaattattttaagagtacctcgtttaaatcaatcgtcaaagaaataa

SEQ ID NO: 1299 - DNA, 429 bp, Staphylococcus epidermidis
ggaggattttttatgcgtagattattatactcttttttattttatatggtcataggtttattaagtggcttttactacagagaattaactaaagcgcatgactttgtgggtgacacgcaattgtctttagtgcatacacatacacttatcttaggcatgtttatgtttttactcttattaccacttgaaaaagtatttaaattaagtagttattacttatttaattggttctttttcgtgtatcatttaggtgtgttaatcacgatttcaatgatgacagttaaaggtacattccaagttattggtaaaaaattttcacccgaaatgtttgcgggatttgcaggcataggtcatacaggtatgcttgcaggtttactgttactgtttttcttattaagacaggctattcttacagaacccaaaaaataa

SEQ ID NO: 1300 - DNA, 285 bp, Staphylococcus epidermidis
tgtaagacattaactaattttttaagcaaaagtttacttagtgttttagtaataatttttgaaaaaatagctaggtctttagctggggtaaaaggaggttttattttgaaagttgttttatatttcatttactttttcgttgcgttttttgttgtagattctttaattagtttggtatttccaattgaatttgatgtgtatacaaatttaattactgcattcatttttgcagtttttatgacaccactattatttgtattaaaacaagacaaaaacaaaaaataa

SEQ ID NO: 1301 - DNA, 1209 bp, Staphylococcus epidermidis
atgatagaatttgatgcaattaccacattatgtttggcatgtgttttatatttaattggtcaaacaataatcaaccatgtttctattttaaggcgaatctgtattccagcacctgtcattggtggtcttttatttgcaatattagtggctatattagattcatttaatatcgttaaaataaaacttgattcggcgttcattcagaatttctttatgctcgctttctttactacaattggacttggcgcatcattaaaactattcaaaattggcggaaaagtcatgttgatttatttcactttttgtggaatcatggctatttgtcagaatattattggtgtatcactcgctaaactcttaaacattaaacctttattaggtcttacagcaggttcaatgtcaatggaaggtggtcacggtaatgctgcagcttatggtaaaaccttacaagatatgggtgtagattctgcagttgcagctgctttagcagccgctacactaggccttgtattcggtggactcattggcggtcccatcgttaaatatttaataaaacgctatgatcttaagccagagcatcgtgacgattcatttaaaaattatggtgtcgttgaatacaatcaatcattacatacaaaatataaacctattcaagtcttttttatacaattttctatactcgtattttgcatggcattaggaacatatattggcaatacttttaccgatttaaccggagttaatattccaatgtatgttggttcaatgtttgtagcagtaattattagaaatgctacagactttattggttgggatatcgttgatttaaaaatgagcgaacaaataggtgatatttcattaggcatctttttatcattagctttaatgagtatccaattaactcaaatatattctttagctatcccactaatcataattgttcttgtacaagtcgtatttatggtactattctcgattttcatattatttaaaggactcggtaaagattatgacgctgctgttatggtaggaggatttattggccatggtctgggagcaacaccaaatgcgatggctaatttagatgttatcactaaaaagtttggcaactcccctaaagcatatctagtagttcctattgttggtgctttcctcatcgacttaatcggtgtaattattgttatgagttttattcaacttttcagttaa

SEQ ID NO: 1302 - DNA, 216 bp, Staphylococcus epidermidis
tcaagttattcatcaaggtatactttagggtatctttatcgtttgaataacttttttaaaattaaaccacttacaataaactaccgcatttatttgcatattttgatagtggtcatagttatcattttattgatgtataatttgcaaagtattttaattaatatttggctatttattatccacacaattaatagtaggagtgaaaataatgagtga

SEQ ID NO: 1303 - DNA, 189 bp, Staphylococcus epidermidis
actgtacattcatatatctacctcctcagtcgtataaacagtattaaactatacacagtagtgattcaaattaactatagcatccactactatacattgcaaggtactgagtttaatttattaatacacacgtctttattcaaattacaccatcttttattgacaaattataaaaatcaatatttttaa

SEQ ID NO: 1304 - DNA, 948 bp, Staphylococcus epidermidis
ttagatacatcaaaggggcaatctagtatggaggaagttttaaaacttaaaatccctgcatcaaccgcgaatctaggtgtaggttttgactcaattggtatggcattggataaatatttgcatatgtctatacgtaagattgaaagagctaattgggaatttctatattatagttcagaactagaaggtttacctaaagatgagaataattatatttatcaaactgctctaaatgttgcgcgtaaatacaatgttacacttccaagcttgcaaattgaaatgagaagtgatattccattagctagaggactaggttcatctgcttctgcattagtcggtgctctttttattgctaattactttggtaatattcaattatctaaatacgaattgttacaactagcgactgaaattgagggacaccctgataatgtagcacctacaatatatggaggtttgattgcaggtttttataatccaataactaaaataacagatgttgctagaatagaagttccgcacgtagatataattttaactatacctccatatgagcttcgtacagaagactctagaagggtcttacccgatacattttcacataaaggtgctgtgcaaaatagtgccattagtaacactatgatttgtgctctcattcagcataaatataaacttgctggaaagatgatggaacaagatggttttcatgaaccatataggcaacaccttattccagaattcaatcaagtacgtaaactatcacgtcaacatgatgcatatgcaactgttataagtggagctggacctacgatactcactctttgtccaaaagaaaaaagtggtaaattagttagaacactacgtgagaaaattaataattgtgcttcagaactagtaacaattaatgaaataggtgttaaagatgaagtggtgtacctaaagtcctaa

SEQ ID NO: 1305 - DNA, 879 bp, Staphylococcus epidermidis
gtagtaatgtctttaacgattatcttatctataataattattattttgattatggctatggttcttaatcaaaaatttatgaaagatagggttgaaacagaagaatatgctagaaatcaattaatctctaaaaattcaattttaagtgaagaaaatttatcattgaaaaaccaaatgttaagtacaaacaatgacgtcggtcaacacgcttttaaaaacgccaagcgtgaattaagaaaaatattaaatagatttaaagaagagggtcgtttacgatcatatacaattgttcctacgagtaatttggctgttaaacatccccttttcgaatatgcacgttcattcgattttattatcattactgatgttggtttgataaatgtggatgttaaaaattggaaccaaaaaacgttttatcattttgatgtgccagatcaacatcttgaagaaggacaaccacaatataataccgaaaaagttgtcggtcattatattagcaatcgatatcatagtcagtttaaaacaacacgttctggtgtctatacttttattgagattttacaggataatcgtgtaatatatgaattttatgaccacgatccatacgataaagccgcaaacaatgcaaaagcattaaaagataaaattgaaaatgattataattttaaaattcaaagtattggcgtcatatattttagtgatggtagcgttaatattattgaaggatccgacgagagtgataaatacgtcgacaccgtatctacaccgatatcacttgaaaaagtaattgaggaagctatcgatttatctaagcacccccttactgataaacaaatcgaagaaatttctgaaaactttaaacaacatatgaataattaa

SEQ ID NO: 1306 - DNA, 213 bp, Staphylococcus epidermidis
tacatgatgttaggagtgaaagaaatggatacatctaatgaaaataaaataacaatcattgccgttatagtagcaataattgttggtgtcgtactacaaattgtctttaaactacccttaatcgtgagtttagtggggtcagtatttttaggtatgttcgttggttttatcgtctacctaattcaatcatttcgtcgtaaaaaaaagaattaa

SEQ ID NO: 1307 - DNA, 189 bp, Staphylococcus epidermidis
ataccagagttagctgctgataataatgatgttaagataacagcgttgatgactgatgcagcaaaagcgatccctattctatcgaaaacaattgtaaacggactttgtgatacagactcattttcattaagtaaaagtggatccgtatatggaatgatggcagctatcacagctatagacaatacgtaa

SEQ ID NO: 1308 - DNA, 552 bp, Staphylococcus epidermidis
aataaggtgacattattgaaatctaagaaaatgtcatcgcttttagtagtagcgatgataggaatacttgtaattattttccagtttgtaaaccattctggaccgtttagtggttcagaatctcaacatcaatcagataattccaatttaaatggtaaagacaaagtatatgtgaaacgagttgtagatggtgatacatttgttgctcaaaaaaatggagaggaaattaaagtcagattaattggtgtagatacgccagagactgttaaacctaatacgccagttcaaccatatggtaaacaagcatctaattatacgaagaagtatctcacgcatcaaaatgtttatttagaatatgataaagaaaaaactgataggtatggtcgtactttggcgtacgtatggttaaaaaatggagatatgtttaacgaatcgctggtgaaaaaaggtctagccagagaaaagtatttttctccaaacggaaaatatagggataccttcgtacacgctcaagaagaggcaaaaaagagaaaattaaatatttggagctag

SEQ ID NO: 1309 - DNA, 1347 bp, Staphylococcus epidermidis
ccccttatctatattttttcaacagtacaattgtttttctcaaaagcacaaacggaggtaatttacatgaaagagttaaatatcgcattacttggtttgagaacagtcggatcaggtgttgtaaagattattgaagagaatagacaacagattaaagacaccatcaataaggatattgtcattaaacatattctagtccgagataaatctaagaaacgtccgttaaatattagtcaatatcatcttacagaagatattaatgacatcttaaatgacaattctattgatatagtcgttgaagttatgggtggtattgaacctactgttgattggttaagaacagcccttaaaaataaaaaacatgtgattacagcaaataaggatttactagctatccatttaaaattattagaagacttagctgaagaaaatggcgtcgctcttaaatttgaagcaagtgtggcaggtggtatccctattgtcaatgctattaataacggactgaatgcaaataatatttctaaatttatgggaatatttaacggaacttctaactttattctctcaaaaatgactcatgaacaaacaacttttaaagatgcgttagaagaagcacaaagattaggatttgctgaagctgatccaacagatgatgtagaaggtgtagatgctgcaagaaaggtagttattacatcttatttatcttttaaccaagtcattaaactgaatgatgttaaatcggtaggaattagtgacattacattagcagacatcaatgcagcaagcgcattaaattataaaattaaatcaataggtaaaggtacatatgaaaatggatatgtgaatgcttctgtggaaccgacactgatacataagaatcaccaacttgcagctgtagagaacgaatacaatgcaatatatgttataggtgatgctgttggcgatacaatgttttatggtaaaggtgcaggtagtttagcaacaggaagtgcagttgtaagtgatttattaaatgtggcacttttctttgaatcaaacttacacactttaccacctcattttgaattaaagacagaggaaactaaagaaatgatggatggtgcagaaccagtggttattcaagagaaatctaattactatatagtaattagtaacaataataaatctttggagaaagttgaatatgacattaaaaagaaattaccattccataaatcgttgcaacttgttgagagggatcaagatacttatgcaattatcgttactggaatagaaacatctccagaaaaagttctaaatcaatcaggatttaatatcaagaaagtttatcctgtagagggagtttaa

SEQ ID NO: 1310 - DNA, 183 bp, Staphylococcus epidermidis
acggaggtatatctcatggagaacaatcaaagtaatattactgaagaaacgaaacacaatgataatttagaaacaacttatgaacaaacgcaacaaaaagagaaaacattctctcaagaagaagtatctcaaatgattaaggatcgtttagctagaaaaaaaagaaatctgaataacgtatga

SEQ ID NO: 1311 - DNA, 231 bp, Staphylococcus epidermidis
tttaatcaatataatgaaaggggtatgggatttatgcaacaaataaaatttaaaactttaactgaggaaacactggagagcttagagaaaagtgttaattcgtttttaaagtctcaagagggtaatggttacaaattattaaacattactattaaacaaatcgaagaacgtgcatttccgcataatgacgaggactttaatgctattttaacattggtaacggaagcatag

SEQ ID NO: 1312 - DNA, 1257 bp, Staphylococcus epidermidis
aaggagatgtataacgtgacacagcatgcgacttataaaacaaaaaataaacgagaaactgctgtattaatcggtgtacatgctcaaacggatcgtcaatttaattttgaatctactatggaagagctcgatgctttatcacaaacttgccaacttaatgttaaaggacaaatcactcaaaatagagagcaatttgaccataaatattatgttggaaaaggaaaaatcgatgaaataaaatctttcatagaattccatgatatagatgttgtcgtaaccaacgatgaattaacgacggcacagtctaaaacgttaaatgataatttgggcattaaaatcatcgatagaacccaattaattttagagatattcgcgttgcgagcgagaagtagagagggaaagctacaagtagaacttgcacaactcgattatttgttaccaagactacatggtcatggtaaaagcctatctcgtcttggtggtggcataggaacaagaggcccaggtgaaacaaaattagaaatggatcgtcgccatattagaacacgtatgaatgagattaaacatcaattaaaaacggtcgtggatcatcgggaaagatatagaaataaacgtgaacaaaatcaagtttttcaaatcgctttagttggttatacaaatgcaggaaaatcgtcatggtttaatgttttagctaatgaggagacctatgaaaaaaatattttgtttgcaacattagatcccaaaacacgacaaatacaagtgaatgaaggatttaatttaattatttctgatacggtaggatttattcagaaattaccaacgacattggtggctgcgtttaaatctacactagaagaagctaaaggtgcagacgtacttatgcatgtcgtcgatgcaagtcattcggaataccgtactcaaattgacactgtaaatcaaattattaatgatttagatatggaccatattccacaagtagttatttttaataaaaaagacttatgtaacgaacagatggatgtacctgtatctaaatctgcgcatgtttttgtatctagtcgtgatgaaaatgataaacaaaaggtgaaaaatttagtaattcaagaaataaaaaatagtctcagcccatacgaagaaattgtagatagtgctgatgcagatagattatattttcttaaacaacacacgcttgttactgaattaatatttgacgaaacacaagcatcttatcgtatcaaaggatttaaaaaattataa

SEQ ID NO: 1313 - DNA, 708 bp, Staphylococcus epidermidis
gaatgtagtcaggaggactatgctatgcaacaagaacgacaatcgtggtaccaaaaatcttggtttattattctcacattgctatttatttttccattaggtctctttctaatgtggaggtatgcgcattggaagaattggttaaaattgactgtttcatcagtctatattattagtttagttttaacacttttatttcaagttagtctattaaatgagaataaaacaaatcaaatagaacatgcatcaactatgaaagaaaagtctaatataaataatgtaaaaacaactaaaaataaaaatatggaaaaatcaacgcagacagacaaacaaaactctgtgaacttaaagcaaaacacaaaagatcaaaataataacgcaaatgatgaagcagcttctccaactagcgaacaaaatgcagctatagcacaagcaaagtcatatgcaaatacattacctatctctaagaaaagtttatacaaacaattaacttcggaatacggagagaaatatccggcagacatagcacagtatgctgttgaccatatcagtgtagattataaaatgaatgcactgagattagcaaaaagttacgtaaaaaatataaacatttctaatcaagcgttatatgatcaactcgtttcagaaaatggagaaggatttactcctgaagaagcacaatatgcaatgaatcatttagataggtaa

SEQ ID NO: 1314 - DNA, 1254 bp, Staphylococcus epidermidis
aaaggaagacagattatgcaagattttagcaatttagttgaagaagttgaaaacacacttattccttactttagaaaaattgaaaagcgtgcattatttaatcaggaaaaggtcttaaatgcttttcaccatgttaaagctagcgaaagtgatttacaggggtctacgggttatggatatgatgattttgggagagaccatttagaacaaatttatgcgcacacatttaaagcagatgacgcacttgtaagacctcaaattatttcaggtactcatgctattactttagctttacaaagtacgttaaaaaacaatgatgaactactttatattacaggtagtccatatgatacacttctagaagtcattggtataaatggcaatggtgttgaaagtcttaaagaatatggtgttcgctataatgaagtcgaattacgtgacggtcgaattgatattcctaaagtcatcactgcaattaatgacaatacaaaagttgtagcaattcaacgatcaaaaggatatgatcaacgtccatcaattacaattaatgaaattgaacaagcaataacatctattaaagaggtttatcccaatatcattatttttgttgataattgttatggagaatttgtagaagataaagaaccgattgaagtaggtgctgatttaatcgccggatcattaattaaaaatccaggtggaggtttagctaaaattggaggatatattgctggtagacaagacttaattgaacgctgtggttatcgtttaacagcaccaggcattggtaaggaagcaggagcctcacttaattctttacaagaaatgtatcaaggattctttctagcgccacatgtggttagccaaagtttaaaaggtgcactgtttactagtttgttattagaaaaaataaacatgaagacctcccctaaatataatgtttatcgtacagacttaattcaaacggttcaatttgagaccaaagagcaaatgatttcattttgccaaagtatacaacacgcttcaccaattaacgcacattttagtccagaacctagctatatgcctggatacgaagatgatgtcatcatggctgcaggtacatttattcagggctcgtctattgaattatccgcagacggacctatacgtccgccttatgaagcatatgttcaaggtggtttaacttatgaacatgtcaaattagctgttacacgtgcggtgcaacatatgcaagaaaacaatttactataa

SEQ ID NO: 1315 - DNA, 534 bp, Staphylococcus epidermidis
acaaagactaactacacaaattgtgttaaattagatgtatatcgaaagggtgataaaatggaaagtatttatgattttgttgtacaaaaaaacaatggtgaaagttataaattagagcagtataagggtgacgttatgcttattgtcaacactgctagcgaatgtggttttacacctcaattcgaaggtttacagaagttatatgatgagtataaggatcaaggatttattattttaggatttccatgtaaccaatttggcggtcaagaaccaggatcgggagaagaagctgctcaaaattgcaaaattaactatggtgtgactttccctattcatgaaaaagttgatgttaaaggtgataatcaacatccattatttcactttttaacaaacgctgctaaaggtatgataaacgaaaaaatcaaatggaatttcactaaattcctaatcgaccgtgaaggtaatgtgattaaacgtttctcccctcaaaagaaaccggaacaaattaagactgaaattgaaaaattactataa

SEQ ID NO: 1316 - DNA, 405 bp, Staphylococcus epidermidis
attaataacaagttcaaaagtagaggagaggttcaagtaatgtctaatgattcaatcagacgaaacatggccgttttctctatgagtgtggttagtaaattgacagatttatcaccaagacaaattcgttactatgaaacacatgaacttgtgatgcctgaaagaacagatggaaataagagattattttctatgaacgatttagagaggttgttagaaataaagtctcttatcgaaaagggatttaatattagaggtattaaacaaattatattcgatgagcaagggcatttaactactgatgaacaagagacaagaaagagaatgattgttgacgcaacgcagaaaccacgtagtgaaacattaccaataaatcgtggcgatttatctcgatttattaaatga

SEQ ID NO: 1317 - DNA, 450 bp, Staphylococcus epidermidis
gtttctcgcaagaaagtgcaccaatttactgaaaattatgatacattattaatagggattgacatgtcccgtgacacattatatttaagaataaataaacgtgttgatattatgttgggccacggattatttaatgaagtgcaacatctcgttgaacaaggttttgaagcgagtcaaagtatgcaagccattgggtataaagagcttgtacccgttattaagggaaatataagcatggaaaatgctgtagagaaattaaaacagcattctcgacaatatgctaaaagacagttgacttggtttaaaaataaaatgaatgttcattggttaaataaagaaaggatgtcacttcaaatgatgttagatgagattacaacccaaataaataaaaggagttctaaccatgattgcaaacgaaaacatccaagaccaagcactagagaactttaa

SEQ ID NO: 1318 - DNA, 1095 bp, Staphylococcus epidermidis
ttgagagcaaatcaacacttttcatcgaataaattaataaatatcgatttaacattggagggaacgcttgtgatttcatttgaaaatgattatttagaaggtgcacatgaaaaagttttaaatcgattagtagagacaaatcgaatacaagctgctggatatggcttcgatgacttttcggcacaagctgcagataaaattagacaacgtattgactgtccagatgctaccattcgttttttagtaggtggtacgcaaaccaatcaagtagttattaactcaatgcttgatagttatgaaggtgttatatccgctgatacaggacatgtggcagtccatgaaggtggtgcgatagaattcagtggacataaagttctaaccataccctcccaagaaggtaagattactgctcaagacgttgagaattatatagaaacttttgaaagtgattttaaaaaagaacacatggtgtatccagggatggtttatatttcacatccaaccgaatatggaactttatacacgaaagaagaattacaatctttatctagagtttgccgtagacatcagattccactatttatggatggtgcacgtttaggctatggccttatgagcaatcaaactaatgtaactatcgaagatgttgcaaaatactgtgatgtgttttacataggaggtactaagattggagcactttgtggtgaagcaattgtcttcactaaacaaaatgaacctaaaaacttcactacaattataaaacatcatggtgctttattagcaaaaggccgtctaactggtgttcaatttttagaattattcactgatgatttatattttgatataagtcgacatgctattaaaatggctgaaaaggtaaaaaaaggatttatagataaaggatatcaagtctattttgattcaccaaccaatcaacaattttttattttaagcaacgataaaattgaagaactaaaacaaaaggtaaaattcgcagtttgggagaaatacgataatcaacatcgtgtagttcgcttcgcaacaagttgggccacaactgaagaaaatgttaatcaactacttgaactaatataa

SEQ ID NO: 1319 - DNA, 957 bp, Staphylococcus epidermidis
caaataaaaaaaggaataggggcagatgttgtgagtcaaagtcattttaaaataacagttgaagatggaacaatgttagaggtgaaaattgataaagcaaaaaagagtactattggtattgttcatcttttccatggcatggctgaacatatggaccgttatcaagagttagttgaggctttaaatacacaaggttatgacgttgttagacataatcaccgtggacatggtaaagaaatagatgagaatgaacgtggtcattttaatagcatgaatcaaattgtagatgatgcttatgaaattattgagacattatatcttgaagagctcaatgtaccctatattatcataggtcattcaatgggctccattattgctagatcatttgttgaaaagtatcctgacattgctcaaggtttaattcttacaggaacaggtatgttccccaagtggaaaggtgtaccaatacgtttagcaatgaagttagttacatttatttttgggaaacgacgtcgactcaagtgggtgaatcaattattgaataaaactttcaataaaaaaatcactcaacctcgaacagatagtgattggatttctacacgtcaggatgaagttgataaatttgtggaagatgaattttgtggattcaaagtatctaatcagctcatttatcaaactttaaagaccatgatgaagacagtagaacgacaacaactaaaaagaatggacaaagaactacctatactatttatttctgggaaagatgatccttttggtgaatatggtaaaggtataaagcatttagctagattatataaaagagcaggtattaaacatataacagtacaactatataaacataagcgtcatgaaatattatttgaagaagattatttgaaaacatggcaacacatgtttgaatggatggaaaagcaaattttgaaaaaacaaaagtga

SEQ ID NO: 1320 - DNA, 396 bp, Staphylococcus epidermidis
aaagaaaaaaatacaagaaaaagcaaaaaagaaattcctgatgtgatacgtagtggtaaaataaaattagatataaatcctgaaaaacaaaatagacattccttaaatcatagtttatatttgaaaaataaaaattttgcattaaaaaataatgaaagattaccaagttatactacgttatctatcaatgaattaaatagattagtacaacagtactcaacttctggtaaaatcttaataaataaaaacggttttaaccataaaaaagtaataaattttgagaggattataggaaaagcatttatagatggaaaatatattgagactacatttggtaaagtgcattattcaaaaacagactctcatataataccttttataagtaaggagaaataa

SEQ ID NO: 1321 - DNA, 210 bp, Staphylococcus epidermidis
gtaaggagaaataaaatgttaattaaagatgcttatcgtaaaaatgttattgtcacacttaaaaataatgaaaagtttaaaggttttgtgtttgattatgaaaacccattagaaagtgatactggaaactattccctggatttagagacagatttaggaatatattcaattgatgaatcggaaataaaaagtataaaattaatatcttag

SEQ ID NO: 1322 - DNA, 708 bp, Staphylococcus epidermidis
aatgtactgaagaaatcttgtgatgaggcaaacaaagcacttaaactttataatttgtctatgaaagtatctagagaaaagctattaaagcagcaattagatttgatagtcaaagactccgctttagacattcatgatgaaatagaaaataagttggttgatagagaagttgaaagacaagcacatatacttggtgaacatgtgaaaattgatgacactgaagtaaaagcggttgttaacagtaactttaaaggtgtgaactggtctacaagattatgtcaagatatggctgtagttcaaaaagaagtagaaaaaacaacgagtaatgtattacttagagggagacatcctaatgagtacgtagctaagtttaaaaagcaaacaaataccacaacatataatgcaagtagattgttagttactgaatcagcatgtgtgcaggctgaatcacagaagttaacttatcttaaagatttaggtgaagatggcgaatataaatacgtggccaaaatcgacaagaaaacatctaaaatatgtcactctttaaatggcaaagtatttaaagttaaagatatgatgcctggagttaatgctccacctatgcacccttggtgtagaagtactacagtaacacatgtgggcaattggcgagatagattctttactgagcgtaaaggtaagtatcagacagagaataaagaatcataa

SEQ ID NO: 1323 - DNA, 1392 bp, Staphylococcus epidermidis
aaaggtaggaaaattatgaaagttgctaagtttggtggaagttctgtatcaactgcagaacaaattaaaaaggtattaactatagtgaatgaagaccctgaacgtaaaatcattatcgtttcagctccaggcaaaaggcataatgacgacattaaaactactgatttattaattcgtctctatgaaaaagtacttaataaattaaattatgaaagtaaaaaacaagaaattatccaaagatatgctgatatagtagaagaattaggtataggaaatgacattttaataacaattaatgacactttagaggaatacattaaacatctttctgacaaacctaaccgtttatatgatgctttattatcttgtggcgaaaattttaatgctcaattaatagcccagtataataatagtcaaggtattcctactcgttatatttctcctaaagaagctggattaactgtaactgatttaccacagcaagctcaaattttagattccgcatataatgaaatatacaaattgcgtgattatgatgaaaagctaattattcctggttttttcggagtttcaaagcaaaattatatcgttacgtttccacgcggtggttctgacataactggtgctatcatagcacgtggcgtccgagcctcactttatgagaacttcactgatgtatcaggaatatataaagctaatccgaatatcataaataatcctgaactcatagaggaaataacttatagagaaatgcgagagctatcttatgcaggatttggagtttttcacgatgaagctctacaacctttatacaaagatcgaattcccgtagttatcaaaaatactaatcgtccaaatgataaagggacctacattttacatgaccgtgaaatcgattctaaaaatgtcattagtggaattagttgtgataaaggctttactgtgattaatattaaaaaatatttaatgaatagattagttggatttacacgaaagattcttggcgttttagaagaatttaatatatcatttgaccacatgccttctggtattgataacataagtattatcatgcgtacaaatcaaattcaaggtaaagaaagtcaagttcttaatgccatacgcaaacgttgtgaagttgatgaattaagtatcgaccatgatttagcagtactaatgattgttggtgaaggtatgaatcaagttgttggtacagctagtaaaattactcacgccctttcagaatcaaacattaatttaataatgattaaccaaggtgcttctgaaatttcaatgatgtttggaattcatgaagcagatgctgaaaaagcagtattatctacgtacgaattttgttacaacggtgtttgtttaaaaaatttgtgtaaataa

SEQ ID NO: 1324 - DNA, 249 bp, Staphylococcus epidermidis
caaagggttgagaaggaatatagcccttcgctcatgacatcattgtttactgaatcgaatccattaactcataaagaacaagttgttttaagagaaataggcaatgggttaagtagcaaagagattgctagcaaattgtatttatcgaacgggactgtgcgtaactatacgagtactattatagacaaaatgaattcagatcatcgttttgaggcatggaaaaaagcaaatgaaaaggggtggatttaa

SEQ ID NO: 1325 - DNA, 636 bp, Staphylococcus epidermidis
tttgattgtgaaagcgcttgctataggggtggtaacatgtttgttaaagaagaaaaaccagtgaataaaatagtcgaaattttaaggaaaacatcatctcatttattcaaatttcacggcgaggtagcgatgcatctatttctgaatgatgattttatattaccatcgaaaatagatatttgtgttgagcgcaaaaagttattggaaattatcagggtgattcctgaagaatttacgattcactattatgataatcagttatatgaaagattaagagaatctttatctttatcagatgttgaacatgttaaagtctttaaaaacgatacagaagtcatgacaatatttgtttatgatgttgtaaatgatgaatggctatttaggttagatcatcatatacgtttaccaaaaaataatatatattttcattctttaagttggaacgtagattatattaagccagaaatagttcttatgtatgatttaatgagtgaacaaaaatatcatcagtttagtaattataaagctgttattgattctcttagttattatcaattctatattttaaaattggtagtaggtgaacagcgtattaaaaaagctatagtaaatagttccactaaaaagatatcttaa

SEQ ID NO: 1326 - DNA, 336 bp, Staphylococcus epidermidis
aatggtatagaggtggataacatggttggacaaacaaatttattcgatgatgttataaagaaagaggaacgctttgttatagttgttcaagcacttgaagaaaaaaatggtaagctcttaaaacggactttgagagaatatccaagcttagagcacacgcaaatgaatgaccttttctctcatcttaaagaagtatttcttgaagaaccttttggggtcaatcaatcagcatatagcattactgtttatacaaacctagattatgccgcagatcaagtatatgcacatgttaaacgctataaaggaaaacatgactggacacatactgcgaaatag

SEQ ID NO: 1327 - DNA, 387 bp, Staphylococcus epidermidis
cgtatgaaagatgcaattcaagaagctgaaaaactagccaagatgaataaagaccaaaagaatcaatatgagttggaaaagctgttaaaagaaaatgaagaactaaaagcagaaaaagctttatctcaaatgaagaatgagactcgttcaatgcttaatgagtcaggtttagaaaacttcgatgatcaaattgttaatatattagtaaatactgatgctgaaaaaacaaggaaaaatgttgaatcatttactaacttacttaatcaaatggtaaaatcaaatgttgaaaaagcattaagacaagactcaccagtaagcactcaatcaaataaaatgacaaaagatgaagaatcagattatcttgtttcagggagaaaatgtctataa

SEQ ID NO: 1328 - DNA, 720 bp, Staphylococcus epidermidis
agattggattgttattgcatttggttggggtttggcagtaacaatgggcgtttatgctgttggacgttttctggtgcacatttaaatccagctgtaacagttgctttagccatggatggtggatttagctgggcgcaagtaccgggctatattgtttgtcaaatgcttggcggtattgttggtggagtttttgtatggttaatgtatttaccacactggaaagttacagaagatccagcagtcaaattaggtgtattttcaacagcaccagccattaaaaattattttgctaactttttaagtgagattatcgggactatggctttaacattaggaattttatttatcggggttaataaaattgctgatggtttaaatccaattattgttggtagtcttatcatagcaattggtttaagcttaggaggtactactggttacgctattaatccagcccgtgacctagcaccacgtattgcacatgctattttgccaattcatggtaaaggtaaatctaactggtcttacgcaattgtacccgttctgggacccatggcaggtggtatgttaggtgcgattgtttacgaagtgttttataaacaaacattcaattttagttgtttcattggtttaattgtacttatattcacacttatacttggcgtgatactaaataagatatctcaaaataaaaacaacgatattgaatcaatttattaa

SEQ ID NO: 1329 - DNA, 1113 bp, Staphylococcus epidermidis
gaaaggagatgtacactaatggaatcaagaagttggggagtgagaataggggaattaagtactttaatatatttaatatttccgattttagctatatttgttgacaaacgtggtaatttcttaacttatttaattgtttgtactatttttataatcagctatgtgacgatgattatattttataaataccttagtgatagtattttatattcattactggttattcattatttaggaatcttttattttgtctatagtgtcaatcctatgaatagtttgtttttcttctatagtgctttcgccttaccttttatttttaatgttcgtgttgtatcaaaagaatttataacctttttaatagctatgataagttgtttaatactaacttatatatttaatccaacatttgtggttccattaagtgcattttatttggttatattaattgttgctgtaggtaattttaaaaatagagacgaacgaattatgaaagctaaacttgaagaaaagaataagtatattaatgtactaatagctcaacaagagcgtaatagaataagtcaagatcttcatgatacattaggacatgtatttgctagtcttactttgaagtctgaattagctgttaaactcatagatactaatcctaaagaagcaaaaaatgaaatgcaggcaataaatcaactttcaacagaagccttaaataaagtcagactcattattgatgatttgaagatacaatcttttgaagatgaaatttcatcattggaacacttattgcaaaatgctaatctacattttaaatttaacaataaaagtgcggctaaatcattaaatccagcgaaacaatcaatattatctatgatttttagagaagcaattaataatgttattaaacatgcgcatgcgactgaagtaataggtgaattgaaggtacatgagcatcaaatcattttaaaaattaaagataatggtgtgggaatagaaaatgaagatgcttcaaatttgaaaagtattaaagaacgtgtagattatttaaatggtaaattaattgtacaatcaaataatggaacacttattattgttgaaatacctagaggtgatttattatga

SEQ ID NO: 1330 - DNA, 900 bp, Staphylococcus epidermidis
cataaatcaagaggtgtgacgataatgattgaactacgacatatatctaaatctttcaaggaacataaagttttagaagatataagtattgatataaaaaataattgttgtacggcattaataggtaaaaatggagcaggtaagtcaacgttaattgatattatcgttggaaataatcactatgatagtggtcaaatcgctgataaatcaaatttgttaaatagacataagatgggtattctttttcaaaaaacagagtttcctaaatacataaaggtttgcgaattattacatttatatcaatccttttatcaaacgtttatttcttttcatcagtttaaagaaatcacacaatttagtgaccgacaaatgaatcagtttgcatgtaatttatcaggtggacagcagaggattttagattttgctttagcattggtaggtaaacctgaactgttaattttagatgagcctacgtcagctatggatgtagaaatgcgtcaacatttttggaatgttatagataaattaaaaatgaataacactacgatactatatacctctcattacattgaagaagttgaaagaatggcagatcaagtaatgatgttagataaaggtaaaatacaattagatgattcacctgaaaatataaaaaggaatcaaagttattctgtaattcgaattccttgcaaatatcaagaacttatcaatcaactgaaacataaatacgaaattgaattaataaaaaatagatatgaaataaaaacaactgatgtgagtgatgttttacaattattgaaacaatatcatgtcaatttcaataagattgaaattcttaaaaaatctttattagaagtcatgttttctaatgatttgtctaaaggagggaattaccagtga

SEQ ID NO: 1331 - DNA, 1104 bp, Staphylococcus epidermidis
tatcaagaaagtttatcctgtagagggagtttaataattatgaaaagatggcaaggattagttaaagaatttaaagaatatttaccagtcaatcaatctacaccagcactaacactcaatgaaggacatacaccacttatttattgtgaaaatctttctcaaaaattagatattgaattatatgttaaatatgaaggagcaaatccgactggctcatttaaagatcgtggtatggttatggctgtaacaaaggcaaaagaacaagggaaaaaagttgttatttgtgcttcaactggtaatacttcagcatcagcagctgcttatgctgcaagagctggtttaaaagcaattgtcgtaattcctgaaggtaaaatagcattaggtaaattatcacaagcagttatgtatggtgcagaaattgtttctatagaaggaaacttcgatgaagcactagaaattgtaaaagagattgctgaagaaaatgatgaaattgaattagttaattctgttaatccatttaggattgaaggacaaaagacgggtgcctttgaaattgttgaacagttagatggtcaagcccctgacattttagcaataccagtgggaaatgcaggtaatataactgcttattggcaaggatttgttgaatatcataataaaaagaatacacaattaccacaaatgtttggcttccaagcagaaggagcatctccaattgttcaaaataaaataatcaaaaatccagaaacaatagctacagctatccgaatagggaatcctgctagttggcaaaaagctgttaatgcactagatgaatcaaatggtttaattgatagtgtgatagatgaagaaattttagaagcttatcagttaatgacaacaaatgaaggtgtttttagtgaaccagcgagtaatgcttcaattgcaggtctaatcaaacttcatcgctctggtaagttacctaaaggtaaaaagatagttgcaatattaactgggaatggacttaaagatcctgacacagctatttctctcttagataatcctattcaacctttacctaataataaagaaagtataattagatacatcaaaggggcaatctag

SEQ ID NO: 1332 - DNA, 831 bp, Staphylococcus epidermidis
ctcttgaaaggagttctatactatatgactcagtataaaatggtagttttagatatggatgatactttaatgaatagtgataataaattatccattgagacaaaatcttacttattagatattcaaaagcgtggttattatgtggtattggcctcaggtagaccaacagaaggtatgttacctactgcgagagaattagagttaaataaatataacagcttcattattagttataatggaggtaaaactataaatatggctaatgaaaatgtagaggtcgatcagcctgtttcaaaggaagatttcgataatattgtagattattgtagagataagaactttttagtacttacttatgataatggatatatcattcacgatagtagtcatgaatatatgaacatagaatcacaacttaccggattaccaatgaatcgtgttgctgatttgaaggaatatattaatcatagtgtacccaaagttatgggtgtggattatgtaggtcatattaccgaagcacgtattgaattggatggttacttcaataatgatattgatgtgacaacgagtaagccttttttcctagagtttatggcaaagaatgtttcgaaggggaacgcaataaaagcactttgtaaaagattacaaatttctctagaagaagttatagtattcggggacagtttgaatgataagtcaatgtttgaagttgctggatattctgtagcaatgggaaatgctagtgatgaactcaagaaaattgctgacgaggtaactttagataataattctaacggtattccttatgctttaaaagaacttttggtttaa

SEQ ID NO: 1333 - DNA, 1515 bp, Staphylococcus epidermidis
aggagtcatatacctatggaaaaatatattttatcaattgatcaaggaactacgagttcacgtgcgatactttttaataaagaaggagaaattaaaggtgtttctcaaagagaatttaaacaacactttccacatccaggctgggtagaacatgatgctaatgaaatatggacatctgttctatcagttatggctgagttacttaatgaaaacaatattaatgcaaatcaaattgaaggtattggtattacaaaccaacgtgaaacgacagttgtatgggataaaaatacaggtcgtccaatctatcacgctatcgtttggcaatcacgtcagacacaagatatttgtacaaatttaaaggaacagggttatgaagaaacatttagagaaaaaacaggtttacttttagacccgtactttgcgggaactaaagtaaaatggattcttgatcatgttgaaggtgctagagaaaaagctgaaaatggtgatttactcttcggaacaatcgattcatggttagtatggaaattgtcaggacgtactgctcatattacagattacactaatgcaagtcgtacattaatgtttaatatttatgacctaaaatgggatgatgagttgttagaacttttaaatattcctaaacaaatgttacctgaagttaaagaatcaagtgaaatttacgggaaaactatcgactatcacttctttggtcaagaagtacctattgctggtattgccggtgaccaacaagcagcattatttggtcaagcatgttttgaccgtggtgatgtaaaaaatacatacggcacaggtggatttatgctaatgaatactggtgaagaagcagttaagtcagaaagtggcttgttaacaaccattgcatacggtttagatggaaaagttaattatgcacttgaaggttcaattttcgtatctggttctgctatccaatggctacgagatggtttgagaatgattaattctgcgccacaaaccgaaaactatgcttcaagagtagagtcaactgagggtgtttatatggttccagcatttgttggtttaggtacaccttattgggattcagaagcaagaggtgctattttcggattatctcgtggtacggaaaaagaacatttcattcgtgctacattagaatctttgtgctatcaaacaagagatgttatggaagctatgtctaaggactcaggtattgaagttcaaaatttacgcgttgatggtggtgctgtaaaaaataacttcattatgcagttccaagcagatatcgtaaattcatctgttgaaagacctgaaatccaagaaacaacagcacttggtgctgcatatttagctggattagctgttggattctgggatgataaagaggatatccgtgaacgttggaaacttcaaactgagttcaaaccagaaatggatgcagatcaacgtcataaactttatagtggttggaaaaaagctgttaaggcgactcaagtatttaaattagaagattaa

SEQ ID NO: 1334 - DNA, 582 bp, Staphylococcus epidermidis
atgactgaaatgacaaagccttttttaatcgttattgtaggtccaactgcttcaggtaaaactgagttaagtattgaagttgctaaaaaatttaatggagaaattattagcggagattcaatgcaggtctatcaaggaatggatattggtacagcaaaagttacaactgaagaaatggaaggtataccacattatatgatagatattttgcctccagatgcttccttttctgcatatgaatttaaaaaaagggcagaaaaatatattaaagatattactagaagaggcaaggtgcctattatagcaggaggaacaggactatatatacaatctctcttatacaactatgcttttgaagatgaatccatatctgaagataaaatgaaacaagttaaattaaagttaaaagaacttgagcatctaaataataataagctccacgaatatttagcttcattcgacaaagaatcagccaaggatatacatcctaataacagaaaaagagtgttgcgagcaatagaatattatttgaaaacaaaaaaacttttaagtttctcgcaagaaagtgcaccaatttactga

SEQ ID NO: 1335 - DNA, 372 bp, Staphylococcus epidermidis
tttattatgatatcgcttgttataactgaggatcaattgatgttaagaaaagctatggtacaactgatagaaatgcatgaagaaatgaatgtaataaaagattttgaaaatggtgtagaggcactcgaatttattgaaaataatgaacccaatgtagccattttagatattgaaattccgggtttaacaggcttggaaatcttatcttatgtaagaaaaaaacaactcaatacaagaataatcatagtgactacatttaaacgtccaggttattttgaaaaagccgtagcaaatgatgttgatgcttatgtactaaaagagcgttcaattgatgatttaattaaaactatttataaagtgacaaagggttga

SEQ ID NO: 1336 - DNA, 1359 bp, Staphylococcus epidermidis
aattggaggatttataccatgccaaaacgtagttttacaaaagatgatattcgtaaatttgctgaagaagaaaacgtaagatatttaagattacaattcactgatattttagggactattaaaaatgttgaagttccagtaagtcaattagaaaaagtattagataatgaaatgatgtttgatggttcatctattgaaggtttcgttcgtatcgaagaatcagatatgtatttacatcctgatttagatacttgggttatcttcccttggactgctggacaaggaaaagttgcacgactaatctgtgatgtatttaaaacagatggtacaccatttgaaggtgatccacgagctaacttgaagcgtgtattaagaagaatggaagatatgggctttactgattttaatctagggcctgaaccagaatttttcttatttaaattagacgaaaaaggcgaacctacattagaattaaacgatgatggtggttatttcgatttagctcctacagatttaggtgaaaattgtcgccgtgacatcgttttagaattagaagatatgggctttgacattgaagcaagccaccatgaagtagcgccaggtcaacatgaaattgactttaaatatgcagatgccgttacagcatgtgataatatccaaacatttaaactagttgttaaaacaattgcacgtaagcataatttacatgcaacatttatgccaaaaccattatttggtgtaaacggtagtggtatgcacttcaacgtatcactatttaaaggaaaagagaatgcgttctttgatcctgaaggtgatttacaattgactgatactgcatatcaatttacagctggtgtccttaaaaacgctagaggattcactgcagtatgtaatccaattgtcaactcatataaacgtcttgtaccaggttacgaagcaccatgttatattgcatggagtggtaaaaaccgttcacctttagtacgtgttccaacatctagaggtctatcaactcgtattgaagtacgctcagttgaccctgcagctaacccgtacatggcattagcagcaatcttagaagcagggttagatggaattgagaataaacttgaggttccagaacctgtaaaccaaaatatctacgaaatgaatcgtgaagaacgagaagcggttggtatccaagacttaccttcaactttatacactgcgttaaaagcaatgcgtgaaaataaatcaattaaaaacgcattaggtaatcatatttacaatcaatttattaactcaaaatcgattgaatgggattactatagaactcaagtatccgaatgggaaagagaacagtatattaagcaatactaa

SEQ ID NO: 1337 - DNA, 357 bp, Staphylococcus epidermidis
ggactttttgtggcaactggaagtgtcatttttcaagctggcccaggaggagctatattagcttatatactaattggtattatgctttattttttaatgtcatcaataggagaattagcaactttctatccggtttctggttcttttagttcatactctaccagatttgttgattcgtcacttggttttacaatgggttggttgtattggggtatgtggtcacttgtaacaagtgtagatatcattgttgcttccaatgtattacaatattgggatgtatttaaagttttaaatccacttacatggagcttaattttcttcactctgttgtttttaattcatatttttttctgttaa

SEQ ID NO: 1338 - DNA, 1035 bp, Staphylococcus epidermidis
ttcatatttttttctgttaaagcttttggagaaactgagttttggttatcactgatcaaagtcattactataattgtatttattatttttggaattatgatgattttcggtattcttggtggtcatacatatggctttgagaattatactaaaggtcaagcaccttttgtcggtggaatatcaggcatattaagcgttcttttagttgcaggtttttcagttggtggtactgaagtagtcgcagtaacagctggtgaatcaaataatcccgaaaaatcaatgcctaaagctataaaacaggtattttggagaatattactcttttacgtattgtctatagctgtgatagctgccatcattccatatacggatccacttttacttaatgaaaatgagtctgtatcacaaagtccgtttacaattgttttcgatagaatagggatcgcttttgctgcatcagtcatcaacgctgttatcttaacatcattattatcagcagctaactctggtatttatacaacaagtagaatgctattttctttaagtgctgataaacaagcacctaaattctttggaaaactcaatgataaaactaaattacctatgcgtgcattaattacaacatatattattattgtattagtcattgtttatgctaattttaatgctaatgctgtatttaacttattaaatatcataggatctatggttattgtagtttggggatctagtatttggtcacaaattagattaagacaagcaattaaaaaacagggtaaaaatccagataaactgttgccatataaagcacctttttacccagtcggacctattattgtccttttcacattattattcttattattaggtagttcctttggtagtatcgcatctggtgatattttaggtgtcatacgaaactttacaccattatttattctagctatcatctatattgctcataaattaatcaaacggacacattttgtcaaactggaagaaatagatttaactccgcataattacaagaattaa

SEQ ID NO: 1339 - DNA, 1485 bp, Staphylococcus epidermidis
gagtatttagtaatgaattttggatttttgggtactattttaactatattgttagtagttgggtttataactaacgtagtattggcatttgtcatcattttccttgaacgtgatcgacgtactgccagttcaacttgggcgtggttattcgtattattcgttcttcctgtcattggatttattttgtatctatttttaggacgaacggtttccaagaaaaagatggaaaaaaataacggtgatgaattacatgcatttgaagatttagttcaagaccaaatcgacagttttgataaacataattatggttatatcaatgatcaagtcattaaacaccgtgatttaatacgtatgttgttaatgaaacaagatgcctttttaacagaaaataataaaatcgatttatttacagatggtcataagctttatgaaaaagtacttgaggatatttacaatgctcaagactatatacatctagagtactatacctttgaacttgatggattaggtaaaagaatcttagatgcacttgaaactaaacttaaagaaggtttagaagttaaacttttgtatgacgatgttggttctaaaaaggttagattatcaaaatttaaacatttcagagcattaggtggagaagttgaagcatttttcccttcgaaagtacctttaatcaatttcagaatgaataatcgaaatcatagaaagattatcattatagatggacaaattggttacgttggcggttttaatgtcggcgatgattatttaggattaggtaagttaggttactggagagatacacatacacgtgttcaaggtgaatgcatcgatgcactacaattaagatttattttagactggaattcacagtcgcatcgtccacaatttaaatttgatcaaaaatatttccctaaaaaaaatggggacaaaggaaacgcggctattcaaatcgcttctagtggacctgcatttgatttacatcaaatagaatatggttatacaaaaatgataatgagcgctaaaaagtctatctatctacaaagcccttactttattccagaccaatcatacattaatgcattaaaaatggctgctaatagcggcgttgaagtaaaccttatgataccgtgtaaacctgatcatccattcgtttattgggctacattttcaaatgcagctgatttattggatagcggagttaatatttacacttatcaaaatggatttattcattctaaaatattaatgattgatgatgaaatttcttcaattggtagtgcaaacatggactttagaagctttgaactgaatttcgaagtgaatgcatttatatatgatgaagatatagctaaacagttacgtcaagcatttgaaaaagatattgagcaatctaaattacttacaaaagaagtatacgacaagcgtccattatcaattaaatttaaagaaggactagcaaaattaatatctccaattttataa

SEQ ID NO: 1340 - DNA, 258 bp, Staphylococcus epidermidis
ataaaaggagttctaaccatgattgcaaacgaaaacatccaagaccaagcactagagaactttaaatcggaaaaaactgaagtcacaattttctttttaaatggctttcaaatgaaaggtgtcgttgaaaattatgacaaatatgttgtaagtttaaattctcagggtaagcaacatctgatttacaaacatgcgatcagcactttcactgtagataatgaatcgtctgaagcaactgaagtgaatagtgaagaataa

SEQ ID NO: 1341 - DNA, 1677 bp, Staphylococcus epidermidis
ataatgtcattatctacattgaaaagggatcatattaaaaagaatttaagagacactgaatacgatgttgttatcgtaggtggcggtattacaggtgcaggtattgctttagatgcaagtaatcgtgggatgaaggtagctttagtagagatgcaagactttgcacaaggtacaagttcacgctcaactaaacttgtacacggtggtttaagatatttaaaacaactgcaagtaggggtagttgcagaaacaggtaaagaacgtgctattgtttatgaaaatggtccacatgtgacaacaccagaatggatgcttttacctatgcataaaggtggtacatttggtaaattctcaacttctattggactagctatgtacgatcgtctagctggtgtcaaaaagtccgaacgtaaaaaaatgttatctaagcaagaaacgttaaataaagaacctttagttaaacgtgatggattaaaaggcggtggctactatgtggaataccgcactgatgatgcgcgtttaactattgaagttatgaaaaaagctgctgaaaatggagcagaaatcattaattatacaaaatcagaacacttcacttatgattccaataagaaagtaaatggtattgaagtattggatatgattgatggcgaaacgtatgcgattaaagctaaaaaagttattaatgcttctggtccttgggttgatgaagtgagaagtggcgattatgcacgtaacaataagcaattaagattaactaaaggtgtacacgttgttatagatcaatctaaattcccattaggtcaagcagtttactttgatactgaaaaagacggacgcatgatttttgcgattccacgtgaaggaaaagcttatgtaggaacaactgacacgttttatgataatgaaaaagcaacacctttaacaacacaagaagatagagactacttaattaatgcaattaactatatgttcccaacagttaatgttaaagatgaagatattgaatcaacatgggctggtattcgtccgctaattcttgaaaaaggtaaagatccttctgaaatctcacgtaaagatgaagtttgggaaggtgaatctggattattaactatagcaggcggtaaattaactggttatcgtcatatggcactagaaattgttgatttattagctaaacgtttaaaacaagaatacggattgaaatttgaatcatgtgccacaaaaaatctaaaaatttccggtggtgacgttggcggaagcaaaaactttgaacactttgttgaacaaaaagttgatgcagctaaaggatttggaattgatgaagatgtggcacgtcgcttagcaagtaaatatggttcaaatgttgatcaactatttaatattgctcaaacggcaccatatcatgatagtaaattaccattagaaatttatgttgaattagtttatagtattcaacaagaaatggtttacaaaccaactgacttcttagtacgtcgttctggcaaattatactttaatattcaagatgtgttagattataaaaatgctgtgatagatgttatggcggatatgcttaattatagtgaaactcaaaaagaagcttatactgaagaagtagaagttgcgattgatgaggcacgtacaggtaatgatcaacctgcaactaaagcttaa

SEQ ID NO: 1342 - DNA, 417 bp, Staphylococcus epidermidis
actaaatcttcaaatgcatgtaattcatcaccgttatttttttccatctttttcttggaaaccgttcgtcctaaaaatagatacaaaataaatccaatgacaggaagaacgaataatacgaataaccacgcccaagttgaactggcagtacgtcgatcacgttcaaggaaaatgatgacaaatgccaatactacgttagttataaacccaactactaacaatatagttaaaatagtacccaaaaatccaaaattcattactaaatactcctattcagtctttcaccaagaaaatttagccgccgatttactgaactatgcttccgttaccaatgttaaaatagcattaaagtcctcgtcattatgcggaaatgcacgttcttcgatttgtttaatagtaatgtttaataatttgtaa

SEQ ID NO: 1343 - DNA, 747 bp, Staphylococcus epidermidis
aggagggaattaccagtgatatcaacttattttaaaatagaattaaagattatatttagaaagaaattgtatttagttatgtccatattcctacctgtcgtgttttatttattatttacttctatattagacatgccagaagaagcaaaacttaagttttataaagagtatatgtacagtatgacagtatttagtttaatgaacttttgtctattgtcatttccattagatttgattgaagagcgaaatcaaggttggtataagcggttaatggtgaccccattatcatcatttcaatattatttagttaaaattagtaagacaatgtgtcagtttttaatagcaattacaattattttttcagtagctcatttttacaaagatgttcacatgactgtttttcaatggatattctctgcattaactttatggattggggttagtttatttttgactttaggattgattatcgctcaactcaacgatattcaaaaagcaagtagttttgccaatttacttaatattacactagctatattaggaggtctatggtttccagtatacacgtttcctgattggcttcagtcgatttctaaacacatgccaacatataatttaaagctacttgctatagatttagcgcaaaataaaggggtgaatatagaagcgtttggctatctcgtggtctattgtataatctttgtgagtattgctttattcatgaataagaaaggagatgtacactaa

SEQ ID NO: 1344 - DNA, 510 bp, Staphylococcus epidermidis
agtattatatctaaatctgacataaatttctattattgtattaataaaaaaatttggagaagtgatattatgaaaacttttaaggcagtaagatttcaaattgtgaatgaacatggtgcaatatcagaatacgtcattgaagatggtgtgattataaataaagaaggaagtggcactgggtggttactagaaatagtaatttcaaatgaacactatgaaacatttaagcaatataaggataacaaacaacttttagatattagagtagtcatcacaagacctgctaacgatccagcgttatttaatgcaacagttaaaagcgttaaaaattttaaatattcaatgtcagtcgttttagaatgtcacatctacactttgagacaagaatacgctgagagtttattagaagaattagttgatgaaggacttacaggtgaaaagttgaaaaaaacatttaatcgtatgatgcaatcaaaacctaagttgaaagatgagaaaatcgaaagataa

SEQ ID NO: 1345 - DNA, 693 bp, Staphylococcus epidermidis
gaaaacaaatcacttttaggaggatttttaataatgaaaaaaacattagttgcatcatcattagctataggactaggcgttgtagcaggtaacgcaggtcatgacgcacatgcaagtgagactacaaatgttgataaagcagagttagctcaaaaagcgttaactaatgatcaatcactaaatgaaagccctgttcaagaaggtgcttataatattaattttgattacaatggtaattcatatcattttgaatctgatggttctacttggagttggagttatgaatcaacaaacaatgctacgcaacctgttcaaccaagccaatctcaagtagctacacaacaacaacctgtacaagtatcagcaccacaaaatgagcaaacagcacaaccacaaacaaaatcaacatctacaagtcaaacttcttcaagtaaagcttcaagtggttcatcagtaaatgtaaattcacatttacaacaaattgctcaacgtgaatcaggtggcgatattcatgcaataaacccatcttcaggtgcagcaggtaaatatcaattcttacaatcaacttgggattctgttgctccaagtcaatataaaggtgtttcacctgcaaaagctccagaaagcgtacaagaccgagcagcagtaaaattatataatactggtggcccaggtcattgggtaactgcataa

SEQ ID NO: 1346 - DNA, 426 bp, Staphylococcus epidermidis
ggtgatttcccacccaattcaagagacacttttttgaagtcttttgcagctttttccataatttttgaacctgtaggaccagaacctgtaaatgacatcattcttacttttggatgttcacttaaaggatttcctactccagatccatcaccattgactaagttaaacacacctttaggtacgcctactttatcaaaaatttctgctaaaataattgcagcaaatggtgtttcttcagatggttttaaaacaacagggctaccagcagcaaacgcagcagctaatttaagtgaagtttggtttgtagggaaattccaaggtgtaacaagtccagcaactccaattgcttctttaacaaccaaatcatcgccacgttgttcttcaaattggaagctatctaaagcatctcttgcagctgtaaaatga

SEQ ID NO: 1347 - DNA, 300 bp, Staphylococcus epidermidis; identical to SEQ ID NO: 233

SEQ ID NO: 1348 - DNA, 714 bp, Staphylococcus epidermidis
ttttattttttgaggaggctaattatgacattttcaaaagagttgagggaagcatcaagacctattattgatgacatttacaatgatggttttattcaagatttactagcaggtaagttatctaatcaagctgtaagacaatacttaagagcagacgcttcttatttaaaagagtttacaaatatttatgcaatgctcatacccaaaatgagttctatggaagatgttaaatttctagtagaacaaattgagtttatgttagaaggagaagttgaagcgcatgaggttctagctgatttcattaatgaaccatatgaagaaatagtaaaagaaaaagtatggccaccaagtggtgatcattatattaaacatatgtacttcaatgcatttgcacgtgaaaatgcagccttcacgattgcagcgatggcaccctgtccatacgtctacgctgtcattggtaaacgtgcgatggaagatcccaaattaaataaagaatcagtgacttctaaatggtttcaattttatagtactgaaatggacgaacttgttgatgtgttcgatcaattgatggaccgtttaactaaacattgtagtgagacagaaaaaaaagagattaaagaaaatttcttgcaaagtactattcatgagagacatttcttcaatatggcatatattaatgaaaaatgggaatatgggggaaataacaatgaataa

SEQ ID NO: 1349 - DNA, 672 bp, Staphylococcus epidermidis
aggaggacgtttgaaatgagtattttagttattggagcaaatggaggcgtaggttctaaactagtaagtcaattaaatgaagaacacgttgattttacagctggtgtacgtaaggaagatcaagttaaagaattagaaaataaagggattaaagctacattaatagatgtagaaaaaaatagtattaatgatttaaaaaatatctttacagattatgataaagttatcttttcagttggatctggtggaagcactggagcggataaaacaatcattgttgatttagatggtgctgtaaaaacaattaaagctagtaaagaagcgggtatcaaacattatgttatggtatcaacatacgattctagacgtgaagcattcgatgcgagtggagatttaaaaccgtatacaattgcaaagcattatgctgatgattacttaagaacatcagatcttaattatacaattgtacatccaggttcacttacagatgatgctggaactggaaaaatagaagctgatttatatttcgacaaagcaggatcaattccacgtgaagatgttgctacagttttaaaagaagtagtaacttctgatggttttaataatcaagaattccaaattttaagtggcaatcatggtgttaaagatgcattgaaaaactatgaatcttaa

SEQ ID NO: 1350 - DNA, 1215 bp, Staphylococcus epidermidis
tacgcaaagtttcaaagggagttagatacaatgcataataaacaaaagatattagattttatagaaaataataaatatgattatgtagaaataagtcatcgtattcatgaacgccctgaattaggcaatgaagaaatttttgcatcgagaacattaattgaccaattaagagcaaatcgattcgaaatcgaaacggatattgcaggacatgcaacaggatttatagcaacgtatgattctgatatgactggaccggttataggatttctagctgaatatgatgctttacctggtcttggtcacgcatgcgggcataatattattggtactgctagcgtacttgctgcagtagcactaaaagaagtcgtcgatgaaattggtggtaaagtagtcgttttgggatgtcctgctgaagaaggtggggaaaatggctccgcaaaagcttcttatgttaaagcaggtgtcattgatgaaattgatgtagcattgatgattcatcctggaaatgaaacctatcgtacaattaatactttagctgtggatgttctagatattaaattctatggacgtagtgcgcatgcatctgaaaatgcagatgaagcattaaacgctttagatgcaatgatttcatattttaatggtatagcacagttaaggcaacacattaaaaaaggacaacgagttcacggggttattttagacggtggtaaagcggctaatattatacctgattttacacatgcgagattttatactcgagctacttcacggaaagaacttgatgttttaactgaaaaagtaaaccaaattgcaagaggtgctgcgattcaaactgggtgtgattttgaatttggtcctatccagaatggtgtaaacgaatttatcaaagcgcctaaacttgatgatttatttgaaaaatatgcaactgaattaggagaagaagtgattgatgatgattttggttatggatctacagatacaggtaatgtaagtcatgttgtaccaactatacatccacatattaaaattggttctcgaaatcttgtaggacatacccaccgctttagagaagcggctgcaagtttacaaggtgatcaggcactcattcgaggtgcaaaaattttagcattaatgggactagaattaatcgaaaataaaccgttgttagacgaaataattgaagagcatacgcatataaaggggcatgttaagtaa

SEQ ID NO: 1351 - DNA, 1194 bp, Staphylococcus epidermidis
atgatgactacaccgttcaaaagaattcatctaatagttatggactcagtaggtataggcgaaggtcctgatgcagcggcattcaatgacgaaggatcacacactttaaagcatactttagaaggatttaagcaaaagttaccacatctagaacaacttggattaggaaatattgcaccgcttcctgttgtttcaaaagttacacatccaggtgcattttataccaaactaagtgaagcttcagtaggtaaggatacaatgactggacattgggaaattatggggttaaatataatgcaaccatttaaggtttatccaaatggtttcccagaagagcttgttaaagagattgaagatatgactggacgaaaggttgtagcaaatagacctgcttcaggaactcagattattgacgagtggggcgaacatcaaatgaaaactggagatttaatagtttatactagtgctgatccagtcttacaaattgctgcacatgaagacgtgattccacttgaagaactttacgagatttgtgaaaaagttcgtgaactaacaaaagatcctaaatatttaatagggagaatcattgctcgaccatatgttggtgaacctggtaacttcactagaacttctaatcgacatgattacgcgttaaaaccatttggacgaacagtgatgaatagccttaaagatagtggttatgatgtaatcgcgattggtaaaattaacgatatttatgacggtgaaggcgtgacagaagctatacgtactaaaaataatatggacggtatggatcaattgattgaagttgtaaaaaaagattttgaaggtatcagtttccttaatttagttgattttgatgcattgtatggccatcgtcgtgataaagaagggtatgctcaagcaattaaagattttgatcttcgtttacctgaattaatgaatcatttaagagaagatgatttagttattattacagctgatcatggtaatgatccaattgctaaaggtacagatcatacacgtgaatacattccacttttaatgtttagtccgaaaattaaagattatcatgaactttcacaagacacgacatttagctctatcggtgttacaatagcagataacttcaacgtagaattacctaaatatggaaaaagttatttaaaagaaatgggggttgagcatcaatga

SEQ ID NO: 1352 - DNA, 912 bp, Staphylococcus epidermidis
attatgtggttttgctttttgaaatccggatttataataattaaacaaattttaagcactccttttttttcatataaatacaatatcaaaattctaataaattttaaattaatatctaacataatagagcacaaaatgttagaatatgctaataagataacattgaagggagataatatcatgaaatttgctgttatcactgatattcatggaaactttgatgcgcttcaaactgttttagatgatattgatagtagagatgatatcgaaaaaatttataacctaggtgataacatagggattggacatgagacaaataaagtactggatactatatttgaccgggatgatatggaaatgattgcaggtaatcatgatgaagctattatgtcactcgtcaatggaacaccttatcctgaagatttaaaagggaaattttatgagcatcatcaatggatagaaggacatttagatgagtcctattacgatgaaattaatcaattgcctagatatattgaaatgaccataaaagggaaaaagattttatttattcattatgaaattgaaaatgataaaatgtcagctcctattgatgaacaaccttttgcacctattacaaaagatgacgaacaagctatttctgaattatttaaagacaaagaagccgatttaattttatttggacataaccataggttgcatatgtttgatgataaatcaacagtatattttaatcctggatcagtaggtttgaacaatggttcaaacaccgtatatggtattattaccgttaatgaaaaaggaatttcagtagagagagtgaaattagcgtacaataatgaagaatttttagcaggatttgaagaaaagcaagtaccagctagagaatttatatttaagaatttcatttaa

SEQ ID NO: 1353 - DNA, 1029 bp, Staphylococcus epidermidis
atgatatacacgtttcaactttacttaaacaagccattcaccactccaaacatcctagtgaaggtggaatttctaatgacaaatcataatcatcaacatcatcattctcatgcacacggacacgttcatacagataataaaaaggtactcatgttttctttcattatcattagtctcttcatgcttgtagaaattataggtgggtttttagcaaatagtctagcattattgtctgatggttttcacatgctaagtgacgctatatccttaggagtagctcttatagcttttatatatgctgaaaagcatgctacaaaaagtaaaacatatggttacaagcgttttgagattttagcagcacttttcaatggagttaccctatttatcatcagtattattataataatcgaagcgatacgaagatttttagaacctcctgaggttcaatcgaaggaaatgttcatcattagtgtgattggtcttatggtaaatatcattgtagcgatacttatgtttaaaggaggagatacctctcacaaccttaatatgagaggcgcatttttacatgtacttggagacttgttcggctctgttggcgcaatcgttgcttctcttttaatttggggctttaattttacaatagcggatcctatagctagtattttagtttcgttaattattttaaaaagtgcttacggcatttctaaatcatcccttaacatattgatggaaggaacgcctaatgatatagatttaaatgctgtaattaaagcaattagtaaagatgaaagaattcaaaatgtacatgattgtcatgtatggaccatttcaaatgatatgaatgcattaagttgtcatgcagttgtaccagaatatttatcagttcaaacgtgtgaaacaatgttaaagtcaatcgaaagtgacctattgcaattaaatattcagcatatgacaatacaacttgaaacaccagaacacaaacacgatgaatcaacattgtgctcaggtatacatgaacactctcattag

SEQ ID NO: 1354 - DNA, 1686 bp, Staphylococcus epidermidis
atacataggttactcacagtttttaatagattttatcaatcattaaatagtttactaaattttacaggaggtcagacaatgacaaagtttatttttgtaacaggcggggttgtgtcatcattaggaaaaggaataacagccgcttctctaggaagattacttaaagatagaggacttaaagttacaatacaaaaattcgatccatatttaaatgtagacccaggcacaatgagtccgtatcaacatggtgaagtgttcgttacagacgatggtgctgagactgatttagacttaggacattatgaacgttttatagatattaatttaaataaatattcaaatgttactgccggaaaagtatattcacatgtgttgaaaaaagaacgccgtggtgattacttgggtggtactgtacaagttattccccatattacaaacgaaattaaagaaagattgctattagctggtgagagtactaatgcggatgttgtaattactgaaattggtggaacaacaggtgatatagagtctttacctttcttggaagccattcgtcaaattagaagcgacttaggtcgtgaaaatgtaatgtatgtacattgtactttgctaccatatattaaagctgctggggaaatgaaaacaaaacctacacagcacagtgttaaagaattacgaggtctaggtattcaacctgatttaatagtagtacgtacagaatacgaaatgacacaagatttgaaagacaaaatcgccctattttgtgatatcaaaaaggaaagtgttatagaatgtagagatgcagattctctttatgaaattccgttacaacttagtaagcaaaatatggacgacattgttattcaacgtttacaattaaatgccaagtatgaaacgcaattggatgagtggaaacatctattaaataccgttaataatttagatggtaaaattacaatcggtttagttggtaaatatgtgagcttacaagatgcttatctatcagttgttgaatcacttaagcatgctggttatccatttaaaaaagacgttgtggtaaaatggattgattcaagtgaggtcaatgatgataatgttgaggcttatttatccgacgttgatggtattttagttcctggtggatttggattcagagcaagtgaaggtaaaattgcagctattcgttatgcccgtgagaataacataccattctttggcatttgtctaggaatgcaattggcaactgttgaatttgcgcgtcatgttttaggctatgaaggtgcgcattcagcagaattagatccaagtacaccatatccaattatagatttattaccagaacaaaaagatattgaagatttaggtggaaccttaagacttggtctttatccttgccacattaaagaaggtacattggcagagaaaatttataataaaaacgatattgaagaacgtcatcgtcatagatatgaattcaataacgagtttagggaacaattagaaagtaacggtatggtattttcaggtacaagtccagatggtcgtttagtagaaattattgaaatacctaaaaatgatttctttattgcatgtcaattccatcctgaattcttatcaagacctaatcgtccacagcctatatttaaatcatttgtagaagcggcgttgaattaccaacaaaaataa

SEQ ID NO: 1355 - DNA, 294 bp, Staphylococcus epidermidis
gggagcttgactgcgagacctacaagtcgagcagggtcgaaagacggacttagtgatccggtggttccgcatggaagggccatcgctcaacggataaaagctaccccggggataacaggcttatctcccccaagagttcacatcgacggggaggtttggcacctcgatgtcggctcatcgcatcctggggctgtagttggtcccaagggttgggctgttcgcccattaaagcggtacgcgagctgggttcagaacgtcgtgagacagttcggtccctatccgtcgtgggcgtag

SEQ ID NO: 1356 - DNA, 786 bp, Staphylococcus epidermidis
tcatattgcgccctctactacaaagggagtaaaaatttaatagaaagaggtgagtttatggatcacaaatccccactcgttagttggaacgtctttggtttcgatattgtttttaatttggccagtgttttaatggtagtgattacagcaattttagtttttattttagctatagtttgcactcgaaacttaaagaaacgaccaactggaaaacaaaacttcattgaatgggtatttgattttgttagaggtattattgaaagtaatatggcctggaaaaaaggtgggaatttccacttcttagcagtgacattaattcttttcatttttgtggccaacatgcttggtttaccgttcgcaattgtcactcatgaccatacgctatggtggaaatcaccaacagcagacgctacggtaactctaacgttatctacaactatgattttgttaacgcactattacggtattaaaatgcgtggaacaaaagcttatgcagctggatattttaaacctttctggccattagctattattaatgtattcgaagaattcacttctacattaactttaggtctacgtttgtacggtaatatttttgcaggtgaattattactcggtttacttgcatcattgttctttgaacaacctgcatggggttggataattagtattcctggattaattgtttggcaagcgttctctatattcgtgggaacaattcaagcatatatctttgtaatgctttcaatggtttacatgtcacataaagtggcagacggacattaa

SEQ ID NO: 1357 - DNA, 636 bp, Staphylococcus epidermidis
ttaagcgattatgttttgaaaaaggtggaactatcaatgtatgaaacgtaccattcaggttggattgaaaccataacaggaagtatgtttagtgggaaatctgaagaacttatacgtcgcttaagacgtggaatatacgctaaacaaaaggtggttgttttcaaaccagcaattgatgatcgttaccataaagaaaaggtcgtctcacataatggtaatgagatagaagcgattaatatatctacagctcaagaaattttaaatcatatgctagaagaagtaaacgtcatcggaattgacgaagtgcaattttttgaagacgatattgtcaacatagttgaaaaattagctgaaaacgggcatcgtgttattgtagcaggtttagatatggattttagaggagaaccgtttaaacctatgcccaagttgctcgcagttagtgaacatattacaaagttgcaagcagtatgttctgtatgtggttcaccttcgagtcgtacacaacggttaataaatggtgaaccggcgaaagtagatgatcccatcatattggttggtgcaaatgaaagttacgagccacgttgtagagcacatcatatagttgcacctagtgaaaatgagaaggaggaaatgtag

SEQ ID NO: 1358 - DNA, 573 bp, Staphylococcus epidermidis
caagtttgctatgttccttttttattttatacaaaggggtgggttcaaatgcgtgatttacaacaactgcttgatgaattgaaagatatgtcattctttaatccaggcgaaatgtgtatcattggttgttcaacttccgaagttataggtaaacgtattggttctgttggatcaatggacgtagctaaagaaatttacgaaaatttgaaacaactagagattgatacaggcgtgacatttgcttttcaaggatgtgaacatattaacagggcagtaacgatagaaagagcaaatttcaacccattgactatggaagaagttactgtcgttccagacgttcatgcaggtggtagtttatccacttacgcttatcaacaaatggaagatcctattgttgttgagcatattactgtttcaaaaggtatagatataggtcagaccttaattggaatgcatattaaacatgtgtgtgttcctgtaagaacaagtgttaaacaaattggagaagctatcgttaccatagcgacatctagacctaagaaaattggtggcgaacgagctaaatatcaataa

SEQ ID NO: 1359 - DNA, 207 bp, Staphylococcus epidermidis
tctgtgcgatattctttaaataagttttactattttgttatcacaatacgaattattttacctaaagagtttaattatctaagattaagcatcttgaatagcaaaagtaagttcacagctacaagcaagttggccatcaacagtcgctttagccgaacccttaccaataggaccttttattttagttatttcaacttccaacattaa

SEQ ID NO: 1360 - DNA, 375 bp, Staphylococcus epidermidis
acaaatattcatatgttggagtgtgaattttcaatgagtggatatcatattaacgttgaaagcaatcaggatacattgattaaagtcactcatattttcaaagctttaagtgattttaatcgtgtgagaataatggagtttcttgaaaacggtgaagcaagtgttggacatatttcacattctttaaatatgactcaatcaaatgtatcacatcaattgaaactacttaaaagcactcatcttgttaaatctaaaagacaagggcaatcaatgatttattctatagatgatatacacgtttcaactttacttaaacaagccattcaccactccaaacatcctagtgaaggtggaatttctaatgacaaatcataa

SEQ ID NO: 1361 - DNA, 672 bp, Staphylococcus epidermidis
aaatcaagtcaaaaaggtagagatatgaatatgatgtttgattcaaaacaattatcagtctattttatttgcggaacacaagatatacctaaaaataaatcaattgagcaagttctcaaagaggcattagaagctggaatcacgctatatcaatttcgtgaaaaaggtccgaatgcactaaaaggggaaaagaaaaaacagttagccttaaaacttaaacaattatgtcactcatatcacgtacctatgatagttaatgatgatgttcaattagcccaagagattaatgctgatggcattcatgtaggtcaagatgatatggaaattcaacaatttgcaagccaatttaaaaataagattataggtttaagtgttgggaatttgaaagagtatcaacaatctgatttgtctaaagttgattacattggagtaggtccaatgtatacaacatcatcaaaagatgacgctagtaaacctgttggtccatctatgatatctcaattaagattatatattcatgattttcctatagttgccattggaggtataaatgaaactaacgtgcagcctattgttgacgaaggtgcagatggtatttctgtcatctcagctattacacgtagtaccaatatagacaaaacggttaaatatttcttaagatatttcacctaa

SEQ ID NO: 1362 - DNA, 687 bp, Staphylococcus epidermidis
actaaaaaacatggaggaaaaatgatgaataaagcaaaattgatagaccatacattattaaaacctgattcaacaaaggaacaaatagatactattataaatgaagcaaaagcatatcagtttaagtctgtatgtgtgaaccctacacatgtacaatatgcatctgaacaacttaaaggaacagacgttttagtgtgtactgttattggatttccactaggtgcaacaactacagcggttaaatcttatgaaacaaaagatgcgattaacaatggtgcccaagagattgatatggtgataaatattggagcacttaaggatggctgttttgatgaagtgcaaaatgatatcgaagccgtcgttcaagcagccaatggtaaaacagttaaggtaattattgagactgttttattaactgagaaagagaagattaaagcatgtcaattatctgaagcggcaggtgcacattttgttaaaacatccacaggttttgctggtgggggtgcaacagttgaagatgtaaaattaatgaaagatactgttggtgatcgtttagaagtaaaagcgtcaggcggcgtgagaaatctagaagattttaataatatgattgaagcgggtgctacacgtattggtgctagtgccggtgtgcaaattattcaaggacttgaatcaaatactgattactaa

SEQ ID NO: 1363 - DNA, 1404 bp, Staphylococcus epidermidis
attaattttaagataaggagcattataatgactgaggaaattaactatttttggcttaattgtggttacaatagatggaatcataatgaaccattagtgggacagacagcgttatttgaatctggcgcacattttaatcctacacaaggatatagagcatttaaaaaagctaaagctggagatcaagtgattttctatcaagtacaaacagattctggacttttaggtataggtgaaattataagtgtgcaatccggtgctcaaaataaaataagagtagaatttaaatttaaagaaacgctaaaaccacttacaacggattatcttaaaagaagtgaaacactcgattttcgtatgagtaacatgagggaaacacttttcaaccaaatcagagagtcagaatttgagttaatagttagtttaggtaaaggaaaatcgaaaattcctcgatattttttattagcagaaacagaagcgtttgaacctggtaaaaactatactatatttactcatacatttaatggaatcaaaaggaatggttatcatttttacactcaactagaggtgggtgataacattattatatataataaatatcaaaaccaatcggttatcggtattggcgaagtatcaaagcatatacatgagaaaccacctataccaggtcgaacgaatagtacagctattgaaattttttatgagaaagatatcaagcccatttcattaggtcatttaaataaacatcctaaattgaagaatctgtactttttacaagaaaatgcgaaacagtcaatagcaagtatgtcacaagctcaatacgatgccattttggacatgagtatgaataatggtattaaacatccttttgaaacagtaaaaaaagcagaactatcaactcaaaatgctgaagatgatagtttaaaaccttttgtattattagttgttgaacaaaaaggagaaggcttaaaggcagctgaagaattactccaaaaaacaaatgcaaaccctgtgattactagcggacatccagattttactgaagatatgctttatggtaaatatttacctaatgagtcaggagcgctatattatcgtgaaggattcatcacacatctaatgcctaagaaagataaaagttatttagtcattgataacttcaatcgcatcgatgtagatattttccaaacatatattaatgtacttgaaggctatgaagtgacattaccgagatataataaagatggaagcatgattaagtggtcaaaaaataaagattctttttatcattttaatcctaattggcatattgttggtattacatatgactctatagaaaaaattaagcaaaaatattcgtcacagtttttaaaatatacgcgtatcgtcaaagtgaatcatgactaa

SEQ ID NO: 1364 - DNA, 1155 bp, Staphylococcus epidermidis
aatttgtttaattattataaatccggatttcaaaaagcaaaaccacataatctaaagttaatactactctcattaataacttttgtcatttgctatattacttctaatattgcattctcattagttatattaagagctcaaaggttaccaatgttagctcaactcggtgaatctactacaaaacctataatatctattatttttattttactcattttagctttattatttatttttgtaggttacccattgataactggtacagtatatgcaattcaaaaagctattaataaagagaaagttctttttagtgatttattttttgcttttaaaaaaggcaaatatgctaaatcagtaattttagctttaataactttagttttattcattgtaatcgtacttattctagtgctattaaataaattatatagtttagctcttagcccaatattaatcggcttacaacaatcaataagcggctacgacaatccaatgggaattttaattacaatacaaattgtgttgttactcataacaggtttcatctcatcaattttctattggtttgtaattatattcattattaattatactaccgcttatacagaagattcatctcgtaaagtaatgagtaatttaaaagaaggatttaaaggtattaaaaacggtaagaaaacttggtttaaatttttcattggcgtattacttattagtttacttgcaagtattattaacaaaccgctattattcggtgtacaatacttaacaagcagtatgtctcaaacggtggctcaaactattattataatagctagaatcgtatctatagtattacgcctatgtctttattacattttgatttttggaattattaattatttcgttagacgtggtgacaaaccagtcaaaagcaaaagacgtcataaaaataaagatattaacaaaggtaatgtaaacgacaaagtagatactaaattaaatgcttccaactccaaagatacagaagcagataaaatgaaagatcaacaaacacatatacaacaagacaaaactgatagtcaagaaaataacatatatgattccatcaaagaaaaagtaaatgaaaataaagaaaatgttacagaacaatctaaaaatctatttgataagaaatag

SEQ ID NO: 1365 - DNA, 183 bp, Staphylococcus epidermidis
acaatttataagatattttttatagttgttttgtataagaaaaacgtgactttcgatcagcaacatagcacgggtggaattttaattcaactttttgaaaatgaattaaattctgcccttatttctttacagcatataatcacagaagaggtgaaaacatgcacacacaaatatgggatttaa

SEQ ID NO: 1366 - DNA, 501 bp, Staphylococcus epidermidis
aatcattataatataataaccattgtaaaaatgaggttcgaaggagtgtttgatatgagtcaacaacaagatgtagtcaaagaattaaatcaacaagtcgcaaactggacggtagcttatacaaagttgcataatttccattggtacgttaaaggtcctaatttcttttctttacacacaaaattcgaagaattatacaatgaagctagtcaatatgttgatgatttagcagaaagaattttggcaataggtggtaatccaattggaacactttccgagtgtttagataaatcaatagtaaatgaagcaggaaaacattattcagctgaagaaatggtagaagaattgtctaaagatttttctaaaatctctaaacaattagaacaagcaattgaagtgtcgggaagtgctagtgatgacgtttcagaagatatgtttatcggcatgcaaacttcagttgataagcataattggatgttacaatcttatttaggtcattaa

SEQ ID NO: 1367 - DNA, 963 bp, Staphylococcus epidermidis
gcttttaataatggaggtgtgaacatgccgttatttttaaaacccatttttctggataaagtatggggcagtgataatcttcgtcaatttgggtatcaactacctaataatcacataggtgaatgttggggaatttcagcacatccacacggaaaaagtgtgattgaaaatggtatatttgctggtcaaacattggatcaagtatggaacaatcatagagaaatatttggagattttccaagtaaagattttccattaatggctaaaattgtagatgctgctgcgccattgtctattcatgtacatcccgacgattcttatgcatatgaacacgaagaaggtcaatatggaaaatctgaatgttggtacatcattgaagctgatgaaggtgcaaagattactataggtacgtatgcgaaatctcgtgatgaatttgaagagcaattggagcaaggtacatttgaaaattatttgagaacaatacaagtgcaaccaggtgatttttactttataccagctggaacgatacattctataggtgcaggcattatggcgtatgaagtcatgcaatcatcagatatttcatacagaatttatgattatcatagaaaaactgataatagcgaggaacgtgaattaaatatagataaggcattagatgttattaattattcaaatgaactacctaatatcactcctcaaaatgaagtgatagaaaatcacaattgtacacatattgtatctagtgatttttttactatggttaagtgggatatttctggaactctaaattatatgaagcctagagaattttgtcttgtttctgttttagatggacaaggtaaacttattgtagatggtgatatatatgaaatatctaaaggttcaaactttgtgttaacttccgaagatttagatagtgttttcgaaggagattttaaactaatcattagttacatttaa

SEQ ID NO: 1368 - DNA, 1194 bp, Staphylococcus epidermidis
gtaatgaataataaagtaaatggtccgtttctcacacttagtgatttgtataatgatgacattgtttacacatctcgaccttcatatgtgtcgaacccatggttgaaaccagatgaacaccaatcaaatttcttaactggaagagaattacttatagctaatcgttttcctgtcattgttcatgaggcaagtgttacaaacaaattagaacaactttttaatatagtgggtagggaaattccaccacatacttataaatttaaagatcaagaaacatatgaaagcttgataaggaatttagctcttcatcaaggtaaaaaaatctactttcaatatattcataatgaagatattttacctaaagaatattatgcacttgataaagatgtttttgttgctcttaataataaagcacgaattccagaatggactaataacaaatatctaccacaaagagaaattgtctcaattaaagattttgaatctcgtattcaagcatggtcgtatccatttgtcataaaaccaggcgatgatttacctacagcaggaggatatggtgttatgatttgttataatgatacagatttagataaagctatcacacgcatcaacaatgcatcagcagagactgaacatttaatcattgagcaaaaaattaatgcagtgaataactattgtgtacaatttgcttattcagatgatattggtatcaaatacttaggaacagcgcaacagttaactaatgactatggattttacaacggaaatgaaaatgttaatgatgtgcctcagaatgtaatagacgctggtagagagattatggaaataggcgtaagcaaaggtttttttggtgtagcaggttttgacttactagtagatgataataatgatgtttatgcgattgatttaaactttaggcaaaacggatcaacgagtatgctacttttagcaaaagatttaactcatggatatcataaattttacagttacttttctaatggagataatacaaaattctataatgctattttaaaatacgtagaattaggtgtactttatccactttcctattacgatggagattggtatggaaagaatcaagttaattctagatttggctgcatttggcatggggaaaataaagaattaattaatcaatatgaacaacaatttatattggaagctggattataa

SEQ ID NO: 1369 - DNA, 792 bp, Staphylococcus epidermidis
atgatgaataatttagaacgattacgttcagaaaatccactcgtaatttgctataccaatgatgttgtgaaaaactttactgcgaatggtttactaagtttaggtgctagtcccgcaatgagtgaggcaccagaagaagctgaagattttactcgaatggctagtgcgcttttaattaacatcggtacactcacacgtgaaaatgaagaagacattatcaaaataggtaaaattgctaatcagcaaggtacaccaatagtttttgatccagtggcagttggtgcttctacatatcgtaaaaatttttgtcaacgttttcttggtgaagttaatgtcacagtaataaaaggcaatgcttcagaaatattgacattaatagattttaatacaactatgaaaggtactgacagtgacagcgaattagattcagtaaatattgcaaaaaaagcggctaatactttaaatactgctattgtcattactggaaaagatgatattattgcaaaaaatgagaaaataattaaattatctaatggttctccgcttcttactaaaatcacgggggctggatgcttgttaggtggtgtattagcaagtttcttgtttagaaatactcaaccttcaattgatttattagttgaagcggtaagtgtctacaacatcgcagcagaatttgctgaacaagcgcctcatgtaaatggacctggtacttttctatctgaactgctagatcaactttatcagatgaatgacattacttataaaaatcaagtcaaaaaggtagagatatga

SEQ ID NO: 1370 - DNA, 870 bp, Staphylococcus epidermidis
atggaggataatatgaaaaatataaaagcaatttttttagatatggatggaacgattttacatgaaaataataaagcctcggaatatactaaacaagtgattaatgaattgagagagcaaaattataaagttttccttgctactgggagatcttattcagaaatcagtcagcttgttcctgatggattcactgtagatggtattatcagttcgaatggaacttcaggtgaaattcatggagataatttgtttagacatagtttaactttagaacgagtacagaaaattgtggaattggctaaaaaacaacatatttattatgaagtttttccttttgaaagtaatcgtatatctcttaaagaagatgaagattggatgaaagaaatgatttccactatagagccacctgacgctgtaagtcaaagtgagtggtcatcgcgaagagaggcaattaaaggaaaaatagattggcgagataccttacctgatgcacacttttctaaaatatatttatttagtcccaacttagataaaataactgattttcgcaaccagcttgttgaaaaccaatcaaatttaggtattaccgtatctaattcttcgcgttataatgctgaaacgatgccatatcatacagataagggtacaggtatcaaggaaatgattgatcactatggtattaagcaagaagaaactttagttattggtgatagtgataatgatagagctatgtttaattttggccatcacactgttgcaatgaaaaatgcaagacaagaaattaaaaatcttacagatgatattaccgaatacacgaacgaagaagatggtgcagcacattacttaaaaagtcatttattagataactag

SEQ ID NO: 1371 - DNA, 225 bp, Staphylococcus epidermidis
gccaacatcctagttgtctgggcaacgccacatccttttccacttaacatatattttgggaccttagctggtggtctgggctgtttccctttcgaacacggaccttatcacccatgttctgactcccaagttaaattaattggcattcggagtttgtctgaattcggtaacccgagaggggcccttcgtccaaacagtgctctacctccaataatcatcacttga

SEQ ID NO: 1372 - DNA, 399 bp, Staphylococcus epidermidis
gttcgaatcctacctgcggagccatggctccttggtcaagcggttaagacaccgccctttcacggcggtaacacgggttcgagtcccgtaggagtcattttatggagaattagctcagctgggagagcatctgccttacaagcagagggtcggcggttcgaacccgtcattctccaccatttaattaaatactgcggaggggtagcgaagtggctaaacgcggcggactgtaaatccgctccttcgggttcggcagttcgaatctgcccccctccaccattcttgggctatagccaagcggtaaggcaacggactttgactccgtcatgcgctggttcgaatccagctagcccagccattagagccattagctcagttggtagagcatctgacttttaa

SEQ ID NO: 1373 - DNA, 465 bp, Staphylococcus epidermidis
aaatttaacaagaatttgaatagaattgacaccataccacaggctatattatcatttagattgtatgagtggaacggtttacatgattggtataggacactcggaggctataaaatgcgtcgtttcaacatcattttcaaacaatatttgcaatattatctttatatattggtaataattggaatattgtactcaatttcaccccacccatttctcttgggtcttatgataggtacatgtggttctttagtaaatacatacatctttgagatttatttagctaaatcaatgcataaagaaactacacaaatgtctactggtagtacttggaggtatttagtggcagttattgcatgtgtattatggttattctttaaagaacacattaatattatcggagttttaattgggttaatgatttcttatattgtaatcatattgcgccctctactacaaagggagtaa

SEQ ID NO: 1374 - DNA, 1332 bp, Staphylococcus epidermidis
aatgggtgcaagtctatgcctggtagagaacgaacatctccgcagtatgaatctttccacgaattatataaaaacaatactactaaagagctcactcaaaaagccaaatctttaaaattaactaattacagtaaattaaataaaaaagaattggtacttgccattatggaagcacaaatggaaaaagatggtaattactatatggaaggaatattagatgatattcaacaagatggatatggtttcttaagaaccgttaactattctaaaggtgagaaggatatttatatttctgcaagccaaattcgacgttttgaaataaaacgtggtgataaagtaacgggtaaagttcgtaaaccaaaagataatgaaaaatattatggtctacttcaagttgattttgtaaacgaccataatgcagaagaagtcaaaaaacgtcctcacttccaagctttaacacctctttatccggaagaaagaatcctattagaaacgcaatctacaaattattccactcgtattatggatttagtcacaccaataggtcttggtcaacgtggtcttatagttgcaccacctaaagctggtaagacaagtttattaaaagaaatcgctaacgcaatagcgagtaataaaccggaagcgaatttgtttatattactagtaggtgagcgtccagaagaagtgacggatattgaaagatcggttgaatctgcagaagtcgttcattcgactttcgatgaaccaccagaacaccatgttaaagttgctgaattattattagagcgtgcaaaacgattagttgaaattggagaagatgtaattatacttatggactccataacacgtttggcacgagcatataatctagtcataccacctagtggacgtacattgtcaggtgggcttgatcccgcttcattacacaaacctaaagcgtttttcggtgcagcacgtaacattgaagctgggggaagtttgacaattttagctactgctttagttgagacaggatctcgtatggatgatatgatctatgaagagttcaagggtacaggtaatatggaattacatcttgatcgtaagttatcagaacgtagaatattcccagcgatagacataggtcgtagttcaacacgaaaagaagagctattaatcactaaagcggaattagattcattatggcaattacgaaatttatttactgattcaacagactctacagacgttttattagaaaacttaagcgttcgaaaagtaatgaagaattgtttaagcaattgccaaaaagcagttgaagagagtactaaaactggaagaccaattatttaa

SEQ ID NO: 1375 - DNA, 399 bp, Staphylococcus epidermidis
cacatgttaaataaaatagtcattgttggtagaatgacgaaagatgctcaaatctatgaaaaggaggataacaaaatagcaacattttgcgttgctacagaaagaaactacaaagatgataataatgaaatttctacagattatttactttgtaaagctttcggtaaaactgccactaatattgaaaagtacactagtcaaggtactttagtaggtataactggacaaatgcgttcaagaaaatatgaaaaagaaggccaaacacattttgttacagaattatacgttgaaacaataaaattcatgtccccaaaaaataaaaacaatgaaactccctctgataatcaatttgaaaacaacacttatcaacctgatgatttagaaataattcatatttaa

SEQ ID NO: 1376 - DNA, 714 bp, Staphylococcus epidermidis
atgaagctaaagagagagttcacgcactcacatctaaatatccattatataattaatagacatacacattggaggaaaatgattatgagtaaagtacatgtttttgatcacccattaatacaacacaaactaagttatattagagatgctcgcactggaacaaaagagtttagggaacttgtagatgaagtcggtatgttaatggcttatgaagtaactagagacttagaactgcaagatgttgaaatacaaacacctgtgactaaaatgacagctaaacgtttggcgggtaaaaagttagcaattgtacctattttaagagctggtctaggcatgacagatggtgtgttaagtcttgttcctgctgctagggtaggacatataggactatatagagatccagagactcttgaagcggtagagtactttgcgaaaatgcctcaagacatcgatgaacgtcaaattattgtggttgatcctatgcttgctactggtgcttcagctattgaagcaatttcttcattaaaaaaacgtggagctaaaagtatacgttttatgtgtttaatagctgcccctgaaggcgttgaaaaaatgcaagaagcacacccagatgtagatatatatattgcggcattagatgaaaaattaaatgacaaagcgtatattacaccaggtttaggtgatgcaggggatagattattcggtactaaataa

SEQ ID NO: 1377 - DNA, 1512 bp, Staphylococcus epidermidis
atggccataaaagctgaagaaatcagtgcattgcttcgctcacaaattgaaaattatgagtcagaaatgtccgttacagatgttggtacagtactccaaattggtgacggtatcgcattaattcacggacttaacgacgttatggctggtgagctagtagaattccataacggtgttcttggtttagcacaaaaccttgaagaatctaatgtgggtgtggttattttaggaccatatgaagaaattagtgaaggtgacgaagttaaacgtactggccgaattatggaagtaccagtcggagaggaaatgataggaagagttgttaatcctcttggacaacccattgacggacaaggtccaatcaatgcgactaaaactcgtcctgtagagaaaaaagcaactggcgtaatggatcgtaaatctgtagatgaaccattacaaacaggtatcaaagcaattgatgctttagtaccaattggccgtggtcaacgtgaattaatcattggtgaccgtcaaactggtaaaacaactgttgcaattgattcaatcttaaaccaaaaagatcaagatacaatttgtatttatgttgcaataggtcaaaaagattcaacagttcgtgcaaatgttgaaaaattaagacaagcaggtgctttagactacacaatcgttgtatctgcatccgcagctgatccagcaccattactttatattgcaccttattctggtgtaactatgggtgaagagttcatgtttaatggaaaacatgttcttatcgtttacgatgatttaactaaacaagcggcagcataccgtgagctatcattattattacgtagaccaccaggtcgtgaagcatatcctggggacgtgttctacttacacagtagattattagaaagagctgcaaaacttaacgatgatcttggaggcggttcaattactgctttaccaatcattgaaactcaagctggcgatatctcagcatacgttccaacaaatgttatctcaattactgacggacaaatattcttacaatctgatttattcttctcaggtgttagaccagcgattaatgctgggcaatcagtatctcgtgttggtggttcagctcaaattaaagcgatgaaaaaagttgcaggaacattacgtttagacttagcttcatatcgtgagttagaatcatttgcgcaatttggttctgatttagatgaatttacagctaaaaaattagcgcgtggtgaacgtactgttgaagtattaaaacaaggtcaaaataacccactgcctgtagaacatcaagtacttattatttttgctttaactaaaggttacttagatgatattcctgtccaagatatcaatcgttttgaagaggaatttaaccactgggctgagtcaaatgcaactgaattattaaatgaaattagagaaactggtgctttaccagatgctgataaatttgattctgctatcacagaatttaaaaaaggatttaataaatcagaagaataa

SEQ ID NO: 1378 - DNA, 543 bp, Staphylococcus epidermidis
ataatggcaaaggtagcaaaaaaatatgccaaagcattatttgatgtcgctctagatacaaatcaactagatgttgtctatgaagatttagaaacaattagccattcatcgtttgatttcatcaaacaacttaaagcaattgatagtaatccaagcttaactgcaaatcaacgtgaagaatttgtagaaagagtttacaacgaagcaaatccatatgtggtaaatactttaaaagtattagcagataaccgacatatttcaattgtagagaatgtttttaaatcattccaaaatttatataacaaatactacaaacaagattttgcaattattgaatcgacttacgagttaagcgaagatgaaatatcaagaattgtagaacttatcaaaaagcaaactgaattatcaaatgtaattgttaacactaaaatcaatcaagatttaattggtggatttagagttaaggttggaactacagttatggatggtagtgttagaaatgaccttgttcaattacaaagaaaatttgaaagagctaactaa

SEQ ID NO: 1379 - DNA, 204 bp, Staphylococcus epidermidis
ggaaatcaaaagtcttatcttgttccctttttatattcaaagttaaatattttaatgagtataattatactaaattttctacttttaaatgaacttgaaaagagtgtaatgcttgattctattgaatccaatttaaagcattgttattttaaagggtcattttcagaaaataatggtatagtaatcaataaaacgctttattag

SEQ ID NO: 1380 - DNA, 1296 bp, Staphylococcus epidermidis
tattttaaaaagaaggaaacaaaggagaaaagtgatatggctcaagaggtaataaaaattagaggtggacaagcactaaaaggagaagtagaaattagtggagcaaaaaatagtgcagttgctattatccccgcaactttattagctcaaggacaagtaaagttggaaggccttcctcaaatctctgatgtcgaaactctagtaagtttgttagaagatttaaatattgaagcaagattaaatggtaaacaattagaagtggatactacacaaatagagaatgcacctctacctaataataaagttgagtctttacgtgcttcttattatatgatgggcgcaatgcttggtcgttttaaaaaatgtgtaattggattgccaggtggatgtccactcgggccaagacctattgatcaacatattaagggattcaaagcattaggagcagaaattgacgaatctagcaatacatccatgaaattagtagcaaaagaacttagaggcgctcatatatttttagatatggtaagtgttggagcgacgattaatattatgcttgcggcagtccatgccaaaggtcaaactgttattgataatgcagccaaagaacctgaagtcgtagatgttgcaaactttttaatgagtatgggtgctgatattagaggagcaggtacaacatcaataaaaatcaatggtgttgaggaactaaaaggttcagagtatcaaattattccggacagaattgaagctggttcttatatgtgtatggccgcagcaatgggtgaggaggtcattttacataatattgttcctaaacatgttgaagctttaactgttaagttgcaagagttaggtgtagatattgaaattgaagatgaaaaaataatcattcgtaaacaaacaccgtataaaaatgtagatataaaaacgcttgtttatccaggttttgcaactgatttacaacaacctattacaccattattattcatgacagaaggaccttcgtttgtgactgatactatttatccagcgcgttttaaacatgtagaagaattacagcgtatgggtgctaatattaaatcggatgagggaacagctgtgattaaaccttcgacacttaatggagctgaagtatatgcaagtgatttacgcgcaggcgcttgcttaattactgcaggtttaatagctgaaggtgtgacgacaatatttaatgtaaaacatatttatagaggatatactaacatcgttgaacatcttaaagcacttggtgctgatatttggacggaaacggtataa

SEQ ID NO: 1381 - DNA, 435 bp, Staphylococcus epidermidis
gcaatgaaaaaggagtgtatacacatgccaataatttattatgatggaaattgtgtttattgttataactatgcaatttggttaattcaaaacggactttcacataaatatgagtttgcaacaattaaaggtcaaataggtaaacaattttttgaaaattatcctgatgctcaaaataagaatagtgttattcttcaaaaaggaaatcatttagaatttgaatcacaggctgttgcaacattgatatcgtcactacctaatcactctaaatttcttggaataggattaagattaattcctaaaccactaagagatttaggatatcgattatttgcaaataatcgagataaaatgtggaaaacacattggcacaagccaactgattatgaaaaatcattttttcttgatgataatgaaaaaatcaaactaacctaa

SEQ ID NO: 1382 - DNA, 1092 bp, Staphylococcus epidermidis
gaaggaggaaatgtagtgtttgatcaattagatatagtagaagaacgatatgaacaattaaatgaattactgagtgatcctgatgtcgtgaatgacgctgataaattaagaaaatattcaaaagaacaagctgacttacaaaagactgttgatgtgtacagaagttataaaaccaaaaaagaagaattacgagatattgaagatatgctaaatgaaacatctgataaagaagaagttgaaatgctaaaagaagaaagtagtgctttaaaaacagaattacctgatatggaagaagaattaaaaatcttacttatacctaaagatcctaatgatgataaagatgttatagttgaaatccgtgcagctgcagggggagatgaagctgcaatatttgctggggacttaatgagaatgtattcaaaatacgccgaggcaaacggatttaaaacagaaatagttgaagcttcagaaagtgatcatggtggatataaagaagtgagtttctcagtatctggtacaggtgcttacagtaaattaaaatttgaaaatggtgcacatagggtccaacgtgtgcctgaaacagaatcaggggggcgaattcacacttctaccgcaactgttgctgtattacctgaagctgaagatgtcgaaattgagatacgtaatgaagatttaaaaattgatacttatcgctctagtggtgctggtggtcagcacgttaacacgactgactctgcagtgcgtattacacacttgccgactggtgttatagcaacttcttctgaaaagtctcaaattcaaaaccgagaaaaagctatgaaagttttaaaagcacgattgtatgatatgaaattgcaagaagaacaacaaaaatatgcttctcaaagaaaatcagctgttggtacaggtgatcgttctgaaagaataagaacttataattatcctcaaagtcgtgtgacagatcatcgaattggtttaacgcttcaaaagttaaatcaaatcatggaaggaaatttagacgagattgtggaggcactcacactttcagaacaaactgagaaactgaaagaattaaacaatggtgaattataa

SEQ ID NO: 1383 - DNA, 426 bp, Staphylococcus epidermidis
aaagctatgaaaataatttttgtatgtagtggcaacacttgtcgaagcccactggctgaaagtatagccaagtcccttttaccacacgatagtatagcttcaagagggctattcgcagttgagggacaggccatatctaaggaatcgttagaattaattcataagtacgatttacctgaaccatcacgagcacaagcatttcatatagatgatcttgatgctgatattatacttaccatgacgcaagctcataaagatttaatattttctatgtatggacgacaatctaatgtctttacattaaatgagtatgtaggtgacacacaagaaattgatgacccatttggtggctcgtttgatgtttatgaacaaacttataccaaaatttatgatttagtcgacaaaataaaatttaaacacgagtaa

SEQ ID NO: 1384 - DNA, 357 bp, Staphylococcus epidermidis
gcatcaatgaaagttttaagattcttattaggactagcatttggaacagctggtgttttacattttactagagagagacaatttagaaatattgttccagattatttacctttacaaaaaactgctgtattggtaacaggtgttatagaaatcttttttggtatcatgttgcttattaaaagaccagcatcatggttgaaaaagggtattaatttattcttgttagcagtgttcccagcaaatatttatatggctcgtaaaggattgccattaggtgacaaagaactacctaaatgggcactttattcgagattaccattgcaatttgtgcttattaaagccattaaaaaattataa

SEQ ID NO: 1385 - DNA, 840 bp, Staphylococcus epidermidis
acaatggtgaattataaagagaagtttgcagaagccaagacaattgccgtaaatgaggggtttgaatcaactcgtgccgaatggttgtttttagatgtttttggttggtcgaaaacagattatttaattcataaagatgagcaaatgtctttgacatcaattaacaaattggataaagcgttggatagaatgatcacaggagaacctattcaatacattgttggatttcagtctttttatggttatcaatataaagtgaatcaacactgtcttataccaaggcctgaaaccgaggaagttatgttgcattttttagaattgtgtaaaaagactgataccatagcagatattggaactggaagtggtgctatagcaattacgcttaagttactgcaacctgaattaaatgttattgcaacagatttgtatgaagatgctttaaatgtagctaagcaaaatgctagtcattatcaccaaaatattcagtttttgcgtggaaatgctttaaaaccgctaattgaaaatgatataaaattggatgggctgatatctaatccaccatacataggccatagtgaaataatagatatggagtcaacagtactaaattatgagccacatcatgctctatttgctgagaaaaacggatttgctatttatgagtcaatattagaagatttaccatttgtaatgaaacaaggtggacatgttgtttttgaaataggttatagtcaaggagatatcttaaaaagaatgattcaagatttatatcctgaaaaagaagtagagattttcaaagatatcaatggaaatcagcgtattatatctattatttggtag

SEQ ID NO: 1386 - DNA, 351 bp, Staphylococcus epidermidis
ctatcgaacctttttttaaattttaaaatgttaaaaagtaatatccatttttataagtatctttattgcctcttttcgtgtacaatgttatacagtaatcttacgaaggagcttaatatggattatcttggtcagttcgcaattgttcatttaatcttacatgttgtttgtatttgcgtagcttattgggctttaaattccataaaattagaccaattttttaaaaagggctacccattacaagttcaagtttgtatgatttttatttctattttactgggtacggcagtcagtaactttatagttgatttattgcaatattcaactcaagtgaaatacttgataaaataa

SEQ ID NO: 1387 - DNA, 204 bp, Staphylococcus epidermidis
ccgcttattgattgttgtaagccgattaatattgggctaagagctaaactatataatttatttaatagcactagaataagtacgattacaatgaataaaactaaagttattaaagctaaaattactgatttagcatatttgccttttttaaaagcaaaaaataaatcactaaaaagaactttctctttattaatagctttttga

SEQ ID NO: 1388 - DNA, 492 bp, Staphylococcus epidermidis
agcaataaggaggataaatgcatgactaaaatgaatgtagaaagctttaatttagaccatactaaggttgttgcaccttttattcgtctagccgggactatggaaggtcttaatggtgatgtcatacacaaatatgacattcgtttcaaacagcccaataaggaacatatggatatgcctggtctacattccttagagcatttaatggcagaaaacattagaaatcatactgataaagtagtagatttaagtcctatgggttgtcaaactggattctatgtttcatttattaatcatgacgactacgatgacgtattaaatattatcgatcaaacattgcatgatgtgttaaatgctagcgaagtcccagcttgtaatgaggttcaatgtggttgggctgcaagtcattctttagaaggtgctaaaacaattgctcaagcatttttagataaaagagagcaatggaatgacatctacggagaaggtaaataa

SEQ ID NO: 1389 - DNA, 1377 bp, Staphylococcus epidermidis
atacaaaaggagcgtttaaaaatgggaaaatattttggtactgatggtgttcgtggtgtcgctaaccaagaactcacacctgaattggcttttaaactaggtagatacggaggatatgttctcgcacataataagggtgaaaagcatcctcgagttttagtaggaagagatacaagagtatcaggagaaatgctagaatctgcattaattgctggtttaatttcaattggcgcagaagtgatgcgcttaggtgttatttcaacaccgggtgtggcttatttgactaaagaaatggaagcagcattaggtgttatgatttctgcgtcacataatccggttgctgataatggaattaaattttttggttcagatggctttaaattgtcagatgatcaagaaaatgaaattgagcaattattagatcaaaccaatcctgatttaccacgtccagtaggagaggatattgtacattattcagattattttgaaggtgcacaaaagtatctaagttatcttaaatcaactgttgatgttaattttgagggtcttaaaattgtattagatggtgcaaacgggtcaacttcttctttagccccattcttgtttggcgatttagaagcggatactgagacaattggatgtaatccagatggttataatattaatgaacaatgtggctctactcatccagaaaaattagctgaagcggtgttagaaactgaaagtgactttggtttagcttttgatggagatggcgatcgtattattgcggtagatgaaaatggacaaattgtagatggagatcaaattatgttcattattggtcaagaaatgtataaaaaccaagaactcaatggaaatatgatagtttcgacagtaatgagtaaccttggtttctacaaagctctagaaaaagaaggtattcagtcaaacaaaactaaagttggagatcgctatgttgtcgaggaaatgagaagaggaaattataatcttggtggtgaacaatccggtcatatcgtattaatggattacaatactactggtgatggattattaacgggtgttcagttggcttccgttattaaaatgagtggtaaaactctaagcgagttagcttctcaaatgaaaaagtatccacaatctttaattaatgtgagagtgactgacaaatatcgtgttgaagagaatattcatgttcaagagataatgacgaaagttgaaacagagatgaatggtgaaggaagaattcttgttcgtccttctggaactgaacctttagtacgtgtaatggttgaggctgcaactgacgcggatgctgaaagatatgctcaaagtatcgctgacgttgttgaagacaaaatgggtttagataaataa

SEQ ID NO: 1390 - DNA, 1098 bp, Staphylococcus epidermidis
attaaattctgcccttatttctttacagcatataatcacagaagaggtgaaaacatgcacacacaaatatgggatttaagaatgtataaaaataatgttagtcaatatccacatatagatgagataaaacaaactttcctagatggaggtttagtagcgatacctactgaaacagtatatggtcttggtgcgaatgctagaaacgaagaagcagtcgaaaacatctatgttgcaaaaggacgtccgtccgataatccgttaatcgttcatattcacagtattgaacaactcgatgattttgtagagtatattgatgataaggttaaagtattgatggatgaattttggccgggacctatttcttttatattaccacttaaacagggatatctttgcagtaaagtgactggtggattagaatctatcgctgttagaatgcctagtcataaaatagggagagcattacttcaaattgtagatgaacccatagcagctcctagtgctaatattagtggtcgaccgtcaccaacaacttttgaacatgtgaatagagatttaaatggtaaagtcaacggtatagttaatggtgatcaatgtgaagaaggacttgaaagtactgtgattgattgcacacagtttccgtttcgtatcgcgcgaccaggttcaattacgcaagatatgatagaaactaaactacctcattcgataaatcgtcaaatatatgaggaaaatgaaaagcctatcgcacctggtatgaaatataaacattattccccagagaccccattaacaattgttaaagatttaaataaaaaaattgctaatgatgataaatggtcaaaagtagcatttgtattcccagagagtcaaagaagtttgattcccgaaaatagcatttttatatctttatgtgaaaataagggagattttaaatcagcaggccataatttatatgaaattttacatgaacttgaccagaatgaagaaatagaagaggcatatatttatggatttgaagataatcatcacactgaagctatcatgaaccgaatgttaaaagcagcaagttataaactaattaaaggtgaaaagctatga

SEQ ID NO: 1391 - DNA, 189 bp, Staphylococcus epidermidis
acctacaactggaatggattttatataaagagacaactatttaaaacatttggtaagcatattttaaatgattcacaactttctgtcatacttgtaacacatataatagaagaaatgccgttatttttgaaaaagatttacttaaagacttttaaatatttaacaaggttaatatttaagatgttatga

SEQ ID NO: 1392 - DNA, 537 bp, Staphylococcus epidermidis
cgaaaggagtgtcatgagcccgtgactgcaacagctaatacatttattctcggtgcaggagttgaatgggggacaacatttgtaacactcgtaacatttgtaatcctcatcatacttttgaagaaatttgcttggggtccattaaaagaagtaatggacaaacgtgaacgtgatatcaataaagatattgacgacgcagaacaagctaagataaatgctcaaaaacttgaagaagaaaatagaaagacacttaaagaaactcaagatgaagttcaaaaaatcttagacgatgctaagattcaagcacgtaagcaacatgaagaaattattcatgaagctaacgaaaaagctaatggtatgattgaaactgctcaaagtgaaattaatagtcaaaaagaacgtgcaatttctgatattaataatcaagtttctgaactatcagtacttattgcatctaaagttcttagaaaagaaatttcagagcaagatcaaaaagaattagttgaaaagtatttaaaagaggcaggggataaataa

SEQ ID NO: 1393 - DNA, 891 bp, Staphylococcus epidermidis
aatgttattttgtcgtatgacagtgtcaataatgattggtataataatcaatatggaaaagtattacccggaggagatgttatggatttttccaatttttttcaaaatctgagtactataaaaattattactagtttactcgatttactgattgtttggtatgtgttgtatcttctcattacagtttttaaaggtactaaagcaattcaattattaaagggaatagttgtcattgttatcggccagcaaatcagtaaaattcttaacttaacagcaacatctaaattgtttgatattgtaattcaatggggtgttttagcactcattgtgatatttcaacctgaaataagaagagccttagaacaattaggtagaggaagttttttaaaacgatatacgaatacttatagtcgcgatgaagaaaagttgattcaatctgtgtctaaagctgttcaatatatggctaagcgacgcattggtgcgcttattgtttttgaaaaagagacaggtttgcaggattatatagaaactggaataccgatgaattcagatatatctcaagagctactaactaatgtatttatccctaatacgccattacacgatggtgcaatgataattcaaggaagtaagattgccgttgctgcaagttatttaccattatcagatagtgttaaaatatcaaaaagtttaggaactagacatagagcggcagttggaatttcagaagtttctgatgcttttactgttgttgtatcagaagaaactggtgatatatcagtcacttttgatggaaaattaagaagagatatttcaaaagatgtttttgaagaattgcttgctgaacattggtttggtgcacactttcaaaagaaaggtgtgaattcataa

SEQ ID NO: 1394 - DNA, 882 bp, Staphylococcus epidermidis
ttaatagataggggtaaagcaatgtttataaaaaaagattttgatgatattacagttcaagtatttgaagaaaaatatagagatgcacttaaccaatttgaattaagtgaacgacaacaaatatattcttcattgcctcaaactgttttagatgatgcattaaaagatgaaaatcgaattgctaatgtagctttaaataaagaaggaaaagtagtggggttcttcgtattgcatcgttattatcaacatgaaggttatgatacaccaaacaatgttgtttatgtacgttcattgtcagttaatgaaaagtttcaaggccatggatatgggacaaaaatgatgatgtttttaccagagtatgttcaagcattatttcctgattttacacatttatacttagtagtagacgctgaaaaccaaagtgcttggaacgtttatgaacgtgcaggttttatgcatacagctacaaaagaagaaggacctattgggaaagaaagactttattatttagatttagattcaaaacatgtatcttctttaaggctaaaagagggggaagccgcatataatgatgatattcacgtgattaatttgcttaaagatgatgtaaaggtaggctttattgcactagaacaaaatgataataaaatgaatatttctgcaatcgaagttaataagcaaaataggaatgagggaattgcagaaagtgctttacgccaattaccaacgtatatacgtaaacagtttgaagacattgaaattttatcaattactttatatggcgaacgtaatgaattaaaaccattgtgcttgaatagtaattttgtagcaatagaggaaactgaggattatacacgttttgaaaaatatattaattattaa

SEQ ID NO: 1395 - DNA, 207 bp, Staphylococcus epidermidis; identical to SEQ ID NO: 239

SEQ ID NO: 1396 - DNA, 297 bp, Staphylococcus epidermidis
ctctgttccagatggttcagggcaaaggagctgaaaaaaatgaaacaaggaattcatcctgaataccacaaagttatctttttagatacaacaacaaactttaaattcttaagtggttctacaaaaacatcttcagaaactatggaatgggaagatggaaatgaatacccagttattcgtttagatgtatcatcagattctcatccattctatactggacgtcaaaaattcgcagcagcggatggtcgtgtggaacgtttcaacaaaaagtttggactcaaatcaaacaacaactaa

SEQ ID NO: 1397 - DNA, 471 bp, Staphylococcus epidermidis
tattattacagcttaagctcggaggttttaaaaatggaaacgatttttgattataatcaaattaaacaaattatcccacatagacaaccttttttactaatagataaaattgtagagtatgaagaaggtaaaaggtgtgtaggactaaagcaagtatcaggtaatgaaccatttttccagggacatttccctaattacgctgtgatgcctggtgttcttattacagaagctttagcgcaaactggtgcagtagctatgttaaatagtgaagaaaataaagggaaaatagcattgtttgcaggcattgataagtgtcgcttcaaaaaacaagtcgtacctggagatacattaatgttggaagttgaaataactaaaataaaaggtcctattggtaagggttcggctaaagcgactgttgatggccaacttgcttgtagctgtgaacttacttttgctattcaagatgcttaa

SEQ ID NO: 1398 - DNA, 936 bp, Staphylococcus epidermidis
atgcttgaaagtaaatggggattaagatttgtcgctctcatattagcagtttttttctttttatcagtaaataatgtgttcggaaatatttttaatacagatgatttatctcaaaaatcatccaaaactattcaagatgtgcccgttgatgttatctataatagtaaagacctacatgtaactaaaattcctgaaaacgtcgatgttaatttaacaggaccacaatcaaaattaatcaaaattgaaaaccctgaagatttgaaagtagttgttgatctttctggaaaaaaagcagggaaatatcaaaaaaaatatcaagttagaggcatagatagtggtatcaactatcaaattaaacctgaagttgcacacattaaccttgaaaataaaataacacgagttatgcatgtgcaaccagacattagtagtaacagtttagatccaaaatataaaataagtaaacaaagtatttcaccagaaactgtaaaagtgactggtggagagcaacaattaaaaaatatagcttatttaaaagcaacttttaaaaattctagtaaagtgaacaaagacaccaatgatgttgcagatgttagtgcatttgataaacaattgaataaattaaatgtatcaattaatccaaatgaagttaatttaaaagtaacagttgaaccattcagtaaaatggttaaggtacgtaaaaaaacaacgggtaagcttaatgaaaataaagaattagatagtgttaaactggaagataaagaagtagaaatctttggtaatagagatgaattacaaaatattaatgaaattactgctgaagtagatattgatggaatttcagaatctacagaaaaaacagtatcatttaacttacctaaagatgtgactaaagtgaatccaaaggaaacaaaagcgtatataaatgttaaaaattga

SEQ ID NO: 1399 - DNA, 246 bp, Staphylococcus epidermidis
tataaggagagaggctttgtgaagcaatttatatatatttctctagtttgtggcattatttccggagcagggatatttttacaattaccacattatccatctatgatgattccaagatttgtggcgattcttggaataattagcgctgcaatcacaataagagataaggaaataagtggtatgcttaaacttggtgggataatgattaatataatgccgttacttgggagtgtcattgctaaataa

SEQ ID NO: 1400 - DNA, 540 bp, Staphylococcus epidermidis
agagattggaggtttacaatgtcaaaaatcttaaacacacaattaactggtatttttaatcggcttgaaaaacaagagttggatattcaaatggcagctcaatgtctcattcaagcaattggtggagaaggacatgtctatatcaaaggctacgatgatttaaaattctatgagtcattcatattacaaagccatgaaaaattagcgtctagcttaccacttgaagatttacaaaattttaacgatatagatacaacagatagggtactgttattttcaccatactacacttcggaagttgaaagtgatgtacttcaacttattgatttagatgtcgatttagtgcttatttgtaataaccctaaacgagatgattttcctaatcatttaattcattatgttaatttatcaacacctaggcccattgtttacacagaagattatgataaaatcattcaaccacatccgatggccttaaattatatttattatgatatttatactcaaatgattgagatgactagagacctagatttatag

SEQ ID NO: 1401 - DNA, 819 bp, Staphylococcus epidermidis
ttgttatggagtgatagacatatgaagattggaattgatgccggagggactttaattaaaattgtacaagagcatgacaatcgtagatattacagaactgaattaacaactaatatccaaaaagtcatagattggcttaacaatgaagaaatcgaaacattaaagcttacaggtggaaatgctggagtaatagcagatcaaattcatcattcccctgaaatatttgtagagttcgatgcatcatcaaaaggtttagaaattttattggatgaacaaggtcatcaaattgaacattacatttttgctaatgtaggtacaggtacttctttccactattttgatggaaaagaccagcaacgtgttggaggtgtaggtaccggaggcgggatgatacaaggtttaggctatttattgtccaatataacagattataaagaattaacgaatttagctcaaaatggagatcgtgatgccattgatttaaaagtaaaacatatttataaagatactgaaccaccaattcctggagatttaacagcagcaaattttggaaatgtattacatcacttagataatcagtttacatcagctaacaaacttgcctctgcaattggcgtcgttggtgaagttataacaactatggctattactttagcacgtgaatataagactaatcacgttgtatatatcggttcatcatttaataacaatcaattactacgtgaagttgttgaaaattacactgttctaagaggatttaaaccgtactatattgagaatggtgctttttcaggcgctttaggagcactttacctctaa

SEQ ID NO: 1402 - DNA, 732 bp, Staphylococcus epidermidis
ctattaaggagaagatatattatgacagaaagtacacctcacattaacccaaatggagttaaaatagctaaaactgtattaatgccaggcgatccattacgtgctcaatatattgctgaaaattttttagaaaatgttgaacaattcaatacagtacgtaatatgtttggttacacaggaacttataaaggcaaagaagtttctgtgatgggctctgggatgggaattccaagtattggtatttattcttatgaactttaccatttctttgatgtggatacaatcattcgcgtaggttcatgtggcgctcttcaagaagatgtcaatttatatgatgtgattattgcacaagccgcttccacaaactcaaattatgttgatcaatttaatataccgggtcactttgcgcctattgctgattttaatctagtagctaaagctaagaaagctgctgatgaaattggtgccatatcacatgtaggtaacgttttgtcatctgatacattttataatgctgattcaacttttaatgattcatggaaaaagatgggtatcttaggtatcgaaatggaatctgcaggtctatatttaaatgccatccatgcaaataaaaaggctttaggtatttttacagtaagtgatcatattctaagagatgaagccactagtgcagaagagagacaaacatcatttactcaaatgatggaaatagcgctcgaaatagctgaatag

SEQ ID NO: 1403 - DNA, 228 bp, Staphylococcus epidermidis
cccaagaatggtggaggggggcagattcgaactgccgaacccgaaggagcggatttacagtccgccgcgtttagccacttcgctacccctccgcagtatttaattaaatggtggagaatgacgggttcgaaccgccgaccctctgcttgtaaggcagatgctctcccagctgagctaattctccataaaatgactcctacgggactcgaacccgtgttaccgccgtga

SEQ ID NO: 1404 - DNA, 690 bp, Staphylococcus epidermidis
gccacacccggtgttgaaataacacctaagcgcatcacttctgcgccaattgaaattaaaccagcaattaatgcagattctagcatttctcctgatactcttgtatctcttcctactaaaactcgaggatgcttttcacccttattatgtgcgagaacatatcctccgtatctacctagtttaaaagccaattcaggtgtgagttcttggttagcgacaccacgaacaccatcagtaccaaaatattttcccatttttaaacgctccttttgtatctatcaatttttaacatttatatacgcttttgtttcctttggattcactttagtcacatctttaggtaagttaaatgatactgttttttctgtagattctgaaattccatcaatatctacttcagcagtaatttcattaatattttgtaattcatctctattaccaaagatttctacttctttatcttccagtttaacactatctaattctttattttcattaagcttacccgttgtttttttacgtaccttaaccattttactgaatggttcaactgttacttttaaattaacttcatttggattaattgatacatttaatttattcaattgtttatcaaatgcactaacatctgcaacatcattggtgtctttgttcactttactagaatttttaaaagttgcttttaaataa

SEQ ID NO: 1405 - DNA, 888 bp, Staphylococcus epidermidis
  unsure (849): Identity of nucleotide at the above locations are unknown.
tactccaaaggtggtgagataatggcctctcttaaagagatagatagtcgtattaaatcgacaagtaagatgaagcaaataacaaaggcgatgaacatggtttctagttcaaaattacgtagagctgagaaaaatactaaatcatttagaccttatatggaaaagatgcaagatgctattacagctgtagctggttcaaatagtacttctaatcatccaatgcttaaatctagagatattaaaagaagtggttacttagtaatcactagtgataaaggcttagccggtgcctatagtacaaatgttttaaaaagcttagtaaacgatatcaattctaaacacaacgacagtagtgaatatagtctaatcgttttaggtcagcaaggtgtagatttcttcaaacatagaggatatgaaattgaaagttctttagttgaagttccagatcaaccttcatttaaatctattcaatctatagctaaacatgctattgatttatttagcgaggaaaacatagatgaattgactatttattacagtcattatgttagtgtcttagaaaataaacctgcaactaaacaagttttaccattatctcaagaagattcaggtcaaggacatggtcaaatgtcttcatacgaatttgaaccagataaagaatctattttaagcgttattttgccacaatacgttgaaagcttaatctacggtacaatcttagatgcaaaagctagtgaacatgcttcacgtatgacagcaatgagaaatgcttcagataatgcgacagaactaatcgatgatttatcattagaatacaatagagcgagacaagctgcgattactcaacanattactgaaattgttggtggatcatcagctcttgagtaa

SEQ ID NO: 1406 - DNA, 234 bp, Staphylococcus epidermidis
atattaggaggaaattttattatgaatttaatcgcagcggcaatcgcaattggtttatcagcattaggtgcaggtattggtaacggtcttatcgtatctagaacagttgaaggtgtagcacgtcaaccagaagcacgtgggcaattaatgggtatcatgttcattggtgttggtttagttgaggcattaccaatcatcggtgttgtaattgcattcatgacatttgctggataa

SEQ ID NO: 1407 - DNA, 1239 bp, Staphylococcus epidermidis
atgtcttatatcgagaaaaaggataaagttgtttacgatgctattcaaaaggagtttcaacgacaaaatagtaatattgaactcattgcatcagaaaatttcgtatcacaagcagttatggaagcccaaggttcagtattaacgaataaatatgctgagggttatcctgggcgtcgttattatggagggtgtgagcatgtagatgtaactgagtccattgccattgaaagagcaaaagctttatttggagcagaacatgttaatgttcaaccccattcaggttctcaagctaatatggctgtgtatttggttgctttagaaatgggcgatactgtgttaggtatgaatttgagtcatggtggtcatttaacacatggggcaactgtcaattttagtggtaaattttatcattttgttgaatatggtgtggaccaagaaaatgaattaataaactatgatgaagtgagacgtttagcaattgagcatcaacctaaattaattgtagctggtgcttcagcatattcaagaactattgactttaaaaaatttaaagaaattgctgatgaagtaggagctaaattgatggtagatatggcacatattgctggtttagtagctgctggtttacatcctaatcctttagaatatgctgattttgtgactactacaactcataaaactttacgcggtccacgtggtggtatgattttatgtaaagaagaatataaaaaagatatagataaaacaatcttcccaggtattcaaggcggtccattagaacatgtcatcgccgcaaaagctgttgcatttggagaagctttgaacgacgattttaaagattatcaaaatcaagtcattaaaaatgcacaagctttagctcaaacattaattgaagaaggcttcagagttgtatctggcggaacagacaatcatttagttgcagttgatgttaaaggttctatcaatatgactggtaaattagctgaagagacacttgataaagtaggaattacatgtaataagaatactattccatttgataaagaaaaaccgtttgtaacaagtggtgttagactaggaacaccagcagctacaactcgtggttttgatgaatctgcatttgtggaagtagcaaaaattattagtttagcattaaataactatgataatgatactaaactaaatgaagctaaagagagagttcacgcactcacatctaaatatccattatataattaa

SEQ ID NO: 1408 - DNA, 216 bp, Staphylococcus epidermidis
aagttgattttaaaaattaaaaatgcaagtatcatcgttagacacttgcatatcatcatcttttatttagcaatgacactcccaagtaacggcattatattaatcattatcccaccaagtttaagcataccacttatttccttatctcttattgtgattgcagcgctaattattccaagaatcgccacaaatcttggaatcatcatagatggataa

SEQ ID NO: 1409 - DNA, 1467 bp, Staphylococcus epidermidis
tatatgtatatatcttttctaaggagtgaatataataagatgagaaatttcactaaacaatatataaacggtgaatgggttgatagtgcaagcggtgaaactattgatgttattaaccctgcaactgaagaagtaatgggtaaaattgctaaaggtaacgaagaagatgttaataaagctgtagatgctgcagataaagtatatttagaatttagacatagttctgttgaagaaagaagagaacttttagataaaatcgtaaaagaatatcaaaatagaaaaaatgatttaattgaagcaattactgatgaactaggagcgcctttatcagtttccgagaacgttcattatcaaatgggattgaatcattttacagctgcaagagatgctttagatagcttccaatttgaagaacaacgtggcgatgatttggttgttaaagaagcaattggagttgctggacttgttacaccttggaatttccctacaaaccaaacttcacttaaattagctgctgcgtttgctgctggtagccctgttgttttaaaaccatctgaagaaacaccatttgctgcaattattttagcagaaatttttgataaagtaggcgtacctaaaggtgtgtttaacttagtcaatggtgatggatctggagtaggaaatcctttaagtgaacatccaaaagtaagaatgatgtcatttacaggttctggtcctacaggttcaaaaattatggaaaaagctgcaaaagacttcaaaaaagtgtctcttgaattgggtgggaaatcaccttatatcgtattagatgacgttgatgttgaagaagctgctaatgcaacaacgaaaaaagtagttaacaatacaggtcaagtttgtactgcaggaacacgtgtacttattcctgaaagtattaaagaagactacttaacagcagttaaagaagcatttagtaaagttaaagtaggtcaaccaagagaagaaggaactcaagtaggtcctattattagtaaaaaacaatttgatcaagttcaggattacattgataaaggtatcaatgaaggagcagagttattctacggtggtccaggtaaaccagaaggattagataaaggatattttgcgcgtccaactatatttattaatgtagataatcacatgacgattgcacaagaagaaattttcggacctgtcatgtctgtaatcacttataataatcttgacgaagctattgaaattgctaatgatactaaatatggtcttgctggctatgttattggtaaagataaagatacattgagacatgttgctcgttcaatcgaagctggtacaattgaaattaatgaagctggtagaaaaccagacttaccattcggtggttataaagaatctggcttaggtcgtgaatggggcgattatggtatcgaagaattcttagaagtaaaatcaatagctggatattttaaataa

SEQ ID NO: 1410 - DNA, 675 bp, Staphylococcus epidermidis
gggttaagtatgtcatacaaatatgaagcattttttaaagatattttgattaatgaatatatttattttgcttcaaaaaataaaaaattaattagaatacaacatgagaatttgccatatattgctatgtggacagacgaaaatgttgctgagtcttatttgttacatcattcaattgattacgacaaaatcattagagcagatattgaccgttttgtaacatatgaaatggatgaaatctttgatccaggtgacaaagttttagttaatgtgaataatggtgaagaaggaaacattgtagatatagttaaaatgactgatgagttgatgtctgaattagatgatataagaatgagagagtttattaaagatgtcgcaaaatatgacgaagtatacggattgacaaacaaaggtgaaaagaattttattatgatttcagatgatgaccataacaaaccacacatcatgcctgtttggagtattaagagtagagcgcgtaaagtacgtgatcaagattttgaagaatgtgatttaatcgaaattgaaggtgaagtctttagtgaatggttagacaagttacgcgatgataataaagcagtggcgattgatttgaaatcaggtgttgttggtactgttgtatcagcgcaaaaactgtcaaatgaagcaacattttaa

SEQ ID NO: 1411 - DNA, 1860 bp, Staphylococcus epidermidis
gcagtgataattaatcataatagccgtgttatcccatttgttggaggatattatatgtgtggaattgttggttatattggctacgataatgccaaagaattactattaaaagggttagaaaaattagaatatcgtggttatgactcagcaggtattgctgtagttaatgatgatggtacaaaactttttaaagaaaaaggaagaattgctgaattacgtaaagttgcagataatagtgatgaggatggtacgttaggaattggtcatacacgttgggcgacacatggtgttccaaattatgaaaattcacatccacaccagtcaacatctggacgttttacattagttcataatggtgtaattgaaaattatgaagaattaaaagctgaatatttatctgatgtcactttttcatcagaaactgatacggaagttattgtacaattagtagattatttttctagacaaggattagctacagaagatgcatttacaaaagtagttaaattattacatgggtcatatgctttaggattattagatgataatgataaagatactatttatgtggctaaaaacaagtctccgcttttagtaggtgtaggtgaaggtttcaatgttattgcttctgatgctctagcaatgttacaaactacaaaccaatacaaagagatacatgaccatgaaatagttattgttaagcgagacacagtagaaattaaagatcttgaggggcacattcaacaacgtgatacgtatacggcagaaatagatgctgctgatgcagaaaaaggcgtatatgatcattacatgttaaaagaaattcatgaacagcctgcagtgatgcgtcgcattattcaagaatatcaagatgaaaaaggtaatttaaaaatcgattcagagattattaatgatgtagcagatgctgatcgtatttacatcgttgcagctggtactagttatcatgctggattggttggtaaagaatttattgaaaaatgggcaggtgtacctactgaggttcatgtagcttctgaatttgtatataatatgccacttctttctgaaaaaccactatttatttatatttcacaatctggtgaaacagctgatagtcgtgctgtattagttgaaacaaataagttaggtcacaaatcattaacaattactaatgttgctggttcaacattatcacgtgaagcggatcatacattacttttacatgctggacctgagattgcagtcgcatctacaaaagcatatacagcgcaaattgctgttttatctatcttatctcaaattgttgctaaaaatcatggtcgtgaaaccgatgttgatttattaagagaactagctaaggttactacagctattgaaacaattgttgacgatgcacctaagatggagcaaattgcaacggatttcttaaaaactactcgtaatgcattcttcattggacgaacaattgattataatgttagtttagaaggtgcattaaaattaaaagaaatttcttatattcaagctgaaggatttgcaggtggggaattaaagcacggaacaatcgctttgattgaagatggcacacctgttataggtttagctacacaagaaaacgttaatctatcaattcgtggaaatatgaaagaagtagtagcacgtggtgcatatccttgtatgatttcaatggaaggtttgaataaagaaggagacacatacgtgattccacaagtacatgaattattaactcctttagtatctgtagtgacaatgcaattaatctcatattatgctgcgttacaacgagatttagatgttgacaaacctcgtaacttagccaaatcggttacagtagagtaa

SEQ ID NO: 1412 - DNA, 567 bp, Staphylococcus epidermidis
agaaaatcctttgaaaggaagtatttttatatgaaaattcaagattacacaaaagaaatggttgatgagaaatcattcatcgatatggcctatactttattaaatgataaacaaacaacgatgaatttatatgatattattgatgaatttaaatctttaggcggatatgagtatgaagatattgaaaatcgaatcgtacaattctataccgatttaaacactgatggtcgttttttaaatgtaggagaaaatctttggggtctacgtgattggtactctgtagatgatattgaggaaaaaatcgcaccaacaattcaaaaattcgatattctagatgacgaagatgaagaagatcaaaaccttaaattattaggtgatgacgacgctgatgaagatgacgatattcctgctcaaacagatgatcaagaaacattagacgagtcagataatgatgaagatgatgttgaaatgaatgaagcagatatcgttattgatgaagacgaagacgaagatattgctgaaggtgaagaagaagcctttgaagacgccgaagactttaatgattaa

SEQ ID NO: 1413 - DNA, 1428 bp, Staphylococcus epidermidis
aaggaggaaatcaacatgggaattggccgtgtagctcaagttatgggtccagtaatagatgttcgttttgaacataacgaagtacctgagataaataatgcattacacatcgaagttcctaaagaagatggagcgcttcaattaacattagaagttgcacttcaactaggtgacgatgtagttcgtacaattgcaatggactcaactgacggcgttcaaagaggaatggaagttaaagatacaggtagagacataagtgtacctgtcggtgacgtaactctaggaagagtgtttaacgtactaggagaaactattgacttagatgaaaaaattgatgattcagtacgacgtgaccctatccatagacaagctccaggattcgacgaattatcaacaaaagtagaaatcttagaaactggtattaaagtagtagacttattagcaccttacataaaaggtggtaaaattggattatttggtggtgccggtgtaggtaaaaccgtactaatccaagaacttattaataacatcgctcaagaacacggtggtatctcagtattcgctggtgttggtgaacgtacacgtgaaggtaatgatctttactatgaaatgagtgacagtggtgttatcaagaaaactgcaatggtctttggtcaaatgaatgagccacctggtgcacgtatgcgtgtagcattatccggattaacaatggccgaatatttccgagatgaagaaggccaagatgtgttattattcattgataacattttcagattcactcaagctggttcagaagtttctgcgttattaggtcgtatgccatcagctgttggttatcaacctacacttgctacagaaatgggtcaattacaagaacgtataagttcaacaaataaaggttcagttacatcaattcaagctgttttcgtaccagccgatgactatactgaccctgcgccagcaacaacgttcgcacacttagattcaacaacaaacttagagcgtaaattaacagaaatgggtatttatccagctgtagacccgcttgcttctacatctagagctttggaaccttcagtagtaggtcaagagcattatgatgtggcacgtgaagttcaatctactttacaaaaatatagagagttacaagatattattgcgattcttggtatggatgaattatcagatgaagataaacaaactgtggaacgagcacgtagaattcaattcttcttatcacaaaacttccacgttgcagaacaatttactggacaaaaaggttcatatgtacctgttaaaacaacagttgcagacttcagagatattttagatggtaagtatgaccatattcctgaagacgcattccgtttagtaggtagcatggaagacgtaattgagaaagcaaaagatatgggtgttgaagtctaa

SEQ ID NO: 1414 - DNA, 1305 bp, Staphylococcus epidermidis
ataatgagaatgattgacatcatagaaaagaaacgagacggtaagtcattaacaaaagaagaaatagaattttttgtaaacggatacactcatgaggaggttccagattaccaagcttcaagtttagctatggcgatattctttcaagatatgaatgatgaagaaagagcggcattgacaatgtcaatggttaactcaggagagaagatcgacttaagcgatatcaatggtattaaggtagacaagcattctacagggggcgtcggtgatacaacgacactcgttcttgccccattagtagcggcagtaggtgttccagttgcaaagatgagtggtcgtggtctaggacatacgggggggacgatagataaattagaatcagttaagggatttaatgttgaaatcagtgaaaaagattttataaaacttgtaaatgataaccaagtagcagtaataggccaatcaggcaatctcacaccagctgataaaaaattatatgcattgagggatgtaacagggacagttaactctattcctctcatcgcttcgtccataatgagtaagaaaattgctgctggcgcagatgcaattgttctagatgtcaaaactggcagtggtgcgtttatgaagacgctagatgatgccgaagcacttgcgcatgcgatggtaagaattggtaataatgtaggtcgtaatacgatggctattatttcagatatgagtcaacctttaggaaatgcaattggtaatgcgctcgaattaaaagaagctatcgcaacattaaaaggaaatgggccgaaagacctaacagagcttgtgttaacacttggttctcaaatggttgtcttagctgaacaagcaacatctttagatgaagcgcgtcagatgctaatcgatgctataaaaacaggcaaagctttaaacaaattcaaaacatttctatcgaatcaaggaggagatgactctattgtggattctcctgaaaagttacctagcgcgaaatatcaagttgaatttaaagctaaaaaagatggttatataactgaaataatagctaatgagataggcgttgcttcaatgatgttaggcgctggtcgtcaaacaaaagaagacgttattgatttaggtgtaggtatcgtgttaaataaaaaagtaggagaacatgttgagaaaggtgaaaatattttaactattcataccaacaccaaagagatcgatgatattttatataaactagacaatagtattactattgagagtaagggcgaagctccaaccttaattcataaaataataaccgagtag

SEQ ID NO: 1415 - DNA, 1062 bp, Staphylococcus epidermidis
atatttttgatgaaaaaagttatgaccatatttggaactaggcctgaagctataaaaatggctccgttgattaaaacgttagagaaagattctgacctggaacccgttgttgtagtcaccgcccaacatagagagatgcttgattcagtgttgaatacttttaacataagtgcagattatgatttgaatattatgaaagctggtcaaacattgtctgaagtaacatctgaagcaatgaaaaagttagaagatatcatacaaaaggaagtgcctgatatggtacttgttcatggtgatacagtgacaaccttttctggagcattagccgcattttatagtcaaacacctataggacatgttgaagctggattaaggagttataataaatattcaccttatcctgaagaaataaatagacaaatggttggggtaatggcagatttgcactttgccccaacctataatgctgcacagaatttagtaaaagagggtaaattagccaaacatatagctatcactggtaatacagctattgacgcaatgaattatacaatcgatcaccaatattcatcatctatcatacaaaaacataaaaataaaaactttattttactcacagcacatagacgtgaaaatataggtaaacctatgataaacgtgtttaaagcgattagaaagttgattgatgaatatcaggatttagcgttggtctatcctatgcatatgaatcccaaagtaagagatattgcgcaaaaatatttaggaaatcatcctaggattgaattgatagaaccacttgatgtggttgattttcataattttgctaaacaagcatatctcattatgactgactctggtggaatacaagaggaggcaccatcattacacaaaccagttttagtattgagagatagtactgaaagaccggagggagtagatgctggaactttgagagtcattggtacgaatgaagaagatgtctataatgaaactaaaaaattaatagaaaacccagacctttatcaaaaaatgagtcaagctgttaatccatatggcggttga

SEQ ID NO: 1416 - DNA, 210 bp, Staphylococcus epidermidis
atatcagtgataacagcaaatttcatgatattatctcccttcaatgttatcttattagcatattctaacattttgtgctctattatgttagatattaatttaaaatttattagaattttgatattgtatttatatgaaaaaaaaggagtgcttaaaatttgtttaattattataaatccggatttcaaaaagcaaaaccacataatctaa

SEQ ID NO: 1417 - DNA, 417 bp, Staphylococcus epidermidis
gaggtatggataatgaatacacttagactaaatattgtcactcctaatggttctgtctatgaacgtgaagacgttgagatggctgtcttacaaacaacagctggtgaaatggggattatgtatggtcacattccaactgttgctgcattaaaaacaggtcatgtgaaagttaattttcacaacggaaatgaatttattgcagtaagtgatggctttattgaagcaagacaacatcaattatcaattatcgtccaaacggccgaacctgctagtgaaatcgatgttgaaagagctaaattagctaagtcgagagcagaatcacatttagaagatgatgatgataatacagacataaatagagctaaaagagcacttgaacgagcaaataatcgtttacgtgttgcagaattacaataa

SEQ ID NO: 1418 - DNA, 948 bp, Staphylococcus epidermidis
ctaaacattgtagtgagacagaaaaaaaagagattaaagaaaatttcttgcaaagtactattcatgagagacatttcttcaatatggcatatattaatgaaaaatgggaatatgggggaaataacaatgaataaacctaaaattgcactaacaatagcaggcacagatcccaccggtggggcaggtgttatggcggatttaaaatcatttcacgcgtgtggcgtttatggtatggccactataacaagtatcgttgctcaaaataccctaggagttcaacatatccataatttagaatcttcatgggtaaaggaacaacttgatagtgtgtttgatgatgaattaccacaagctatcaaaacgggtatgattgcaacaaaaaaaacgatggagttgattcaaagttacttaaaggaacattccaatattccttatgtgattgatccagttatgcttgccaaaagtggtgattcattgatggatgaaaatactaaaaatcatttgcaatcaacattattacctttggctgatgttgtcactccgaatatacctgaagctgaggaaattactggtattaaaattaatgatgaagaaagcatacgtaaagcaggtcaaatctttattaatgaaattggtagtaagggtgttgtaattaagggagggcattcagccgatttaaataatgctaaagattttctttttactaagaatgaaacgtatacctttgagaacaaacgctttgatactaaacatactcatggaactggttgtactttttcagcagttattacagcagaattagctaaaggtcgttccataaaagatgcagttaaaaaagcaaaagagtttatttcattaagtattgaacataccccagaaattggcaaggggagaggacctgtaaatcattttgcttatatgaagaaagtaggtttagatgatgaataa

SEQ ID NO: 1419 - DNA, 912 bp, Staphylococcus epidermidis
tataatgacgttgaaaaaaacgtgcactgttgcactcaaggaggaactttaatgcctttagtttcaatgaaagaaatgttaatcgatgcgaaagaaaacggttatgcggttggtcaatacaatcttaataacctcgaatttacacaagctattttagaagcgtctcaagaagagaatgcgccagttattttaggtgtttctgaaggggcagctcgttatatgagtggtttttatacagttgtgaaaatggtagaaggtttaatgcatgacttagacatcacaatcccagtagcaattcatttagaccacggttcaagctttgaaaaatgtaaagaagcaattgatgctggattcacatctgtaatgattgatgcatctcatagtccttttgaagaaaatgttgaaatcacttctaaagtagttgagtatgctcatgatagaggcgtttctgtagaagctgaattaggtacagttggtggacaagaagacgacgtagttgctgatggcgttatctatgcagaccctaaagaatgtcaagaattagtagaaaaaactggaattgatactttagctccagcattaggttctgtacatggaccatataaaggtgaacctaaattaggatttaaagagatggaagaaattggtgcttcaactggattacctttagtattacacggtggtacaggtattccaactaaagatattcaaaaagctattccttatggtactgctaaaattaacgtgaatactgaaaatcaaattgcgtctgctaaagcagttcgtgaagtattaaacaacgacaaagatgtgtatgatccacgtaaatatttaggaccagcacgtgaagcaattaaagagacagttaaaggtaaaattagagaattcggtacttctaatcgcgctaaataa

SEQ ID NO: 1420 - DNA, 1296 bp, Staphylococcus epidermidis
ctgattagagttttaagtggaggattaaagatggataaaatagtaataaatggtggaaatcgtttaacaggtgaagttaatgttgaaggagctaaaaatgctgtattacctgtacttacagcgtcattacttgcttctgaaggacacagtaaactagttaatgtcccagagttaagcgatgttgaaacaatcaataatgtattatctacactcaatgcaaatgtagagtatgataaagataaaaatgcagttaaagttgatgcaactaaaactttaaatgaagaagccccttatgaatatgtgagtaaaatgcgagcaagcatcttggttatgggaccactacttgctcgactagggcatgctattgttgctttgccaggaggatgtgcgattggaacacgtcctatcgagcagcacattaaaggatttgaagctttaggtgcagacattcatttagaaaatggaaatatttatgcaaatgctaaagatggattaaagggagcacatattcatttagattttccgagtgtaggtgcaactcaaaatattattatggcagcgtccttggcatcaggaaaatctatcattgagaatgtcgctaaagaacctgaaattgttgatttagctaattatattaatgaaatgggcggtaaaattacaggtgcaggtactgataccattacgatacatggtgttgaaaaactttacggtgttgaacatgcaattataccagatagaattgaagctggaacgttacttatcgcaggtgcaataactcgtggtgacatatttgtacgtggtgcaattaaagaacatatggctagtttaatatataagcttgaagagatgggggtagatcttgaatattatgaagaaggtataagagttacagcaaatggagatttaaatccagtagatgtaaaaactttaccacacccaggtttcccaactgatatgcaatctcaaatgatggctttattattaacagcaaatggacacaaagtgattactgagactgtttttgaaaatagatttatgcacgttgcagaatttagaagaatgaatgcgaatataagtgttgaaggaagaagtgctaaaattgaaggaaaaagccatttacaaggtgctcaagttaaagcaacagatttaagagctgctgcagccttaatcttagctggtttagttgcagagggaactacgcaagtgactgagttaaagcatctagatagaggatacgtcaatttacatggaaaactaaaaagtctaggtgcaaacatagaacgtgtaaatcgataa

SEQ ID NO: 1421 - DNA, 186 bp, Staphylococcus epidermidis
cgcgaagaattagatacggtaatacctaaatttgattggttttcaacaagctggttgcgaaaatcagttattttatctaagttgggactaaataaatatattttagaaaagtgtgcatcaggtaaggtatctcgccaatctatttttcctttaattgcctctcttcgcgatgaccactcactttga

SEQ ID NO: 1422 - DNA, 1131 bp, Staphylococcus epidermidis
acaattacgttaaagaaaaaggctaaaagaactgtaattgtaatggaggaaaacgaaatgacaaaagaaaatatttgtatcgtttttggaggtaaaagtgcagaacacgatgtttcaattttaactgcacaaaatgttttaaacgcaattgataaagaacgatatcaagttgatatcatttatataacaaacgatggtgaatggaagaaaaaagataatattacacaagaaataaaaaatactgatgaactcgtcattaacgatgtagagactggagaaatctcacagttactcagtaaaggtagtttaggaaaatcatatgatgcagtattcccgttattgcatggtccaaatggagaagatggaactatccaaggtctttttgaagtacttgatataccatatgtaggtaatggtgtgttagctgcttcaagctcaatggataaactcgtgatgaaacaattatttgagcatagaggtttacctcaattaccttatattagctttttaagaagtgagtatgaaaaatatgaaaataatatcattaagttagttaatgataagttaacatatcctgtatttgtaaaacctgctaatctcggttcaagtgttggtataagtaaatgtaacaatgaagaagaattaaaatctgggatagctgaagcattccaatttgatcgtaaacttgtcattgaacaagggattaatgctagagagatcgaagtagctgtcttaggtaacgattatcctgaaacgacatggcctggtgaggttgttaaggatgtagctttttatgattataaatcaaagtataaagacggtaagattagattagatattccagcagatttagatcaagatgttcaaatgacattaagatacatggcattagaggcctttaaagctactgattgttcgggattagttcgtgcagatttctttgttactgatgataatcaaatttatatcaatgaaacaaatgccatgccaggatttactgcatatagtatgtatccaaacttatggaaaaatatgggcttatcttaccctgatttaattgctaaattgattgatttggctaaagaacgttatgaagataaaaagaaaaataaatataaaattgattattag

SEQ ID NO: 1423 - DNA, 471 bp, Staphylococcus epidermidis
ctatggttgacccaaatgaataatttagcattacaaagccttaccgaaagtatagcgataaagtattttggcaaagcttttaagcacgaggtatattataataagcgtttacgtaccactggcggtagatatatattaagtagtcataatatagaaataaatccaaaacagtatgaaatgtttggagaaaaagcagtcattgatatcataaaacatgaactgtgtcattattttcttcatttagctggtgaaggatatcaacatcgtgataaagcattcaaaattttgagtgccaaagtaggagcacctaggttttgtactccgacagaatcttatcaagatagagctaattataaatataggtgcatctattgtgaacaagaatttattcgtataaagcgtgtgaatcttgaaaaaatgcgttgtggacgatgtggaggtattttaaaacttattcaaacaagaaagtga

SEQ ID NO: 1424 - DNA, 1215 bp, Staphylococcus epidermidis
gcaatgaattattcttctcgtcaacaacctaaacgtaactggttacgtaaagtagactggatactcgtactagttatatcactattagcactaacaagtgttattttaatcagttccgctatgggtggcggacaatatagtgcaaatttcagtattagacaaattatttattatattttcggagctattattgcatttttaattatgataatttcaccgaagaaaattaaaaataatacttatattttatatagtatattttgcgttctattaatagggttacttattttacctgaaacttcaatcaccccaattattaatggtgctaaaagttggtacagtttcggtcctataagcatccaaccttccgaattcatgaaaattatacttatacttgctttggctaaaacgatatctaaacataatcaatttacatttaataagtcttttcagtctgatttaatgttattttttaaaattttaggtgtatccattatacctatggcattaattctattgcaaaatgacttaggtactactttggtgttatgtgcaattatagctggcgtcatgttagtaagtggaataacatggaggatattagcccctctatttattgttgcatttgtgagtggttctagtattatattagctatcatttataaaccatccttgatagaaaacctattaggaataaaaatgtatcaaatgggacgtatcaattcttggttagatccctattcatacagtagtggggatggatatcacttaacagaatctttaaaagctattggttctggtcaattattaggtaaaggttataaccatggcgaagtttatattcctgagaatcataccgactttattttttcagtgattggagaagaaatgggctttataggttcagtattattgatattacttttcttattcttaatatttcaccttatacgattagctagtaaaattgatagtcagtttaacaaagtatttatcataggatatgtatcgttgattgtttttcacgtgttacaaaatatcggcatgacggttcaattactaccgattacaggtataccacttccgtttattagttacggtggaagttctttatggagtttaatgactggtataggagtagttctttcaatttattatcatgaaccccaacgatatgaaatacccacattatctaaaaaatctaatacaatttaa

SEQ ID NO: 1425 - DNA, 1587 bp, Staphylococcus epidermidis
gtgaacatatatgtaaaaaagcatattaagaaatatacacgtaaaaggagaattattttgcaaaattttaaagaactagggatttcggataaaacggttcaaacattagaagcaatgggatttaaagaaccgacacctatccaaaaagatagcatcccttacgcgttagaaggagatgacatccttggacaagcccaaactggtactgggaaaacaggggcgtttggtatacctttaattgagaaagttgtaggccaacagggtgttcaatcattaattcttgcgccaacgagagagcttgctatgcaagtagctgagcaattaagagagttcagtaaaggtcaaaaagtacaagttgttacagtctttggtggtatgcctattgaaagacagattaaagcattaaaaagaggccctcaaattgtagtaggtacgccgggaagagttattgatcatcttaatcgtcgtacacttaaaactcaaggaattcacacgcttattttagatgaagcagatgaaatgatgaatatgggattcatcgatgatatgagatttattatggataaaattccagctgaacaacgtcaaactatgctattttctgctacgatgccaaaagcaatccaagaattggtacagcagtttatgaaagctcctaaaataattaagacaatgaataatgaaatgtcagatcctcaaattgatgaatattatacaatcgttaaagaattagagaaatttgatacatttacaaactttttagatgttcatcagcctgaattggcgattgtctttggtcgtactaagcgtcgcgtagatgaattaacaagcgcgctattatctaaaggatacaaagcagaaggtttacatggggatattacccaagcaaaacgtttagaagtattgaagaaatttaagaacgatcaaatagatattttagttgctacagatgtggctgcacgtggtcttgatatttctggtgtgagtcatgtttataattttgatatccctcaagatacagaaagttatacgcaccgtattggacgtactggtcgagcaggaaaagaaggtattgcagttacttttgtaaatccaattgagatggattatattcgacaaattgaagatgtcaataatcgtcgaatgaaagcattaagacctccacatcgtaaagaggtgcttaaagcgcgtgaagatgatattaaagatagagttcaaaactggatgtcaagagaaaatgagccacgtttacaaagaatatcaagtgaattacttaaagaatatgatagtacagaattagtagcctctttacttcaagaacttgtagaagctaatgatgaagtggaagtacaattaacttttgaaaaaccattagcacgtaaaaatcgcagtaataaaggcggttctagaagaagtaatcataaacgtggtaatggtaagtttgataataaaaatagacgatcaaaagggtctaaaggtcaatcaagcaaaaagaaaaaccaaaagaaatttgaccgtagagataagcaacaaaaaagtggtaatcaatcactaaaaggtcgcacatttgctgatcaccaaaaataa

SEQ ID NO: 1426 - DNA, 327 bp, Staphylococcus epidermidis
ataatacgatataatatgaacagaggtgactttatggcagacatggagagtgcacatcactcagagcaaataaaaacaaatttaaaatcaagattaaatagaatagaaggtcaagtaagagcaataaatcgtatgattgatgatgacgtttactgtgatgatgtactaactcaaattagagcaacacgttcagcattgaatagtgtagctactaaattactagaccatcacatgaaaggttgtattatggaaaaaataaacgacggtgcgcaagaagaagcaatggatgaattgctcgtgacattccaaaaattaataaaagattaa

SEQ ID NO: 1427 - DNA, 669 bp, Staphylococcus epidermidis
gtaaggagtctatctatgaactcaagaatgaagattaaaaaagcttatgagtatatgaaaagtttccatcaacatgatacaactggacatgatattgcacatgtggaacgtgtctataacaacgcttgttatatcgctaaacgagaaaatataacagatacacttgttatagaactatcatctttattgcatgatactgttgatagtaaattaactgatgaaattttagcatatgatcagcttaaacagttcttatctaccctagatttaagcagtgaaatatcacaacaagttctctatattattaaacatatgagttatcgagctggtaaaaataatcacgttaaactttcaatagatggtgaaatcgttagagatgctgatcgcctagatgcaataggagcaatcggcattgcgagaacattccagttttcaggacactttggtgaacctatgtggactgaaacgaagctttcaaatgaagagttacatacgtctctcgttgaagaattagacaattcagcaataaaacatttttatgaaaaattatttaaattaaaagatttaatgcacactcctactgcaaaaaaacttgctgaagaaagacatcaatttatgattcaatatctcaaacaatttatgtcagagtggaattttaataaagagtaa

SEQ ID NO: 1428 - DNA, 486 bp, Staphylococcus epidermidis
aataacatgcaatctacacaagattatattgaaatgcggttgccagcttctgcagaatacgtaagtttaatacgtttgacgctttcaggggtgttttcaagagctggcgcatcttacgatgatatagaagattctaaaatagcagtgagtgaagcggtgacaaatgcggttaaacatgcatataaaaaaaattctgaaataggcatgattaatctttgttttgaaatatttgatgatagaattaaaattgttatttcagaccaaggagaaagttttgattatgaagccacaaaatcacatttaggtccatataatgataatgaaaatattgattttctacgtgaaggtggtctaggattatttttaattgagtctttaatggatgaagttactgtttataaagaatctggtgtaacaatcagtatgattaagtatataaaaaaagagcaggtgcgaaataatggcgaaagagtcgaaatcagctag

SEQ ID NO: 1429 - DNA, 2187 bp, Staphylococcus epidermidis
gtaatttttaaagaaaagcgtggtagaaaaaaacaaatggataacagtttaattgaaacaattgtaagtaaatatcaattttcggaaaaacaaattaaagcagttttaaaattgctgaaagaaaacaatacggttccatttatagcgagatatcgtaaagaagctacaggtggacttgatgaagtagaaattaaacaaatcaatgatgaatataactatatgttaaatcttcaaaaacgtaaagaagaagtaatacataatattgatcaacagggtcttttaacttcagatttaaagcaagacatattaacacagacgaagctccaaagagttgaggatttgtatcgtccatataaacaaaaaaagaaaacacgtgcaactgaagctaaaagaaaaggattagaagatttagcagattggttttcacaatcaaaattggatacaaaaattgaagataaagcccaattattcttaaatgatgaagtgactacaattgaagatgcaatagaaggagctaaagatattatagctgaacgtatttcggataatcctcaatatcgctctaaaatacttaaagatgtttttaatcagggactaattgtttcctcgaaaaagaaaaaagccgaagatgagaaacaaacattttctatgtactatgattacaatgaaccaattaaacgtattgctaatcatcgtgttttggcgatgaatcgaggagaaaaagaaaaagtattatcaataaaaattgattttgacacgacacgtattcaaagagaaatagcaaatgttgagataaaaactcaaaatgaggcaactccgtttattaaagaggctattcaggatagtcttaagcgattaattcttccttcaatagaaagagaaattagaggagatttaacacaaaatgcagagtctcatgcaatagatgtattcagtgaaaatcttagaaatttattactacaaccaccaatgaaaggtaaacaaattcttggagtagatccagcatttagaacaggttgcaagcttgctgtcgtcaatccatttggtacctttattgctaaaggtgttatttatcctcatccaccaatatcaaaagttgaggaagcggaaaaagagctagtaaaggtgataagtgactataatattgagcttttagcgattggtaacggtactgcgagtagagaaactgaacaatttgttgctaaagtaataaaaaaatatcaacttcaagctcaatttatcatagtcaatgaagctggcgcatcagtttattcagcatcagaaattgctagacaagaatttccagattttcaagtagaagaacgaagtgcagtttcaattggtagaagagttcaggaccctttaagcgaacttgttaaaatagatcctaaatctataggagtaggacagtaccaacatgatgtcaatcaaaaagatttaagtagtgccttaacgtttgtagtagagactgccgtcaatcaagttggtgtggatgtgaatactgcttctaaatccttgttacaatatgtatcaggtcttacatcaactatcgctcaaaatattattgattatagagaagaaaacggacctataaaacatcataaagaaataagtagtattaaacgattaggtgcaaaaacatttgagcaaagtattggttttttaagaattgttgatggtgaagaacctttagataatactgcaatacatcctgaaagttacgatgttgcatatcgcatgcttcatcaactagatttaactgcacaagatataggttccgttaaactcaaaaatacgttatcaaatgttaatatttcaacacttgtgtctcaattaaatattggtgaacctacattaaaagatataatacaatctttgattgcacctaatagagatccaagagatgaatttgaaacacctattttgaagtccgatgtattatcgattgaagatttatctaaaggcatgaagttgaatggtacagtaagaaatgttgttgactttggagcatttgtagatatcggtgttaaacaagacgggctagtacacatatcaaaattatctaagaaattcgttaaaaatccaatggatatgataagtgtaggagatattgtagaagtttggattttagatatagatgaaaataaaggcaaagtttcattgactatggttgacccaaatgaataa

SEQ ID NO: 1430 - DNA, 219 bp, Staphylococcus epidermidis
aatgttaataatcataaaaattatatgtttgatgattgttgtcttatgaattttatcattagacgtcttattaattgtaaagtaataatcgatgacttgaatatgatgatgtcacttttttatattattaatgtccatataaaggtaattttagttatccttgacttacgctatggtagtaaaataaataaaaagaacatatttgtattttttaattga

SEQ ID NO: 1431 - DNA, 1026 bp, Staphylococcus epidermidis
agtggaagtaaggaggcgcatttcgtggaagaattcacaaaaagttataaagcccttgttaaagaaagtttaataactaacaataaaacattattaattaagaaatgtgaagcattcacaaatgaagttataaagaaagatgttttacctgaagatatagttgagatacataaagattatattaatacattagatttaactgaagaagatatattagaaacactcgatgtgttacaagaagtcgttaaaggatttggatatagttaccgagattaccaaagacttgttaataagcttcaagtccacgataaagaaatggatttagcctcaagacttcaacaaactatgctgaaagctgatattccacaatttgatagcattcaaataggagtgatatctgttgctgcacaaaaagtaagtggtgattattttaatcttattgaccataaagatggcacaatgagttttgctgtggcagacgttataggttcaggcataccagcagctttagctatgagtatgataaaatttggcatggatgcttatggacattcacaactacctagtgatggtttgaagcgtttgaaccgtgttgttgaaaagaacgttaaccaaaatatgtttgtcacaatgttttatggactgtatgaagagatgaatcatctactttactgtagctcagctgggcatgaacctggctatatatatcgcgcagaaactgaagcgtttgaggaaattggtgtgcgaggaagagttctaggtgtgagtcccaaaacacgttatagccaacaggaaatccctatttatcttgatgatttaatcataatttttactgatggtgttacagaggcacgtgatgtagagggtaattttattgataaagataagttgttagacttaattcaaaaatataagcatatgcatccacaggatatagttcaaattatttacgaagcgattttaaaattacaaaatcctgcgagaaaagatgatatgactattttaattataaaaagagtaaactaa

SEQ ID NO: 1432 - DNA, 327 bp, Staphylococcus epidermidis
atgaatctaaatattgaaacaataactcatgatgatttttatgaggttaaagttggtggagaattggacgtatatactgtacctgaattagaagaggtactagtaccaatgagacaagaaggcacacatgatgttcacgttaacttagctaatgtgagctatatggattcaacaggtctcggtttattcgtaggcacgttaaaagcattaaatcaaaatgataaaaatctctatatcttaggtgtttcagagcggataggtagattgtttgatattacaggtttaaaagatttaatgcatgttaatgaaggaacggaggtagaataa

SEQ ID NO: 1433 - DNA, 186 bp, Staphylococcus epidermidis
cggcttctgaaacttaatattatcatatttttaaattcaattgcatttgataatctaaatatagaactaaattttaatgacaatttgcgccaatatacatatttttattatgactattacatattaaaagttaataaggtgctatcattctgtgatattctagcaaatttaaaagaagtcatgtaa

SEQ ID NO: 1434 - DNA, 216 bp, Staphylococcus epidermidis
gagggtatgaaattgaaaaaaggattgataaatgtttcaggtattaaaacaactgaacaagctaaacagctcaaagatcatttatctaagatgataggcatcaatagtgtggatatcgattaccaaatgaatgagattcgagtagaatttgacactcctgcaaatttaaataacattgaaaaagaaatttacgattacggatttcgtattttgtaa

SEQ ID NO: 1435 - DNA, 186 bp, Staphylococcus epidermidis
ttatgtttagatatcgttttagccaaagcaagtataagtataattttcatgaattcggaaggttggatgcttataggaccgaaactgtaccaacttttagcaccattaataattggggtgattgaagtttcaggtaaaataagtaaccctattaatagaacgcaaaatatactatataaaatataa

SEQ ID NO: 1436 - DNA, 1488 bp, Staphylococcus epidermidis
cctatgatagaagtctttactatggcacttcatcaatctaatattataattaatattttattagttagtgcctttttattaaatttagtttttgcattcattattattttcatggagaggcgtacagcaaattctatatgggcgtggttattggttttagtttttctacctttagtaggattcatattgtatttattattaggtcgccaaatacagagagaacatatatttaaactcgccaaagaggataaagttggtcttgaaatgattgttgacgagcaattagaggcattgaaaaagcaagacttttctaagggtaatcatcaaattgttaaatttaaagaaatggtacaaatgttactttataataatgctgcttttttaacaactgataatgatctaacaatttatacagatggtcatcagaagttcgatgatttaattaatgatattagacacgcacaatcatatattcacatccaatactacattattcatagtgataatctcggaaagcaattgttacatgaattagaaaaaaaagctgaagaaggtatagaagttaaaatgctatacgatgatatgggctcaagagatttacgaaagaaagatctaaaaaagtttcgtcaaaaaggcggtcacgctgaatctttctttccatcaaaattaccacttattaatttaagaatgaataatagaaaccacagaaaaatagtagtcattgacggtacgattggatatgttggtggttttaatgtaggagatgaatatataggtaaatctaagaaatttggttattggagggacacacacttacgtattaaaggtgacgcggtaaatgcccttcaacttagattcatcttagattggaactcacaatcaactcgtgacaatttaacttatgaatctcgatattttcctgatgttgactctggtggtacgataggcatacaaattgcttcaagtgggcctgatgaagattgggaacaaattaaatatggttatttaaaaatgatttcatcagccaaagaatctatatacattcaatcaccatacttcattcccgatcaagcttttttagattcgattaaaattgcagcgcttggtggtgtggatgttaacatcatggttcctaacaaacgtgatcatccctttgtttattgggctacgcttaaaaacgtagcgtctttacttgaagctggcgttaatgtctatcattatgataatggttttctacattcaaaaacacttgtcattgatgatgaggtagcaagtgtaggaactgccaatatggataatcgaagctttacattaaactttgaggtcaatgcttttatttatgatgaaggcgtagcacgatcattaaaacaagctttcattaatgatatgaaattatctaacaagctcacttctgaagaatatgctaaacgaaatctgctagttaaattcaaagaagggatttcacaactactttctccaattttataa

SEQ ID NO: 1437 - DNA, 375 bp, Staphylococcus epidermidis
tatactaaagaggcgatacaagtgatttatggaataggtatagatttaatagaaattgaacgaattaaaaatcttcagaatcaaacaaaatttattgaaagaatacttactatagaggaaagagacaaattaaatcaatatacaaacgagcaacgtagattagaatttttagctggacgctttactgtgaaagaagcatttagtaaggccttaggtactgggttggggaaatcagtatcgtttcaggatattaactgttacaacgacgctctaggtaaaccatgtattgactatcctggtttttatacacatgtgagtattacacatacggagaattatgctatgagtcaagttattcttgaaaaaaacgaatga

SEQ ID NO: 1438 - DNA, 522 bp, Staphylococcus epidermidis
aaggtgatactcatgaagtcttataaatatatgcatcaaaacggtattaaagtaatgagaattagtggtgctttttggacacttttacttgtgatagcattgtctattttaatattgcttaatgaattaaaattccattttattgatactaaaaatttaataattggagtaataattttaactacaatagtttgtattttatttatgattatagtgccttggtttaaatttaaacatcttagatattttttagatgataaagaaatacatattagagaaggtatcatttttatagatgtgcacgtcatcccttactttagaatacaaaatatagatatagttgagggatttatcatgagaaagttccaactcgcttcgctgtcattatcaactgctgggggaaattctgaaatagcattgatagatattcaagaagcacaaagattgaaaaaacaaattaaacaacaaaaatcaataacgacaaatgtaacttcattagaaaaattaaacgatgatatataa

SEQ ID NO: 1439 - DNA, 276 bp, Staphylococcus epidermidis
gggatgacgtgcacatctataaaaatgataccttctctaatatgtatttctttatcatctaaaaaatatctaagatgtttaaatttaaaccaaggcactataatcataaataaaatacaaactattgtagttaaaattattactccaattattaaatttttagtatcaataaaatggaattttaattcattaagcaatattaaaatagacaatgctatcacaagtaaaagtgtccaaaaagcaccactaattctcattactttaataccgttttga

SEQ ID NO: 1440 - DNA, 792 bp, Staphylococcus epidermidis
aaaaagagcaggtgcgaaataatggcgaaagagtcgaaatcagctagtgaagtatcacctgaacaaattaaccaatggattaaacaacatcaagaaaacgaagatagccaagctcaagataaattagtaaaacattatcgtaagctgattgaatctttagcttataagtattctaagggacaatcacatcatgaagatttagttcaagttggtatggttggtctaataggtgctattaatagatttgacttatcatttgatcgtaagtttgaagccttcttagtaccaacagttattggtgagattaaaagatatttacgagataaaacatggagtgttcatgtacctagacgtattaaagaaatcggtccaagaatcaaaaaagttagtgatgaattaacaaatgaacttgaacgttcaccatctattagtgaaatcgcacaacgcttagaagtttcagatgaagaagttttggaagcgatggagatgggtcagagttacaatgccctaagtgtggatcactctatagaagcagataaagatggttcgacagttacattattagatatcatgggacaacaagatgataattatgatttaacggaaaagcgtatgatattagagcgtattttacctattttgtcagagagagaaagacaaatcatacaatgtacttttattgaaggtcttagccaaaaagagactggtgaaagaattggtcttagtcaaatgcatgtttcacgtttgcaacgtaccgcaataaaaaaattacaagaagctgcaagacagtaa

SEQ ID NO: 1441 - DNA, 1083 bp, Staphylococcus epidermidis
  unsure (1060): Identity of nucleotide at the above locations are unknown.
gtagtttcaaggaggacatatatgtcagagaagttttatagagcaacatatttaaatgtgaatttagatgcaattttagcaaattatcaaaatttcaatcaattacacgctaataagactgtcatttcagtcattaaagccaatggatatggattaggaagtgtgaaaatagcacaacatttaatgcgtcatggtgcaacattttttgcggtggctacacttgatgaagcaatagaattaagaatgcatggagttgatgctaaattattagttttaggtgttgttccaacagaagacattgagaaggctatacagcatcgtgttgctttaacagtaccttctaaagcatggttgaaggaaactatcaagcaaattcctgatgataaccaaaaaaatttatggctacatgtaaaattagatactggtatgggccgaattggaatgaaagatatagatgaatataaagaagtggttgatttaattaataaaagagatcatttagtttttgaaggagttttcacacattttgcgagtgcagatgaacctggaaattctatgaatgaacaatatactttgttcaaagagatggttaatcaagttgagaaaccaaactatattcattgtcaaaattctgctggatcactactcatggatggtcaattttgtaatgcaataagattaggaatctctctttatggatactatccttcagaatatgttaaagataatgtaaaagttcatttaagaccaagtgcgcagttagtatcagaaaccgttcaagttaaaacacttaaagctggtgaaactgttagttatggacgtacatatattgctgatgaagaaatgacaattgcaattttacctattgggtatgccgacggatatttaagatcgatgcaaggtgcgttcgtcaatgttaacgggagtcaatgtgaagtcattggacgtatttgtatggaccaattgatagttaaggttccttctcatgtaaaaacgggtgataaagtaatacttatggataatcacgttgattcaccaccatcagctgaaaccgtacccnataaacaaggtaggactaactag

SEQ ID NO: 1442 - DNA, 501 bp, Staphylococcus epidermidis
atcttgaaaaggagtacatttatgaaaaatgatagtacgtttcatagaagcccaatccaagcgctaaagtactattacataactagttgcataggtttatttattttgcttgttatacttagtttacttttgtattttagctatttaaatcattggtggccttttacatcctacatctttcttgggctaggtttgttatcgattttaaacacttgtatatctccactaattaaatatagatatcattattataaaattcacgaagattttgtcatattaaaaagattatttatttttaggaaagaagaattaagtaaaatagagagaatacaatttatcgatattggaactaatccgttatcaaaaaaattaaatcttaattccataactttatttactgcaggtcatacaatctcatttccaataatatctgagaaagaagcacaaaatattcaacaacaaatactattgagattgagaggtgcaaatgacgatgtatag

SEQ ID NO: 1443 - DNA, 363 bp, Staphylococcus epidermidis
atgattagaagaggagatgtttatttagcggatttatcaccagttcaagggtctgaacaagggggagtaagacctgtagttatcattcaaaatgatactggtaataaatatagtccaactgtaattgtagctgcgattactggtaggattaataaagcgaaaataccaacccacgtagaaattgaaaagaaaaagtataaattagacaaagattcagttattcttcttgaacaaattagaacactagataaaaagcgtttaaaagaaaaattaacatttttatcagagagtaaaatgatagaggttgataatgccttagatattagtttgggattaaataactttgatcatcataaatcttaa

SEQ ID NO: 1444 - DNA, 837 bp, Staphylococcus epidermidis
ctattgattggcctatcaggttgtgattactctacacctgagaagcaagatggattcttctttaatacttttgttcaacctatgaaacatctcttacagtggttaggaaatgatgtttttcataataattttggactagcaattattgtattagttcttttcattcgtttaatcttgttaccatttatgttatctaactataaaaatagtcacatgatgcgtgagaaaatgaaagtggctaaacctgaagtagatggcattcaagaaaaggttaaacgtgcgcgaacacaagaagaaaaaatggctgcaaaccaagaacttatggaagtttataaaaaatatgatatgaaccctatgaagagcatgttaggatgtttacctatacttattcaaatgccaattattatgggattatactttgtattaaaagataagcttgtaaatggtttatctgaacatccgcatttcttatggttcaatttaactaagcctgatatttggattacagttattgccggtgtgctatactttattcaagctgtagtttcaagcaaaacgatgcctcaagagcaacgtcagatgggctatatgatgatggttatttctccaataatgattatttggatttctttacaagcatcatcagctttaggtttatattggtctgtcagtgcattattcttagtaattcaaacgcattttgctaatatttattactctaaacttgctaaaaaagaagttcaaccttttattgaaaagtatgaaagagaacataatccatcttcaaagaaaaaagggaaaaatactcaagtagtatcaaaaaagaataaaaaataa

SEQ ID NO: 1445 - DNA, 1521 bp, Staphylococcus epidermidis
gaggtgcaaatgacgatgtatagtccgcaaaagctacatccaatttcttatattgatggcttgattagtgtgattaaatcaaatttcattgtaattatcatctttttatttaatataaaagattttaaatatgatgatttttcgtcttatattattccaggtataatgactttgatattttctatcggtttcattcataatattattaaggtttataatacacgatattggattgaagaggatcattttattttaactactggtgtttttaataaggaacgaaaagaactaaatattagtcgcatacaatctgcagatacgtctcaaggtttgattaatcaaattgttggcggcgttgaactcatcattaaaacaccaagtgatggcatagaattagggacaatttccaaaaagcaaagtgaagttattgaacaagaattgcgatctattcaagaacgcatgaataaccaggtaaatcaagaagctaaagagttaaatgatgagaatcatactcagacatatcaacaacatgccaaaccccaatatgcaatatttaaaatgccttttaaacaactattatttatgtctatgacaagtggagctatagcacttgcttttgtgacactatctcctattattggcagtctctcaagtgttattccatgggataaatttggtgaagaaatatcttcggtatttaaaacgatatatttcattgtcatttttattgtcatactagtgttattattaagttatataatcggaactatcatgtacttaataaagttttatggatatcaagttattcaagataatcatcaacttaaaattcaatatggattatttacaaagaaaaatatcactgtaccaactgaccgactgcaaggtgtacttgaacatcaatcttttatacgaaaattatttggttatacatctatacatttctatattacaagtgatatagatactactgaaggggaacccactgataatgatggaagaattatgattttaccgtttattccaagaaaagaggcatataaagtgattaggcctttggttcctgagatgacatttaatcatgctaaaattggcatgcctttaaaaggatttcatcgtcactttctaattccttccttatgtattattggtatgggcattattggatggtatatgtggtctttatggtctttaatcatagctttattaccaatcttattattttttgtttacgctatactttatacacgttttagtggttttgcttttagcgaatcagagctagttgtccaaaaagcgtctatattaaatattaagagattttatgttaaaaaagaaaaagttttaggaatggctattagccaacatccctttcttgaaagaagtcaactcgcaaattttcaatttgttattgctaagggtagtagtcagcaaaacattggtttgaagtttagtgaagtagataatgttcttaaactcaaaaattggtacatgaaaggtgatactcatgaagtcttataa

SEQ ID NO: 1446 - DNA, 207 bp, Staphylococcus epidermidis
tataacaacttttggaatcagatggaggttcttttcatgttatcttttaatcaaaatagaaaccacagtcttgaacaatctttaaaagaaggttatgcacaaatggccgatttaaacctctccctagcaacagaagcttttccgatagagtgtgaagcttgtgattgcaatgaatcacatttaatatctaattcaaagaatgaatga

SEQ ID NO: 1447 - DNA, 1374 bp, Staphylococcus epidermidis
ttattagaggttttagttatgataaacgtaacattagagcaaattaaaaactggatagattgtgaaattgatgaaaaacatttaaaaaaaacgataaatggggtttcaattgattcacgaaaaatcaatgaaggggcgctatttataccttttaaaggtgagaatgttgatggccatcgttttatcacgcaagcgttgaacgatggtgctggagctgtttttagtgaaaaagagaataaatattctgaagggaaccaaggtcctattatttgggtagaagatactttaatagccttacagcaattggcaaaagcatatctaaatcatgtgaatcctaaggtgatagcggttactggttctaatgggaaaacaacaacaaaagacatgattgaaagtgtattatcaactgaatttaaagttaagaaaacacaaggaaattataataatgaaattggaatgccgttgactttactagaacttgatgaagacacagaaatttctattctagaaatggggatgtcaggttttcatcaaatagagttgttatctcatatcgcacaacctgatatagcggtcatcacaaacattggtgagtcacatatgcaagatttaggatcgcgagaaggcattgcaaaagctaaatttgaaataacaactggtctcaaaacaaatggtatatttatttatgacggagatgaacctttattaaaacctcatgttaatcaagttaaaaatgcgaaattaataagcattgggttaaattcagacaatacatatacttgtcatatgaacgatgtaaaaaacgaaggtattcattttactatcaatcaaaaagaacattatcatttaccaattttgggcacgcataatatgaaaaatgctgctattgcaattgctattggacatgaattaggcctaaatgaaacaataattcaaaataatattcacaatgtgcaattaaccgctatgagaatggaaagacatgaatcatcaaataatgtaacagtaattaatgacgcatataacgcaagtccaacgagtatgaaagctgccattgatacattaagtggcatgaaaggtcgaaaaattttaatattagcagatgtacttgaattaggacctaatagtcaattgatgcacaaacaagttggtgaatatttgaaagataaaaatattgatgttttatatacatttggtaaagaagctagttatatccatgatagtggtaaaatttttgttaaagaagcaaaatactttgataataaagaacagttaattcagacgctaatatctcaagttaaacctgaggacaaagtcttagttaaaggttcacgaggtatgaaacttgaggaagttgttgacgcattgttgtaa

SEQ ID NO: 1448 - DNA, 2217 bp, Staphylococcus epidermidis
tattttagattggtgcataataaagataaattaatgaggtgtatgtatagtatgcaaactcgattgggagaaaaagatattaatttaccgcagtattacaacaatagggagttaagttggctagattttaactatagggtattacaagaatcatatgataaaaataatccgttgcttgaaaaacttaattttatttctatcttcagttcaaatttagatgaattctttatggttcgagtggctgggttaaaagaccaagtcaaaatgggatatgacaaacctgaaaataaagcacaaatgacgcctcaagaacaacttgatgctattaaaattaaaaatacagactatgtgaacactcaatatcaacgttataacgaattaattaaagaattagccaattacgatattgagatggtaaaacctgaagacttatcagatgcattgatagaaaaattagaacaagagttcaagttaagtgtcttgccgacactcactccgttaggtattgatgcgtatcatccatttccaaagttaaataataaaagtttaaatatttttgttgatatcgatacggaagatgccattaattcagctatcgttcaaattccttcattaattccacgctttttaactttaaatgagggtacaaaacaatacgttgtcatggtagaagatgtgattacgtatttcatcaattatttatttacaggatacgaagtactaaatacttttactttccgaatcacacgtaatgcagatttaaccattcatgaagatggcgctgaggacttgcttatagaaattgaacgtttcttaaaagaacgtaagagtggttcggctgtacgtttagaattagattgtcgcacttctgaaaaagagaatgtagaatggttaatcaatcaattagaaattgaagataatgatatttattatttagatggtccacttgatttaacattcttatttggattggttgatcatctatctcataagctcaaatatttaacgtatgagaaatatactcctcaaccacctagatcattaggcaacaagaatatctatcaattatcattagaaagagatatattcttccaccatccgtatgaatcatttgaaccaatagttgactttattcgacaagcagcagatgacccaaatacaatcgctatcaaacaaaccttgtatcgagtgagtaaggattcgccgattattaacagcttaaaagaagctgctgaaaacggcaagcaagtaacggtgctcgtagaattaaaagcacgctttgatgaagaaaataacgtacattgggcacgtatgctagaagatgctggctgtcacgttatttatggtatgacacatctaaaaacgcatagtaaaattgcgctagtcgttaaacgcatcaacaatgaacttacgtcatttgttcatttaggcacaggtaactataatgataaaactgctaaattatacacagatatgggtatcattacgacaaataaagatatcgctgaggatgcaattaacttctttaattacttgagtggttactcaacaaaaccagaatacaataaattgattgtagcaccatacgatattcgagacgtcttcattgatcgtatcgataaagagatacgtagtcatttacaacatggtaatggtaaaattatgatgaaaatgaactctttaaccgataaaacgattatcgaaaagctcttcgaagcatcccaagcaggcgttaaaatacaactcatcattcgtggtatatgttgtcttaaaccaggcattccaggtattagcgaaaatatagaggttgttagtatagtgggtcgtttgcttgaacattcacgtatttactacttccataataatagtgaggcgcatatttatttatcttcagctgacgttatgacacgtaatatgattaaacgtgtcgaaatattgttccctgttgaagataaatcaataggacaacgattagttaactatatgaatttacaattatctgacaaccaaaaaggtcgttaccaagatgcacaaggcctttatcattatgtcgaaaacaattcatctcctttaaactctcaatcttacttgatgcaagaagcaattaagtatggagaagaactaaaaaaacaatcggtacaaccttctggacaacctgttcattctagacgtggcggtagttggatgcgaaaattaaaaaacacatttaaaagataa

SEQ ID NO: 1449 - DNA, 591 bp, Staphylococcus epidermidis
acagcaatatctttcaaaaggggcaagctaattatgaatatatataataaagtgacattatctgtcattttagttataacaattatcatttcgttcctcttttatttttatacaacagagaaaaaagtggacaaagataaattgtatgaaaacaaaattacaaatcataaacaagcaggtaaacctaaaaattatggtgtcgcatctaataataaaatagctacgaaagtcggaaataagattattgaagatggtggaaatgcggttgatgcggcaataggtgtttcttatgcactagcagtgacagaacctcattcatcaggactaggaggtggcggtgcgacacttacatataatggtaaagagaatgaaacgcctaaagcttatgaatataaaacaatgtcctcatatgaatataaagaaggcgacaaaattggagttcctggcttcgtgagaggattacatgatatgcacgcgaaagaaggaaaaatggatgagaaaaagattttagattacgttattccgcttgctaaagatggttttgaggtagattcagaactagtaaagaagtttgaaattatatggtcgtga

SEQ ID NO: 1450 - DNA, 231 bp, Staphylococcus epidermidis
tttgaagtatcattttgtttatttttgcgattgtgttctatttttttatcattcttattagaattcgtatggtggttaatagctgcatataatgaaaagcccaatgcgcatataagaatgattactactattgtagctgaaaattttttcaaagcgtatatcctccatcctttttatcaactatattttattataatccttttttttattgtaagtagaattattctataa

SEQ ID NO: 1451 - DNA, 390 bp, Staphylococcus epidermidis
atagctggatttgtactccactgcattaaattccacataaataagccaactaataataatcctgttcctggtaataataagttaagaattatcatcattattataaatattgaaatcgaaattattaaccaacgcttactagtaaacttatcagataaaacaccgcctaatgaagtaccaatcacacctgctacaccattaacaagtagtgctaaagacacaaaagacatttcatgtccattggataaaattaatggattaataaacacgaatgttacagaattagcaaccagcactaaaaatgtaatcatcagatatttaaaaacctcacgaggtcttatgacgcttgagccagtttgtgattcaatactagatgaacgaggtgtttga

SEQ ID NO: 1452 - DNA, 825 bp, Staphylococcus epidermidis
atagggggattaacgatgattaaagccattgcggtagatatggatggaacatttcttgacacaaataaacagtttgatcgaaatcgttttgaaactatttttaaagaattaatagataaaaatattaagtttatagctgcgagtgggaatcaatttgcaaagctaaaatcaatttttggagatagggaaatgttctttatatctgaaaatggagcagtcatctataaaggtaatcaactttacaattatcgaagttttgatcagtatatttttcaaaaagttgtaaattatttaaatttgaatcaaaagataaacaatttgattatttgtggtgtaaaaagtgcatatattttaaaagaaacaagcgaagcatttaagcaagatgcacgtacatattatcaccaactaatagaggttgactccttacaaacattacctgatgatgattatgtgaaaattgctttcaatataaatcgtcagactcatccagacttagatgagaaattagctcttaagtttaaagacgatattaaactagtatcaagtgggagagatagtatagatgttattatgccaaatatgactaagggtcaagctttgtctagattattaaaagaatggcaaatgcctgcttcacatttaatggcatttggagatgcaaataacgataaagatatgttggagcttgccgaacatagttatgttatggctaatagtgaagatcaatcattatttgatatagcgagtcatgtggcaccttccaatgatgaacaaggcgtactatcaacaatcgaaaatgttgttctcggttattccaataaataa

SEQ ID NO: 1453 - DNA, 1566 bp, Staphylococcus epidermidis
ttatcagaatcagccaattcattttatctacatgtagatgattttttaatacgtattgttaaggaatgtttgctgactcatgttaatagtaagttgatgttatggaggtttgttatgggaagtttttttaatcggatgactcgaaaagagaatcctactatttatcaaagtaaagatgggcatcttaaacgcacattacgtgtacgcgactttcttgcactaggtgttggtacaattgtttctacatctatcttcactttaccaggtgttgtcgcggctgagcatgccggacctgctgtttcattgtcattcttattagctgctattgtggcaggtcttgtagcctttacttatgcagaaatggcatctacaatgccttttgctggttcagcttattcatggattaatgttctttttggtgaattattcggatgggttgccggttgggcgcttttagcagaatactttattgctgttgctttcgttgcttcaggcttttctgctaacttaagaggtcttattgcaccattgggcatttctttacctaaatcattatctaatccatttggaagtaacggtggtgtcattgatatcattgctgctgtagtgattattttaactgcattactattatcacgcggaatgaacgaagccgctcgtatggaaaatgtattggttatattaaaggtgttggccatcattttatttgtgattgttgggctaactgcgattaatttcagtaactatataccttttattccagaacataaagttactgaaactggcgactttggaggttggcaaggtatttatgctggagtttcaatgatttttttagcttatattggttttgactctattgctgctaattcagctgaagcgattaatccacagaagacaatgcctagaggaatcttagggtcactcatagtagcaattgtattgtttgtggccgtagcacttgttcttgttggcatgttccattactctcaatacgctgataatgcagagccagtaggttgggcattacgagaaagtggtcatggtattattgctgcaattgttcaagcaatttctgtcatcggtatgttcactgcattaatcggtatgatgcttgcaggttcacgtctattatattcatttggacgagatggtttactcccttcttggttaagtcaattgaatcacaaacatttacctaatcgagcacttgccatacttacaatcattggcgtagttatcggatcaatgttcccgtttgctttcttagcacaattgatttccgcaggtacccttgttgcattcatgtttgtgtcactagcaatgtatcgattaagaaaacgtgaagggaaagatttacctaagccagagtttaaattacctttatatcctatattgcctgcaattacatttatattagtattgctagtattttggggattaagttttgaagctaagttgtatacactgatatggtttattgtaggtataattatttatttaatttatggaattagacattccaaaaagaatgatgaagaagcgtatcaagtacctagaaaataa

SEQ ID NO: 1454 - DNA, 201 bp, Staphylococcus epidermidis
attgctctgtcttctgctttctctttagcaaatatgattgttaaaattactgttatggtagccaatataccaccaatgagaattgcagatccacgtaaaagtgcttcttctggggctatcggtaagtttatagataagcaaaacgttactaaaaagaatgtcgatgatggaccagcgatttttagtgcattaaacgtataa

SEQ ID NO: 1455 - DNA, 312 bp, Staphylococcus epidermidis
tataacatgtcatttaatatttggatgtggattttacttgtattatttattgtggggacaatagctgtaattctcattttaacagttggctcagtgttagaagagcgctcatatgaccgtcgatcagaagatgaaaagcgcaaaaatttagaaaaaaatcttgagatgtcaaagggacatacagatgtatcgcaagagtcgagcaatggggaagaacaagtaacacaagagcattctcaacatgtcgttcaagatcatcaacaaacacatcaaaatataaatcaatcaacacaagataatagaaataattag

SEQ ID NO: 1456 - DNA, 225 bp, Staphylococcus epidermidis
ctatatgcgtctggcgttaaggtagcaatacctgttttaggatcatacgtcgcagatccagacagattcatatgttcattaaagttatctttgttcaccacaacagaattagatgtcagacttgaagttgttgtcgtggacgttgttgtcggtgctgccatcgtattcaaaacagtaaatctactaaatgttcttaaatttgcaaaggaagtaggactcgattga

SEQ ID NO: 1457 - DNA, 1458 bp, Staphylococcus epidermidis
catctaactttaacatatatagagggtgaaacgatgtcagggaaactagaagaattacaattaaaagtagctcgattaagtcgacgtactcatgaattaggtattccaattatggtattatttgaggggattcctgcttcggggaagacacgtttatcaaatgaattactattgcacctagatgccaaatattcgcgatttatagctactaaatcgccagagtcaaacgatttacgttaccaatttttacaaaaatattggaatactttaccacaaaagggcaatataaatatttattttagaagttggtattcacactttttagattataaagaaaataaaattaagcatgatcaatataaaaattatgatgttttagtcaatcaaatttatcattttgaatcgatgttaaagaatgataactatgaaattataaaatttttcatagaaataaatgaagaaaaacgcaatgaacatattcaacagacaaaagataatccattaactagatggaaagttcaagaatatgaaaatgttatacctcaagaaagttatctaaatcaaatgcatcaattcatcaacaaagataaagattggaaagtgatcgattacacagagcgcgagcatgcttttgaaaaaatgtacttacatttaatagatagacttgagcaagctataaaaaaagttgaacaacaaacaactaaagtcaacggtaagttcacatcaagctttacgacttctttatttaataataatcttgagaaagtagacaaaaaaacgtataaaaatctcattgttgaattgcaacagagaatgagagaaatccaatttgctttatatgaaagaaagattccccttgttttggttttcgaaggtatggatgctgctggtaaaggtggcaatattaaacgtattagagaaaaattagatccaacaggatatgaagtgaatggtattagtgcacctacggatgtcgaacttaagcatcattatttgtggagatttgctaaaaagatgccaaaatcaggtcatataaaaatatttgatcggagttggtatggtcgtgtactagttgaacgtgtagaaggttttgcaagccagaatgaatggcaacgagcatctgatgaaatcaatcaatttgaaaagatgtggacagatgaaggtacaatcatattaaaattcttcttatgtttagataaagatgagcagcttaagcgttttaaagaccgtgaaaataatcctgataaacaatggaagattactgaagaagattggcgtaatagagaaaaatgggatgaatatttagaagcaagtcatgatatgattgaatctacaaacacttcatatgccccttggtatattgttccggcagatcataaaaaaacgagtcggattgaagtacttaaaacaattattagaaaatgtgaagaagtactatggggagttaagacgtattaa

SEQ ID NO: 1458 - DNA, 1311 bp, Staphylococcus epidermidis
ttcaaaacttttcacaatttttgtaaagcgcttacatatttattatatattcctggtcatgtctgttatatttcattgtataaaacgaattttctttggtatgatactagtgctacttcaaaaaatgaaaggatgtcacaccttatgaatataggtatagataaaataagtttctatgtacccaaatattatgtagacatggctaaacttgcagaagcgcgccaagtcgatcctaataaatttttaattggaattggtcaaactgaaatggctgtgagcccagtgaatcaagatatcgtatctatgggagccaatgctgctaaagatattataacagaagaagataaaaagaatattggtatggttatagtagcaactgagtctgcgattgataatgccaaagcagcagccgttcaaattcaccatcttttaggtattcaaccctttgcaagatgctttgaaatgaaagaggcttgttatgcagcaacacctgcaattcaacttgccaaagattatcttgctcaacgccctaacgaaaaggttcttgtcattgctagtgacacagctcgttatggtattcattctggtggtgagcctactcaaggtgccggtgcagttgcaatgatgatttcacataacccaagtattttaaaacttaatgatgatgccgtagcatatactgaagacgtttatgatttctggcgtccaacgggtcatcaatatcccttagttgctggtgcattgtcgaaagatgcctatatcaagtcattccaagaaagttggaatgaatatgcacgtcgccataataaaacactcgctgatttcgcttcactatgtttccatgtaccattcaccaaaatgggacaaaaagctttagattctattattaatcatgccgatgaaactacacaagaccgtcttaactctagttaccaagatgcagttgattataatcgttatgtcggtaatatttacacagggtccttatatttaagtctcatctctttattagaaacacgtgatttaaaaggcggacaaacgattggtctctttagttatggttctggttctgtaggcgagttctttagtggaacattagtagatggattcaaggagcaattagatgttgagcgccacaaatctttattaaataatagtatagaggtttctgttgatgaatatgaacattttttcaaacgctttgaccaattagaattgaatcatgaacttgaaaaatcaaatgcagatcgtgacattttctatttaaaatctattgataacaatattcgtgaatatcatatagcagaataa

SEQ ID NO: 1459 - DNA, 2091 bp, Staphylococcus epidermidis
tcttatttgttcatgctttttttgtggcacgtaaataagaagatagagaggaatgaattgattatgtttaaaaagctatttggtcaaatgcaacgtatcggtaaagctttaatgttaccagttgcgattttaccggctgcagggttgctattagcaattgggactgcgtttcaaggcgaagcgttacaacattatcttccatttataaaaaatgatattgttcaacaaatcgctaatatgcttacaggtgctggtggtattatatttgataatctacctattatctttgctttaggtgtagcaattggtcttgcaggtggagatggtgtagctgctattgctgcatttgttggttttatcattttaaataaaacaatgggggcattcttgcatgtaactccagataaattatctgatccaactaatggatatgcaaatgtattagggattcctacacttcaaacaggtgtgttcggaggtattattattggtgcactagcagcctggtgttataacaaattctataatattaccttaccatcatatttaggattctttgcaggtaaacgttttgtaccaattatgatggcaacaacatctttcattttagcctttccaatggcaattatttggccaacgattcaaaacggtttaaatgcatttagtgagggattattagattcaaatacaggtgtagctgtatttttatttggatttattaagcgattattaataccatttggtttacatcacattttccatgcaccattctggtttgaatttggttcttggaaaaatgctgctggagagataattagaggcgaccaacgtatttttattgaacaaatccgtgaaggtgctcatttaacttctggtaaattcatgcaaggggaattcccagtcatgatgtttggattaccagctgcagcattggctatttatcaaacagcaaaacctgagaataagaaagtagttgcaggtttaatgatttctgctgcattaacatcatttttaactggtattactgaaccattagaattctcattcttatttgtagcaccattcttattcgtaattcacgcagtattagatggtttatcattcttgacactatacttgttaaatgtacatttaggatatactttctctggaggatttatagattatgtcttattaggtattctacctaataaaacagcatggtggcttgtcatcccagtaggtattatttatgcagtgatttactactttgtatttagattccttattgttaaatttaactataaaacaccaggtcgtgaagataaaaaatcatctgtaacaactacatcggctagtcaactgccattcgatgttttgaaagcaatgggtggtaaagaaaatattaaacatctacatgcttgtattactagactaagaatacaagtaaatgaaaaatcaaaagttgatgttgccggccttaaatcattaggtgcttcaggagtacttgaagtcggtaacaatatgcaagccattttcggtcctaaatctgatcaaatcaaacatgatatggctaagataataagtggagaaattacaaaaccaagtgaaacaacaattgatgaagaagtgtcagatgagtctgtacatgtggaagatattgtagaaacagaaatttacgcacctggacatggtgagataataccgttatctgaagtacctgataaagttttctctgaaaagatgatgggtgatggtatcggatttgtaccagattcaagaaaaattgtagcaccatttgatggtacagttaaaacaattttccctacaaaacatgcgataggattggaatctgatagtggcgttgaagtgttaattcacattggtatcgatacagttaaattaaatggtgaaggttttgaaagcttggtaaatactgatgaaccagtaacacaaggtcaaccattaatgaagattgatttagaatacttaaaggaacatgctccaagtattattacaccagtaatcataacaaaccaagaagacaaaacattaacaattgaagatgtaaaacaagtcgatcctggtaaagcgattatgacaattaaataa

SEQ ID NO: 1460 - DNA, 1590 bp, Staphylococcus epidermidis
ggggtattgtttatgtcagttttaactgtcatgcaattcatagtcaatattatcatcatgattgtgttattaacgattatgattcttgggggtatttggttatttaaagataaaggtcaaaatcaacacagtgtactaagaaattttcctgttttgggtcgaatccgttatatttctgaaaaaatcggtcccgaattaagacaatatttcttcgctaacgataatgaaggaaaacctttttcacgaagtgattataaaaacatcgttttagctggaaaatataaatcacgaatgaccagttttggtacagggaaagattacttagagggattttatattcaaaatacgatgttcccacttcaagcaactgaattacatatcgatcatactgaattcatttctacattcttatatcatattgagaatgagcgcctatttagtagagaagaatacagaaaaagcgctcaggttgatccgtttttcttaactgatgaacatgcagtagtattgggctctaaccttaagcatccctttaaaattaaacgcttagttggtcaatctgggatgagttatggcgctttaggtaaaaatgcaattactgcactgtcaatggggttagctaaagctggtacatggatgaatacaggtgaaggtggattatctgaatatcatttgaaaggtaatggtgacatcatctatcaaattggtccaggactctttggagtaagagatcatgatggcaattttaatagagacatgtttatcaatcttgccgaacacaataatgtacgcgcatttgaaattaagttagctcaaggtgctaaaacacgtggtgggcatatggaggggaacaaagtcacagaagagattgcacgcattagaaatgtgaaaccatatgaaactattaattcacctaatcgttttgattttattaaaaatccaacagatttactgaatttcgttaatcatttacaatcgataggtcaaaaacctgtcggcttcaaaattgttgtcagtaaagttgaagaaatagaggcgttagttaaaacaatgatagagatagacacctatccaagctttattactgttgatggtggtgaaggtggtacaggcgctaccttccaagagcttgaagatggtgttggtttaccgttatttacagcacttcctatcgtttcaagtatgttagaaaagtatggcataagaaacaaggttaaaatttttgcgtccggtaaattagtgactccagataaaatcgctattgcattaggattaggtgcggatctcgtcaatattgctagaggtatgatgataagtgtaggatgcatcatgagccaacaatgtcatttaaatacatgtccagttggagtagcaacaaccgatcctaaaaaggaaaagggacttattgttgatgaaaaacaataccgtgttacaaattatgttacaagtttgcatgaaggtttatttaacatcgctgcagctgtaggcgttcatagtccaacggagattacttccgaccatattatctatagacaattagatggcactacaacgtccattcaggattataaacttaaattaatttcttaa

SEQ ID NO: 1461 - DNA, 1164 bp, Staphylococcus epidermidis
agcagattgttactcattatagcgtgtgttgcgcttattctctggctaggaattaaagagaagaagcgtcatgcaaatcgacttgaaaaaattccattacgtattaacataaatggaattcgtgggaaatctacgattactcggatggcttacagtgttctacgtgaggaccagtatagagttgttggtaagacaacaggaacagatgcacgaatgctctattggtttactgaaaaggaatatccagtaatcagaaaaccacaaggcgccaacattggagaacaacgagatattattcgtaaggtggttaaacaaaaagcaaatgccctagttaatgagtgtatggctgtaaatccagattatcaaattacctttcaaaatgatttagtaaaagcaaatatcggtgtaattgttaatgtgatggaagaccatatggatgtcttaggaccgacacttaaagatgtagcgcaagcttttactgcaacaattccatataacgggaaattagttgtaatgaaagataactatactagtttctttgtaaaggaagctaaaaagcgtaattcagaactcattgttgtagataaagacgtcataccagaatcatatttacggaagttcgattatttagtatttcctgataatgtagctattgtgttaggaatagcgcaagcagttggtgtagatgaagaaactgcattacaaggtatgttaaatgcaccagccgatccaggtgctgttagaattaaatatttccatgcaaatcgcacaaaaaatgtatttgttaatgcattcgctgctaatgaaccgcagtctacaaaagcgattttaaataaagtggaatcatataattatccatacgataagaaaataatcattctcaattgtcgttcagatagggttgatagaacacaactctttgttgataactttttaggtgaagtcgattacgatgttctcatttgtacaggaaaaagtacacaaatggtgacacagtttatggaaactatgccagaaaaaacatatatcaattatgaaggacgagactttgtagagattgaaaaaggtattctacatgaagctgagaatgcacttgtattttgtgtaggaaacatccacggcccgggtggtagaatagcggaattcatagaagggatagaataa

SEQ ID NO: 1462 - DNA, 747 bp, Staphylococcus epidermidis
gagggggctccgctaatgtctatagaaagaattatttatgacaattttcaaaacgatccatttataaatgaattagatattaatgatgagacaaaaggcgcttatgagattttaaaatgggcatatcaaacttatgaaaatgatattgtttattcttgcagttttggtgctgagagtatggttttgattgacttgatttctcaaattaaacccgacgcacaaattgtatttttagacactgatttacattttcaagaaacatatgacttaatagatagggtgaaagataaatatccgcaattacgcattaaaatgaaaaaaccggaacttacgttagaggaacaaggtgagaaatataatcctgctttatggaagaatgatcctaaccaatgttgctacatacgcaagattaaaccactagaagacgtattatctggtgctgtagcttggatatcaggtcttagacgagcacaatcaccaacacgagcacatacaaatttcattaacaaagatgaaagatttaagtcaattaaagtgtgtcccttaatctattggacagaagaagaagtatggtcttatatacgtgataaggacttaccttataatgaattacatgatcaaaattatccaagtattggttgcattccatgtacatcacccgtatttgattctaatgattcacgtgctggtcgttggtccaattctagtaagactgaatgcggattacatgtagctgataaaccataa

SEQ ID NO: 1463 - DNA, 1389 bp, Staphylococcus epidermidis
gctacgactttatatgtaaaggtgtgttcaaacatggttcaagtcaagataggtaactgtaccatcaatggcatacacaaaaagaatattgatgtattcttaggtatcccgtatgccaaatcgttcaataagatatctcgattccaacattcaaagcttatggaactaagcaaaccaatgattgatgcaactcatattcaatccatcccaccacaaccctacaattcacttgaagactttttttcgatgacagattcatcgtttaattcttttaaacaaaatgattattgcctgtttttaaatatttggaaaccatcatccaatcaaaatcatttacctgtagtgatttacttttatggtggtagttttcttcaaggacatggcacagctgaactatattgtcctgaacacatagtagaacaagaaaatataatagtagttacttttaattatcgcttaggtgcactcggctacctagattggtcttattttaatcaacatttgaactataataatgggatttctgatcaaattaacgttttaagatgggtacatcaatatatcgaacattttggcggtgatccaaataacgtgacactaatgggtcaatctgcaggtagtatgagtatcatgacattaatgcaaatgcccgaacttgatgattattatcataaagtgatgttactaagtggaacgttaactactgatacaccactcaatgcacatactaaagtacaacatttttcacaactcatgaggcattattttcctaataaaacacttaagacacttaacagtgatgacattttatatctaatggagtctcaaaaaatagagcgtggaagatctcgtggacttgatttgatttatcaacctattaaagatcatcatatgtcacgatccattaaaaaatttcccaaaccgacattcatgagttatacacacgatgaaggtgatatttatattgaagacgcaacacgcaccttaccttctgaacgttttattcacttgatgtctcaatatggtacacacgtcgaaaaaaatgatgccctcacaatgaaacaacaaagaaatgtaataacagagtattgttttgttcgtccgatttatctatttttaaatcaaatgaatagttgcgacacttggctagcacgttttgattggcaccaaccccatacctcctactttaaaagtgcatatcatatattggatttagtattttggtttggtcatctctctattttgactaaaaatcattattctgtaacccaacatgatatgaatttaagtcgtaacatgatatctgacttagcttattttgcccgaaaaggtaagatgccatggaaatgttatgaacctcaacatcaagcgttacatatctatagataa

SEQ ID NO: 1464 - DNA, 408 bp, Staphylococcus epidermidis
aaaggggtgttgttgatggaaaaagcaaaatttgtcattaagttaatacttcaacttgcccttatcatgcttattacttttataggcacagaagttcaaaaattacttcatatacctctagcaggtagtatcttagggcttatgctttttttcctattgttacaatttaaaattgtacctgaatcatggattaatgtaggagcagactttttacttaaaacaatggttttcttctttatcccatcagtggtaggaattatggatgttgcatctaatatcacgatgaattatatattattctttattgttattataattggtacatgccttgtagcactatcatcaggttatatcgctgaaaaaatgctagaaaaaagcaatacacgtaaaggaactgatcactcatga

SEQ ID NO: 1465 - DNA, 1293 bp, Staphylococcus epidermidis
attgttacgtttgaattcaaccactttacacaaaggatgggatatcaattggataaacgtcaatttgaaattttagatatgctagtgagatttaatactgaaagtccacctggacgtaatacagatccattgcaagatgaaatcgaaacgttacttaaacaactggatttttcaatacagagagaacagttatatgacaatgatagtgtgatagtagccaccttaaaagggcacaatcctaaagcgccaaaactgatattgaatggacatgttgatgtagcttctgtagatgacgatcaatattggcagtatccaccttttaaacttaccaacaaagatgaatggttatacggtcgtggcgttagcgatatgaaaggtggtatgtcttcattattctacgtcttggagcaattacatcaagcggggcaacgtccagaaggtgatattattgttcaatcagtagtcggtgaagaagtaggtgaagcaggaactaaacgtgcatgtgaaataggacctaaaggtgacttagcccttgtcttagatacgagtgagaatcaagcacttgggcaaggtggcgtgattaccggatggattacagttaaaagtaaaaatacaatacatgatggtgcgcgtagtcaaacgatacatgctggtgggggcttgtttggtgcaagtgccattgaaaaaatgacaaaggtgattcaatcgcttaatgaacttgaaaggcattggggtgtcatgaagaagagtcctggaatgcctccaggtgcgaatacaattaacccagctgtcatagaaggtggacgtcaccctgcatttattgcagatgaatgtcgattatggattactgttcattacttaccgaacgaaagttatgaatctgtagttaatgaaatagagcgatatttaaataaggttgcagaagcagatgtatggctcagagagaatccacttgaatttgaatggggtggtacatccatgattgaggataaaggagaaattttcccaagtttcactgttccgacacatcatccaggttttaagcaattagaagaagcacatgaacatattcataataaaaagcttgaacatggtatgagtacaactgtaactgatggaggttggacagcacattttggcattcccacgatattatatgggccaggtagtttagaagaggcacatagtgtagatgagaaaataaaagcaaaggaattagctcaatatagtgatgttttatatacatttttaaaagaatggtatgaacacccacaatcctataaatcatcatag

SEQ ID NO: 1466 - DNA, 1986 bp, Staphylococcus epidermidis
atgtatgcgtttacaattattgttaggaaaaggagcgtgcatactatgaaaatacttgcaattacatcatgtccaaatggaattgctcatacatatatggctcaagaaaaattagaacaagcagcaaaagatatgggcgttgatattaaggttgaaactcaaggaggcgtcggagcagaaaatgtgctcacttctaaagaaatcaaagaagctgatggaatcatcattgctgccgatagacaggtagatttatcaaggtttaatggtaaacctctcatcaatgaaagtgtacgtgaaggtattcatagacccaaggaattaatacaacgtgtgattgaccaagatgcacaaatttaccatgatcaaaatatttcttcaaatatatctagagaccaggaagaacctcataaaagtaatattcaaatggtatatcagcatttaatgaatggtgtttccttcatggttccatttatcgtcgttggcggtttactcatagctattgccttaactcttggaggacacaccactccaaaaggattagttatcaccgaagattcattttggaaatctattgaaaatattggtagtttatcgtttaaattcatggttcccatccttgctggttatatcgcggtgagtattgctgataagcctggtcttgttccaggtatgattggtggtgccattgctgctgatggtagtttatatggaagtgaagcaggagccggtttcgttggtggtatcgtcgcaggtttcttagcgggctatattgcaaaatggattaaacagattaaagttcctaaagctatggctcctattatgcctattattattatacctattctatcttctttaatagttggtctcatttttatatttgtaataggcacaccaatttcaaatatatttggtgcattaacatcatggttaaaaggaatgcaaggtgctaacatcattattcttgctcttattattggcgcgatgattgcttttgatatgggaggtccagtaaacaaagtagcattcttattcggttctgcattaattactgaaggcaactacactgtgatgggaatggttgctgtagcagtatgtacaccaccgattggtttaggtttagctacatttgttcgtaaacaccaattcaataaagcagaacaagaaatgggtaaggcatcatttacgatgggattatttggtattactgaaggggcaatcccttttgctgcacaagatcctctaagaatcattccagccaatatgattggcgcgatgattgcttcagtaatagcggcggttggaggtgtcggtgataaagttgctcatggaggtcctattgtcgctgtactaggtggaataagtaatattttatggttctttatagctgttgtcgttggaagcttagtaaccatgttcacagtcttgttatttaagcgtcacacccctgctatagcaaaaagcaataatggaaatgatacttctgttggaactgaaaatgtattttctgatgaccaatctattaatcacagcaaacaactctcacatcatatggtgttcgataaatcactcattgaaattaccaaggaaccaatgacaagagatcaagctattgatagattacttactaagttatgccatcgtcattacattacgaatatagaagaggtaagaaccgcaatccttaaacgagaggctgagtcaacaactgctatcggaatgaacgttgcaataccacatgctaaatctcatgcagttaaacgtcctatcgtcgctgtattaaatcataaagcaggtgtagagtgggaaagtctagatgaatcaaatcctcagctcatttttcttattgcagttcccaatgataataacgatacacatttaaaactgctacaacggttatcacgaacgctcatgaaagataatacgcgtgatgagttaattcatgctcaaagtcgtgatgaaatatttaatattttaaaagagatataa

SEQ ID NO: 1467 - DNA, 1035 bp, Staphylococcus epidermidis
cagaagaagcccaagcatctatttaataacacaacgaaatcaataggtaggctagcaggaaatgatgaaagtttaaaactaaatttgcgtgacatgttttctgaggtgtttaaatctcacaccaaagatgaagcggatgatgtatttattgctggaacaaagcgtacgacgccacatattaatgaagtttcggaggagtggggaagaccttgggtgttctcgcgtgtatttttagctttaggtatcactttcctagcgttatggatattaacaaatatatttgataatgccaatgccataccaggtatgatatttattggcgcactattagttcctatttcaggattaatcttcttcttcgaatctaatgcatttaaaaatattagtatctttgatgtaatgaggatgttctttattggtggtgtattgtcactcattagtacaatgattttatatcaatttgttacatttagtactgaatcgcaatactatggaattatgactataacagatgcattcatagtaggatttgttgaagagcttggaaaagcaactgttgttattttatttattaattatttaaaaacaaataaaatactcaatggattacttatcggtgctgctgttggtgcagggttcgcggtgtttgaatcagccggttatatctttaggtttggatttaatttatttgatggagctaataatattactgaaatcactatacaaagaggttggacagctttaggcagtcacctcgtttgggcagctattgttggtgctgcggcagtaatagtgaaagaaacaaagcatttcgaatgggcgaatatcatcgataaacgttttatatttttcttttttgtagcagtgacattacacggaatatgggatacggaaataacacttttaagtagtggttatttaaaatatatcttattaattatgattgcatggctatttatatttatacttatgaaagcagggctaactcaggtgaatcagttgcgtgatgaatacaatcgtttagaggaaaggtga

SEQ ID NO: 1468 - DNA, 906 bp, Staphylococcus epidermidis
aaagaacagttaactgaagacaatgtccaatctattgaaggatttgatggactatcattgtctcaaacattaccattatcagaaacaatttataataaattaaatcaacttggaattcggcagatcgctcaacgaagtgctggatttgatggttataatttagagttagcatctaaatatggtcttattatatctaatgtgccttcctattcacctcgaagcattgctgagtttaccgtgactcaagccatcaatattgtacgtcactttaatcatattcaaagaaaaatgagattgcacgattttaggtgggaagcatcaattttatctcaatcaatcaaagatttaaaggtagcggttattggcacgggacatattggtggcattgttgcacaaatattctcagaaggatatctatgtgacgttgtagcgtatgatccttttccaagtgaacatgtgaaaccttacgttacctataaacaaagtataaatgaggcaattaaagaggcagatattgtcacaatacatatgccgtcaacacaatataacaattacctgtttaatgaaaacatgtttcaaatgtttaaaaagggtgctgtgtttgtaaattgtgctagaggatccttagtagataccaaggctttgttatctgcaatagagcaaggtcaaattaaaggtgcagcacttgatacttatgaatatgaaattggagtatatacgacagatagaagtgaagaaggtttgaatgacccacttttagaggaattaattactagagaagatattattgttacaccgcatatagcattttatactgaagaggcaatcaaacatcttatttttgatgctttagatgcaacaatggaagtattaaatactggcacgacggagttaagagtaaattaa

SEQ ID NO: 1469 - DNA, 471 bp, Staphylococcus epidermidis
tatattaagttaagtgtaattcaaaaacaaggagtttttataatggcaaattctatttactcaactacaatgatttcaaatggtggacgtgatggtcgcgtttttagtccagataatacatttgttcaaaaccttgcaacacctaaggaaatgggtggtcaaggaggcaacgatactaatcctgaacaattatttgctgctggatatagtgcatgctttaatagcgcgctatcattaatcttatctcaaaataaaataagtgatgccaacccagaagttgaaatcactattgaattacttaaagatgatactgacaatggttttaaactcggcgcagatattaaagtcacacttgaaaatatgtcccaacaagatgctgagaaatttgtggagcaagcacatcaattctgtccatactcaaaagcgacacgtggtaacattgacgttcagttagatgttacagcgcaataa

SEQ ID NO: 1470 - DNA, 213 bp, Staphylococcus epidermidis
aatgtaaagttgctcatcaccgaaggaggactatttatgtttaccatatcaatcatcgctatgattattggtgttgtgcttattgttttaagtcaaattatctatcattcaaaaccgatagatgctaaggaaaaaatgtttatacccggtgtatgcctttttttagtaggactcttaagtttaatcggtcactttgttaatggctacgtataa

SEQ ID NO: 1471 - DNA, 849 bp, Staphylococcus epidermidis
ctatgtgagttcgaaagtgagggaaaaattagcatgaatacgttggatagtaaatatgaattaaaatcaaaaaaacatcgtcagcgaataattaaaaattgggttatagtcactgtagttgcagctgtaattatatgggcgtttgcaggaattccaggtcttgaacttaaaagtaagtctattgaaatattaaagtctatcttttacggactatttcatccagatttaagttacatatatatacctgatggtgaagacttacttagaggtttgctggaaacttttgctattgcagtgattggcacgttcattgcttcaattatatgtattccttttgcatttttaggagctaaaaatatgatgaaattacgaccggttacgggcataagtaaattcatattaagcattatacgtgtgtttcctgaaattgtaatggcgttaatatttattaaagctgttggaccaggttcgttttcaggtgtacttgcactggggattcattcagtcggcatgttagggaagctttttgttgaagatattgaaagtttagattttagcgctgtagaatctttaaaggcgagtggagcaaataaaatgaagacgttaatgtttgctgtaataccacaaattttaccatcgtttatttcacttattttgtatcgatttgaattgaatttacgttcggcctccattttaggattaatcggcgcaggtggcataggtacaccattaatttttgctttacaaacacgatcttgggaccgagttggcatgattctaattggtttgattgcgatggtcgctttagttgatttaatatctggcgcggttcgtaaacgtatcgtttag

SEQ ID NO: 1472 - DNA, 1449 bp, Staphylococcus epidermidis
aaggcatatacgttttcaatccctccttctaaaggagaaatgaatatgaatgacacaggagataaaagattaagtcgaacatcattaatcggtcttgttataggttcgatgattggtggcggtgctttcaatattcaatctgatatgggaggccacgctggaggattagcaattataattggatggttgattactgctataggaatgatttcattagcacttgtctttcaaaacctaactaatgaacgatctgatttagatggtggtatttatagttatgctcaagcaggttttggtgattttatagggtttgcaagtgcttggggatattggttctcagcttttttaggtaatgtcgcatatgcaacgttattaatgtcttctatagggaacttctttccaatatttaaagggggcaacacatttcctagtatcatagtggcatcaatattattgtggagtgtgcactttttaatattaaaaggagttgagacggctgctttaatcaatagtattgtcactattacaaaattaattcctatcttattagtgattatatgtatgattgtagcctttaattttaatacattcaggataggtttctttggaatggatggatatggatcattatcatttcatttcgctaatacgatgtcacaagttaaaagtacgatgttagtgacagtttgggtatttattggtattgaaggtgctgttgtattctccggaagagctaaaaataaaaaagatgttggaactgccactgttatcggacttatttcagtattgctcatttacttcttgctgactgtattagcacaaggtattgtgattcaaaatcatatttctaaacttgaggcaccatcaatggcacaaattttagcttatatagttggtgattggggagcaacatttgtcaatattggtcttattatttcagtattaggtgcatggctaggttggacattactcgccggagagttgccttttattgtagctaaagatggtttgtttcctaagtggtttgcaaaagaaaataaaaatggggcacctatgaacgccttattcattactaatgtattagttcaaatattccttattagtatgctgtttaccaaaagtgcttatcattttgcattttctctcgcggcaagtgctatactttatccatacatgttcagtgcgttttatcaggtgaaatatacaatagaatacaagttaactgcaacgcctaaacaatggattataggaattctagcatctatttatgcaatttggctggtttacgcgtcaggtatagattatttgttacttaccatgttgctctatatcccggggattatcgtctatgttgttgttcaaaaaaataatcaaaagcgacttacacaatttgactatattttcttcggtcttatcgttattttagcattgatagggttattacgatga

SEQ ID NO: 1473 - DNA, 2385 bp, Staphylococcus epidermidis
atggcgaatacaacgttgactttggatattattggtatgacatgtgctgcgtgctcaaatcgtattgaaaagaaattgaatcgtatgaatcatgttcaagctaaagtgaatctgactactgaaaaagcaactatcgactatgagtctgacgattatcatctcgaagattttgtagagcaaattcaaagtctcggctatgatgttgcagttgagcaagtagaattaaatataaatggtatgacatgtgctgcatgttctaatcgtatagaaaaggttctaaatcaaacgcaaggtgtacaacaggcaacagtaaacttaactaccgaacaagcactcatcaaatattaccctagtgctacgaacacggaagcattaattaagcgtattcaaaatattggatacgatgctgaaactaaaacttcatcaaaagcgcaatcaaatcgtaaaaaacaagagttaaaacataaacgcaataaattaatcatttcagctattttatcgttgccactattattagtaatggtggtgcatatctcaccaatttccattccatccattttggtcaatccttgggtacaattaattctttcaacacctgtccaatttattattgggtggcaattttacgttggcgcgtataaaaatttgcgaaatggttcagctaacatggatgtattggttgctgttggtaccagtgccgcatatttttatagcatttatgaaatgatgatgtggctcacacatcaaacacatcacccgcatttatattttgaaacaagtgctattttaattacgttaattcttcttggtaaatatttagaagcacgtgccaaatcacagactaccaatgcattaagcgaattgttaaatttacaagcgaaagaagcacgagtaattaaagaaaataaagaaattatgcttccacttgataaagttaaagtcggagatactttactaataaaacccggcgaaaagatacctgtagatggcaaagtcactaaaggtgatacttctattgacgaatccatgctaactggtgagtctatacctgttgaaaaaagtagtggcgattcagtgattggttctaccatgaataaaaatggttcaatcatgattgaagcaactcaagtaggtggtgatactgcattatcacatataattaaagtggttgaggatgctcaaagttctaaagcaccgattcaacgcttagctgatattatttctggatattttgttccgattgtagttagcattgcggttattacttttatcatatggattatattcgttcaccccgggcaatttgaacctgcacttgtttcagcaatatctgttttagttattgcttgtccctgtgcacttggtttagcaacgcctacatctattatggtaggtacaggacgtgctgcagaaaatggcatattattcaaaggaggccaatttgtagaacgtgcacattatgttgatacaatcgtgctagataaaacaggcacaattactaatggtcaacctgtagtaactgattatgttggtgacaatgatacattacaacttttagcaagtgctgaaaatgcttcagaacatcctcttgctgatgctattgttacttatgctaaagataaaggtcttaatttacttgataatgacacttttaaatcaattccgggacatggtattaaagctacgattcatcaacaacaaatccttgtgggcaatcgaaaattaatgaacgattacaatatatctattagtaataaattaaatgaccaattaaatcactatgaacatttaagtcaaacggcaatgatgattgccgtggataatcaaattaatggaatcattgctgttgctgatacagtaaaaaatgatgctaaacaagcgataaaagaactaagaaatatgaatatcgacgtggttatgctgactggtgataacaatcgaacagctcaaaccatcgccaaacaagttggcattgaacatgtaattgcagaagtgttgcccgaagaaaaggcacatcaaatctctttattacaagacaaaggtaaacaggttgccatggtcggtgatggaattaatgatgcgcctgcacttgtaaaagccgatattggaatggctataggcactggagctgaggtagcgattgaagctgcagatattacgattcttggtggtgacttgctattagttccaaaagctatcaaagcaagtaaagctacgattaaaaatattcgacaaaatttattttgggcatttggatataacgtagctggcatcccaatagctgcttgtggtttattagcaccttggattgccggtgctgctatggcattaagttctgttagcgtagttatgaatgcattaagactgaaaaaaatgaaactatag

SEQ ID NO: 1474 - DNA, 210 bp, Staphylococcus epidermidis
actaaattaacgaggtgccttatgtataaagattataatgtgactcaacttacgctaccaatgaaaacttcattttttatccccgcaaatgatatttcacgacatgcaaatgatattgtagaaacaattcccgagactgaattcgatgaattaagacatcatcggggtgcaacatcataccattcaaaaatgattttaaaagaactatga

SEQ ID NO: 1475 - DNA, 297 bp, Staphylococcus epidermidis
aagtggataacacccatactatttatagatattgttatttttacaccaatcattgaagaacttttatttcgtcatttaatcattcatgaactaggtaaaaaattaacttatggtttgatgtatattgtgtcaatagtgggatttacatattttcattgtactgatgcagtttcaccatttgaagcaggaccttactttattgcagcagtcgtatttgttataggttaccattttagccaccgtaatttagcagtacccattgctttgcatatgattacaaatttaatagcattttaa

SEQ ID NO: 1476 - DNA, 225 bp, Staphylococcus epidermidis
aatttctcaactccatttacatatatctatgtgtatgttagaaataattatgtaagcgtatcacaaacaacaacaagggaggattatattatgtcaggtatcgttgaatcattacataacgctgtaaacgctggtttacacgtaaaacaagattgggtagacatgggattcggtattgcagatacagttgcaaaaatcgttgaccaagttttaaaatttgtttaa

SEQ ID NO: 1477 - DNA, 2421 bp, Staphylococcus epidermidis
acacatcaaactatcacaggagtgatacgaatggctaaaggtgttaaccaaattattaataatattaggttaagaaaattgcgcaaaatattaaatcaaattaatgcgcttagtgaggagttctcaaattttagtgatgaagcacttcaagcgaagacaaaagaatttaaagtttatttaaatgataataaagcttcactcaatcacattctgccacaagcttatgcaacagttagagaggcttctaagcgcgttttaggtatgtatccaaaagatgtgcagattttaggagcaatcgctatgcatcaggggaatattgcagaaatgcaaacaggagaaggtaagacgcttacagctaccatgcttctgtacttaaatgcacttacaggtaagggtgcttatctaatcacaacaaatgattacttagcaaaacgcgattttttagaaatgaaaccactatatgaatggctaggcttgtctgtatcattaggatttgtggacattccagaatatgaatacgctgaaaatgaaaaatatgaactgtaccaccatgacattgtttacacgactaatgggcgactagggtttgattatttaattgataatttagctgatgatattcgtgccaaatttttaccgaaattaaactttgctattattgatgaagtcgattctattatattagacgctgcccaaacgcctttagttatttctggtgcaccacgtgtacaatctaatttatttcacatcgttaaaacgtttgttgaaacacttgagaaagataaagacttcatagttaattttaataaaaaagaagtgtggctcactgatgagggctcggaaaaagcaagccattatttcaaagtgaatagtatataccaacagcaatattttgatttagttaggatgattcatttatcgcttagagctaagtatttattcaaatataatttagactattttatttttgatggtgagattgtgcttatagatagaataactggtcgtatgctacctggaacaaagcttcagtctggtttacatcaagctatagaggctctggaaaatgttgaaatttctcaagatatgagtgtgatggcaaccataacattccaaaacttatttaagcaatttgatgaattttcaggtatgactggaacaggtaaattaggggaaaaagaattctttgatttatattcaaaagttgttatagagattccgactcacagtccgattgaacgagatgatagacctgatagagtatttgctaatggtgacaaaaagaacgatgcaattttaaagacagtgattggtatacatgaaactcaacaacctgtgttactaattacacgtactgcagaagcggcagaatatttttcagctgagttatttaaacgtgatatacccaacaatttattaatcgctcaaaatgtagctaaagaggcacaaatgattgctgaggcgggacaattatctgcagttactgttgctacaagtatggcagggcgtggaactgatataaagttatcaaaagaggttcatgatatcggtggcttagcagtgattattaatgaacatatggataatagccgtgttgatcgtcaattaagaggacgctcaggtcgccaaggagatcctggatattcacagatttttgtatcacttgatgatgatttagtaaaacgttggagtaactctaacttggcagaaaataaaaacctccaaacgatggatgcatctaaactagaaagtagtgcactctttaaaaaacgtgtaaagtcaattgttaataaagcgcaacgtgtatctgaagagactgctatgaaaaatagagaaatggcaaatgaattcgaaaaaagtattagtgttcaacgagataaaatttatgctgaacgtaatcacatacttgaagcaagcgattttgatgattttaattttgaacagcttgcacgagatgtgtttacaaaagacgttaaaaatcttgacttaagtagtgaacgtgcacttgtgaattatatatacgaaaacttaagttttgtcttcgatgaagatgtatcaaatattaatatgcaaaatgatgaagaaatcatacaattcttaatacaacaatttactcaacaatttaacaatcgtttagaagttgctgctgattcatatttaaaacttcgtttcattcaaaaatcaattttgaaagcgatagatagcgaatggattgaacaagtagataacttacaacaacttaaagccagtgtaaacaatcgacaaaatggacagcgtaatgtcatttttgaatatcataaagtggctcttgaaacgtatgaatatatgtctgaagatataaaaaggaagatggttagaaatttatgtttaagtattctagcctttgataaggacggagatatggtcattcatttcccataa

SEQ ID NO: 1478 - DNA, 1575 bp, Staphylococcus epidermidis
aacatcaaaacacattctaggggggagtgcatgtctaaaattttactaactggtgcatcaggttatattggtaaccatctcaagaataaattaaaaaaagatcatgaagtgatagctatatccagaaatactcataataaaacggatgaagaaaatgtcacgtggaagtcagcagacttatttgatttggacgaagttacaaaagtaatgaaagatgtagatacagcgatatatttagtacactctatgatgccatcagcaaaattaacgcaggctagctttgaagatatggatgcattgttagcagataattttgcgcgtgcggctcaaaagcagggtgttaagcatattgtctacatgagtggtttaataccagaaaatgatgagctatctgcacatttaagaagtcgacttgaatgtgaaaaaattcttggtgattacggtataccagttagcacattacgtgcaggtttaattattggtgcaaaaggtagttcttatccaattcttaaacgactagttgagagattgccagcaatggttttgcctagttgggcttacaataaaattgcacctgttgccattgacgatgtgatagatggtttagcagcattggtgaatcgaacacccaaagataacgaagcaattgatatcacaggtcctgaagtgatgaattataaaacgctgatacagcgcacagctaacgtacttgataagcgactgcctatgcttgatttacctattatacccattatcgtaagtcgatattgggtacaactgatttcaaatgtaccgaaagaaatggtatatccattaatgaatagtttaactcacgatatggtaccacatcgaaaacgcgttgtgtctaacttgtccgtaggaaatatcacctttgaagatagtgtgaaaagagcactaagagaagaacaaaagacttctaagaaaaagtcagattcgaaaaattctcaatcatttgggcttatgcatcaagaaattaaagatgtacgagccattacacggtttaaaattccggaaggttattcgattaaagatgtgactaaagaatatgcaaaattcatcaataatatcacactacatatcgttaaaggtacgataaatgaacgagaatttaatatgaatttgcccttcattaataaatttattttaaaaatggaacgtgatgaagctgactctacagaagatatggtggtatataatattgtgggtggcgatttagcacattcaaatgatggtggaaatgcacgctttgaattccgaagaataagaaacaccaatgagggtattattgctttacaagaatatgaacctacattaccttgggtagtatataaactaactcaagctaaagcacacaagactgttatgaatatttttaaaaacaaaatggcacgtttagcgcaacaaaaaaatgtaaaagatgaaacatatatgtctaatcgtgtaactattggagtaacagtagcatcagcgttcgttattggaagcgcagtagggttccaactttttaaaaagcatcaaatcaaaaagaacacaatgtcgaatgcagaattataa

SEQ ID NO: 1479 - DNA, 1170 bp, Staphylococcus epidermidis
aaaatgaaaacagtatctaaatattttgtatatatgatgatattagttacgtttttcatagttgttagtgggtgttcgattaatcaatcttttagcgataaacaaaatacaaataaaacaatacgtgtggttgctgtaggtgataatttaattcacccagttgtatataaagatgcacaaattacggggaatagttttgattttaaacctatgtatcaaccagtaaaaaaagacattcaaaacgcagatatttcttttgttaatcaagaatcaccattaggtggggatgataggccttattcaggatttaaaaactttaatacaccgagtagtattgctcaggatttagtagatactggctttaattttgtaaacggtgcaaacaatcatgccttagatcaaggagagcaaggtgtaagaaatcatattcatacttggaacaaatttaaatatcaagttttgttcacgggtgtatatgaatcagaacaagcacaccgtcaaattcctattaaaacaattaaaggtgtgaaagttgctttattaagttacacatttggtacaaacgatcatcaaccaactcatgattatacggtagatacgtttgatgaaaataaaattaagcaagatgttaagaaagccaaacaacaaagtgatgtagtacttgtttcagcacattggggtaatgaaggtaagcatcagcctaacgccactcaaaaaaaatatgcacaaattttcgctgatgcaggtgttgatgtagttttaggtacacatcctcatgtgattcaaccagtaaaatgggttgacggtagagaagggaatcgtacactcgtagcatattcattagggaatttcttgaacggtcagtcaacagggaatgaaagtaatgatttattaggacggatagattttaaaattagtaagaaagataaacagtttcaagttcaagatgtgaagtggagaagtatggtgaattattacgaattaactcaacaccaaaaccagttccttaagtcgaactttaaagtgatgatgctagatgactataatgacaaagatgccactcatcatggtcgcaatcaaatggatagttcttcgatgagccctgcacacttacgagatatcacacgttcagttattgataaacaatatttagacaatcggagtttatag

SEQ ID NO: 1480 - DNA, 726 bp, Staphylococcus epidermidis
gttgatagaacgattaacgataggagtggatataaaatgaattattcaccaaaacaaggtgttaaaagtcatggattgccacatgatccgttcaaaagtagcacagtacctagacctataggttggatttctacagtatctaaagaaggtaaagataacttggcgccgtacagtcaatatcaaaatcttacatgggatcccccaatggtaatgtttgcggctaatcagtcagtgcttggcgatcatgaaagaaaagatacagttaaaaatgcggaagaaactggttggtttgtatggaatatggcaacatatgatttgcgtgaagcagtgaatttatcatccaaagcattacctccagaagatgatgaatttgactttgctggtgtgacgaaagaatcgtgtatcgaagctcctggaagtagggtaaaggaatcacctgttcattttgaatgtgaatatgttcaaacagtaagaattcccactggagaccctgtttcaactgtggatgtagtcatcggtcgtgtagcacaagtgcatattgacgataaagtaattatggacaacggaaaattagacattaagtcaatcagacctatagcacgtctcggttattatgattacacggttgtcgatgaaatatttgaaatgaaagcacctgcagcttcgaaagaagaattggctggacttgaaggtcgaaattttgacaacactaataatgaatcatga

SEQ ID NO: 1481 - DNA, 2031 bp, Staphylococcus epidermidis
atgaagagaacagataaaattggtgtctacctcaagctgtcatgttctgcgttgttacttagtggttcgctggttggttatggcttcacaaaagatgcttttgcagattcagaaagtacatcatcaaatgttgaaaatacttctaatagtaactccatcgctgacaaaatccaacaagctaaagatgatattaaagatttgaaagaactttctgacgcagatatcaaaagttttgaagaacgtttagataaagtcgataatcaatcaagtattgaccgtattataaatgatgcaaaagataaaaataatcatttaaaatcgacagactctagtgccacatcatcaaaaactgaagatgacgatacatctgaaaaagataatgatgatatgactaaagacttagataaaatactgtcggatttagattcaattgctaaaaatgttgataaccgtcaacaaggtgaaaatagtgcttctaaacctagtgactcaacaaccgatgaaaaagatgattcaaataataaagtacacgatacaaatgctagtacacgcaatgcaactactgatgattctgaagagtcggttattgataaattagataaaatccaacaagattttaagtctgactctaataataagctttctgaacaaagcgatcagcaagcatcaccatctaataaaaacgaaaataacaaagaagaatctagtacgacaacaaatcaatccgatagtgatagtaaagacgataaaagtaatgatggtcgtcgctcaacattagaacgtatagcatcagatactgatcaaattagggattcaaaagatcaacatgtcacagatgaaaaacaagatatacaagcaattacacgttcactacaaggtagtgataagattgaaaaagcacttgctaaggtacaatctgacaatcaaccactagattctaattatataaataataaattaatgaatttaagatcactagatacaaaagtagaggataataacactttatctgatgataagaaacaagcgcttaaacaagaaattgataaaactaagcaaagtattgaccgacaaagaaatattattatagatcaactcaatggtgctagtaataaaaaacaagcaaccgaagatatcttaaatagtgttttcagcaaaaatgaagtagaagacataatgaaacgtattaaaacaaatggccgaagtaatgaagatatcgctaatcaaattgccaagcaaattgatggtcttgcattaacttctagtgatgatattttaaaatcaatgttagatcaatctaaagataaagaaagtttaattaaacaattgttgacgacacgacttggtaatgatgaagcagatcgtattgctaaaaaattgttaagccaaaacttgtcgaattctcaaatcgtagaacaattaaaacgtcatttcaatagtcaaggaacagctacagctgatgatatattgaatggtgtgattaatgatgctaaagacaaaagacaagcgattgaaacaatattacaaacccgtatcaataaagacaaagctaaaattatcgccgatgttattgcgcgtgtacaaaaggacaaatcagatatcatggatctcattcactctgcgattgaaggcaaggcaaatgatttattagatatagaaaaacgagcaaaacaagctaagaaagatttagaatatattttagatcctataaagaatagaccatccttgttagatcgtattaacaaaggtgtcggtgattctaattcaatatttgatagaccaagtttacttgataaacttcactcaagaggatctattcttgataaattagatcattcggcaccggagaatggattatctttagataataaaggtggccttttaagtgatttatttgacgacgatggtaatatctcattaccagcgacaggtgaagtcatcaaacaacattggataccagtggctgttgtactcatgtcattaggtggagcgctcatctttatggcgcgtagaaaaaaacaccaaaattaa

SEQ ID NO: 1482 - DNA, 606 bp, Staphylococcus epidermidis
aatggaggaacaagaatgatacaacgtaaaggtgaattaatactttcatggattggcaatggattacatctgttgtatgtatttttagtaggcatatttttcataatgacacaaacaagtgaatttaaaaatgggatgattcaaggatttatagaagaaaatccgggggaatatgatttagcataccaaacttataatttgatgttaggtttaggtgttgttttcattattatacttctcattttattaattgtatcaatagttgccgctattttaattggcaaaaatgcaaaagtatcaggaatattacttgttattacaggaatcattggtctctttttaagttttattgctggtgccttatggttaatagcaggtatcatgcttttagtacgtaaaccacaaacacaaaatgaccaaatcaattctcaatatagtaatgacatacattcacatgttgtgccagaagaaaagaaacgtgaacaacaacaatataatatgaatgaaccacatattggtcaatcatcaacatctcatcatgatcacgcattgaatgatcaaaataaacgagaaaatcataatcatgataatcaaccatacaaatag

SEQ ID NO: 1483 - DNA, 1203 bp, Staphylococcus epidermidis
aaaggaggaacaacgacgatgctaacagtcggaattataccttcgccaggtatagcgcatcaacatgtaaaaaaaataattccaaatgttaaacagttattgtcaaagcggactaaacatagtcaatggaatttcgacatcaaagtcgatctcatgataggatctgcagaagatgtacatgaaagtgttgaaaaagcagcacaaattaaagaggaacatcagtgggattacgttgtttgcctgacagatttgcctagtatttcagataataaagtggttgtcagcgactttaatagtgacaaacatgttgcaatgctatcattaccgtcactaggttttattgatttgaaacgcaagctagttaaaacgatgacttcattgattgaacaattatattataatcaaccgaaagacaaaaatgcgccacatccttttgtacgcgtgaaggctgtagaacctgacgaagacgccacatcaaagcaacgatatattaatattttatttatcataagttggattcagttaattggtggactgacacgagcaaatcagccttggaaaaacatctttaattttaagaaaatcatttcagttgcctttgcaacaggaacttatgtctccatattttcaatgccatgggaattaagcgtgatttattcgccgcttcgacttatcatattgatggtgattgctatacttgggatggccggatggctattctatgcgcatcaattgattgaaaagaaaactgctaaatctcagcgagtatatcgatatatttataattcaaccacacttgttacattaagtttgattaccctcataaattatgtcattttatatttattgttaatcatcagtattacactctttgtccctgtggaattatttaatagttggacgagtgcccaatcacaatttacattctcaaattatatgagattgatttggtttgtatcatcattagggcttttagctggagctatgggatcaacagttgaaaatgaagagaaaatacgtcgtattacttattcttatagacaatatcatcgttataaagaagctgagcaagaacaaaaagaacaagaaacttctcgtgatgtatcacaacaaaatgtcgaacaacaaacttcaagtaaagatgaaaataatgaacaatatgaaggtaaaaaacaaggacatagagaggaggatgacgcatga

SEQ ID NO: 1484 - DNA, 867 bp, Staphylococcus epidermidis
agcaacatgactaaagttattacaacaatcaatgaaatgcaatctattgttaaacaacatcaacgtgaaggtaaaacaataggattcgttccgactatgggagctttacatgatggtcatttaaccatgatgaagcaatctgtaagcgaaaatgatctcacggttattagtatatttgtgaatcccttgcagtttggacctaatgaggattttgatgcttatccacgtcaactcgatgatgatgtggctgcagtaaaaaagttacaagtggattatgttttccatccgagtgtagatgaaatgtatccagaagaattaggtattcatctgaaagttggacacttggcacaagtattagagggagcacaaagacctggacacttcgaaggtgttgtgaccgtggtcaacaaactatttaatattgtgcaaccagattatgcctattttgggaaaaaggatgcacaacaattagctattgttgaaaagatggttaaagactttaatcttcctgtacatgttatcggtattgatatcgtaagagaaaaagatggtttagccaaaagctctagaaatatttacttgacctctgaagaacgaaaagaggcaaaacatttatatcaaagtctacgcttagcaaagaatttgtatgaagcgggtgaacgagatagcaatgagattataggtcaaatcgctgcgtatttaaacaaaaatattagtggacatattgatgatttgggtatttatagttatccaaatcttatacaacaatcaaagattcatggacgaatattcatatcattggcagttaaattttctaaagcaagattgatagataatataattattggagatgactatattgattag

SEQ ID NO: 1485 - DNA, 1971 bp, Staphylococcus epidermidis
ctatgcatgacccatattacagaaagtgaaatgaaacaaaaatatctagatttactctcacaaaaatttgacagtgcagaaaaacttgctactgaaattattaacttagagtcaatcttagaattacctaaagggactgaacattttgttagtgaccttcatggtgaatacgaatctttccaacatgttttaagaaacggatctggaaatgtgcgtgctaaaattaatgatatcttcaaagataaattatcccagcaagaaatcaacgacttagcagcattagtatactatccggaagaaaaactaaaattagttaaaaataatttcgattcaatcggaacattaaatatttggtatattacaaccattcaacgattaattgatttaattacatattgctcatcaaaatatacacgttcaaaattacgcaaagcattacctgaacaatacgtttatattattgaagagctactttacaagagcaatgaatttcataataaaaagccttattatgaaacattagttaaccaaattattgaattagaacaatcagatgatttgatcattggcctttcctatactgtacaacgtctagtcgtagaccatcttcatgtcgtgggcgatatctatgaccgtggtcctaaacctgataaaattatggatacattaataaattatcattctgtagatatccaatggggaaatcatgatgtattatggattggcgcctatgctggttcaaaagtatgtcttgctaacctactacgaatctgtgcacgttatgataatttagatattatcgaagatgcatatggcatcaatctacgtcctttacttacgcttgctgaaaagtattacgatgctgaaaacccagcgtttaaacctaagaaacgaccagataaagacgtcagtcttacaaaacgcgaagaaagtcaaatcacaaaaattcatcaagcaattgcgatgattcaatttaaacttgaaatgcctattattaagcgccgtccttcttttgagatggaagaacgtttagttttagaaaaaatagattatgataataatgaaatcactatatataataaaacatatccgcttaaagatacttgtttccaaactgtaaaccctaacaatcccgctgagttactagcagaggaaaaagaagttatggataagctattactttcattccaacaatctgaaaaattaagacgtcatatgtctttccttatgcgaaaaggaaaattatatcttccatataatggcaaccttttaattcacggttgtattcccgtcgatgaaaatggagaaatggaatcatttgaaattgaaggtgaacgtttaagtggtcgtgaactactcgatgtttttgaatatcatgtaagaagagcttttgaccataaagaatctaccgaagacatttctacagatttagtatggtatctttggacaggtaaatattcatctttatttggtaaacgtgccatgacaacgtttgaacgttattttatagaagataaagcatctcataaagaggagaaaaatccttattattacttacgtgaagatgttgatatgatacgtaaaatgttaaaggattttggtcttaatccagatgaaggacgtatcataaatggtcatacgcctgttaaagaaattgatggtgaagatccaattaaagctaatggtaaaatgttagtcatagatggaggattttcaaaagcttatcaatcaacaactggtattgccggatacacacttttatataattcatttggtatgcaattggttgcacataaagagttcaatagaaaagaaaaagtgttatcaatgggggcagatgaattgtcagtgaaacgcgttgtagatgaagaattgcaacgtaaaaaaattagagataccaatatcggtaagcaactgcaagaccaaattgatatcctcaaaattttaatgcacgaccgatatttaacataa

SEQ ID NO: 1486 - DNA, 999 bp, Staphylococcus epidermidis
tttttaatgacaaaaattatgtttttcggcacaagagcatatgagaaggacatggcattacgttggggaaagaaaaataatatcgatgtcactacatcaacagaacttttaagtgtagatactgtcgatcaattaaaagattatgacggtgttacaacaatgcagttcggtaaattagaacctgaagtttaccctaaattagagtcctatggtattaaacaaattgcacaacgtacggctggatttgatatgtatgacttagaacttgcaaaaaaacatgaaattattatctcgaatatacctagttattcacctgaaacaattgctgaatattcggtatctatcgctctgcaactcgtacgaaaattcccaacaattgaaaaacgtgtgcaagcacataatttcacatgggcgtcccctattatgtctcgtccagtaaaaaatatgactgtagcaatcatcggtacagggcgtattggtgctgcaactggtaaaatctatgctggttttggtgcgagagtagttggttatgatgcatatcctaatcattctttatctttcttagaatataaagaaacagtagaggatgcaattaaagatgctgatattatctcattacatgtacccgctaataaagatagtttccatttatttgataacaatatgtttaaaaatgttaaaaaaggtgccgttttagtcaatgccgcaagaggagctgtgataaacacgcctgatttaattgaagcagtaaataatggtacattatcaggtgctgccattgacacatatgaaaatgaagctaattatttcacatttgattgttcaaatcaaacgattgacgacccaatattattagacctaattagaaatgaaaatattttagttacacctcatattgcctttttctccgatgaagcagtacaaaatttagtagagggtggtttgaatgcagcattatcagtaattaatactggcacatgtgatacgcgattaaactaa

SEQ ID NO: 1487 - DNA, 213 bp, Staphylococcus epidermidis
gcctcaatgacatatatttctttatcacaaaagattcggaacgcaaatattctaaattatcagaaaatatttacaaatttgaaaattattagtatattgattactatcctattaatattgatttattttaaaacgatagcagttgatagttttatagcttcatatgtagatagctatattaaaaagagtcactattgggagggaactcaatga

SEQ ID NO: 1488 - DNA, 1062 bp, Staphylococcus epidermidis
cttatgtcgacgataaaaaatatcgatggaccaaaggattttgtttttagagtgttatcaggggtagcaattggaatagtagccggactcgttccaaatgcaattttgggagaaatttttaaatactttatgcaatatcatcctattttcaaaactttattaggggtcgttcaagccatccaatttacagtgccagcgcttattggagcattgatagctatgaagttcaatatgacacctttagcaatagctgtagtagcaagtgcctcatatgttggtagtggtgcagctcaatttaaacaaggtacatgggtaattgcgggaattggggatttaattaatacgatgttaactgcatccatcgccgtgttacttattttattaataaaaaaacgtgttggtagtatggctttaattgtttttccgacagttgttggtggtttagcagctacaatcggcgtatttactttaccatatgtaaggttaattacaacgggaattggtaacatggttaatagctttactgaattacaaccagtgtttatgagtatgttaatctctatggtgtttagttttataatcatatcaccattgtcaactgtagccatagctattgctattggattatcaggtattgctgcgggatctgcttcaataggtatagcagcgacagaagctgtattattgattggtaccagcaaagttaatcatgtaggtattcctttatcaatatttttcggtggggtgaaaatgatgatgccaaatatggttaaataccctgtcattatgattccgattttcttgacagcggcaatatctggtattgcttcagggattattggtatttcaggaacaaaagaatcagcaggatttggttttatcggaatggttgggcctattaatgcctttaaatttatgcatgttgattctgcatggttaagtttattacttattgtcatcgccttttttgttgtgccgtttctagttgcatggattttagatttaatacttagaagattaattcatttgtatgagaatgatatttttaaatttatgggataa

SEQ ID NO: 1489 - DNA, 198 bp, Staphylococcus epidermidis
cctggaacgactaaccctgctggattaatcccaaatttctcagcaaatatcaaactgagtacgacacctacgaataaggagaaatataattctgaacctatcattttattctatcccttctatgaattccgctattctaccacccgggccgtggatgtttcctacacaaaatacaagtgcattctcagcttcatgtag

SEQ ID NO: 1490 - DNA, 483 bp, Staphylococcus epidermidis
gagaaggcgactactatgaaaaaagtcatatcgcttttagtagtattagttataagtgctgtatctctttcggcatgtgggaaagaacgcacaaaaacttatgaaggcgaagtcaacggaaagcaagtgattacatctttgacatacaaagatgatgaagttctcaaacaatctactatagcaacaattaaatatgatgatttaggcatcgataaagatgaagctaaacaaatgtttaaaaatgatgaacaagcattcaaagggatagacggggttacatataaagctgattttaaagatcgaaaagccatcgaacatatcgatattgattataaagatgcggatatagatcagcttaagaaaaatttaggtttcatatcatcagatgccaaaaaaggtgaccatgtgagtgtggatagggttgttaaacaactcaaacgtaatggtttaaaagataaaagtaaaatgaatgaagataattaa

SEQ ID NO: 1491 - DNA, 993 bp, Staphylococcus epidermidis
cacagttatttgtgtaactttattatgaaggagttcgttaaaatgaaaaaatttgggaaaaaagttgttttagtaggagacggttccgtaggttcaagttatgcatttgctatggtgactcaaggaattgcagatgaatttgtaattattgatattgcaaaagataaagtggaagcagacgttaaagatttaaaccatggtgcactttacagttcttcaccagtgactgtaaaagctggagaatatgaagattgtaaagatgcagatttagttgttattacagcaggtgcacctcaaaaaccgggtgaaactcgtttacaacttgttgagaaaaatactaaaatcatgaaaagtatcgtaactagtgtcatggatagtggctttgatggtttcttcctaattgctgcaaacccagttgatatcttaacacgttatgttaaagaagttacaggtttaccagctgaacgtgttattggttctggtacagtgcttgatagtgcaagattcagatatttaataagtaaagaattaggtgttacatcaagtagtgttcacgctagcattataggtgaacatggtgactctgaacttgcagtttggtctcaagcaaacgttggaggtatttcagtgtatgatacattgaaagaagaaactggtagcgatgctaaagcgaatgaaatttatattaatacaagagatgctgcttacgatatcattcaagctaaaggatctacgtattatggtatagctctagcactattacgtatttctaaagctttactaaataatgaaaatagtattttgacagtttctagtcaacttaatggtcaatatggatttaacgatgtttatcttggcttaccaacacttatcaatcaaaatggtgcagttaaaatttatgaaacaccattaaatgataacgaactacaattactagaaaaatcagtgaaaactttagaagacacttatgattctataaaacatttagtttaa

SEQ ID NO: 1492 - DNA, 579 bp, Staphylococcus epidermidis
aatggaggtgcaatgatggattataataacaatgacagtcaatatatcgaagaagctaaagatttagttatcaactcaatcggtgaaaccatggatttgtatggtatcaaccgtagtgtaggtaacttgtatggcattatggtttttgaaggaagtatgacacttgatgaaatgcgacaacaactgcaaatgagtaaacctagtatgagtacaggtgtaaaaaaactacaagaatacgatatcgtcaaacaacaattcacgcgtggtagccgaaagcaacattttattgcagagaaagatttcttcactttcttccgcaacttttttactaaaaaatgggaacgtgaaattgacactaatatggaagcaattgaagatgcagaaaatatcattcacccacttcttgaaaagaatgatatagatgaggaagttaaaaaacaagcaataaatgtaaaagcgcagttagaccactctaaaatatattacaagtggctcgctcaattaagtgaagctctagagtcaggagaaatttttaactatttcccaattccagatgaacaacatcatcatgatcaataa

SEQ ID NO: 1493 - DNA, 441 bp, Staphylococcus epidermidis
ttttatttggctggagctatttcagacaagattttgaatacaggtcaatcacgttttgttgcacgtggcgtaattgcgattgcgggatttgtggtattctcaatttcaattttcttagcagtacatacagacaacttatatgtaaccattttctggttatcactttgtttaggtggcgtacgtatttctatgggaatgagttgggctgcagccactgacttaggtcgtaatttctctggaactgtgtcaggttggatgaacttatggggaaatgttggcgcacttattagtcctttacttgcaggaattgttgtagatcatttaggatggtcaatgacattacaactcttaatcgttccggctattatagcagcaattctatggttcttcgttaaaccagacaaacctcttattgttagtgaagaacacgttaataaataa

SEQ ID NO: 1494 - DNA, 288 bp, Staphylococcus epidermidis
acgtcgatggctgcagaaattaaacaaggcgatcataaattctatgtaggtaatgacgaaaataacccaaaagctgttattacatttaaagaggttgataacaatgaaatagacattgatcatactggagtttctgatgaactcggtggacaaggtctaggtaaaaaattagttaatcgtgttgttgaacatgcacgagaaaacaatctaaaaattatcgcttcttgtccattcgcaaaaaacgtattagaaaaagatgatcatgcacaagatgtttatctaggatag

SEQ ID NO: 1495 - DNA, 864 bp, Staphylococcus epidermidis
atgaaggaggccaaaatgaagaagcaacagaataaagtccatatgattaatatatctttatgccttatagggacattacttattgcaatcgcagtaaatagttttgttataccgggcaatttaggtgagggtggttctataggcctttcattaattctgaattatactctaggtatttcacccgcactcagttccttcatcattaacgcaatattaattattgtaggttggaaatttctcagtagaacgacagcgatttacactgctataacaatcaccgcaagttcaatttttcttgatttaactcacacattcggattaggtattcatgataattttattaattcaatttttgcaggtttaatgttgggaatcggttctgggttagtaattactgctcatagtacattgggtggtacatctgtcattgcacgtatcatttcaaaatatagtgagatgaagacgtcacaagcactacttatattagatgcaatcatcgtgttatcatttatcgttgttttacctataacgaatgtattatatactattgtgatgctatttattgttgaaaaatcaatgtcttttgttgttgaaggatttaatcctaaaaaagctgtgacagttatttcaaaatataataaagaaatcagtgctgatatatatgaaatgactggaagaggggcaaccttattaagtggtaaaggtgcttaccaaaaaagtgatacagaagttctatatgccgtggtatcccaaaatcaagttggagcaataaaaaagattgttaatcaatatgatgaaaatgcctttttagtgattcatgatgtgcgtgatgtcttaggtaatggatttattaatattaaataa

SEQ ID NO: 1496 - DNA, 546 bp, Staphylococcus epidermidis
tatacacatttaaggagttggagaaatatgtatcaatcaatgtatgactcgcccgttggcttattgcaattaattacaaacgatggcatctcgttgtcacatgtcttataccctaatcaacatttgaaaggaattaaaacaaatgatacgttagatgtttttaaagatactaaagcgtggttaagagagtattttaaagggaattatcctgagataaaagtaccgttagcaccaaaaggcactgattttcaacagaaggtatggaatgaacttcagacaattcgttatagagaacttaaaacatatggagagattgctaaaacagtaggacgagcaatgaataagccagcaatgtctgctcaggctgtaggaggtgctgttgggagtaatcctatttctatacttataccatgtcatcgagtggttggtaaagatggaaatttaacaggatacggaggtactttagacaacaaaataaaattattaaaattggaagaaatagatatgacacatttatacagacctaaaaaaacaacgaaaccttga

SEQ ID NO: 1497 - DNA, 357 bp, Staphylococcus epidermidis
caacttttttatagagataacttgaaagtagggattaaattgatttgttctaattgtggggcacatttagagaaggatgataaattttgtgttaattgtgggcagagtgtgttcgataatccaaagacaaaaactgaacataattttaatagtcaagatagacaatgtccaaagtgtcacaaagtagtaaatgtcgatgataagttttgtatcaattgtggtcattctcttcagcaaacattatcaaattcaaatgacaacatagcatcacatacatattcaaatacaaaacctgaaattgaaaatgaaactgcagatcatattcgattgacagaagaagcccaagcatctatttaa

SEQ ID NO: 1498 - DNA, 213 bp, Staphylococcus epidermidis
tcaattatttatataaaggatgaattcgtcatgtttattttagtcaatacaatattgttcatagcgatttttggttatacagcaatgacattagtaaaattctttaaacgttcaaaagaaggtgattgtggtgggtgtaaatctaattgcaaatgcgatacgaatacttcatctcataaaaataaattaaatattccacatattaagtcatag

SEQ ID NO: 1499 - DNA, 477 bp, Staphylococcus epidermidis
atgagtatttatgatattgaggtagagaattatgatggctctacctatttactaaaaagatataaagggaaagtgctcattatcgtaaatactgcaacgaattgtactttgaatgatcaatttaataaattagaaatgctttataaaaaatatcataagtatggtcttgagattttgagcttcccttgcaatgattttaataatcaggagccaggattaatcaaagatatttatcgagtatataaatataagtttggtattactttccccatccatgctaagattaatgttaatggagagcatgaacaccctttgtacacattattaaaatgtaaacaaccaggattatttggttcgcaaattaaatggaatttcactaaatttgtagtagatcaacagggaaatattgttaaacgatttttaccttgtgataatcctaaccaaatggaaaaattaataaggcaattattaaaataa

SEQ ID NO: 1500 - DNA, 1212 bp, Staphylococcus epidermidis
attaaagtttataataatcttgaggagaggattaagatgaatcaaactttagttcaacatctacgtgaaaaagagcaaagaatgaaagaaataagacgttacttacatgaaaatcctgaattatcattcgaagaaaatgaaacatctaaatatattgcaaacttttataaagataaggattgtttagttgagacgaatgtgggtcctaatggaattaaagttaccatcgcaggtaaacatccaggaaaaactatcgctattcgtgctgactttgatgcgctaccgataaaagaagaaacagaattaccttatgcttctaaaaatgagggagtcatgcatgcttgtggtcatgatgcacatactgcgtacatgctaatacttggagaaacattaattgaaatgaaagatcaattgagaggtaatgtcgtgattatacatcaacctgcagaagaaatgccaccgggcggtgcgaaaggtatgatagatgacggcgtattagaaggggtggaccatgttttaggtgcacatgtgatgagtatgatggaaacaggtaaaatatactatcgtgaaggttttgttcaaacgggacgcgcttattttagacttgttgtgaaaggtcagggtggtcacggctcatccccacatacatcgaatgacgctattgtagcaggtgcgcattttgtaacgaccgcacagaccattgtttcaagacgcttaaatccgtttgaaacgggtgtagtcacaataggttccttcgacgggaaaggacaattcaatgtgattaaagatacaataacaatcgaaggtgatgtacgtgcactgactgatgatacaagagacaatattcagaatgaaatgacacgactagtcagaggattagaagagatgttcggagtgatttgtgattttgaatttaaaaaggattatccagctctttacaatgatcctgaatttacttcttatgtagcaacaactttaaaaaatgctaagctggatgacataaaagcaatagatatttgtgagccgcagccaccctcagaagatttcgcgttttatgcgttagaaagaccttcaacatttatttattcgggtgcagcaccagaagatggacctatgtaccctcaccatcatcctaagtttaatatcaatgaaacatctatgcttgtagttgcagaggcagtgggtacaattgtattagattatttgaaataa

SEQ ID NO: 1501 - DNA, 1296 bp, Staphylococcus epidermidis
agttgtaattacattgataaagttaaagttttacaatttatgaaaggcggtatcatgatgagcgtattatctaatgaagaaagagttgaaattttatccgatatagtctcaataaaaactgtaaatagtaatgaattagaggttgcacagtattttgaaagactatttagtcagtatggaattcgttcatatatagatattgttgcagacgggcgagcgaatttaatagcaacggttggttccagtcatccagttattgggatatctggacatatggatgttgtatctgaaggaaatcatgatgattggacgtatgatccttttacactaacagaggaccaaggctatttatacggtaggggagctgcggatatgaagtctggattagcagctttagccattgctcttattgaaattaaagaaagtggtaagttaacacagggaactattaaattcatggcaacagtgggtgaagaaatggaacaatcaggttcgcaacagttgtttgaaaaaggatatgctgatgatttagatgccttactcatagcagaaccatcatttcctagtttggtgtatgcacataaaggttcaatggactttagaataaaatctaaaggacgtgcttcacatagttcaataccatttttaggacaaaatgctattaaaccattattagagtttattcaaaatataaatcaagaatatgaaaaaataatgcaaacagtaaaaggtgagtccttagatttttcaaatatgattaataaattagagaatcaattacctaaccatataacaaaagaaaaagcacaagagcttatacaggggcttgttatgacaaatagtatcgttcaaggtggtacacaagtaaattcagtaccagattttgctacagctgaatttaatgtacgcacaataccagaatataataataacaaagtaaaagcgttatttaataaatatgtagagcaagcaaatcacaatggtgctagtttgactcaagaactttatcttgatttagaacctgtagtaacaacaggtcaaaatcgcttggtagagctaggatttgatattgcaaaaagccatttttctaacgaaagagatttaatcattactcctactgtagcagttactgatgcttcaaacttattaaaaggaaaagatgaaaattttccatttttaatgtttggcccaggaaatggacctcatcaaattaatgaatgcgttgaaaaagtaaattatttagaatttgttgaatattatatagagtttatcacttcatatttaaatgaaaagtaa

SEQ ID NO: 1502 - DNA, 873 bp, Staphylococcus epidermidis
aaagtgaatttattaaaatttcacaacaaaatcaaaggatatactcaaaatagacaaccaggtattgaagcggatatggaacctaaacccattgcagaattagaagaatataaagcagcaggaaagttagagaataaagttgctctaataacaggaggagattcaggtattggacgtgcgatagcaatactatatgctaaagaaggggcaaatgttgctattggttattatgacgaacatcaagatgccgaagacacagttaatcgacttcaagaaatgggtgtaaaagctaaagcttatgctcatgacttaaaagatgaaaagcaatctcaaaagttaatcaaagatgtcataaatgacttcggtagtttaaatatattagtaaataatgggggcgtgcaatttccacgcgatcattttgaagatatcactccacaacaagtgaaagaaacttttatgacgaatatttttggtatgatgtttttatcccaggcagcagtaccttacctatctgaaggagatacaattataaacactacaagtgtcacagcatataaaggatcggggcatctcattgattattcagctacaaaaggtgccatagtatcgtttacccgttctcttgctactactttaatggaaaagggaattcgcgttaacgccgttgcgcccggcccaatctattcacctttaattcctgcgacatttgatgaagaaaaagtagaacatcaaggtgacgaaacgccgatgggtcgtcgtggacaaccagcagaacttgcaccatcttatgtcttcttagcaacacatgcagatagttcctatattactggtcaagttattcatgtcaatggtggcgattttatcacatcttaa

SEQ ID NO: 1503 - DNA, 198 bp, Staphylococcus epidermidis
cagcaattctatggttcttcgttaaaccagacaaacctcttattgttagtgaagaacacgttaataaataatatttttcaaacacatgcaatgacattcatatcattgcgtgtgtttattcttttattatgtggtatagaacatggaagcgataagcgaattgttttttttatcagttataaactgctaaacttataa

SEQ ID NO: 1504 - DNA, 2088 bp, Staphylococcus epidermidis
agaaacctttttaatcatgcatatctagttaaaaaattaaatagcaagattaagattgttggtgaaatacatggtccattggaatatattaatgagaatatagatttagcattagactgtattgattgtgttcgagtgagtacagctagaattaaaaatgaatttatagctaaatatgactatcatcgggtttttaatcaatacgtaaatgcacaacatatcgatttaaaatcagagccgataaatactaaacgaaattttttaattaaagcacgttttgaggatgaagttaaagatatttcatatattattaaattgtttaattacatcattaaaaaccaaattgttgatgatgctcaactttatttaataggatatggtccttcagaaatgctttacaaaaatttgataaattactatcatcttaatgagtatatccatattaatgaaaaagaaccacagagttatatttatgtatctagttcgccatatgaaacgctcggctattctatattagaaacgattgcacagggtaataaagctctagtttactatggtgatgataacgtgttaaaggatatctatgcaccatatgaagcgatacgttttttaaccaaagatatgattaaagatagtaaaataattaaagactttctaaattataaatatagtcactttgatcgacaaaaatattatcgacagttggaaagtacgtttaaatgcattaattatggacaggaatttttaaataatgttgaaactttctcttcatctcaacatgtaaaagtgaagaaaattcatcgacatctcggtagtgaaaaacaaatagatatagcaagtcgtttaaaagagagtcgttggatgaatttaattagaaaaaataaatatttatttaataaatgtaaaacgtactatgaaaaaagaacgcatatgagctatatcaaaaatttaaatcaaatacctgtagacgacgattcaatatttatagagtctttccatggcaagaattttagtggagatcctaaatatattgctcttgctattaagagacagtatgatcataaaaaaatatatgtgagttcaaccaattcacttgttgatatggaaatcaaacgttacggttttacacctgttcgatttggaagcgagaaatatattaaaacgtttagaaagtgtaagtatgtttttatcaatggtaactcgtgggataaagtgtacaagtcttcagatcagatatttgttcaaacatggcacggttttccattaaagaaaatggttaatgatttaaatgaacaacatgaaagacaacaacaactagaggcattcataccacgcatgaaaaaatgggattacattttgacatcatcagatattaatacgacgttgttggaatctgcttttatgctaaataaaaatccaaatcttaaagttctagaatacggcgcacctaagaatgaatatttaataaataataataatttacaagagcgccagcagttacagcttaaatatatgtataagatagatgatgataaaaaatatatattatattgtcccacttggaggggaaatcaaagaaaagaagtcactcagattaatttaaaagatttacttaaatatttaccagagaattatgagattattgtgaaacttcatcctaatgaaagtcatttaagaaccagatataatcaaatagataatcgaattcactgttatttcaatgaacttgttgatattcaagaactgtatattctgagtgaatgtatgattacagattactcgtcgaccatttttgactatatacatttaaacaagccagtctttattcttcaagaagacgagcaacaatataaacaaagtgttggtttttattttgatttgtttgaagtgggtgattttcttaaagcctctttaaatgaacacatgttagctaaacaaatttgtagcactgattatataaattattcaaaagtggttcatcgtttgatgaaacaagatagttcgaaaagcagtgaaaagttaatggccgaaattcttggggaaccagaatatccaagttcatcaaactgcaaacaacagatttcttaa

SEQ ID NO: 1505 - DNA, 1881 bp, Staphylococcus epidermidis
tatacactatatatagcgaagggtgacgaaatgactactctagaaacatcattaactcgattaatcacaaaagatccaactatattaaatgaaaatgcaaataaagatagtaatacattctcaacaatgcgagatttaacagctggaacggtatcaaagtcttatgcactcgatcatttacttccaaagcatgttgctcatgcacatcaatcgggagatattcattttcacgacttagattaccatccatttcaaccattaaccaattgttgtctcatagatgcaaaagatatgttagagaatggctttgagataggcaatgctaatgttacaacacttcaatcaatacaaaccgcttcagcacaacttgtacaaatcattgcaaacgtttcaagcagtcaatatggaggttgtactgtcgatcgtgttgacgaattactaagtaaatatgcacaaatgaacgcacaacatcacagggaagtagcgaatgatttcgttcaacctgacaaaattgagaattatgtggatacacaagtaactaaggatattggtgatgcaattgaaagtttagagtatgagattaacacactctatacttccaatggacaaacgccattcgttactttgggatttggtttaggaacagatcaattaagtcgaaaaattcaacaagcaattttacatacccgtattaaaggtctcggtaaagatagggtcactgcaattttccctaaacttgtattttcaataaaaaaggggattaactttggtccagaagatcctaactatgatattaaacaacttgcattggaatgttcaacaaagcgcatgtatcccgatattttaaattacgataaacttgtggaactgcttggtgattttaaagcaccgatgggatgtcgttcatttttaccaagttggaagaatgatgaaggtcaattggaaaataatggacgatgtaacttaggtgtagtgacgttgaacgtaccgagaattgcaatcgaagcagatggcaacatgcagcagttttgggatatctttgaaaaacgcatgcaattattacatgatgcacttgtgtatcggattgaaagactacaagatgctattccagataacgcgcctattttatataaaagtggtgcatttaaaaataaactcacttcagaagatactgtcgattcattatttacaaaacaacgcgcaacgatttcaatggggtatatcggtttatacgaagcggcaacattattttatggaccgaattgggaacacaatcctgaagctaaaacattcacactagacatattaagagaaatgaaacgttatcaagtagagtggacgaaacaatatgatatttggttcagtatatacagtacacctagtgaatcactaacagatagattttgccgattggacaaagaaaaatttggatctattccagatgttactgataaaggatattaccaaaattcattccactatgatgtgcgtaaagatgtaacgccgtttgaaaaattagattttgaaaaagactatccttactatgcaagtggtggattcattcattattgtgaatatccaaagttaaatcataatctgaaagctttagaagcagtatgggattatgcttatgataaggtaggttatttaggtacgaatattcctattgatcactgttatcgttgtggctatgatggagattttgaaactactgctaacggatatagatgcccacattgtggtaacactgatcctaaaacggttgacgttgtaaaaagaacatgtggttatttaggaaatccagttcaaagacctgttattgaaggtcgacaaaaagagatatgtgcaagagtgaaacacatgaaggcacttcgttcatga

SEQ ID NO: 1506 - DNA, 1683 bp, Staphylococcus epidermidis
tataatgtatattttaattttaataaagaggaatttgtaaatatgaaaaataattggatagatgtattagatgaaagtttagtcaaagatttttataataatcaaacttccgaagagcaacaagaaggacttaatactacactgtcttttggcacggctggtattagagggaaattcggtttaggtgaaggacgattaaataagttcacagtatctaaagtagcgttaggctttgcccattatttaacatcaagtatcgcgcatcctgttgtcgtcatacattatgacacaagacacttatcacctgaatttgctcaaattatcgctaatattctagcaagtcttgatattaaagtttatcttgctgatacatacagaacaacacctgatttgtcatttgcagtcagatacttacaggctgatgcgggtgttatgattacagctagtcataatcctaaagattacaatggaattaaagtttatggagaagatggtgctcaattatcaaccgacgattccgcacgactaagcacatatatcgataagttaggtcatccgcttcatattaatttacctagtttaactactgaacaacaatcattaattcattcagtcccgagcgaagtcagagaagattatttcaaaaacgtacaagacttagttggaacgattccacagtctgatttaaaagttgtctttacaagcttgcatggtacgagtgtgccagttgtacctgacatcttatcttctcttaactttaatcaatttgagttagtcgcatcacaatgtgaacctgattcagatttcagctctgtagccagtgcaaatccagaggatcataaagcctttgatcaatcgatagaactcgctaatcacattgatgctgatttacttattggcacagatcccgatgcagaccgtttaggaatagttgaacgtgatgctgaaggtaacatccactattacaacggaaatcagattggtgcacttttgttaaattatcgtatcaaacaaacagaaggattatctaacagaattatgttccaatcaattgtaagtggtggcttagctaaatctcttgctcaatatcataatgtcaatttcaaagaagttttgacaggttttaaatatatcgcagctgaaataagacatctgtctcctgaacaaaactttatttttggctacgaggaaagttatggcttcttagcccgtcctttcgtgagagataaagatgcgattcaaattgtgccattaatgattaagtatgcagctgaattaaaaaacaaaggacgcatgcttaaagatgaattagaagacattactcgaaatgtcggtaactttaatgacaagcttttctcacatacatttgaaggtactcaaggcaaggcaaaaatcgaaaatattatgactcaattcagaagtgaaacaccttcggaaatgtgtggtcttaaagtcattgcaatcgaagattttgaaacaggtaaaaagactgacttacaaaatgatgaagtcagcgatataactttacctaaagcgaatgtaataaagatatactttaatgaaggatttattgctttgcgtccttctggtacagagcctaaaattaaactttatgtatcactttcttgtgaccattttgacgtagttgcacaaaaaatgaacgatgctatatttaactcttaa

SEQ ID NO: 1507 - DNA, 801 bp, Staphylococcus epidermidis
tattggacatatcattttaaagagaaaggaaagatggtaatcatggatgacttgaaacaaaatcaatcttctaacgaaaaacctaaaggtaataaaataattaatattttgatattcatcggaatgattttattaattcaaatacctattggcgtgtcactaatagctttacctttttcagtgaaattcagtaagttaacatccatcgcattaagtatgctaataactggtacagcactattaatcatatggttagttaggaattattatttgagtcatacatatgaaagacaatatcaatcaatgaggggaaaagatatctttattaatattggttttctggtattatcaatggtttttagtattctaagtagtgtattaatggtcatatttactggcaacgatactacagcgaatgagaaagaaatcaatgaaagtttagatttacttttacaaaaagaccatttaccacatatttcaattgttgcaactgttgttttaatgatatgtattataggtccgtatttagaggaattactcttccgaggaatttttaaagaaacattatttatgaaatatcgattttggctaccattcattatatcttctattatttttagttcacaacatttatcaacaaatatattttcatatgcaatttattttctaatgggttgtgtattataccttgcctataacagaagacgtaatatcaaagatagtatgatggttcacatgttgaataattctgtttcaacattaccggtatttgttggttatttatggatatattttagatag

SEQ ID NO: 1508 - DNA, 1011 bp, Staphylococcus epidermidis
tttcaaaaatatacatattacaccaatattgatatgaaggggacagtaagtagaatgaaaaatcttaagtttttagtggtgcttgttttatcggtggttatttttgcagcagcctgtgggaattcaagttctttggataataataaaagttcggatagtggatcagattcaaaatcgggtagttatacacctaaagaattaacagtacaatttgtaccttctcaaaacgctgatacactcgaagctaaggcaaaaccgttagaaaaattgttgtcagataaattagggattccggttaaagtatcagtttcaacaaactacaacacgatagttgaagcgatgaaatctaagaaagtggatgttggtttcttgccaccaactgcatatacattagcacacgatcaaaaggcagcggatttattattaaaggcagaacgttacgacgttaatgaagatgggtctccaagtaaaaagttagttgatgattataaatcagaaatccttgttaaaaaggactctggtattaataatctcaaagatttaaaaggtaaaaaaattgcattacaagatgtaacttctacagcaggatatacattccctctagtaacattaaaaaaagaagctggtattgatgcaacaaaagatatgaaaatagtcaatgttaaaggacacgatcaagcagttatttcattgttaaatggagatgtggatgcagcagctgtatttaatgatgcacgtacagttgtaaaaaaagatcaaccaaatgtatttaaagatactaaaatattaaaactcactaaacctattcctaatgatacgatttcagtacgtcctgatatggataaaaaattccaagataaattgaaaaaagcttttaaagaaatttctaaaactaaaaaaggtcataaaatcattagcgaggtatattctcatgaaggttatgttgatactaaagattcagactttgatatcgttagacaatatgaaaaagctgttcatgatatgaaataa

SEQ ID NO: 1509 - DNA, 1335 bp, Staphylococcus epidermidis
aatatgaaatattgcagtaattgtggtcaacctcttcgagaaggtgtaaaggtgtgtacaaattgtggtacgcctgtgagaaatgatggacctaattataaacattcagaacaacgttattctcatcaacaaccacgttccaataagagtaataaaaaaacttggttgattgttactatagtgttagccattatcattgctttggtagtaatctttactatagctaaaaatcaaatgtctccagaaaaacaagcgactcacattgcacatgctatcaaaaaagacgatgctaaatcattatctaagcaattaacatcaaacgatcatcgtttaaatgaagaagaagcacgtgcgtacttaaagtatattaaagcagaaagtgatttaaagcatgttgctgacaaagttgaagaaaacaccaaagatattaaaaataatcactataacaatttatctgtagatgcaaatgataataatattttaaatatatctaaagacgggaaaaaatatgttttttttgataactatcaatttaatgttcctcaaaaaacaattacgatcgtttcaagtgatagtggtgaaattacttatgaatttaacggggataaacatcatatttctgtagaagaagatgacgataaagaattaggaacatttcctatcggtgattataatttaaaagcatcaaaagacatggaaggtaaaaattttaaaggcgctattacaattgatatgagtgaaagtgatagtattgcatatgaatcgtttaaacaaaaacgttttaatgttgatactgaaggcggatatatattagataatgtaaaaatatatgctaatggtaaagaaataggcgatggtttttcatcagaaacatatggtccttatgatccagatgaagaagttatcgttcacgctgaaggttcatacgaaggaaaaacttttaaatcaaattcggtcaatgtagcaagtgcaagcgaaaaagatggtggtgtgacagatgtcacagtcaaattcgatgaagaagctattgatcagtatgtcgataaaaaattagatgaaaaatacgatgattcagatgacgagtcagataacgattcaagtagtggcgaagtaacgcgtgaaaatgtaattgataaagtagagtcatatgaaggacatacactagatactgatacgtatacgtataaagaacctgaaaaaaccggtgatggtaaatggggtttttcattcttagataaagatggagatttagctggatcgtacacggtagacattgacgacggttatgttacagaatatgacgaagatggtgaagaagttggatctggttattaa

SEQ ID NO: 1510 - DNA, 1545 bp, Staphylococcus epidermidis
aatatgaaatatatgattggtgtagatatggggacaacgagtacgaaggctgtgctatatgatgaaaatggcaagtttataatgaaacataatattggctatgacttacatacaccaaacgtagatgtgtctgaagaaaatccggatgaaatatttgatgctgtgcttatgacggttaaatatattgtaagagaatctggcatcgcaaaagaagatattaagtttatttccttgagtgcacaaatgcatagtttgattgctatgaacgaggataatcaacgtttaactgaaaatatcacttgggctgacaatcgtgcgaatgattatgctgatttaatagaaaaatcatatggcggttttgaattgtatcaacgaactggtacaccgattcatcctatgtcaccattatctaaaatcttttggatgagacatgaggaaccgaaaatatttaaacaaacagctatgtttgcagatttaaaaacatacgtactgtttcaattatatgaaaggttcgtcattgattattctttaggatcagctacaggtatgatgaacttagaacaattagattgggataataaggctttagaattgttaggtattgaaagaaatcagttaccacaacttgttccaactacacatgttttaactggaatgaaaaaacgctacgcaacgttgatggggattgatgagcaaacgcctgtgattgtcggagcgagcgatggcgtattatctaacttaggtgtaaatagctatcaaaaaggtgaagttgctgtaactattggcacatcgggtgcaattcgcacggtaattaatcagccaaaaacagacgagaaagggcgtattttctgttatattctcgacaaagatcaatatgtgattggcggtccagtcaataatggtggtgtcgtcttgagatggttgcgagatgaaattttagcgagtgaagttgaaacggctaaaaggttgggggtcgatccttatgatgtgttaactcagattgcaagcagagtaaaaccaggtgcagaaggattgatttttcatccctatttagctggagagcgcgcaccattgtggaatgctgacgcaagggggtcattcttcggattgacattatctcacaagaaagagcatatgattcgtgcggccttggaaggtgtactgtataacttatatacggtttatcttgctttaattgaagtgatgaatgaaacaccaacaacgattaaagcaacgggtggttttgctaaaagtgaaatttggcgacaaatgatggcagatatttttgatacagacttaatcgtacctgaaagctacgaaagttcatgtctaggtgcatgtgtacttggaatgaaagctctgggagaaatagatgatttttcagtcattaaagatatggttggtactacacatgcccatgaacctaaccaagaaacagttgccatctaccaacaacttgttaccatttttattaacattagtcgttctatgactgagaactacagtgatattgcgaatttccaacgagaacatttaagtgattaa

SEQ ID NO: 1511 - DNA, 1557 bp, Staphylococcus epidermidis
ggacggagatatggtcattcatttcccataaacaaagaggtgttagacatgacgatttataatatcaattttggaatcggttgggccagtagtggtgttgaatatgcacaagtgtatcgagcaaaactattaaggcaattaccttatccaacaaaatttatatttttagattttattcaatcagaaaatattcaaacactcacaagcaacatagggtttaaagatgatgaagttatttggctatatcaatacttcacagacgtaaaaatcgctcctacaacgtacacagttgatgatttaatttcagagttaggtaatgaggttactcgaaaagaacaaaacggtaaagtattacgactctatttaaataatcagcaaacattcgtaacctgctatttaaaaaatgctaacgaacattacgttgatcgtgcagagtttgtggtgaatggaatgttaattaggaaagatttttatagctatgtaagaacattctcggagtattatgctccttttgacaataaagctaaaatatatatgcgtcaattttataatgaaaatggatcaattgcatatcgcgaatatatagatgaagatgaacatgtttttgtgtttgatgatgcacgtttatacagtaaacaagcactcgtcgcatactttatacgtcaattgcgattgaattcagaggatatcattattattgatcgagcaactgatgtgggacaagccatattagaaaacaagggatccagtaaagttggcgtagtcgttcacgctgaacatttcagtgaaggtgcgactgatgggactcacattttatggaataattattatgagtatcaattcgaaaatgcacagcatattgatttctttatcacagcgacagatttgcaaaggcagacactaagtgaacaatttaaacaatataagaatgattgtccacgtatacgtacaattccagtaggtagtatagaatcgttacaatatcctgaaaaagaaagaaaaccatattccatcatgaccgcatcacgtcttgctaacgaaaaacatgttgattggatagtggaagctgtgattaaagctaaacatcagttacctcaattgagttttgatatctacggacaaggagaagaacaagaaaaaattaaaaatattattaccaaacatcgtgctgaggattacatacaaattaaaggacatagaaatcttcgtacaatatatcagcaatatgaattattcatagcggcctcacaaagtgaagggttcggactgacattaatggaagcggttggctctggtttaggtatgattggatttgatgtgaattatggcagtccgacatttattcgacatcatcaaaatggctatttgataccgatagattttgaacaagcgtctactgatgatatcacaacgcaaatcgctcatatgattattcgatattttgaagatggtcccataagggcacatgaggtatcgtatgacattgcagaatcatttaaaacatcgcatattgttgatctatggagacaactcattgaagaggtgctatatgattaa

SEQ ID NO: 1512 - DNA, 1539 bp, Staphylococcus epidermidis
aaactaactctcagtcaaagtttgtcttctatacttgatttatcatacatattgggaggcaatttatttatgaaatttatgaacaaaatgggtaagacgacgcttgcttcatcaatcgtagcagcatccgttttaagtacggtaaacgtatcatatgcttcaggtagctcagaacaaagtgctcaaactaagcaaacacaaaacgatgccattgctttcggcaacacaaaaaatccaaaaaatgtcatctttatggttggcgatggtatgggaccttcttttaacactgcatatcgctattataaaaataagcctggtgctaagaaaatgactccaactgcatttgataaatatctaaaaggaacaaatcgtacttattctaatgatcctaaagaaaatgttacagactctgctgctggaggaacagcttttagtaccggtcacaaaacatataacggtgcgattagtgttgatacaaataaaaaaccaattaaatctgtgctagaacaagctaaagaacaaggaaaatcaactggtttagtaactactgctgaacttactgatgcaacacctgctgtatatgctgctcatatagattcacgcgacaaaaaagatgaaattgcacagcaattttataatgataaaataaatggcaaacataaagtcgatgtgatgttaggtggcggtgcaaaatacttcggtaaagaaaataaaaatttagcgaaaaaattcaaaaaagatggttatgatatcgtttctaataaagatgaattaaatcaatcacaaagcaagcaagttttaggtactttctcagaaaaagatatgccattacaaatagatgcacctcaatctaatccgttgctagtagacatgcaaaacagtgcactaaataaattaagtaaaaataataaaggattctttttaatggttgagggtgcttcaattgataaagctgcacaccctaatgatatcactggtgtgatgtctgaaatgtctggtttcgaaacagcttttgataatgctattaattatgcaaagacacataaagatacacttgttgtagcaactgcagaccactcaactggtggtctatcaaccgcaaaaggtaaagattataaatggaatccagaggctattcacaagatgaaacattctggaatgtatatgacaaaacaaatcgctgatggaaaagatcctgaaaaagtaattaaagatggatacggcattgatttcccaaataaacaactcgataaagtcaaaaaagcagcagacgagcttcacaaattacaaaaagaaggtaaagatgacaaagacgaaaaagttgtagaacaaacaacaaaattacaaaatgcaattcaaaaaccaattaacgatgcttcacacacaggttggacaaccaatggccatacaggtgtagatgttaacacatatgcatatgggccaggttctaacaaattcaaagggaatatggaaaatacccaaagcgctaaaaacttatttgactttttcggagacaatgtaacatcaaatcaaaattag

SEQ ID NO: 1513 - DNA, 684 bp, Staphylococcus epidermidis
aacgtgacgtatggttatccgaaaaagtggaaggaaaacatgacttcaggacaagtaatagctgctgagttacgtttaggaatagtgagtggtgaaattgaatcccatatacaactaagtgaaaatcaagttgcacaacaatttaatgtgagtcgttcaccagtcagagatgcatttaagttacttcaaacagatcaactgattcaattagaacgtatgggcgcacaggtacttccttttggtgatcaagagaaaaaggaaatgtatgatttgcgtttgatgctcgaatcattcgccttttcaaaattaagtggaacagatacacaacatattgttaaggaaatgaaaaagcaattagaaatgatgaaggttgcagtccaattcgaggatgctgaagcatttacacaacatgattttgagtttcatgaggtgatgattcaagcaacaaaccatcagtatcttaaagtgttttggaatcaccttaagcctgttatggaatcactcatactcatttcaatgagacaaagaatgacaaatgaccccaaagatttcgagagaattcatagtaatcatcaagtttttatagatgctgttgagaacgatgatgcctccatattgagaaaagcattccatttaaattttgatgatgtaggagaaaatattgaagcattctggttacgttaa

SEQ ID NO: 1514 - DNA, 222 bp, Staphylococcus epidermidis
tataaagatttacttcggcacattttaaattcagccattaacttccaatatacaaaacacctgagacaaatatcgatgtctcaggctcagttatttaagtataaacacctacttgaaaagcacacttcaatttatgtactagtcattttaatatttaaattgtggagtgagaactattggtgtaccttaatgaaatttacgtgcatatgtacaatacattaa

SEQ ID NO: 1515 - DNA, 2835 bp, Staphylococcus epidermidis
atgcactatctgatgttgatgtactcgttgagtctgaaatgcttgtacttgttgactcacttaaggatgtacttgcactgtccgagtcgctctcacttgttgacgttgatccactttctgatgtcgatgtgctcgttgagtctgaaagactcgtacttctcgagtcacttaatgacgtacttgtactgtttgaggcactcacactcgttgatgttgatgtacttgtcgattctgaaacgctcgtacttgtcgagtcacttaacgatgtacttgcactgtccgagtcgctctcacttgttgatgttgacgcactgtctgatgtcgacatactcgttgaatctgaaagactcgtacttgtcgattcacttaatgacgtacttgcactattcgagtcactcacactcgttgatgttgacgcactttctgacgttgacgcgcttgttgaatctgaaacgcttgtgcttactgattcacttgatgacgtacttgcactgtccgagtcgctctcacttgttgatgcagatgcactgtctgatgtcgatgtacttgttgagtctgaaacgcttgtacttgttgagccactcaatgatgtgcttgtactgtttgactcactcacactcgttgatgtggatgcactatctgatgtggatgtgcttgttgattctgaatcacttgtgcttactgattcacttgatgacgtacttgcactgtccgagtcactcacactcgttgatgttgatgcactgtctgatgtcgatgtactcgttgaatctgaaacgctcgtacttaatgattcacttatggatgtgcttgtactgtttgactcactcacactcgttgatgttgatgcactgtctgatgttgatgtacttgttgagtctgaaatgcttgtacttgttgagccactcaacgatgtacttgctctttccgagtcgctctcacttgttgatgcagatgcactatcggatgttgatgtacttgttgagtctgaaacgcttgtacttaatgagccacttaacgatgtgctggcactgtttgagtcactcacactcgttgatgttgatgcactgtctgatgtcgatgtactcgttgaatctgaaagactcgtacttgtcgagccacttaaggatgtacttgctctttccgagtcgctctcacttgttgacgttgatgcactgtctgatgtcgatgtactcgttgaatctgaaagactcgtacttgtcgagccacttaacgatgtacttgcactgtctgactcactctcactcgttgatgtggacgcactgtcggatgtcgacgcgcttgttgaatctgaaacgcttgtgcttatcgactcgcttaatgacgtactttcacttgttgagtcactctcactcgttgacgttgatgcactgtcggatgtcgacgtactcgttgaatctgaaacgctcgtacttaatgattcacttatggatgtacttgcactttccgagtcgctcacactcgttgatgttgatgcactgtcggatgtcgacgcgcttgttgaatctgaaacgcttgtgcttgtcgactcgcttaatgacgtactttcacttgttgagtcactctcactcgttgacgttgatgcactttctgacgttgacgtacttgttgagtccgaaagacttgtgcttgtcgattcacttaatgacgtacttgtactgtctgactcactctcactcgttgacgttgatgcactgtcggatgtcgacgtactcgttgaatctgaaatgcttgtacttaatgatccacttaacgatgtgctggcactgtttgactcactctcactcgttgatgtggatgcactttctgacgttgacgcgcttgttgaatctgaaacgcttgtgcttaatgattcactcaacgatgtactttcacttgttgagtcactctcgcttgttgacgttgatgcactgtcggatgtcgacgcactcgttgagcctgaaagactcgtacttgtcgattcacttaatgacgtacttgtactgtctgactcactctcactcgttgacgttgatgcactgtcggatgtcgacgcactcgttgagcctgaaagactcgtacttgtcgattcacttaatgacgtacttttactgtttgattcactctcgctcgctgacattgatgcactgtcggatgtcgacgtactcgttgaatctgaaacgcttgtacttgtcgattcacttaatgacgtacttgcactgtctgactcactctcactcgttgatgtggacgcactgtcggatgtcgatgtacttgttgaatctgaaacgcttgtgcttgtcgatttacttaatgacgtacttgcgctattggagtcacttacgctcgttgacgttgatgcgctatcagacgtcgacgtactcactgattctgataatagtttacttgtgcttgctgattcgctcgcttttattgatgcgctatcagacgtcgatgtgctcgttgagtctgaaatgcttgtacttgttgagccactcacacttgttgatgttgacgcactttctgacgttgacacgcttgctgaatctgaaacgcttgtgcttgtcgattcacttaatgacgtacttttactcgttgactcactctttcttgctgactctgatgcactatcagatgtcgacgtactcgctgattctgataattgtttacttgtgcttgctgattcgctcgcttggattgacgtactattcgacgtcgacgcacttaacgactctgagagactcttacttgttgataatgattgactcgcttttacactatcacttagcgatgtactattacttatacttgttgaaacactatttactatgctag

SEQ ID NO: 1516 - DNA, 1197 bp, Staphylococcus epidermidis
aaggggcatctagttgttatgactgtcgcacgcacaacaacatttatattaagtgttttcatcgtaggtatggttgagatgatggttgcaggtattatgaatttaatgagtcaagatcttcatgtttctgaagcggtggttgggcaactggtaacgttgtacgcgcttacctttgcgatatgtggtccgttattagtgaagttgactcatcggttttcttcgcgatcagtattattatggacgttaattgtctttatcttcgggaatggtatgattgccattgcgccacattttggaataatagttgtaggacgtattttatcttctgccgcagcttcactcattattgtgaaagttttagcactcacagcgatgctcacatcagcaaaaaacagaggtaaaatgattggtattgtttatacaggttttagtggagcgaatgtctttggtgttcccatcggtacagtgattggcgactgggtaggatggcgatttacatttttattcattattattgtaagtgtatttgttggtgttttaatgttaatatatctaccaaaagaagatgaattgtcacatccaaatcaaacacctcgttcatctagtattgaatcacaaactggctcaagcgtcataagacctcgtgaggtttttaaatatctgatgattacatttttagtgctggttgctaattctgtaacattcgtgtttattaatccattaattttatccaatggacatgaaatgtcttttgtgtctttagcactacttgttaatggtgtagcaggtgtgattggtacttcattaggcggtgttttatctgataagtttactagtaagcgttggttaataatttcgatttcaatatttataataatgatgataattcttaacttattattaccaggaacaggattattattagttggcttatttatgtggaatttaatgcagtggagtacaaatccagctattcaaagcggtattattgaacacgtcgaaggagatacaagccaagtgatgagttggaatatgtcgagtctcaatgccggtattggcgttggcggaatcgtaggtggactcgttatgacacatttatcagtggaatatgttacttatactagtgcattgataggtttaattagtcttatcattgtattcactttaaaaaatagacattatgctaaaaatttatga

SEQ ID NO: 1517 - DNA, 198 bp, Staphylococcus epidermidis
acgtttattcatatcgttaatattgatgaaaatattaacgatatgaataaacgttcttctatcaattgcaataattatttcctttccaaactaaaaagtcgttgtaaagtggctataagtcatctccctcattcacgcacattacaacgacatgttatatataaattaaaacatttcagaaacaactttttgttctaa

SEQ ID NO: 1518 - DNA, 411 bp, Staphylococcus epidermidis
aatcatattcattatcaagaagccccaaatcttacaaaggttgaatatggtgaccattatgaacgcagatttatgaagcctaagaaattgaaggccaacatcgaatatacaacaccgcatggacacgtgtatcgaacggatcacaaaggccgtattaaagaagtatatgcggatgacctatcacttctagatggcggacgtaattcatatgcgcaacgaacagtaggaagagaataccgattaccagatgatgacggcggtcatttaattgcgcgcggattcggaggttctaaagatatagataatctcgtcccccaaagtaaatacatcaaccgctcatttaaagagaacggagaatggtataacatgaagaaagaatggcaaaaagcaattaaaaagggagagaagtaa

SEQ ID NO: 1519 - DNA, 2028 bp, Staphylococcus epidermidis
tgcacgactcataacattagaggagtagttataatgactcaaagctactgtattcttggaaaccctaatgtaggcaaaacatcattatttaatgcgttaaccggttcttacgaatatataggtaactggagtggcgtaaccgttgaaaagaaagtaggaaaattgaaagataatgtaggtgatttagttgatttaccgggcatttatgatttatcacctatttctaaagatgagacggttgtcacagattatttaatgtcaacgtcattcacaggaatgattaacattattgacgcatgtcagcttaaaagaaatcttaatcttacaatacagttgatggaactcaacaaacctatgattattggtttaaatatgatagatgttgcaacacaaagaggtattaaaattaactatcaagctttgatgagaaaattaaaagtaccggtatttccaattgttgctagaaaggcaaaggggacacatagtcttttaggagagcttaattatttagaaccacatcaacgtcgtgcatttaagattaattatggaactgaaattgaaactgcaattcaacaaatttgttcaattatcaaacaggataatatgtatccaacagaacgtttacgttttatagccatacagtatttaatagacaatgttcaaatttatcaagaactcgatgccatgattttagaacagttagaacccattaagcgaaagttaagtaacgcgacagaacaatcaacacgccaaagaattgaagctgtgcgaaatgattacattaatcagctattggaagatatcgtagaatatcccgaagaggataaacaattctttacttcaaaagtggatcgattattattaaatagatatctaggtatacctatatttttaggtattatgtggcttatttttcaaacaacctttacatggataggaacaccattatctgatcaattagacgcttttataagtggtcctttatcagaatggattaaatctgttatgaatacattacatattacgtcgtttcttcaagatcttattacagatggtattatcgctggtgtgggttctgtattggtatttgtaccacaaattgttgtgttattcttttttatttctttattagaagattcaggttatatggcaagaatagctgtattaatggataaaacaatggaatctataggtttaagtggaaaatcatttattcctatgattattggatttggatgcaatgtaccaagtattatggcagcaagaagtatagagaatgagaaagaacgtttgattacaatattggttgcacccttcatgtcatgttcagcacgcttaccggtttatgcactttttgtaggagcgttcttttcagcacatcaatcactagttgtattaagcttatatattttaggtatagttgtcgctttactagtaagtacgttattgaataaattgatattaaaagataatcagtctgtttttattgtggagttaccgacataccgtgttccatcatttaaaacactttggcgcagtacttgggaaaaagcaaaaggttttgtcaaaaaagcaggtacctttatttttggtggttcagtcgttatttggacactcacatacatcggtccgcacggtgttaatgtcccgattaatcaaagttttatgcatatgattggtcaagggttcgcgaatttaattgcacctttaggatttggctcttggcaggcaggagcaactttaatacctggctttcttgctaaagaagtgattatcagttctatggctattttatactcttctagcgaaagtggtttaacacaagtcattcaacagcaattcactccactttcagcttatgcattcatgatttttattttactttacgttccttgtatttcaacagtcgctacgattcgtaaagagacaagttcttggaaatggacattactagcggttgtttatccaatagcaacagcatatatattaacgttcgtattctatcaagttagtcaattatttatataa

SEQ ID NO: 1520 - DNA, 1083 bp, Staphylococcus epidermidis
cttgaacatcacgaaatacattcacttatgctattaaatttgatagcgacttataaaatgaaaggggcgcatcccatgaaaaacatcaagaaaccctttgatttaaaaggtaagtcattgctaaaagagtatgatcttacaggtgaagaatttgaaggtctaatcgattttgctatgacattaaaaaaatataaacaacaaggcacaccacatcgatatttagagggtaagaacattgctttactcttcgaaaagacatctactcggacgcgtgccgcatttacagtcgcatctattgatctaggtgcacaccctgaatttttagggaaaaatgatattcaattaggaaaaaaagaatctgttgaggatactgctaaagttttaggcagaatgtttgatggaattgaatttagaggtttttcacaaaaaactgttgaacaattggccgaattctctggagtaccagtatggaatgggttaactgatgattggcatcctacacaaatgttagctgattatatgacaattaaagaaaattttggatatttaaaaggcatcaacctaacttatgtaggaaacggacgtaataatgttgcacattcgcttatggtggcgggtgcgatgcttggcgtaaatgtacgtatttgtacaccctcatcattaacaccgagagatgtatattttaatattgctaaagatcaagcgtctaattatggaggttcagttaagatgactgataacattcatactgctgtcaaagatgcagatgttatttatactgatgtttgggtatcaatgggtgaagaaagtgaattcgaaacacgtattcatttattgaaagactatcaagttaatagaaaaatgcttaatttaaccggtaaagtagatacgatatttttacattgtttaccagcttttcatgatacacaaacagaatatgggcagaatatttttgagaaatatggcttaactgaaatggaagtgacagacgaaatctttagaagtgagcattctagagtgtttgatcaagctgaaaatcgaatgcatacgattaaagccgtgatggcagcaactttaggctag

SEQ ID NO: 1521 - DNA, 477 bp, Staphylococcus epidermidis
gaggttgatcattcaatgaaaaagagtaaacgacaagatttagtaactatgattgttaagcaaaatcacatttataaaaaagcagatattattgattacattgatgatcactttggtgtacgttatagcatgactactattgcgagagatttaagagaacttcatatttatcgcctgcctgtgaaggcaaatcaatatgaatacaaattacttacgcaacaatctcaattagactcaagagtaagactaaatgattatatagaaacagaaattattaacactatgattaaagaatcgtatatactaataaagacgacaccaggatttgcacaaagcataaattattatattgatcagttacaactgaaagagattataggaacgataagtggtaatgatacaattatgattcttacacattcccagtctatagctgaatatgtctattacaaaatatttaatcataattattcataa

SEQ ID NO: 1522 - DNA, 297 bp, Staphylococcus epidermidis
gggatgagtcaatatccattctatagacgcatgtttatcatcataaaaaaatgtacactcatatataattcaataaaggagttgtatcctatgagaaaaatacttaagggtattatattatcattaataatcatcggcttaatcaaaacgttcaatgaatatgatattatacattgtgcaaatcattatttcgaacaaatcaaaagtggaaaaataattgaagatatcaaaatcgatcatttcaataattatcataatattaattttgaagatctaaatccttctgactttttttaa

SEQ ID NO: 1523 - DNA, 732 bp, Staphylococcus epidermidis
aagagaggtcatattgtgattgaagcgaatcaaattttagctaaaatgaaaaatcaaaaaatcaactatgataaagtattaagaaagataatttctcaatgggaacgtgatggagaacgccctaaaatcttacttcatagttgttgtgcaccttgtagtacatatacgttagagtttttaacacaatatgcggatatagcgatttattttgcgaatcctaatatacatcccaaaagtgaatatttaagacgtgctaaagttcaagaacaatttgtaaatgattttaataataaaacaggtgcaaatgtaaagtatattgaagccgaatatgaaccgcataaatttatgaaaatggcaaaagataaaggtttaactgaagagccggaaggtggactaagatgtacggcttgtttcgagatgcgattagaaattgttgcaaaagctgctttagaacatggttacgattattttggtagtgcaatcacactctctccaaagaaaaatgcgcaattaatcaatgaactaggtatggatgtacaaaatatatataatgtaaaatatttaccaagtgattttaaaaagaataaagggtatgaacgttctatcgaaatgtgtaatgattataatatttttagacaatgttattgtggttgtgtatttgcagcgatgaagcaaggtatagattttaaacaaataaataaagatgctcaagcatttttacaacaattttaa

SEQ ID NO: 1524 - DNA, 1983 bp, Staphylococcus epidermidis
gggagcacacataagatgaagaaaaataaatttttagtatatttactatcgacggcgcttatcacgccaaccttcgctacacaaacagcttttgctgaagattcatctaataaaaatacaaattcagataaaatggaacaacatcaatcacaaaaagaaacatcaaaacaatctgaaaaagatgaatttaacaacgatgattctaaacacgattctgatgataaaaaaagcacttctgacagcaaggacaaagactctaataaaccattatcagctgactcaacacatcgtaactataaaatgaaagatgataatttagttgatcaactttatgataattttaagtctcagtcagtagatttttctaaatactgggaaccgaataaatacgaagacagttttagtttaacgtcactcatccaaaatttatttgattttgattctgatataacagattacgaacagccacaaaagacaagccattcttctaatgacgaaaaagatcaagtagaccaagcagatcaggcaaaacaaccatcacaacatcaagaaccatcacagtcgtctgctaaacaagatcaagaatcatcaaacgatgaaaaagaaaagacaactaaccatcaagccgattctgacgtcagtgatttacttggagaaatggataaagaagatcaagaaggcgaagacgtagatacaaacaaaaatcaatcttcttctgagcaacaacaaactcaagcgaatgatgatagctcagaacataacaagaaatattctagtattacagattcagcattagactctatattagatgaatatagtcaggacgctaagaaaacagaaaaagattacaataagagcaagaatacaagtcacactaaaacatctcaaagtgataatgccgacaaaaatccacaattaccaacagatgatgaattaaaacatcaatcaaaacctgcacaatcatttgaggatgacattaaacgctcaaatacacgttcaacaagtcttttccaacaactacctgaattagacaatggtgacttatcttctgattcatttaatgttgttgacagtcaagacacacgtgatttcattcaatcaattgctaaagatgcgcatcagattggaaaagaccaagatatatatgcatcagttatgattgctcaagctattttagaatctgactctggaaaaagttcacttgcacaatcaccaaatcataacttgtttggaatcaaaggtgactacaaaggacaatctgtaacttttaatactttagaagctgatagcagtaatcatatgttcagtatccaagcaggtttccgtaaatacccaagtactaaacaatctcttgaagattatgcagatttaatcaaacatggtatcgatggtaatccgtcaatttataaaccaacttggaagagtgaagctctatcatataaagatgctacttcacatctgtcacgctcatacgccacagatcctaattattctaaaaaattaaatagtattattaaacattatcatttaacatcttttgacaaagaaaaaatgcctaacatgaagaaatacaacaaatcaataggtacggatgtctctggtaatgacttcaaaccatttactgaaacttccggtacatcaccttacccacatggccaatgtacttggtatgtgtaccaccgtatgaatcaatttgatgcatccatttctggtgacttaggtgatgctcataattggaataatcgtgctgaaagtgaaggctatacggtaacgcacacacctaaaaatcatactgcagttgtgtttgaagctggacaattaggtgctgatacacagtatggtcatgttgctttcgttgaaaaagttaatgacgacggttcaattgttatttctgaatcaaatgttaaaggattaggtgtcatttcattcagaactattgatgcagaagatgctcaagatttagattacattaaaggtaaatag

SEQ ID NO: 1525 - DNA, 684 bp, Staphylococcus epidermidis
cataaaggtcttagaagaagaaaaagacaatttctatatttattcaatagaaattgtcttttttataattgtataaagaaaaccatgcgctatgcgtatggttcagaaaaggttttaccgttatctaaaaaaacatctcatcatgctagaatatatattggtcagccaaccaaaatattcaacacgaggagatgcttttttatgtcatctgacacaaacagtttagcacatacaaaatggaattgtaagtatcacatagtctttgcaccaaaatatagaagacaagtgatatacggaaaaatcaaaagagatattggagttattttacgtcaactatgtgaaagaaaaggcgtagaaataatagaagcagaagcatctaaaaatcatattcatatgttagttagtattccacctaaattaggagtatcctcatttgttggatatttaaaaggtaaaagcagtttaatgatttttgatagacatgctaatttaaaatatagatatggaaatagaaagttttggtgtaaaggattttatgtagatacagtaggtagaaataaaaaggtaattgaaaattacattcgtaatcaattacaagaagagatcgttgcagatcaaatttcaatggaagaatacctagatccctttacaggagaagaaattaaaaaaagacgaaaaaaatag

SEQ ID NO: 1526 - DNA, 756 bp, Staphylococcus epidermidis
ataacaaaacaaacaaattttaaattatatctggaggatttatatatcatgaaaaaaacagttatcgcttctacattagcagtatctttaggaattgcaggttacggtttatcaggacatgaagcacacgcttcagaaactacaaacgttgataaagcacacttagtagatttagcacaacataatcctgaagaattaaatgctaaaccagttcaagctggtgcttacgatattcatttcgtagacaatggataccaatacaacttcacttcaaatggttctgaatggtcatggagctacgctgtagctggttcagatgctgattacacagaatcatcatcaaaccaagaagtaagtgcaaatacacaatctagtaacacaaatgtacaagctgtttcagctccaacttcttcagaaagtcgtagctacagcacatcaactacttcatactcagcaccaagccataactacagctctcacagtagttcagtaagattatcaaatggtaatactgctggttctgtaggttcatatgctgctgctcaaatggctgcacgtactggtgtatctgcttcaacatgggaacacatcattgctagagaatcaaatggtcaattacatgcacgtaatgcttcaggtgctgctggattattccaaactatgccaggttggggttcaactggttcagtaaatgatcaaatcaatgccgcttataaagcatataaagcacaaggtttatctgcttggggtatgtaa

SEQ ID NO: 1527 - DNA, 228 bp, Staphylococcus epidermidis
ctttattttaaatatatcggtgacagacatccactgaaaaacactagttatatttttaaaatgagagcttcaggaatttttctctatacaaataaaccgataaataaaataaatataatacctgatactgaaataattgtctctaataacgaccatgttaaaaatgtttctttaactgtcagcccgaaatattctttaaacatccagaatcctgcatcattgacgtga

SEQ ID NO: 1528 - DNA, 1101 bp, Staphylococcus epidermidis
agacttattaatggaggaatgactatgccagaatctaaagcgttacttaaatctttaacagatgttaatggtatttctggacatgaaatgcaagttaaatctttaatgaaagattatttaacacctgtgagcgatgatatcgttgaagaccaattaggtggtatttttggtaaaaagaatgctactcatggaactaaatctttaatgatttctggccatttagatgaaattggctttatcgttacacaaattgatgaacaaggatacatttatttcacgccaattggtggatggtggaatcaagtcatgttatctcaaaaagtgacgattactactgaaagtggcaaagagatacgtggaattattggttctaaacctccacacgccctctcgtcggaagaacgcaaaaaaccagttgatattaaaaatatgtacatcgatattggtgtgcgtaataaagaagaagcgaaagaagcgggaatcgaattaggtaatatgattacaccttatagcgaatttgaatcattagcgaatgataaatacttaactgctaaagcttttgataatcgctatggatgtgcactcgctgttgaagtacttcaacaactaaaagatgaaaacatagacatcaatttatatgccggtgcaactgtacaagaagaagtaggtttacgtggtgctaaagttgcagcaaatttgattaaacctgatttagcaattgcggtggacgtcggggttgcatacgatgttccaggtatgacgagtgaaaaaaatgaaggtaagttgggcgatggtccattagcaatattgatggatgccactagtatcgctcacgatggtttgcgcaaacatattaaagacgttgctgagcatcataatattccagtacagtgggcaacaacacctggtggtggtacagatgcaggtagcattcatgtagccaatgaaggtatcccaacgattacaatcggcgtgccattaagatatatgcactctaatgtatctgtgctcaacattgatgattatacaaattcagtgcgcttaattactgagattgttcgatcattaaatgatgacagttatcaagcacttatgtggtaa

SEQ ID NO: 1529 - DNA, 189 bp, Staphylococcus epidermidis
gttaaaattaaagtaactaatcttatattgaggtgtatcatgagaaaactgatatctaccattatcgtttcaacattattaattggaggatgttccacggtgcataaagaagcaaaacatacatcacaatcaattcctgaagaagttcccgcaagtcaatacaaaggtcaaggtttccacaaccagtag

SEQ ID NO: 1530 - DNA, 882 bp, Staphylococcus epidermidis
atggaaattaaacaaattaaatatttcgtagaagttgtacgacaaggtggtatgacgcaagcatctgaacacttatacattgcacagtcaacgattagcaaagcgattaaaaatattgaaaatgaatacgatattacattgtttgaccggtcacaaaaacaaataaaactaacagatataggtcaaacattttatgataatagtttagaatttttagctttattcgagaaattatctttagaaatgaatgacattgtgaacgttcaaaaaggtcatattaaaataggcttatcaccaatgatgaatgttcaaatgtttacaaatgcattgaatcagtttcacagactctatcctaatgtgacatatgaagtgattgagggtggtggtaaaattgttgagaacttaacatctaatgatgatgtggatattggtattactacattacctgtagatcacactgaatttcattcaacttctttatataatgaagaattattattagtagtaagtaatgaccatcatttagcacatttaaataaagtagacatggcagatttgaaagatgaagagtttgttttatttcatgatgattattatttaaaagatcaaattatagagaactgtaaaaggctaggctattaccctaaaactgttgctaatatttctcaaattagttttatcgctaatatgattcaacaaggaataggaattagtatcgttccagaaagtttagttaatttaatggggaataacgtaacgtccattcaattagagaatgttgaattatcatggcatcttggcgtgatatggagaaaagatgcttatctcaatcatgtaactcgcaaatggattgaatttatttctgagatgaaaccaacatag

SEQ ID NO: 1531 - DNA, 273 bp, Staphylococcus epidermidis
atgaagattaacatatttggatataatatcttcgccaagggcggaacatcaagaagtaatattaacttagtgaaaagcttattagaaattggacatgaggtacactactttaattatcaggactataataaaagtgatatcacaaaactaattatttacgaaggtttgagcacaaagcatcttcatattcatcaatttaatagtggaaaagaacttgctcatggagacctacttataattactagagaaacctttttaatcatgcatatctag

SEQ ID NO: 1532 - DNA, 912 bp, Staphylococcus epidermidis
agggggattaacatgtttgattcaattagagagacaatagattattcagttgaaaataacatcagttttgctgatatgatgattaatgatgaaatggaaagagaaggtaaatctcgcgaagaagtgcgtgatttaatgagacaaaacttaaatgttatgcgtgaggcagttgaaaaaggtacgactggcgacggtgtggaaagtgtaacaggttatacaggtcatgacgctgctaaacttcgagattacaacgagaataatcatgcattatcaggtcatgaaatgattgatgcagtcaaaggtgcagttgcaacgaacgaagtcaatgcagcaatgggtattatttgtgctactccgacagctggttcctcgggaacgattcccggcgtaatatttaaattagaaaaaactcataatatcactgaagatcaaatgatagattttctattcacatcagctttattcgggcgagtagttgcaaacaacgcaagcgttgccggtgcaactggtggttgtcaagccgaagtgggttcggcatctgcaatggctgcagctgctgcagtatcaatttttaacgggtcaccagaacaatcaggacatgccatggcattggcaattagtaacttattaggcttagtttgcgatccagttgctggtttagttgaaattccatgtgtaatgcgtaatgctattggttcaggaaatgcattaatatctgcagaccttgcactagctggagttgaaagtcaaattccagttgatgaagtcataggtgctatggatagagtaggtcgtaatttacctgcatcattaagagaaacaggtttaggcggtttagcaggtacacctactggcgaagaaattaaacgtaaaatattcggcgaagcagacaacatggttaaaaataaataa

SEQ ID NO: 1533 - DNA, 303 bp, Staphylococcus epidermidis
gagttgactaaaatgattataattaatgctaaattaaaaatcgatgctaataaacgcgaggattatctaaaacttatgaaagaattagtcataaattctagaaaagaagacggtaatttattctatcatcattacgaagatgtaactgagaaaaatgtctttgtcgtagttgaaaactataaagacgaacaagcggttcaagcacacaatcaatcagatcactttaaagtttttagtgataatattagtcaatatttaattgaagaacctcaaattgatgtaagtcaacctattcaattataa

SEQ ID NO: 1534 - DNA, 942 bp, Staphylococcus epidermidis
ttattttataaagtggtttattttgttgagttaaatatattagaatgtgagggagtatttgaattgaagaaattagcagtgatatgtgcgtttacaatattaatattagctggttgtggtcttggtgatagtgataataatggaagctcaacgataaatgatgatcaacaatcaggatataaaagtaacagagattcaaaatcaagtataagtagaaatcaaacagaagataatcagcaggacacacaacaagatacccattcgaatagatactatgctcaagtttggttaactgctttagatagttatagaggtgaaagtgaccttccttttgacgatttagaaattgtacatcaaaatatttctaataaagttttagatccctatcacccagacgaatcagccaaactacctgaaggaacagaattgttaacagcaagtgttactgcagcaggttcagtttattataaaagtaatggagatggcacaattacaatatatagtgtaccatcacatttccaagggagttggcgtgacgctgattactctaaaagagaatctcaacgcattatagatgatgctcgtacagttaagttatacaacgctagtgaaagtgaaatcaataagataagtcagatgatgaggactgaattttcagttggtgataatttaacagatgaagatgatacttctgaatctgaagatcaatcaagtagttctgatgaagtaacggtgacacgaagtaatgttatcgatatagttgaagactacgaagggcatcaattagatacagacacatatatttacaaagaaccagaaaaagatagcgatggtagttgggggttctcatttacagataaagaaggccatttagaaggatcttatattatcgataaagatggagaagtaacgaagtatgatgaagatggagagccagaataa

SEQ ID NO: 1535 - DNA, 240 bp, Staphylococcus epidermidis
attccatataaaggagtatatattttccgccactttttcaactcatatattctcaaattgatttatagtaatagtatgtatttctcttcattattatttagacatttacttcaaaacaatataattgaaataaaaaagagtctggacatccatctaccttgtgtccagactcttaatcatgctcatagtattttattgattcaatcatcatcttatttatatcttttcaaacctttttga

SEQ ID NO: 1536 - DNA, 687 bp, Staphylococcus epidermidis
tgtcgatataaggatgtgtttaaattgctacttaaggttgaacatcttacatacaaggttgataatcgtacgattttagatgatattaatttgaatattaataaaggagacacgattgctattgtaggtccttctggaagcggtaagagtactttactcaaacaattgaatcatttaattagtcccacgagtggagatttatatttgaatgatcaatcttactttaattataagccggaagagataagaacacgtgtgagttatttaatgcaacaaagtgagttaatcggttatacaattgaagataatatgaaatttcctgctgaggctagaagtgaagcttttgaccgtgataaagcgaaacaactcatctctcaagtaggattaggtaattatcagttagatgctcaaattgagcacatgtctgggggagagcaacaacgtattaccatcgctagacaactcatgtatgaacctgaagttttattattggacgaagctactagcgctttagatacacataataaaaagaaaattgaagaaattatatttaaactagcagataaagggattgccattttgtggattacgcatagtgatgaccaaagtatgcgtcattttaagcgtagaatcacaattactgacggtaagatatcgagtgatgaggagttgaatggtaatgagtaa

SEQ ID NO: 1537 - DNA, 318 bp, Staphylococcus epidermidis
ataacgtataaaagtttaagaatgctattattcattggaggtcctatcatggataaaataaacaaagaagataccgatactaaaaaagatagtaataacaactataaacatcaaaatgaccatatagatagacaaggtttaaatggttatcaaaaaactgatttagatcttgagatagaacgagaactacaggaaatgatggaaaatggagaatctaataaagaaacaaaaagtaagcatttcaaaatcttatctttcgtttcaatgattgtcattgtagtgatagccatcatacgattcatccaaaaaacgatataa

SEQ ID NO: 1538 - DNA, 297 bp, Staphylococcus epidermidis
caattaaataaagcctataagaataacttaatggctaaaacaaacaagtctgggacaaggatattttatgtcccagaccttctttatgtatatacagattcttatgagatgagtccaacacagagaatttccgaagaaattccacggacaaagcaagttggggttggggccccaacagagagaatttccgaagaaattccacggacaaagcaagttggggttggggagaagacaggggacaatgaattctatcctagtttagcgttcattttaataaggggaattttacaaagttga

SEQ ID NO: 1539 - DNA, 813 bp, Staphylococcus epidermidis
gggtggaataaagtgacgacaccaacaacgcataaatataatcgctatttaaataaaaggatgtctcttaaaactagcttttcaattattttaatcacgggtttgattatctggagttttatttatactggatttagcattggagatttaatgataggtctgccacaaattggcgtattcttcaaacaaatgatacctccagattggggttatctagatcatattacacaaccaatgctagacacgattcgtatggcaattgtcggtacttttctaggaagtattgtctccattcctatagcgttactgtgtgcgagtaatattgttcaaacaaagtggattgcgattccatcacgttttgtccttaatattgtacgcacaatacctgatttattattagctgccgtatttgtagccatatttggtattggacaaattccgggtgtattagcactttttgttctaacaatatgtatcattggtaaattattatatgaatcattagaaacaattgatccaggacctatggaagctatgacagctgtaggggctaataaagtgaaatggattgcatttggcgttgttcctcaagcaatttcatcatttatgtcatatgtgttatttgcctttgaaattaacattcgggcatcagcagttttaggtcttgttggcgcaggtggtattgggttgttctacgatcaaacgttaggattgtttcaatataaaaagacagcaatgattatcctgttcactctaatcattgtagttattattgactatgtgagttcgaaagtgagggaaaaattagcatga

SEQ ID NO: 1540 - DNA, 231 bp, Staphylococcus epidermidis
agaggtgataaggtgagtttttatcattttatacaaaatttcgttggtgatgaaacacctctaggtaaactagccacatgtattaaccaagatgaagatttacctatggaagaaacaacagcacataatatattaaactattttaatcagttaaattattttgatgacgattgtattgaagctgtaaaacgctcactatcactatatgaacaaagtaaagtagccctataa

SEQ ID NO: 1541 - DNA, 2637 bp, Staphylococcus epidermidis
aaaggagataacagtatgtctaaaagctacgctaaattttacaaatgtgctttgcaagttaacccatatagttacattaaatatagaggcctagaacatgaaatgacagaggaacaatataatgagtctatataccaatattgtaagaccaataatatatcaattattggtctagcagatcatggtaacgttgataactcgagtaaactcagacaatatttagtatctaaaggtatccttgtatttccaggttttgaaatttccacatcagaaaaagttcacattgtatgtttattttcagaaaataccgaagaacgagaattagagagatacttaggagaactaggattatcaaatcttgaagaaggtaattctccaagtactctaagttttcatgaaatcacacaaaaagtattagatagaggaggattttggtacgcagcacatgttaccagtgataatggcatcttgaaaggaaaacataacaatctctggcaatcagataaattaatagcagcacaaataccttcaaaaaaaaacgaagtagaccctaagtatactagtatacttaaaaataaagatcctaattatcaaaaacaaactccttttgctcttattaatgctaaagatattagtaaaccggaagatctagcgttagatacttcaagttgtttaattaaaatgtcaaagcttaattttgaaagctttaaattagcttttagagatcctgatgctagagttaaattaaactctgacattaataacaaatttccacattcttctattgataaaattaaaatttctatgggatacttggataacctctcgttagatttatcttcaaatcttaatactattattggtggtagaggaactggaaaatcaacacttatcgaattaattcgttatgcattagatatagctcctacgagtcaaaatacaaacacatcttttgaaaacatctgtaagtctaatttaggaatcggtggaaaagtagaattaattgtcacatcacatgcacaatatggtaaacaatttaagataataaaaagatataatgaagatcctataattaaagatatagacaacaatgtgtcaaattacacagttaaagatattctccctaatatagaggtctatagccaaaatgaaattatcgatttaactacaaatgaaaacgcaaaactaaacattttgaatcgatttttagataaagatgatagaagtaatgataaaaaagaagaaataaaaactaatttacattcaaattcaaaatctttaattaaagctaaagaagatcttgaaaatttacaagaaaagatcaatcaattacctaaattaaaagaaaagttaaaacatttcaatgaactaggtattggaaagaaattagaagtacagggtaaaatatctagagaagaacaatacatacagaatactaaacaaattattgaagacaatgatatttctataacaaatatcattttaccttttaacgaaaattataatcaacaaattaaacatgttgagatttttgatagtattaaaaatattacagacaatcataataaaaaattaaaagaaataaaatctatgtttactgacctaaaagatactacacaaaacgaaatagaaaaaatttataatgtttggaaagaaaagaaaaaaaatattgagaaggaaatcaatagagctattaaatccctagatgatatagaaggtaaaactaaagaagatatagcacatgaatacactgagactcaaaaacaaataacttctattgaaccattagaaacacaattatctcgagttaaaacatctattgaaacattagaaaatgaaaggatacaacttaaagaagatttaaaagaaatatttgatgaacaactaaaaaatcttaacagatgcgtaaaaaaaataaataatagatatttaaaaaaacaagtaaacattaaaattcaaccatatgcaaatgttaataatttaatagagttcctcaaagaggaaaacggattaggagattcaacattaaaatggataaaaaatcatcaaagctttaattttcctaagtttattaaattaattaaggatagagacagtgaagctatatacgaggaatataaagatagcggtttaaaaaaacacacagcagatattctttcaaatatgctctatgagagaattctaaagttggaatcaatagagctagaaaatattatagatatacgattgaatgttggaagtgacaaagatacgaaattccgatctctaaatcatttatccaaaggacaacagtgcactgctattttgaatctattaactttaagtaataatgatcctcttttagtagatcaaccagaagataatttagataattcttttataacaaacaatttagttgaaaatattcgtaaattaaaaattaatagacaatttatttttgctacacataacgctaacatacctgtatttggcgacgcagaattaatagtgacaatggaaaatgaaaacggtcaaggaagtgtaaacaatgaaaacttaggatccattgataatactttagtaagaaattctgtcatccaaattttagaaggtggagatgttgcttttaaaatgagaaaaaataagtatggtctttga

SEQ ID NO: 1542 - DNA, 1011 bp, Staphylococcus epidermidis
ggttcttgtaaaatgtcgcgttatgaacgtcaaacacgctttgcaccatttggagaagagggtcagcaaaagctatcctcctctcaaatacttatttttggcgctggtgctttaggaagccatattgtagatcaactcgcacgcatgggggctcatcatattgcaatcgtcgatatggatattgttgaaatttcaaatttacatcgacaaacactcttcgatgaagaagacgcacatactttaatatccaaagttgaagcaatcaagcataaggttaatcaaattaatataaatgtcaatctaacaacttatgatttagaagttacttcatcaaatatcgaaaatttgataaaaaatgtcgaaccagacatcatcattgatggcatggataacttcaaaatacgatacctgattaatgaggtttgtcacaagtatcaaatcccatgggtttatggtgcagctgttggtagtaaaggatcagtatatggaatagatcaccaaggaccatgtctaaaatgtttattgcaaacaattcctgacacaggggaaagttgcgctattaatggcgtaattccccctgttatatcaatgattgcaagctatgaagtagcagaggccgtacgttatctttcaggaaaaggattttcaaagcaattaatcactattgatgcatttaatatcaattataagtcaatgaatgtagatgcactcaaaaataaagattgcccagtgtgtgaaaaacatgaatatacgttactagaaagccaacaagaacgtactattgaggacttgtgtgggaatgcttatttatttagattcccacctaaagcttttaaacacgctgcccatttccctgggaatatggtgaaatctacttcctttgccaaattaattcaatatcaaacttatgaattcaccttgtttaaagatggtcgtatgaatgcatatggtatacacaatgatgaagaagcacatcacctatacaatacgttgttaaaatccatacgctaa

SEQ ID NO: 1543 - DNA, 948 bp, Staphylococcus epidermidis
ttaagatgtaatattagtaaagaaaggtgtatcatgataaaaataatcgccacaattatcgtttcaacactaatattaggaagttgttcgacaatgaatgaagaagaaaattatgcatcacaatcaattcccgcaagtcaatacaaaggtcaaggtttccaaccagtagctgaaaaaagtgctatcgcacacgcgaaaaaacatcgtgaagaatacgaaaaacttggcgaacaattttttaaagataattttagccttaatgttaaagccacaaatgttgtaggaagtggtgatggcgtcgaagtctacgttcattgcgatgatcatgacattgtgtttaatgcaagcatcctttttgataaggaagcaatacatgaagaaggctccatgcgaagcaatgataatggagatactatgagtgatatggtaggaactgtgttaagcggttttgagtatagagcaaataaggaaaaaatggataacttagaaaaatacctcaaagataaagaagataaatatcactatactggattcaccgatgaagcaataactaaaactcaaaatataggttatcaaaataattacttttacattactactagttccacgaaattacgagattatagaaaacattttgaacctttaattaaagaaagtaacgatgattttagaaagcatatgaaacaattaaagtctaaaaaagatacgtatcttaatacagaaataacaactacacttttcagtactcttgatgaatatgacgaaaaaatcattagaaaaaatagtatatccatggctaaagaaataagaaaagagccatctattccacataatttcacattccacttattatttagcaataacaaattaaaaatcaacgatccaaacataaataacaatcaaattaatgagtatggggtgttccaccatgacggatttaaaaattaa

SEQ ID NO: 1544 - DNA, 219 bp, Staphylococcus epidermidis
aacgtacgtaaatggttcatacaaccttcttttgtcatgatgacttggtcaaatgaatacttaattaatggtaagtttttaactgcagaagcaagtaaagtcgtaatgttatatggtttaattgatttgaataaatccaagttagaaccatgttttaggaatttaggtcccacgtttgcaaatggtccaaataataatgttctttcaccatcaatgtaa

SEQ ID NO: 1545 - DNA, 189 bp, Staphylococcus epidermidis
aatctgatcaaaatggaggttatacttttgaatattaaaaagcattggttaccaattgttgtagtcattcttgtagttgttatctttttattagttactttcgctagggcaaatgaaggtttagataattatgagcaacatgaattaaataatggtgaacagcaatatctttcaaaaggggcaagctaa

SEQ ID NO: 1546 - DNA, 1521 bp, Staphylococcus epidermidis
aaatttaacaaacttaacggaggtcgtttgatggaacttgtagataaattatcaaatcgtcaatatattgatggagaatgggttgaaagttcaaataaaaacacaagagatattataaatccttacaatcaagaaacaatcttcactgtagctgaaggaactaaagaagatgttgaaagagcaattttagctgctagaagatctttcgaagacggtgaatggtcacttgaaacaagtgaagtcagaggtaaaaaagtgagagccgttgctgataaaattaaagaaaatagagaagagttagctaaattagaaacattagacactggtaaaactttagaagaatcctatgctgatatggatgatattcataatgtgtttatgtattttgctggtttagctgataaagatggcggtgaaattatcaattcacctattcctaatgctgaaagtaaagtagttaaagaacctgtaggtgttgttactcaaattacaccttggaactatccattacttcaagcatcttggaaaattgcgccagctttagcaacaggttgctcattagttatgaaaccaagtgaaattactccgttaacaacaattcgtgtatttgaattgatggaggaagttggtttccctaaaggaacaattaatttagtacttggtgctggatcagaagtgggcgacgtgatgtcaggtcatgaagaagtcgatttagtttcatttacaggtggtattgaaacaggaaaacacatcatgaaacaagcagctaatcacgtgactgacgttgcattagaattaggcggcaaaaatcctaatattatttttgatgacgctgattttgaattagctgtagaccaagcacttaatggtggatatttccacgctggtcaagtgtgctctgctggttcaagaatcttagttcacaatgatattaaagataaattcgaaaaagctcttatcgatcgtgtaagcaaaatcaaattaggtaacggttttgatcaagatactgaaatgggaccagttatctcaacagcacaccgcgataaaattgaaggttatatggaagttgcgaaaaaagatggagcaacaattgcaattggtggtaaacgccctgaacgtgaagacttacaagccggattattctttgaacctactgtaattacagattgtgatacatcaatgcgtattgttcaagaggaagtctttggaccagttgtgactgtagaaggatttgctgacgaagaagaagctattcgcttagcaaatgattcaatttacggtttagcaggtgctatatttactaaagatattggtaaagcacaacgtgttgcaaataaattgaaacttggtacggtttggattaacgatttccatccatactttgcacaagcgccatggggcggttacaaacaatcaggtatcggtagagaattaggtaaagaaggattagaggaatatttagtaagtaaacacattcttacaaatactaatccagaaccagtggattggttcagtaaataa

SEQ ID NO: 1547 - DNA, 1389 bp, Staphylococcus epidermidis
ataataaacaagagaaagaaggggaatgcgatgtttggagagatttggccactcatcagtgttgtattaggaattattatcttattaacattaattattggattgaagcttaatacatttatttcattaatcattacctcaatgataacggcgttattattaggtatgccacttaacaaaattatggaaaccattgaaaatggtatgggtagtacgttaggtcatattgctttaatctttggcttaggtgcgatattaggtaaattattagccgatggtggtggggcaacacgtattgctgatacacttattgcaaagtttggtcagaaacatgttcaatgggctatgttgatagcagcatttatcgttggtattgcgctattttttgaagtaggtcttgtactattaatcccactcgtatttacagtagctaaacgcgcaaatgtatcaatattaaaattgggactaccaatggtcacagcgttatctgttacacacggattcttaccaccacatcctggacccgttgtcatcgctaaggagcttaaagcaaatataggtgaagttttgttatatggtatgattattgctatccctgtaacacttattgcaggtccaatctttaatcgatttgcacaaaagatggttccaacagcgtatacgagagaaggggatatttcttctttaggtactcaaaaggaatttaaagaagaagagatgcctggtttcggaataagtttattgactgctattttacctgttattcttatgttgatttctacaattgtgcaactgattacaggacacgaagaagcaacaaatgtattcgaacaaattgtttacttcataggaactgctggtactgcattgcttatcgcagtaatatttgcaatctttacaatgggaatgaagcaacaacgaaaaatggaagacattatgaaatcagttacgcatgctatttatccaatcggcatgatgttactcatcatcggtggtggtggtacatttaaacaagtgctcatcgatggtggcgtaggtgatacaatcgctaagatgtttgaaggaacaagcatgtcgcccattttattagcatggattgtagctgcagtcttaaggatttcattaggatcagctacagttgctgctgtatcaacaacaggcattgtgttaccacttttagagcattcagatgttaatgtagctttggtcgttcttgcaataggtgcaggtagcgtaattctctctcacgtcaatgatgcaggattctggatgtttaaagaatatttcgggctgacagttaaagaaacatttttaacatggtcgttattagagacaattatttcagtatcaggtattatatttattttatttatcggtttatttgtatag

SEQ ID NO: 1548 - DNA, 903 bp, Staphylococcus epidermidis
tatatgcgcaaagtattaattttcgcaattgcgggatttttagcacaacttgttgatgggtcattaggcatgggatttggcgcttcatcgtcatcaatattattaacttacggtatagcaccggcagtagtgtcagcaaccgttcatttttctgaaattgcaacaacagctgcatctgggacatcacattggagatttgataatgttcataaaccaacaatgttgaagttagctatacctgggtcaataagcgcctttatcggtgcaggtgttttgacatttattcatggtgattatattaaaccattcattgctttattcttgttaagtatgggattttatattttgtatcaatttctatttaaacgtgcacatgaacatcatcatcatgtgggaaatttgagtagttttaaagtaattccacaaggttttgtggcaggatttttagacgcaatcggtggtggtggttggggaccggttaatacgccgctcctgctttcaagtaaaaaaattcaaccacgatatgcgattggaacagtctcagcaagtgaattttttgttacgtcatctgccgctttaagtttcattatctttttaggagtcactcaaattaattggtttgctgtaattgctttaagtctcggtggaatggtagcagcacctatttcagcgtatttagttaaagtgttacccattaacattcttgcaatttgtgtcggtggtttaattatttttacaaatagtaatgcattattaagctattttgtaaaagataacactatttcaaatacagttcgattcattattattcttgcaattattattttgcttgtttttcaagtcgttcgaaacaagaaattgtctttttcttataagaaaagccgagtaaacaaatataattaa

SEQ ID NO: 1549 - DNA, 1542 bp, Staphylococcus epidermidis
ctggaaagcaatatgataactactacacaagaggtgaacattatggctatgtctgacaaaaaagacgtcgtgttaatcggtgctggtgtactaagtactacatttggttctatgttgaaaacgattgcacctgattgggacattcatttatatgaacgtctagatcgtcctggtattgaaagttcaaatgaacgtaacaatgcaggaacaggacatgcagctttatgtgaattgaactatactgtacaacaacctgatggttcaattgatattgaaaaagctaaagaaattaatgaacaatttgaaatttctaaacaattctggggtcatttagttaaatcaggagaaattcaaaatcctaaagaatttattaatccattacctcatattagttttgttcgtggtaaaaataacgttaaattcttaaaagatcgttatgaagcgatgaagcaattccctatgttcgataatatcgaatatactgaagatattgaagaaatgagaaaatggattccattaatgatgaaaggccgtgaagataagggctacatggcagcgagtaaaatagacgaaggaactgacgtaaactacggtgaattaactcgtaaaatggctcaaaatcttaaaaactcaccaaacgttgaagtgcaatacaaacatgaagttgttgattttgaacgtttgtctaatggtaaatggtcagttaaaattaaaaatctaaataatggacaagtattcgaacatcaaactgattatgtgtttatcggtgctggtggtggcgcaattccattattacaaaaaactggcattccagaaagtaaacatttaggtggattcccaatcagtggtcaatttattgcttgtacaaatccgcaagttattgaacaacacgatgccaaagtttatggtaaagaaccacctggtacaccaccaatgacggtacctcacttagatacacgttacattgatggtgaaagaacattattatttggaccatttgcaaacgtgggacctaaattcctaaaacatggttctaacttggatttattcaaatcaattaaaccatataacattacgactttacttgcttctgcagttaaaaacttaccattaattaagtattcatttgaccaagtcatcatgacaaaagaaggttgtatgaaccatttacgtacgttctatcctgaagcacgtgatgaagattggcaagtttatacagctggtaaacgtgtacaagttattaaagatactgaagagaatggtaaaggatttatccaatttggtactgaagtggttaattctgaagaccactcagttattgcattactaggcgaatcaccaggagcatcaacttcagtatcagtagcactagaagttttagagaaaaacttccctgaatacgcgaaagactgggaacctaaaatcaagaaaatgattccttcatatggtgaatcacttattgatgatgttcaattaatgagaaaaatacgtaaacaaacatctaaagatcttgaattaggattctataataaagcaaaataa

SEQ ID NO: 1550 - DNA, 1056 bp, Staphylococcus epidermidis
tataatttaaaagattacaaaatatttattataggagggttttatatgcattgtccgaattgcggtaatccaatagaagatgatgatttattctgtggtgaatgtggacataaaataagtcgacatccacagtcagtcagaaatgcagaaagtgaaataacaaaagctgaaaagaatgatgaagaacaaaacataacatcaaataataaagaaaacaacgcagcgactcatcaaaatgttgattcaacatctcatgatgagactagatcaaatgaaaatgacgtagcagattcaacattacaatctaagcagtcacataatgatacccaacaatcaaatctctctacataccatcaaagacctcaacatcgagaaattcctcaaaatcaacacaatcacgatcaacagcaaagtcaaataggtcaacaagctaaacaagtaacaaatgaaagtaaaggtttctttaaaagtgcatttactgcacctgataaaatcattcaaactaatcatgttttcagttttaaattattattatcattattaataatcggttttattgtattagcaattttactcgcttccgtaataccagttgagattggtattttcggtactacaagaggaagtttggtaacgagtatcatttttggtattattctatttttggttgtcatagtaggtgcaatatttgggcttacacgtttagtagttagacaacctattgcatttaaaaaagtattatcagactatgtgttaattaatagtgtttcgttagcaattttaattatttctgtaattttaatattagcagaatcatacagctttggcggaagtatagcattattgtctttattattatttattgcttctggtatttatctaattgcgaagtatagcactggtaatcaaacaagaatatccagcttttatggtgtgattatttatatcattattttgttcttatttattcgtatttttggggaggcatttttccatcaaatatttggtgattttatagaagaactaggggatttatttgaaggaggaacttattaa

SEQ ID NO: 1551 - DNA, 1482 bp, Staphylococcus epidermidis
tgcaatttaaatttaaaactgatctttcagggaatacttctaatggaggtgtttaacatgacaaatcaattatttattaacaatgaatttatagaaagtcagtctaaagagacaatggatgtcattaatccagctactggcgaggcatttgatactatcactcttgcaactgaagaggaagtaaacgacgccattgaaaaatcgcaacaagcacaacttgaatgggagcgcgtgcctcaacctacacgtgcggaacatgttaaattacttatacctttattagaaaaaaatcgcgatgaaatagctcaattatacgtaaaagaacaaggtaaaactttagcgcaagcttatggagaaattgacaaatcaatctcatttatcgattatatgacaagtctgagtatgtcagataaaggacgtgttctacaaaatagtattgcaaatgaaacgattcaaattatcaacaaacctatcggagttactgctggtattgtgccatggaacgcaccgatacttgtccttatgcgaaaagtcattccagctatagtaactggttgttcagtagtgattaaacctagtgaagagacaacgttactcactcttcgattagctgaattattcagagcatcaactataccagcaggattgtttcaaattgttcctggcactggagaaacagtaggtacacaattagcttcgcataaagacattcaacttatttctttaactggaagtatgagagctggtaaatctgtttacgaaaatgctgctcaaactgtaaagaaagtaaatttagaattaggtggaaacgcaccagtcattgtcacatcaaatgccgatttagataaagcagttaactatatcgtgacagcccgtataaataatgcaggtcaagtttgtacgtgccctgaacgtatctttgtacatgaagatgttcacgatgactttttaaataaagtaacttccaaaatgaaaagcttaactgttggagatccatttgatgaaaacaccgattacggcgcaattattaaccaaaaacaacttgatagtattcatgaaaaggttcaagatgctattaaaaatggcgcaacattgatgactggtggacatcaattaaaacgccatggtttcttctacgcaccaacggtattagataacgttagaaaagactataatgtctttaaagatgaaatttttggtcctgttcttgcgataacaacataccgcgattttgaacaagtgattgaagacgctaatgatacaaacgctggcttatcttcttatatcttctctgaaaatttaacagaagtaatgacagcaaccgaacgtctaaaatttggtgaagtatatgcaaattgtgaggctgaagaagtcgttaatggctatcacgcaggttggcgtgaatcaggcttaggtggcgctgacggtattcacggttttgaagagtactacaataccacagtaagttatatcagatactaa

SEQ ID NO: 1552 - DNA, 834 bp, Staphylococcus epidermidis
atgaaattaaagcgtggatttcaaaaaaataagacgcccgggcgtctagaaatgaataaagttattgaaagtgacgtaacgttatcgagtatgctttggctaggaggtgagaagtctatgtcgatttatacttcaggagatatagctcataaatgccatgtgtcaacacgcactattcagtactacgataaacaaggaatcttatcgccaaactatacttctgaaactaacagacgtttttacactgataaggaagtggagaaacttgaactgattttactacttaaggaaataggttgcacaattaaagaaattaaagtgttattaaaagatgattcatcaatgaaatctctttacacgtttcttcaaatcaaaaagcatgagatacaacagtcaataacagataaagaacacaaggtatgtaaaatagagcaaattcaacgctatgttcatcaaaattcaatttctccaattcattatttacaagatataactacttatatggaagaatctcatagactcaaaggtgtcagaaagaaattatggttaagtatagctctgattgggtcattacaatatggtggtttgatcatctcaattgtaactcgaaggaaaaagcctttcttgtcgatgatgcctgtggtagctatgtattcactttggttaacaaaaaagtataaaaagaatgtttcatatgtctgccctaattgccatcatgtgtttaatcctagtgtcattcattttgtaacagcatcacatacacctaaaactagaaagcttcaatgtcctgattgtcacgaaatgcattactgtatagaaattgctaagcaatga

SEQ ID NO: 1553 - DNA, 1773 bp, Staphylococcus epidermidis
aaagagataaaagatatcaaagagacgtgtattaatagaagggacgggggatacatggttaatacaaataatcatatttcggaagaattagataaaaatcttgatgaaatggaatttttaaaagcaaatagtgactttttgcgtggaactattgaacaaagtttagctaatccaatcactggatccattacacaagatgatgcaaaactgctaaagtttcacggaagttatatgcaagatgacagggatttaagagatgagcgtcgtaaacaaaaacttgagcctgcatatagttttatgattcgagttcgtgtacctggggggaaagcgactcctgaacagtggattgctatggatgatatctctaatcaatatgcaaatcatacgattaaattaacaacacgccaagcatttcaatttcatggaattcttaaacgtaatttgaaacaatcaatgaaaaatattaatcatgcagtacttgattctattgctgcatgtggagatgttaatcgtaatacgatgtgcaatcctaatccttatcaatctcaagtacataaggagattaatgattatgcaacgcgtataagtaatcacttacttccaagaacaaatgcatatcatgaaatttggcttgatggtgaaaaggttttagattcgagtgaggaaaaggaacctatttatgggaatacgtatttaccacgtaaattcaaaataggtattgcagtaccaccatctaatgatattgacgtctattctcaagatattggtttaatcgctatcgttgaacaagatgagttaattggatttaatgtgactatcggtggcggtatgggtatgactcatggtaatactgaaacatatcctcaacttggacgtctcataggttttatacctaaggaaaaggttgtagatgtatgtgagaaaatacttacaatacaacgtgattatggtaatcgtgaaaatcgaaaaaatgcacgttttaaatatacagtggaccgtctaggagaaacttgggtgactgaagaattaaaccgacgattaggttgggaaattaaagcgccacgtgatttcgaatttgaacataatggtgatcgattaggttggattgaaggtattaataattggaatttcactttatttatacaaaatgggcgtgtgaaagatactgaagactatttgttaaaaacagccttaagagaaatcgcagaaatccatactggagatttcagattatcacctaatcagaacttagttattgcaaatgtttctcctgagaaaaaggaagaaatacaagctattattgataaatataaattaacagatggcaaaaattatacaggacttagaagaaattctatggcttgtgttgctttcccaacgtgtggtttagctatggcagaatctgaaagatatcttccttcactaattacaaaaattgaagatttattagatgagtctggtttaaaagaggaagaaataacgattcgtatgacaggttgtcccaatggatgtgcgagaccagcgctagcagaaatagcctttatcggtaaagcacctggtaaatataatatgtacttaggtggtagttttaaaggcgaacgtctaaataaaatatataaagagaatatcgacgaaaatgagatattagaaagtctacgtccattgttgttgcgttatagtaaagagcgtcttgacggagaacactttggggactttgtaattcgtgacggtgtgatagccaaagttcatgatggtcgcgattttcatagttaa

SEQ ID NO: 1554 - DNA, 600 bp, Staphylococcus epidermidis
tttaaagtaaagattcataaattaatattagggggatcacatttgaaaaaggaaaaagttatggactggacgaccttcataggcgtagtcattgtgttactttttgctgttatacctatgatggtttttccgaaagcaagtgaaataatcattaccgatatcaatagtgccatttctaattcaattggatcggtatatctctttatgggactggctatattttgttttgttttatacatagcatttggtaagtatgggaatgtcacgttaggaaaagcgactgacaaacctgaatttaataatttcacatgggcagccatgttattctgtgccggtattggttcagatattttatattggggtgttattgagtgggcattttattatcaagtacctcctaacggtgcaaaatcaatgtccgatcaagcacttcaatatgcaactcaatatggtatgtttcactggggacctatagcctgggcaatatatgtgctaccagctttgccaatcggttatttagttttcgttaagaagaaacccgtctataaaattagtcaagcttgtcgaccaattttaaaaggacatacggataaattatga

SEQ ID NO: 1555 - DNA, 1674 bp, Staphylococcus epidermidis
aagaaatcaaaggtggaattatatatgaaacaacgcgtaggacaatatttaatggacgcggtttattcagcaggtgctgacaaagtttttggtgtcccaggagattttaatctagcctttttagacgatattattgcacataatgatattaaatggattggtaatacaaatgagcttaatgcaagttatgctgccgacggatatgcacgtattaatggcatcggtgcaatggtaacaacatttggagtgggtgaattaagtgctgtcaacggaatcgctggatcttatgctgagcgtgtgccagttattgccatcactggggcacctactcgagctgtagaacaagaaggcaaatacgttcaccattcccttggcgaaggaacttttgatgattatagaaaaatgtttgagcctattacaacagcgcaagcttatattacacctgataatgctaccacagaaattccaagagtaatcaatacggcgcttcaacaacgtcgtccagttcacattcatttacctattgatgtcgcactaacagagattgaaatttcaaacccattcaaaccagaagtcgaaccacaaaaaaacgttcaaagttatatcaatatggttcaagacaaacttgaatcggcatcacaacctgtcattattacaggacatgaaataaatagtttccatctgcataaagaactcgaacaattcgttaatcaaactcaaattccagttgttcagttatctttaggtaaaggtgcatttaatgaagaaaatccttattatatgggtatctttgatggttcaatagcagaacaagatattcaagattatgttaatcaaagtgatgctattttgaatattggtgctaaattaacagattctgcaacagctgggttctcatatcaatttgatattaatgaagtgattatgctaaatcataatgaatttaaaattaatgatacatgcatcgaagcattttcattaccaaatatattaaatggtttaaataagtatattcactacaaaaacactaatgatttcccacaatatgagagaccacaatcacacaattacgaacttagtgatcagccattaactcaagagacttatttcaatatgatgcaagattttttacaacaagatgatattttaatcgctgaacaaggtacatcattctttggtgcttatgacttagccttgtacaaagataatacttttatcgggcaaccattatggggatctatcggctatacactaccagcaacgctaggaacacaaattgcaaatccatatcgtctaaacattctattaattggtgatggatcactacaattaactgttcaatcattatctacaatgattcgtcaaaatttaaaccctgtgatatttgtaattaataacgatggttatacagttgagagaatgattcatggtatgaaagaaccttacaatgacattcgcatgtgggattacaaatcattaccttctgtatttggtggtgacaatgttttagttcatgatgtaaacacttcagaagaactcatgctcaccttcgaaaatattaaatctaatagtgatcgcatgcactttgtagaagtgaaaatggctgttgaagatgcaccagttaaattaagtaatatagctaaagcattcgcatcacaaaacaaatcatcttaa

SEQ ID NO: 1556 - DNA, 1113 bp, Staphylococcus epidermidis
cgcatgacaaatcaaaaaactgtgggtctagtcgtcgctccaggtgttactgaacgccttgcagaaaatctcatacaagaaatgcctaaaatgttatctacacattatgatcatcagcaagaatggatttttgatttagttacggatccgcttactggttttgctgaatctgtagatgaaatttttgggaaagtagccgattatcacgataagagacaatgggattatgtgatagcaattacagatttaccgatgtttgcggacaagcaagtgatggcattagatattaatatggaaaatggtgcagctatattctcatatccggcatttggctggcgtccagttaaaaaacgtttcaagcatgcgatttataatattattcaagaattaaatgaagctgaacaagaaagtcgtaattatgataataataagcaaatagaaaattcagtaaaaaaacaatttccgctctctaaaatagataaagaaacaatatatatgaaagaaacagactcttatcacttaagatatttatcaagttcacgttctagaggcatgtttcgccttgttagtggaatgacctttgcgaataatccattaaatatgatggcaagtttaagtaatatagtagctattgcatttactacaggtgcatttggacttgtatttacaacgatgtggcaaatggcttataacttttcaatgtggcgcttatttggaatttcaattattgcgattattggaatgctaatatggataatgatgtcacatgatttatgggagccagttaataaaagcaaccataagcatattacttggttatacaatcttacaacaataatgacattgatttttgccattataatttattatattattctttatttactattcttaattgctgaaatcgtattattgccatcaggattcttaggtcagcaagttggattgaaaggtcctgcaggcattgatttgtatttaagtattccatggtttgcagcttcaatttctacagttgcaggtgcaataggtgctggtttacttaatgatgaactcattaaagaaagcacatatggatatcgtcagcgtgtaagatacgaagaacaacgtcgataa

SEQ ID NO: 1557 - DNA, 1890 bp, Staphylococcus epidermidis
acaatgacaaatatcggaataacaaagtataagaggtggataagattgaacttaagtgttaccaatagtccttttacggaagggcaagctaaacaaatcaatgaattgcttcacactttatcacctaaccaacaagtatggttaagtggctatctgatggcaaatcaacaatcaaatacatctacagattctgtagaacaacataacttagatgacaatacagaagcgatgctacatgaaaaggaaccttcagttgagccggaagctagatcgataacaattttatatggatctgaatctggtaatgcgcaaggacttgcagaaatatttgaacaacgtttatctgatattggaaatgacgttacgctcaaatcaatggatgactttaaacctaagaatttgaagaaagtagaagatctatttattatcacatctacacatggcgaaggagatccaccagataacgctgttgaattacatgaatacatccacggacgtaaagcgccaaaattggatggggtgagattttcagtattagcattaggagatcaaacctatgaattcttctgtcaaactggtaaagattttgataaccgtttggctgaattaggggcagaaagactttatcatcgtactgattgcgatgttgattatgaagaagacgctgaaaagtggatggccaatgttattaatacgattgattcaacaccagctggtactgaaagtgaacaagttgttagcgaatctataaaatcagcaaaagaaaagaaatatagtaagtctaatccttacgatgctgaagtattgaccaatattaatttgaatggtagaggttcagacaaagagacgagacacattgagttattacttgataattttggtgaagaatatgaaccaggagattgtgtagttgtcttgcctcaaaatgatccagctatcgtagacttacttattagcacattaggctggagtccagaaacacaagttttaattaacgaggatggagatactttaaatcttgaagaggcattaacatcgcattttgaaattactaaattaacaaaaccgttaatagaaaatgctgcgatattttttgataatgaagagctttctgaaaaaattcaagataaagaatggattcaaaactacgttgagggaagggatttgattgacttattaaatgacttcgcaacgacagaactacaacctgaaaatttacatcaattattaagaaagttaccacctagagagtactcaatatctagtagttataaagcaacaccagatgaagttcacattactgttggagcagttagatatcaagcacacggtcgggaacgttcaggtgtttgttcagtacaatttgcagagagaatacaagagggcgatacaattcctatctatttaaaacgaaatccgaattttaagtttccgcaagatgaatcaacacctgtgattatgataggtcctgggacaggtgttgcaccgtttagatcctatatgcaagaacgagaggaactaggttttgaaggaaatacatggttattctttggagatcaacacttcactacagattttctgtatcaaacggaatggcaagaatggcttgaagatggaactttatcaaaattagatgttgctttttctagagatactgataaaaaagtgtatgtgcaacataaaattgtagaaaatagtgaacaatttaatcgatggattgaaaatggcgctactatttatgtatgtggtgatgaaagtaaaatggcaaaggatgttcatcaagcgattaaaaatgtgttaatcaaagagcaaaacctatctgaaacagatgcagaagaatacttaaaacaaatgaaaagagataaaagatatcaaagagacgtgtattaa

SEQ ID NO: 1558 - DNA, 597 bp, Staphylococcus epidermidis
aggtcgacaaaaagagatatgtgcaagagtgaaacacatgaaggcacttcgttcatgaatattttaaacattaaagaaggtcaacactatatagctaaaatagaaagtcatagctttgtagatggtgaaggtgttcgatgcagtgtatatgtttccggatgtccttttcaatgtaaaggttgttataacgttaaagcccaaaattttaaatacggagaacctttcgaacttgaaatgcttgaagagattttagattattgtgcgccttcttatatcgaaggcttaagcatacttggtggagaaccattttgtaatttgtttatcacactccaacttgttgaagcttttagacaacgattcggtcatacaaaaacaatttgggtatggactggctttttatttgaatatttgaaacagcaagacgatgcgcgcaagtcattactcgaacatattgatgtattagttgatggtatgtttattcaacatttatatcgtccgaatcttccatataaaggatcacttaatcaacgggtttggtgcattgatgttcaatcttccttacaaaaagaacaggtcattgaatatctaactaaatag

SEQ ID NO: 1559 - DNA, 255 bp, Staphylococcus epidermidis
aaaaaagcaaatgaagcaacaaatttcaaagccaaaattgaagtcgtttcaacattattcagtactaaatctgatttcactaaaaataactctaagaaagatttattattcttaagtgatgatttatatcattacaaagaaaaacctgaaaacacaaacataactttacaattaagtgagccaaaaattaattctacacgcgcattttatgatgctaataacccattagaatatggagtgcataaacatgagtaa

SEQ ID NO: 1560 - DNA, 696 bp, Staphylococcus epidermidis
tgtatggcaaaagttaaagagaaagttgcagtcgttacaggtgcgagtagcggtataggagaggcgattgccaacaagttaagtcaacaaggtgcatcaatagttctggttggtcgtaacgaacaacgcttaaacgaaatagtccagcaattaaataacccggctaaagttgttacagcggatgtcactgtaaaatcgaacatagatgatatgttaaaagctgtaatagaccattttggtcatatcgatattgttgtgaatagcgcaggtcaaagtttatcatctaaaattacagactataatgttgagcagtgggatactatgatagatgtaaatattaaaggtacactccatgttttacaagcgacattgccttatttgttaaaacaatctagtgggcatatcatcaatcttgcatcagtatcaggatttgaaccgacaaagacgaacgccgtttatggtgcgacaaaagcagcaatacatgcaatcacacagtctcttgaaaaagaattagcacgtacaggcgttaaagtgactagtatttcaccaggaatggttgatacccctatgacggaagggactgattttggggaacgcaaaaaacttgaagcacagaatattgctgatgctgtagtatatgctttaacacaacctagtcacgttaatgttaatgaagtaacgataagacctgtttaa

SEQ ID NO: 1561 - DNA, 447 bp, Staphylococcus epidermidis
atgtctaaaaataaaaatgattacgaacatatgctgttttacttcgcgtataagacttttattactacagcggatgaaattattgagcaatatggcatgagtcgccaacatcatcgattcttatttttcattaataaattaccgggtataacaattaaagaacttttgattacgcttgaaatatctaaacaaggatcgcatgcaacgttacgtaaattaaaagaagaaggtttaatcgtcgaacaaacatctaagcaggatagacgagtaaaaaaactttttaccactgaagcgggtgatgatttaataggtaagttaaaccaagcacaagatgaattaattcaacagacactacaaaaagtaggccatgattggtacgcgatgatggaagaactagctaattatcgtgaaggattcaaaacaattgaacatttgaaagaagattaa

SEQ ID NO: 1562 - DNA, 753 bp, Staphylococcus epidermidis
tttgataaaaaaattcttccatatgggggacatggatggaaacaattgggtggcataaaaggtcgtaaagaaacgaatttccctcaagattggacaatattctactggtcatggtggctcgtttatgcaccgtttattggattgtttatcgcgcgtatctcaaaaggacgtacacttaaagaagttgtattaggaacaatatgctatggaacattaggttgtgtgttatttttcggtatttttggtaactatgctgtatatctacaaattactgagcaatttaatgtaataagctatttaaacaattatggtacagaggcaacaatcatagaaataatgcatcaactaccattctcgacaattactattatcttattcttaatatcagctttcttattcttagcaacaacattcgattctggttcatatattttagcagcagcgtcacagaaaaaagtgataggagaaccgttacgtgctaatcgtttgttctgggcgtttgcgttatgtttactaccgttctctttaatgctagttggaggagaacgtgcattagaagtattgaaaacagcatcattacttgctagtgtacctttaattgttatatttacgctaatgatgatttcgttcttaattatactcggacgagatcgtatcaagttagaaagacgtgcagataagcataaagaaattgaaagacgttctctaagaatagttcaggtcaaagacaaacctgaagacgataacttataa

SEQ ID NO: 1563 - DNA, 927 bp, Staphylococcus epidermidis
aatatgaaaaaattttggggaattttattaattgtgatgtcaattgctcttgtgggatgttcgaatagcaatgattcagatcaatcttctaatgaaaagtcatcatcaaaaagttcggagaaaaaaacggatgtggcgactgaatatacaaaagaggacgaatataaagaactagaaaaagaagctaaggatcttaaacaaaagccagttcttaatgaaatcgatgcacttattacagaaaaaggttttacaaacaaaacgggattgcaaggctgggaagactataaaaaattagtggataaggtaacacttgcagattataaatacacaaaagaatctaaagggtcatctatagaagaagttaataagttctttaaagataaaaaaggtgtagagattaaacgaatgaaaagtaaggaaaaaaatattaagcatatcaattatatgtatgtagatccagatggtaaaaaaacaggtgaaaataagcaacctatgtcctacgctcaaatacttgcaacatttaaagaaggtaaattagtagctacaaatattcaacctggattttttgctttagacaaaaagaaaatggttaaagctaaagacttagaaaaagttaagacattggaagatttaacgcgtttgaaagatcctaaagcgacatcatatggtattttacagacgaaatataaagggaaaccatacactcaagtttcaatattaggcagtgattctgatgaagagaatgatatttcctcagccatcttagcttattatctattttcaccaacggaattagatagtgacgataatcataaatacgttgaagttgcatcagcgccattcttaagtgctcaaaacgatttttcatcttatcaactaggcgtatttaaaaaaattatcgaaagtagtatgtcgttcgatgaataa

SEQ ID NO: 1564 - DNA, 933 bp, Staphylococcus epidermidis
gacaaagaaaaatgtaggatacagggtttgagacatatgaagtttgcatatattcaatcgattcgtaatgagatttcaattattttaataattctattattttttgcacttatattttatgtgttttctttaccttttgatgcatacgtactagcaatcagtataatattactattgatgtgtgtacgttggtggataaagtatttaagttttaaaaagaatgaacatcttaaagataaagtagcatatttagaacatgagttagcacatgttaagaatcagcaaattgaatatcgtaacgatgttgaaagttattttttaacatgggtacatcaaattaaaacacctatcactgcctcacaattacttttggagagaaacgaggagaatgtagttaatcgtgttcgacaagaaattgtgcacattgataattatacaagtctcgcattaagttatttaaaattattaaatgaagagtcagatatgacaattaccaaagtgacagttgatgatttgattcgcccgttgattttaaaatatagaattcagtttattgaacaaaagacgcaaatccattatgaaaaaagtgaggacattattttaaccgatgcacaatgggcttctataatgatagagcaacttttaaataatgctttaaaatatgctaaaggtaaagatatttggatagattttgatgttgccaatcaaactctacagattaaagataatggtattgggattagtaaagcagatattcctaaaatttttgataaaggatactcaggatttaacggtagattgaatgaacaatcaactggtataggtctatttatagtgcaacacattgcaaatcatttaaatatacaagtaactgtacaatcagagttgaatcatgggacagtattttttatacattttactaaagaaaaataa

SEQ ID NO: 1565 - DNA, 1665 bp, Staphylococcus epidermidis
atggcggaaaaacaatattctgcagcacaaatggtaattgatactttaaaaaataatggagttgagtatgtatttggtattccaggtgcgaaaatcgactacttatttaatgcactagaggatgacgatattgaattagtcgttacgcgtcatgaacaaaacgcagcgatgattgcacaaggtattggtcgtttaacaggaaaaccaggtgtggctattactacaagtggcccaggggtaagtaacttaactactggtttattaactgcaacttctgaaggtgaccctgtattagctatcggtggtcaagttaaaagaaatgacttattacgtttaacacatcaaagtattgataacgcatcattacttagatcctcaactaaatatagtgcagaagtacaagatccagaatcactatcagaggttattacgaatgcaatgcgtacagccacttcaggtaaaaatggagcgagctttatcagtattccacaagatgttatttcatcacctgtcaaagctgatgcaatttcattatgtcaaaaaccacatcttggtgtaccttcagaacaagaaattaatgaagtgattgaggctattaaaaattctaaattcccagtattattagctggaatgagaagttcaagccaagctgaaacagaagctattcgccgtttagttcaaaaaacaaatttacctgttgttgaaacattccaaggtgccggcgtaattagtcgcgaattagaaaatcacttcttcggtcgtgttggtttatttagaaaccaagtgggtgacgaattacttagaaaaagtgatttagttatcacaatcggttatgaccctattgaatatgaagcaagtaactggaataaagaattagatactaaaatcatcaatgtcgatgaagaacatgctgaaatcactaattacatgcaaccagttaaagagttaatcggaaacattgcaggtacaatagatatgatttctgaacatgtaaatgaaccatttattaatcaagatcatttagatgaacttgaaaaattaagaggcgaaatcacagaagcaactggaattaaagcaactcacaaagaaggtgtgatgcacccagttgaaatcattgaaacaatgcaaaaagttttaactgatgatactactgtaactgtagatgtgggaagccattacatttggatggctcgtaaatacagaagttacaatcctagacatttactatttagtaacggtatgcaaactctaggtgttgcacttccatgggctatttcagctgcacttgtacgtccaaatacacaagttgtttctgtagctggagacggtggtttcctattctcaggacaagaattagaaactgcagtacgtaaaaacttaaatatcattcaattaatttggaatgatggtcgttataacatggttgaattccaagaagaaatgaaatataaacgctcttcaggtgtagaatttggaccagttgattatgtaaaatatgcagaatcatttggcgctaaaggattacgtgtgactaatcaagaagaattagaggcagcacttaaagagggttacgaaactgatggaccagtattaattgatatcccagttaactatgcagataatgttaaattatctacaaatatgttaccaaatgctttaaattaa

SEQ ID NO: 1566 - DNA, 1206 bp, Staphylococcus epidermidis
ttaattggaaaaggagatttgattataatgtctaacaatgaaacaataaccaattatacaattaaacctcatggaggagaactcatcaatcgtgttgttgaaggaaacgaacgtgaacgtttgattgaggaagcattaaaatttaaaccgattactttaaatccttggggaatatcggatctagagctcataggtattggcggatttagtccccttacaggatttatgaacaaggaagactacactaaggttatagaggaaacacatttaagcaatggcttagtttggagtattcctatcactttacctgtaacagaatccgaagcagataaacttgaaataggtgatgatattgctttatatggtgaagatggtcagttatatggaacgcttaaattagaagaaaagtacacatatgataaagaaaaagaagcgcgtttggtgtacggaactactgaagaagctcatcctggagttaaaaaggtttatgaaaaaggtaatatatatttaggtggtcctattaaactattaaatcgtccaaaacatgacgcgttttcaaattatcatctggatccttcagagacgagacaattatttcatgatttaggttggaaaactgtcgtaggttttcaaacgagaaatccagtgcatcgagcacatgaatatattcaaaaatcagcactagaaattgttgatggtctacttttaaatccactagttggtgaaacaaagtcagacgatattccagcggatgtacgtatggaaagttatgaagtgatattaaaaaactattatcctgaagatagagcacgtctagtcatttatcctgctgcaatgcgctatgccggaccacgtgaagcgatacttcatgcaactgtccgtaaaaattatggttgtacacattttattgtgggaagagatcacgctggggtaggcgattattatggtacttatgaagcacaagagctgattactcaatttgaagatgagttaggtattcaaattttaaaatttgaacatgccttttattgcgaagcttgtggtaatatggcaactgctaaaacatgtccgcatgacgcttctcaacatttacatttaagtggtactaaagtaagagaaaaactgcgtaatggcgaatcattgccaactaaattttcaagaccagaagttgccgaagttctaattaaaggtttgcgagaaaaataa

SEQ ID NO: 1567 - DNA, 696 bp, Staphylococcus epidermidis
ggagagtgtttaatgatggctaaaagctatgattatcaaagtgctttcgatattattggaccagtaatgatgggaccttcaagttctcatacagcaggtgcagtaaaaattggtaattcagcgagagctgtgttaggagatatgcctaagcatatagaaattcgttattatgaatcttttgctaaaacgcatcaagggcatggtacagacgttgctattgtcggtggtgctatgggctacagcactttcgatagtagaattaaatcatccttagacatagcaaaagatgaaaatattacaattgatattattgaagatgaaggagaaagtattggtcaacatcctaactgtgcttatatcaaagcaaatacgaaagacggacgttatatagaagtgataggtatttctattggtggcggtacaatcaaactaaaaggtatcaatgtaaatggtttaaatgtggaactgaatcatgggcttccaatgttagttatagatggaaatatgaataaagctaaaataaatcatcttattaatgatttatcagatatggacttagacttaggtgaagaattaatagaaacaaatgataatgaaggtttagttgtatttcctttaaataaagcaatctcagaatcagcattaaatattattaaagataaacatagtgatttaaacgtttcctatatcaaatag

SEQ ID NO: 1568 - DNA, 1074 bp, Staphylococcus epidermidis
agaagtttgaaattatatggtcgtgatattgatcacaactcaccattctataaaggaaataaaagtgttcgcgaaggagatattgtaaaacaagataaactcgctaatacattaactaaaatcaaagataaaggtcctgattacttctatgaagatattggtaaaagtgtttcaaaacaattagataataaattaactgaaagagatttcaaagaatttaaaacagaagaaaaagaagcggtaagtactgattataagaataatcaagtgtattcagcacctaatcctttaggaggcacattaatgcttcaaggattgaaaattgatgaaaaagaaaatgtagacaatatggatcgcaataattttatcacagcaatgattaaatcacgtgatgttatgtataagaatagagacattgttaatggtaatgagcctagtaatgaacaacatctgactgatgattatttacttggtgaacttaacaaagttaatattggtgaaaacacagataatggcagtgattttgatcaaattagaacggataatacaagtacaacccattttgtagttattgataagaatggtaagttagcaagtacgactaatacactatccagttactttgggacaggagactatatgaaagagggattctatatgaataactctttaggcgactttagtaaggataaatcaagtcctaatcatggtgaacctcacaaggcgcctagatcatttatttctccgtcagtaattgttggccctaatttctatatgggtattggtacaccaggtgggaacaagattccaacaattcttaatgaagtgattgtcgattatttaaacagtgatggttcattacaagaatctattaataaaccaagattttataatgacggcggcacgatattttacgaaaatgctatgactgatgaagatataaatatctttaaaagtcttggttatggtgttgaagaaaagcataatgatccaaactttggcagtgtccaaggtgctgtttatgataaagataaaaatactgtagatgtcggtcatgatgtaggtaaccgttaa

SEQ ID NO: 1569 - DNA, 825 bp, Staphylococcus epidermidis
aatgaattgaaaactttaaatcatttaaacaaaatgaaggcatcacagcaaaagatttctatggttacagcttatgattatcctagtgctaagcaagcacaacaagctgaaattgacatgattttggtaggagattctttaggaatgacagtgttaggatatgatagtactgttcaagttacattgaacgatatgattcatcatggtaaggctgttaaaagaggtgcttcagatacatttatagttgttgatatgcctatagggactgttggtttaagtgatgaagaagatctaaaaaatgcacttaagctttatcaaaacacgaatgctaacgctgtcaaagtagaaggggctcatcttacatcatttattcaaaaagcaactaaaatgggtatacctgttgtttctcacttaggtcttacacctcaaagtgtaggtgtaatggggtataaacttcaaggggatacaaagacagccgctatgcaacttatcaaagatgctaaagctatggaaactgctggtgcagtagtactggttttagaagccatacctagtgatttagctcgagaaattagtcagcaactcactattccagttataggtataggggcaggaaaagatactgatgggcaagtgttagtgtatcatgatatgttaaattatggtgttgatcgacacgctaagtttgttaagcaatttgcagacttttcaagtggtattgatggattaaggcaatataatgaagaagttaaagcagggacgtttccttctgaaaatcatacttacaaaaaacgtattatggatgaggtagagcaacatgactaa

SEQ ID NO: 1570 - DNA, 672 bp, Staphylococcus epidermidis
acatatatgaaaattttcattgtagaagacgatttagtgattgctgaaagtttagctaatgagctatctaaatggaattatgaggtgcatgtggttgataattttgaaaagataatggaagattttcgccgagtagaaccacaactcgtattattagatatcaatctaccaacacttaatggcttccattggtgccaagaaatgcgaaaagtatctcatgtgcctattatgtttattagttcaagaacagataatatggatcaaattctggctatccaaatgggtggcgatgattttatcgagaaaccatttaacttgtctttaacagtagctaaaattcaggcactattgcgtcgcacttatgatttatcaatagctcgtgatgaaatagctgttaaaggttgtaaactaattgttgatgaggccaagcttagcaaggataatgaacatgttcaactttccttaacagagctacagatattaaaattgttatttcaaaatgaaaataaatatgtaagtcgtacagctttaattgagaagtgttgggagtctgagaattttattgatgataatacgctcgcagtaaatatgacacgattacgaaaaaaattactttctatcggtgtcgatgatttaattgagacaaagaaaaatgtaggatacagggtttga

SEQ ID NO: 1571 - DNA, 696 bp, Staphylococcus epidermidis
tcactcatgaatgaatacttacaagcagttctaatgattttgttaactattgttctgtactatgtttccaaaaagattcaagataaatacaataatccactattaaatccagctcttattgcatcaattgcaataattattgttttattggtttgcggagtaagctataaggggtatatgaaaggtggtacctggattaaccatgttttaaacgctacagttgtatgtcttgcatacccactttatcaaaataaaaagaaaataaaaaaatatttaacaattattttcacaagcgtgttgactggtgtagttctcaattttgtgttagtatttacaacgttgaaaatctttggttattctaaagacacaattgttaccctgttacctagatcaattacagcagcagtaggtatagaggtttctcaagaattgggaggaacagatacaattactgtgctctttatcataactacaggtttaatcggcagtattttaggttcaatgcttttacgtatgggaggttttaaatcttccattgcgcgaggactaacttatgggaatgcttctcacgcatttggtaccgcaaaagcattagagcttgatattgaatcaggagcgttcagttcaattggtatgattttaacagcagtcattagttctgttctcataccagtactgattttattgttttactaa

SEQ ID NO: 1572 - DNA, 1350 bp, Staphylococcus epidermidis
gagttaatgaaacaatatgatgtagtatttttaggaagtggtcatgcagcttggcatgctgcgttaacattaaagcaaagtggtaagcaagtagctatagttgaaaaagataccatcgccggtacatgtactaactatggttgtaatgcgaaaattttattagagggaccttatgaagtgcttgaagaagccaaacaatatcctaatattattgatagtcacaatttagaagtgaattggaagaatttaatgcgttacaaagaaaaagtcattaatcctatgtctgaaaccctcacatcgatgtttgaacaacaggaaattgatgtaatcatggggaaaggtaaactggtagatgctcatacaatagaggtaaataatacaactttacaatcagattatattgttatagccactggacaacatagtcatcaattagatattgagggtaaagaatatacgcatgatagtcgggaatttttatcaatgcaatctttaccggatagtatcacttttattggagcaggtattatcagtattgaattcgcttctatcatgatcaaatctggtgtagaggttaatgtgattcatcatacaaatcaggcacttgaagggtttaacgaatcacacgtcaataaattaattcaaaagttaaaagatgaaggtgttaaattttactttagtgagaataccaagtcagttaaaccgaatgcgcaacgttttatagtagaaactgagtctggaaaaatgattgaaacagattatgtactggatgcaaccggtagaaagcctaatgttcagcaaataggtttggaaaaagtgggtatacaatttagtgatagaggtattgaggttgacgattatttaagaacaaatgtgaaaaatatatacgcaagtggggacgttatcaataaaatgattcctaaacttactcctacagctacatttgagtctaattatatcgctgcccatatccttggattgaatacagatgctattcagtatccaccaataccttcagtgctttattcattgcctcgtttatctcaaataggtgtcacagttagcgaggctaagaaagatgatacgtatatgattaaagatataccattcggaagacaaatggtatttgagtatcaaaacgaaacagaagctgaaatgtcaattgtattagatagtcacaaacgtttagtaggagcagagatttatggtaatgacgctggtgatttggttaatctcctagtttttatcattaatcaaaaacttactgcacaagacttaaataaaaatatttttgcatttcctggagcttctagtggtgttatagatttattgaaattggcgatgatgtag

SEQ ID NO: 1573 - DNA, 468 bp, Staphylococcus epidermidis
attgaaatgaagggatgtcttatgttaattagcgatacaaataaaacatatataatagaagaaactagtaattcattcacaattgaaaagaataatgatcagcagcactacgaagtattagaatcaatcaacagcttatctaatgattcattttgtgtgttaaatcacttattcgtcaatggaggtaatgaagaggtttttgagtcacggtttttaaagcgaaatcaacatttgcaagatgtgcctggttttaaagcgttaagatttcttagaccggtagtcaaagggagacattacattatcatcacgctatggaacagtagacaagctttctatgattggcaaaattcacaagcatatgcgcaaactcataaaaaacgtggaactcaaaaaggtgttgatcatcgtatagtcaatagagatttatcctataatataagaatagagttagaaagtcttaataactaa

SEQ ID NO: 1574 - DNA, 1494 bp, Staphylococcus epidermidis
acgatggtgaaagaagtagttctaggaattgatttaggcacaagcgcaataaaaattattgctgttgatcaactaggaaatgtcattgaatcagtaagcgaaacattaaagttataccaagagcatcctggttatagcgaacaagaccctaatgaatggtttgaggctactaagaaagggataaaagaattaattcaatcaacagaaatgtcagataagatagtaaaggggatttctttttcaggtcaaatgcatgggttggtcatagttgatgataatggcattcctttgagaaaagcgattttatggaatgatactagaaattcaatacaatgtagacaaattgaagatatatatggtgaaagattgaattacaatccgatattagaaggatttacacttcctaaaatgttatgggtacaacaacatgaacctgaaatttggaatcgagttgatgtttttatgttgcctaaagattatttacgttattgcttaacgcagacaattcatatggaatatagtgatgcatgtagtacattattattcaatcctgagaattatgaatggacaagagatgttggagatacatttaacattggtgatatctatccacccttagtaaaatcacattcgtatgttggaaatgtaacttcatcactggctaaagaattaggattatctagtgatgttgctgtatatgctgggggtggtgataatgcatgtggtgcaattggtgctggtgtcatccatgataaaagtgcattatgtagcataggtacttcaggtgttgtattaaatgttgaataccaacgtgtgacctcatatgatagtaatttacacttattcaatcatagtgttccagatacttattacgcaatgggagtaacgttggcagcaggctatagtttaaactggttaaaacaaactttttttgaaaatgaatcttttgaagagattttaaatttagctgcatcttcaaagataggtgccaatggactactatttacaccttacttagctggagaacgtacgccacatggtgatgctcaaatacgtggaagttttataggtatcagtgggcaacatactaaagctgactttgcgagagcagtaatcgaaggcataacgtattctttatatgattctataaagattatgagacgagctggtcatgaaatgaactctatcacttcaatcggtggtggtgctaagagtagattttggttacaacttcaagctgatatttttaatgtgcaaataaaaagattgaagcatgaagaaggcccaagcatgggagcggcaattttagcggcatacggtctaggatggtttaaaacaattgagtcttgtgtagaggcatttattaaagtagacgaggtgtttgagccgaataatgaaaatcatgacctttatgaacaatactattcagtttatgaagctatatataaacaaacgaaacagcttactgctgatttgttaacgataacgaattaa

SEQ ID NO: 1575 - DNA, 1101 bp, Staphylococcus epidermidis
ttaatcacgaacaaggagcgcgtactaatgacaaagaaaaaacgtttatcgcctagtgagtggttgcttaaacaatctaaaagacataaaaggaaaaatacactttacacggcaattgtacttttagtagcgttagttctactcatatttgctgttaaatcaatacaagtagaacctgtaaaaagtgatacgagagacaaagatagcattcgtatcacctatttaggtaacgtcactttaaataaacatattcgacaaactaacttgaatgatgtttttaaaggtattcaagatactttagatcatagtgatttttcaacaggttcattaatagtaaatgatttttcaagaaatcaaaaagataacataaataaaaatattgaaaatatcatgtttctacgcaagcataatgttaaaagtgttaacttaatcaacgaatctatggataatattcaagcgacagcaatgatgagaaaaatagattcccaagcaggttataattttttaacaggtaatggttcaaatccaattaatagtaaaactgtacaacaagacattaaaggtaaaaaaatagctaatgtttcatttaccgatatcgaatctaactatactaactctttaaaaaacacgacgtcaattagtttagatccagctatattttatcctttaataaaaaaattaaaggaaaataatgattacgtcgtagtcaatgtagattgggggatacctaatgaacgaaatgtgactacacgtcaaaaagaatatgcacatgcgttagcgaatgctggtgcagatgtcattattggtcataatacagttattcaaaaagttgaaaattataagcgaacgcctattttttatagtttaggtaacacaacgtctgataacttcttatcaaaaaatcagaaaggaatgattgtacaacaagactggaaaggttcgcataatcagttccatatcacaccaattcaatcaaaagatggaaaaatctctaaagataatatgaataaaatggatcatattcgattcaaaaataacattaaagataaatcaattgatttaaaatctgatcaaaatggaggttatacttttgaatattaa

SEQ ID NO: 1576 - DNA, 420 bp, Staphylococcus epidermidis
gaagggacgaataagatgaagaaaacagcagtattaaatagtcacatttcaagcgcaatctccacactaggtcactatgatttattaacgattaatgatgcgggtatgcctatacctaatgatgacaaacgtatagatttagcagtgactaagtcattgccatgtttcattgatgtgttggagacagtgttaactgaaatggaaatacaaaaaatatatttagcagaagaaattaaaactgcgaatgcacagcaattaaaagcaattaagaaattaatcaatgatgatgtagaaattaaatttattgcgcattctgagatgaaagaaatgttaaaatctcctttaaataaaggaaatatacgtactggtgaaatcacccctttttctaacattatcctagaatctaatgtgactttttaa

SEQ ID NO: 1577 - DNA, 900 bp, Staphylococcus epidermidis
tgtattaagaataagaggatgtatatgattaagcaaaattttacaactaaagtttatccacttaaacaatttgagggagagtatagtgaagttgcctacgcaggagatagccaagctgatgatgtgattgtatttattcatggtgcactcttaacatataaaattatgacgatgttcgagccttacttcagagattacaaattaatatttattaattgtccaagtcgtggtaaaagttcagatttagatcgtgacacacatacattagatgattacgctgcacgtatatatgatgtattaacgcaaattgttaaggagcaacaaataaaagaactgagtattgttggttattcaatgggtggaatgattgcgacacgattacttaagtacaatacattaccagtctctcatcttatttatttacatagcgcagcgaaaattactccagatgcaagtatgttagcacgattattcactagtgagagtaagagagcagtgttaaaagatgaaattaaggcagtaaaaaatcttcctcaatatatactagataaaacgatttatgcacaaaaggaaaacgcacttgatttggtacaatttattgcaccaattaaaactataattacggatatgatctacacgattaatacagattatttaccagatatcgatgagattaaacaatttccgaaaatattatttatgtctggaaaagaagatcaaattattccttatacggattctcaagctacgttagaaaagtttaaggcgttaggtggaaaaactaaagaagttatttatccaggaattggtcatatcgatttcccaagtgttttagaaacccaatcagatggacaaactggcgtggtagatgaaattaaagcgtggatttcaaaaaaataa

SEQ ID NO: 1578 - DNA, 870 bp, Staphylococcus epidermidis
gagggtgagaaaatgaatgaacaatggatgagcgcattgccacttgacaatgtgaaagacatttctccagtaagtggcggagatgtaaatgaagcatttaaagtcactacagttgaagaagatattttttttctactcgttcaacgtcaacgatcagaagccttttatgccgcagaaattgcaggactaaatgaatttgaaaatgcaggtataacagctccaagagtaattgcaagtggagagataaatggagatgcatatttattattaagttttcttgaagaaggtagtcaagggagtcaaagagagcttgctcgattagttgctagaatgcatagccaataccaacaagataataaatttggattccgtttaccacatgaaggtgcagatatttcctttgataattcatggactgagacatggaaagagatttttataaatcgtagaatggatcacttacaagatgagttattacgtgtaggattgtggaaacaagaagataaaaaaatgtatgaacgtgtaagaaaagttattgttgatgaactttcaaatcatactagtaagccctctctgttacatggtgatttatggggaggtaactacatgttcttaacaaatggccaacctgctttatttgatcctgcaccactatatggagatagagaatttgacataggaatcactacagtatttggtggatttacacaagagttctatgatgaatataatcaacagttaccactagccaagggatcacaaaagcgtatagaattttatagattatatttacttatgatacatttacttaaatttggaggtatgtatgctgatagtgtacaacgctctatgaaaatcattttagaataa

SEQ ID NO: 1579 - DNA, 1809 bp, Staphylococcus epidermidis
atgaacgagaacaattatagacgtctcaacaaaacttataaaccgcactatttgcctggtttagatggtttgagagctatagcagtcattgggataatcatttatcatttaaatacgaaatggttatctggtggattccttggagtagatactttttttgtcatttctggttatctcataactagtttattattaagtgagtattatagaaataattctattaatttagttaatttttggcttagaagatttaaacgattaataccagcaatgatgtttgttgtcacggttgttttaatatatacattactatttaaacccgaattaattattagtataaaacatgatgctatagcagcacttttctatgtttctaactggtggtatatcatacaagacgtagactattttaatcaatttgctgtagcgccattaaagcatttgtggtcattagctattgaagaacaattctatctattctttccatttatacttttaggcttattaaagtttttcaaaaagagaactacaatgattattctattaatcatctctttattatcattaactgcaatgataacgatacatatgtatacaggtaacaattctagagtttatttcgggactgacacacgtttacaaacgttattattaggatgcttactagcatttatttggccaccgttctctttcagaaaggatatatctaaaggtgctaaagcaagtataagtgcaataggcatagtcggaatggcagtgctcatttatttgtttgtagtggttagtgatcaagataaatggatatatagtggaggattttatgccatctcgttcttaacactgtttgtcattgcaagcgttgtgcatccatcaagtgttttaaagaaaatactaagtttcaagttatttatttatataggtaagagatcgtatagtttatatttatggcactatcctatcattatttttatgaatagttatttcgtacaaggtcagattccttggtttgtatatatttgtgaagtgatacttatgtttgtcatggctgaagtatcttataaatttatcgaaacacctattagaaaaaatggatttaaagcattcacggtgataccgaaaaatttaacaagattttcaagaacgattattgtgttaatcttgcttgttccttctgcattcatagtatttggtgcctatgatagtttgggtaaagagcatgataaacaacaagctgcgaaacaaaaatcttttaaaacgaaccagaaagcaaaacctaaaaagccagatgaaaataatcaagataagtcttcacaacaacattttaatcctaaagaagcgtctccattattgctgggagattcagtaatggtagatatcggtcaagtctttagtgaaaaagtaccaaatgctaatattgatggaaaagttggccgacagttaattgagggtaaagatttaatcaatcaaaagtaccaagattatactaaaaaaggtcagagtgttgtgatagaacttggtacaaacggtgagtttacgaaagatcaaatgaatgaattaattgattctttaggtgaagcagatatttacttaattaaggtaagagtaccgagagactacgagtctactaataataaaattatggaacaagtagctaagaaacataaaaatgttcatattgttgattggtataaaacatctgaaggtcattctgagtattttgcatatgatggtattcacttggaatacagtggtgttaaggcattatctaatgaaatcattaagaaaatgaaagaagttaatgaaaaataa

SEQ ID NO: 1580 - DNA, 234 bp, Staphylococcus epidermidis
gtacttcgtttctttttaggaggatttggagcacacagattttaccatggtaaagtaggaagtggagttggattattagtcttaacattattaactgtttggtttacttttggaattcctactttaatatgggctattattgatgcttttttaattccaaactgggttaaagaagatgaagaaagaatacgtcagcaagctttaagcgaagtaaaattaatgaaaaataaataa

SEQ ID NO: 1581 - DNA, 216 bp, Staphylococcus epidermidis
ttggaatacctaattcatgagtacgtcgacttaatcgagctacttttaattgtaattcttctagtttccctgacatcgtttcaccctctatatatgttaaagttagatgttatattgttatattttaacatagaaaaatctcttcaacgttctaaacgtcgaagagatacgaagctttatcccataaatttaaaaatatcattctcatacaaatga

SEQ ID NO: 1582 - DNA, 198 bp, Staphylococcus epidermidis
ctaaaatttgattcgcttcaatcacaatatgacctctctttcatctacataacacattatttaataatattatatattagcgaatatataaaggaaatatcgaatgtacaagacaattcgactttaactcttaaaaaattaaaaaaagcgaccgaatttgaattgcgtgtatttccacattttaacaacaagtcctaa

SEQ ID NO: 1583 - DNA, 1356 bp, Staphylococcus epidermidis
ttgaaaattgatcaaacacttacatcacgaattagacaacttgaggcttatatcatgaaacaatttttaaacatcactcaacgtaaatttatcgaatggttgattatcttatccatttttatagttagcattcctaataaatggacattaatgatatctatcgctttatctttattacttcttaaaagaggggcgctaggtgtcgttcaattaatcatactttatatgctcagatcgcaaatatacactccctatgatacacaagagatggcgcattacatagtaagtatgaaatatatcttgatttatgtaattggagtattttttctatttaaatatgtaaaacattggataagaaatgaaatgatattaagatttatcaagtctactatgattcttatgctactttatatcataatgagtttagtcgtatctaatgatccgatagaatctattcttaaattgcttaacttctttataccgctaattttgattgttatgtatgttagtttaataaaaaagataaagaatctcattaactggattaatcaatttatcacgctagtgattgcctttacttttttatttatagttatagcgccaaaatcatatttaattgatgaggaatcacttagaagtgttttcaaggatgcacattcattcgcagttattcttgctatgggtctagttctatatatggtaacaataatcaaacaacaagattatgatgtattcaatttattattattaaatattggaatgatagagctctatttatcaaactctcgtcatattttcatatctgttattttatgtctaatgcttctattaccgttatctcacataaaaaagagaattaaacatcccataattggtgctatgatactaatggcaattgctataataaatcaaccatatatttatcatctttttattaaactaatcttaaaagggaagaatagccaagaggtctttatgccgagtgatatgaatattaaagctattgattatgcgctaactgagcatccttttttaggaagcggttttggtataccaatgataaaagcgagttcagaaatacaatactttaatgtagcaacgagtaatatcatcttcggtatgattatctttactggaataataggacttactttatgtacgatatacatgcttcatatggtacttttagttacttttccaatgagtattactattttattatttttaatcactatctttgttaatatggattatattattttatttgattccgtggggctaggtatattgtgttatatattttggggaatatatttaaaagaaggtatgtatcaatacaacaacggacaatggtaa

SEQ ID NO: 1584 - DNA, 543 bp, Staphylococcus epidermidis
tggtttaatgagaaaattttaactgtgagcatatatattgtgaatatatgcgagtcattttacactataatcaatcgtgcgcgattgaaaagaggtggatatgtgaaacaagaacaaatgaggttagcgaatcagctttgtttttcagcatataatgtaagtcgtttatttgctcaattttatgagaaaaagttaaaacagtttggtataacttattctcagtatttagtattactgacgttatgggaagagaatcctcaaacattaaattcaattggtagacatttggatttatctagtaatactttaaccccattactaaaaagacttgagcaatctggctgggttaaaagagaacgtcaacaatctgataaacgacagttgataattacgttaactgacaatgggcaacaacaacaagaagctgtttttgaagcaatttcaagttgcttaccacaagaatttgatacgactgagtatgatgaaatgaaatatgtgtttgaagaactagagcaaacattaaaacatctcatagaaaaataa

SEQ ID NO: 1585 - DNA, 1377 bp, Staphylococcus epidermidis
aaggaggacctcataatgaaatatattgtggtaggtacatctcattcaggatatgaagtgatccaaacattgcttaaagaagatgaaaatgctgatattcaagtttttgaaagtgcagatcaaccgtcctttttatcttgtggtattcaaagttatcttgaagacatctcatcatcattagatgatttacattacgcatcagttgactcttataaggcacaaggtgtaaatattcatacgaatagcacagtcacagatttagatactgacaataagactgttgtagttgaacaccaaggtcaaacagcaacttattcttatgataaattgttcctaagtcctggtggcaaacctgttacccctccagtcgatggaattgaaaaatataaacatgtattatttatgcgtggacgtgattgggcaaatcaaattaaagaacgcatgaaagatgccaaaaaggctgttgtagtcggaggtggctatatcggtattgaagctgctgaagcttttgctaaagcaggcatagatactacaatcgtagatgtcgctgatcgtatattaaacacttacttagataaagaatttacagacatattagaaacaaatgcacagcaacatggtcttcattttaaaggtggcgaaacagtaaaatcaatttcaggaaatcaaaatggcgaagtaactactgtagttaccgacaaaaatgaatatgacgcagatactgtcttatttgctgtaggtgtcgaaccagctaccgagtggctaaaagataaaattgatttaggtaagaaaggaattataaacattaaccaccaacaacaaacatctgctaaagatgtctatgcgggtggcgatgcgacattagttccttttgcaccagtatctgaggatcgttatattgcattagcaacaaattcaagacgtcaaggcgttgtcgcagcaaaaaacatgttgggtaaagaaatgacaatgccacgcgtttctggtacttcaggtttacaattatttgattataaatttggacaaactggcattcacggtacagaaatcgataattatgatggcaatttaggtcaaacatacgtagaagaattgattcgtcctcagtttatgcaagatgatacgaaaattcatatgaaaattatttatgataaagacactcaccgtatacttggtggtcaagtcatgtcaaaagaagatattactgcttctattaacacaatttcagtagtaatatctgctggtttcacacttgaacagctcgctgtccaagatttcttcttccaacctgattatgatagaccttggcattatcttaatgtgttagcccaacaagcattgggagatacatttggtagcgataagatgttattctaa

SEQ ID NO: 1586 - DNA, 1632 bp, Staphylococcus epidermidis
tgtttagatgaaagtgaattgaaaggaagtacacttatgaataaatcaaatttactagcacctgagaattataatattgttacagaaatagaaaaatatgcctcagaagatcataaaaaagccattatttacaaggataacgagcatgaaaatatttctgtaagttataaagaacttatcagtaatgctaataaagtagggaatgtattcctcaatcatgggctaaaaaagggagataaagttctcatcatgatgccacgtgcaatcgttacatatgaattatatattgcagcattgaaactagggatagcgattgttccaagttcggaaatgttacgaacaaaagatttacaatatcgaattactcacggtgagattgatgcagttatttcatttgattctctaactaaagaatttgaaaacgttaaagaatatgaccaattaaaaaaatttatagtagctggtcacaaagaagattgggtttcaatagaagatgaaaaagaaaaagtaagtgatgaccttaaaggcgcagatacaacacgagatgatttggcgattctttcttatacatcaggtacaacaggcaatccaaaagcagtaacgcattcacatggatgggggtatgcccatttacaaatggcaccaaaacattggttatgtatacaagagaatgatcttgtatgggcaactgcagcaccagggtggcaaaagtgggtgtggagtccatttttatctgtattagggatgggagcaacagcatttgtctataacggtcgtttccaccctgaaacatatctcgagttacttcaaaattatcaaattaatgttctatgttgtacaccaacagaatatcgtatgatggctaaacttagtcatttagaacagtacaatttagagtatttacacagtgcggtgtctgcgggtgaacctttaaatcgagaagttgttgaacaatttaaacgtcattttaatattactgttcgagatggatatggacaaaccgaaagtacattgttgatcggatttctaaaagatactgaaccacgtatgggttctatgggcaaaggtatacctggtagttttgttactgtcattgacgatgatggtaaagaggttggtccaaatgttaaaggtaatatcgccgtgcctttagacttaccggctttatttaaaggttactttaaagatgaagcacgcacaaaagcagcttcaacaggtgattattatgttactggagaccaagctcatattgataatgatggttatttctggttcgaaggtcgccgtgacgatattatcattagttcaggatataccattggacctttcgaggtagaagatgcactaacaaatcacgcagctgttaaagaatgtgcagttgttgcaagtcctcatgacattcgtggaaatattgttaaagcatttatcatcttgcaagatgattatgaagcaagtgatgagttaatccaagaattacaagtattttgtaaaaatgaagtagcaccgtataaatatccaagagcaattgaatttgttgaacatctaccaaaaacaaattcaggtaagatacgtcgtgttgaattacgtgacgcagaaataaaaaaatataaacaacaagattcatcacattaa

SEQ ID NO: 1587 - DNA, 813 bp, Staphylococcus epidermidis
aaggaacacgaaactatgacaaattttcattctatagatgctacacaagtaacaaacgtcactttaaatgttaaagatttaaataaattaactgatttctattctaatgtattaggtttttctattgaaaaacaaacgaatcaacaaaccgtattcaacatcggaaatcttggttatactttaactttaaatgaacttaacaacggtcgacaaccggaatttagagaagcagggttattccatgttgcttatcttttaccgactcgtagcgatttagcagacttcctttatcatgctaacaatctcaacatcgcaatgggtggtggagatcaccttgtcagtgaagcgctatatttcactgatcctgaaggcaatggtattgaagtctatcatgatcgcccttcagaagactgggtgtggcgagacggttttgtcaaaatggatacattggaagttaatgtcaatgatttaatggctcaacggtcaaatgaaggttggcaaggttggccggaagaaggaaaaatcgggcatttacatctcaaaacacacaatttagaatctgcttatgaattttatgttgaaaagctagggttcgaacatatatctaatttcccacaagcactatttatgtctactcaaaagtatcatcatcatatagctacaaatacttggcagtcaaataagattagaactcaaaatgaacaaacttatggtttatgtcactttgacatatatcaacctaatgcaaatactactcatgttacctcacctgaaggctttgacattacaattcatggtaacgaaacaaaataa

SEQ ID NO: 1588 - DNA, 1818 bp, Staphylococcus epidermidis
atcgaattagaaataaagaaggtgtttaatatgtcattggaattgcccgtgatgctaacgattgtattgttcttagcactaggcatttttagtcaatggttagcgagtagaataaaatggccatcgattgttgtcatggccatcgtaggtttgcttgtaggacctatttttggactagcaaacccaaaagaggcacttggacctgaggcatttagttcaattgtatctcttgctgtagcaattatattatttgaaggtagtagtaatctagattttagagaattaaaaggcatttctaaagctgttataagaattattacaataggagcgggaattgcatggattttaggagcaatcgctttacatgtcactatgaatttccctctgtctatttcatttgttatcggaggactattcctaatcactggtccaaccgtgattcaacccttgctgaagcaagcgaaagtaaaaagaaatgtcgattcagtattaagatgggaaagtattatcttagatcctattggacctattattgcactcactgcattttatgtattccagatttttgaggaagggataggcttagtcgttattattctctttatcttgaaactcttagctgcaattttaataggttttggtgcagcctttctatttaattggcttataagtcaagataaaattcctcaaagtttaatgccacccattcaacttgtatttattcttttaacatttagtatctgcgatgagatattatcagaatcaggtttactagctgtaacaatttttggcttaatgatggcgcgtaaaaaacgtcacgatctcatctttaaagaatcagaccactttatagataatgcatcatctatacttgtgagtactgtatttattttaattacgtcttctctcactaaagatgtgttgctcaatgtgttatcttggcagctcatactctttagtttggttatgattgtattagtaagaccaatttcagtgcttctttcaacattaggtactgaaataactaaaaaggaacgtgcagtagtagcactaatggcgcctagaggtattgtggttttaacagtggcacaattcttctcaagtttatttatggacgataaaattcctatggctcaatatattacaccagtaacttttggtcttgtatttatcactgtagtcatttatggatttggttttacacctttaagtaaactgttcggtgtagcaagtacggagccaccaggcgtaatcattgtcggagaaagtgaattttcgttccatcttggtattaatctaagggatcatggtatacccgtcatgatgttcaacttatttgaaaatacatcagaaaaagcccacgaagctgggttcgaagtatttaaaggtaatcttttatctagcaatgatagaatttattctgatttattacgttataataaatgtattttgatgacacaatcgtttatctttaacagtttagcatttaatgaattagtgcctgaatttggcttgaataatgtagatatgatgccagtatcttttaatgatgaacaagcacgaaacaatttaaatggtccaatcagaaatcatatattatttgatgaaaatcataccccacgttggtttaatcaatttattacacaacataatattgttgaagtaccggcagaagattatgaaaaaattacagaaaatgatatgttaatctatcatatcaatgaagataaagaagtgacgtttaaacgaagcaatagagatatacctgaacatgaaacaggtgtttatggtattttaaaaaatgcttatttaacttaa

SEQ ID NO: 1589 - DNA, 576 bp, Staphylococcus epidermidis
cacatgcaagaagataggaaatttgaagtcaaatggcgactagttaattcatcaacttttatgtatggtacaaaattacgttttaatcaagataatatctattttgagaaccctttgatgccatccggtacaatcattcacagttggtatatgttaactgattttgcagaagaccgtgtaagccctaagctacctattttaaaaaaagggcgccaatatcaatttcaatttaattttgaagttgaacctgagggtgcggcttattttaaaatgaaattttatcgtaagaataaagaaattcttagtcatcaaattctaaaaaataaaaaagaaaatattgtctatcctagagaagcatattcatatgaattagaacttattaatgctggcatgaatcatctatcttttcacaatataattgtgcaagaattaagagaagatagtaatcaagcttatgaggcaacgcaatatatagatcctaagaaaaaacttaaagtaattaatcaaataataaccaatataaggacacatcatctagacacatcaaactatcacaggagtgatacgaatggctaa

SEQ ID NO: 1590 - DNA, 1263 bp, Staphylococcus epidermidis
tgtagcgaagaaaaggaggaaatgagtatgacaaatggacctattcaagttaacagtgaaatcggcaaactaaagacggtattacttaaaagaccagggaaagaattagaaaacttagtgcctgattacttagatggattattgtttgatgatattccatttttaaaggtagctcaacaagagcatgatcattttgctcaagttcttcaagatgaaggaatagaagtgctttatttagaaaaattagcagcacaaagtatagaagattcaaatgtcagagagcaatttatagatgacgttttagcagaatctagaaaaactatcctaggtcatgaaaaagaaataaaaaaactcttttcaactttgtcaaatcaagcattaattaataagattatggctggcgtacgcaaagaagaaatacaacttgaatcgacacatcttgtagagtacatggatgataaatatccgttttatcttgacccaatgcctaatctatatttcacacgtgatcctcaagcttcaattggtagaggtatgacagtaaatcgtatgttttggagagcgagacgcagagaatcgattttcatttcatatattttaaaacatcatcctagatttaaagatgagaatattcctttatgggtggatcgtgactgtccgttcaacattgaaggtggagacgaactggtgttatctaaagatgtacttgcaatagggatatctgaacgtacttctgcacaagcaattgaacgtttagcacgacgtatttttaaaaatccgttatctacttttaaaaaggtggtggcgattgagattccaactagtcgaacatttatgcacttagatactgtttgtacaatgattgattacgacaaattcactacacattcagcaattcttaaatcagaaggaaacatgaatatatttattatcgaatacgatgataaagctgaagatatcaaaatccaacgttccagtcatcttaaacaaacattagaaaaagtgctcgatgttgatgaaattacattaataccaactggaaatggtgatatcatcgatggtgctcgtgaacaatggaatgatggttcgaatactttatgcatccgtcccggtgtggttgtaacttatgatcgtaattatgtttctaatcaattgttacgtgagcatggtatcaaagttattgaaattcctggaagtgaacttgtacgtggtcgaggaggccctcgatgtatgagtcaaccattaataagagaagatctatag

SEQ ID NO: 1591 - DNA, 1398 bp, Staphylococcus epidermidis
aatggagaagaaaagattatggcagataaactgcaaagagaattaagcaatagacatatacaattaattgctattggcggggctattggaacaggtttatttcttggtgctggccaatctattcatttagcaggcccatctatcttactaacatacataatagtaggttttgttctctttatgttcatgagagctatgggagaattactgttatccaatttaggatttaaatcgtttggtgacattgctcatcatcatattggttctatggcaggttttatggtggggtggacatattggttaacatggattatttcaggaatggcagaagtgactgctgttgccaagtatgtttccttctggtatccaacaattccaaactggttaacagctgcagcgactattttagttttagttgctttaaatctattcagtgctaaattatttggagaattagaattttggctatctattattaaagttttgactattttagctttgatagccgttggtgttgttatgattgtatttggaatgaagacaagctatggccctgcaacggtaacgaatatatggaaagacggaggctttttccctaatggtgcacaaggtttcttcatgtcattccaaatggcaattttctcatttattggtattgagttgattggaataactgcaggggagactaaagatcctcacaaaacaattcctcaagcaattaataatgtaccgtttagaatattattattttatataggatcgttggcagttatcatgtctgttgtaccatggcaacaattgaatcctgctgacagtccatacgttaaaatgtttggattagttggaatcccttttgcagcaggtattattaactttgttgtacttacagctgcagcctcttcttgtaatagtggtatatttgctaatagccgtacgatgtttggattagctggaagaaagcaaggtccagcattcttacatagaaccaataagcacggcgtaccacattatgctattttagtgacatgtggcttattaagtatttcagtcgtgttaaatgcaatttttaaagatgcgactaaagtgttcgtacaaattacaacattttcaactgttttaaatattatgatttggacaattattatgatcgcgtatctaggttatttaagacatgaaccgaaacagcataaagaaagtaactataaaatgtggggcggaaaatacatggcttacagtattttagggttctttgcatttatttttattatactattgattaatagtgcaacgcgttatgccgtactttctgcacccgtatggtttgttatcatgctattgatgtatcaaaaatataaaaaagaatctcgcaaagctaaaattaaaaatgaggaagagtaa

SEQ ID NO: 1592 - DNA, 789 bp, Staphylococcus epidermidis
aaattgttggaggcggttaatatgtttaaaataggaaatttagaattacaatctcgtttacttttaggtactggaaaatttgaaaatgaagaggttcagtcaaaagcaattgaggcatctgaaacaaatgtacttacatttgcagtaagacgtatgaatttatatgatcgtaacctacctaacccacttgcaaacgttaatttaaaagattttatcacttttccaaatactgcaggtgccaaaacagctcaagaagctatcagaattgctgaaattgctaatcacgcaggtgtatgtgacatgattaaagtcgaagtcattggtgatgacgaaacattattacctgatccattcgaaacatacgaggcatgcaaagtattgttagaaaaaggttacactgtttgtccttacatctctaacgatttagttttagctcaacgtttagaagaattgggtgtacacgcagttatgccacttgcatcccctattggtacaggaagaggtattaataacccattaaatttaagttatattatcgaaaatgctagtgtacctgtaatcgtagatgctggtattggttcccctaaagatgcgtgtcatgccatggagcttggcgcagatggtattttactcaacacagccatttcagcggcaaaagatcctgtgaaaatggctgaagcaatgaaattaggtataaatgctggcagactttcatatgaagctggacgcattcctgttaagtatactgcacaagcatctagtccatcagaaggtttagggttcttgtaa

SEQ ID NO: 1593 - DNA, 621 bp, Staphylococcus epidermidis
cgttgtatggaacaaattatcactgattttattagtaagtggggttatacagcgatattcattttaatcttattagagaacgtattacctgtcgttccatctgagattattttaacttttgcaggcttattatctgtgaaatcacacttatctatttggacattattaatcatagcaacaattgcttcattcattggtttactcattttgtattatatttgtagacttatctcagaagagaaattatatcgtttcgttgatcgacatggtaagtggatgaagttaaaaagtaaagatttgaaacgggcaaatgattggtttaaaaagtatggtgcatgggctgtatttttatgtcgttttgtcccagtacttcgagtattaattacaatacctgctggcattaatcgaatgaacgttatacagtttacaactttatctttaataggtactacaatttggaattttgctttaatactgctcggtcgtttgctcagtgacagttttgacgctttgatgaatggtattcatacatattcacgtatcatgtatgtcattattattattgcagtcatatattttgttatacgttatttaatgaaacgtcgtcggagtgttaaataa

SEQ ID NO: 1594 - DNA, 825 bp, Staphylococcus epidermidis
ctttggatggaacgtttagaaaacaaaatcgcagtgattaccggtgcgagtactggtattggacaagcatcagccgtggcgttagcaatagaaggagcacatgtgttagcgcttgatatatcagatcaattagaagaaactgtgcagtctattaatgataatggtgggaaagcaactgcatatcgcgtagacatttcagatgataaacaagtcaaacaattctcagaaaaaatagcacaagaatttggacatgtagatgttatttttaataatgcgggtgtagataatggcgccggacgtattcatgagtatccagttgaagtgtttgataaaattatggctgttgatatgagaggaacgtttttagtaactaaatttttattacctttaatgatgaaacaaggtggttctattattaatacagcttcattctctggacaagctgccgatttataccgttcagggtataatgctgcaaagggcggtgtcattaatttcacaaaatctatcgctatagaatacggacgtgaaaatattcgtgctaatgccatagcacctggaacaatcgaaacaccacttgttgataatttagcaggtacatcagatgaagaagccggacaaacattccgagaaaatcaaaaatgggtaacaccattaggtcgactaggaacaccggatgaagtcgggaaacttgtagcatttttagcttccgatgatagttcatttataactggtgaaactattcgtatagatggtggcgttatggcttatacatggcctggagaaatgttaagtgatgaaagttggaaaaactctactaaataa

SEQ ID NO: 1595 - DNA, 192 bp, Staphylococcus epidermidis
aattctacggacaaggcaagttggggttcggggccccaacaaagagaatttcaccgagaaattccacggacaaggcaagttgtcggtaacttggataacttattcaaaataaggtgtgtattcaactacgataagttatcatccttattttgtttcgttaccatgaattgtaatgtcaaagccttcaggtga

SEQ ID NO: 1596 - DNA, 1278 bp, Staphylococcus epidermidis
atgaaaagtttagataaaggatttagacatttaacacgaaaagataaattaaaaaaacttgttgaatacggttggctagatgatgaaaactatgaaatattacttaatcatccgttaattaatgaggaagtcgcaaacagtttaattgaaaatgtcattggtcaaggtgcactaccagtagggttattacctcgaattatagttgatgataaagaatatgtagtacctatgatggtagaggaaccttctgtcgtagcagcagcaagttatggcgcaaaactcgttaatcaaagtggtggatttaagacaatttcaagtgaacgtctaatgattggacaaattgtctttgatgatgttgaagacacaggcacattagctaactcaatatatcaaattgaatcacaaattcatcaaatcgctgatgaagcttacccttctattaaagcaagaggtggaggatatcaacgtattgaaatagatacattccctaatcatcgattattatctttgaaggtttttgttgatactaaagatgctatgggtgctaatatgttaaatacaatattagaagcaatcactgcacatctaaaagttaaattttcaaatcaaaatgttttaatgagtattttatctaatcatgcgacagcatcagtagtaaaagtacaaggggaaatagatattgaagatttacatagaggagagagaagtggcgaagaggtagcacaacgtatggaacgagcgtcagttcttgcacaagtagatatacatcgtgctgcaacacataacaaaggtgtgatgaatggtatacacgctgtagtattggctacaggcaatgatacaagaggagttgaagcaagtgctcatgcatatgcaagcaaagatggtcattatagagggatagctacttgggaatatgatcgctcacgtaataaattggttggaactattgaagttcctatgactttagcgacagtaggtggaggtacgaaagttttacctattgctaaagcctcattaaatttgcttaatgttgaaaatgcacaggaactagggcaagttgttgctgctgttggattagcacaaaatttctctgcatgtagagcgctagtgtctgaggggatacaacaaggacatatgagtttacaatataaatcattagcgattgttgtaggtgcaaaaggcgaagaaattgcgcaagtagctgaagcgctcaaatatgaatcacaagctaatactgccaaagctcaagaaatcttgatgaatataagaaagtcataa

SEQ ID NO: 1597 - DNA, 927 bp, Staphylococcus epidermidis
ttaaacttactattgaattatatcaaaactagggggatatgcatggatataaaacacatgaaatactttgttgaagttgtcaaacaaggtggtatgacaaacgcttcaaaatccttgtatattgcgcaaccaactatcagtaaagcaattaaggatattgaagcagagatggctgtccctttatttgaccggagtaaaagaagtttagtacttactgatgcaggtaaaatttttttcaagaaatgtcaagaaatcatcgcactatatgataatttgcccactgaaattaatagtttgtatggtttagaaacaggtcatatcactattagtatgtctgcagtgatgagcatgcgtaaatttattggcgtattaggagactttcatcaactttatccgaatatcacgtacaacttaatcgaaagtggtggtaagacgactgaaaaccttatacttaatgatgaagtggatattggtgtgacaacattgccagtagatcatcaaaaatttgaatgtatatctttaaacaaagaagaactgactgtagttttaaataaagaacatcctttagcacaaaaatcttctattaaaatggaagaattagctgatgagaacttcattttatttaatgaagatttctatctcaacgataaaattattgaaaatgcgaagaatgctggattcgtgccgaacatggcctcacaaatctcacaatggaatgtgattgaaaatcttgtcattaatcaattaggtatttccatattgccagccactatagcacaattacttaatgatgacgtcaaaattgtacatttggaaaatgcacatacaacttgggagcttggtgtcgtttggaaaaaagataaacgtttaagtcatgctacaaataaatggatagaatttttgaaagaaagattatccgaagaataa

SEQ ID NO: 1598 - DNA, 1440 bp, Staphylococcus epidermidis
caacgcttacttggatacttaaaatttactcgtaattatttttcagttttatacatcatcatacgattaggaggttacaacatgtttaatttcttaaaaccagctagacatatcaaatcattgccagcagaaaaagtagatgatacatataaaagactacgctttcaagtctttttaggaatatttatcggttatgctggttactatttattaagaaagaacttctctttagcaatgccttcattaattgagcaaggctttattaaaggggaattaggtattgcattatctgcagtatctatcgcatatggctttagtaaatttgtaatgggaactgtcagcgatcgaagtaatgctcggatgttcttaactttaggtttagtattgacagcaattattaacttattattaggatttattccattctttacttcaagcataactattatgtttatcatgctgtttttagttggttggttccaaggaatgggctggccaccatctggacgtgtgttagttcatgggtttagtgtcagcgaacgcggaagcaaaacgtcaatatggaatgtagcacataatgtaggcggaggtttaatggcacctattgctacgtggggtatttccatgactgcattatacaacttcggttatttaaaagggtttgaaggcgtctttatataccctgcactattggctatcattattgccatcttctcttacatactaattagagatacaccacaatctcagggtttaccaccaattgagcagtataaaaatgattatgccacttcaactaaacaaacaattgaaacagaactaactactaaagaaatattatttaaatatgtacttaataacaaatgggtatgggcgattgcttttacaaacattttcgtttattttgtgcgttatggtgttttggactgggctccgacatacttaagtgaggaaaagcattttgatttaagtgcttcaggttgggcttacttcttatacgaatgggcaggaattccgggcacgctactctgtggttatctatctgacaaactatttaaaggtcgtcgtggtccagcaggcttcttctttatgttaggcgtaacaatctttatccttatatattggttaaatccaccaggtcacgcatggttagataatctttcattaattggtattggtttcttaatttatggtccagtcatgttaattggtttacaagcgttagattatgttcctaaaaaagcagcgggtactgcggctggtctaactggtctatttggatacttgttcggtgcagttatggctaatattgtattagggtttgtagttcaacattttggatggcatattggctttgtgttattaacagtcatcagcatactcgctatgttatgtttcattttaacttggaataaacgtggtcaagaacaaatcgactag

SEQ ID NO: 1599 - DNA, 189 bp, Staphylococcus epidermidis
tcaaagctactgcatccgcttaacattaaaatgatgattgacactataattaatttcttcaatataagtgctccctgctatgaccaatttatacgcttatcactatatctgttacattataaaaaagcaatagttatcaatataaatgtaaactgtaaactaattatgtttgaaaacgtcaaagcgtga

SEQ ID NO: 1600 - DNA, 954 bp, Staphylococcus epidermidis
caaatggtactttttcttcaacccgtatttcaagaacgtttatggggtggcaccaatctcactcaatttggctacgatattccgaataattctaccggcgaatgctgggcaatttccgcacataaaaacggtcctaacacaattctcaacggaaaacataaggggaaatctttaaaacaagtttgggacgaagataaagcacttttcggaaatgactcacgtaaagattttccacttctcactaaaattttagatgcacatgattgtttgtcagtacaagtacatcctgatgatgaatatgcgcttaaacatgaaggcgaatacggtaaaactgaatgttggtatattttagacgctcaacctggtgctgaaataatctatggtgttaatgctacaagtaaaaatgaacttgaacatatgattgatcatcatcaattcgactatttatttaaacatgtacctgttaaaccgggtgatttcttttatgtaccagccggtacagttcatgctattggttccggaatcctcattttggaaactcaacaatcttcagatacaacatatcgtatatacgattatgacagaaaagataaaaatggtcatacgcgtgaattacatttaaaccaaagtaaagatgttattgatatcactacaactgaacctaatacaacacctaagactgaaatgataaatggcaattgtcacactcaatttgttgccaatcatttctttacggttgaagaatggtctatcaaagacatattagattttcaaaaaccacacacttattgcctagtgtcaatgattaacggccacgggcaagtttcaatcaataacaaagtatataaaatcgataagggcgatcattttattttaacttctgaagatcaatatattaaatttgttggtaatatggatttaatagtcagttttagtaaagatgaggcatattaa

SEQ ID NO: 1601 - DNA, 1365 bp, Staphylococcus epidermidis
aaagagtcactattgggagggaactcaatgagtaaggttaatcatttgatagatgaagatgaacgttattttgcacattctggacggattaaatattatcctctagttattgatcatggttatggagccacgttaatcgatatagatggtaagtcttatattgatttattagcaagtgcaagttcgcaaaatgtgggtcacgctccgaagccagtagtcgaagcaattaagaaccaaactgagaaatttattcattatacaccagcatatatgtatcatgaaccgttagtgcgattatcaaaaaaattatgtgacattgctcctggaaattatgagaaaagagttactttcggattaagtggctctgatgctaatgatgggattataaagtttgcacgagcgtatacaggacgtccatacatcataagttttactaatgcataccatggttcaacatttggttcattatcgatgtcttcaattagtttgaatatgcgtaagcgttacgggccattacttaatggattttaccatataccttttcccgataagtatagggggatgtttgagcaagctaaacctaacacagttgaggaatatttagctcctttaaaagaaatgtttacaaaatatgtccctgcggaggaagttgcatgtattgtggttgaaacaattcaaggtgacggtggcttacttgaacccgtgccaggttattttgaagcattacaagagctttgccacgctcacaatattcttattgcagtcgatgatatccaacaaggattaggtcgtacaggaaagtggagttccgtagatcattatcattttactccagatttaatgacatttggaaagtcattagctggaggtttaccaatgtctgcgattgtaggtcgtaaagaaatcatggaaagtcttgaagcacctgctcatttatttacaactggtgcaaatcctgtaagttgtgaagcagccttagctacgataaagatgattgaagatgaagatttactaaacgcttcatggaaaaaggggagttacgttagaaaaagaatagacccatggatagaacgttaccaatatgtaggtgatgttcgaggtattggattatcaattggaatagacatagtatcaaataaaattgagaaaactagagattctgaagcagcattaaagatatgtaattactgctttgaaaatggtgtgattatcatagcagttgcgggtaatgttttaagatttcaaccaccacttgtgattacctataagcaacttgataaagcattagatacaatagaagaggcgcttgaaaagttggaaagaggagaattaaatcaatatgacattagtggtcaaggttggtaa

SEQ ID NO: 1602 - DNA, 963 bp, Staphylococcus epidermidis
cagggagcacttatattgaagaaattaattatagtgtcaatcatcattttaatgttaagcggatgcagtagctttgatcatcgtaaacgcgaaagtattaatgacaagaataaaatgaaagtatacacgactgtatacgcatttcaaagtttgacacaacagattggtggaaaatatgttgacgcgcaatcaatatatcctgctggtgctgatttacactcatatgaaccaacacaaaaagatatgattgatattgccaaaagtgatctgtttgtctattcaagtcatcaattagatcctgtcgctgcaaagattacgaattcgatgaccaataatagcatgaaattagcgcttgccgaaggactcaaacaaagtgattttattcactctaaagaccatgatgaaaatcatgagcatcattcacatcatgaagaatcgaatcaagatcctcatgtttggttagatcctgttctaaatcaaaaattcgctttcatgattaaagagaaattaatagagaaagaccctaaacatcaagcttattacaataaaaattataaaatagtaaataaagatattgtgcatattgatcaacaactacaatcaataacgaagcattctaaaagagataaagttgtgatatcacacgattcgcttggatatttagcgcatcgttatggttttaaacaacaaggtgttaaaggtatgaatgatgaagaacctagtcaaaaagagattttgaatatcgttaaagatatacagcattcgcatgcgccttatgttttatatgaacaaaatattacctccaaaattacagatgttattaagaaagaaacagatactaaaccattaagttttcataatttagctgtattgactaaagaggagcaaaatgatgattcaatttcataccaatcattaatgaaaaagaacatttacgtattaaatcgcgcactcaataattaa

SEQ ID NO: 1603 - DNA, 765 bp, Staphylococcus epidermidis
aaaggagtttgcatagtgttattagaggttaaaaatgtaaaaaaagtctatggcagaggtatgaacacgacaatggctttaaatcaaatgaaccttgaaattgatgaaaatgaatttgtagcaatcatgggagagtcaggttcaggtaaatctacattactcaatttaattgctacttttgatcgtacaactgaaggcttgataaagttagacgggttgccacttaatcaattgaagaataaagacattgcacgttttcgtagagaaatgatgggatttgtgtttcaagattttaatgtgttgaatacgatgtcgaacaaagataatattttgatgcctcttgtacttgcaaatgaacgtccaaaaataatgcaaaaacgcttaatggaaataagtgaacaattaggaattgaagacttgcttgaaaaatatccgtctgaaatatctgggggacaaaaacaacggatagctatagcccgtgcgttgatagcacgacctaaattattattagctgatgaacccactggtgcacttgattcaaaaacctctaaaaaccttatgtgtttatttcgaaaaattaatcaaaagcatcaaactatattaatggtgacacattcaaatattgacgcgtcatatgcgaaccgtgtcatcttcatcaaagatggtcgtttgtatcatgagatttatcgtggtgaagaatcgcaaacagattatcaaaagcgtattgccgatagtttggccatattgaatggagtaggtgactaa

SEQ ID NO: 1604 - DNA, 417 bp, Staphylococcus epidermidis
acgatgccttggacgatggaagattatcctcaaagttggaaaaactttgaagaactcgaacggaaaaaagcgattgatattggtaatgcgatgctcaaagatggctataaagaatctgatgtgatacctattgctacaaatcaagctgaaaaatggtatcaacatgcttcaaaagaagaattagagacgttaaaaaacaaacatatcacgcaacatcaagaagatgaatcagcaaatcctaaacttaacgaagaaaatgttcatgtatattatgaagatcagctatggaaagtaaaatctacagaggctaaacgagcttcagatacatttgacacaaaatctgaagcagttaatcgtgcacatcatatcgcagagaataaaggtactaaagtggtcgagcatcgaaaagatgagtga

SEQ ID NO: 1605 - DNA, 750 bp, Staphylococcus epidermidis
atgaaattctgccctcattgtggaaatccgataaaaaaggaacagtcattttgtaataaatgtggaaaacatttaaagacatcgacacaaagaaaaagtgaaaatcaaattgaacatatgcgtgaacagcaatcgtatatttctcgtgaggaaagacaacatcatgattcaacattttataaagaacaaaaacatactggttggctaattgtattatcaattatatttgtcttgttgatagcagcgctattgtatggtgcgtactatgcttacaatcattatattagtgatgagcaaagtcaccaaacaacagagtctcagcaatcaaatgaaagtgatcaaaatagggaccaatccactggtccaagcattgatgtttttagtgatgactttgatcaaggttatatgaagtcagcttcaacaagtggatatagaggtgtttataatggaatgacacgtgaagaagttgaagataaatttggaacatccaatggttctgtagaaagtttgaagtggagttacgaaacatatggtgatttagctgtagcctacgatgataatgaagttgttagcgtaggtgtagcacctaatcatatttcagaagatcaatttttaagtatgtataatgaaccggatgatagaaattcaagccagctcatttatgatagtaacaaagataatgacttctctgtattagttaatgttaaaaatggagatgttactgtcattgaaaatgtaaatcaaatttaa

SEQ ID NO: 1606 - DNA, 1191 bp, Staphylococcus epidermidis
aaaggagtatggaaatcgatggaagaaagtaaaaactataatctcattacgacaatcatgtttatttcaggtatcattgtaatggcaagtttatatacggctctacctcttacagcaactttcgcagaagactttcatgttcctaaatctatagcaactttaaacggtgttttattctcattaacatattcaatcagttgtctattttatggaacgatttctgaaaagtatggcagaattaaaactattttagtaggtatgagtgcattagttatcatctgtcttatgataggtattgttcattcatttacagtgttattaatattaagagcactacaaggcgtatttgctgcatcattttctcctgtagtcatgacttatacaactgaaacttatccacgtgtgaaacgtgtaacagcaattagtttcatcagtacaagttttatgttatcaggtgtgttagggcaaaatatgagtgaattagtcgtaagttatttgaattggcagtgggtatattttattttaacaatcttatatttaattctcgtattagttatttataaaaatgtacctgagagtccacataaaaatcctgatatacaactcattaagtttttcaataactttaaagatttcaaagacaatcttaaagttttctattgtttatttatttcactaacattactgattatgtttataagtatgtatgatattttaaatgaatatgtcacatcacaccaagttgggggagacatgtctgtgtcctcaatgatgaaattgttcggtgtgataggcatgttattatctctattagcagggcgtgtaagcagtcgtataggtatgaagcgcttgctaactatcgcattaacaacatgtattgtgtcgatcatactcatgggtgtaactacgaatattatacttattacaacatttagtgtgttgtttgttgcaggtatcgcatttgcgattcctactgttatttcaaaaataggtgtagttgttaaaaacaatcaaggtttctttttatctgttaatacatttgtattattcttaggaacagcgattgcacctattttaatgttatttgtaggcgaactgtctaactttttcttacagtttttaatgattgctattgtcggactgattgctttagttgtatcaatatttatgccaggtgaccaacgttcttga

SEQ ID NO: 1607 - DNA, 1953 bp, Staphylococcus epidermidis
ttgaatttgtgggatgttagagaaaggaagattgggatgcaacaaatcattaactctttgatacacttcgaccgttcaaaaattgatatagctaaaggaatacgacaaggatttttaatgatactaccagcattgataggttacttattaggattccctatgtttggtattctaatatcaacaggtacgctagcacatgtctacgtttttagtggatcaccacaatctatgttaaaaacagtcatcacctgttcactatcatttactatttgcatgattcttggcaccttaacagtatctcagcctattttatttggattactattactgattgttgttacaatcccatattatacgtttaatgcactaaaaatcgctggtccatcatcgacattctttttagtaacgttttgcttatctataaacttaccgatagccccagaagaagcacttttacgtggatctgcaattctcattggtggtatattggctaccataacagtaattttaacaatcatatttgctaaagagaaagcagaagacagagcaattcatgcggattttaaaacattacataacttgctacatcattttgatgagccagaggatttcaaagcatatgctcgaaacgctgttacagaatttagaaattctgaaaaacttttaattacctcaacatcaggtggtaatggaaaattaagtaaaaggtttcagaaattaattttattacacacatcagcacaagggatatattcagaattactagaactcaatgaaaatcatattcgtccattaccaagtgacttagttgaaatgatggatcatatcattaaaaatgttcaacaacctaaacaacaatatcgaccgtggtcaaaagttgttgatgtggcaccagaatttcaaaatttaatggatcatattttgaaaatagatgaaatgattcacgcaaacgataatcaaattaaatatgaagcagatattcgcaagcctttatatagtaagcgaatatatcaaaatctaactttcgactcaattgtatttagaaatgctttgcaatatacagttattatggcagtagctatatttattgctctagcgtttaacattcaaaaagcgtattgggtgccattgtcagcgcataccatcatgttaggtaatgtgacaacgattcgtacgttagacaggtcacttgctagaggtattggaacgataatcgggactattgttttgtcgggaatcttggcatttcatatcgatcctattttcgctattatcattatgggattttctgccatgatgacggaagcgtttgtggcatctaactatgcatttgcagtcatttttattacgacacaagtcattatgctcaatggtctagcctctcaaaatttaaatattgagatagcgtacacccgaattattgacgttctgataggtatagctattgcagttattggtatattcatactcgcgcgtaaaactgcatcctcaatgttatctgatgctattgccgaattggtacgtaaagaaggtattttatttcattatttattttcaaaaaataaacaggaaacgaatgaacgtgatagggtagaaagtttgaatttaaacgttaaaatcagtaatgtgacacaaatttacaattcagcgaatggtgaattgtttagtaataaagaagcggtaaggtattactatccaagcatatttgctctagaggaaataagttttatgctagagcgtgccatgaataataaacaccgacaaacaataaatgatgatttaatgggtgaatatttagtcgtatttgaaaatatagctaagcatttccaatttcaagcagatttaaatatcagagacatgcaaccattacctcaatataattacatccgtgcttcgcttatgaatatacagcgtaattgtgctgaacaacgtcaggccatcacaaaagattag

SEQ ID NO: 1608 - DNA, 612 bp, Staphylococcus epidermidis
atgaagcagtggatgaatagattaatcaccttaataggcgtattgttaatcattttagctatttatttattctcaaagccatatatcgataattatctacatgaaaaagataacgatcataaaattgaaaattatgataaaaaggaaaaagaacagacaaagacatctaaatcgacgccaaagataccttccgataaatctaaaatggctggttatatagaagttccagatgcacaaataaaagaaccagtataccctggtccagcaacaccagaacaactcaatagaggtgttagttttgcagaaggtgacgaatctcttaatcaacagaatatttcaattgctggtcatacgtttacagatcgttcgcactatcaatttacaaatttaaaatcagccaaaatcggtagtaaagtgtattttaaaactggaaatcaaactagaaagtataaaataactaaaatacgtgatgttaagcctacagaggttaaggtattagacgaacatcctaataagaaaaatcaattaacattaattacttgcgatgactataacgaagaaacgggtgtttgggaaacaaggaaaatattcatagctacacaaattaactaa

SEQ ID NO: 1609 - DNA, 699 bp, Staphylococcus epidermidis
ggagttatttttatgactggaaatcaaatgttttgtagagaaaatgaacttgatgaaagttttaaacaattagcatcttatatcaatattcctgtaggcgtattactgccatttaaaagtcaatgttttgtgagacattacaacaaaggacaaattgtctactattcgtctgatgaaaccacgcatatttatctactcttaaaaggtaatattatgagagaaaattttaatttgaatggtgatgtatatcgatatctgaatagagaaaaagtgctctttcctttaaataacttatttcaagataaagttcctaatgaaatgtgtacagccctaacagattgcgaaatgattggaataccaagagatttaatagaatatttatgcaaaaatcacgaagagatttttgtgaaattattctccttattaagcgaaacacagtgtcaacatattgaatacaatatggctttaacgagtaaattagctaaagaacgcgtgactaagattttacgttacctatgtcaaacagtaggttatgatcatgacgagttttatgaaattaagcattttatgacaatacagttattgagtgatatggcaggaatatctagagaaacgacgagtcatatcataaatgaacttaaagaagagaaaatactctttaaaaacagtaaaaattggttggttagtaaagacttataa

SEQ ID NO: 1610 - DNA, 576 bp, Staphylococcus epidermidis
agaagttcccgcaagtcaatacaaaggtcaaggtttccacaaccagtagctgaaaaaagtgctatcgcacatgcgaaaaaacatcgtgaagaatacgaaaaacttggcgaacaattttttaaagataattttagccttaatgttaaagccacaaatgttgtaggaagtggtgatggcgtcgaagtctacgttcattgcgatgatcatgacattgtgtttaatgcaagcatcccttttgataaggaagcaatacatgaagaaggctccatgcgaagcaatgataatggagataccatgagtaatatggttggaactgtgttaagtggttttgaatataaagcacaaaaagaaaaatatgataacttaacaaagttctttaaaaacaatgaagaaaaatatcaatataccggttttactaaagaagcaatacataagacacagaatgttggatatcaaaatgagtattattatttagcaggtaacgttactaatattaataattatagaaaatattatgaacctttaataaaaaaagattctaagagtttcaaagaaggtatgaaaaaaagcaaatga

SEQ ID NO: 1611 - DNA, 471 bp, Staphylococcus epidermidis
aatggtaaacgatgccgagaaaagattattaatcaaaatcgtgatattgtcgcaactgagaaatctttaccaccgtggaaacgttttttaagtcatttcagtttctacgcaatcgcattgcaatactttgtagttcagtttgttatcgcgttgttcctaatatggttaccaacatatttaactgaacaatatcatgtgaatttcaaagaaatgactatcagtgcattaccttggttatttatgttcttcttaattttatttggctggagctatttcagacaagattttgaatacaggtcaatcacgttttgttgcacgtggcgtaattgcgattgcgggatttgtggtattctcaatttcaattttcttagcagtacatacagacaacttatatgtaaccattttctggttatcactttgtttaggtggcgtacgtatttctatgggaatgagttgggctgcagccactga

SEQ ID NO: 1612 - DNA, 627 bp, Staphylococcus epidermidis
gggaaatggcgtttttttattgtagaaattggggggatatttatatttattgcgattacatatcataaacaactgactaaggacgatttacagcattataaacatatcgaagaagctattgatggcttgttatttcgcacttccatgaataacgaagaaaacaaggagatgattcaatctttacttcaattgggttttagtaaagataaaataattattcatagcgatgtgacactgttagaggatttacaccttaaacgtatccattttaaagaaaatgacacaactgctttcacatataaagaagctcatcctgatatttgtgtaagtatgtctacacatgacgttgaaacagtaaaacgatgttacgaaaatggtttggattctgtcttttttggacatatttttcctacctcttcacatccaaatgtaccaccgcgttctaaagaagctattcaacaggcattaaatgttcctatccctatttatgctattggtggtattaatgaacattcacttcaaaagatgccacctggatttaaaggtatatgtgccatatcatattttaacaatgcttcactagaagaaattaaacaattaagaaaggagtggtctactcatgcatga

SEQ ID NO: 1613 - DNA, 471 bp, Staphylococcus epidermidis
agggaatttagaataaaatgttttacggaggagattaatatgaattggttaaaaatattttatcatttattatgcgcaaccacgattagcgtgatattacttattataactatattaatggatgtgttactacaaaacacacatttaactcagttattactcaatattgattttttaatcaaccctgatgaagtgccaacaattattgaagtactgattcatttaagtattggaatattgatttatctcgcctttttaattatctatcattattcaaaatccttgtatcatctagcatacttacctttagtattgatatttactttgatgtatccacttctcgtttttcttgcgcaacgtccatttttttcctttagttggaacgaatttgcatggtggttagttgcacatctttttttcatcattttaatggcgacttgtctacctatcatttcgaaaaaaattttatga

SEQ ID NO: 1614 - DNA, 1557 bp, Staphylococcus epidermidis
ggggtaattagaatggtagtacctttcaaaaatgaacctggtattgatttttcagtacagacaaatgttgagcgttttaatgaagaattaaggaaagtaaaagcgcaactaggacaagatataccacttgtgattaacggagaaaaacttactaaaactgatacttttaattcagtgaatcctgcgaatacatcacagctcattgcgaaagtgtctaaagcaacgcaagatgatattgaaaaagctttcgaatcagcaaatcatgcgtatcaatcatggaagaagtggtcgcataaggaccgtgcagaattactgttacgtgtagccgcaattatccgtcgtcgaaaagaggaaatttccgctattatggtttatgaagccggcaagccttgggatgaagcagttggagatgcagctgagggtattgattttatagaatattatgcaagatcaatgatggaacttgcagatggtaagccagtattagacagagaaggtgaacataatcgctatttttataaacctattggtacaggcgtgacaattccaccatggaattttccatttgcaattatggctggtacaaccttagcccctgttgttgcaggtaacactgtattattaaagcctgctgaggatacagttttgactgcttataaattaatggaaatattagaagaagcaggtttaccacaaggtgttgtaaattttgttcctggtgatccaaaagaaattggagattatttagtcgaccataaagatacacattttgtcacatttacaggatcccgagctacaggtacacgtatttatgaacgtagtgctgtagtgcaagaaggacaacagtttttaaaacgtgttattgcagagatgggtggcaaagatgcgatagttgtagataataatgtagatacagatttagcggctgaagcaattgttacatctgcttttggtttctctggtcaaaaatgctctgcgtgttctcgtgccatagtccatcaagacgtacatgatgaaatattggaaaaagcaattcaattaactcaaaaattaactttaggtaatactgaagagaacacatttatggggccagtaattaatcaaaaacaatttgataaaatcaaaaattatattgaaattggtaaaaaagaaggcaaactagagactggtggtggaacagatgattctaccggttatttcattgaaccaacgattttctccggactacaatctgcggatcgtatcatgcaagaagaaatttttggaccagtcgtaggctttattaaggtcaaggattttgatgaggctattgaagtagctaatgatactgactatggtttgacaggcgctgtaattactaatcatcgtgaacattggattaaggctgtgaatgaatttgatgtaggtaacctttacttgaatagaggttgtacagctgcagtagtgggttatcatccatttggtggattcaagatgtctggtacagatgctaaaacaggaagtccagattacttacttaatttcttagaacaaaaagttgtttctgaaatgttttaa

SEQ ID NO: 1615 - DNA, 2871 bp, Staphylococcus epidermidis
aggagaattagattgagtaatttgatacaagatattaagcaatctttatataagggatttatagataaagatagttcccataaaggcaattttgttccaagattactagtaaataacaaagaagaaaatgtactttctactattatagatcagctgcataattgccaatcattttgtatttcggttgcatttataaccgagagtggtttagcaagtctaaaatcacatttttatgatttaagtaagaaaggcgtaaaaggaaggataataacatcaaattacttaggatttaatagtccgaaaatgtttgaggaattattaaaattagagaatgtagaggttaaattaacaaacattgaggggttccatgctaaggggtacatatttgaacatcataatcacacttcttttattatagggagttcgaatttaacttctaatgcattgaaattgaattatgaacataatttatttttatctactcataaaaatggagatcttgttaacaatattaaacataaatttgatgaactttgggattctagcttttctttaactaatgaatggataaatgaatataaacagtcttttgaatatcaaacattgcaaaaagtatttgataacactgtcgttcaaaattcagaaattaaaaagtttaatgagtcaaaacttataaaacccaatttaatgcaagaacacgctttaaagtcattagaatctttgagaaatgtgggaggagaaaaggggttaattatatctgcgacaggaactggaaaaactattttatgcgcacttgatgtaagagcatattctccagataaatttctatttattgttcataatgaaggtatattaaatagagctatagaagaatttaagaaagtatttccatatgaagatgaaagtgattttggattattaacaggaaagagaaaagatcatgatgctaaatttctttttgcaacaattcaaacactttctaaaaaggaaaattataaattctttaactctaatcattttgactacatcgtttttgacgaggcgcatcgaactgctgcatctagttatcagaaaatatttaattattttaaacctaactttttgctaggaatgactgcaacaccagaaagaactgatgaattaaatatttttgaattatttaattataatattgcttacgaaattcgtttacaagaggccttagagagtaatattttatgtccttttcattattttggagttacagattatattcaaaatgaaatgagtcaagaagatgcatttaatctaaaatatttagcatctaatgagcgtgttgaacatatcataaaaaagactaattattatggttactcaggtgatgttgtaaaaggtttaatatttgttagtagtaggggtgaggcgtatcaattagcaaaccaattaagtaaacgtggtatatcatcggttggtttgacaggaaaagattctatagcttatagaactgaaacaattcaacaactaaaagaaggatctattaattatataattactgttgatttgtttaacgaaggaattgatattcctgaaataaatcaagttgtaatgttaagacctactaaatcaagtattatatttattcaacagcttggtagaggattaagaaaaagtactaataaagaattcgttactgttattgattttattggtaattataaaactaactatatgatcccaatagccttatctggaaataaatctcaaaataaggataattatagaaaattcttaacagatactacggttttaaacggtgtttcaacaataaattttgaagaagtagctaaaaataaaatttataattcactagattctgttaaattaaaccaaccaaaattaattaaagaagcttttaacaatgtaaaagaccgtataggtaaattacctttactcatggactttataaataacgattcgatagatccaagtgtgattttctcacgttttaaaaattattatgagtttttaataaaaaataaaattattgagaatgaattaagtattaatgaatttaaaaatttaacatttttatcaagacaattatcacctggacttaaaaaagtagatattgatgtattgaaagaagttatacaaaatgacgtaacttatgaaaatttaacaaaaaaaatgttaaacattaataacgatatttctgaatatgatattaacacttcattaagcattttagattttacttttttcaaaaagactataggtaaaacttatggactacctttaatacaatataaggataatcttatttgtctagcaaatgaatttaaagaggctttaaataaaccactatttaacacatttgttcatgacttaattgatcttgctaattataataatgacagatatcaaaataagaaaaacagtttaattctatataacaaatattctagggaagattttgttaagttattaaactgggataaagatgaatctggaacaatcaatggttatcgtatgaaacatcgtacacttcctttatttatcacttatgataaacatgagaatatcagtgataatactaagtatgacgatgaatttttgagccaagacgaattgaaatggtacacgcggtctaatcgtaaattaacttcaccagaagtacaaaatattttaaagcatgaagaaaataatacagatatgtatatatttgtgaaaaaaagagatgatgaagggaaatatttctactatttaggtaaagccaaatatattaaaggaactgagaagcaagattatatgcctaatggaaatagcgtggtaactatgcatttatcaatgaatacgtccattcgagatgatatttatagatacatcacttaa

SEQ ID NO: 1616 - DNA, 210 bp, Staphylococcus epidermidis
cctttttatagttgttttaaagtgaaattttttaaaaagtatgaaattgatttaaaaaaagatattttgtttatgaaaagtaaattgaatgagagattggaaatgaaaaacagagactgtggaagtatgaaagtatataaaaagagtagaacagaattcaatttgaattcattattctactctttaatcttgtatagaaacatttgctaa

SEQ ID NO: 1617 - DNA, 864 bp, Staphylococcus epidermidis
aagtctaatagaaaaacattaaaattattgtacggctatattaagatgaaaataaatgttttatgcgagaagagggacaatatggatattaaacaatcttcagagaaacaaggtcgaccgcatcatttatcagacagtaggacagttttgaaaagaaattttatattaataccaacttatattttattacaaagtatcataccaatcattgttgttttcggctcattaggcatcactgccatgataacacaacaggcaccaccacaatggttgtatcattgttcattgagtttaagttttgtgattgctcaaggtctaatattaattatcttttataaaatacatcaatctgtaataaatgatgtgatgaagcaacaatggataattgcaaagaataaaataattaaaattgtaatagttgcgattgtcgtatatttattattacttataattcgggtgattggaacatcattacctaatcatttaagttatcatctcactcaatccgaacaacgtacgctagggctatttaaatcaccatatgtgttgttagttacttttatatccatggtattcttacgtccaatggtagaacaaatcatttatagatatctcatcatccatgaattaggaaaagtatggaatagacaatttgtaattggtttgtctattgttattgaaacgatcgtacatgtttacgacatggcatcgatttttgaaatttttccatatatcgttattgcttcagcagctacaatactatatattaaatcgcgggataatttaattgtcgcttatatatttcaagtgattttgcaatgtatcctttttatagaaattttatgtaagtataccaacttttaa

SEQ ID NO: 1618 - DNA, 858 bp, Staphylococcus epidermidis
ctacagctcagagtcaagcggaggaaagcgagcgataaggtgaaggataataatgaagtattaaagttatttatagtttcagattcaattggagaaacagcgcaacggatgattcatgcgacgctgacacagtttccagatttaactcaagtagaaattaagaaatttccatatattaaggacgaacaagaatttttaaatgtcttacaattagctaaagaacagaatgcaattgttgcaacaacattagtgagtgagtcatttaatgcattaggtcatcagtttgcaaatgaacatcaaattccctatgtagattacatgtctgagttaattagcataattaaacaacatacacacgctaaaccattaatggaaagtggtgcgttgcgtaagcttaatgatgagtattttaagcgtatagaagcaattgagtattcagtgaaatatgatgatggtaagcattttacagatattggagaagcggatgctttaatagtaggtgtatcacgtacctctaaaacgccattaagtatgtacttagctaataaaggatataagattgcaaatattcctttagtccctgaagtggctattccagataatgtatttcaacaaaagaatttaaaggtatttggattaacagcaagtcccaattatatcgcaaatatacgacgtaatcgtgcagaaacattagggctatcttcagaatctaattacaatagtttagagcgtatcaaaaaagaattatcttatgctgaagaagtttttagaaaattaaatgcaacggtaattaatacagaatataaatcgatagaggaatcggcattttatattgaaaagtttttagctaaacgttaa

SEQ ID NO: 1619 - DNA, 1761 bp, Staphylococcus epidermidis
aaagggaggctatttgtaaaaatggcacaaattaaagcaaatgaagcattagttaaggcattacaaacctggaatattgatcatttatatggtattcctggcgactcagtagatgctgttgttgatagcttacgtacggtcagagatcaatttaaattctatcacgtacgtcatgaacaggtagcgagtttagctgctgcaagttacacaaaaatgacagggaaaattggtgtagctttaagtatcggaggacctggtattgtacacttattaaatggtatgtacgatgctaaaatggataatgtacctcaacttattattgctggacaaacaaatagtacattattaggtacaaaattcttccaacagacaaacatttctaaaatggttgatgatgttgctgtatatcaccaccaaattcaaaaaggtgataacgtatttgaaattacaaatgaagcaattcgtacggcatacgagaaaaaaggtgtctctgttatcatttgtccaaatgacttattaactcaaaaaattaaagacactacaaatcgtgcagttgatacaactaaaccaaaaccagcttcaccaaaattcaaaagtattaaaaaagcagctaaattaattgataaagctaaaaaaccagtaatgcttattggtttaggtacacaacacgctaaagatgaattacgtgaatttattgaagctgcaaaaattccagttattcacacattacctgcaaaaacaatcttacctgacgatcatccttatagtattggtaacttaggtaaaattggtactaaaacatcttatcaaacaattcaagatgcagacttattaattatggctggtacgaactatccgtatgttaactatttacctaagaaaaacattaaagctattcaaatcgatacgaacgaagaaaatattggtgcacgctttaaaattaatgtaggtattttaggtgatagtaaagttgctttccatcaactaactgaaaacattaagcatgttgcaaaacgtccattcttagataagacattagaacgtaaagcagtttgggataaatggatgaaacaagatttgaataatgacaattcaccattacgtccagaacgtttaatgaaagcaatcaatgctaacttaaaagatgatgcaattatctcagcagatgttggtacttctacagtatggtctacgcgttacttaaacttatctgtaaataataaattcattatttctagttggttaggtactatgggctgtggtttaccaggtgcgatggcagctaaaattgcttatccaaaccgtcaagcagtagctatcacaggtgacggtgcgttccaaatggtaatgcaagactttgctacagctgttcaatataacttaccaatgacaatcttcgtattaaataacaaacaattgtcattcattaaatatgaacaacaagctgctggtgaattagagtatgccattgatttttctgatatggatcatgctaaatttgctgaagctgctggtggtaaaggctatgttgtgaaagatgtaagtcgtcttgacaacatcgttgaagaggcaatggctcaagatgttccaacaatcgttgacgttcatgttgatcctaatgctgcaccattaccaggtaaaattgtaaacgaagaagcatttggttacagtaaatgggcttatagatcaattactgaagataaaaacttagactttgatcaaatcccaccaatctctgtagcagctaaacgtttcttataa

SEQ ID NO: 1620 - DNA, 903 bp, Staphylococcus epidermidis
ggagtggaaagtatgaataaagaacaattagaaaaaatgactcatggtaaaggattcattgctgcattagaccaaagtggtggtagtacacctaaagcacttaaagaatatggtgtgaatgaagaccaatacagtaatgaagacgaaatgttccaacttgttcacgatatgcgtacacgtgttgtaacttcaccttcattttcacctgataaaattttaggtgcgattttattcgaacaaactatggatcgcgaagttgaaggtaaatacactggagactatttagcggacaaaggcgttgttcctttcttaaaagtcgacaaaggtcttgctgaagagaaaaatggcgtacaattaatgaaacctattgatgatttagatgaaactttagatcgtgcaaatgaacgtcatatcttcggtactaaaatgcgttctaacatccttgaacttaatgaacaaggaatcaaagatgttgttgaacaacaatttgaattcgctaaaaaaatcatcgctaaaggtttagtacctattatcgaaccagaagttaatattaatgctaaagataaatctgaaattgagaaagttttaaaagctgaaatcaaaaaaggtttagattcattaaacgatgatcaattagttatgttaaaattaactattcctactgaagctaacttatataaagatttagctgaccaccctaatgttgtacgtgtagtagtattatcaggtggttacagccgagatgaagctaacaaattgttaaaagataacgatgaattaattgcaagcttctcacgtgcattagcaagtgacttacgtgctagccaatcacaagaagaattcgataaagcattaggcgatgctgtagattcaatctatgatgcgtcagtaaataaaaactaa

SEQ ID NO: 1621 - DNA, 1431 bp, Staphylococcus epidermidis
gggcacatgaggtatcgtatgacattgcagaatcatttaaaacatcgcatattgttgatctatggagacaactcattgaagaggtgctatatgattaatttattcgaaaattataatcaagaaacacaggaattacatcaatctcttaagcgtgctggttacaatcactttacgattgtaattaatgatgatggatttttacctgatgatgtgacatcgccgtatcgttttttcacagcatatcaaatttatgaagatgatacccctgctttttttaatgatattgatacgccgcctttttgggaaattaaaggagatgcgacaatggctaccattacagatatgggtgagcttagaggtaaaatcttttataaggaacattataagacacgtgtagttagccatgtagagtggcttgattcaaaacagcgtttgcgttcggttgattattatacaaaagaaggatttaaatttgctgaaacagtttacgatttgttaggtaatgcaatattaaaaaagtatatgacacgtgaaggtaaagaagtgatttatgagaattatgtaactaacgatgtagttgtagaatatgaagggaaatcttatttttttgagtcatatacagagtggattaaattttacttgagtgaaatgggcattgagataaaagaagttatatttaatactttatcaacaccatttttagcaatttatcatttgccgacattgaaaaaaggtattttattttggcaagaacaatctcagggttatgtcccaggaaatatgaaagtcatgttatcaccaaaccttcaaagtcgctttgccgttattgtccctaatcagaatgaatacaaattgatcaaggaacaactatctagggaggaacaacaggcagtatatgcatctggttacttatatgacacgtataaacggaatcattattctaagaatgtattaacattaacaaattcagatcaaataccacatgttgaaacgttggtacgtttgcataaagattatcaatttcacataggcgctaaaactgagatgtcttcaaaattattaagtttatcgcaatatgaaaatgttaaattatatccaataattaaagaacaaacagttcaaaccttatatcaacaatgtgacatctatttagatattaatgaggggaacgaaatagggaatgctgtaagaagcgcatataatcatcaattgttaattatgggatataaagaggttgttcataatcaagatttcgttgcaatagaaaatcagtttcttgtaaatgatataagtcagttgagtaacgctttgaaagagataggaaatcatcgtggtcaatttgaaacacgtttagcactacaacaacgtcatgctaatgctgtgccggtatcaacatttaaatacgcattagtacaagcattaagtggttaa

SEQ ID NO: 1622 - DNA, 783 bp, Staphylococcus epidermidis
atggtaatgagtaatacagcactttgtctgacagcacttttattactaatccctatctttatttcttataaagaaggattgcatattatcaaagatttagttattgctacaattagagcaaccatacaactattgattttaggctttttattacattatattttcgaaattaatgaaaaatggttattagtgctatgtgtgttagtcattattatcaatgcatcttggaatacaataagtcgtgcttcacctgtcatgcatcatgttttttggatatcatttgtggctatatttgtgggaacagcgctaccattggcagcaactgttgctacaggtgcaattaaatttacagcgaatgaagtgattccaattggaggtatgttagctaataatggtttaatcgcgattaatctcgcttatcagaatttagaaaaagcatttgttcaagatgtttctgatattgaatccaaacttacgttagcagcgacacctaagctcgcatcaaaatcatctattagagaaagtatacgcttagcgattgttcctacaattgattctgtaaaaacatatggtctagtttcaattccaggtatgatgacaggattgattatcggaggcgttgacccacttcaagcaattaaatttcaattgcttgtcgtgtttattcatacaacagcgacgattatgtctgcactcattgcaacgtatatgagttacggtcaattctttaatgctcgtcatcaactcattgctagaacgcaacgcacaagacaaagtagttaa

SEQ ID NO: 1623 - DNA, 525 bp, Staphylococcus epidermidis
aaaggatggaggatatacgctttgaaaaaattttcagctacaatagtagtaatcattcttatatgcgcattgggcttttcattatatgcagctattaaccaccatacgaattctaataagaatgataaaaaaatagaacacaatcgcaaaaataaacaaaatgatacttcaaatcagaatcgtgatactaatcaacaccaagaccaaactcaaccaacaaataatgactataacaacgataatcaatcagatactgaacaaccagcacaacaacctaactatcatcaatacccaaataataatcaacagtctggttcaaataaaaataactcttcagaaaataacaaacagaaaccgaatcagaacaaaactaatcaatcagattatcaaccatcacaatcaacaccacaacagtcgtcacaacctaataataatcaatctgattcacaacaaaatggcaactcaaataataattccaacaatcaaaatcatggaacaaatgataatcagaataaaaatcgttaa

SEQ ID NO: 1624 - DNA, 1356 bp, Staphylococcus epidermidis
ttcataaggagaattgatatgaaagtcaaaagtatttcacggttcttttcaatgaagaaagtgacgctaagtttcgttactttatttattggagtagggacaataggttcatacaatcagtatgctgatgcaagtatgaaaacgcaacaaacacatgtaactaagtcatctccaactcaaaagacgacgtccaattttaaacgttcagttaaagatacgtctgttaaatctagagctacatcaataaaaagagctacatcaaccaaacaagctatatcacccaaaacgtcatcaactaaaaaaactacaatagcaaaaaaatctaccacagtaaataaaacgcgcacaacaaccaagactcagcctaccattcgtaagagttcaacaacttcaacacgttcaaaaacaatgcctacttctgtgaaacgcacaacttctcataaagcaactactgtgtcgccaacttctaaagctaaaatatcaacaaagacacaacaatcaactaaaagtcatacaacttcagttaagaaaaacactacacaactaagtaaaacaaaatctccgtcaacgtcaacaaaatctaaaacagttcaatcctctacgacaaaggcacaacctactttatcgactcaagttagtacaactactaaagcaaagcaattttcaacgccaactacttctaaaactgatagcagtaaatctttagtaagtttagcatctacagaacgtaaaatagataaataccaatcgatgactcagttagaaaaagaaacaactgaaggtgtacattggagaaaagatacgaaaaacacagggaatcaagtactcattgtggctccacatggcggaagtattgaacaaagtacaacagaattaactaaaacattagcagataaaggtaattatgattattatgcacttgaaagcattcgacctaaaaacaactctgaattacatgtgacgtctacacattatgatgatccgacattaaatcaaatgattaaaaaccgtactgcaactatttcgattcatggcgcatcaggtactgaggagattatctatcttggtgggccccgttcagatttaagaaatgctatagagaagcaacttgtaggatgtggatttacagttaaagttccaccagagtatctaggtggtcaaaataataaaaacttcattaataaagaagacaataacactggcgttcagttagaattaacgactgctttaagaaaagcattctttaaaaatggagatactagtacaaaaaatcgtaccaataaagaaaattggacaccaacaatggaagcatttattaatgcattatatgaaggtatcaatcaaacgtattcataa

SEQ ID NO: 1625 - DNA, 489 bp, Staphylococcus epidermidis
ttgctaattgggaggaataaatgtatgaagggtagcaaaaaattaaatgagttactagaagataatcagaagaaactaaaaaaattatttaagtacgatcataaaaaggctttggcgtttacaccagaggatagagaaaaagttaaggataagtttggtgtctatgtgattttcgatgagaaaaaaccagtgtttgtaggtcaaactggaggatattcatccacacatcaacctataaatagtgatttgtatacaaaattaggacaatacaattcacgttcagaaacaggtacaactaaatttagaaaagcttatgctcaaaataaggacttaaatccaaatcatttaaaagacattactgcagataaatacggcttcacttttcaatatataaaagtaaaagacgaacctgcgtttattaatgttttagaaattctcgcattagaatatgcaaaaaataaagggtatgaactttataattttcaataa

SEQ ID NO: 1626 - DNA, 6414 bp, Staphylococcus epidermidis
gaaaactatggggagtttattatgacaaagaaagaaaaggattataaaaaaagtcttgagcaacaaaaaacacgggtaaaaatatacaagtcaggaaaaagctgggtaaaagcaagtattaatgaaatagaattgttaaaaacaatggggctaccatttttaagtaaaaacgaaatacaagaaaatgtgactgaaaagacgaaaggtcataaattaaaaaaaagtgcagctaaaacaacagccctagttggtggagcatttacatttaatatgttgaataatcatcaagcatttgctgcctcagaaacaccaatcacctctgaaatttcatccaatagtgagacagtagccaatcaaaattcaactacgattaagaactcacaaaaagaaacagtcaattctacaagtttggaatctaaccattctaatagtacaaataagcaaatgtcttcagaagttacaaatacagatcaatccagtgaaaaagctggaattagtcaacaaagtagtgaaacatcaaatcaatcatctgagttaaatacatatgcctccacagaccatgtagagagtacaactactaacaatgataatactgcacaacaagatcaaaataagtcttcgaatgtaacctctaagtcaacacaatcaaacacgtcatcctcagaaaagaacattagctccaatttaacccagtcaatcgaaacaaaagcaaccgattcattagcgactagtgaagcacgtactagtacaaatcaaatatctaatctgacatcaacatctacttcgaatcaatcgagtcctacttcctttgcaaatttaagaacatttagtagatttactgttttgaatacgatggcagcaccgacaacaacgtccacgacaacaacttcaagtctgacatctaattctgttgtggtgaacaaagataactttaatgaacatatgaatctgtctggatctgcgacgtatgatcctaaaacaggtattgctaccttaacgccagacgcatatagtcaaaagggtgccatatctttaaacactcgattagattcaaaccgtagcttccgttttacaggtaaagttaaccttggtaatagatatgaaggttattctcctgatggtgtaacaggtggagatggcattggctttgcattttcaccaggccctttaggacagataggtaaagaaggggctgccgttggaataggtggtttgaataatgcctttggttttaaattggatacgtatcataacacatcaactcctaaatctgatgctaaagcaaaagcagacccacgtaatgttggtggtggtggcgcttttggtgccttcgtaagtacagatagaaatggtatggctaccactgaggcatcatctgcggctaaattaaatgtacaacctactgacaattcattccaagattttgtcattgactataatggtgatacaaaagtgatgacagtgacgtacgctggacaaacttttacgagaaatcttacagattggattaaaaacagtggtggtacgacgttttctctatctatgactgcctcaactggtggcgcaaaaaacttacaacaagttcaatttggaacattcgagtatacagaatcagctgttgctaaagtacgctatgtagatgcaaatactggtaaggatattattccacctaaaaccattgcaggtgaagttgatgcgactgtgaatatagataaacaattaaacaacttgaaaaattcaggttacagttatgttagtacagacgctttacaaaactccaattattcagaaacatcaggtacacctacacttaaattaactaactcaagccaaacggtgatttataaattcaaagatgttcaaggtcctcaaattagtgttgatagtcaaactagagaagttggaaagaccattaatccaattacaattactacaactgacaatagtaaagacgtattaactacaactgtgacaggtctaccttcagggttatcttttgatcaaacgacaaatacaattactggcacgccaagtgaagtaggaactacaactgtgacagttaatactactgatgctactgggaacgtaacatctaagcaatttacaataacgattcaagatacaatcagccctgttgtaaatgtgacgccaagtcaagcatcagaagttttcacgccgattaatccaattacgataactgctacagataatagtggcaaagtggtaacgcatacagtaactggattgccacaaggacttaaatttgatgcatctacgaattcaattgttggaactccaactcaaataggaacaaatacaatcacgattgagtcaacggatgcgagcggaaataaaactacgactaaaattaattatgaagtaacgagaaatagcgcaagtgactctacttccactagcatagtaaatagtgtttcaacaagtataagtaatagtacatcgctaagtgatagtgtaaaagcgagtcaatcattatcaacaagtaagagtctctcagagtcgttaagtgcgtcgacgtcgaatagtacgtcaatccaagcgagcgaatcagcaagcacaagtaaacaattatcagaatcagcgagtacgtcgacatctgatagtgcatcagagtcagcaagaaagagtgagtcaacgagtaaaagtacgtcattaagtgaatcgacaagcacaagcgtttcagattcagcaagcgtgtcaacgtcagaaagtgcgtcaacatcaacaagtgtgagtggctcaacaagtacaagcatttcagactcaacgagcacatcgacgtctgatagcgcatcaataaaagcgagcgaatcagcaagcacaagtaaactattatcagaatcagtgagtacgtcgacgtctgatagcgcatcaacgtcaacgagcgtaagtgactccaatagcgcaagtacgtcattaagtaaatcgacaagcacaagcgtttcagattcaacaagtacatcgacatccgacagtgcgtccacatcaacgagtgagagtgagtcagacagtgcaagtacgtcattaagtgaatcgacaagtacaagcgtttcagattcaacgagtacgtcgacatccgacagtgcatcaatgtcagcgagcgagagtgaatcaaacagtaaaagtacgtcattaagtgaatcgacaagtacgagtctttcaggctcaacgagtgcgtcgacatccgacagtgcatcaacgtcaacgagtgagagtgagtcagacagtacaagtacgtcattaagtgaatcgacaagtacgagtctttcaggctcaacgagtgcgtcgacatccgacagtgcatcaacgtcaacaagcgagagtgactcaacaagtgaaagtacatcgttgagtgaatcattaagcacaagcgtttcagattcaacaagcgcgtcaacgtcagaaagtgcatccacatcaacgagtgagagtgagtcaaacagtgccagcacatcgttaagtggatcattaagtacaagcatttcagattcaacgagtacgtcgacatccgacagtgcatcaacgtcaacgagtgagagtgagtcagacagtacaagtacgtcattaagtgaatcgacaagcacaagtctttcggactcaacaagtacgtcaacgtcagaaagtgcatcaacgtcaacgagtgagagtgactcaacaagtgaaagtacgtcattaagcgagtcgacaagcacaagcgtttcagattcaacaagcgcgtcgacatccgacagtgcatcaacatcaacgagtgtgagcgactcggaaagtgcaagtacatccataagtgaatcattaagtacgagcgtttcagattcaacgagtacgtcgacatccgacagtgcatcaacgtcaacgagtgagagtgactcaacaagtgaaagtacgtcattaagcgagtcgataagcacaagcgtttcagattcaacaagcgcgtcgacatccgacagtgcgtccacatcaacgagtgagagtgagtcagacagtgcaagtacatcgttaagtggctcgacaagtacgagtctttcagattcaacgagtacatcgacatcagacagtgcatcaacgtcaacaagtgagagcgactcggaaagagcaagtacatccttaagtggctcgacaagtacgagtctttcagattcaacgagtacatcgacatcagacagtgcatcaacatcaacgagtgtgagtgactcaaacagtgccagcacatcgttaagtggctcattaagtacaagcgtttcagactcaacaagtacatcaacatccgatagtgcatctgcatcaacaagtgagagcgactcggaaagagcaagtacatcgttgagtggctcaacaagtacaagcatttcagactcaacaagtacatcaacatcagacagtgcatcaacatcaacgagtgtgagtgagtcaaacagtacaagcacatccataagtgaatcattaagtacgagcgtttcagattcaacgagtacatcgacatcagacagtgcatcaacatcaacgagtgtgagtgactcggacagtgcaagtacgtcatcaagtgaatcagtaagcacaagtgattcagaatcaacaagcacatccacatcagatagtgcatccacatcaacgagtgtgagtgagtcaaacagtacaagcacatcattgagtggctcaacaagtacaagcgtttcagactcaacaagtacatcgacatcagacagtgcatctgcatcaacaagtgagagcgactcggacagtgcaagtacgtcatcaagtgaatcagtaagcacaagcgtttcagattcaacaagcgcgtcaacgtcagaaagtgcgtcaacatcaacgagtgtgagtgactcgaatagtgcaagtacgtcattaagtgaatcgacaagtacgagtctttcagattcaacgagtatgtcgacatcagacagtgcgtcaacatcaacaagtgagagcgactcggacagtgcaagtacatcgttaagtgactcgacaagtacgagcgtttcagaatcgacaagtacatcaacatcaacgagtgtgagtgcctcaaacagtacaagtacgtcattaagtgactcgagaagtacgagtctttcagactcaacgagcacatcgacatcagaaagtggatcaacgtcaacaagtgagagcgactcggacagtgcaagtacatccttaagtgagtcaacaagtacaagcatttcagactcaacgagtacatcaacatcagatagtgcatctacatctatgagtgtaagcgactcaaacagagcaagtacgtccttaagtgactcgacaagcacaagcgtttcagattcaacaagcgcgtcaacatcagaaagcgcatcaacgtcaacaagagagagtgaatcaacaagtgcaagtacgtcattgagtgaatcgacaagcacaagcgtttcagattcaacaagtacatcgacatccgacagtgcgtcaacgtcaacaagtgagagtgactcaaacagtgaaagtacatcgttaagtgagtcgacaagcacaagcgtttcagattcaacaagcgcgtcaacgtcagcaagtgcatcaacatcaacgagcgtgagtgactccaatagcgcaagtacgtcattaagtggctcaacaagtacaagcgtttcagactcaacgagtacgtcgacatcagcaagtgcatcaacatcaacgagcgagagcgactccgatagcgcaagtacgtcgttaagtggctcaacaagtacaagcatttcagactcaacgagtacgtcgacatcagacagtgcgtccacatccacatcagaaagtgcatccacatcaacgagtgtgagtgagtcagacagtgaaagtacatcggtaagtgaatcatcaagtacaagcgtttcagattcaacaagtacatcgacatcagaaagtgcatcaacgtcaacaagcgagagtgaatcaacaagtgaaagtacatcggtaagtgaatcatcaagtacaagcatttcagattcatcaagcacgtccacatcaatgagtacatctgaaactttcacttctcaatctcctataaatagtgaaagtcaatttattggtgatagcttgtctgaagatacaatcgtgactcaatcaaaaaatacgaatatgcttaataaaactggaaaagattatgatttacaagaacaaagaggttatactgattcagaacaacacaatgaaacacaaagtaatcaagctgataatcactcaaacaacctcgatttacttcatcaaaatcgtttacaagataaagtcgttaaacaaccgactaaaggagaagatggagttgtaagcaacggttttatagtagcagtagcaatagtattggctatcttcggtttggcaaaaaaatctagaaaagacgatgatgatcaagatggtagtaaataa

SEQ ID NO: 1627 - DNA, 1137 bp, Staphylococcus epidermidis
gaaaggagtggtctactcatgcatgatgtactaatcattggttcaggagttattggtatgtcaattgctagacacctcagtgcaacacacttagatgttgcagtcatagatagagatgtacctggaaagcatgcgtcatataaagctggaggtatgcttggcgcacaaaatgaatttacagaggatagtgacttgtttcaattagccatcgaatctcgtgctatgtttccacaattaagtaaatcattattagatgaaacaggcatagacattcaatttaaaaattcaggacttatcaaaattgctaatgaacacgatgatatctcatctataaaacgacaatatcaatttctgaatagtcaagaccgtagtgtcaaacaattatcagatgatgatttgctacaacttacacatggtgaagttaaaccttcatacgcggccattcacataccacacgatggtcaaattaatgcacatcattacacactggcattattagaatcaatgaagttaagagatattaagcgttatgagtctacagaggtcacttcaatagaacggcataatggctattattcagtgaaaaccgatcaatcttcaacaattgaagcgcacaaaattatcgttgcaggtggcgcatggtcttcgcaattattaacacaatatcatctacaacgacaagtgattggcgttaaaggtgaagttatcttattagaaaataacgatctttcacttactgagacattatttatgactaatggttgttacatcgttccaaaacaacccaatcgttttttaattggtgcgacgagtgaatttaataattattctgtcggtactacagatgaaggtatggattggcttcttcgccatgcatatcatcgtgtacctcaactaaaagacagtcatatactgaagaaatggtcaggagtaagaccatacacagaaaaagaaatgccagtcatggatcaaattgatgatggcttatacgtgataagtggtcattatcgaaacggaatattattgtcacctattatcggtcgtgacattgccaattggctactttctggtattaaaccatcacgttattcaagttttacagttacaaggaggaataatcatgaagtgtatcattaa

SEQ ID NO: 1628 - DNA, 1584 bp, Staphylococcus epidermidis
atattggtagggaggaggttttggaatatgaaacgatttataccagcttggtatagccgtaacagatggtgggaaagtacctcaagaccattctatctaaaaaaacagtatacagattttgacgatatgattagtttaatgacaatgcatagttcgaataatgtggattatcaattgatagttttaaattttagtccatatcttagaacattcctccatcgatatgatttgtatgaaagtcattattggtctgtatttgatgagatacagggcgttggacatcaaacgcctcaagctattgattatcgcgatctttcatggccagaaggcactgaatttatttttactccctttcaaattcaagcgattacaggtgataacacgttttctaaaattcacttcagccaagaggggtacctgatgtgggtagaggattacaagtatagtacaattcaaagacgatttgtattcgatgacagaggatttatatcggcagtgcgtacttatacacctgatggtgataacaataaaaaacactatttttcaaaagatggggaagaaatatttgttgaagacttaaatgttaatacagtaacgattaataaaaatttccaatcaaaatttaaaagggttacgtattcatctatggctgagttgatagaagagaaattccaatcatatgtagaaagagaattgaatgaagatgattctgttatagtggcatctgatgaacgtcataattcaatgatggcacgcactattgatgcatcgtctttatgtttttctatttttactgagcgaaataaagtggtgacacaagatttatatgactctatttctagagcatattattgtctcgttgatacacaagctaatcaaaatatgattgaacactacgcaggattgaacatgaatgatattaatcttttaagggtaacgccttttgatgcgaagtcattacctaaccaaagtagtcaattgtatgacacttatattggattatggatagatggtttggacgagattgaaatacgagagattgtaaacagcttatttcaatatattcaacataaagatggctataagttgaaaattttaactaagagtagagataatcttacggaaaatcttatagatgaagttgctcatctcaatgatttatatcaccaagagaaaaaggaaataagtgatgtaattgaagacgtgatacagaataaaaaagaaacaatcattgatattgaaacagtaccgtttgaagaagatcttgtaagcgttatttcaaaattaagagttgtagtagatttatctttagagccgaaactttttttacaaatctgttgtattggcgcgggtataccacaaattaataaaaagagaacagattatgttaaacatatgcataatggatatattattgatgacatatcgcaaactgtagaatctttagattattttttggcacatttaaaaaattggaattattcttatgcatattccatgagattaacggatgattttagttcaattaatattattcatcaaattaatcagttatttaaaggtgatgtttcaagtggcacgtaa

SEQ ID NO: 1629 - DNA, 888 bp, Staphylococcus epidermidis
ataggtaaaggagtttatagattgaaaaagataaaaaaagcaataattcctgccgctggtttaggtactcgttttttaccagcaactaaggcgatgccaaaagaaatgttaccaatattagataaaccaacaatccaatatattgtagaagaagcttctaaagcagggattgaagatattattatagtgactggcaagcataaacgtgcaattgaagatcactttgataatcaaaaagaattagaaatggttcttgaaaataaaggaaaagcagacctgcttgaaaaagtacaatattcaacagatttagctaatattttttacgtacgacaaaaagaacaaaaagggctaggacatgcaattcatactgcaaaacagtttatcggtaacgaaccatttgcagtgttattaggagatgacattgtagagtctgatacaccagctattaaacaattaatggatgtttatgaagaaacaggccattcagtaataggtgttcaagaagtaccagaatctgatacacatcgttatggtgtgattgatccttctgctaaagggggaagtcgatatgaagtacgtcaatttgtagaaaagccgaaacaaggtactgccccgtctaatttagcaatcatgggtcgttatgtattaacaccagaaatttttgattatcttgaaacacaacaagagggtgctggaaatgaaattcaattaactgatgcgattgaacgaatgaatagcaaacaaaaagtgtatgcatatgattttgagggtaatcgttatgatgttggagaaaaattaggatttgttaaaacaacgattgaatatgctttaaaagatccagaaatgagtcatgacttaaaagcattcattaaacaactagatatttaa

SEQ ID NO: 1630 - DNA, 681 bp, Staphylococcus epidermidis
agagaggaaggtatgattatgaatcagatgaatcaaacgattattgatgcattccattttagacatgcgacaaaagaatttgaccctacgaaaaaaattagtgatgaagattttaatacgattttagaaacaggtagattatctccaagttcactaggtttagaaccttggcactttgtagtggttcaaaataaagaattgagagaaaaattgaaagcctatagttggggagcacaaaagcaacttgatacagcaagtcactttgtattaatttttgctcgtaagaatgtgacggctcatacagattacgtgcaacatttacttcgtggcgtcaaaaaatatgaagaaagtacaattccagcagttgaaaataaatttgatgatttccaagaaagtttccatattgccgataatgaacgaacattatatgactgggcgagtaaacaaacatatattgcattagcaaacatgatgacaagtgctgcattactaggtatcgactcatgtccaattgaaggatttgatttagataaagtgactgaaattctttcagatgagggtgttttagatacggaacaatttggtatttcagttatggtaggctttggttacagagcacaagaacctaaacatggcaaagttagacaaaacgaagacgacatcattagttggattgaataa

SEQ ID NO: 1631 - DNA, 780 bp, Staphylococcus epidermidis
tacagtagaggagtgacatatatggctttaataacaatgaattacaattcaccaacgataggaatgcatcaaaatttaacgattattttaccggaggatgtaacattctttggtagttcaacaacagcgaaacatttgaaatcaatgttgttattacatggattgtctagcgatgaaacaacttacataagatatacaagtatcgagcgttatgcaaatgaacatcaacttgcgattataatgcctaacgtcgatcatagtggctatgcaaatatggtatatggacatagttactatgattacatattagaaatttacgaatatgtacatcaaattttaccactatctagaaaaagagaagataattttattgcaggacattcaatgggcggttatggaacgattaaatttgcgctaactcaaagtgataaatttgctaaagctgcaccactttcagcagttttcgaagcacaacgtttcattgacttggattggactgatttttcccctcaatctatcacaggcaacaatactcaaattaaaggtacagaactcgatacgtactacttacttgatcaagccatcgatgctaatgtagatattcctgaattgtttatcatgtgtggtaaagaagactttttatatcatgataaccttcaatttattgagacattaaataaaaaaggggtttcttataagtttgaagatggtccaggagatcatgattatgcttattgggatagagctattaaacgtgcgattaagtggtttgtccagtaa

SEQ ID NO: 1632 - DNA, 1542 bp, Staphylococcus epidermidis
tttataggaggtaataaaatgaagaatttttctaaattcgcacttacaagtattgctgcattaactgtggcaagtcctttagtcaatacggaggttgacgctaaggataaagtatcagcaactcaaaacatcgatgcgaaagtaacccaagaatctcaagcaactgacgcattgaaagagttaccaaaatctgaaaatataaaaaagcattacaaagattataaggtcactgatactgaaaaagataacaaaggatttacgcattacacattgcaaccgaaagtgggcaacacgtatgcaccagacaaagaagtaaaagttcatacgaataaagagggtaaggtagttcttgtcaatggtgatactgatgctaagaaagttcaacctacgaataaggtatcgataagtaaagaaagtgccacagataaagctttcgaagcaataaaaattgaccgtcaaaaagctaaaaacttaaaaagtgatgtcatcaaaaccaataaagttgagattgatggagaaaaaaataaatatgtatataacatagaaattattacaacttcaccaaaaatctctcattggaatgtgaaaattgacgctgaaactggtcaagtggttgataaattaaatatgatcaaagaagcagctactacaggtacaggtaaaggtgtactaggtgacacgaaacaaattaatattaatagtgtcagtggtggctatgcactacaagatttaactcaacaaggtacactttcagcttacaattacgatgcgaatactggtcaagcttacttaatgcaagataaagatagaaattttgatgatgatgaacaacgtgcaggtgtagatgcaaattattacgctaaagaaacgtatgactattataaaaatactttcggccgagaatcatatgataatcaaggcagcccaatcatttcactcgcacatgtaaataatttccaaggtcaagataacagaaacaatgcggcttggattggtgataaaatgatttacggtgacggagatggacgtacatttacagcgctgtctggtgcaaatgatgttgttgcacatgaaattacacatggtgtaacacagcaaactgctaatcttgtttaccgttctcaatcaggtgcattaaatgaaagtttttcagatgtatttggttacttcgttgatgatgaagatttcttaatgggtgaagatgtatacacacctggtgtaggcggagatgccttaagaagtatgtctaatccagagcgttttggacaaccatctcatatgaatgattttgtttatacaaattctgacaacggaggcgtacatacgaattcaggtattccgaacaaagcagcttacaacacaattcgtagtattggtaaacaacgttctgaacaaatttattatagagcattaactgtttatttaacttcaaattctgatttccaagatgctaaagcatcattacaacaagcagcacttgatttatatggcgacggtattgctcaacaagtaggtcaagcatgggacagtgttggtgtgtaa

SEQ ID NO: 1633 - DNA, 801 bp, Staphylococcus epidermidis
acgagagggggagtggttcatatggggaaagtatatttagttggagctggacctggtgatccagaattaataacgttaaaaggtttaaaagccattaaagaagccgatgtcatcctttatgaccgacttgtaaataaagaaatacttaattatgcttctccttctactaagttcttctattgcggtaaggatcctcacaggcactccttaccgcaggaagaaacaaataaaatgatggtaaccttagccaaaaaagggcacatagttacacgtttaaagggtggcgatccatttgtttttggacgtggcggagaagaagcagaggaattagcatgtcataatatccactttgaaattatacctggaattacatcgggaattgcagcaccagcatatgctggaattccagtaacacatcgtgattatagttcttctgtagcatttgtaactgcagtgaataaacctggtatggataaaggcaaatactggcaacatttggccaatggtcctgaaactttatgtatttatatgggggttaagagactcagtgaaatttgtgagttgttaatacaatatggtcgttcgtcagaaacaccagtagctctcgtgcatatgggaacgtcaaaacagcaaatgacagtgactgggacactcgatacaattcaagaacgagcacatcatattcagaatccagcaatgattattgtaggcgaagtggttaagatgagagaaaaaattaattggtttgtagaacaggcaactgttcaaaatgaaacgttaacggaaatgtcatcaacttag

SEQ ID NO: 1634 - DNA, 396 bp, Staphylococcus epidermidis
cttttctttataaaagaagggtgtttgttgatgagtcaaatcgaatttaaggatgttagtaaagtgtatccaaatggccatgtgggattaaaagatattaacttaaatatagaaaaaggtgattttgcagttattgttggactgtctggagcaggtaaatcaacattactacgatcggttaatcggctacatgatatttccaaaggtgatattactatcgaaggtcagtcaataactaaagcacgtggtaaaaaattattagaaatgcgtcgaagtataggtatgatttttcaacattttaacttagttaagcgttcaacagtgcttagaaatgttttgagtggccagggtaggataccatcttacttggaaaatgatactgggtctttttcctaa

SEQ ID NO: 1635 - DNA, 234 bp, Staphylococcus epidermidis
ttatactttatcattttattgttgaaaattataagaatttttatgtcgtttgtgacaaagtacgtaaacatacattcaaatttaaaattaatctatttatttaattatcattttatctatatttcctttttattgttagtaggttttatatcattattactatgcggtcacacttacgctagacaaaccgtagccttacctcaaggtgcaataaggagctttgtatttttttga

SEQ ID NO: 1636 - DNA, 891 bp, Staphylococcus epidermidis
aggtgtcttatggactttatagctattttaatcggattagggccactattaggttggggattatttccaactatcgcttctaagtttggtggacgtccagtcaatcaaatctttggtgctactgttggtactttgatcttcgcaattgttctagcactatttaaaggtataggtttaccaggaggtatggcattagtattttcgctcatatcaggtgcaggatgggcatttggtcaaattattacttttaaagcgttcgaattagtaggttcatcaagagcgatgccaattactactgcatttcaattacttggtgcatctttatggggcgtttttgcgcttggcaactggcccggtataacaaacaaaatcattggatttctagctttactcgtaatccttataggtgcacgtatgactgtatggactgaaacaaagcaacaagaatatagtaaaaatctacgaagtgcagtgatcttattacttgtaggtgaaattggctattggatatattctgctgcacctcaagcaacggatattggtggatttaaagcttttttacctcaagctataggaatggtcattgtggctgtcatctatgcgttgatgaatatgtctaaaggtaatgcttttaaagagaaagtaagttggcaacaaataatatccggatttttctttgcgtttgctgctttaacttatttaatttcagcacaacctaatatgaatggtttagcaacaggatttgttctatctcaaacatctgtagtattagcaacgctaacaggcatttttttcttaaatcagaaaaaaacatcaaaagaattaatgattacaattgtgggattagttcttattttagttgcagcatcaatcacagtgtttattaaataa

SEQ ID NO: 1637 - DNA, 324 bp, Staphylococcus epidermidis
gtggtcattatcgaaacggaatattattgtcacctattatcggtcgtgacattgccaattggctactttctggtattaaaccatcacgttattcaagttttacagttacaaggaggaataatcatgaagtgtatcattaatggcgacctcttcactttcgatcagaatcaatcgatacaagaggttttacattcacttgaattagacccaaaacgagtgattgttgaactaaacaaagaacttatcaagcaagacaaatatgaagaatatactgtaagagaagacgacagattagaattactagaaattgttggaggcggttaa

SEQ ID NO: 1638 - DNA, 1485 bp, Staphylococcus epidermidis
ggacgaattatgttcccgccatcaggcggtatgagcaactatgcacagtatactcacggctcattacttggttttattgcagcatgggcgaactgggtatcattagtaacaattattcccattgaagctgtgtctgctgttcaatatatgagttcttggccttgggattgggctaaaccaatgggatctttaatgaaagatggctcaatcagtacttacggtttgattgctgtttacatcattattgcaatcttttcattattaaactattggtcagtaaagttattaacatcatttacaagtttaatttctgtattcaaattaggtgtccctattttaaccataattatgttattagtttccggttttgatacaggtaattatggacactctatcggtacatttatgccttacggaagtgcacctatttttgctgcaacaacaacatctggaattatcttctcatttaatgcattccagacaattattaacatgggatcagagattaaaaatccagagaaaaacatcgcacgtgggattgttatctcacttacattaagtgctatattatatatagttttacaaagtacgttcattacatctatgccaagctcaatgttgcacgagcatggatggagcggtatcaatttcaattctccatttgcagatatggcaattttattaggtcttaactggttagcaatattactttatatggaagcagttgtgtcaccgtttggtactggggtttcttttgttgccgttactggacgtgtgttacgcgctatggaagaaaatgggcatattcctaaattcttaggtaaaattaataaaaagtataatatcccacgtgttgccattgcatttaatgcaattatcagcatggttatggtgacattgttccgtgactggggtacactagctgcggttatttctactgcaacattagttgcatatttaactggtccaactacggttatttcattacgtaaaatggcaccaaaaatgactcgtccattcaaagctaatattttaaaatttatggcacctttatcctttgttttagcatcattagctatctattgggcaatgtggccaacaacagcagaagttattttaattattattttaggtttacctatttatttcttctatgaatataaaatgaattggaagaatactaaaaaacaaattggcggaagcttatggattattatctaccttattgttctcgcatttttatcatttattggaagtaaagagttcaaaggcttaaattggattcactatccatgggatttcttagtcattgtaatcgttgctttaatcttctatcaacttggtacaacaagttactttgaaagtatttatttcaaacgtgcaaacaagttgaataagaaaatgggcgataaattgcgtaaaacacgcaaaaaagcgcgtcataaagattggaaagaacgcgatcgacaagagcaaaatcaataa

SEQ ID NO: 1639 - DNA, 195 bp, Staphylococcus epidermidis
ttcattgttattaaagccatatatgtcactcctctactgtattatctattattttacttattcttttcattaatttatagaaaaaacgcaactttgactatagattatataaatttctatactttccaatgcggaactaaaattttattctctatattaaacaagttgattcagtatcgattgtctaacctttaa

SEQ ID NO: 1640 - DNA, 204 bp, Staphylococcus epidermidis
ccaatccctataaaaattaatcctaaaattaaaaatattattaaccgtacacgtgacttttcatgcgtcttacttttatttttaagcaataactgtaaggagtttttaaatgatattttaaaattgttaataacaaacaatatgatcatcaaactgagtagcatggttaatgtgattttcattgataaaacatcaaatggataa

SEQ ID NO: 1641 - DNA, 630 bp, Staphylococcus epidermidis
atacatcatatatcatcaattcgaaatggggttatcaatgtgaaaaagatttctctaattgcaacgactgtattaacaggattattattatttccaagtgtcaatgacacaacgacacatgcagccgaagtaacatctcatgatgcacaagctgtagcaattcaagctatgaaaaatagtggtggcaatccggacttacaaaatttcaaaaaagttaaggataaaggggattatttcacaattgatataaataataaatctggtgcaggtgtcggtacttataaagtatacaaaaatggagtggtgctatataaaagtggaaattatggagaatatagtcaactcaatacacgacaatgttatgttgcacaagatattgctacaacatcttcacaagtaaaacgacactctactcaacagacacaagcagtggatagtacacgtgagctcaattcatactacgtaggtcaagttcaatcttctgacttaccacaacaaagttcatctgatatgctaccgaatactggtatgaaagataaaaatttcaatacaaatggtataataagtctatttttactcactgctggtttcattacactttaccatcaacctttacgtaaaatgtcatag

SEQ ID NO: 1642 - DNA, 192 bp, Staphylococcus epidermidis
cttaatcatatatttttctttcatataagagaagcatcgataattacaacagtgcctgtttctatagcaataaaatctgtcactgttaaatttaggataaacaaaaacggttatccaccttttgttaaggtgaataaccgttttttaatttatctttctaagataagaacaatacaacatgttttcctgtaa

SEQ ID NO: 1643 - DNA, 2022 bp, Staphylococcus epidermidis
gtgactaatatgactttcaagattttgtggaaaatgattaaacaaaattttgttaatcaacgtcatatcattgttccatttattagcgtaataagtattttattcggtattgaatacatattgttatcgttaacaaccaacatttactttaatgagcatcatcctgaattaaaaatatctgcgattattggaatagtgtttatgacgatgttattattcatatttttaatttatgcaaatcactttgttatgaatcataggaaaaaggaatttgccttaaatatggttcttggtatggagaaaaaacatctaagactcatcatcttgattgaacttttcattcagtttattatatctgcaatattgagcattgttggaggttacttatttggtgagctcttttttatgttatttaataaactagttaatacgcatcaacctcagttgtctgattatccatttgatgttttatcaatgaaaatcacattaaccatgctactcagtttgatgatcatattgtttgttattaacaattttaaaatatcatttaaaaactccttacagttattgcttaaaaataaaagtaagacgcatgaaaagtcacgtgtacggttaataatatttttaattttaggattaatttttatagggattggctattatttagctataaaacctaacacagctatcggttccttggggattatattttttgcgattttgtcaacgcttattggtacctatttgctctttgttagcttaggatcaatagttttagaaatgttacaaaaattagattattattattataaacccaatcattttttctttattgcaggactcaaatcacgcgtaaaatctagtgcgattggtttagctaccatttcatttatgtgtacatttctgattgttacgttaagtatgacagtctcaacttatagaaatatggatcataggtttgaatttgcatttaaaaatgattacgcaggttattatattggtgattttcataaagatagcaaacttcaacgtaagatagaaaatttaaaaaaagatattcgccaagaagttccaactggtcaatttaaaatttatgcacgaggtatggttggagccgaattgcagggaggcttaaaacataaaaagctaaaaagacaaactgtatcgagtggtttatttaatttcggaaataagcaaaaattcaactcttttatttctatatataataaaagtgattataataaaaacaataaaaaaataaaattagatgatgatgaaattgcaataagtacaagtgtgtcattatttaaaaaaatgaaaacgctcaatatatttgggaaaacatatagagttaaatatattgagtctacaaatatagataacttactctatgcagatggtataactttaattgtgaatcaacaacaactgatggatcgtatcgttaatgaatatcgtaatcacaatgatgaaaatttaatcatcactcctaatcaagtccaaactgccgttgaatttaatgtattaaaagaaaaggataagttgaatcatcgtattaagaaaataggtgttcaacacgatattgaatttcaagtgaaaaaacaaaacctattgatgtggaaacaagtcaactcaagtttagtttttgttggaagtgttgtatctctagttttattgataggtatatttcttatgatgtattataaacaagtttcagaaggacatgaagatagagatgcatatataacgatgaaacaactaggattagatgaaattttaatcaaaaaaacaattaataaacaagtaatatgggtatttctcattcctgtaattgttgcaatcatacatacgttagctgcttttcgcatcatatactctgtattaggaatcgttggtcaatatgacttgggactgtatgctacaagttatgtcggtgtgatagttgtatttattattttttattcaataatgtactggattacttctagaatttattatacgatgataaacggtaagcattaa

SEQ ID NO: 1644 - DNA, 1626 bp, Staphylococcus epidermidis
cggatgattttagttcaattaatattattcatcaaattaatcagttatttaaaggtgatgtttcaagtggcacgtaaatttagagtacttcaagtaggtggtcatgatttaggttctttatttaatcaaaaaagtaatgtcgaatgggattattttgatgttggtttgtttgattttgaaagtggctatcaagatgttgtagtacatattttagatgaaaaaggacaatttgattttgtttttgtacgtgaaaaatattctgattcattaatgaaacttttatcattagtcagtacaccgtataatactgtgattgacaatgagtattgggataatcaataccaacaagataagacaatacaacgtaattttataaaaccactcatttatgaaaatgaagaacaattacaacaaaaactagaggcagttacatttcctgggcaatatggagataaagttaaacctattcattgtcgcgttagtattcattttgatggttcttatcaatttaatggaaatgagtctattgaagtatcaggacgatttggggaatcataccaacccctcattacatggagtcaaaatatcattgctgatgccaataaggtgaatcaaatatggccagaatttaaagttgaaggtgatgctaaaatccaatatacattgagattgacgcctgtttattcaactgatcaaccagtagaaaagctaatatatgaacaagacgatttagacactcccatagaactacctgctcgtccttatcaaacatatgtgagtgtatcaatcaaagctaaaggtaaaggaacattatttataggtgctattcataaacgttggtcacgcttggaattagggcagttcatattaggcggaaaacgatatagtgatgaaaataagcaagaatttatacattacttccatcctggagatttaaaaccaccactcaatgtatattttagtgggtatcgtactgctgagggctttgaagggtactttatgatgaaacgtatgaatgctccatttattttaatagctgatcctagaatcgaaggtggtgccttttacctagggtcagagaattatgaacaggcaatccgtaaggtcatccaaaatgctttggattatttgggatttgcgaacaaccaattaattctttctggattatcaatgggatcatttggcgcactttattacgctacaaaattaaatccagcggctgttattgtaggaaaacctttgataaatctcggtactattgctaataatatgaaactcgttcgtccaaacgattttggaacgtcacttgatattttgcgattgaatcaaaatggcataactaacaaagatgttgttcagttagataatcatttttggaagcaaattcagcatagtgatttgtcaatgaccacatttgcgattgcttacatggagcatgatgattatgacaaatatgcatttcaagatttattgcctgttcttacaaaacaacatgcacgtgtgataagtaaaagaattcctggtagacataatgatgattctgctactgttactcattggtttattaatttttatcatttaatcatggaagagcgatttgggagggtaacacatgcaagaagatag

SEQ ID NO: 1645 - DNA, 534 bp, Staphylococcus epidermidis
gaaacaaatatgaaagaaaaacgtagtaatgttcgttggtattttgcaatagggttcttctttattggggttattgcttacatggatcgatctaacatatcttatattgcagtaccgatgatgaaagatttggggttaactaagacacaatttggtttattagcatcatttttctccctaggatatgcattaatgcaagtaccttcggggatgttagcagagaagtttggaccacgtaaaatgattactgtcgctttagtttggtggagtgcatttaccatcttaacagggatgattaaacatcatggtttactttactttattagattcttatttggtgttggtgaagcgccaatgtatccatccaatgcagtttttaactctttttggttcgctaaaaatgaaaaaggtcgtgcatctattgcgttgttagcaggatcttattttggtccagttttagcacctatcatcactatagccattgtcaatgcttttaactggcaagccgttttctatattttcggggttgtatga

SEQ ID NO: 1646 - DNA, 1149 bp, Staphylococcus epidermidis
gtaaaatgtattttttcacaaaaattatatatatccattcaacaaacgtggtataattattgtgaaaaatttcacataataaatggaggtattgatatgaaagcttatgaatacttaaaacctggtcatgcacaacttacggataaagagaagccaactattacgagcagtactgacgctattattcgcatagttaagacgacaatatgtggtacagatcttcatatcataaaaggagatacacctgaagttaaatcacatacgacactaggtcacgaaggtattggaatcattgaagaaattggtgacaacgttaacaacttcaaagttggagataaagtgattatctcttgcatttcatcatgtggcaaatgctactattgcaaaaaaggtatctatgcacattgtgaaaacggaggaggatggatattaggacatttagtgaatggtactcaagcagaatatgttaaagttccttttgcagataattctttatatcacgccccttcaaatttaaaagacgacgcccttgtaatgttatcagatatacttccaacaggttatgaaattggtgttttaaaaggtaaagttaaacctggctgtacagtagccattgtaggcgctggtcctgtaggtttagcagcattacttacagcacaattctattcaccttcaaaaattattatgattgatttagatgataatagattagaaaccgctaaagaactaggtgctacgcatttaattaactctaaagagactgaaaccgcaattaaaaaggtaaaatcgttaaatccacgtggtgttgatgttgctattgaagctgtcggaattccacaaacctttgatttatgtcaaaatttaattggtgtcgatggtacgattgctaatgttggtgtgcatgggttacctgtacaacttgatatagataaattatggattaaaaatattaacgtaactactggtttagtttcaggaaatacaactgaagaattacttgaagcgttaaaaagcaaaataatacaaccagaacaactcgtgacacattatagtaaactgagtgaaatcgaaagtgcctatgatttatttagaaatgcaacagatcataaagcgattaaattaatcatagagaatgatatcacaatttaa

SEQ ID NO: 1647 - DNA, 201 bp, Staphylococcus epidermidis
aggaggcgtatcatgttttctactggtaataaagctaaaaagactatatttggagctatgacttgttcaaaatgtggtaagacactcaataatgatgaaaatattaccatcaaaatcaatactaaagaattaaaaggttatactcacttatcaagttgggctgatgcacagtataaattgtgtgaaaactgctcagaataa

SEQ ID NO: 1648 - DNA, 270 bp, Staphylococcus epidermidis
attatattcatatttaagttatttttatcgttaaacttgaaaacaaataaatatgtatataaaatttataatttaatacacacaaaaaagcaccttaaatgttttcattactcatttaaggtgcttattaaattaaatatttattttaacggttacctacatcatgaccgacatctacagtatttttatctttatcataaacagcaccttggacactgccaaagtttggatcattatgcttttcttcaacaccataaccaagacttttaa

SEQ ID NO: 1649 - DNA, 312 bp, Staphylococcus epidermidis
ataccattcatcaaagcgtcaaaactgtcactgagcaaacgaccgagcagtattaaagcaaaattccaaattgtagtacctattaaagataaagttgtaaactgtataacgttcattcgattaatgccagcaggtattgtaattaatactcgaagtactgggacaaaacgacataaaaatacagcccatgcaccatactttttaaaccaatcatttgcccgtttcaaatctttactttttaacttcatccacttaccatgtcgatcaacgaaacgatataatttctcttctgagataagtctacaaatataa

SEQ ID NO: 1650 - DNA, 336 bp, Staphylococcus epidermidis
gtgtatatcatgtatgagaatatacaaaatattgaagatttttaccgatttataaatgcacacgctttagctgttgttcatattatgagagataattgtacagtatgtcatgcagtattaccccaaattcaagatttactaaaggactatccgaaagcacaattaggtgtgattaatcaatctaatgttgaagctattgccggagaactttctatttttacagtacctgttgatttaatttttttgaaagggaaagaaatgcatagacaagcacgttttatcgatatgcaatcgtttgaaaaacaattgtatatgatgcaaaatgccatcgattaa

SEQ ID NO: 1651 - DNA, 624 bp, Staphylococcus epidermidis
gaggaaatcatcatgaatatgcccttaatgattgatttaagtaacaagaaagtcgtcattgtaggtggaggtaaagtggcaacacgtcgtgctaaaactttattagcttatacaaaacatattcatgttgtaagtccaacaattaccgatacattacaaaaatatctagaaacgaagcaaatcacttatgaaaagaaacacttcgaaccacaagatgttgagaatgctgatgtggtcatcgcggctactaatcaatctgatgttaacaacgatgtgggggcagctttgtctaagaacgtattatttaatcatgcaggacaagcagacctaggtaatataacgttccctaatttcttaaaaagagataaattaacaataagtgtatcaactgatggtgcaagtcctaaattaggtcaacgaattattaaagatttaaaagatacatacaataaagactattcaatgtatattcagtttttatatgaaagtagacaatatattaaatcacttaaaattgagccatctgataaacaagcgttactcgagcaaattttgtcagacaaatatttagatgagaagaagcaacaagatttcatccgatggctaaaatcacaagtcaaatga

SEQ ID NO: 1652 - DNA, 207 bp, Staphylococcus epidermidis
tttttatacataagacacctcgttaatttagtttattggtatttattaaattatacgaaaggtccttatttttcaaagtattttaatataaaattacatatatgcacaaagtattttggcgagactcttgagggaacaggacaagctgaagactacaggctgaagctgtcagataagaaagcgagccaacaatacgaagtattataa

SEQ ID NO: 1653 - DNA, 1542 bp, Staphylococcus epidermidis
gaggcaaacatggaagaaagaattggtttgatagacattggttccaacacgattcgacttgttatatttggctacaataaaaaaactgggctcaatgaaatactgaatataaaaacacctgcacgattaagtcaatatctcactaagtccaatgaaatgaatgatgaaggtattcatgttttaaaagagacattaagcagttttagaaaagttgcggataaatttaacgttgatgcattatatcccatcgcaacagctgctatccgtcaatcaaaaaatcgtgaagctatcattaaagaaattaaacaagatattcatatcgaaattcaaattgtacctgaagaagatgaagcattttacggttactatgcgattacacatactactgatattgaaaatggaatttctgtcgatatcgggggcggttctaccgaagttacccttttcaaagacaagcaacttaaagaggctcatagctttccattcggcgtggtatcacttaagcgtcagttttttggtgataaagcacacaatgacaaaacagccattaaaaatatggaacagtttttacgtgagcaatttagtcagttagactggctatccaaccaacatattgcgcttgtaggagtaggtggttctgcacgtaatgttgcacgcattcatcaatcagcacatgcataccctatcggtggcgttcataactataagatgacttcgaaagatattaacaatgtttatgatttaatccgtaaaagttctcgcgatgaacttacaaatttagacggtttaagccgcgatcgcgtcgatattattctgccagctatctccgtctttaaaacacttttcaaaaaaattgacgccacacaattcaccttctcaagaaaaggaattcgtgaaggatttattatgaaccacatcagcaaacgatatcctgatgagtttaataaaagtaacgtacgtaaagatgcattacgtcatttagcgaatgaatatcatattgaagaaacgagtgctaatcgtcgtgtaaaattagctcaatccttattgaatcaaattataagtgaacgatcacttaatatttcagcaatggaaaaagaattatttattgaaggttcctacatttattacctaggtagtttcattgattcagactcaagttcaccacatacgtattacttaatcgcaaattcaatgattaacggcttttcacataaagatcgtgtgaaattagctttgttagctagttttaaaaacaaatctttacttaaattttattgcaaagaaacacagtggtttagtaataaagaaatagatacaatacaagctttaggggggattattaaatttgcaaacaccttgaatatctcacatactagttttgtagaggaagttaaactaaaagcaaagaaagatgacaaatacgatttattagtttattacaaaggttcacctattgcagaagaataccaagcaaatcgtcagaaaaagcatattgaaaaaattttaaaaggtaaggtttctattatatttacaaaatcttaa

SEQ ID NO: 1654 - DNA, 1080 bp, Staphylococcus epidermidis
aataggagcatttatatgtacaaattagttaagcctttattattcaaattagatcctgaacgagcacatggtttgaccatcaatgcgttgaagtgtgttcaaaaatgttcacccattttacctatcgttaataagttatttacttataacaatccaatattaacgcaacacattcacggtatttcttttgataatcctatcgggttagctgcaggttttgataaatcttgtgaagttccaaaagcacttgaaaacattggcttcggtgcaattgaactcggcggtataacacctaagcctcaaccaggtaatccaaaaccacgcatgtatcgtttactagaagatgatgcactcatcaatcgtatgggattcaataataagggtatgaataaagcactaagtaatttacgtaatcattcatgctcaataccagtaggattaaatgttggtgtgaataaaacaacttcctatgaaaatcgctatcaagattacattaaagtgattgacacatttaaaaatgacgtctcattctttacagtgaatattagctccccaaatacagaaaatctccaaaactttcacgacgaagatgaattttcgatgttatgtgatgctttaaattcatttaaagctaagaacaatattaatgtacctatctttttaaagttaacatctgatatggaattagatggttttaaaaaaatcttgccttcaattacagatacattcgatggggttatgttggcaaatacgacacgacaacgcgatggattaaattcaaaaaataaaatacaaaaaggtggcttgagtggcagaccattattccaaagaaacttacaactggttaaatatgcctatcaacaaacacgaggtaacttcttaattattggaactggtggtatattcagttctgaagatgctatcaaaatgttaagaaacggtgcatcattactacaaatatactcttcattagtcattgaaggaccaggtttgactaagaaaatgaataaagaaattgcgcattatttaactcgacatggttatgctaatgtaagtgatattattggtttagatgcataa

SEQ ID NO: 1655 - DNA, 318 bp, Staphylococcus epidermidis
aacaacttttttcccaaattttttcattttaacgaactccttcataataaagttacacaaataactgtgttagcttatttgtataatatttctattaaaataactagaattttacttcagttcagatataaaaaattcattttaatgacaatttttcaacacttttctgaagcaatcaattcagcgactaactttattacgtttattattatagtacgtgacaaagtattaataaaatacataataacgatgttaaccattcataaaaggaataggtttcctatagaaaaatgtaatactttgtttattcatatatga

SEQ ID NO: 1656 - DNA, 1185 bp, Staphylococcus epidermidis
attattttaatgaggaggcatagcatggaaatgtcagaaaggctagcttcaattcctgatagctactttggcaaaacaatgggccgtatagttgaacatggtcctttaccacttataaatatggcagttggaattccagatggagaaacgccaaagggtattatcaatcatttttcagaggcgctatgtattccagaaaatcaaaagtatggtccatttcacggcaaagatgcctttaaacaagctattgttaacttctaccaaagacattacgatgttgaattagacaaagaagatgaagtttgtattttatatgggactaaaaatggtcttgttgcattacctacttgtgttgttaatcctggtgaaattgtacttttacctgatccgggatatacagattatttagcgggggtcatgttagctgatgctaagccactccctttaaaattgtcgccaccaaattatttgccgaattggaatactataagtgctaaagttcttgagaagactaagctaatttatttaacatatcccaataatcctaccggttcgacagcgacacaagatgattttgatgaagcgattcatcgttttaaaggtactcaaacaaagatagttcatgactttgcatatagtgcttttggatttgacgccaaaaatccaagcatattagcttctaaaaatgcaaaagatgttgctatcgagatattctctttatctaaaggttataatatgtcaggctttcgtgttgggtttgctgttggtaataaaaaaatgattcaagcgttaaagaagtatcaaactcatacaaatgcaggtatgtttggagcacttcaagatgctgctacgtatgcactcaatcattatgataagtttttagaaaagcaaaatgaaatatttagacgtagacgtgataattttgaatcacaactaaaacatgcacatttaccgtttgttcactctaagggaggtatttacatttggttacatacacccccgggttatgatagtgaagcattcgaacagttgttattaaaagaaaagtcaattttagttgcacctggtaaaccatttggtgaaaatggtaatcaatatgtgagggtttcattggcgctcgatgataaacaattagaagaagcggcgaatcgcttaacacaattacggtatttgtatgaaagataa

SEQ ID NO: 1657 - DNA, 447 bp, Staphylococcus epidermidis
attacgctaatcacaataattatagcttatcatagttgggtcataataaatttacttataatttacattagattaaaacaacgatgttacattatatatgaaagatattacgactttaggaggagaggtatggagaagtcagttaaacttgctgttggcatctatctagcaattattttaattatttgtagtatttacctcgcatttatacttattggaagcttaaatggtaaagacatgagtaattctgttctagatactgatcactctcgtatcaacaatacttcaagaaacagtaacgaagatgttacgtcatcaaataatgagtcaaacaatacaaaagcgcactcatttgcaaactctgaatataaagctattaacataaacgaagcatttaaaaataataagcaaattaaaaaagcgaattcgagttatcaatactattga

SEQ ID NO: 1658 - DNA, 744 bp, Staphylococcus epidermidis
ttcgctataatgggtttgaagagaaatcggaggttgagaaagatgtatgtagagagaaagcctgcactttatatcgaagatttacgagacgaattcaaaaatagcttaaaacattttaaagatgatgatgaagcatttaatacattagttggatttgtggaactggaccacctatattcttcagcacttaaagaaataagtacaaaattaagtattttagatgataactttaactatcaatataaacacaatccaattcatcatatggaacgacgagtaaaagagatgcacagtttagttaaaaagttgaatcgtaaaggatttgaagtgagtgcacaaagtgctaaagataacattatggatattgctggtatacgggtcgtatgtaactatttagacgatgtttatgtcattgaaaaaatgttattaagacaagaagatgttaaattattaaaacgtaaagattatatcacacatcctaaagaaaacggctatcgaagtttacatatcgtcgtatctattccagtgtttttagcagattcagtagaagtaacaccagtagaaatacaaattcgtacaatcggcatggatatgtgggcaagtttggaacacaaaattcgttataaaaatgatacagacactgaaaaatataaaggactattagaacaatgtgcatcagaaattacaaatgtagaaagtaaaatgcaacaaatacattcagaaatttcaaatcgagagaagtag

SEQ ID NO: 1659 - DNA, 2661 bp, Staphylococcus epidermidis
tatgacataataaaaaataagaggtggtcaagaatgacacaattcgtttatgcatttaatgaaggaaatatagctatgaaagacttacttggtggtaaaggtgccaatctttcagagatgaagagactcggactaccagtaccagatggttttacaattacgactgaagcttgtattacatatttaaaacaaaatgaagaactacctacagaagtaaagacacaattaattgatcatttagcagctttttctaaacgaacaggaaaagccttttcctctgatgataacttgttattagtatcagtacgtagtggtgcaaaaatttccatgccaggaatgatggatacaattcttaatttaggacttaatgatgataatgtaaaaaagcttgttgacaaaacaaatgatgcacgatttgcatatgattgttaccgtcgtttactacaaatgtttggagaggttgtttatggtattccaatgacagctttcgatacatattttaatgattttaaaacaaagcatcgttatcaaaatgatgctgaaattccggcagaaggactacaaactatatgtgaaaaatataaagaaatctatgtagaagaggcatataaaccttttccccaagaaccgttaaagcaattagaagaagcaattgaagcagtatttaaatcttgggataatgatcgtgcacgtgtatatagagatttaaatgatattccacatgatattggtacagccgtaaatattcaggaaatggtatttggtaatagtggtgaaaatagtggtacgggtgtagcatttacaagaaatccagttactggagaaaatcatttattcggagagtacttacttaatgctcaaggtgaagatgttgttgcaggcattcgtacccctaaggatattgacactttaaaacaacaaatgccagatgtacatcaagagtttgttgatgtaaccaaacaacttgaaaaacattacaaagatatgcaagacatagaatttacaattgaaaatggtaaactttatttattacaaacacgtaacggaaaacgtactgctaaagctgcaataaaaattgctgtggatttagttcacgagcaattaattacacgtgaagaagcagtatcaaaagtagaagtaaaatcaatagaccaattattacatcctaattttaatgaagaatcattaaagcaagcgacagtggtttctaaaatgggcttaccagctagtcccggtgcagcaacaggaaaagtagtcttctctgctgaagaagcaaaacttcaagctgaaaatggtaataaagtagtgttaatgcgaccggaaacatcacctgaagatattgaggggatggtagcaagtgaagcaatcgtaacaactcatggtggtatgacatcacacgctgctgttgtagcaagaggaatgggcaaatgttgtgtgacaggatgttcgaatgtagagatagatacagtgaacaaaacagtatattatcctgaaggtgaattacatgaaggggatatcgtttctgtagatggttcagctggtgatttatatttaggagcaattgaaacagtcaatgctgaacatagtgaagagttcgatcaatttatgacttggtctgaagagattgcaagactgcaagttagaatgaatgctgaaacaccacaagatataaaagctggatataattttggttctaaaggaataggtttagttcgtactgagcacatgttctttggccctgaacgtttaatagaaatgcgccgttttatcttagcttcaaatcatgacgaacgtgtacaagctttagaaaaaattaaaacataccaagtagaagattttgaaacaattttcagattatctcaagatagacctacgattgttcgtttacttgatccaccgttacatgagttcttaccatcatctgaagaagatataaacaatgtttctcaacagctgaatgtatcttcagagttcttacgcaagcgaatcgttgacttaaatgaggtcaatccaatgcttggtcatcgtggttgtcgtttggctgtgacttatccagagttatatgagatgcaagttgaagctatcattgaaagtgttattaagcttcaaaaagagggcataacgtgcctaccagaaattatgattcctctcgtgtcaacagtagaagaatttacaactttaaaagaacgattagttaatacaattacacatttagaaaaagaatcacaacaagatatacaatatatgataggtactatgattgaaacgcctagagcatgcttgattgcgaatgaccttgcgaaacattgtgatttcttcagttttggtactaatgatttaacgcaattgacatttggtttctctagagatgatgcaggaaaattcataaatgtgtatactgaaaataacattttacagcttgacccattccaaactttagatagagaaggtgtaggacgactaattcaattagctgttgaacaagctaaaaatacaaatccagagataaaaattggtgtatgtggtgagcttggtggcgatgcaaaatcaattcgtaaatttaaccaatgggaaattgattatgtttcatgttcaccatttagagttccgggtgcaattttagctacagctcagagtcaagcggaggaaagcgagcgataa

SEQ ID NO: 1660 - DNA, 2889 bp, Staphylococcus epidermidis
aaaagaataatgataattaggagtgtgaaaatgaaaaacgcactaaaactttttatcacggatttaaaaagagttgctaaaacaccaggtgtatgggtcatcttagctggtttagcaattcttccttcattctatgcatggtttaacctctgggctatgtgggatccgtatggtcatacaggacatatcaaagttgccgtagtgaatgaagaccaaggtgaaaaagttcgtggtaagaatattaatgtaggaaataaaatggtcaaaactttaaaaaagaatgatagttttgactggcaatttgtgagtagagaaaaagccgaccatgaaattaagatgggaaaatattatgcaggtatttacataccgaagaaatttacacatgaaatcactggtactttaagaaaacatcctcaaaaggcggatatagattttaaagtaaatcagaagattaatgccgtagcagctaagttaaccgatacgggatcgtcgtttgtgattgataaagcaaataaacaatttaacaaaaccgtagcaaccgctttactttctgaagctaataaagtcggactatcaattgaagataatgtacctacaatcaataaaattaagagtgctgtatatcaagctaataattcattgcctaaaattaatcaatttgcagacaagattattgaactaaataaacatcaagacgatttggatgcttatgctaatcaatttagaagtttaggaaagtataaagggaatgtattagacgctcaagaaaaacttaatgctgttaattcgtctattccggcgcttaatgaaagggctaaattgatacttgcacttgatagctacatgcctaatattgaaagaattttaaatgttgctgctaatgacgttccagcacaatttcctagaatcaataggggtgtcgatattgcaagtgaaggtattgatgcagcgagtggtcagttaaatgatgcaaaaggttatttgactcaagctaaagcgagagtgggagactatcaagaagcagctggccgcgctcaagatgtgaacaaccaagcaaatcaaaatctaagaaatcaaacatcaactacaccccaaagcgctataaagtcatcgcattcggaagggaagagtcattcaagtattaaaacagtacctgtgagtcaatcaggtgagaatcaacccgtttatggtgataacattttatctaacagtgatgtaaaatcaatgaatacagctttaacagaagctttattatcattatctaatcaaacagatcaacaagcacaagctacccaacaagacattaagtcattaaaaaatatagcatatggtgttatcgcttcagataaaccatcagagtttaaagaaccattaaaaaatataaaatcacgcttagaaaacgcatctaagtataatcaacaatttatagatatcttgtcagagttggaaaaaagtgaacatgttgatctatctaatgaaattaagcaagtgaaagaagcaaacaatagcattaatgataatttaaaaagtactaatcaattaatagatgcattgtcaaatggtagctccggacaattagaagcagtcaatgtattacgtgacttacctaacttaaataaaaggttagatacattacgaaattacattaaaaaagaacttaatcgtaatttactagctgtttctaatgagattactgatcaacttaataaaggtcaaaatacattatcgacaatccaatctaaattaaatactattaaccgagtgattaacgctggtcaagatattttaaatagcggtaaaaagagaattgatacgattcaaactgcattgccagcaatcgaaaacgcatatataaatgcaatgcgaactgcacaagcttacttcccaacagctaaaaaagatgtcgcgaaagctgcagactttgtacgtaatgacttgcctggattagagagagaattagctaatgtaacacagtctgtaaaccaaaaaataccatctttatttagtcgttatgataatgctgtagatttattaaacgagaaacagcctcaagcaaaagaagcacttgcttcgcttgccgatttctcagaaaataaattgccagatgttgagaaagacttgaaaaaagcaaataaaatcttcaaaaagttagataaagatgatgctgtagataagctaatagatacattgaaaaatgatttgaagaaacaggcagatattgttgctaaccctattaataaaaaaacgacagatgtgttcccagtaaaagactatggttctggtatgacgccgttctatactgcattgtctatttgggttggaggattattaatggtcagcttattatctgtagataacaaacatgaacacttacaacctattatgacgaagagacaagtgtatcttggtaaatctggtttctttttcttattaggtatcatacaggcattaatagtatctatcggtgatttagttatccttaaagcatcgatagaatcaccgatattatttgtctctattgccgtgtttagttctctcgtatttaattcgattatttacacatctgtatcattgttaggtaaccctggtaaggctgttgctattatcttacttgtgttacaaattgctggtggaggaggtacattcccaattcaaacaacgccagaattcttccaagcgatatctccatatttaccattcacgtattctatcgacgcattacgtgaaacagttggaggtatagttccagagatactgattacgaaagtgatcattttaggtttattcggaatcggattcatggttgtaggttattgcttgaaacctgtgactgaccctattatccgtaaaattgctgaaaaagctgatgaaagtaaagtaactgaataa

SEQ ID NO: 1661 - DNA, 210 bp, Staphylococcus epidermidis
acaataccaatcattttacctctgttttttgctgatgtgagcatcgctgtgagtgctaaaactttcacaataatgagtgaagctgcggcagaagataaaatacgtcctacaactattattccaaaatgtggcgcaatggcaatcataccattcccgaagataaagacaattaacgtccataataatactgatcgcgaagaaaaccgatga

SEQ ID NO: 1662 - DNA, 231 bp, Staphylococcus epidermidis
accaggcaaatagtgcggtttataagttttgttgagacgtctataattgttctcgttcattcaattacactccgtttaatttttaaaatacttgctcttaatattatcacaattacatcctcaattgcattgacatgtcatctttttactttaatattatactttaacaaattaaataggtatacatttattagagcatcttcatataagttgtgtaggcaagcaatttaa

SEQ ID NO: 1663 - DNA, 249 bp, Staphylococcus epidermidis
acatgtaaaataatctataataggtatcataattattgggggctagagaccctaagagaaggtgagacaatgatatttgtaatgttatctccaatattaattattttgtttattgtactaagcgtattagaagaaaaacgtagaaagaaaaattcaaaagaacaaaattcgaatcatgtagatcagcaacaatatgattataccgacaaagaacaacaacaaaataaaaattcaaatgatgataaataa

SEQ ID NO: 1664 - DNA, 1209 bp, Staphylococcus epidermidis
ggtgaaaaaatgtttaagaaattcgaatataaaatcttatataaaagaatattttttacatgcttaattttagttatatatattataggaagtaatatttcaatcgtaagtaatgaaaatttaagaactcataaagactccttttttaagttagctattactaatgtaggtggggatttacatacattaaatatattttcactaggacttgggccgtggttaagttcgatgattattttgacactaataaaccacaaaagtaatgataaggttaaaacacaaactcgtagggaacgacatttcaaagagcgagcgttaacacttatcattagtgctgctcaaggattttacattattcattcatatattaataaacatgcgattaaagatagtaatatgctcattttattattagtcttaattacaggaacgttgttaatggtgtggttagcagatcaaaatacaacgtatggcatttcgggacctatgccaattgttttaatgagtcttgttaaatctatatttaatacaccttttcctaaattaaattcaagcgcatctttaattactatgattattgtcttattagtgctggacttatttatactcttctttattgagttaacagaatatcggatagaatataatgatattatgaatatttctgctaaagatataccatcatatttatcatggaaacttaatccagctggtagtatctctatcatggtgagtttgtcattatttatgttaacgaataatatcgttaatttcataggacgctttatcgtgaatcataattttgaaacacatgtctttaattttacaaatccagttggaattactatatatcttctgttacaaatgattttgggttactttttatcaagattattaattaatacgaaacgtaaatcaaaggaatttcttaaaaatgggaattacttcgagggtatacaacctggacagcagacagaaaaatttctagggagtaaagcacgtcgtatttgttggttcggttcaatagtagtagcgattgtactcgctataccaatgtattcagcgctgcttgtcccccacttacttaaagaagtttactttacaactcaaatgattgtatttgtctatattggaattaatatcgctgaaacaattagagcgtacttatactttgacagctataagcaaattttaaataaatattggtag

SEQ ID NO: 1665 - DNA, 1116 bp, Staphylococcus epidermidis
attgttgaaatcgctttctttagggtgtacgataactatggcctaaaaataaagaaagaaggttttggggaaatggatattattttaggagtagggactttagtactcgttcttattatcatgacgcttttcttaaattttgcgccatatggtaaacaaggtttacaagctttatcaggggctgcttgtgccacgtttttaccacaggcgttcttaagttacgcaattggtggcgtattccatgttaaatttttccaagaaattggtgatctagcagggagtttaagtggtatagctgttggtatattaacttgtctaaagttagaagtgtctccagtatttgcagtcattgtaggtttagtattacatgactcaaaattattacctgcgtttatcgcagcgtatgttgttgcatttggaatcaagtttgttgagaaaaaagttccagagggactagatttaattgttgttattttattggctccagcagttacatttggtcttgcaaacttaatttctccaggggttattgcagtacttaaacaaattggtagtgcaatcacttcagtaggtgataacaacccatatgcattagcagtcattttaggacttgttattcctgtaactggtatgacgccattaagctcaatggtgcttacaagcttattaggtttaactggtattccaatggcaattggtgcattaacatgtacaggagcatcttttgttaatggaatcttatttagcaaattaaaaattggtaataaaggtaatgccttcgcggtatttgtagaaccgttaactcaaattgacttaattgccaaatatccactacaactgtttggtgcgaatgccattattggtgttgtaaatgcttgtattgtcacatacagtggactaattattgatattaaaggtatggcaacacctatagcaggtgctattgtactttatggctttaacgacgctgtaagatctacaattacaattatcgcagtagcaattgcaagtgtgatattagcgtacgttattagtgctattattaataaatttaacttgatgaatgtcggattcaagttaccacgtagaaaaaaccaagttaaggagagtgtttaa

SEQ ID NO: 1666 - DNA, 459 bp, Staphylococcus epidermidis
aataaaatgataggttcagaattatatttctccttattcgtaggtgtcgtactcagtttgatatttgctgagaaatttgggattaatccagcagggttagtcgttccaggttatttagctttgatttttgatcaaccgatcatgttgttatcagtattaatcattagttgcttaacttattttatcgtaagcaacggtattagtaagtgggttattttatatggtagaagaaaattcgctgccatgatactgacgggaatggtgattaaatttatatttgatctcttgtacccattgaccccatttgaaatggttgaagtttcaggtataggtgttgtcattcctggtattattgcgaatacaattcaaaaacaaggtgtagtcattacactttctacaacaatgttattaacatgtattacatatatcatcttatttttatatagttttattaattaa

SEQ ID NO: 1667 - DNA, 1878 bp, Staphylococcus epidermidis
ttaatcgtgattgatagacaaatcaaactcatcaaattgttattaaattatacagatacgtatataagtggccatgatattgccaaacagttaaatgtatctaatagaactatacgtaatgatattaaaactatacatactacatttctaaatgaattaattttaagtgtacaatctaaaggttatatgctaaatacatgtctttatacacctgatgagatacaatctgctttagagtcagttattgtaaaagagaataaattgcttatcacaattgcttataggttatttatggaaaagcatacattcactatcaaagagctatcttcaacttaccatttaacaaaatcaaaagtgattgattatgtaacacgtatacaaacgtgggctataaaatttgatatttatttatcaataaaaaagaagcaaggtatcatgatcgatgcgagtacaacgagtatcagtaatgctgtacttcatatcaatcaacttacagacgatgactttaaagttgaaaaccttattttacaagagttacctcaagcccatactagaaaaataaaacaaattatctcaaagcatatagataatcatcaattatcaacttctgaaaataaaatacaacaattacttgtgcatctaattttaattatcaaacattctcaaccagaggaagaagattggagcactgatacagaatctttaactattgcgaaaaagtgtataaaagatatcaatgaaacccttggatatcaacttaacaataaaacaagtgaatgcttttccttttttattagctaccatttcaataagtttgatttagggatccaacaactatttattcaaagttatatcgatcgactcattgaattaatggagcaacatattggttttcccttttcacaagatacaattttaaaagataatatgaacgtccactttagtcgtacatatttgcgattaatgagtcatgtttatctaaataatccattaacaagtcaaatcaaacgactatatccctttgtctttaatacactatatgatagtattcgacaattatcacaagataccaatatccaattaagcgaagatgagattgcctttttaactatacattttcagtcttctatcgaacgccataagtcatcacatattcatgttgtaattgcttgttattatggcttaggcatttcaacgttgcttgctgagaaaatcaaacaacttaatcatgcaatacagatcgtagatacattaaaacttgaagatattaacaactatcattttgaagggattgacttattaattactactcacgactttgatacaagtcaacttttacaaatacctaaagtcatacaagtatcacctttattttcagatgaagatgctaaaaaaatcgaattctttgtaaaagacatgcaaaacccattatcaaaagatgatatattatcaaaaattcagttgagtgttgagtccaatttcaaaatgaatcattcaaatcacattcttccaatttttgagaaatccaaagaaattttagattatcatcatgcaactctagatggctatatagaaagtgccatagatcgcgaaaaacaatcttcaacatatataggtaaagggatagcactcccacacggcaaccctgaaaaagtactgaaatcacacatgattatatttaaaccttctcaacctataacatggaaacaacatgaagttaaacttgttttctttttagcaatgagtaaaaaagatttaaatattaaccgtaaaattatacaaacaattgctcaattagaagaagatgacatccatcaattatgtcttttagatgatttacaactaaaaaacactttgtatgcacgttttaaagaataa

SEQ ID NO: 1668 - DNA, 222 bp, Staphylococcus epidermidis
aaaggagtgataattatgacacaaaaaatcataaaagttgaaggaatgagttgcgaacattgtagaaacgccgtagaatcggcactagctaaactaaatggcgtatcaagtgctgaagtaaatttagatgaaaatcatgtacgcgttgagtataatgattcaaaagttacatttgaaaatatgaaagaagcaattgaagaacaaggttatgatgttaaataa

SEQ ID NO: 1669 - DNA, 366 bp, Staphylococcus epidermidis
attgaggtgattaattgtatggaaaattttgataaaagttatcatgataaaacgggtgatgtattaggggctttaagttatctaagtgtatttttcgcacctgtattgtttccattaatcgtatggattgttggacaaccaccagcatctacgtattcaagaaatgcattatttaaccatattttgagttgggtgtgtttggtattaggacttatatcatttgctgctggactatccttgattgattcgacaaatggagtcgctgtactagtgataggagtaattattggaggtattctacttatcgcttcgcttgtattatttattattaatattgtgaagggtatcaaattattgatgatatag

SEQ ID NO: 1670 - DNA, 783 bp, Staphylococcus epidermidis
aagtttcagatgtactcattgatgtggacgtgcttgatgaatctgaaatgcttgtacttgatgattcacttaccgatgtactttcacttgttgattcactctcgcttgttgacgttgatgcactttctgatgtcgatgtacttgttgaatctgaaacgcttgtacttgatgattcacttaccgatgtactttcactgtctgactcactcacactcgttgatgtggatgcactttctgatgtggatgtggacgcactgtctgatgtcgacgtactcgttgagtctgaaatgcttgtacttgttgagccacttaacgacgtacttgcgctatcggagtcgctctcgctcgttgatgttgatgcacttgctgatgtcgacgtactcgttgagtctgaaacgcttgtacttgttgagccacttaatgacgtacttgcgctattggagtcactcacgctcgttgatgttgatgcacttgctgacgttgacgcgcttgttgaatctgaaacgcttgtgcttgtcgactcacttaacgatgtactttcactgtttgagtcactctcacttgttgacgttgacgcactgtcggatgtcgatgtacttgttgaatctgaaacgcttgtgcttgtcgattcactcaatgacgtacttgcacttgttgattcactctctcttgttgacgttgatgcgctttctgatgttgacgcgcttgttgaatctgaaacgcttgtgcttgtcgagtcacttaaggacgtacttgctctgtttgagtcgcttacactcatag

SEQ ID NO: 1671 - DNA, 504 bp, Staphylococcus epidermidis
ggaattgagatgattagatttgcgcgactagaagatcttcaaggtattttgacaatttataatgatgccatccttaatacaacagctgtttatacgtataagccacaacaattagatgaacgtcttcaatggtatcaatctaaagcaaaaataaacgaacctatatgggtttatgaaaaagaagggaaagtagttggttttgccacttatggttcctttagacaatggccggcctatttatatactattgaacattctatatatgttcatcaacagtacagaggactaggtatcgcttctcaattattagagaatttaattcgttacgctaaagaacaaggttatcgcactattgttgctgggattgatgcatcgaacatggatagtatcgcattgcataagaagtttgacttctcacatgcaggtacaattaaaaatgtaggttataaatttgatcgatggctcgatttatcattttatcaatatgatttatctgattcataa

SEQ ID NO: 1672 - DNA, 405 bp, Staphylococcus epidermidis
ttattggagatgactatattgattagaacatttatgaactcaaaaatccatagagctagagttacagaatctaatttaaattacgttggaagcataacaatagatgccaatatattagatgcggttgatattttacccaatgaaaaggttgctattgttaataataataatggtgctcgatttgaaacatatgtcattgctggagaacgtggtagtggaaagatgtgtttaaatggcgcggcttcaagactagttgaagttggagacgtcattattattatgacatatgcacaattaaatgaagatgaaatggtagatcactcaccaaaagtagctgtgttaaatgaaaataatgaaattatagaaatgataaatgagaaagaaaatacgatatcaaatgtataa

SEQ ID NO: 1673 - DNA, 1593 bp, Staphylococcus epidermidis
atgaattggatatcgattattttatttattatggtcgtaggtggcatttctttttatgcttatttgcaatcaagaaaaattaaaacgagtagttcagatggttattttatgggaggaaatagccttactggatttacagttgcctctacaattatcatgaccaatttgtcgacagaacaaattgttgggcaaaatggtcaaagctatgcacaaggaatggaagtaatggcttgggaggttacggctgccgtagcagttgtattgttggcttgggtctttcttcctaaatatctaaaatacggtgttaatacaatttctgagtttttggaattacgttatgatacatttactaaacgttttgtctccattttatttatctttacctatgtcgtatctttcttgcctgtagtattgtactctggttccctagtgttcaataaaatgtttaaagttgatgaatatttaggtgtaagtagttcaactgctgtcatcattatttcatctattattggtataattggcattatttacttatttataggtggtttatcgttaagtgcttttagtgattcaatttatggcatggctttaatcataggtggacttgcgattacaatattaggtctaggtcaattaggagatggcaacttcctacatggcttcgacaaaatcgtgcaagacacacctgagaaattgaatggttttggtaaggtggactcggatgttgtaccttggccaaccctattcttcggtatgttctttaacaatttattcttctggtgcgcaaaccagatgatagttcaaaaagcactcgcagctaaaaatttaaaagaatctcaaaaaggtgcaatatatttaagcttatttaaagttttcggaccattaattacagtcttaccaggtgtagtagcatttaactattttaatggtagtattgacaaatcagataacgcttaccctgcacttgtaacttcagtattaccagaatgggcatttggcttatttggtgcggttatttttggtgcaatattgagctcatttgttggctcattgaatagtacaactacactattgacactcgatttctataaacctatttttggaaaaaataaatcagataaacatattgctcgagtaggccatattgctactgtagtcattggagttattgttgtagcacttgcaccagtcatctcattattccctagtggtctttatgcagtagttcaacagtttaatggtgtgtatagtatgccagtgctagctttgattttagtggctttcttttctaaacgcacatctaaattgggcgctaaagtgacactcttcacacatataattttatacgctatcatcagctttgtatttacagaaattaattacctatacacatttagtgtattattctttgtagatttaattattattttgatctttaacaaagttaaaccatctagtgagtttgatttaagcacgcaccaaccgaaagtagatatgacgccatggaaatatcgttacgttgcaggtattattgttcttgcattagtagtagtaagttatattatcttctcaccactcgtgttagcaaaataa

SEQ ID NO: 1674 - DNA, 1509 bp, Staphylococcus epidermidis
aaggtggggattaaaacaatgatatatacagtaacaagcacattacccttagtgcacggaggaagaactaaatcattattaacaagaattcgatttcttgataaagaaatgggcattcacaataaaatattaacaacgaattataacgccaattataacgaagtttatcaaaagttcgaagagaatcaactcataacgaaaaatacgcaaatcgaaaacatatatgattggttatctgatttcaaattactttcaatacctaaaagtagatttaagaaaaaaacgctttactctgaaaaagatagagacatagaaggtttaacttctaaagcattcaatgatggcaatgtgatgagatattatgatcaagaaacttatgttttatatcggaaattttatgaagatacaaatatcatagaatttgaagacgtgatgtcaccaatttctaagaaaaaaattgaacgtagagaatataatcacttcggtcaattgcatagaaagatttacttctcaagccgtacatatcacaaaattttggaagaatattttgacactgagggaagtatttactgtaaaaaattcttcaattcacaaaaggcaaatgaattagattttattcaaatttttaaaaatcaacgtatcatgaaggcttttaaaaacgaaaaagatctctttaaatattatttcgaacatcgctttaaacaaaatgatattgtgtttaatgatgctagacttttagataaaccacttttaaataactgtatgaacacaaaaaatgtgcttgtatttcataatagccacatcgatggcgataatattaaatcttcatacaaaattgcattggaaaattctgataaagtagctcaatacctcttgctcacacatatgcaaaaagacgatatacaacatgcatatggtattagcgatgaaaaaatatcgattgtacctcactttattaaaagctatggacaaaaagatactcatcacaaagaggatagattcgtatttattggtagactaggcaaacaaaaacaagtggaccatttaatcaaatcttataatcaattcttaaaaaatggacatcaaacgaaattagcgatttatggtgcagatgaacaaaatcaaaaacaagtcatactagatttagttaaagaatatcaaattgaagataaagttgatttaaatgattttaccaagcatcctcttgaagaatttaaaaaatctaaagcctcactattaactagtgaatacgaaggttttggtttaaccgttatgcgaagtattgaagtaggttgcccagtcatttcttatgacgtaagatacggtcccggtgaaatcatagagcacggtgaaaatggctatcttgttgagccagataacattgaagcattcgcagcttatatggataaaataattaaaaatccactcaaacatgttaaaacaaaagaaacattaaagtatgaacaagcaaagaataactatcaaaagttgtttgagagagtaaagtaa

SEQ ID NO: 1675 - DNA, 792 bp, Staphylococcus epidermidis
ggagtggttttgttgagtaactcaaaaaaagtagccgttgtcacaggtgcagcacaaggtattggcttgaaaattgctgagcgtctatttgaagatggatatagcatcgcgcttgtagactttaatgaagcggtagctaaagagtcagctgaaaaattatcaaaagaagggcaagaggcagttgcttttaaagcagacgtttcaaatcgcgatcaagtatttagtgtgttaaatcaagtcgttgaacactttggcgatttaaatgtcctagttaataatgctggtcttggaccaatgacaccaattgaatcagtaacacctgaacaatttaatcaagttgtaggtgttaacgtaggtggtgtattctggggtatccaagctgcaattgaacaatttgataaattaggacatggcggtaaaattatcaatgccacatctcaagcaggtgttgaaggtaatgcaggcttatctctatacagcagtactaagtttgctgttagaggattgactcaagtagcagcacgtgatttagctgagaaaaatattacagtcaatgcatttgcacctggtattgttgaaacaccaatgatgaaaggtatcgctgaaaaacttgctgaagaaaacaaccaaccaatggaatggggttggaaacaatttacagatcaaattgccttaaaacgcttatctaaacctgaagatgtagctaatgtagtaagcttcttagcaggtagcgattcagattatattactggccaaacaatcatcgttgacggtggtatgagattccactaa

SEQ ID NO: 1676 - DNA, 183 bp, Staphylococcus epidermidis
gtcttggttgttgtgcgcgttttatttactgtggtagatttttttgctattgtagtttttttagttgatgacgttttgggtgatatagcttgtttggttgatgtagctctttttattgatgtagctctagatttaacagacgtatctttaactgaacgtttaaaattggacgtcgtcttttga

SEQ ID NO: 1677 - DNA, 705 bp, Staphylococcus epidermidis
atgactaatgtattatatcaacacggaacattaggaactttaatggcaggtttattagaaggaactgcttcaattaatgacttattagaacatggtgatttaggtattgctacgcttacaggttctgatggagaagtaatttttgttgatggtaaagcttatcatgcaaatgaacataaagaatttatagaattgacaggcgacgaaatgacaccatatgcaactgttacaaaattcaaagcagactcaagttttaaaacatctaataaaaatcaagaagaagtattcgatgaagttaaaaaacaaatgaaaagtgaaaatatgttctcggcagttaaaatttcaggaacgtttaaaaaaatgcatgtacgtatgatgcctggtcaagaacctccatacacacgtttaattgattcagctcgtagacaacctgaagaaacacgtgaaaatatcaaaggttcaatcgtaggtttcttcactccagaattattccatggtattggttctgcaggtttccatattcactttgcaaatgatgatcgtgattttggtggtcatattttagactttgaagtggatgatgtgactgttgaaatacaaaactttgaaacatttgaacaacacttcccagtagatgctaaatcatttactgatgctgacattgactataaagatatagccgatgaaatcagagaagctgaataa

SEQ ID NO: 1678 - DNA, 1773 bp, Staphylococcus epidermidis
gaaagagatgttaacaaacaaagaaaacaaatcaatttttggaggtctttaacgatgagaagaaaacgcgattcatacgattatgtcatcattggtggcggtagtgcaggttcagttcttggtgcacgcctttcagaggataaagataaaaatgttttggtattagaagctggacgtagtgactatttctgggatttatttattcaaatgccagcagcattgatgttcccatcaggtaatcgtttttatgactgggaatatcaaactgacgaagaaccacatatgggacgtagagtagatcatgcgagaggtaaagtattaggtggctcaagttctattaacggtatgatttatcaacgaggtaacccaatggactatgaaggatgggcagaacctgaaggaatggacacatgggactttgcacattgtctaccatacttcaaaaagttagaaacaacatatggtgcagcgccatacgataaagttagaggccatgatggtccaatcaaattaaaacgtggaccagctactaatccattatttaaatcattctttaatgcaggtgttgaagcgggctatcataaaactgcagacgttaatggatacagacaagaaggttttggaccatttgatagccaagtacatcatggacgtcgtatgtctgcttcaagagcgtatctacgcccagcattaagacgtagaaacttagatgttgaaacacgtgcattcgttacaaaattaatttttgatgaaaataatagtaaaaaagtaacaggcgtgactttcaagaaaaatggtaaagaacatactgttcatgcaaacgaagttattttatctggcggtgctttcaatacaccacaactattacaattatcaggtattggtgactcagaattcttaaaatcaaaaggtatagagccacgtatgcatttaccaggtgttggtgagaacttcgaagatcacttagaagtatatattcaacataaatgtaaacaaccggtttcactacaacctagccttgatgtcaaacgtatgccgttcatcggtttacaatggatttttgcacgtaaaggtgcagcggcgtctaaccactttgaaggtggtggctttgtaagatcaaatgatgatgttgattatccaaacctcatgttccatttcttaccaattgctgtaagatatgatggtcaaaaagcaccagtagcacatggttaccaagtacatgttggaccaatgtactccaactcaagaggtagtttgaaaatcaaatctaaggatccatttgaaaaaccaagtatcgtgtttaattacttatctacgaaagaagacgaaagagaatgggttgaagcaattagagtagcaagaaatatcctaaaacaaaaagctatggacccatttaatggtggcgaaatttcaccaggaccacaagttcaaacggatgaagaaattctagattgggtacgtaaagatggagaaactgcattacatccatcttgtagcgcgaaaatgggacctgcatctgacccaatggcagtagtcgatccattaactatgaaagtacatggtatggaaaatttacgtgtcgttgatgcttcagcaatgcctagaacaacaaatggtaatattcatgcacctgtattgatgttagctgagaaagcagcggacattattcgtggtagaaaaccgcttgaacctcaatatgttgactattataaacatggtattgatgatgaaaaagcaggtgcaatggaagatgatccattctaccaatattaa

SEQ ID NO: 1679 - DNA, 246 bp, Staphylococcus epidermidis
ttagagagtgtgaacaatatgattagtgtaaacaatggggtaaaaaataaaaaatataaagtgaagcatatagggatttcaaataaaaatatgttgtatcgtttaggggcattaggcttaaacattggaagtgaaattagcatcaaacagaaatgtttactcaacggtcctagcgttgttgaagtaaatggtcaacatttaagtttacgacaacgtgatgcacgactcataacattagaggagtag

SEQ ID NO: 1680 - DNA, 615 bp, Staphylococcus epidermidis
atcaggagtgttaaaatgagtgaatcaaatcatattacatggcatgactcagaagttacgaagaaacaaagacagcataaaaatggacacaaaagtgctgttatatggtttacagggctatctgggtcagggaaatcaacggtctctgttgccttagaaaaagaattatttaatgaaggaaaacaaacataccgtttagatggtgataatgtgcgtcatggtcttaataaaaatttagggtttagtcctgaagatcgttcagaaaatattcgacgcattggagaagtagcaaaattaatggtagacgctggagccttaacagttactgcttttatctccccatataaagaagacagagaaggtgttagagcattactagaggataatgagtttatagaagtatatacaaaatgtagtgttgaggaatgtgaaaagagagatcctaaaggattgtataaaaaagcacgatctggggaaatacctgaatttacaggtataagtgcaccttatcaagcacctgaaaaccctgaaattactatagatactgaacacgacactattgaacaatcagtggtacaaattatacgttatcttaaagaacacgaatatatttaa

SEQ ID NO: 1681 - DNA, 915 bp, Staphylococcus epidermidis
gaaacgaccgttgcttataaacaatttatacgttttgcacaacatcatttacattttcatcatctagggaggcattttatggttatttcaaaaaaattatcacttatcactataggtatcttaataagtattcttttaatttctctacttattgatcaaactatctcacatcaattcatgaatcagaattcaattttcggtactttatttcaaaactacggtttatttccgcctacgctcatattaattatttcaactgtaattttaaattattatattttcactacatttcaaaataaattagctaaaatattaacattgcttatatctttcatattcaccctaattaaaaccaatgaattcgtgtcagaaactgctcaatatatgctatcaacttcagcaaacataaaaaatcataaaccaatggggatggcaaataatgaaggaaacgctggaaatgctttatctttaggaatgagtttctttatttctttgattatacttataattatcacttttatttgttatcaattttggttaaaacatacaaataaccaagaactttatcatttattcaaagtttcacttattagctttatgattttatttattggattagaactcgttgatagcttgaaacatttatggggacgttttagaccatatgaaatcactgacaaagctggacatttcactcactggcttacaataaatggaaatactggacatagttccttcccttcaggacacactggaaatggtgcatttctaatgtttatcgcattttactttaaaaaattacgcactcaaaaaatagtgtttagtatcggattatgttatagcattttaatggcattgagcagaattcgtattggtgcacatttcactaatgattattgcagattttatcattaa

SEQ ID NO: 1682 - DNA, 1050 bp, Staphylococcus epidermidis
atgaacaacgttaaagaatccatcattgttgccttcgcctttgtaggcgttgtagttggagcaggatttgcaacaggtcaggaaatctttcagttcttcactagtcatggtatttacagtattggcggtatttttattactggacttatcttaactcttggaggaatattcgtattaaatactggctttcgtcttagatctcaaaaccactccgaatctattcgttattatttacatccaacaatagctaaattatttgatattatacttacagtatttttattttctctagcaattattatgacagccggcggagcatcgactataaatgaaagtttcggcttacctttttggttaagttctttcattttagtgatacttattttgataacattatttctaaagttcgatcgtcttatcgctgttttaggaggggtaacaccatttcttgtggcagtcgtagtaatgattgcagtgtattactttattaccggtgatttaaactttagtgatgtcagtcaatattcaaatcaaaataagtcgatttcacctggttggtggtttgacgcaattaattatgctagcttacaaattgctgctgcatttagctttttaactgtaatgggcggtaaactacgatatcaatcgtccacaatttatggtggacttatcggtggtattattgtgactttactattacttttgattaattttggtcttgttacagaatttaatcaaattaaagaggtagcattaccatcattgctacttgctaagcagatttctccatccattggtattatcatgtctgtcattatggttttagtcatatacaatacagtagtaggtttaatgtacgcctttgcatcacgctttagtcgaccgtttacgaaacgctattatattcttatagttatgatggcgataataacatttgcttgtacttttgtgggattcatttctctcattggtaaagtgttccctatcatgggactttttggttttatcttattgattcctgtgatatacaaaggaattttacgaaaataa

SEQ ID NO: 1683 - DNA, 207 bp, Staphylococcus epidermidis
actgtaatagttagtaagatgattgaacgtcaaattatattagatccatctaaaccagtcaatcgttcaataccagctgagatcatcggcacgcctagagcgagtgatgttgcagcaccaccgagcaaaccgaaaataaataaaatatctacgatttttcctcataatttatccgtatgtccttttaaaattggtcgacaagcttga

SEQ ID NO: 1684 - DNA, 948 bp, Staphylococcus epidermidis
aaagataaagtaggtgaagttgaaatgaataaaaataaagtgattgtaattggatcaacaaatgtagataaatttcttaatgttaaaaggtttccaaaacccggtgagacattacatattaatcaagctcaaaaggagtttggtgggggcaagggagccaatcaagccatagcagctagtagattagcagcagatacaacatttatcagtaaagttggtaaagatggcaatgctaactttatattggaagatttcaaaaaagcaggtattcatacacaatatattttaacttcagaaagtgaagaaactgggcaagcatttatcactgttgatgaagcaggacaaaatacgattcttgtttacggtggtgcgaatatgacattaagtgcaactgatgttgagatgagtgtggatgcgtttattggtgcagactttgttgtagcgcagcttgaagttccatttgaggcgatagaacaagcatttaaaattgctcgtaaacaaaatatcactactgtattaaatcctgcaccggcaattgaattgcctaagtcacttttagagttaactgatataattattccaaacgaaacggaagcagaattattaacaggtatttcaatcaataatgaaagtgatatgaaagaaacagcaacatattttctcgatttaggtatatctgcagtattaattactttaggggagcaaggcacgtattgtgcatatcaagaacaatacaaaatgattcctgcgtgtaatgtaaaagcaatagatacgacagcagcaggagatacatttataggtgcttttttaagtgagttaaataaagatttgagcaatttagaatcggctattcgacttgcaaatcaagcgtcgtctctaacggtacaacgaaaaggagcacaagcttctataccaacacgtaaagaagtagaggcagaatataattaa

SEQ ID NO: 1685 - DNA, 3561 bp, Staphylococcus epidermidis
gaagtgaaagtttcagatgtactcattgatgtggacgtgcttgatgaatctgaaatgcttgtacttgatgattcacttaccgatgtactttcacttgttgattcactctcgcttgttgacgttgatgcactttctgatgtcgatgtacttgttgaatctgaaacgcttgtacttgatgattcacttaccgatgtactttcactgtctgactcactcacactcgttgatgtggatgcactttctgatgtggatgtggacgcactgtctgatgtcgacgtactcgttgagtctgaaatgcttgtacttgttgagccacttaacgacgtacttgcgctatcggagtcgctctcgctcgttgatgttgatgcacttgctgatgtcgacgtactcgttgagtctgaaacgcttgtacttgttgagccacttaatgacgtacttgcgctattggagtcactcacgctcgttgatgttgatgcacttgctgacgttgacgcgcttgttgaatctgaaacgcttgtgcttgtcgactcacttaacgatgtactttcactgtttgagtcactctcacttgttgacgttgacgcactgtcggatgtcgatgtacttgttgaatctgaaacgcttgtgcttgtcgattcactcaatgacgtacttgcacttgttgattcactctctcttgttgacgttgatgcgctttctgatgttgacgcgcttgttgaatctgaaacgcttgtgcttgtcgagtcacttaaggacgtacttgctctgtttgagtcgcttacactcatagatgtagatgcactatctgatgttgatgtactcgttgagtctgaaatgcttgtacttgttgactcacttaaggatgtacttgcactgtccgagtcgctctcacttgttgacgttgatccactttctgatgtcgatgtgctcgttgagtctgaaagactcgtacttctcgagtcacttaatgacgtacttgtactgtttgaggcactcacactcgttgatgttgatgtacttgtcgattctgaaacgctcgtacttgtcgagtcacttaacgatgtacttgcactgtccgagtcgctctcacttgttgatgttgacgcactgtctgatgtcgacatactcgttgaatctgaaagactcgtacttgtcgattcacttaatgacgtacttgcactattcgagtcactcacactcgttgatgttgacgcactttctgacgttgacgcgcttgttgaatctgaaacgcttgtgcttactgattcacttgatgacgtacttgcactgtccgagtcgctctcacttgttgatgcagatgcactgtctgatgtcgatgtacttgttgagtctgaaacgcttgtacttgttgagccactcaatgatgtgcttgtactgtttgactcactcacactcgttgatgtggatgcactatctgatgtggatgtgcttgttgattctgaatcacttgtgcttactgattcacttgatgacgtacttgcactgtccgagtcactcacactcgttgatgttgatgcactgtctgatgtcgatgtactcgttgaatctgaaacgctcgtacttaatgattcacttatggatgtgcttgtactgtttgactcactcacactcgttgatgttgatgcactgtctgatgttgatgtacttgttgagtctgaaatgcttgtacttgttgagccactcaacgatgtacttgctctttccgagtcgctctcacttgttgatgcagatgcactatcggatgttgatgtacttgttgagtctgaaacgcttgtacttaatgagccacttaacgatgtgctggcactgtttgagtcactcacactcgttgatgttgatgcactgtctgatgtcgatgtactcgttgaatctgaaagactcgtacttgtcgagccacttaaggatgtacttgctctttccgagtcgctctcacttgttgacgttgatgcactgtctgatgtcgatgtactcgttgaatctgaaagactcgtacttgtcgagccacttaacgatgtacttgcactgtctgactcactctcactcgttgatgtggacgcactgtcggatgtcgacgcgcttgttgaatctgaaacgcttgtgcttatcgactcgcttaatgacgtactttcacttgttgagtcactctcactcgttgacgttgatgcactgtcggatgtcgacgtactcgttgaatctgaaacgctcgtacttaatgattcacttatggatgtacttgcactttccgagtcgctcacactcgttgatgttgatgcactgtcggatgtcgacgcgcttgttgaatctgaaacgcttgtgcttgtcgactcgcttaatgacgtactttcacttgttgagtcactctcactcgttgacgttgatgcactttctgacgttgacgtacttgttgagtccgaaagacttgtgcttgtcgattcacttaatgacgtacttgtactgtctgactcactctcactcgttgacgttgatgcactgtcggatgtcgacgtactcgttgaatctgaaatgcttgtacttaatgatccacttaacgatgtgctggcactgtttgactcactctcactcgttgatgtggatgcactttctgacgttgacgcgcttgttgaatctgaaacgcttgtgcttaatgattcactcaacgatgtactttcacttgttgagtcactctcgcttgttgacgttgatgcactgtcggatgtcgacgcactcgttgagcctgaaagactcgtacttgtcgattcacttaatgacgtacttgtactgtctgactcactctcactcgttgacgttgatgcactgtcggatgtcgacgcactcgttgagcctgaaagactcgtacttgtcgattcacttaatgacgtacttttactgtttgattcactctcgctcgctgacattgatgcactgtcggatgtcgacgtactcgttgaatctgaaacgcttgtacttgtcgattcacttaatgacgtacttgcactgtctgactcactctcactcgttgatgtggacgcactgtcggatgtcgatgtacttgttgaatctgaaacgcttgtgcttgtcgatttacttaatgacgtacttgcgctattggagtcacttacgctcgttgacgttgatgcgctatcagacgtcgacgtactcactgattctgataatagtttacttgtgcttgctgattcgctcgcttttattgatgcgctatcagacgtcgatgtgctcgttgagtctgaaatgcttgtacttgttgagccactcacacttgttgatgttgacgcactttctgacgttgacacgcttgctgaatctgaaacgcttgtgcttgtcgattcacttaatgacgtacttttactcgttgactcactctttcttgctgactctgatgcactatcagatgtcgacgtactcgctgattctgataattgtttacttgtgcttgctgattcgctcgcttggattgacgtactattcgacgtcgacgcacttaacgactctgagagactcttacttgttgataatgattga

SEQ ID NO: 1686 - DNA, 1344 bp, Staphylococcus epidermidis
aatattgaagtgaaaattgttcggcataagttaggagattcttccatgttattgtttatcatagaaatcataatcatgattctagcgatattattaggattaagaactgctggtgcactgggatgtggcatctttgctatagtagcgcagcttatcatgatatttggattccagttacctccaggttcagcaccagtgacggcagtgttaatcatattatctattggtatagcaggtggtacgttacaagccactggtggtattgactatttagtatacattgcatcacgtgtgattgaacgctttccaaaatcaattatatttatagcgccaatgattgtctttgtctttgtttttggaattggtactgcaaatatagctctttcacttgaacctatcatagcgaaaactgcacaaaaagcacgaattcagcctaaacgcgcattaactgcttcggtacttacagccaatttagccttactttgtagcccggcagcttctgctacagcttatattatttctgtattagcagggtatgaaatatcgatgggcaagtatttaagtattgttttacctacagctttaattagtatgttaatgcttagtacattttgtacatttgtaggacgaaaagaacacgtgcgtgatgagtcagaacgtttagttcagatgccagaagtcgaaatcaaaaatgacttttcattaaaagtaaaaataggtgttatctcattcctattatgtgtcatgggtattttaacgtttggcatatttcctaatctcatgccgcaattcaatgtgaatggagatgtagttaaagttgagatgactgaaattgttcagttctttatgtatctcagcgctacaatcaatttattattaataaaaatcaatacttctgatattctgtcatcgaatattacacaatctgcaatgggagcactttttgcagttcttggcccaggttggttaggtgcaacaatatttaatgctccacataacttaaaaatattgaaaaatgatattgggtcaattattagtgaagtaccttggcttgttatcatacttgtttctgtagttgcaatgattgtcatttctcaaacagctacagcatcaattatggtgccgatagttatgagtttaggtatacctcccatctattttgttgcgatggtacaaacattaaatgtgaatttcgttattccagctcaaccgacactattatttgctgtagaactagatgaaacaggtagaacaagacctacgagctttatgataccaggattttttgttataacagtatccgtcattacaggatttgttattaaaaccattttaggatattaa

SEQ ID NO: 1687 - DNA, 843 bp, Staphylococcus epidermidis
gtatcatttttaagatttgagcaatcaagactatataagcatcgagaggatgatactatgtttatttcaaaacaagaattatatgaaaagttacaatatgttacgccaagaacgtttgcctacttgaatgaaatagattattataacttattaatgataattgaagagcatcaaatatctattccaccgattcatcaacttcgaaaaacattgcgaggaagtaaaattatgaagcctaagaatcgcgtagacaattgttatattcatttaaaggatgaaattccgacccctattaacaatgaacaattaagtttcctgcatttttatccacgtcagcaaatacatttaattttgagtgcttattctagaatgaaaagtctaaagttacaatctcaaaaacattgtttaaagctcaaattccccttagatcagcattctattcgtaaagaaattacaccacctcaaagctctgataaagacaatgatattttaatttgtctattacaaaaattaatcaacgaaattaccaaatgtcaagttcctgtttctctaaagaataattctttcgaaataaaactaccaaactatatcataaaggttgatttaaactatcacgaacagcaagaccatttatatccattacaatatagcatccacgcatggcatagagatttccaatatctcgaaatctcaaataccttcacaataccgtctttgaatgatcttattttccatatacaaaagctttttttacttatatttcaattacctgaacatctcgcgagacaagaatattcattgagtcaatattatttttactcgcaatgccatacaaaaaattaa

SEQ ID NO: 1688 - DNA, 189 bp, Staphylococcus epidermidis
ttaagaaaggttttaattagtttgaattttaaagtatttctaattatcatttttcatgattttcttatttattatgaacacggttttatgtatagccgtttcaaagaacatgctgaacaatcatcacatttatttatattaaaatcacatttaaagccatttccaccatttcgatatacatatgattaa

SEQ ID NO: 1689 - DNA, 411 bp, Staphylococcus epidermidis
agtgtgaaggtgatgaaattgaaaaaggaaattaatgtagtaggtgctattatatattctgataacaaaatattatgtgcgcaaagaagcgaaaatatgagtttacccttaaaatgggagttcccaggtggaaaaatagaaaatggggaaaccgaaaaagacgcattaataagagaaattaaagaagaaatgaaatgtgatttaattgttggtgataaggtaacaaccacaacttatgagtatgattttggaatagttaacttaacaacctataagtgtgaacttaacaataaaaaaccaactttaactgaacataaggaaataaaatgggtaggaaaaaatgaactagataaattagattgggctccagcagacgtacctgctgtaagacgtataatagaggagaattag

SEQ ID NO: 1690 - DNA, 210 bp, Staphylococcus epidermidis
attattgaggtgatgactatgagaaatgctatagaagaattaatcttctccgatgtaagtagttatgacatctatgtaaacacaggcgttaaccaagggttggttggagacataaaagatggatatttgacgattgattctatcccatatattgatgctgaaagattatactattatagtttagagcgcaaagccctcgttacaagttga

SEQ ID NO: 1691 - DNA, 1002 bp, Staphylococcus epidermidis
attgaggaggttggcacattcatgtttaaaaagattgctactataataggttcgacattatttggtacagttttattcgcaaaagtgaaagaaaagcgtagttataaaagttttttacaagagaaaatgattagaatatcaggaatgaaaaagacatttgaaagtatagatgacgcgaaaaaagctttgaatgagactaaatatcaaacttcaggtaaatataatggaacaacatatgaatttaagcataaagttcaaataagagattattatggttctttagtctatgttgttaatgatcatggtcttccagatcaacgcacggtcttatatgtacatggaggcgcatggttccaagatcctttggaaaatcattttgaatatttagacttactcgttgatgcgctcgatgctagggtgattatgcccgtatatcctaaaataccacacagagattatcgtacgacatttgaattattaacaaaaatatataagcgattattgactaaaattgatgaacctgaaaacttggtcatcattggagattcagccgggggacaaattgcattagctttcgcacaaatgttaaaaaaagagcaactcagtcaacctggccatattgttcttatttcaccggtgcttgatgcgacatttaagaatccagaagcaagaaaatatgaaaaagaagatccaatgcttggaattgatggcagtaaatatcttgtagagttatgggctggtgatgcaccactagatgactataagatgtctccaatgaatggtgatttagaaggcctaggacatattacacttactgtaggaaccaaagaaacattatatcctgatgcagttaagttctctcacatgttaaatgataaaggaataaagcatcagtttatcccaggttacaatttatttcatatttatcccttattccctatcccagagcgtcaacactttttagaacagcttaaaaaaatcattgtcacaaaagagttataa

SEQ ID NO: 1692 - DNA, 465 bp, Staphylococcus epidermidis
gtggccagggtaggataccatcttacttggaaaatgatactgggtctttttcctaaagaagataaagtcaaggcattggatgctttagaacgtgtaaacattttagataaatatgaccaacgctctgaccagttgtcaggtggtcaacaacaacgtatatcaatagctagagcgttatgtcaggaaccaaccattatattagcagacgaaccagttgcttcattagatccattaactacaaaacaagtgatggatgacttaaagaaaatcaatgaagaacttggtattactattttaattaatttacactttgtagatttggcaaaggaatacggatcgagaataattggtttaagagcgggagagctcgtttatgatggacccgcgtctgagacaaatgacgaagtatttaatcatatatacggtcgctctattaagaacgatgaaaaattaggggtggaataa

SEQ ID NO: 1693 - DNA, 483 bp, Staphylococcus epidermidis
atactattattattactgtcattaaataaatacattttttgggagaaagaaatgaaattcaaaaaattattatctcgtattattatcgctacaatgattacatttactggaacactctcatatcaagctattgaacaaacgcatatttcccatgctgcacataattattatggtaaaaaacaatgcacttggtgggcatttaaacgtcgtgctcaattaggtaaacctgtatcaaatcgatggggtaatgctaagaattggtatagcaatgcacgtcgatctggttatgcaactggacataagcctcgaaaatacgctgttatgcaatcaacgagaggctattatgggcacgtagcagtggttgaaaaagtatataagaatggaaaaatcaaaatttctgaatataattataatgtgccattaggctacggcacacgcattattagtaaatcgtctgcacgaaactataattatatttattaa

SEQ ID NO: 1694 - DNA, 225 bp, Staphylococcus epidermidis
ggtgagatattgagcttttacgaatttatgcaaaatttcctaggtgatgacacgccattaggtgaattggttgattggattaatcaagatatcaatttccctaaagacgtgacgagccaaaaagaaatcttgacatattttcgaaatcatccatgtccggaaaacataccagtgacgagtatcaaacgggcactagctgttttcaaccaattcactaaagtataa

SEQ ID NO: 1695 - DNA, 258 bp, Staphylococcus epidermidis
ttagcttcattttcatatgtgtcaatggcagcacctgataatgtaccattatttactgcttcaattaaatcaggcgtgtttatcacagctcctcttgcggcattgactaaaacggcaccttttttaacatttttaaacatattgttatcaaataaatggaaactatctttattagcgggtacatgtaatgagataatatcagcatctttaattgcatcctctactgtttctttatattctaagaaagataaagaatga

SEQ ID NO: 1696 - DNA, 369 bp, Staphylococcus epidermidis
gaggaatctttaatggttttacgttatgctacaaatttaaaactagctaaagaattatatgatgcaagtaaacctaaattaaaaggcgatcaaggtatgattgatactttcactaatacatttggtttaccggaaaactcagttaagttagcaggtggcgttgaagctgcagctgctggtttatttgctgctagttttttaaataaaaatatttcacgcttaggctcacttgcagcaatttcagtacttggtgttgcagcttacaaacattttgaagcagggcatggtaaaaagggtgcacaacatgctttagacttattaggtttatcaacacttagcttattagatactttttcttgtaaaaaataa

SEQ ID NO: 1697 - DNA, 201 bp, Staphylococcus epidermidis
agcaattcattgatttgtttagcttgcccttccgtaaaaggactattggtaacacttaagttcaatcttatccacctcttatactttgttattccgatatttgtcattgtttatatatgtctatttttgaaagttattaattatatcttcaattctagtatgtaccatttgttattttcagtaaatgtaatactcaattga

SEQ ID NO: 1698 - DNA, 510 bp, Staphylococcus epidermidis
gttaacacatttgctttagggagtgaggatatggaaacggtatattttgctggtggatgtctatggggaactcaagctttttttaatacgattccaggagttattcaaacagaagctggaagggcaaatggaacgtcgaaatgtttagatgctccttatgatggctatgctgaatgtgtgaagatacactttgatcctgcaaaaacttcaatacttatgctgatggattatttgtttgaaatgataaatccttatagtttaaatcaacaaggtcaagacaagggtcaaaaatatcgaacaggtgtgtatagtgaaagttcgaagcatttaaatgaagcaaaagactacattaagcgcagggaagacgcgaaacaagtaatggtcgaagtacaacctctaagtaattatgtgaagagtgcagaagaacatcagaatcatcttgagaaatttccggaggattattatttatgtcatgttcctccagcattgcttaataaatacaagaaataa

SEQ ID NO: 1699 - DNA, 327 bp, Staphylococcus epidermidis
attcagacattatcgtggcttaatataagaaaagtaacagctcaacgaggtgaaaatcatcaaaaaaattataaaaaagacaatttctatattatttcaatagaaattgtctttatttacttatcttggacctttttgtcccaggctcatttgtatatttatatcgttttttggatgaatcgtatgatggctatcactacaatgacaatcattgaaacgaaagataagattttgaaatgcttactttttgtttctttattagattctccattttccatcatttcctgtagttctcgttctatctcaagatctaaatcagttttttga

SEQ ID NO: 1700 - DNA, 954 bp, Staphylococcus epidermidis
agttttcaattcatttcaccctcaatttcctttattattagcaatagtataatgaatcgtaaaaagaaaggaaagaataaagttatgacaattgccattataggcccaggtgcagtgggtacaacgttagcttttgaattaaaaaaagttctaccagatacggaactcatcggccggcaagataaattaatgacctatttcccagaaaatacttctaatggaagtaatgttaaagtgacttcatttaatcatattaatcaaacttttgatgtcattatcatagcagttaaaacacatcaattggatgacgtcattaaacaattacctaaaatcactcatgacgattcgctcattatcttagcacaaaatggctatggacagcttaataaacttccatatcaacatgtctttcaagcagtcgtctatattagcggacaaaaagttaacaacaatgttcaacatttcagagattaccaactatatattcaagatagcacactaactcgtcaattcaagcaaatggttcatccttccaaaatagaggtggttttacaagaaaatattgaaaaaagcatttggtataaattattagtgaatttaggtataaataccatcactgctattggacaacaaccagctaaaattttaaaatctcctcatattgagtcgttgtgtcgtcgtatattagttgatggtcttaaagttgctagagctgaacaaattgactttgaagatcatatcgttgatgatattttaaatatttataaaggttatccagacgaaatgggaacaagtatgtattacgatgtcattaacaagcatcctcttgaagtcgaggccatacagggttatatatataaatgtgcaaaaaaacatcatttagagacaccctatctagatatggcttatacatttttatacgcttatcaccttgaatacacacaaccagattga

SEQ ID NO: 1701 - DNA, 186 bp, Staphylococcus epidermidis
aaaagacaatttctacattatttcaatagaaattgtctttatttacttatcctggaactttctgtcccagccactcttttaataattacaaaatttttaaatactatgttttgttatagagatgttggtatgttttacagttttgaaaaaagattatacgtagccattaacaaagtgaccgattaa

SEQ ID NO: 1702 - DNA, 804 bp, Staphylococcus epidermidis
ttatttaaatttttaggaggatatttaacaatgaaaaaaatcgctacagctacaattgcaactgcaggaatcgctactttcgcatttgcacaccatgacgcacaagcagcagaacaaaataatgatgggtacaatccaaacgacccttattcatatagctacacttacacaatcgatgctgaaggtaactaccactacacttggaaaggtaactggagtccagatcgtgtaaatacttcatataactataataattataataactacaactactatggttacaataactatagcaactacaataactacagtaattacaacaattacaacaactatcaatcaaacaacacgcaatcacaaagaacaactcaaccgactggtggtttaggcgcaagctattcaacatcaagtagtaatgttcacgttacaacaacttctgcgccatcatcaaacggtgtatctttatcaaacgctcgctcagcatctggtaacttatacacttcaggtcaatgtacatattatgtatttgacagagtaggtggcaaaatcggttcaacgtggggtaacgcaaacaactgggcaaacgctgcagcacgttctggttacacagtaaacaattcgcctgctaaaggtgcaatcttacaaacgtcacaaggtgcatacggacacgtagcatacgttgaaggtgtaaacagcaatggttcaatcagagtttcagaaatgaactacggtcacggtgcaggtgttgtcacttcacgtacaatctctgcgagccaagctgcttcatataactatattcactaa

SEQ ID NO: 1703 - DNA, 213 bp, Staphylococcus epidermidis
tggccgaaattcttggggaaccagaatatccaagttcatcaaactgcaaacaacagatttcttaaagaaagttgttatttactgggaaataatataagtatgggtactttgagacaagaatcatgtgactcttgtctcagtttcatatttttgggtaaacatttaacatatagcaatgataaccaatacaaatttaataagtatacaatctaa

SEQ ID NO: 1704 - DNA, 1533 bp, Staphylococcus epidermidis
gcgattacttcaaatatcactaaaaaaggatgggttttaatgacaaatattaacgtaagaaattatatagatgaaagttacggcttgtttattaacaatgaattccaagctagtgatagtggggaaacattaactgtttctaatccagctaatggtgaagatttagctaaagttgcacgcgctggtaaaaaagatgtagataaagctgttcaagcagctcatgatgcatttgatagttggagtaagatttctaaagaagaacgtgcagattatttattagaaattagtcgacgtattcatgagaaaactgaacatttagcgacggttgaatcactgcaaaatggtaaaccctatcgtgaaacatcaacaattgatgtaccacaagcagccaatcaatttaaatattttgctagcgttttaacaactgacgaaggttcagttaatgaaattgatcaaaatacaatgagtttagttgttaatgaacctgttggagttgttggtacagtagtagcatggaacttcccaattttattagcatcatggaaattaggaccagctttagcagcaggtaatacagtagtaattcaaccatcatcttcaacgcctttatcattaattgaacttgctaaaattttccaagaagttcttcctaaaggagtagttaatgtcttaactggtaaagggtctgaatcaggagacgctattttccatcatgaaggtgtagataaattatcatttacaggttctactgacgtgggttacggtgtagcacaagcaggtgctgaacgtatcgttccgacaacattagaactaggtggtaaaagtgctaatattatctttgatgacgctaatttagagcaagtgattgaaggtgttcaacttggtatattatttaaccaaggtgaagtatgtagtgcaggttcaagattattagtacaatcatctatttacaatgaattgttgccaaaattgaaagaagcatttgaaaatattaaagttggcgatccatttgatgaagatactaaaatgagtgcgcaaactggaccagaacaattagataaaattgaaagttatataaaaattgctgaagaagatgacaaagcgaacatcttaactggtggtcatcgaatcacagataacggcttagacaaaggttacttctttgagcctacaattattgagattaacgataacaaacatcaacttgctcaagaagaaatcttcggtccagttgtagtagttgaaaaattcgatgatgagcaagaagctatcgaaattgcaaatgattctgagtatggtttagctggaggtatcttcactacagatattcatcgtgcattaaatgtagctaaagctatgagaacaggtcgtatttggattaatacttataatcaaattcctgctggtgcgccattcggaggatataaaaaatcaggtattgggcgcgaagtatataaagatgctatcaaaaactatcaacaagttaaaaatatctttattgatacaagcaaccaaactaaaggtttatattaa

SEQ ID NO: 1705 - DNA, 444 bp, Staphylococcus epidermidis
gaaagagagacatatatgaaatacgatgattttatagtaggagaaacattcaaaacaaaaagccttcatattacagaagaagaaattatccaatttgcaacaacttttgatcctcaatatatgcatatagataaagaaaaagcagaacaaagtagatttaaaggtatcattgcatctggcatgcatacactttcaatatcatttaaattatgggtagaagaaggtaaatacggagaagaagttgtagcaggaacacaaatgaataacgttaaatttattaaacctgtatacccaggtaatacattgtacgttatcgctgaaattacaaataagaaatccataaaaaaagaaaatggactcgttacagtgtcactttcaacatacaatgaaaatgaagaaattgtatttaagggagaagtaacagcacttattaataattcataa

SEQ ID NO: 1706 - DNA, 273 bp, Staphylococcus epidermidis
ttagtctatcaaaataaaggggttgggactgttatgagtgataatttgtcattattcattgactatatcaatgataatataatctatggtagtgaaatcaaacgggagaaattagagaatttatttaatcaatttgctataaaaaatgttgaaaagaacattgtctatgatgaactgaaatctttagatattacaatcattgagtcacaggattcatataaaaataaattgaagagattattttcggttctgttgcaaagtaaaaaaatatag

SEQ ID NO: 1707 - DNA, 771 bp, Staphylococcus epidermidis
aaaaataaaaatgcaaggagaggtaatatgctaactgtatatggacatagaggattacctagtaaagctccggaaaatacaattgcatcatttaaagctgcttcagaagtagaaggtataaactggttggagttagatgttgcaattacaaaagatgaacaactgattatcattcatgatgattatttagaacggactacaaatatgtccggggaaataactgaattgaattatgatgaaattaaagatgcttctgcaggatcttggtttggtgaaaaattcaaagatgaacatttgccaactttcgatgatgtagtaaaaatagcaaatgaatataatatgaatttaaatgtagaattaaaaggtattactggaccgaatggactagcactttctaaaagtatggttaagcaagtggaagaacaattaacaaacttaaatcagaatcaagaagtgctcatttcaagctttaatgttgtgcttgttaaacttgcagaagaaatcatgccacaatataacagagcagttatattccatacaacttcgtttcgtgaagactggagaacacttttagattactgtaatgctaaaatagtaaacactgaagatgccaaacttactaaagcaaaagtaaaaatggtaaaagaagcgggttatgaattgaacgtatggactgtaaacaaaccagcacgtgcaaaccaacttgctaattggggagttgatggtatctttacagacaatgcagataaaatggtgcatttgtctcaatag

SEQ ID NO: 1708 - DNA, 390 bp, Staphylococcus epidermidis
attcaactttgcaacagaaccgtattatggaatagagatgttggtaacatttatacaggatcattatacttaagtttaatttcgttattacagaaccacacattccaaccagaagagaaagtatgtctatttagttatggttcaggagcagtaggagaaatctttagtggttcaatcgttaaaggatatgacaaagcattagataaagagaaacacttaaatatgctagaatctagagagcaattatcagtcgaagaatacgaaacattctttaacagatttgataatcaagaatttgatttcgaacgtgaattgacacaagatccatattcaaaagtatacttatacagtatagaagaccatatcagaacatataagatagagaaataa

SEQ ID NO: 1709 - DNA, 1191 bp, Staphylococcus epidermidis
aaatctgattgggataaaggtgatctatataaaactttagtccatgataagttacccaagcagttaaaagtgcatataaaagaagataaatattcagttgtagggaaggttgctactgggaactatagtaaagttccttggatttcaatatatgatgagaatataacaaaagaaacaaaggatggatattatttggtatatctttttcatccggaaggagaaggcatatacttatctttgaatcaaggatggtcaaagataagtgatatgtttccgcgggataaaaatgctgcaaaacaaagagcattaactttatcttccgaactcaataaatatattacatcaaatgaatttaatactggaagattttattacgcagaaaataaagattcatcttatgatttaaaaaatgattatccatcaggatattctcatggatcaataagattcaaatattatgatttgaatgaaggattcacagaagaagatatgctagaggatttaaagaaatttttagaactatttaatgaattagcttcaaaagttacaaaaacatcctatgatagcttggtcaatagcatagacgaaatacaggaagacagcgaaattgaagaaattagaacagcacaaaaagataagacactcaaggaagtggaagcacctaaaggaataattccaaaatataaaaaaggtgtatcaaagactactaaaaatgattcagaaattgaaaaatcaaataaagagaataaattaaccggtaaagttggagaaaaattagcgctaaattactttaatgagctaattgataataaaatagacgaagataagaaagaacagtttaggaatattttaaatgataatccaggctctcaacacggtcatggctatgatttagtagcttttgatccaacaaatacagataaagctgtagaaaaatttattgaaattaaaacatctacatcttctagtattgaggaaccattttttatgtcgctaaatgaaatgtttgctatgaaagaatataagcagaaatatttaatattaagaatatttaatgtttccggtaaagaaccacaattttattttatagatccatatgcaaattattctgaatttaaagatgtagatgatctcattgacaaagtatttaatgtagaagctattcagtataaagtttttggcgaaaaatga

SEQ ID NO: 1710 - DNA, 2028 bp, Staphylococcus epidermidis
  unsure (52): Identity of nucleotide at the above locations are unknown.
tcttatataaggagtatattgatgaaaaagataaaaattgttccacttattntaatagttgtagttgtcgggtttggtatatatttttatgcttcaaaagataaagaaattaataatactattgatgcaattgaagataaaaatttcaaacaagtttataaagatagcagttatatttctaaaagcgataatggtgaagtagaaatgactgaacgtccgataaaaatatataatagtttaggcgttaaagatataaacattcaggatcgtaaaataaaaaaagtatctaaaaataaaaaacgagtagatgctcaatataaaattaaaacaaactacggtaacattgatcgcaacgttcaatttaattttgttaaagaagatggtatgtggaagttagattgggatcatagcgtcattattccaggaatgcagaaagaccaaagcatacatattgaaaatttaaaatcagaacgtggtaaaattttagaccgaaacaatgtggaattggccaatacaggaacagcatatgagataggcatcgttccaaagaatgtatctaaaaaagattataaagcaatcgctaaagaactaagtatttctgaagactatatcaaacaacaaatggatcaaaattgggtacaagatgataccttcgttccacttaaaaccgttaaaaaaatggatgaatatttaagtgatttcgcaaaaaaatttcatcttacaactaatgaaacagaaagtcgtaactatcctctaggaaaagcgacttcacatctattaggttatgttggtcccattaactctgaagaattaaaacaaaaagaatataaaggctataaagatgatgcagttattggtaaaaagggactcgaaaaactttacgataaaaagctccaacatgaagatggctatcgtgtcacaatcgttgacgataatagcaatacaatcgcacatacattaatagagaaaaagaaaaaagatggcaaagatattcaactaactattgatgctaaagttcaaaagagtatttataacaacatgaaaaatgattatggctcaggtactgctatccaccctcaaacaggtgaattattagcacttgtaagcacaccttcatatgacgtctatccatttatgtatggcatgagtaacgaagaatataataaattaaccgaagataaaaaagaacctctgctcaacaagttccagattacaacttcaccaggttcaactcaaaaaatattaacagcaatgattgggttaaataacaaaacattagacgataaaacaagttataaaatcgatggtaaaggttggcaaaaagataaatcttggggtggttacaacgttacaagatatgaagtggtaaatggtaatatcgacttaaaacaagcaatagaatcatcagataacattttctttgctagagtagcactcgaattaggcagtaagaaatttgaaaaaggcatgaaaaaactaggtgttggtgaagatataccaagtgattatccattttataatgctcaaatttcaaacaaaaatttagataatgaaatattattagctgattcaggttacggacaaggtgaaatactgattaacccagtacagatcctttcaatctatagcgcattagaaaataatggcaatattaacgcacctcacttattaaaagacacgaaaaacaaagtttggaagaaaaatattatttccaaagaaaatatcaatctattaactgatggtatgcaacaagtcgtaaataaaacacataaagaagatatttatagatcttatgcaaacttaattggcaaatccggtactgcagaactcaaaatgaaacaaggagaaactggcagacaaattgggtggtttatatcatatgataaagataatccaaacatgatgatggctattaatgttaaagatgtacaagataaaggaatggctagctacaatgccaaaatctcaggtaaagtgtatgatgagctatatgagaacggtaataaaaaatacgatatagatgaataa

SEQ ID NO: 1711 - DNA, 252 bp, Staphylococcus epidermidis
ttttttaaagtttacagtgatatgcttatttttttatcttacgattttgtacgtgcatgcttgcctaggggtatggctcgagccattagtctctcgcacatactattccctcaggcgtcagcacttacaaaatcggttgtaattttcatttttatacgcattcttactgagattatactaataagaggaatagtaaaagcaattctaagtaaaattgcagataagaggtttgttaaaagcagttctaagtaa

SEQ ID NO: 1712 - DNA, 693 bp, Staphylococcus epidermidis
caaaaaggagtcttctgtatgaactatttcagatataaacaatttaacaaggatgttatcactgtagccgttggctactatctaagatatacattgagttatcgtgatatatctgaaatattaagggaacgtggtgtaaacgttcatcattcaacggtctaccgttgggttcaagaatatgccccaattttgtatcaaatttggaagaaaaagcataaaaaagcttattacaaatggcgtattgatgagacgtacatcaaaataaaaggaaaatggagctatttatatcgtgccattgatgcagagggacatacattagatatttggttgcgtaagcaacgagataatcattcagcatatgcgtttatcaaacgtctcattaaacaatttggtaaacctcaaaaggtaattacagatcaggcaccttcaacgaaggtagcaatggctaaagtaattaaagcttttaaacttaaacctgactgtcattgtacatcgaaatatctgaataacctcattgagcaagatcaccgtcatattaaagtaagaaagacaaggtatcaaagtatcaatacagcaaagaatactttaaaaggtattgaatgtatttacgctctatataaaaagaaccgcaggtctcttcagatctacggattttcgccatgccacgaaattagcatcatgctagcaagttaa

SEQ ID NO: 1713 - DNA, 192 bp, Staphylococcus epidermidis
aagaaatactcatgtctatacaaacggggtagtctaaccgtcccacttaacacaagtcatctttataagatttccttaacatctactattatatctacgatgatttacatttctaaattttattatgcaatcaatacttactttcctttatatttgtcacccatgcttcataatagaagcaacgtaatctaa

SEQ ID NO: 1714 - DNA, 198 bp, Staphylococcus epidermidis
gaaattgactcagatttttctgagttagatacacttcctgattctgacaagaactcgcttgtagacgtactttttgattcaatttccgatttgctatttgtattactttcggatgttattgagttagactcggacagagatgaactcattgaatcatttgctgattcagattggttcaaacttgctgtagtgctttga

SEQ ID NO: 1715 - DNA, 411 bp, Staphylococcus epidermidis
attggaggattaaaaatgaagttagcaattattaaattttcagttggtggtttagctgttttaattagttatattgtttctgtcgtgcttccatggaaggaatttggaggtatatttgcaacctttcccgcagtgtttttagtttcaatgtgtattactggtatgcaatttggcaatgaggtagctatgcatgtgagcagaggcgcagtcttcggtatgataggagttttatgtagtatactagcaacctggggattactacaagctacacatatgtggctattgagtattattggtggttttgtagcttggtttgtaagtgcattgattatttttgaaattgtggaattcatagcacataaaagaagggataaacatggctggaagaccaaaagatccaacaatcaataa

SEQ ID NO: 1716 - DNA, 270 bp, Staphylococcus epidermidis
aggagacaatcaattatgtttggattaataggtatgattattgtcggcggtatcattggatggatcgcaggtttaattttaggtaaagacgtaccaggaggtattctaggaaatattattgctggtattgtaggatcatgggttggtactatgattttaggtgaatggggaccacaattaggtaaaattcacatctttccagcattattaggttcaattattttaatctttattatttcattaattttaaaagcactaagaaaaaaataa

SEQ ID NO: 1717 - DNA, 243 bp, Staphylococcus epidermidis
aggagtactttaatgacattattaactaaagttttagatactttaacaggcatatgtgttgctttattgtttaccaagtattttgtaaattatgcaaatgatatgtttgactggcacttaagatggtatttcctagaaaatgtacctcatttagcgctcattttgtttattctagtatttatctttgctgttccttctgaaatgattaaagataaaaataagaaaaagcataatgattcataa

SEQ ID NO: 1718 - DNA, 555 bp, Staphylococcus epidermidis
ttttgtatgtttagttatcaaataaataaaaatattaaattaaaaatattagaagaacgagaagccgaacagttatttaaattagtagatagcaatcgtgactatttagctgaatttctaccttttgttgaacatacgaagaaagttgaagatagtaaacactttatccattcggcgttgcaacaatttatcgatggtaatggatttcattgtggaatatggagtaataaagaattgattggagtcataggattgcattacttagatttagttaataaaacaacttcaattggttattatttagctgaagactttcaaaagaaaggtattatgactaaatgtactaaagcgttaattcgctatgtatatgaagtgtatgatattaatcgtatagaaatacgaatgtctactaaaaataagaaaagcagagctataccaattagacttgggttcacgcaagaaggtatattgagaagtaatgaacgattacaaggggaattctcagatagttatgtttttagcttgttgagggaagaatgtacgtatactagataa

SEQ ID NO: 1719 - DNA, 327 bp, Staphylococcus epidermidis
aagtgcatacctttttattttcaaaagtcttcctcctccataataaagatatcttcaacaggttcaccaaagattcttgcaatttttattgcggttaatatagatggtgtaaaatcgttgcgttctattaaagacaccgtttgtcgtgatattccagcttttttagcaagctctgtttggttatatccatcacgggctcgtaattctttaagtctattgcgcaaattgtatcacttccttacatataaactatataatatatttgtcattatgacaagtatattagtcaaaatgacaaaaataatagactttttagggattgtataa

SEQ ID NO: 1720 - DNA, 1101 bp, Staphylococcus epidermidis
ataatggctttaacagcaggtatcgtaggtttgcctaacgtaggtaagtctaccctatttaatgcaattactaaagctggcgcattagcagcaaactatcccttcgcaacgattgatcccaatgttggtatcgttgaagtgccagattcacgtttaataaaattagaagaaatggttcaacctaaaaaaacaattcctacaacttttgagtttactgatattgcaggtattgttaaaggtgcatctaagggcgaaggtttaggaaataaattcctttcacatattcgtgaagtagatgctatatgtcaggtggttcgtgcgtttgacgatgagaatgtaacacatgtatcagggcgtgttaatccgcttgatgacatagaagtcattaatatggaacttgttttagcagatttagaatctgttgaaaaacgtttaccgaaaatagagaagatggctcgtcaaaaagataaaacagctgagatggaattacgtatattaacacaaattaaagaagcgttagaagacggtaaaccagtacgcagtattgatttcaatgaggatgatcaaaagtgggttaatcaagctcagttattaacatctaagaaaatgttatacattgctaatgttggtgaagatgaaattggagataaagataatgataaagtgaaagcaattcgtgaatatgcagcaaacgaagattcagaagttatcgttattagtgcaaaaatcgaggaagaaatcgctacattagatgatgaagataaagaaatgttcttagaagatttagacatcgaagaaccaggtttagacagactcattagaacaacatatgatttgttaggtttatctacttactttactgccggtgtgcaagaagtgcgcgcttggacatttaaacaaggaatgactgcaccacaatgtgctggaattattcacactgattttgaacgtggttttattcgtgcagaggtaacaagctatgaagattatgtacaacatggtggcgaaaatggtgctaaagaagcgggaagacaacgtttagaaggtaaagattacatcatgcaagatggggatattgttcatttccgttttaatgtttaa

SEQ ID NO: 1721 - DNA, 1143 bp, Staphylococcus epidermidis
atctattacacaaggagaatatatatgaataagaaactattgtggagcatcattggtattgtaattattgtcgtattaatcattgctgcttttatattaaaacaagttaatggttcaggtagtaaagatagtaaggcatacgatacatatacagtaagaaaagaaacacctattagtttagaaggcaaagcgtctccagaatctgtgaaaacttataataataatcaatctgtgggtaacttcttaagtgtttcagtacaagatggccaaacagttaaacagggtgaacgtatcatcaattatgatacaaatgggaataaacgccaacaactagtgaacaaagtgaatcaagcacaatctcaagttaatgatgattatcaaaaagtaaatcaaagtcctaacaatcatcaattacaagttaaattgactcaagatcaaagtgctttaaatgaagctcagcagtcattgtcacaatatgacagacaactcaatgacagcatgaatgcatcatttgatggtaaaattaatattaaaaatgattcagatgtaggtgaagggcaacctattttgcaattaatttcttcaaatcctcaaattaacgcaactatcacagagtttgatattaataaaattaaagaaggcgatgaagtagatgtcactgtaaatagcacaggtaaaaaaggaaaaggaaaaattcttaaaatagatgaacttcctacaagctatgatacaagtgacgatagtacagcatcatcggcacaagcaggggcacaaggtgatagtgaagaaggaactgaaatgacgacatctaatcctacaattaatcagccaacaggtggtaaaagtggcgaaacatcaaaatataaagttatcattggtgatttagatatacccgtgagatcaggcttctctatggatgctaaaatccctcttaaaactaaaaagttaccaaataacgtattaacaaaagataataacgtatttgtcgttgataaaaataataaagttcacaaacgtgaaattaaaattgaacgtaataatggtgaaatcattgtgaaaaaaggattgaaatctggcgataaagtccttaaaagtccaaaaggtaatttaaatgatggagaaaaagtagaggtgtcatcatga

SEQ ID NO: 1722 - DNA, 453 bp, Staphylococcus epidermidis
ccatctccaacaatactaaaccagtctgttgattgttcgagagttttagactctgcaccatatatgaggtgtaatacaatgccaaatacgatacctattgctaaagcggtaaagacacgtttagggaatgagacgtgttttcttgccataatatttaacattactaggaaaacaagtaacacgatgacattaattactgtaaaaagtatttccatatcgatatatagctcctttttaatttttagtattccgacatatgtaataagaataaagggggttaagaagaaattcaagttgttgatttatagttttcagattcatttaaagttgaatagagtgaaggtgattattagaacaatgaaaaatgagaagtttatgtttatcagaaaagtgagcaaagaggacgtaaagaggtttatattaataaaaaagacgcgtgcaatcatgctataa

SEQ ID NO: 1723 - DNA, 300 bp, Staphylococcus epidermidis
actatgagaacatatgaaattatgtatatcgtacgtcctaacattgaagaggatgctaaaaaagcgttagttgaacgtttcaatggtatcttagcttcagaaggatcagaagttttagaagaaaaagactggggtaaacgtcgcctagcttatgaaatcaatgatttcaaagaaggtttctataacatcgtacgtattaaaactgataacaataaatcaactgacgaattccaacgtttagctaagattaatgatgatatcattcgttacatcgttattcgtgaagaccaagataagtaa

SEQ ID NO: 1724 - DNA, 216 bp, Staphylococcus epidermidis
ataataatgacagcaaatgttgtagtcatcacaatgacatttgaattttcagaaccgaatttgaatgttagaggaaacataatggagaaagtccctgcgccaccaatggcaacacatagtgaaatgaataccatacttaaactttgtgtgattagaccgacactaggtacacctgcaagtatcccaactaatgcacacaagagaaaaatagtataa

SEQ ID NO: 1725 - DNA, 1395 bp, Staphylococcus epidermidis
ggaggcgagactcttatggattttgatacgattacaagtatttcaacaccgatgggtgaaggtgctattggaattgtgagattatctgggccacaagctattgaaatcggagatatcttatataaaggaaagaaaaagttatctgaagttgagacgcatacaataaattacggtcatattattgatccagaaacaaatgaaacagttgaagaagtcatggtgtctgtattacgtgcccctaaaactttcacacgagaagatattattgagataaattgccatggtggtattttaacaattaatcgtatattagagttaactatgacttatggtgcacgtatggcagaaccaggtgaatatacaaaacgtgcatttttaaatggtcgtatagatttatctcaagcagaagcggttatggattttatacgttccaaaactgatcgagcttctaaggttgcgatgaatcaaatagaaggacgtttaagtgacttaatcaagaaacaacgtcaatccatattagagatactcgcccaagttgaagttaacattgattatccagagtatgatgatgtagaagacgcaacgacggacttcttactagaacagtctaagcgtattaaagaagaaatcaatcagttacttgaaacaggagcacaaggtaaaataatgagagaagggttatctacagttattgtaggacgtcctaatgttgggaagtcttcgatgctaaataaccttattcaagataataaagcaattgtgactgaggtcgctggtacaacaagagacgtgttagaagaatatgtcaatgttagaggtgtcccgttacgacttgtagatactgcgggtattagggatactgaagatatcgtagagaagattggtgtagaacgttctaggaaagctctaagtgaagcagatttaattttatttgtgcttaataacaatgaacctctgacggaagatgatcaaactttattcgaagtcattaaaaatgaggatgttattgtaatcattaataaaacagatttagaacagcgattagatgttagcgaactaagagagatgattggtgatatgccacttatacaaacatcgatgcttaaacaagaaggtattgatgaattagaaatacaaattaaagatttattctttggtggcgaagtacaaaatcaagatatgacttatgtatctaattcacgtcacatttcattgttgaaacaagcgagacaatcaattcaagatgcgattgatgctgctgagtctggtatcccaatggatatggtacagattgatttaacacgtacttgggaaattctaggagaaattattggagaatcagcgagtgatgaattaatagatcaactatttagtcaattttgtttaggaaaataa

SEQ ID NO: 1726 - DNA, 270 bp, Staphylococcus epidermidis
gagagtgctgctgagaataaactgctcgctttggcgtcagatttaaatattttagaaataactagaaagattaaaaatacaacaacaacactaaagattgttcctatgaaagcacctatagttgtagtcatacgtaacatattttcatccatttggctattagctatcgattggttatctaatagttcattgctagtattatatgtgatgaaagcgctaataatagctaatactatcactatgattgatttaagtatccattttggctga

SEQ ID NO: 1727 - DNA, 1116 bp, Staphylococcus epidermidis
gaggagctagctatgaaggatacagatttagctcaaattgctttaacacaagatcacactggcgcaattgccaatccaatatatttatctactgcatatcagcatcctcacctaggtgaatcaacaggctatgattatacacgaacgaaaaatccaacaagaacagcctttgaagaagcttttgcacaacttgaaaaaggcattgcttcatttgctacttccagtggtatggcggcgattcagttaatatgtaatatattcaaaccaggtgatgaaattctcgttgcatttgacctatatggtggaacatttcggttattcgatttttacgaaaaacaatatggtttgaagtttaaatatgtagactttttaaattatgaagaagtggaaaaaaacatcactccacaaactagagcattatttattgaaccaatctcaaatccacaaatgattgaaattgatgtagaaccatattatatccttagcaaaaaacatcaactattaacaattatcgacaacacttttttaacaccttatctttcgacaccactcgaagaaggtgcagatatcgttctgcattcagcaacaaaatatattggcggacataacgatgtgttagctggagttgtaactgttaaggatgctcaattagctgaacaattgaatcaattccataatatgattggagcaactctatcacctcttgatagttatcttttacaaagaggtctaaagacattacatcttcgcatagagcgttcccaagaaaatgctcaaaaacttgcacaacgatgtcgccagtcagattcaattgatgaagttttatatagtggacgaacaggcatgcttagtttaagactgaaccaagcatatagcgtcgctaaatttttagaaaatttagaaatttgtatatttgcagaaagcttaggtggtacagaaacatttatcaccttcccttatacacaaacacacgttgatatgccagatgaggaaaaagacaaacgtggcattgatgaatatctcatcagattgtccgtaggtatagaagattataacgatatagaagctgacataattcaagcattagagaattctaaagtaggagtgatttcatga

SEQ ID NO: 1728 - DNA, 765 bp, Staphylococcus epidermidis
agatatctttattatggaggaggaagacttttgaaaataaaaaggtatgcacttctatgtttattaggaggattagttggaggcatcatcggatacatcataggagctattaactgggagaagttatttaattatgcacagttcgctaactttaaagttgtgctttatacaaccatcgtagcatcattaataaatgttatacttactgtgtatttatttatagtccaaaacgcgtcacttcactataaagctaaaattgacgcaaatatttcagatgatttagcagatacatatgaaaataaatcatacatcaaatcattgaaagtaagatttatttacacaatgcaattaattgtcgcttttattgcaattttaatacccgtcataggaaattcatctgagaatcacattgctctaataatgattcctttctttattacaatcatttcatccataatgattgggatattttatagaaaatttgatgctcgataccctaaattaggagagaaacattacactgaaaaagcatttaatattatggacgaaggagagcgatacatcacactcgtttccttgtataaagtgcaccagcagaatattgtattactttttataggaattatgatgttgggaatattctcaataactacaggcatgaatcaatcgctaggcataattttgtttatcattttatttatctataattcattgggatatttactgaaagtcagtaatttttataaatcagaacagaaatcctaa

SEQ ID NO: 1729 - DNA, 201 bp, Staphylococcus epidermidis
ttaacatttcttcctttgtgctttaaattacttatttccgcaataaaagtgaaagcaactggactatccattccaatagcaaaccccattatacaacgacatattattagaataattacatttggtgcgagtgccgcaccaagagaggttacagtaagtgttagtaaggcaattgataaaatacgcttgcgtccaaactga

SEQ ID NO: 1730 - DNA, 1200 bp, Staphylococcus epidermidis
ggagatgaatatgacatgtcacgcatagtattagctgaagcatatcgaacacctataggcgtgtttggtggtgtatttaaggatatacctgcctatgaactaggtgcaacagttattcgtcaaattttagaacatagtcaaatagatcctaatgaaatcaatgaagttattctaggaaacgtattacaggcaggtcaaggacaaaatcctgctcgtattgctgcgattcatggtggtgtgccagaagcggtaccttcttttactgtaaataaagtttgcggttctggattaaaagcgattcaacttgcctatcaatctattgtagcgggagataatgagattgttatcgctggaggcatggaaagtatgtctcaatctccaatgcttcttaaaaatagtcgtttcggttttaaaatgggaaatcaaactttagaagatagtatgatagctgatggtttaactgataagtttaatgattaccatatgggtatcacagccgaaaatctagttgaacagtatcagattagtcgtaaagaacaagatcaatttgcattcgattctcaacaaaaagcatcacgtgcacaacaagctggtgtatttgatgctgaaattgtacctgtagaggtaccacaacgtaaaggcgaccccctaattatttctcaagatgaaggcattagacctcaaacgacaattgataagttagcacaactccgtccagcatttaaaaaagatggatcagtaactgctggtaatgcatccggtatcaatgacggtgctgctgctatgctcgttatgacggaggacaaagcgaaagcattgggcttacaacctatagctgtattagatagttttggtgcgagtggtgtggcgccttcaattatgggtattggtccagttgaagcgatacataaagctttaaaacgttctaataaagtgataaatgatgttgatatttttgaattaaacgaagcttttgcagcgcaatcaattgctgtaaaccgtgagttgcaattaccgcaagataaagtcaatgttaatggtggtgcgattgcactaggacatccgataggggcttcgggtgcgcgtactttagtttcattattacatcaattaagtgatgctaagccaacaggtgtggcatctttatgtatcggtggcggtcaaggtatcgctacggttgtatctaaatatgaagtttaa

SEQ ID NO: 1731 - DNA, 2073 bp, Staphylococcus epidermidis
gggaaaaatcttatagaggtgatttctttgacaaataataatagaataaaaagatttagcattagaaagtacgcagtgggagtagtatcaattattacaggtgtaacaattttcatcggagggcaacaagctcaagcagctgaaacttcagtgcaacatgcggatgcacacccagaagactcgcaaacaacacaacaattaaaaaatgataaggtagaagaaacgttaaaagcttcaaaacaaggtaatgctgatagtcaacaagtacaaacaattgatcaatctaaaacaaatcaaaacaaccaacattctgtagctgaaagtgcacaactgaaaagtgatgagacagctaatcagccaaaaaaagaagaaagtagctcagtaaaacaagacgtccaaccgtctaaaaatgtaaatcaacaagacgcagctactcaatcaaatgagagagaaaataatgacataaaaggtgaaggtcaaacttcaaagacgagcaatcaacatattcagagttctaacagtcataatcaatcaacaggaacaaaagacagcgactcagaagaaatcgaccaaccattagtgaaattacaaaagccgtctaatgattctacatatcaaacacaatcaaaaacaaaacaagatagttctaaacaactccctcaagaaaaaacaacaaaacgtcaaattcaaacaactgaaaatgaacagacaactaaagttgattctaaaaaagctaatgacactcaaaatgttgaaaaacatactcaagagcctaaaaatgatacatcaacatcacaaaaaaatcatcatcaagtagctacaaaagaacaatctaatagaagtacaacaaggaagacgcaaaagcaatcatcaaatgctaatcaaaatcatcagtttacacatcaagcacagttcaaaaaccaatatccagtagtatttgtccatggtttcctaggctttgcaggtgataatcaatttagtttagctccaaaatattggggtggtacaaaatacaatattgacagaaatttaactaatgagggttacaatgtacatgaagcaaatattggtgcttttagtagtaactatgatcgcgcagtagaattgtattactatgtcaaaggaggacgtgttgattacggtgcagcgcatgcagctaaatatggtcatcatcgctatggtcgaacatacaagggcatcatgcgtgattgggaacctggcaaaaaaattcattttataggtcacagtatgggtggtcaaaccattcgtcaaatggaagaattcttaagaaatggtaaccaagaagaaatagaatatcaacgtcaacatgggggcactatatccgatttatttacaggtggtaaagataatatggttgcttcaattactacacttggcacaccacataatggtacacctgctgcagataaaattggcacacgtaaacttgtaaaagaaacgattaatcgtattggtagattaagtggtggtaaagatgtagatatagatttaggtttttctcaatggggattaaaacaacaaccaaatgaaagttacattgattacgcggaacgtgtatccaaaagtaagatttggaatactgaagatcaagctgttaatgatctgacaacgcaaggtgctgaaaaaattaatcaacaaacaagtctaaatcctaatattgtctacactacttatacagggtcagcgactcacacaggacctcttggtaatgaattacctaattctagtgaaattcttttattgaacttaaccagtcgtattattggtaaagatgtaaacaaagaaattagaccgaatgatggtgtagttccagttatatcatcacaacatccttctaatcaagcctttaaaaaagttgatgatcatacaccagctactgataaaggtgtttggcaagtgagacccgttcaacatgattgggaccatttagatttagtaggtatggatgcatttgatttaacacatacaggtagagaattaggtcaattctatctaggtattatggataatatcatgagaatcgaagaagcagacggtattacaaataaataa

SEQ ID NO: 1732 - DNA, 897 bp, Staphylococcus epidermidis
ttgatacttcattttagttataataacatcaaaattatatttcatataattgcacttaatattaaattcattataaaggagtcgtttatgttaaagaaattttcttactcaatcatttcactttcaattttcgctactagccttaattttatagatactcaagcacaagcgtcttcatcttctgtaagcgaaaaaggtacaatggggtatggctatcaacaatacttaaaagaccatcctaaaaagcaaactcataaaacacaaaatcgttctactttctctgctgaatctaatattactgaaacaaataatggtgaaagagtcttagatatttctgaatggcaaggacttttaactaatgaacaaataaaacaactaaagaaaaattatgattttattattttaagagcacagtacggttcagaatacgttgataagacttttgaaaaaaatgcagaattattagaacaaaataaaatgaaatacggcgtgtactcttatagcatgtacgaaagtccaaaagatgcacgttatgaagctaaaactttatctcaacgtgctcccaaagccgccttttacattaatgattatgaagaacaaaccgttaaatccggagatgatgaaacagcgacacaagcatgggcaaacgaaatgagaaagcttgctggaaacaagaagatccttttttattcatatgaaaatttcatgttaaatcatgcatcaaatgctgtcagttcatatgatggctactggttagcagcatatcaagctgaggaaccaaaacgagagaaagtgctatggcaatatacagatagttactactctcctgaattaaatcaaaatgtcgatgcaaattatattgacgaaaatgtgaattcgtcttggttcacttcataa

SEQ ID NO: 1733 - DNA, 1527 bp, Staphylococcus epidermidis
aatatgcttaatgctgatttaaagcaacaattacaacaattacttgagcttatggaaggcgacgttgaattcgttgccagcctaggctctgatgataaatcaaacgaactcaaagaattattaaatgagattgctgagatgtcagcacacataacaataactgaaaaatctttaaaacgtacaccaagtttttcagttaatcgccctggtgaagaaacaggtattacattcgctggcatacctttaggccatgaattcaactctttagtattagctatactacaagtgagtggtcgcgcacctaaagaaaagcaatccattatcgatcaaattaaagggctcgaaggtccatttcatttcgaaacctttgtaagtcttacttgtcaaaagtgtcctgacgtcgttcaagcattaaacctaatgagtgttattaatcctaacattactcatactatgattgatggcgctgttttccgtgaagaatctgaaaacattatggcagttcctgccgtcttcttagatggtcaagaatttggtaatggacgcatgacagttcaagatattttaactaaattaggaagcacgcaagatgcctctgaattcaacgataaagatccttatgacgtgttaatcgttggtggcggacctgcaagtggtagtgctgcaatttatacagcacgtaaagggctacgtacaggtattgtcgctgatcgaattggtggtcaagttaatgatactgctggtatcgagaacttcatcactgttaaagaaacgacaggttcagagttctcatcaaatcttgcagaacatattgcacaatatgatattgatacaatgactggtattcgtgctacaaatatcgaaaaaacagattcagctattcgcgtaactttagaaaatgatgctgttttagaaagtaaaactgtcatcatttccacaggtgcaagttggcgtaaactaaacatcccaggcgaagaccgtctaatcaataaaggcgtggctttctgccctcactgtgacggacctttatttgaaaataaagatgttgctgtcatcggtggtggtaactctggtgtagaagcaactattgatttagccggcatcgttaaacacgtaacattatttgaatacgcttctgaattaaaagctgatagcgtattacaagaacgtttacgctcactacctaatgttgatattaaaacgagtgctaaaacaacagaagtaattggtgacgattacgttacaggtattagctatgaagatatgactaccggagagtcacaagtagttaatttagatggaatatttgtacagattggattagttcctaatacatcttggttgcaaaatgctgtcgaattaaatgaacgtggcgaggttatgattaatcgcgataacgcaacaaacgttcctggtatctttgcagctggtgacgttaccgatcaaaaaaataagcaaattattatttctatgggtgctggtgctaatgccgcacttaatgcattcgattatataattagaaattaa

SEQ ID NO: 1734 - DNA, 1200 bp, Staphylococcus epidermidis
cacgtgaataacttttcaaatgtcatatcagttgctattcgttccattttaaaaaacaaacgacgtaatatctttacgatgattggaataattattggtattgcatcagtaattactatcatgtcgttggggaacggttttaagaagtcaacgactgagcaattcaatgatgctggtgctggtaaaaatcaagcttcaatttcttacatgacagaaaatatggaagcgcctaaaaataatccatttaagcaagaggatatgagtgttgttgaacaggttaatggtgttaagagtgctaaagtaaaagaggataaggatagcacatattcagtcaaaattacgaatacacatggcagtagtgatgctagtttaaaaaaggttgataaactgacagatgtagatgaaggaaaaggatttacgaatgatgataatgaagtgctagaaaaagtagccgttatagataaaaaaattgctaaaaaagtattcaataatcatgcaatggggcaatccatctatataaatggagaagggtttaaagtcgtaggcgtctctgatagctcagaagttgatgaaagtgggatgcctattgagtcattaattcaaatacctacaaaatcatttaataaatatatgggcaatttgacacaaggtatgcctcaattattagttacagttgaaaaaggttcagataagaaagacgtaggtaaaaaggtcgaaaaagcgttgaataaaaaaggaactggtgtatctgaaggtcaatatagttatgaagataatgaagcagtaatgaaaacgataggttcagtcttagacacgattacttactttgtctctgctgttgcgggaatatcactctttattgcaggtattggtgtaatgaatgtcatgtatatttcagtcactgaacgaacagaagagattgcaattcgtcgtgcatttggcgctaaaggtcgagatattgaaatacaattcttagtagaaagtgttgtgttatgtctcataggtggtatcatcggattaattctaggtattattattgctacattgattgatctcgtgacacctgaaatggttaagagttccgtcagtctaggttccgtcatcctagctgtaggtgtatcaacattgataggcatcattttcggttggatacctgcacgttcagcttctaaaaaagaattaattgatattattaaataa

SEQ ID NO: 1735 - DNA, 603 bp, Staphylococcus epidermidis
aaacatatcaagggagccataataatgaagaaagaaataatagaatggattgtagccataatcgttgcaattgttatcgtcacacttgtgcaaaagtttttatttgcttcttatacagtcaaaggagcgtctatgcatccaacatttgaaaatagagaaaaagtgatagtaagtcgtatagcaaaaacgcttgatcatattgatacaggagatgtagtgatttttcatgctaacgcgaagcaagattatattaagcgacttattggtaaaccaggtgattcagtagaatataaaaaagatcaactatatttaaacggtaaaaaagtagatgagccttatttaagtgaaaataaaaaacacaaagttggagaatatctaacggaaaactttaagtctaaagatcttaagggtacgaatggcaatatgaaaattcctagtggtaaatacttggttttaggtgataatcgtcaaaacagtattgacagtcgcatggatgaagtaggtcttttagataaaaatcaagttgttggaaaagtagttttgagatactggccatttaatcggtggggcggtagttttaatcctggaacatttcctaactaa

SEQ ID NO: 1736 - DNA, 285 bp, Staphylococcus epidermidis
aaatatttaaagcaggtattttacatgcaacataaaaataaatttcaacgtattaaccaaattatacaagttataggtttcctttcatttttagcaattctcactatcattacacttaacttttttataaaaggacacttacaaggtcattttgaaataggttttaatattcaaagtaatcaagtctatgtagtaacgacactaatcatagttacaatcatctgtactatattatcagctattctaaacatgctttctaataaaaaacaaaattacaaacattaa

SEQ ID NO: 1737 - DNA, 186 bp, Staphylococcus epidermidis
gagtttaaaaagaaagaggtacgcttttcctatactaatctcgaactactttataaacattcgttactcaatctaaatctttgttcttcatttctatcaaaaaggcctactgcatttgaactaaatttcgagttattagttgaattatcaattaattcgtatatcaatgtttctaatcaactctag

SEQ ID NO: 1738 - DNA, 846 bp, Staphylococcus epidermidis
attatggaaaacttattagaagttcagcaactcaataaatcatataagaattcagaatttcagcttactgacatcacattctctgttaaacctggcgaggtagtgggtttaattgggaaaaatggttcaggtaagtctaccctcattaatacacttgtaggaaatagacataaagataatggttcactgaaattcttcgataaagaggtgacagagaacgacttcaaatataaagaacatttaggtgtagtttttgatgatttacgtgttccagataaattaactctacaatatatcaataaagtttttactgaaatatatgatgcttggaacagcgatacattcttttctttaatcaaagcatttgaactaccaacaaataatcaaattaagacattctcaagaggaatgcgtatgaaagcagctttaacaattgctttaagccatgatgctaaattattaatcttagatgaagctacagcaggtatggacgtatcaggacgtgaacatgtgttagaaattctagaggattatttaggagacgatcgtgccatattaatttcatcacatatttctgaagatattgaacagctagctactcagctcgtttttatgcgtgatggtcgaattattttaaaagaaagtaaagaagttttattgagccaatacggcatcatcgatcaaccagttgagcatttcaatatttcaaatgagtatctaatcgcaacgcgcagacgtaatgatcgacaaatcagtttagtgaataactatcaaaaagtacctgatgcacaaccactaaagacaatcgatgatgcaactaaaattattatgcgaggtgaagtataa

SEQ ID NO: 1739 - DNA, 645 bp, Staphylococcus epidermidis
agtataatgaaaggtcttactcttagtatattttatacagctaaaaaatcatttttcatctatttagtagtcggaattattgctgcagtcgttttctcatttttaaatccaacgatgaacagctttcttgctatcatttttttaatatctcctattacggataacttcaaacgtgaaaaggactcaagatggatgaattacatatccacacttcctgttagaagagctgattatgttaaaagttattatactatttttctcttgtgtgcattagttgggatacttgcaggtgtacctagtgtcggtctaatcacacaaagtttaagtatggtattcatttcactatgtgttgccattggtggcgcagggactttctccattatgtttcctctaacattcaaattcggttctgaaaattcaaatgtcattgtgatgactacaacatttgctgtcattattatctatttcttattctatatcgcatcaatgatattgagtaatcaaacaggaagtggctctatgattacaatgctgagcaacacacaaagctatgttgtatattctatttatggaatacttggattgatttcaattattatctcttatattttatcgattaaaatttttaacaaacaagaactataa

SEQ ID NO: 1740 - DNA, 486 bp, Staphylococcus epidermidis
  unsure (16),(17): Identity of nucleotide at the above locations are unknown.
caactggtgaagttgnnaagcgcctctttgccaactatccaaaattctcaagaggtgattcagtcagcacaagaacaacaatctaaagacatcgctaaagctaacgaattaaaagatagtgaattacgtagtcattttgattcaatgtcaaatagcgcttcaatatctcagagcaacgtcgcaagtcaaagcactacagcaagtttgaaccaatctgaatcagcaaatgattcaatgagttcatctctgtccgagtctaactcaataacatccgaaagtaatacaaatagcaaatcggaaattgaatcaaaaagtacgtctacaagcgagttcttgtcagaatcaggaagtgtatctaactcagaaaaatctgagtcaatttctcattctcaatcaacatcagctacaccttcttctcaatcgacttaccaacaacaacctaaagaagagaagaaaggtttctttgcacgtctatttaacttataa

SEQ ID NO: 1741 - DNA, 915 bp, Staphylococcus epidermidis
atgaattatgaaaaaaatgaaagggagggcatattttatatgaatcaacttaaacatattttatcttcattgttcgaacctttaacaaaggttgaaacatatgaaaatttaattactaaagtaataatgattttaatttatatccttgtagcgattgttgttatagcaattttgaataagattattgagcaagcatttaaaattcaaaataaaagcaaaaaaggaaataaaaaacgttcaaaaacactgatttctcttgtacaaaacatagtaaaatatatcgtatggtttgttgttatcacaacaattttaagtaagtttggtattagcgtcgaaggtatcatcgctagtgctggagttgtaggtattgcagttggtttcggtgcgcaaacaatagtaaaagatattattacaggtttctttattatctttgaaaatcaatttgatgtgggtgactatgttaaaatcaatagttcaggaactacggtagcagaaggtactgtgaaatctattggtttaagatcaacgcgaattaatacaatttcgggagaactgactattttacctaatggtagcatgggggaaattacgaacttttcaattacaaatgggactgctattgtagaactaccagtatcagttgatgaaaatatagatcaagttgaaaagaaactcaatcgtttatttgtttctttacgtagtaaatattacttatttgtcagcgatccagttgttgatggcattgatgcgatagaatctaataaggttactatacgaatttcagcggaaacaattcctggtgaaggattttcaggcgctcgtattattcgtaaggaagctcaaaaaatgtttagacaagaaggtattcgcatgccacaaccagtcatttcaaattataatgaagaaaaaagctaa

SEQ ID NO: 1742 - DNA, 213 bp, Staphylococcus epidermidis
aatacatatgaggtgtttttcatgagattaaatttagattggaataaagatttccaagagtttcaagatatcttaaatagtggcattcacccagaatggctatactgcgctaaagcaaatttagttctcgaacccgcatacactggtgaaggcaaacaattttttagtacacaagacatcattaaagcaagcaaaatcattccatttttttaa

SEQ ID NO: 1743 - DNA, 1191 bp, Staphylococcus epidermidis
agtaggagtgatttcatgagtttatctaaagaaacagaagtaatattcgatgtgcgtagaggtaatgactacgactcagctaacccgccactttacgattcatctacattccatcaaaaagtgttaggcggtgagactcaatatgattatgcacgaagtggtaaccctaaccgaactttacttgaagagaaacttgcacgtttagaaggtggtaaatatggatttgcttatgcttcaggcattgctgcaatttcagccgttttactcacattaaacgcaggggatcatgttattttacctgatgatgtttacgggggcacatttagattaactgaacaaatactcaatcgattcaatattgaatttactacagttaacgctacacatatagatcatatcactgaagctattcaatcaaacacaaaactcatctatgtagagacgccttcaaatccacttttcaaaattacagatattcatgctgtagcaacgctagcaaaggaacataagatactattagctgttgataatacgtttatgacacctttgggtcaatcacctttagcactaggcgctgacatagttattcatagtgcaactaaatttctaggtggacatagcgatttaattgcaggtgcagcaattactaataatagagaggttgcaaatgcattgtacttattacagaacggcacgggcacagccctttctgcatatgatagttgggcacttgcaaaacatcttaaaacattaccagttcgttttaaacaatctgttcataatgctgaacgccttgttcaatttttgagtcaaagagaggagatttctgaggtgtattacccgggaaataatcttacacatctcaagcaagcttcaactggaggtgcagtgataggtttccgacttaaagatgaatctaaagcacaaaagttcgtcgattctcttactttaccacttgtatcagtgagtctcggtggtgtagaaactatcctatcacatcccgcaacaatgtctcatgcagcagtgccagaagatgtgagacgtgaacgtggcatcactttcgggttattccgtttaagtgtaggtcttgagaattcagaagaactcatcgcagattttaactacgctttaaaggaggctttcaatgagtcatttactgaaccaattaaagagcaacgttttagtagctga

SEQ ID NO: 1744 - DNA, 660 bp, Staphylococcus epidermidis
aagaaaggtgacaaaatgaaacagctattatttaaaacaagttgcgtaataatggtacttctcacgtcttctttaagtattgtcagtacatattctcatgcaacaacgtcaggaggaacgagtagttccagtttggcaagttctagttcaagtagcagtgcagcttctgcatctagaggttcaacttcttcaagtacaagtatgagtcgttctagtgcaataaatgcgtctcgcaatgcacaacaatctagtcagcgtgctgcccaacaagcaacaaaatcaagtcgtgtaacagcaaccaaaaataaaggacaacaaagtgtatcaagacaaaaagcacaatctcgttctttgatgccgtctcaaagaccttatgattcaagtgcaccatactcatctcaatatattgctacaacttattataataattggttattctattatatttttgcacattcgtttttaaatcaacatgaaaagaaaaacagtgtagatgctcagtttaatatgttgaaacaacaaatgaagcctcatgagaaactttatactgttactgtaaagactaaacaaggaaagcgtgtcgttgttgtacctaaaaaacaatatgacaaaattgaaaaaggaaaacacattaaagttaaaaatggtgttgttcagtaa

SEQ ID NO: 1745 - DNA, 765 bp, Staphylococcus epidermidis
tacgagctagaggtgaggcaaatgtcacagtatccactttggaatcaattaaatactttaaaagaggctcagtgggtcgatttaacacatactttcgacccaaatatccctcgttttagcgaatttgaaaaaggtgaagtctcaacgctattcaatgttaaagatcatgggttttatgtacaacgttggagtatcgtaactcaatatggaacacacattgatgctccaatccatttcgttgaaaatagaagatatttagaagaattagatttaaaagaacttgttttaccattaattgttttagattattctaaagaagctgcacaaaattcagattttatcgtatcacgtaaacatttagaagactgggaacaacaacacggtcgcattgaagcaggtacttttgtcgcattacgtactgattggtcaaaacgttggccagatatagaaaaatttgaaaataaagatgtagatggccatcaacatcttccaggttggggccttgatgcattaaaatttctcattgaagaacgtggtgttaaatccataggtcacgaaacatttgatactgatgcctcaattgatacagctaaaaatggtgatattgttggcgaaagatatatcttaggtcaagacacattccaagtcgaattacttaccaatttagatcaattacctaccagaggtgcaattatctatgcaatcagcccaaaaccaaaagatgcaccaggctttccagttcgtgcattcgcaataaaaccttaa

SEQ ID NO: 1746 - DNA, 870 bp, Staphylococcus epidermidis
attaagatagaaagatgtggaaaagagatggcatatacagatgatcagaggttgaaaatgaataatgatgatagtgtgcaatttattgaactagaattaattagacctaatccttatcagccacgtaagacgtttgaagaagaacgactcaatgatttagcttcatcaattcaacaacatggtatattacagcctattgtattacgtcaaactgttcaaggttactatattgttgtgggtgagcgacgatttagagcatctaagttggcgggattaacagaagtgccagctattattaaagaactatctgatgaagatatgatggaattggcaattattgaaaatttacagagagaagatttaaatgccattgaagaagcagaaagttataaaaaaatgatgacagatttgaatattacacaacaagaggttgcgagacgattaggtaagtcacgtccttatattgccaatatgcttaggttattacagttacctaaaaatgttgctcaaatggttcaacacggggcgttatctagtgctcatgggcgtacgttattaactttgaaagacgccagtaaaataaaaaagacggcaaaacaagccgctcaggagtcttggagtgtaaggtatttagaggagtacgtcaatggtttagtcagtaaagacatctcaaggaaagttgacaaagagactaaggaaagtaaacctaaaatgattcaacagcaggaaagatttttaaaaaagcaatatggtgcgaaagtagatatttcgacatctaaaaatgtcgggaaaatcacgtttgaatttaaatctgaagcagaattcaaacgcttgattcgtcaacttaataaagattataaggaatattaa

SEQ ID NO: 1747 - DNA, 561 bp, Staphylococcus epidermidis
cacataaaagaagggataaacatggctggaagaccaaaagatccaacaatcaataaaaaaatttatactgagattcaacgtttattggaaacgactcattttagagatattactatagatcaaatttctgagaatactggtatttctaaagcaactatttatagacgttggaaggataaatcttcaattatcatgtccgcgtttattgaacaatctcaatatattgtgattcataatcaagataatttatatgatgatttattccagtttttagtgaaaataaaagatatctataaaacaaaactaggtagtgctgtgattgaaatattaattagtcatcaacaaatggaagctagagaaacttttatgactaattactttaatcataatcgcaaagttttaaaagagattgttcgtaagcacatacaagaggaagaacaagatttgtttattgatttaatcttctcacccatctattttaatatattaattaaacctgaaactctggataaaaattacattaaaaagatgttgaatcaagttttacgtatatatcattga

SEQ ID NO: 1748 - DNA, 354 bp, Staphylococcus epidermidis
tgtttaatggaaaaagcatatcgtattaagagaaattcagactttcaagcgatatacaagaatgggaagtctgttgcaaatagacaatttgttgtctatacctataaaaatagagatttaaaacattttcgcttaggaataagtgtctcaaaaaaactgggcaacgctgttacaagaaatagaattaaaagagcgataagagagaattttaaagtgcataagcaaaatattatcgctaaagatattatagttattgcgaggcaaccagcaaaagatatgaatacactggagattcaaagcagtttagagcatgtgcttaaaattgcaaaagtgtttaataaaaagattaagtag

SEQ ID NO: 1749 - DNA, 651 bp, Staphylococcus epidermidis
tacgtaaaggagatatattacatgagtacacaggaattaaaagaaaatgatattcagaactcaagtattccatttgttaatcattttaacaaactaagacatcagccaaaatggatacttaaatcaatcatagtgatagtattagctattattagcgctttcatcacatataatactagcaatgaactattagataaccaatcgatagctaatagccaaatggatgaaaatatgttacgtatgactacaactataggtgctttcataggaacaatctttagtgttgttgttgtatttttaatctttctagttatttctaaaatatttaaatctgacgccaaagcgagcagtttattctcagcagcactctcttattcaatcattattttaggatttacaattattatttctttaattcaaatagtttttggactaaagataacagactataagcttgatagcttaaacattttttcaaaggataataaaacactcatggctttcagtttaactaatcttttaaaagcctttttaactggtgttgtttattactcaacaagtcgtttatctaaaaaaacatctatgatattaggaatcattgcactcatcatattaataggatcaggtatgctaggtggaatgaatggctaa

SEQ ID NO: 1750 - DNA, 642 bp, Staphylococcus epidermidis
aaggagttactcaattctatgaaaaagagagtcattacatacttgatactagcgttgtctttaacacttgcagcatgctcaaatacgaacgataacaataatcaagagcatcacagcaacgctcatgcacctaaaaacgctaaaactttaaaggaaaaagatatcttttcttcaaacaaaaagggacaaaaaattagcgaaaaagagatgaagcaagctttagaaaaatatttacaagcgaatagcgatgtacttgataataagtatgtcatgcaacataaattagataaacaaagtgatagtaatcctaaaatcacagaatcacaagctgatcgtcttagcaagttatccaatttagcagttaagaacgatttacatttcaaaaaatttataaaaaacaatcacatccctgaagaatataaagatccaacagatcgcataattaattattttcacgctttaaatagtaccatttcaaatgtagatgcagacattgagaaattaaactaccaaccacaaaattcaattaacgttgttgatgtacccacaaaatattcaggtgatgtaaataaaaaacaacaagataaaattactactttccttaagaaaaaaggaatagacacagaagtatttaataaataa

SEQ ID NO: 1751 - DNA, 2277 bp, Staphylococcus epidermidis
atcaatcactgccaacaaggaggcaatattatgacaacaattaaaacttcaaacttaggattcccaagattaggtagaaaaagagaatggaaaaaagcaatcgaaaattattgggcacataaaattgacaaagcagaactagatcaaacactgactgatttacacaaagaaaatcttttacttcagaaaaattatcatcttgatagcattccagttggggatttctctttatatgatcatattttagaaacgtctttattgttcaatattatccctgaacgtttccaaggacgcgaagtcaatgatgatttattatttgatattgctcgtggtaacaaagagcatgttgcaagtgcacttattaaatggtttaacaccaactatcactacattgtacctgaatgggacaacgtagaacctaaagttgaaaaaaatacgttattagaacgttttaaatatgcacaatcaattaatgtaaatgcgcatcctgtaattgttggtcctatcacatttgtaaagttatcaaagggtggtcatcaatcgttcgaggaaaaagttgaaacattacttcctttatataaagaagttttacagtcacttgtagatgcaggtgcaaagtatattcaaattgacgagcctattctagtgactgatgacagcgaaagttatgaagacattactagaaaagcatacgactatttcgcaaatgaaggtttaggaaaatatctcgttattcaaacttactttgaacgtgttcacttaaaattcttaagttcattaccagtgggcggtttaggattagatttggtacacgataacggctataacttaaaacaaattgaagatggtgatttcgatcaaagtaaagcactttatgcaggaatcattgatggccgaaatgtatgggcggctgatattgaagcaaaaaaacaattaatcgaaacattacaacaacacacacaacagttagtcattcaaccttcatcatcacttctacatgttccagtatcactagatgatgaaacacttgatgaatctattgcagaaggattaagttttgctactgaaaagttagatgaattagatgcattgcgtcgtttattcaatgataatgacctgtcaaaatatgaacattacaaagcacgttatgaacgcttccaaagccaatcatttaaaaatcttgaatacgattttgaaagtgtaccgacacatcgtaaatcaccatttgctaaacgcaagcaattacaaaaccaacgtctaaatttaccagatttacctacgactacgattggttcattccctcaaactcgtgaagtccgtaaatttagagcagattggaaaaataatcgcattacagacgctgagtatcaagaatttttacaaaatgaaatcgctcgttggattaaaatccaagaagatattggtttagacgtacttgtacacggtgagtttgagcgtaacgacatggttgaattttttggggaaaaacttcaaggtttcctagtaacaaaattcggttgggtacagtcttacggttctcgtgcagttaaaccaccagttatatatggagatgtgaagtggactgccccacttactgtaaaagaaacagtatacgcgcaaagcttaactgacaaaccagtaaaaggtatgcttacaggcccagttactattttaaactggtcatttgaacgcgtagacgtacctagaaaggttgttcaagatcaaattgccttagccattgatgaagaagtgttagctttagaagaagcaggtatcaaagtcattcaagttgacgaaccagcattacgtgaaggcttacctctacgctctgaatatcacgaacaatatttagaagatgctgtacattcatttaaattagcgacatcatctgtgcatgatgaaacacaaattcatacacatatgtgctattctcaatttggacaaatcattcatgctatccatgatttagatgcagatgttatttctattgaaacttctcgtagtcacggagacttaattcaagatttcgaagatattaattatgatttaggaattggattaggtgtttacgatattcacagtccacgtattccaaccgaagaagagattactactgcaattaatcgttcattacaacaaattgatcgttctctattctgggttaacccagactgtggtctaaaaacacgtaaagaagatgaagtgaaagatgcattaacagtgttagtcaatgcagttaaaaagaaacgtcaagaatctgaatcaacaacagcataa

SEQ ID NO: 1752 - DNA, 384 bp, Staphylococcus epidermidis
tctagtttatgtttaaattgcgcagctattttattctggcttatattaaaatcatctggagaagtcatttctaaagttgtattagtattagattgtgtaattgccgcgaagcaaagaatactaaccgtgaaagctgaaatgatagcaataactgtgagagacatcgcatttttcttcattctgtgcatgatagatgatgtaaagacaacgtctgtgatatttacacgaccatgtttgatatgttttagtgttttaaaaataagtgatacagaacttctaaagaataagaaagcaccaacaatagttaaaaaaagtatgctaaaaggtgtaatcaaagcagttgttaaggctttaaaaacaccaaacatttcagtagacatataa

SEQ ID NO: 1753 - DNA, 510 bp, Staphylococcus epidermidis
atgttaaatcgagttgtattagtaggtcgtctaacgaaagatccagaatacagaaccacaccctcaggcgtaagtgtagcgacatttactctagcagttaatcgtactttcacgaatgctcaaggggaacgcgaagctgactttattaactgtgtagtcttccgtagacaagcagaaaatgtaaataactacttgtctaaaggtagtttagctggcgttgatggtcgcatacaatcacgtagttatgaaaatcaagaaggtcgtcgtatttttgttactgaagtcgtatgtgatagtgttcagttccttgaacctaaaaatgcacaacatggtggccaacgttcacagaacaataatttccaagactacggtcaaggatttggtggtcagcaatcaggacaaaatacatcttacaacaacaataattcatcaaactcaaatcagtcggataatccgtttgcaaatgctaatggaccgattgatatcagtgatgatgatttaccattctaa

SEQ ID NO: 1754 - DNA, 183 bp, Staphylococcus epidermidis
aatattatacgtttatctaatataaccgctctttcattgagtgacgcaatacaagttttctttgctatggttaagatgttattaggtacatttaatatgattattaatgttgatatttgctatttggatattttattgcacagaattttttaccgttatactattaaagataatgcactgtaa

SEQ ID NO: 1755 - DNA, 210 bp, Staphylococcus epidermidis
tacaatttgcgcaatagacttaaagaattacgagcccgtgatggatataaccaaacagagcttgctaaaaaagctggaatatcacgacaaacggtgtctttaatagaacgcaacgattttacaccatctatattaaccgcaataaaaattgcaagaatctttggtgaacctgttgaagatatctttattatggaggaggaagacttttga

SEQ ID NO: 1756 - DNA, 237 bp, Staphylococcus epidermidis
agaaaaaagctaatcatcattggaggtcatttcatgacgtcaaagtatggaataaatgatatagtagaaatgaaaaaaccacatgcatgtggaacaaatcgttttaagattattagaatgggtgctgatattcgtattaaatgtgaacattgtcagcgcagtgttatgattccacggcaagtgtttaataagaaaatgaaaaaagttcttgaatctcatcaagacaaagaaagttag

SEQ ID NO: 1757 - DNA, 243 bp, Staphylococcus epidermidis
tcattgcttagaaagaaagtgatgcatttgatgatgatagatcataatggaatttttctatgtaaatttggtaatataatgtggaatgtgtttactgcaattaaagtatgtaatactcatttaaatacaatgaaggtaagagataaactcttaaataatagatttgaatatccaaatataatgacaataagaaaagaaggtttgcttcttccctcatttttagaaaagtataagttatattaa

SEQ ID NO: 1758 - DNA, 711 bp, Staphylococcus epidermidis
tggagaaaaagtagaggtgtcatcatgattgaattgagaaaaatcaatcgacactttaaaaatggaaatgaatcaaatcatattttgaaagacatagatattcatattgatgaaggtgaatttattgctatcatgggtccgtctggttcaggtaaaagtacgttaattaatatcttgggatttattgatcgtggatatgaaggagaatacttttttaacaatgagaattatcaaaaaagctcagataataagctcgcagaaattcgaaatcatactgtaggtttcgtctttcagaattttaaattgattcaaaataacactattttagaaaatgtaagtattccgctaatttataatggtttgagtaataaagcgagaaaaagcaaagttttagacggacttcatgacgtcggtctaaaaggtaaagagaatctcttaccaaataaattgtcaggagggcagcaacaacgtgtagctattgcccgggcaattattaatgaccctaagtttattattgccgatgaacctactggcgctcttgattcgaagacatctcaagatattatggagcttttcgtaaaactgaacaaagaacagaatacaactattattatggtaacgcatgatcgtgaagtggcggaaaaagctgatcgtattatccatattttggatgggcgtgtgcaagaggaagaggtgttgacacgtgaataa

SEQ ID NO: 1759 - DNA, 402 bp, Staphylococcus epidermidis
atggagaaaaggagtattaatatgaaaaaagtatttatgatcataagtatacttaccataactgttactttaagtgcatgtggaggttctggaaaacaaaaagagccatctaaggaaagtcaaaaatctgataaatatgattatgtttattatgaaatattaaatgatggagattctgaaacgccaaatgttgagattaaatataaagataaaaaaggtaaatcacatatagaaaaagctgatttagatcacgtgtatgaacatatactaggtgatggtaataaaaaaccatatattgtaaaggatgggaagaaaattcatgtatatcgaccaccatatatgatttatggtgatgatgatgttgaaggcaaagccgtttcgaaagatgaagttacgaagtaa

SEQ ID NO: 1760 - DNA, 273 bp, Staphylococcus epidermidis
aataaaatgagtcaaaggaggcagttaaccatggcaggtggaccaagaagaggcggacgtcgtcgtaaaaaagtatgctatttcacagcaaatggtattacacacatcgactataaagacactgaattattaaaacgttttatctcagaacgtggtaaaattttaccacgtcgtgtaacaggcacttcagcgaaatatcaacgtatgttgactacagctatcaaacgtgctcgtcatatggctttattaccatatgttaaagaagaacaataa

SEQ ID NO: 1761 - DNA, 399 bp, Staphylococcus epidermidis
aaagaaatgaggaaaatcattatgaagatacgtttaacatttattatcttagcaatactatccaccatcggcttagtacttgttttagcaaaatatccaacaggcccacacacaatcaactataacgaaccttatacagtactcatagccattacgacaatagttataatggctttaccagcactcatattaggtatatttaatcatcttgcatgtagaatcatatcggcgatattacaaataagtgcactgatgatgtgggggtttttagtaatcattagcttaattatgggacaaattgtcattatgcttatggcttccttaacgatacttgcattacttgttagttctattgtcacactttcagtgcacccatctacttcagataaaataaattaa

SEQ ID NO: 1762 - DNA, 381 bp, Staphylococcus epidermidis
atatggatgagaagggttattgtgtttggtatatcaatttctagtgctatactacatttcgttatcggaggatttgctgttgcacttgcatcaattatggctgataaagtaggaggaaaattaggtggcattattgccacaatgccggcagtctaccttgcagctattatagcgttagctatagaccataaaggacagcaacttattcaaatgtcaattcatttaagtacaggagcaattgttgggattgtctcatgtattgtaactgtgttctttacttcaatttttattggtaagaaaaattatagaagtggaacagtatttgcaattctttgttggtttgtgatttctgttgcgattttcttagtcagacatatttaa

SEQ ID NO: 1763 - DNA, 771 bp, Staphylococcus epidermidis
aggagtgagaggatggctattttaacagcaaatcaattatcaaaagtatatggtcacaaacaaaaatatcgagctttaaataatataagtttttcagttgaaaaaggggaatttgtagctgtcatgggtccttctggatcaggtaaaacgactttactcaatgtgttaagttcaatagatactatttcaggaggaactgtagaagttgaaggcaaagaaattaataaactgagccacaaagaagtggcaaattttcgaaaacaacatctcggttttatttttcaagattatagcgttttacccacattaacagtaaaagaaaatattatgctaccactctcagtacaaaaattccataaatatgaaatggaacaaaattataaagaagtggctgaggcattaggtatttataacctgggaaataaatatccaagtgaaatttctggcggtcagcaacaacgtacggcggcagcccgggcattcgtccataaaccaacgattattttcgcagatgaacctactggcgcattagattctaaaagtgctcaagatttgttacaccgtctagaagatatgaataaacaatttaattcaaccattatgatggtgacacatgatccttcagccgctagttacgctgagagagtcattatgttgaaagacggtgatatacactcagaaatctaccagggtaacgattcaaaacaaacattttaccaagaaattatgaaacttcaaaccgcattaggtggtgtcagtcatgacatttaa

SEQ ID NO: 1764 - DNA, 591 bp, Staphylococcus epidermidis
cttttcaggaggaatttatctatgtctttaattaacaaagaaattttacctttcacagcacaagcttatgatccaaaaaaagatgagtttaaagaagttactcaagaagattttaaaggttcttggaacgttgtatgtttctatcctgctgacttctcattcgtatgccctactgaattagaagatttacaaaatcaatacgctaaattacaagaattaggtgttaacgtgtactcagtatcaacagatacacacttcgtacacaaagcttggcatgaccattctgatgcaatcagcaaactagaatacagcatgattggtgatccttctcaaacaatcactcgcaatttcgatgtgttggatgaagaatctggtctagcacaacgtggtactttcattatcgaccctgatggtgtggtacaagcagcagaaatcaatgctgacggaatcggacgtgacgcaagtacattagttaacaaaattaaagccgctcaatatgtacgtcaacatccaggtgaagtttgcccagctaaatgggaagaaggttcagaatcattacaacctggtttagacttagtaggtaaaatctaa

SEQ ID NO: 1765 - DNA, 861 bp, Staphylococcus epidermidis
ttgagagggagagaatggataatgaagaaacctttttcaaaattatttggtttaaaaaataaagatgacatcattggttatactgaagaagaacgtaataataatgtagaatccattcatattgaacgtatcgtacccaatcgttatcaacctagacaagtatttgagccaaataagattaaagaattagcagagtctattgaagagcatggattattacagcctatagttgtacgtccaattgaagaagatatgttcgaaattatagccggcgaacgacgatttcgagcattacagtcgttgcataaacctcaagtagatgtcattgttcgagatatggatgatgaagaaacagcggtagttgcattgattgaaaatattcaacgtgaaaacttatctgtcgtcgaagaagcggaagcttataaaaagttacttgaaatcgggggaacgactcaaaatgaattagcaaaaagtctaggcaagagccaaagcttcattgctaataaacttagattattgaagttagcacccaatgtgattaagagattacgtgaaggtaagattacagaaagacatgcacgagcggtattagtattacctgataaaacacaagaagaattaatcgagcaagttattagtcagaagttgaatgtgaaacaaactgaggatagagtacgtcagaaaactggaccagagaaagtaaaagcgcagactttccaattttctcaagatgtaacacaagcaaaagaagaactaggtaagagtattgaaacgatagaaaaatcaggtatacgcgttgaacaaaaagataaagaacatgaagattattatgaaattaaaataaagatatataagaaataa

SEQ ID NO: 1766 - DNA, 237 bp, Staphylococcus epidermidis
acatttaatggtaatgcacctgcacttgaacgtgaagtaaatgcaaagattagtacttctattgtctttttcacgtatttaacgggattgatacctaagacactcagtataattaaatggataatatacattgtgattagagctgcgtatgaagcaattaagaatttacctaacgtccaaattgcagaaaaatcacttgtcgcaagagtagaagccataatagctaaaatgccataa

SEQ ID NO: 1767 - DNA, 777 bp, Staphylococcus epidermidis
attttgataggagtgggtatagtgtcagattatgtttatgagttgatgaaacaacatcattcagttagaaaatttaagaatcaaccacttggttctgaaacggtagaaaaattagtagaggcgggacagagtgcttctacatccagttatcttcaaacttattctattattggtgttgaagatccaagcattaaagcgcgtttaaaggaagtgtcaggtcagccttatgttttagataatggttatttatttgtatttgttttagattattatcgtcatcatttagtagatgaagttgcggcgtcaaatatggagacatcatatggttctgcagaaggactattagtaggtacaatagatgttgcattagttgcgcaaaacatggcagttgctgccgaagatatggggtatggaattgtttatttagggtcattgcgtaatgatgttgcgcgagtgcgtgaaattttaaatttacctgattatacgtttccgttatttggtatggcagtaggtgaaccttctgatgaagaaaatgggtcacctaaaccgcgcttgccatttaaacatatttttcataaagaccagtatgatgcaaatcagcatcaacaacgtaaagaattggaagcatacgaccaagtagtgagtgaatattataaagaacgtactaacggtgtgcgtacagaaaattggtcacaacaaatagaaacatttctaggacgtaaaacacgtttagatatgttagatgaattgaaaaaagcaggatttattcaaagataa

SEQ ID NO: 1768 - DNA, 1896 bp, Staphylococcus epidermidis
cttttgggaggtaaaagagtggttcaagaatatgatgtagtagtcattggtgctggtcacgccggtattgaagcaggtttagcttcagctcgtcggggtgctaaaacgctgatgttaacaattaatttagataatattgctttcatgccatgtaatccatctgtaggtggtcctgcgaaaggaatcgttgtacgtgaaatagacgctttaggtggacaaatggcaaaaactattgataaaactcacattcaaatgcgtatgcttaatacaggtaaaggtccagctgttagagctttacgtgctcaagcagataaagtattatatcaacaagaaatgaagcgtgtacttgagaatgaggataatttagacatcatgcaaggtatggttgatgaactcattatagaagataatgaagttaaaggtgttcgtactaatattggtacagaatatcgttctaaagctgtcattattacaacaggtacattcttacgtggagaaattatactaggaaacttaaaatattctagtggccctaaccatcaattaccatctgtaactctagcagataatttaagaaaattaggatttgatatcgttagatttaaaacgggtacaccaccacgtgtaaatgcgagaaccatcgattattctaaaactgaaatccaaccaggtgatgatataggtcgagcgtttagttttgaaacaaccgaatttattttaaatcaattaccttgttggttaacttatacaaatggagatacacatcaagtcattgatgataacttacatttatctgctatgtattccggtatgattaaaggtacaggtcctagatattgtccatcaattgaggataaatttgtccgctttaacgataaaccaagacatcaacttttcttagaacctgaaggacgtaatacgaatgaggtatacgtgcaaggattatctactagtttacctgaacatgttcaacgtcaaatgttagaaaccattccaggtcttgaaaaagcagatatgatgcgtgcgggttatgctattgaatatgatgcaatcgtgcctactcaattatggccaacgttagaaacaaaagcgatcaaaaacttgtatactgcaggtcagattaatggaacatcaggatatgaagaagcagcgggacaaggaatcatggcaggtattaacgctgctggtaatgttttaggtacaggtgaaaaaatactcagccgttcagacgcatatattggtgtacttatagatgatttagtcactaagggtacaaatgaaccgtatcgattattaacttcacgtgcggaatatcgattattactacgtcatgataatgctgatttacgtcttactgatatggggtatgaattaggtttaatatcagaagaacgctatgcaagatttaatgaaaaacgtcaacaaatcaaagatgaaatacaacgacttaccgatgtacgtattaaaccaaatgaacatacgcaagcaattattgaagctaagggtggttcaagattaaaagatggcatattagcgattgatttattacgtcgtccggaaatgaactacgaaacaattttagaaatcttagaagaatcacatcaacttcctgaagcggttgaggaacaagttgaaattcaaacaaaatatgaaggttatatcaataaatctttacaacaagtagaaaaagttaaaagaatggaagcgaaaaaaattcctgaggatttagattatagcaaggtagatagtttagcatctgaagcacgcgaaaagttagctgaagttaaaccattaaatattgcacaggcttcacgaatttcaggtgtgaatccagcagatatctcaattctacttgtttatttagaacaaggtaaacttcaaagggtgaaacaataa

SEQ ID NO: 1769 - DNA, 741 bp, Staphylococcus epidermidis
acttcaaagggtgaaacaataatgagtattgaatggttatcagagaaattaagcgagcaaggcatagaactatctaatacgcaaaaagagcaatttcaaaaatattataaattacttgttgaatggaacaaaaaaatgaatttgacaagtattactgatgaacatgatgtttatttaaaacatttctatgattcaatagcgcctagtttctattatgattttaacggtcaattaagtctttgtgatatcggtgctggtgcaggttttccaagtatacctttaaagatagtataccctgaattgaaagtaacgattgtagattctctaaataaaagaatacaatttctaaatcatttagctgcagaactaggtcttgaagatgttagttttgtgcatgatcgagcagaaatatatggcaagggtgtctacagggagtcttatgatattgttacagctcgtgcagtagcgagattgactgtcttaagtgagttgtgcttacctttagtaaaaaaaggtggacagttccttgcacttaaatcatcaaaaggtgaagaagaattgcaagaagcgacatttgctattaacattttaggtggtaatgtgaaagagactcatacttttgaattacctgaaaatgccggtgagcgacaaatgattattattgataaacgtagacagacatcaaaaaaatacccaagaaaaccaggtacgccaaacaaatctccactagttgaaagttaa

SEQ ID NO: 1770 - DNA, 600 bp, Staphylococcus epidermidis
tttcaaatcataattaaggagtttaaagcaatgaatgttagcaatcaaatcaaaaaatttagagaaagagatgggtattcacaagaatttttggctgagaaaatgtttgtttcaagacaaactatttcaaattgggaaaatgataaaagttatccggatattcataatttacttattatgtgtcaactcttcaaggtatctctagacgaactagtggaggatgatttgaaaaacgtgcaaatcaaaaatattaaaaaagaattagacttttggacatggatgatgataattacaatggtattaggaagtgttctcataggtcctatgattcattactttcattggttaggaataggaataacatatttagtatttttaataggtatcattgcttctacaaaattagaaaaaattaaaataaaaaatgatattgaaacatacgacaggatattagcatttattaatggtaaagatcctaaagaggtgcaaaaaagtaagtttagagatatatggacatcctcaatttcttttattttctttgttggtgtgatcatcggtataagttacttaagtatcattttaactgattattttttataa

SEQ ID NO: 1771 - DNA, 675 bp, Staphylococcus epidermidis
tatgtaataatgaattgtaaaacgacatcgaggaggtttcttatggacggtttaattacatttatcattatcacattattgattattatagtacctgggccagatttcattattgtaatgaaaaacactattaattcaagtaaaatgaatggttttatggctgcatttggtattactacggggcatattttatactcttcattagctatttttggaattatatacatacttacgagtttacactttgtttttttaacaataaaaatattgggtgcttgttatcttatttatctcggaatcaaaagtattttgagtgcgcacagttctgttgattttagtaaacaagctttagctgatgtcagaaatgtgagttatatcacttcttttagacaaggttttttaagtacaagtcttaaccctaaggctttattattttatgttagtatattcccgcagttcctttctaacggtaatatacatatgaaatctgaagttgcgttatttgctttttcagttgttgtagttatatgcttatggtttttattttgtgtattcatctttcaatatattaaattattattcagcagaccgagattcaaggctatatttgattatattgtagggtttgttttaattggcttatctattaatttattattaagtaaaagtagctaa

SEQ ID NO: 1772 - DNA, 600 bp, Staphylococcus epidermidis
ggagacagaatggaaatttatttagtgaggcatggtgagtcacagtccaattatgataataaacacgggtatctatatttttgtggacagttagacgtccctttgacggaaaggggtataaaaagcgctaaagaactatctgtttattttaaaaataaatacattgacaatgtatatgtatcagatttaaaaagaacaaggcaaacgtatgaggagctatttccttatgatattccaacaatatatacaaagacgttaagagagcgttcgttaggtgtttttgaaggtaaaaataaagaagaagtttgtaaagacaaacggttcgaaaaatatttccgtgatcctaattataaatactttagacatagcttttcgcaaaaagcaccacaaggagaaagttatcaagatgtctatgatagagtggttactttcattgaaaatgagcttaatcaacagcagagacgtgtagtgatagttgcgcaccaagttgtaattagatgttttttcgtctattttaaaatgataactaaggaaaaagccttaacgacggaaattcataattgctatccatatttaattaaagaagaaatgaagttttga

SEQ ID NO: 1773 - DNA, 1413 bp, Staphylococcus epidermidis
cgaccttggattacgattgaaaagaagatgaaaataagggatgaaaatatgaatttcgttaaatcaaaaactgacttatttagactcatagacaatgaagctcaaacatcgacatctaaggtggttttattcttaatattaggaactatatttttagatgcatatgatattactattttaggtacaatgactgatcaactcactcaacagtttcatttatcaccagcaacgctatctatagtaatgacctctttacctattggtgcattatttggtgcattacttggtggtacattagcatatcagtttggacgcaagcgtattttatcaattgccttactaacacttactgtaacctctcttggtgcggcactcgcaccaaatgtaattattctaataatatgtcgttgtataatggggtttgctattggaatggatagtccagttgctttcacttttattgcggaaataagtaatttaaagcacaaaggaagaaatgttaactattggcaagtcgtttggtatgttgcaatagttacttctgctttagtggtcactgcgttctttatgctaggggctggtgcacatttgtggagatatgcagttggatttggtgcacttattgcttttgtcttgtacatcttgcgaattaaatatttacacgaaagtccgacatgggtgattaatcattattctttagaaaaagcaactgaatttataagaaaatattatcataaagacatccacctagagggaacgcttgaagatgatttaaattctgatgtgacttcgccacataattcttggacagacttatttaaaccgagatatataaaaagaattatcctagcgactgcgatttcaacattacaaggtatgcagtactatggtgtcggtttatacatacctattattgcaacttatcttattagtaaggataaaataggtgtattattaggtactgctatagtcaatatagcaggtattctaggcgcatatttaggtgctcaattgacttataaattaggtacacgcaagcttacaatgataggcttcacacttgtattactttcaatggtatgtgtaggactcttttatcatcatctaccaatgcttcttaacactttccttattggattatttttatttggccattcaggaggtcctggtactcaaggaaaaacaattggtgccttatcattcccgactcatttacgttcacaagctactggctttgtagaatctgtaagtcgtactggtagtatcataggtacttttgtctttccaatcattcttgctgcagtaggtctaacgaatactatgttaatcttgtccattgtccctttactcggaattatcataacagtatctataaaatgggaagctgtcggtaagcatattgaagtagaataa

SEQ ID NO: 1774 - DNA, 207 bp, Staphylococcus epidermidis
aggacggtttttattatgaaattcaaagaattaatcaaacaatcatatgaggatttaaaaaacttaacagttaattggtttaacgtactcagtttaactgtaatcatatttattttaagtaacattgtcacaccgcttattggtatatctgtgggtttactcggtggtgcatatatcctaaagagacgtgaagagaaaaataaataa

SEQ ID NO: 1775 - DNA, 1476 bp, Staphylococcus epidermidis
atcaacaacttgaatttcttcttaaccccctttattcttattacatatgtcggaatactaaaaattaaaaaggagctatatatcgatatggaaatactttttacagtaattaatgtcatcgtgttacttgttttcctagtaatgttaaatattatggcaagaaaacacgtctcattccctaaacgtgtctttaccgctttagcaataggtatcgtatttggcattgtattacacctcatatatggtgcagagtctaaaactctcgaacaatcaacagactggtttagtattgttggagatggttatgttgcactattacaaatgattgtcatgccactaatattcatttcaattgttgccgcttttagcaaaatacaaattggtgaaaaattcgctaagatcggttcttatatttttatgtttttaattggtactgtagccattgcagctatcgttggaattttttacgctttgatctttggtttagatgcatcgtctattgatttaggtagtgcagaacattcacgtggtacagaaatttcaaaacaagccaaagatttaactgcaaacactttaccacaacaaattctcgaagtattcccaagcaatccatttttagatttcacaggacaacgtacaacttcgacaattgcagttgttatttttgcaacgtttgtgggctttgcttatcttagagttgcaagaaaacagccggaacatggaagcttacttaaacgtggtatagaagcaatctattctatcgttatggctatcgtaacttttgttttgcgattaacgccttatggcattttagctattatggcttctactcttgcgacaagtgatttttctgcaatttggacgttaggtaaattcttaattgcttcatacgcagctctaatcacaatgtatattatccatttaattatactgagtgtcttaggtatcaatcccgttaaatacgtgaaaaagacaatagaagtactaatctttgcatttacttcacgttcaagtgcaggtgcattaccattaaatgttcaaacgcaaacaaaacgtttaggtgtacctgagggaattgcaaacttctctgcaacttttggtttatccatagggcaaaatggctgtgcaggaatctatcctgctatgctagcagttatggtggcaccagtagcaaatgtagaaattgacttccaatttgttgttacacttattgctgttgttattataagttcatttggcgttgcaggtgtaggtggcggggcaacattcgcatcaatactcgtattatctacacttaatctaccagttgctctcgcaggggtactgatatctatcgaacctctcatcgatatgggtcgtacagcacttaacgttaatgactcaatgctagctggaacaggtaccgcacgcttaacgaatcattgggacaaaaaaacatttgactcaaatgattacggcgatttatctgcaaattaa

SEQ ID NO: 1776 - DNA, 258 bp, Staphylococcus epidermidis
aaccccttagtgcatattttcaatgacatacgtactaaggggttttttaatgcttattctacttcaatatgcttaccgacagcttcccattttatagatactgttatgataattccgagtaaagggacaatggacaagattaacatagtattcgttagacctactgcagcaagaatgattggaaagacaaaagtacctatgatactaccagtacgacttacagattctacaaagccagtagcttgtgaacgtaaatga

SEQ ID NO: 1777 - DNA, 510 bp, Staphylococcus epidermidis
tgggtatttttagtaataccatcgatatatgaaaggagtaatatgatgagtaatatcacagtttataatgtcattgaattgggcgtaaacaatcttttagccgattatgacaattggaatgttgaagaagtattagataaagaaactcaacatttcccaaacactttacattggcaatatggtcatgtattaacaatctttgaacaagcattatcattaggcaatcaacatgtagtagatgttgaaaaatataataaattgtttggatatggttcaaatcctagagactggaagggacaagatgtacctgctatcaacgaaatcaaacaacacattcaaacattaccagaacgtgctaaaaaattaacacacgagcagttagctcaaaaattagaccaacctatcgcaggttgtaacacacttgatgaattattaatgttaaatgctatccatgtgccattacacaccggtaaaattgaagaaatgacacgtgtacttcgtgaaaaataa

SEQ ID NO: 1778 - DNA, 1893 bp, Staphylococcus epidermidis
gtggtgtcagtcatgacatttaaccaacttatccttaaaaatttaagaaaaaatattaagcattatggaatgtttctattttcattattgattagcattatactttattttagtttctcaactttaaaatattcaaatagtattaataactcagattcttcaactattattaaaaatggtgctacaattggtgccacaattctttttatcattattgttgttttcttaatgtatgcaaatcatttatttattaaaaggcgtacaaaagagtttgccttataccaactgataggtttaacacgtggaaatattctaagaatgctcaatatagaacaactagtattttttattgtaacgggaattttaggcactttaattggtatttttggttcaaaacttttacttgttatcgcttctaaattaatgaagttaaacacacatatctctattggctttgaaccccaagctatacttattactatcgtaatgttagctgtcgcttttttattgataatgatacaaaattacattttcttaaaaaaacacagcattttagctttgatgaaagacaattataccccggaagctacccaaaaacggataactacgtttgaagcaatcggcggcattttaggaattataatgatagtatttggatattatatgtctactgaaatgtttggtgtttttaaagccttaacaactgctttgattacaccttttagcatactttttttaactattgttggtgctttcttattctttagaagttctgtatcacttatttttaaaacactaaaacatatcaaacatggtcgtgtaaatatcacagacgttgtctttacatcatctatcatgcacagaatgaagaaaaatgcgatgtctctcacagttattgctatcatttcagctttcacggttagtattctttgcttcgcggcaattacacaatctaatactaatacaactttagaaatgacttctccagatgattttaatataagccagaataaaatagctgcgcaatttaaacataaactagatcaagaaaatttaaaatatcatcagcggacttatgaagtaatcaatccaaaaacattaagcgaccacgtcatgaagagtaaaaatggttctgatatgtctactaatacaacatcactaatgatgaactcacatctcaaaggtcatgaagctaaaataacgaatatacaatcatcaacaggattaatagatattcatttaaatcataagattacagttaaaggaaaatctaaacaatctattatcgttaaagacaaagataactctaaaatatatccatcccaattatcatttggagctcctatagttgaggtgagtccggaggtatataacacattaaaaactgacaatattgttaataagatgtacggttttaatttcaacactcacaaagatgtgaaaaaagcagaaaaaattgcctcaaaagttaatcgtaatattgtatcgcacgatgaatataagaaatttataaaccaaagcaatggcatacttatctttgtaacatcattcttaggaatagcatttttaatggctgctggttgtattatttacattaaacaaatggatgaaactgaggatgaacttgataactttaagatattacgtcgtataggatttacctacactgatatgtctaaaggtttactattaaaaattgcatttaattttggattaccgcttctcattgctttattacatgcattatttgcagcacttgcatttatgaaacttctaggaaatgtctcaatgtcacctatattcatagtaatgattatatatacaattgtttatttcatttttgctatgatttcatttatacactcgagtcgtatgattaagcattctatttag

SEQ ID NO: 1779 - DNA, 213 bp, Staphylococcus epidermidis
gaggttagggtattgagcttttatcgttttatgaagaattttgaaggtgaaaaaagtcattttggagatttgtttgaaggtatgaaagatattaattttcctgaaaacattacgactccaagggaaattatggaaaagttccaacattggttacaagaacctagtttacacgatacgatacaagatgcgattaagcagtatcaaaataaataa

SEQ ID NO: 1780 - DNA, 816 bp, Staphylococcus epidermidis
tataaattttcagataatttaggggaggggtacaatatgacactaacaaataaagaagttgctaaagttttatttaaagcttatagatataaaaaacccatcgatttcattagtgagaactatcaattaaacgaagaagaagcatatcatgtacaagaagaactaattgaccaattaactttcaaagaccgttcgactgttacagggtataaagttagtatgactagcaaggcaacgcaagcaattgctaacactaacgaacctgcatatggaacactcttatctaaccaaattgttaatgatggtgcctcagtctctctttcagaattattttcaccattactagaaccagaaattatctttatagtgcaggaagacttaccttatgatgctgatttagaaacaattagatatcatacccgtatcgcgccaggcattgaaattccagatgcaagatataaaaattggtttccaaattttactttatcagatttaatatcagataataccgcaacaggacttgtcgtagtaggtgaccctgtagacggacttgataacgatgcatttgctaatgtacatttaaatttatataaagatgataaatgcattgccacaggagaatcatccgaagtactcggaaatcctttaaacgctattcattggctaattaaaaaactacacacgcacggtaaacaacttaaaaaaggagatatcatttcatctggaacttttatatctccactaaaattagaatatggcacgtaccgtgctgaatatagtggtatcggtaaggtatcattttcggttaataaataa

SEQ ID NO: 1781 - DNA, 1851 bp, Staphylococcus epidermidis
aggaggctttcaatgagtcatttactgaaccaattaaagagcaacgttttagtagctgatggcgctattggaacaatattctactcggaaggtcttgatacttgtccggaagcatacaatcttactcatccagataaggtcgagcggattcatcgttcttatatcgaagctggtgcagacgtcattcaaacgaatacgtatggtgctaactttgaaaaattaaagtcctttggtcttgaacataaagttaaagaaattcaccaagctgcagttcaaattgctaaacgtgcagcaaatgaggacacaattatacttggaacggtaggtggattcagaggcgtccggcaagaggatatcagtctttcaacaattcaatatcatacagaacttcaaatcgatacattaattgatgaaggtgtagatgcccttctatttgaaacttattacgatttagatgaattaactcgcatcgtcactgctacacgacaaaaatacgatattccaatcatcgctcaactcaccgcttcaaatacgaattacttagttgatggcactgaaattaatgccgcattgaaatacgtagttgaatgtggcgccaatgtagttggattaaattgtcaccatggcccacaccatatgcaacgatcattttcacatatagaacttcctaaacatgcgtatttatcgtgttatccaaacgctagtttattagatatcgagaatagtgaattcaaatatagtgataatgctcaatatttcggagatatagctcaagaattaattaatgagggagtcagattgataggtggttgttgtggtacaacacctgaacatattcgctatattaaatcagcagttaaacatttaaaacccgttaaagataaaaaggtaatccctattaataaagcttcatctcaaaagcaaacgcgagttcttaaacaaaaccttacttctaaagttaaaaatggcccaacagtcatcgtagaacttgatacacctaaacatttggatactgatacatttttcgataatgtaggcaaattagatgaagctggcatagatgctgttacattggcggataattcattagctaccgtaagagtaagtaacatcgcagcggcaagtttaattaaacaacgctacgatattgagcctcttgtacatgtgacatgtcgtgaccgtaatttaataggattacagtctcatctcctaggtttatcactcattggtgtcaatgaaatactagctattaccggagatccttctaaagtaggccatttgcctggagctacaaatgtctatgacgtgaactcaaaaggccttacagaacttgcactaagatttaacaaaggtattaacactgacggcgatgcgctgaaaaaacatactaactttaacatcgctggtgcgtttgatcctaacgtacgaaaattagatggagccattaaacgacttgaaaagaaagtagcaagtggcatgagttatttcataactcaacccgtttatagtaaagaaaaaattattcaagtatatgaagaaacaaaacatttaaatacacctttcttcataggtatcatgccaatcgcaagttataacaacgcacttttcttacataatgaagtgcctggcatcaaaatgtcagacgatgtacttaaccaattcaaagctgttaaagatgataaagaaaagactaaagaattaagtttaagactttccaaagaactcattgatacagtacatgaatacttcaacggtctgtacattattacacctttccaaaaggtagattattcattggaactcgcagcatactctaaatcaatcactgccaacaaggaggcaatattatga

SEQ ID NO: 1782 - DNA, 237 bp, Staphylococcus epidermidis
ggtaagtcttcctgcactataaagataatttctggttctagtaatggtgaaaataattctgaaagagagactgaggcaccatcattaacaatttggttagataagagtgttccatatgcaggttcgttagtgttagcaattgcttgcgttgccttgctagtcatactaactttataccctgtaacagtcgaacggtctttgaaagttaattggtcaattagttcttcttgtacatga

SEQ ID NO: 1783 - DNA, 654 bp, Staphylococcus epidermidis
aggaggtatcctcgtgagatgaataaacttatagacttttctaaaggattagtaccagtaattttgcaacatgcacaaacggatagcgtattaatgttgggatatatgaatgaagaagcttatcaaaaaactctgaaagaaaagaaagtaaccttcttctctagatctaaacaacgtttgtggactaaaggtgaaacttctggtcatttccaacacgttgagagtattcatctagattgtgatcaagatgcgatcttaatcaaagtgatgccacaaggtcctacatgtcacactggaagtctgagttgttttaatagtgaaattgaatcacgttttaaaattcaagctttagcacaaacgattcatcaaagtgctaaagccaatcaatctaactcttacactcaatatttgttaaaggaaggcatcgagaaaatatccaagaaatttggtgaagaggcatttgaagttgtgataggtgcgataaaacataatcgtgaagaagttattaatgaaacagcagatgtcatgtatcacctttttgtgttactacatagtttagatattccattttcagaagtagaacaggtactagcgcatcgccatcaaaaaagaaataattttaaaggcgagcgcaaagaggttcgagaatggtaa

SEQ ID NO: 1784 - DNA, 621 bp, Staphylococcus epidermidis
aacgccatgttacgagttgcattagcaaagggtcgtttattaaagagttttatcgaatatttacaacaagttaatcagatagatattgcaactgtacttttaaatagacagcgacagttattgcttacagtcgacaacattgaaatgattttagttaaaggaagcgatgtgcctacttatgtagaacaaggtattgctgatgtaggaatagtgggaagtgatattctgaatggtcaaaaatataatattaataaattactcgatttgccatttggtaaatgtcattttgcgttggcggcaaagccagaaacatctcgctataaaaaagtagcaacaagctatgtacatacagctactcaattctttaataaagaaggtatggatgtagaagtgattcaccttaacggttcagttgaattgtcatgtgtagtggatatggttgatgctattgtagatattgtacaaactggttctacgcttacagctaacgggctcgttgagaaaaagcatatcagtgaaattaacgctaagttaattacaaataaagaatcatattttaagcaatcatctgaaatagagagactaatcaagcagttaggagtgtctattaactatgcttag

SEQ ID NO: 1785 - DNA, 1308 bp, Staphylococcus epidermidis
aaaaggctaacgcataggaggtgtatcacaatgagtgaaaatattattatgccaaagcttggaatgacaatgaaagagggaactgttgaagagtggtttaaatcagagggtgacaccgtaaaacaaggagagagtattgttacaataagctctgaaaaattaaccaacgatgttgaagcgccggcgagtgggacattgttagaaattaaagtgcaagccggagaagatgcagaggttaaagcggtattaggtataattggagaagaaggggaagctattgataaagatgaagatgatttagcatcagaaaaagtaaaagaagacaacgagcatgagaaggaaacgcaagaagttaaagatacatcacaaccgtcttccgataataaagataattcgcctaaaagcgcagcacgagaaagaatctttatctcacccctcgcacgtaatatggctgaggataaaggattagacattaacaagataaaaggcacaggcggtaatcatcgtattacaaaactagatattcaacgtgttgaagcaaatgggtacgactatgctagtgatacgacatctaatgaagatacaagtcatgttccaacacagactgtggatacaagtgcgattggtgaaggattgaatcctatgcgtcaacgtattgctcaaaacatgagacaaagtcttaatagtactgctcaattaacattacatcgtaaggttgatgcggatcgcttgctagatttcaaagacagattagctacggaacttaaacaagcagatcaagatgttaaattaactgttactacattattagctaaagcagtagtgcttgcacttaaagaatatggggcaatgaatgctcgctatgaacaaggcgagttaactgagtatgaagatgttcatttaggaatcgcaacgtctctagatgaaggccttatggtgccagtgattaatcatgcagatacaaaaagtatcggcactttagcccatgaaattaaatcatcggctgaggctgttcgggaaggaaacacaggagcagtacaattagagggagcaacatttacaattactaatatgggtgctagtggtatagaatactttacaccaattttaaatttaggtgaaacaggtattctaggcgttggtgctttaactaaagaagtcgtgctagaagcggataacattaaacaagtttcaaaaattcctttaagcttgacatttgatcatcaaattttagatggtgcaggtgcggccgattttcttaaagtactagctaaatatatcgaaaacccttatttattaatgttatag

SEQ ID NO: 1786 - DNA, 537 bp, Staphylococcus epidermidis
atgttagaaacacatagattaaagctagtgaagcctaatttgagttatacagatgaactttatcaattgcatacaaataaggtagctacaaagtatacacctaaaggtattcatcagaataaagtagcaacccaagattttattaaaggatggatgaggcattgggatgaatatcaatttggttacttcattttaattatgagagataatcacgaagtagtggggatagcgggatttgagtatcgtacaattcatcaacaacagtttcttaatgcgtattatagaatctttccatcgtatactggtgttggtttagcttttgagtcaatggaggagattgcccgtcatttaaaaaagcatgataccataacaccaaaattaattcgaacaaatcaatataatacaaattctattaaattagcacaaaaactcggatataattatgatgctaactgggacgatgtaattaataaaggagatcgttgttttttaacctacaagcgttggataataactaaaagcatgatgaattcgtag

SEQ ID NO: 1787 - DNA, 183 bp, Staphylococcus epidermidis
aatacaagaacacatattataaatgcctgggacacattaaatgtctcaggcatatttatttatggcaatcgttgcattaatagaaaatacaatgagttgtatcaaattttcaaattaagctatacgagtgaggaacataaagttttattcaacctttgttctacttcttttatttatacataa

SEQ ID NO: 1788 - DNA, 993 bp, Staphylococcus epidermidis
ctaaaattgactaaagaggagcacagatttatggattatagagtactactttattataaatatgtaactatagatgaccctgaaacttttgcagccgaacatttgaaattttgtaaggaacatcatttaaaaggaagaatactagtttcaacggaaggcattaatggaacattatctggaacaaaagaagatactgataaatatatagagcatatgcatgcagatagtcgttttgctgatttaacttttaaaattgatgaagctgaaagtcatgcgtttaaaaagatgcacgtgcgtccaagacgtgaaattgttgcacttgacttagaagaagatattaatccacgtgaaattaccggtaaatactattctcctaaagaatttaaagccgcactagaagatgaaaatactgttatattagatgctcgaaatgattatgaatacgatttaggacatttccgtggagctattcgtcctgatataacacgattccgtgacttacctgaatgggtgcgtaataataaagaacaactcgacggaaaaaatattgtcacatattgtacaggtggcattcgttgtgaaaaattttctggttggttagtaaaagaaggatttgaaaacgtaggtcagttgcatggtggtattgctacatacggtaaagaccctgaaactaaagggctatattgggatggtaagatgtatgtatttgatgaacgttttagtgtcgatgtgaatcaaattgataaaacagtcatcggcaaagagcattttgatggtacaccttgtgaacgttatattaattgtgcaaaccctgaatgtaataaacaaattcttgtttctgaagaaaatgaagaaaaatatttaggtgcatgttcgtatgattgtgcaaaacatgagcgcaatcgctacgttgcccgtcatcatattagcaatgaagaatggcaacgtcgtttaaataatttcaaagatgtgcctgaacacacacatgcataa

SEQ ID NO: 1789 - DNA, 966 bp, Staphylococcus epidermidis
gaggaattgacaatgaaaatggaaaaagaacaagcacattggatttataaaacgatgaacgaaattcgattttttgaagaaaaggtacacaaaatttttagtgatggtagaattccaggattcgtacacttatatgtaggtgaagaagctgttgcaacaggtgttatgtctcaattaaatgatgatgactatattacaagtacacaccgtggtcatggtcatgcgattgcaaaaggatgcgatttaaatggtatgatggcagaaattatgggtaaacgtgacggattaggtcacggtaaaggtggctcaatgcatgttgcagaaattgacaaaggaatgctcggtgcgaatggtattgtcagtggtggttttgggttagcaattggtgcaagtatttctatcattaatcaaggtaaagataatgttgccgtatgtttctttggtgatggtgctgcaaatgaatgtaatttccatgaaggtcttaattttgcttcaattttagatttacctgttctttttatatgtgaaaataaccaatttgctgaaggaacaacacatgactacgcaagtgcttctgaaacaattgcagagcgtgctgcggcttataatatgccgggtgtacgtgttgatggcatggatgttatggaagtatataaagcaacacaagaggctgtagaacgcgctaaaaaaggtgaaggaccaacgttaattgaatgtgatacgtatcgtaaatatggacattttgaaggtgatgagcaaaaagtaaaatcaccagatgatcgtaacgcagataaaaatgcgacagtagaatttagaaaaagagcaattgaagaaaattggctcactgaaaaagaagcagatgaaatagaaaaagcagctgaacaagctgtagaagatgctgtgaaatttgctgaagaaagcgaattaccagatgaggattcattatacaaggatgtttttgcttaa

SEQ ID NO: 1790 - DNA, 597 bp, Staphylococcus epidermidis
agaaatggagcgtatgttatgaactatcaaatcaaaagaaacactgaagaaactcagcttaatatttcactggctaataacggaacacaatctcatattaatactggtgtaggatttttagatcatatgttaacgctatttacttttcatagtggattaactttatctattgaggccactggagatacgtatgttgatgatcatcatataactgaagatataggtatagttattggacaattacttcttgaattaataaagactcaacaaagttttacaagatatggttgctcatatgtacccatggatgaggcgcttgctcgaacagtagtggacattagtggtcgtccatatttctcatttaatagcaagttgagcgctcaaaaggtaggaacttttgacactgaactagttgaagaattttttagagcattgataattaatgcgcgattaaccgttcacattgacttattaagaggtggaaatacacatcatgagattgaggcaatatttaaatcttttgcaagagcattaaagatttctcttgcacaaaatgaagatggacgtattccatcgtctaaaggagtaattgaatga

SEQ ID NO: 1791 - DNA, 237 bp, Staphylococcus epidermidis
ctttattctcattttataaaaatttatattaaatgtcattatagctacacgactacacttttattcatatatgaaaaccaccacatcttatatcggtcaaatgacggatttataggctatcttattgaaagcaattctcattttgatacaatattaaaatgtctaatttttaaacttcaatcactatcatttttttatataaattcaaatacttttaaattaactaaaattgactaa

SEQ ID NO: 1792 - DNA, 1542 bp, Staphylococcus epidermidis
ttatttttgcacgaattcttaaaccaaagaaaggtgagcaaaaaaatggctaataaagagtcaaaaaatgttgttattattggcgctggtgtcttaagtacgacatttggttctatgattaaagaattagaacctgattggaacatcaaactctatgaacgcttagatcgtccaggtattgaaagttctaacgaaagaaacaatgccggtacaggacatgcggcgttatgtgaattgaactatacagtacaacaacctgatggttcaattgatatagaaaaagccaaagaaatcaacgaacaattcgagatttcaaaacaattctggggtcacttagtaaaaagtggtaacatcagtaaccctagagatttcattaatccacttcctcacattagtttcgtaagaggtaaaaataacgttaaattcttaaaaaaccgttacgaagcaatgcgtaacttccctatgttcgataacatcgaatatacagaagatatcgaagaaatgagaaaatggatgccattaatgatgacaggtcgtactggtaacgaaatcatggcggctagtaaaatcgacgaaggtacagatgttaactacggtgaattaactcgtaaaatggcaaaaagtattgaaaaacatccaaatgctgatgttcaatacaaccacgaagtaattaatttcaatcgtcgtaaagacggtatttgggaagttaaagttaaaaaccgtaattctggagacgttgaaactgttctagctgattatgtatttatcggtgcaggcggtggcgctattccactattacaaaaaactggtatcccagaaagtaaacatcttggtggattccctatcagtggtcagttcttaatttgtacaaaccctgatgtaattaatgaacatgacgtcaaagtatatggtaaagaaccaccaggcacacctccaatgactgtaccacatttagatacacgttatatcgatggtgaaagaacattattatttggaccatttgcaaatattggccctaaattcttaagaaacggttctaacttagacttattcaaatcagttaaaccttataacatcacaacattactagcatctgcagttaaaaacttacctttaatcaaatactctatcgaccaagtattaatgactaaagaaggttgtatgaaccatctacgcacgttctaccctgaagctcgtgacgaagattggcaattatacactgcaggtaaacgtgttcaagttatcaaagatactaaagaacacggtaaaggattcattcaatttggtacagaagttgttaactctaaagaccactctgttatcgcactattgggtgaatcacctggagcatcaacttcagtatcagtagccctagaagttttagagaaaaactttgctgagtatgaaaaagattggactccaaaattacaaaaaatgatcccatcatatggtaaatctcttatcgatgatgttaagttaatgagagcaactcgtaaacaaacatctaaagatttagaattaaattattacgaatctaaataa

SEQ ID NO: 1793 - DNA, 495 bp, Staphylococcus epidermidis
tcccaatgcaaattacttatatttgtcagtaaccttcctcctcaggtcgtccatcatttcaattttaaattgaggagggacttatctatgaaattatctatttttcatgatggtcaattttttgtaggtgtcgttgaataccaaaaaggcttcattcataaatatctaaaagttacatttggcaatgaacctagcgatgaaacagtgttacgattcataacttttaaacttattcctttattaaatcaaacacacggtaagaagaaacctattcaaaagcataaaaagattaatccaaaacgtttacaacgtaaaatcgctaaagaacaaaaagagaccaatttaactacatttgctcaacaagcgattaaagaagaacaagagttgaataagctaaagagtaaaaaacttcagcgattagaaaaagaacgacacagacaatacaaaagaatgttaaaaagaaaaaaagcacatgaaaagcacaaaggtcactaa

SEQ ID NO: 1794 - DNA, 627 bp, Staphylococcus epidermidis
aaagccgtaaatttaatgagagcaaaaaaattgataagtcatcttactgtatctagaataacaagtacaagaaacgtaattattgtaataaagagagaaggggttataataatgacaaaatttaactttgatcaagttcacagtgatattcagtttaaaattaaacatcttatggtgtcccaagtaaaaggaacatttaagcaattcgatgttcaattagatggagatattaatgatttaacttcactaaaagcaacagctactattattccaagttcaattgacactcaaaatgaggacagagacaaccatttaagatcaaacgatttctttggtacagaagacaacgataaaatgacatttgtaactaaagaaattaacgaaaatcaagtagttggagatttgacaattaaaggtgaaactcatgaagagacatttgatgttgaatttaatggtgtaagtaaaaatccaatgaatggacaacaagtcactggttttatcgttagtggaacaattaaccgcgaaaaatatggtattaattttaaccaagctttagaaactggtggcgtgatgttaggtaaaaacgtaaaatttgaagcatcagcagaatttagcatcgacaattaa

SEQ ID NO: 1795 - DNA, 519 bp, Staphylococcus epidermidis
tacattatgaaaaggtttgcaaaagcatttgtcgtaagtggtattactttaggtgcagttttaggtttaaacgtaacagagcataatggtgtatctaatgaagcaaaggcacaaacagcacacagttactggtataaatataatggttatactgcatcgggtggcgactttgtacttagcaattcattttatcaaggtttaaaagctggaaacgttacatttaatggtattaaggtaaatcaaaaatatgaatctaagactgctactaaaaaaatatacgatcagacatttcaacaaattaatggaaataaagcaaacaacgtacaatttaaaattgcttccagaactgttactttagatcaagttaaacaaaagtatggaaaaaattataattatcagccgtcattatctaaaaacaaaacaagtaagacagatggcttgtacggttatcaagtcggaaaaggaaacatcgttttccacgttaaagatgggtatgtcacaagtgctacattgtcataa

SEQ ID NO: 1796 - DNA, 1617 bp, Staphylococcus epidermidis
aaagggatgaataaaaatattaaaatgaaaaacaaacgaaaaataaacaatacgcttgtttatactatctctgttttaattattgttgttattactcttattgcgggtatctttcctaaagcatttgggatgtatgcgcagagcgtttatgattggattacaaattggtttggttggctattccttatcattgtctttattttagatgtatttttaatattcttagctttttctagatatggtcgatttaaacttggttcggatgaagaagaaccagaattttccatgctatcttggattggcatgttattttcagcaggtcttggcgtcggtatagtcttttggggtgttgcagaacctttaacgcattatctccattcacccttccctggaaaaattgcagatcactctgaagaatcagcacgtgttgcgatgggatatacattcttccattggggtatttcacaatggtcaatatttgcaatttcaggattaatcgttgcatactttcaatttagaaaacaacgtaacgggcttatttcaacagctatggaacccgtttttggtgaagcttataaacgtcctttcaggaatattattgatatattagctattatcgcaaccgtcatgggaattgctacgtcgattggtttgggaattatgcaaatcggtggtggattaaaccatctctttgatgttcctaataataatttcactaaaatcttaattactattttgatggtagccatatttttaggatcttcattaactggcttaaatcacggtgtaaaatggttaagtaatttaaatattttattaggtgctattttacttatatttattttgatttttggagatttaaaatttattttagaatcatacacactagcaatttctgattatttgcagcattttatagaatatagtttacgcgtaaatccatactcaggagatgatagttggattcaacagtggactgttttctattgggcttgggttatttcttggtccccttttattgggggctttgtagcaagagtatctcgaggacgtacaattagagaatttgtcgtaggtgtactcattattcctcctctaatttcgtttacatggattgcaggttttggaggtacagctattaaacttgctttaaatcataacgacaagcttgttcatattgtagataaagattatactgttgccttgtttgaattattatcacattttccattgtcggaagtcactagttccttagctattgtacttattttcatctttattgtaacaagtgctgattcaactacgcatattgttgcaggtatggctacaggtggttctatcaatccaactttaaaacataaagtcctatggggtctacttattggggcgatttcagttgctatgacaattgcaggtggtcttaaaagtttacaaactgcatcagttattacaggtctaccattctctatcattttattattaatgatattctcactcatgagggctttaaaaagagaacccatccatcattttaaaatgacatcaattgatgatgaaaaagattactctatttcattagaagagcgtgaaaaacaggacgaacaagataacaagtaa

SEQ ID NO: 1797 - DNA, 213 bp, Staphylococcus epidermidis
ttcgctaagaaagaatataaaaaatcctccaacgaagttggctcgacttcgttggaggtatcaggggtaggggttaattttgtttctaaatttatttactctaatttaatattaattaaggttttgagtatagggagaaatattttatacttatttattttctcttcatcatttttatattttacagggaaagtattttatttagattcgtaa

SEQ ID NO: 1798 - DNA, 972 bp, Staphylococcus epidermidis
  unsure (124): Identity of nucleotide at the above locations are unknown.
ggcacgactgaatatcgtggctcactaggttcacttaatcaactaatgattacaattggtattttagcaccatatttagtcaactatgcatttgcggatattgagggttggcgttggatgctangattagcagttgttccatcggttattttacttgtgggtatttattttatgcctgagagtccaagatggttacttgaaaatagaaacgaagaagccgctcgtcaagtgatgaagattacttatgacgatagcgaaattgataaagaacttaaagagatgaaagaaattaacgctatctctgaatctacatggacagtcattaaatcaccatggttaggtagaatattaattgtaggttgtatatttgctattttccagcaatttattggtatcaatgcagtcattttctattcatcttcaatctttgctaaggctggactgggtgaagcggcgtctatattaggttcagttggtataggaactattaatgttcttgtaacaatagttgccatttttgtagtagataagattgatcgtaaaaaattacttgttggtggtaatattggtatgattgcctcattattaattatggcaatcttaatttggacaattggaattgcttcatcagcgtggattattattgtttgtttatcattatttattgtattctttgggatttcttggggacctgttctatgggttatgctacctgaattattcccaatgcgcgcacgtggcgctgctacgggcatttcagcgcttgtgctaaatatcggaacgcttatcgtgtcattgttcttcccaatattaagtgatgcattaagtacagaatgggtatttttaatctttgcgttcataggtgttttagcgatgattttcgtaattaaattcttaccagaaacacgcggacgtagtttagaagaaatagaatatgaattacgtgaacgtacaggggcaagaactgaataa

SEQ ID NO: 1799 - DNA, 306 bp, Staphylococcus epidermidis
ataccgagtgaggttaaactcaaaaagttcctaaaaatcattcaaaaaacaattcattacatcaatcatcatttagaaagtgcaattgaaatttactcaacgtatactcaaaccgatatctctaaccaattaaacaaagatacaattgaagcaacagctaaatgttttacaaatgatttgtctatgagttccgactactacaatgatttacagttgtggcttaaagaagtcaatgatattaaagacacgattaacccaactttatattttacaaatcaactactattcagtcgatatacaaaataa

SEQ ID NO: 1800 - DNA, 1437 bp, Staphylococcus epidermidis
gtaaaggaagatggtgtcgtgggaagtactgttaaatatcgtaagtttattctacctattgtcgttggtttaattatctgggcattgacgcctattaaaccagatgccttaaatgatcaagcttggtttatgtttgctatttttgtgtcaaccatcattgcttgtattacccaacctatgactataggtgcagtatcaatcattggttttacaatcatgattttggttggaattgttgatacaaaaactgccgttcaaggcttcggtaatagtagtatttggcttattgcaatggcctttttcatttcaagaggatttgtaaaaacagggctaggtcgacgtattgctctgcaattcgttaaattatttggaaagaaaacgcttggtttggcttattcacttgttggtgttgaccttatcttagctcctgctacgccaagtaatacagcacgtgctggtggtattatgtttccaatcattaagtccttgtcagagtcatttggttcatcgccgagagatggttctgagagaaaaatgggtgcgtttttaatctttactgagttccaaggtaatttaattacttcagctatgtttttaacagctatggccggtaaccctatagcgcaaagtttagctgaaaaaacggcacacgttcaaattacatggatgaattggtttgttgctgctattatacccggattgatttctctcatcgttgtccctttcattatttataaattatacccacctactgttaaagaaacgcctaacgctaaaaaatgggctactgaacaactagaagaaatgggacatatgtctatagccgaaaaattgatggttggtgtctttatcatagcattggctttgtgggtattaggaagcttcattaatgttgatgccacgctcactgcatttattgctttagcattgttactattaacaggtgtattagcgtggtcagatattttaaatgaaacaggcgcatggaatacactcgtttggttctcagttcttgtattaatggcagaacaattaaacaagttaggctttatcccatggttaagcaaactcattgctcaaggtttgaatggctttagttggcctatcgttttagttttactcatcttgttttatttctactcacattatttattcgcaagtgcaacagcacatgtcagcgccatgtacgccgcgttactcggtgttgcagtcgcttcgggtgcaccgccattattcagtgcattaatgttagggttctttggtaacttactggcatcaacaacacactatagtagtggaccagcgcctatattatacgcagctggctatgttacacaaaagcgctggtggactatgaatattgtacttggtatagtctattttattatttggattggtgtaggttcactatggatgaaactcattggtatgatgtaa

SEQ ID NO: 1801 - DNA, 792 bp, Staphylococcus epidermidis
ttagtaatggatatacaaaagtttgaatcttatttaaaaattaagcattcatattattcaaacccttctcttgaagcattgaattactatgtaagacgctttatgataactgtgccatttgaaaatattaatgtacaaaacaagattcctatctcaatcgatatcaaagatttatacaataaaattgttattcaacggcgtggcggtttttgctatgaattaaatcatttgtttgctacgtatttagaacataaaggcttccacgtcactcgtgctgcggcaacagttcacacaccaaatggtgggcgtagtcctgaaggctcgcatatgtcactttacgttaatatcgaaggaacactttatattactgatgttggatttggtgatttacctacaagtattatcgagataggttctaaaacacaattcattccaacatatgataaaaatggagtttactgtgctgtttggattaatgacaatcaatatgccttacagaagcttagacaaaataaatggatgacactctatgaagcgcatttaaaacctcaaagcattaaagactttaaagataaaataagctacaatgagcatcatcctcattctatttttgtacgacatttgcttattacacaaccacaatcgtttggacgtgcaacaatgacttatcattctttaactttaagcaatgacagtactaaacataaatatgacgttactaccaataactacaagtattttttaaaaaaatattttaatttaaatgtatcaatcatcccatttgaaccataa

SEQ ID NO: 1802 - DNA, 450 bp, Staphylococcus epidermidis
atttatagtttacttattaataataaggagatttgcccattggacctaacaaatcaaaaaatcctacacttacttgagcaaaatagtaagctatcgctttctgaaattggaaaggaagtaaatttatctacaccctctgttcgagaacgaatctataaacttattgattcgaaaatcattgaacgatatacaatcgatattaattacgatgcattaggtttcgatattaatgttttgatagaagtaactataaaaaataacctatataaagatttcaaagcatttatttcagttcaaaacaatgttgatttttgctatagaatttctggagatagttgctttatatttaaagcgcattttaaaaagatgagcgaagtcgaaacactcatcaacgaaatccaatattatggtcatacaaaaacacattttatattttcagaaacaaaatag

SEQ ID NO: 1803 - DNA, 1062 bp, Staphylococcus epidermidis
ccacataaggaggtttttacgatgagtgaagaacgcaagttaacatttatgggggctattaatgaagctattgaccaatctatggaaaaagatgaggatgtcattttaattggtactgatgtctcaggtggtgcaaaagtagaccacatcaaagatgacgatacattcggtggtgtatttggtgtaacaaaaggacttgcaaaaaaatatagtcgtaaacgtgtaatcgatacaccaattgctgaacacattacattgagcacggcagtaggagctgctgcgacagggctacgtccaattgctgaactcatgttcaacgactttattggatttggtttagatccaattttaaatcaaggggcaaaaatgagatatatgtttggtggaaaagccaaaatcccactagttgtacgtactgttcatggagcaggggcaagcgctgctgcacaacactctcagtctttatataatatgtttgcagcaattccaggagttaaagttgttgttccatctaatccatatgatgcgaagggtctactgatgtcagctattcaagagaacaatcttgttgtcttttcagaagataaaacattattaggacaaaaaggtaatgttcctgaagaaccttatactatagaaattggtaaagccaatgtgacgcgtgaaggtgacgatttaacaattgtggctattggaaaaatggtagctgtagcggaagaaactgctgaaaaacttgcagaagaccaagtatcagttgaggtcatcgatttacgctcagtgtcaccatgggatcaagaaacagttttagattctgtgaagaaaacgggtcgcctaattgttattgacgaatctaatccacagtgtaacattgctggagacgttgcttcagtgattggagatgtaggatttgattacttagatggtccaattaagaaagtgaccgcaccagacactcctgtaccatttgcagcgaacttagaggcggcatatatgccgaatgctgataaggtattagacattgcatctgaattaattgatgatttaaaaaaggctaacgcatag

SEQ ID NO: 1804 - DNA, 363 bp, Staphylococcus epidermidis
gtagcatcactattagaatgtattgttactgcaccagccggtttaatctatgttatttacctatggcagcaacaacacataacatttggattaaatatatcatcattttggctactattttcaggtgcaattacagcaataccattgattctgttctcagcaggtgctaagcgaattccattatcgttaactggcttcattcaatatgtagggccgacaatcatgtttatcttaggtatctttgtctttaaagagccatttaacactgatcaattgattacctttatttttatatggataggtattgtgttatatagtatttctcaatatgttcaaattaagaagaacccagttgtaaaatag

SEQ ID NO: 1805 - DNA, 531 bp, Staphylococcus epidermidis
actttgagactaaaagtaaaggggagtatgaagatgaagtcttcagttcgattgttgaatcacatcataaagataatgaacttacaacaatcattaattataagagatgaacagtggaatcaatcttatgaggcatacaatttcaatattaatggctacgtatttaaaagtaggttagctaagaaaacaacaaagaaaaaaggatattttttatcgctttgggaaaaagataaaacaaagaaaaatcgagcatttgactatgagtcatttcctgggaaattaattgtacacgtgttggatgattctcaagtaggtcagtttatttttccaaaacatgtactttttcataaaggtattttaagaaatcatgcatctaaagggaaaatggcttttcgagtgtatcctacatgggagaaagatttaaatcgtgtcgctcacaagacacaagagtggcaaaaacaatactttatagatatgtctcaaacaattgatgtaccaagtattaaacgtgcttattttaatgaagattga

SEQ ID NO: 1806 - DNA, 642 bp, Staphylococcus epidermidis
ttaaatggatggaggaatttttttatggacaaattaacagtaggtttagaatggtttttaaatcctgatcatatgccgttaatcttaggtatcgaaaaaggttggtttaaagaagaatcattagaaattgagatgattgaaccaaaggaacactttgacgcactagacgagattgaaaatggttcaatggatatcgcgattactgaacctattcatctggttcaagatagagctaaagaacaaaaagtcatcgggtttgcgagatatcttcacactaatggaggtattatgtataacaaagataaaaatatcgctcgccccaaagatttaatcggtaaacggcttcaatatcccggtgctcccggtccaggtggtattgctatggctaaaacgatgattgaagctgatggtggtacatttgaagaaggtgacatcacaccagttaatcatagtttttatcatactgatgcacttttaactgataaagctgatgctgctacactcattttcgaaaattttgaaattcttgaagctagaaatcaaggacttaatgtagattattttccacttaaaaattataatgtacccgatttttgtcaactcattttcattacaacacctgaagtattaaataccgagtga

SEQ ID NO: 1807 - DNA, 660 bp, Staphylococcus epidermidis
gtctacttaaggagtgtttgcatggaaatattagtcacagcatttgaaccatttggagatgaaaaaattaattctgcactagaggctgttagccatttggaaactaaaattggctgtcataaaattgatcgattgatacttcctacagtatttcatgactctgcggatatgattgctaaagtgttaaaatctaaaaattatgatgttgctctagctatcggacaagcaggtggtcgtagtgaaatcactcctgagcgtgtaggtataaatatagatgacgcacgcattaaagataatcaaggacaccaacctattgatcaagttatacgtcacgatggcgcacctgcttatttttctaatttacctatcaaaagaatgacaatggcaattcaaaaggctggtcttcctagcagactatctaattccgctggaacatttgtatgtaatcatatcttatatcaactcggatatatggcagaccatttttaccctgacttattatttggatttatacacgtgcctttgattcctgaacaaacaatcaatcattctcaacaatcttcaatgtccgttgaagatatcgtaaaaggattaactgaagcaatcaaagctatcgacttcgttgaagataacaagatcgcattaggagaaatccaatag

SEQ ID NO: 1808 - DNA, 831 bp, Staphylococcus epidermidis
gggaggggtggcttaagtatgaacaataccatcatttcaatgaaagaaaaggaattacgttttttaaagttttttcatcaacaaaaatataatgttgtagattttaacttaattgaagaattggattggcaacgattgactcatgaagatttgcaacaaatggatgaaagaagcttttggcaacaaaataaatctatctatgcattaagaaatgattttaccgatcaattattcagatattattcgaactatccaacacattttaaaaaagtagcttatgcaggggatattatcagagataacagagttataaagcaagtcggcattgagaattacgagccacaatttgataatatcactcaaaatttcttagatttccaatattttattcaaaacgtacttcatgatgacattcaatttatcattttaggtcactatcaattgattgatgcacttttagagaaaaatcatcaaactagagaagttatggagatgatagaagaacgtaatttatcagggcttattcaaacactaactttcaatcatcccatcattcaaattcttaaagagaacacattaaatcaacttaaaatactctctcattatttaccagagcgacaccctgcaatggtggcaattcaatcttggtcacaatggtttactgatcatgggattactgaaatccaccttgatgtaactgcacaagcgcctagatcttattacaaaggtatttttataaaatgtcatcttaaaaatactgctcatagcgttttgacaggtggatattatcacggttcactagaaggttttggtttaggattaacactttaa

SEQ ID NO: 1809 - DNA, 999 bp, Staphylococcus epidermidis
ataaagagagggattcaatcgatggcaaatcaaaaattaccaacattaaaatatactggtaaatcagaaagtgcagtgccaattgtgtcagaaagtgaattgcaaacggtaacagcagagccgtgggtgaaaatttcagataaagggttacaactagaaggacttaattttaatcgcgaaggtcagttattcttattagacgtgtttgaagggaatatttttaaagttaatcccgcaacaaaagaggttacaacaaaatttcagtctgttaaagataatccggcagcgattaaagtacataaagatggtcgtttatttatctgttatctaggtgattttaagacaactggaggcatatttgcgacaacagaaaaaggtgaacaaatagaagaaattatttctgatttaaatacagaatattgtattgatgacatggtttttgacagtaaaggcggattttatttcactgattttagagggtattctacacaacctttgggcggtgtttactatgtagatccagactttaagacggttacgccaattattcaaaatatttctgtggcgaatggtattgctttaagtacggatgaaaaagtgctatgggtaactgaaactacaactaatcgacttcaccgaatcgcattagaggatgatggcgtgactattgcaccatttggagcgacaataccatattattttacaggtcatgaaggaccggattcttgttgtattgatagtaatgataatttatatgtggctatgtatggccaaggacgtgtattagttttcaataagagaggttatcctataggtcaaattttaatgccaggacgtgatgatggaaagatgttacgtacaacacatccacaatttatacctggtacaaatcaacttataatttgtactaatgatattgaaaaccattctgaaggtggatctatgctttatacagttaatggttttgctaaaggatatgagagttatcaatttcaataa

SEQ ID NO: 1810 - DNA, 777 bp, Staphylococcus epidermidis
attctgggagggattatcttgattaaaaaaagagtgattccatgtttagatgttaaagatggacgcgtcgtaaagggtatccagttccagtcattaagagatatcggtaatccagttgatttggctctttattataatgaagccggtgcagatgaactagtctttcttgatatttcgaagacggaagcaggacatgatcttatgatagaagtgatagaagcaacggcaaaacaattatttatccctttgacagtaggaggagggattcaaaatttagatgatattacacaactattaaatcacggagcagataaaatatcactcaattcaagcgctttaaaacatccagaattaattcgacaagcaagcgagaaatttggtcgtcaatgtatttgtattgctattgatagcttttatgataaagacagagaggattatttctgtactacgcacggtggtaaaaaactaactgatgtcagtgtatatgattgggtacaagaagtagagcatttaggtgctggggaattgcttataactagcatgcatcatgatggaatgaaacaaggttttgatattgaacatttagcaaaaattaaacaattagttaatattccgattatcgcctctgggggtggaggaaatgcacaacattttgttgaattatttcaacaaacagatgtttcggcaggtttagcagcaagtattttacatgatcaagaaactacagtggcagaaattaaagataaaatgcgtgaaggaggtatcctcgtgagatga

SEQ ID NO: 1811 - DNA, 771 bp, Staphylococcus epidermidis
ctgtcaatgggttggaatgagtctcattttttaatcatttatattgagggagggttaatggtgtcttcggagtataaaaaaggaatatttttagctttaggtgcttatattttatgggggattttacccatatattggcgtttaattgatgaaataggcgcttttgaaattttggcattccgtattattttttcagtgatatttatgatttttgtgctcattataggaaaaaatcaacggaacgcttttttaagagatgttaatcagttggtatcgcatcccgtgcaacttattgccatcatagttgcagggtatgttattacagtgaattgggggacatttatttgggcagtatctaatggtcacgtgctacaatctagcctaggttactacattaacccactagtgagtatcgtcttggcgcttatatttttaaaagagagatttaataaattcgaatggttagccatcatttttgcattaataggcgtactttatatgacaataaaaatcggtgaatttccatttatttcacttctgttagcattttcttttggtatttatggtttattaaaaaagattgtgcatatcgatgcgataagtagcatcactattagaatgtattgttactgcaccagccggtttaatctatgttatttacctatggcagcaacaacacataacatttggattaaatatatcatcattttggctactattttcaggtgcaattacagcaataccattgattctgttctcagcaggtgctaa

SEQ ID NO: 1812 - DNA, 591 bp, Staphylococcus epidermidis
aagtatgatattaacgagatgggtgacaaaatgtataaatatttaaaaagaaatcgattctcaacgcagacttcaattataaaaaatgacgctcagcaacctgttggtatgatatcgaaagtgtataaaaattttattcaaaaatgtattggttatttgaccttaggtttaaaattaaatcaatatgagatatgtgatgtgaataataatagtgtagcttatattaaggtatcgcgatatatggagaaaaaacattttaaagttgaatatcatgattcaaaaggtaggcagtgtgaagcgttatttgataagcaaagtaatggttatgaggagacgtatggaatattaaaaattgacggtataatattaaatattcatgctaatgagaaacatcatactactatcaaagatataaagcgagatacacaaattgcgagttggaaacaaattggtgattatgcttatgcagaagggaatgatgggctatttaaagaacatcaattactctatattcttatcatgcacgcttttgctaatacatatgtgagcaaacgtcaaacgagcttgatgttcccagggccacctgtttaa

SEQ ID NO: 1813 - DNA, 417 bp, Staphylococcus epidermidis
atggctataattaacttatctcatcgtggtgatacttcttttgacaaacttctcggacatctccctagtgttcaagaaaaatggaatgcattggaagatatattaaaaaatgaggggcaattatctgttgatttaaaagaagaaattaggaaaatactagctcaaaacagtggttgtctatactgcaaatctaaaggaaaacccaataagaaatttaccgatgaaaaatctttagtttgcataggatttgttgatgtttatgtgtcacaaaatggacgggttccacaatctacaatacaggttttaacaaagacactaactgatatagaaattgtagaattgttagcattcatatcatttacccactgtcaacaagaatttggtgccatgatgaatttacaacctagcaataactga

SEQ ID NO: 1814 - DNA, 234 bp, Staphylococcus epidermidis
aaattgataattaagaacgtagaaagatttcattataaaagaaagaattttccgaaaaatacttgtcagataacttgtaacatgttagtgtattactacatttttactttaatgtattatcgaactaaagaattcggcgtgagggaggggtggcttaagtatgaacaataccatcatttcaatgaaagaaaaggaattacgttttttaaagttttttcatcaacaaaaatataa

SEQ ID NO: 1815 - DNA, 579 bp, Staphylococcus epidermidis
atgattgcgattattgattatggattgggaaacataagtaacgtcactcgagcaattcaacatttaggatatgatgtgattttgacatgtgatgataaagacgtgcaaaaagctgaagctatcgtacttccaggtgttggacattttcaggatgcgatgcattctatagaagaaaaaagcattaaagatatgcttaaaaatatacatgataaaccgataattggaatatgtttaggtatgcaattactttttcaacatagcgcagaaggtgacgttagtggattggaacttgtcccgggaaatatagtgccaatccaatcatctcatcctattcctcatttgggttggaatgaattaaagagtacacatcccttactgcaaagtgatgtgtattttgttcattcatatcaagcagaaatgtcagaatatgtagtagcttatgctgactatggtacaaagattccgggagtcattcaataccgaaattatataggtatccagtttcatcctgaaaaaagtggaacgtatggattagagattctaaatcaagcgcttaaaggagggtttattaatgattga

SEQ ID NO: 1816 - DNA, 504 bp, Staphylococcus epidermidis
ttaccgcctgtgccttttatcttgttaatgtctaatcctttatcctcagccatattacgtgcgaggggtgagataaagattctttctcgtgctgcgcttttaggcgaattatctttattatcggaagacggttgtgatgtatctttaacttcttgcgtttccttctcatgctcgttgtcttcttttactttttctgatgctaaatcatcttcatctttatcaatagcttccccttcttctccaattatacctaataccgctttaacctctgcatcttctccggcttgcactttaatttctaacaatgtcccactcgccggcgcttcaacatcgttggttaatttttcagagcttattgtaacaatactctctccttgttttacggtgtcaccctctgatttaaaccactcttcaacagttccctctttcattgtcattccaagctttggcataataatattttcactcattgtgatacacctcctatgcgttagccttttttaa

SEQ ID NO: 1817 - DNA, 732 bp, Staphylococcus epidermidis
atcaagcgcttaaaggagggtttattaatgattgatttatggccagctattgatttaattaattcaacaagtgttcgattaacagaaggcaaatatgattcaaaagaaaaaatggaaaaatctgtagaagacagtatccgattttatagtcaatttaaatgtgtgaaacgtatacatattgtagatttaattggggctaaagcaaaagaggtaaaagaattcgactacatccgttccttaagaaagttgaccactaagcctatagaagtgggtggcggcattcgttcaaaacaaacaattgaaaattatattcattcaggaatagactattgtattgtaggtacaaaaggtatccaagatatagagtggttaacacatatgacacatcaatttccaaataaactctacttatctgtagatgcttttggagagaaaataaagattaatggatggaaagaggatgctaaactcaatttatttgattatgttgccaaaattgagcatttacctttgggtggtgtgatttataccgatatttcgaaagatgggaaactttctggacctaattttgatttgacaggtcgtctcgcactttatacatcgttacctgtgattgcttcaggaggtattagacatcaagaagacttgtttcgattagaatcgttaaatgttcatgctgctattgtaggaaaagcagcacatctggatgaattctgggagggattatcttga

SEQ ID NO: 1818 - DNA, 207 bp, Staphylococcus epidermidis
tttaagccagttaatgaagatcctaaaaatatggctaccatcaaaatagtaattaagattttagtgaaattattattaggaacatcaaagagatggtttaatccaccaccgatttgcataattcccaaaccaatcgacgtagcaattcccatgacggttgcgataatagctaatatatcaataatattcctgaaaggacgtttataa

SEQ ID NO: 1819 - DNA, 1722 bp, Staphylococcus epidermidis
acgttggaggttgaaaatatgaaaagtgcccaagcacttaaacagaatttaacatcgttagacggtcaaaagtacggtgcgtataagcaaataaaagacctatacgaatttaatttatttaaactacgtattaatcatatccaagctgatccatttgcgccaccatctaagatgagtgttgttatagatcgccaacaagcaaaatttcctgattctttattaaattctgaactgaaacaacgggctgtgagtgattacttaacgcgcgtgtttcataagcagattcaatcaatagtagcccaagataaaaaagtaagtaaaattcaaattgatagttgtggccaagaaatcttagagcgtaccgcaatagtaattaagaatcatcaaattgaagcacgtattgaagttggattaccagcacgaggacgtaccatattaggtagaatagcaagacatacacttattaatgtattacctcaaatagtagaacatgccttatgttatcgcaacattaatggttcacaattgcaacaacaagttgaattaatgatggatcaagaggagattagacaacagttagtaaaacgtgaccttgttgcatttgtagcaaatggtgctattttaccaagaaaaagtggtgtttcagatctccctatgaataacgctattgaatttaaaagtcctaaacaatatgagattgtaatgaaactatcgagtggcaaagttattaagggtatgggtattcctaaaggcattacactaatagttggaggcggttatcatggtaaatcaacattacttgaagcgttagaacgaggtgtatataatcatattgctggtgatggtagagaatatgtgattacaaatcaagatgcaatgaaaattcgtgctgaagacggaagaagtattcaaaatgttaatatccagccatttattgatcatttgccaggtgaaaaagatactacacatttttcaactgaaaatgcgagtggtagtacgtctcaagctgcaaatgtcatggaagctttagaatcacaagcatcattgttactcattgatgaagatacatctgcaacgaatttcatgattcgtgatggtcgtatgcaacgtttaattgctcccgaaaaagagccgattacacccttttctaataaggtaaaagcattatatgacgaccataacgtgtcgactattctaatcgttggaggttcgggagattattttgacgtggcagatcaagtattgatgatggatgaatatgtgttgaaagatgttacgcaacatgctaaagacattgcgcagtcagatggttatcaaagaaggctttcttctcactatcagttcggtcacattccatcaagaattccgttgagagcgagttttaatcaaaaagggaaacgtgatcgctttaaagctaaaggattgaatgtagtaacgtatggtaaggaaactattcatatttctggcttagaacaacttgtcgatgacagtcaaacacaaggtttagcgatgatgttaagttatgtaaaaaatgaattgctagatgacaaaagtacgattgtagaattgaccaatagtttgtatcaacggattgagaaacacggattagatgttatatcaaatcatcaggggcatcctggtcatttagcgctacctagaaagcaggagtttattgcgacacttaatcgatatcgtagattaaaaataaagcaaagggaataa

SEQ ID NO: 1820 - DNA, 1425 bp, Staphylococcus epidermidis
aatttcttattcctcatgcaaatgaaattgggatggcacaacgtactattggtgaaaggaggcatttattatatgagtaaatcatatgacttaatcgtaataggagctggacctggtggctatgtagctgcaatacgtggtgcgcaacttggtaaaaatgttgcagtcattgaaaaaaataatgctggaggcacgtgcttaaatgtaggttgcatcccctctaaaacgttgttagaacacggcgagaaagcacacagcatacgagttgcaaacgattggggaatcacaacgaaagacttaaaaattgattttactcaatttgtccaacgaaaaaagaaagttgtacaaacacttacgggtggcgtgaagcagttgttaaagaaaaataaagttacttatattgaaggggaagcacgaatttctaaaaacttaaaagtggacgttaacaatgaaacgtatcaagcgaaagatataattttagcaactggcagtcagccgttcattccaccaattgatgggttagatcaagtcaattatgaaacaaccgatacatttttcgatttagagaagctaccaaaacagttagcggttatcggtgggggtgtgattgcaacagaactcgcatcctcaatggctgatcttggggttagagttacgataatagaagttgcagatgacattttattaactgaaatcaacgaaactagagaaatgttaaaagcacatttagataatcaaggtattaagatactgacgaaagcaaagataaaacaagtaaaggaatcgaaaataatattagatgggcaagatgatgttagctttgatacccttcttgttgcaacaggtagacaaccgaatacgcaagttgcaaaagatttaaatttggaaatggatggtaaattctttaaagtcaatgaacattatgaaacgagtcaaaaacatgtctatgctataggagatttaattaaaggatatcaacttgcacatgcagcaagtgcgcatggcattcatgttgtcgaaacaataatgaacaaacagccgtcacttgtgcgtcaagaagatattacgcgttgtatatacacaagacttgaagcagcatcagttgggttatcagaagagcaagctaaagaggctggttatgatgtgaaagtgactcaatcagcatttcaagggaatgcaaaggcgttaatcaaaggagaaaatgaaggatttattaaacttgtcgttgataaaaagtatggagaggttcttggtgcttttattgtaggaccacatgctacagatataattggagaacttttaagtgtcaaagcatcagagggtacgattcatgaactttctcaaattattcaaccacacccggctttattagaagcaataggtgagagtgcagatgcattttttgattctgcaattcatatgtag

SEQ ID NO: 1821 - DNA, 1260 bp, Staphylococcus epidermidis
gagtgtctattaactatgcttagcgcacaacaatttttaaaagaatttaataatgttgaatctctagatgaatctttgtacgagatagtgagtcagatttgtgaagaagttaaattacagggagataaagctttaaaaaattataatttacaatttgatcaagtggaaactgagaagcttgaattagagcaaagccaactaaaaaatgcatacgacatgctagataatgaaacacgagatgcattagagcaaagctatcagagaattaaagtgtaccaagaaaatattaaggtaaaacaggaatcatctcaacaaactgaatgttatgaacgataccatcctatcgaacgtgtaggtatttatgtgccgggaggtaaggctagctatccgtctacagtattaatgactgcaacacttgctcaagtagcaggtgttaatgagattactgttgttaccccacctcaaaatagcggtatatgtcaagaggtgttagccgcttgttacattacaggcgttcatcatgtttatcaagtcggtggagcacaaagtattgcggcgctaacttatggcacggaaactataaaaaaagtcgacaaaatcgtaggtccagggaatcaatatgttgcttatgccaaaaagtttgtattcggtcaagtaggcatagaccaaatcgcaggaccgacagaaatagccttgattatagacgaaagtgctgacttagacgcaatcgcttatgacgtatttgcacaagcagaacatgatgaaatggcttgtacttatgtgattagtgaaaatgaaaaggtacttaatcaattgaacactataatacaagagaaacttcagtatgttgaacggcaagatatcatatcacaaagtattgctaaccatcattatctaatattagctcaagatactgaagaagcatgtttaattatgaacacgattgcacctgaacatgcatctattcaaactcgagcacctgaaatgtatatagataaagttaaatatgtaggcgcactttttttaggtcatttttctcctgaagttattggggactatgtggcaggtccaagtcatgtacttcctactaatcaaacagctagatttacaaatgggctttctgtgaatgactttatgacacgacattcagtcattcatttatcacaaaaaacatttaacgaagtggcagaatcagctgagtatattgcacatatagaatctttatttaatcatgaaaaatcgattcacgtacgccgataa

SEQ ID NO: 1822 - DNA, 252 bp, Staphylococcus epidermidis
ttaatatcctccttagggaaaaagatgggtagtaatgttaaagattctaaaattacaccgaataaaataagtttatttaccggttctttagttactaatgaaataactacgatagtacaatataaaaatatggagagtattttttttcgctttacaagacgtctaggtataggttgtttcttagttgctgcaggtgcgtataaaatcgtaataattaatccgactaatgccatagataaaagaacaaaatag

SEQ ID NO: 1823 - DNA, 216 bp, Staphylococcus epidermidis
atgtcattatctaatgaagaaatgatttgtaatataagacaaaaattaaatattgtaaatcaagcattacttaatccggaaaaatttaaatcaacacctcatcaagacataagcgaaatatatgaattcgtaatgtctaaagattcattctcgcctagtgaggttacggctattgctgaccatttaggacagcttagacaagatatggaggattaa

SEQ ID NO: 1824 - DNA, 1497 bp, Staphylococcus epidermidis
atatttaagtcgattggagatgttaaagtgtaccaatataacgacgatagcttaatgttacacaatgatttatatcaaattaatatggctgaaagctactggaatgatggtatccatgaaagaatagcagtgtttgatttgtattttcgaaaaatgccatttaatagtggatatgcggtattcaacggattgaaacgcgttgtgaatttcatcgaaaactttgggtttacaaatgaagatatcacatatttaaaatcgataggttacgaagaagattttctaaactacctaaaagatttgaaatttacagggaatattaaatctatgcaagaaggtgaaatttgttttggtaatgagccattattaagagttgaagcacctttaatccaagcgcaacttattgaaactattttgttaaatatcattaatttccaaacattaattgcaactaaagccagccgaattcgtcaaatagcaacgcatgacactttgatggaatttggtacaagaagagctcaagagatcgatgctgcactgtggggcgctagagcagcctttattggagggtttgattctacaagtaatgttagagcaggaaaactttttaatatacctgtatttggcacacatgcacacgcactagtacaaacatatggtgatgagtatatagcattcaaaaagtatgctgagcgacataaaaattgtgtgttcttagttgatactttccatactttaaaatcaggagtaccaaccgcaattaaggttgcaaaagagttaggagatactattaattttataggtatcagattagattctggtgatattgcgtacctatctaaagaagctcgtagaatgttagatgaggctggttttacagaagctaaaattatcgcatcaaatgatttggatgagcagactattacaagtttaaaagcacaaggcgctaaagttgacggatggggagtaggtacaaaactgattacaggatatgatcaaccagccttaggcgcagtttataaattggtttctattgaaacagatgatggcacaatgagtgatcgcattaaattatcaaataatgctgagaaagttactacaccaggcaaaaaaaatgtttatcgtattattaataataaaacaggcaaggctgagggcgactatattacgctagaaggtgaaaatcctaatgacgaatctccattgaaaatgttccatcctgttcacacttacaaaatgaagtttattaaatcatttaaagcggttaatctacatcaatctatatttgaaaatggcaaacttgtataccatcttccagatgaatatgaagctcaggactatcttaaaaataatttaagtattttatgggaagaaaataaacgatatcttaacccgcaagattatccagtagatttaagcactaaatgttgggaaaataagcataagcgtatttttgaagttgctgaacacgttaaagagatggaggatgaaaatgagtag

SEQ ID NO: 1825 - DNA, 759 bp, Staphylococcus epidermidis
agaagcattccactttatatatcatatgagtgctgtagcatagaaaggtggcgaaatatgacacgcaaatatatatcaactgaaatgttgattatttttactgctttaatgattattgctaatttttactatatattttttgaaaaaattggctttttactagtactcctattaggatgtgtacttgtatatgtagggtatgtgtattttcataaagtaagaggactactatctttttggataggaaccttattaattgcttttacacttttgtctaataagtacacgattattattctatttatatttttaattgtagtcatcatacgttatttggtttataagtttaaaccattaaaagtgattgctacagatgaagacatcacatcacccatttttattaagcaaaaatggtttggtgaacaacatacaccagtgtatgtatataaatgggaagacgtacagattcaacacggtataggagacatacacattgatatgacaaaagcggcaaatattaaggaaacaaataccatagttgtgcgtcatattttaggtaaagtacaagtagttgtacctcttaattataatataaatttacatgcgactctcttctacggcactgcttatgtgaacgataaatcttataagattgagaataaccatgttcaaattgaagaaaaaacgaaagatgataattatactgttaatgtttacgtttcatcattcattggagacgtagaggtgatttacagatga

SEQ ID NO: 1826 - DNA, 1377 bp, Staphylococcus epidermidis
aaacgaacttttcttataaaaaatgtgataatgtacagtttttgtaggagctataatacatacgataggagtttacaaagaatgatagaacgttattcaagagatgaaatgtctagtatttggacggatcaaaatcgctatgaagcatggttagaagtagagattctagcgtgtgaagcatggagtgagttaggttatattcctaaagaagatgtaaaaaaaattcgtgaaaatgccaaagtaaatgttgaacgcgctaaagaaattgaacaagaaacacgacacgatgtagttgcatttacacgccaagtttctgaaactttaggtgatgaacgtaagtgggtacattatggattaacttccactgatgtagttgacactgccttaagttatgtaattaaacaggcaaacgaaatccttgaaaaagatttagaaagatttatagatgtattagctgccaaagctaaaaaatatcaatatacattgatgatggggcgtacacatggagttcatgctgagcctacaacttttggcgtaaaaatggctctttggtatactgaaatgaaacgtaatcttaagcgttttaaagaagtgcgtaaagaaatagaagtagggaaaatgagtggagcagtaggaacatttgccaatattccacccgaaattgaggcttacgtatgtgaacatttaggaatagacactgcagctgtttctactcaaacattacaaagagatcgtcatgcttattacattgctacattagcactaattgctacatcaatggaaaaatttgcagtagaaattcgtaatttacaaaaaactgaaactagagaagtcgaagaggcatttgcaaaaggacaaaaaggatcatcagcaatgccacataaaagaaatccaatcggttctgaaaatattacaggtatatctcgtgtgattcgaggatatattactactgcatacgagaatatacctttatggcatgaaagagatatctctcattcttctgcagaacgtatcatgttaccagatgttacaattgctctagattatgcacttaatcgatttacgaatattgttgatcgactaacagtttatgaagataatatgagaaataatattgataaaacgtatggtttaatcttctcacaacgcgtactactagcattaattaataaaggcatggtacgtgaagaagcttatgataaagttcaacctaaagcaatggaatcttgggaaacaaaaacaccatttagagagctaattgaacaagattcatctataactgacgttctatcaagtgaagaattagatgattgcttcgatcctaagcatcatcttaatcaggtcgacactatattcgcgcgtgctggtttatcttaa

SEQ ID NO: 1827 - DNA, 507 bp, Staphylococcus epidermidis
ttgaagatgttaagtaaagaactattagcagctttaaatgaacagatgaatcaagaatattttgcagcgcatgcatatatggcaatggcagcatactgtgacaaagaatcttatgacggatttgcaaatttttatatagaacaagctaaagaggaacgtttccacggtaaaaaaatctatgactatatcaatgatcgtggcgaacatgccatctttgatacaattaaagctcctaaagtagaattttcttctattttagaaacatttaaagatagtttagctcaagaacgtgatgttactcaacgtttctataatctatcagaattagctcggaatgataaagattatgctacaatttcatttttaaattggttcttagatgaacaagttgaagaagaatctacatttgaaactcatatagattaccttactcgtattggcgatgattgtaatacactttacctatatgaaaaagaattagcagcgcgttcattcaacgaacaataa

SEQ ID NO: 1828 - DNA, 303 bp, Staphylococcus epidermidis; identical to SEQ ID NO: 234

SEQ ID NO: 1829 - DNA, 213 bp, Staphylococcus epidermidis
acattaacgtttcctaaatgtatatctaaaggtgctacgtataaatatagaagacattgttttttcatctcaacacatcccactttccacattttctttagcgttttagaaggaaatgctcatcactttgttcatgaccttttgttaattaaccatcggcataagttatttacaattcagtcattaactgctaatacgttaaaatgcccctag

SEQ ID NO: 1830 - DNA, 840 bp, Staphylococcus epidermidis
cctttatttacgataaaatacataatatacatatatagatggagggaaaagtttttctttttaaatttggcacaaaaaacgcgttttgttaaattgcggtatcccctattaacccgtttctattctcacggtttagctcaaatactacctgggttggttttaggtagccatttacttggagatatgtataaaatgcaaactgcccaaacaatgagtatcatgcaagtatctatctttatcatcgctgcattgttaatcattttcatgcaagcaaccattaaaaatcctactcaattagaacaaggacataaggaacctaaaagatatattttcgcctgggttctattaggattttgtattgtgatgatttaccaaatcatcatcagtataattttatttgccatcaatggcagtccgcaaagaagtccaaacactgaaaggttaatggctattgctaagcaaatgccgatatttatcgttttaatatccatagtaggtcccattttagaggaatacgtttttcgtaaagttatcttcggagaattgtataactttataaagggatcacgtgtggtaagctttatcattgcttctatagtaagttctctaatattcgctttagcacataatgacttcaaatttataccggtatattttggaatgggagtcattttctcacttgcttatgtttacacaaaacgaattgctgtacctataggcatacacatgcttatgaatggttcggttgtattaactcaagttgtgggtggagattctattaaaaaattgcaagaactaaaggcccccaacatttatattccatcttatattttaaaataa

SEQ ID NO: 1831 - DNA, 840 bp, Staphylococcus epidermidis
aagggtgagtttgagaaaaggagaaaacccatgaaaagaagcgataaatatacggatgattatattgaacaacgttatgagtctcaacgacctcattacaatacatattatcaaccaatagggaaaccaccgaaaaagaaaaaaagtaaaagaattttcttaaaagcaattatcactatattaattttattgattatattttttggtgtcatgtactttatttcttcaagagcaaatgtagatgatttaaaatcaattgaaaataaaagcgattttgttgctaccgaaaatatgcctaactatgtaaaaggcgcatttatttcaatggaggatgagcgtttctataaacatcatggctttgatataaaaggaacgacaagggcattgttttcaactattagcgatagagatgtgcaaggtggaagtacaattacgcaacaagttgtaaagaattattattacgataatgaacgatcctttacaagaaaaatcaaagaattgtttgtagcgcgtaaagttgaaaagcaatacagtaaaaatcagattttaagtttctatatgaataatatttattatggtgataatcaatatactgtagaaggtgctgcaaatcattattttggtgtaacggtcgataaaaacaattcaaatatgagtcagattagtgtgttacaaagtgctatattagcaagcaaagtaaatgcaccaagtgtgtatgatgtaaatgatatgtcgaataattacatcaatagagttaaaaccaatttagagaaaatgaaacaacaaaattttattagtgaatcacaatatcaagaagctatgtctcaacttggaaattaa

SEQ ID NO: 1832 - DNA, 1155 bp, Staphylococcus epidermidis
atagtgtatacttatactattaaaattagaaatgagattattatgaaaatagtagaagtaaaatctaagaatggtaccaattttatgattttagatggtaataatgaacctatagtagatgcagtaagatatttgaagtatctggatagtgttaagaaaagtttaaataccaagaaaacctatgcctatgcactaaaaaatttttttgtttacttagaaagtaaaaagatatgctataaagaagttagttttgataactttgttgattttataagatggatgaaaacaccttttgaatatgagaatgtcctctcttatcaccgaaaagaaaaaagcattagtcctaagacaattaatctgactatgactgtagtatctaatttttatgattatctctataggagtaaaaaattagatgttaatttctatgattttatgcatatggaaagtaaatactctaaaaaatataaaagtttcatgcatcacataaataaggactatagaacgttgaaaaatattttgaaagttaaagaaccaaagaaaaaaatagaagtgttaactaatgcggaggttaagaaattattagaggaagctaataatattagagataaattcttaatacaattactatatgaaaccggattacgtataggtgaggtattatcattacgtattgatgatattaaatttgactttagaaaaggccatcaaatagttttgaaaaatagatttaatgataatggtacttatttgaaaactggggaaagaaaaatatttatttcccaatcgttaattgatttatacgatgattatgtctacgaaataattgacgaactttcaatatgttctgattatctttttgtaaaaataaaggggagaaatgtaggagaagctatgaattatagtgatatatattcattatttaaaaggctaaaacataaaacatctataaatgttcatcctcatttatttcgccatacacatgcaactgttttttataatgaaactaaggatataaaacaagttcaagaaagacttggtcatagtaatatacaaacgactattaatttatatgttcatcccactgaagaagatatacgtgaagattggaataaagtaaagcatcaatttcaagtttttaataaaggggaatga

SEQ ID NO: 1833 - DNA, 1089 bp, Staphylococcus epidermidis
gaggcacatacaactatgaaagacaacaaacctaataattcgaaattaattcaaacatatttaagtaagaaaactttaagatatggtacagcaagtgcattaacattggcactctatttatttaacagtaacgtaactgtgtatgcggatgaaaatactgcaaaccaaaatcaaggaacatcaccaaaaatttcacagacagcacctacaaataatactgaaaatacagatgccacagccataacaacagatcaaaataataatgatgaagaagaatacgatgcgtcatatgaacttccaattctttatgtaactgtctggctagatgatcaaggaaatattattaaagatgctgtggaagatgctaaaacccctgcttcagaaaggcaaccggtgaaaattcctgggtaccaacattatagaacttctgtgagtgacggaattactaagtttatttatcgtaaaattagcactgcacaatcacctatagttgaaaataatcaacaagataataatacaaataaagttgttgaaacaaccaatcaaaataaagatgaagtgaatggaaaagaacaaaatcaagcaaatacttcagtaacaaatacacaaattaccaaaaacgagaaagacgaagacacaaaaacactaaagaaagataaagatgagaaagaatctaaagacacaaaaacaccaaagaaagacaaagaaaagaaagacataaaaactccgaagaaagatagagaagagaaaaaaccagtaataccaagtaacggtaaagtcgagaaagacgaagacacaaaaacaccaaaaaaagacaaagaaaagaaaatcacaaaaactttgaagaaagatagagaggagaaaagcccagtaataccaaaaagcggcaaagacgagaaagacacaaaaataactaagaaagacaaagaagacgaaattacaacaacttccaagaaagataataacaatgatgtacaagataaattaccggaaacaggtaaaacaaaagatattcaaaatcctgctttaataatgttacttactggattaggtttattaggattatttagaaataaaataagagaatag

SEQ ID NO: 1834 - DNA, 711 bp, Staphylococcus epidermidis
ataaaggagtttcataaaatgtacgacataaccaagtggaaacatatgtttaaattagatccggctaaatcaatttcggatgaaaatttagaggcactgtgtatgtctaacactgatgcaataattattggtgggacagatgatgtaacagaagataatgttattcatttaatgagtagagtaagacgttatccgttaccacttgtcttagaagtttcgaatgtagaaagtgtgatgcctggttttgatttctattttattccaacagtcatgaatagtaaggatacaaaatatcataacgaaattttactagaagcccttaaaaaatatggacatgtgattaattttgatgaagtttttttcgagggatatgtcgttctaaacgcaaatagtaaagttgcaaaaattaccaaagcttatactcaattaggtatagaagatgtcgaagcatatgcacaaatggcagaagaattatatcgatttccaatcatgtacgtagaatatagtggcacatatggagatgttgataaggttaaagcgattgcaaatatgcttcaacatactcaattattttatggcggtggtataacaaacattgacaaagctaacgaaatgtctaacattgcggataccattgttgtcggcgatattatatataacgacattaaaaaagcattaaaaactgtaaagataaaggagtctaataaatga

SEQ ID NO: 1835 - DNA, 579 bp, Staphylococcus epidermidis
tctaaatggttaaatacgataaaggtggtgtggagtatggtaaaggaatccatacctaaagaaggagaaaacattaagattcaaagttataaacatgatggtaatattcatcgtgtctggtcagaaaccacaattttaaagggaacggaacatgtgattattggtggtaatgatcacactttagtaactgaaagtgatgggcgtacatggattactcgagaaccagcaattgtgtactttcattctgaatattggtttaatgttatttgtatgtttagagaagatggtatttattattattgtaatttatcttcgccttttgcatgtgacgaagaagcgttaaaatatattgattatgatttagatatcaaagtttatccgaacggaaaatatcatttacttgatgaagatgagtacgagcaacatatgaaccaaatgaattatccacacgatatcgatattattttaagaagaaatgttgatattttacaacaatggatagaacaaaaaaaggggccttttgctcctgactttataaaggtatggaaagaacgttataaaaaaattagagattattaa

SEQ ID NO: 1836 - DNA, 303 bp, Staphylococcus epidermidis
ccattcgcaactttaccagaacagtttgaaacaatttatcaatatatgatagatcaaaataaagtgagcagaccagtgctttcagacgaccaactttcgcaactaaatatacatttacatgaagcactacaacaatcacgcccagtcaatatcaaatattacgaagaaggatatattaactttatagagctcattgtacatcggattgattcaataaattatgagattgaaggtactgctcctcattcaagagaacgtcataaagtttcatttttagatattatagatatttcttttatataa

SEQ ID NO: 1837 - DNA, 1209 bp, Staphylococcus epidermidis
atgaagcgaacaatatttttactcatgtcgatactgttattattaacggcttgcggagatggacataaacaaacttcatcagataaagaacaaagtgaacataaggataaccataataaaaatcaagtgaaacaaatagcgactgataaaaaagttcaaggtgataactataggactatattacccttcaaagaaagccaggctcgtggattattacaagataatatggcaaatggttataatggagaagattttgaaagtggtttactagaattaagtaaagaaatctttccaacaaataagtatttatatcaagatggacaatatttagataaaaaaacgattaatgcatacttagatccgaagtatacgaaaaaagaaattgacaagatgagcgaaaaagaaaagaaaagcaaaaatgctaatgagaatcttggactcaatccatctcacaatggtgaaacagatgaagagaaaatagctgaaaattctccagcctatctttcaaatatactcgagcaggatttttatggaaatagtgattctaaaggtaaaaatataaaagggatgacaattggtttagccatgaatagtgtttattattacaaaaaagagaaagatggcgaaacatttagtaaagatttatctgataaagagattgaaaagcaaggtaaacagatggctagtgaaatgctttctcgtttacgtgagaatagtgatttgaaagatattcctattcattttgctatctataaacaatcaagtcaagattccattacaccaggtgaatttatagttggtactacggttgaagagggtaaaactaaaattaactcttgggataatattaatgaaaaagcagccttaattccttcgtcaactgcagctgattatgatgaaacgctgaataataactttaaacagtttaatgataatttgcaatcgtatttttcaaacttcacacaagcagttggtaaggttaaattcgtaaataaaaaagctaaacaacttacagttgatttgcctatagattattacggacaggcagaaacgataggtattacacaatatgttacagagcaagccgaaaaatattttgataaactagatgagtatgaaattagaatcaaagatggaaatactccacgtgctctcattagtaaaactaaagacgataaagaaccacaagttcatatctatcataattag

SEQ ID NO: 1838 - DNA, 2076 bp, Staphylococcus epidermidis
aggggaatgactatgtcaataccaattaatttacctacaaacagtactatgattaatgaattatgtacattacaaagtagaaccatcaatataaaaggagaggttttaataactgaaatatatgatgattacttttttaaaaatgatgagtggcacattacagcttttaacaaattcaagcaatttcaagatagtatcaagaactatagagacaaaagaaaaaatgttttctttaggattaaaagtaaaaatttgaatttagaatttaaatacctttttttgaaactgatagttaaagaggattggtccttatctaatttatttaatactggagcagtaaagcttaataagattgctaagttctttaatgaagtttatccaaatttaaattctttacttgattgtgatataaatacattagaaaagcactggtttaattggctgactgaaaataatataccaataaaaagaagatcatcaacaatagtttttggtgattatgaatacaaaagcggactggcttcttttttaaagaatatgtacattaatctaattaagttcattgataagcgagaagaatgggaaaaagataaatgggatattagaaatttagaaaaatatggattgagttataataaaacactaactggcaattatttaaactttgaaaaaattgagtcaattaaaatgcgagaattagcaaaaaaatatttaaaaaatcgtttgataactggtgatatagcatttgctacagcaaggttttatataagagttttaactaggttttttcaaaatatatctaaaaataaagaaacaaggaatagtttaaatgaactagatagatgtcatatcgaagcatatatagaatttttgtttgaatatgcagctaataaacatttgcaaagtactaagaattttgtgagagaagaattaaaaacaattagaaggttcttaaacgatattataactcaaaactatgctatagcaccgtaccaagatatacgatttttaatttatcctcaagacttacctaaacacgaaaagaaaaatagtagccaaattgattatatcccagattttgtattggaacagctttttgagcatataaatgatttgcataaagatttaatacctgtagtttggatagcttttaaaacaggattaagaatttctgatgtattgacattacaaaataattgccttgcaaaagttaatggaaagtattcaataatcacagatattgctaaaacttttgttaaaggacatagaataccaattgataataaattagctgatataatagcagttttaatagccgattctaaaagtaaaagtacaaaagataataatcctaataattatatttttgctatttataaaggaaaaagaaagggaatgccctttacacaacatatggtcagagcacacttaaatcatttatcaaagactaaaaatattattgatgaacaaggagaaatcttccatttcaaaactcatcaatttagacatacctatgcagtaaaattgttaaatggtggagcagatatattaacgatacaagaattattagcacactcctcaccagaaatgactctaagatatgctaagttacttgatgatacaaagagaaaggcttttgaatcagttattgatcaaggagcttttagttttgatgttgacggtaaaattaaaaatatacagcatagtagtgaactatctgaaaaagcattgaattctttatggcaagaacataaattaaacgcaatggacaatccttatggcacttgtcatgctagattgagtggtgattgtccatacatggaagctccgccatgcctgacttgtaattctgggaaaccatgtaaggatttagctattggattttctgatttagatgttgaaaaatatgaattacatatcaaatcaacggtcaaatctatagaattagctaaaaataataatagacaagatatggttgaaaagcatataaatatattaaataaatatgaagaaatactaggtaatataaaagatggaaacattatattcgggagaagtaatagaataaaagtatag

SEQ ID NO: 1839 - DNA, 249 bp, Staphylococcus epidermidis
tcaccgaagacatatgtaaagacaacagcaaataacgcaccaataactgttgctggcaaccttttataccccttttttaatgatgctttagcagtaggttcaattgtaacaattgcagtaagtatggcaaaaattggagtgaggtttaacaacatacaaaataaagacgtaaaaaaagtagccaaaccagttttaatagttcgcgctccaattatatgtctataccatttatcattcatatcatactga

SEQ ID NO: 1840 - DNA, 1476 bp, Staphylococcus epidermidis
atggggaggacgcttaagatgagtattcgttttgaatctatcgaaaaattaactgaattaatcaaaaataaagaaattaaaccttctgatgtagtaaaagatatatacgcagctattgaagaaactgatccaacaatcaagtcattcttagctttagataaagaaaatgcaataaaaaaagccgaagaattagatgaattacaagctaaagatcaaatggatggtaaactatttggaattcctatgggaatcaaagataatatcatcacaaaagatgtagaaactacatgtgcaagtaaaatgttagagggatttgtacctatttatgaatcaactgtaatgaacaaactacatgatgaaaacgcggttttaattggtaaattaaacatggatgagtttgcaatgggtggctctacagagacttcatattttaagaaaacattaaatcctttcgatcacacagcagtaccaggaggatcttcaggtggttctgcagcagcggttgcagcaggtttagttccttttagtttagggtcagacactggtggttctattagacaacctgcatcttattgtggtgttgttggtatgaaaccaacttatggccgtgtatcacgtttcggtttagttgcatttgcttcttctttagatcaaattggaccaatcacgcgtaatgttaaagataacgcattagtacttgaggcaatttccggtgtagatgcgaatgattctacaagcgcacctgttgatgatgtagattttacttctgatattggtaaagatattaaaggtcttaaaattgcattacctaaagaatatttaggtgagggtgtaagtgaagaagttaagacttctgtaaaagaagcggttgaaacgttaaaatcacttggtgctgaagttgacgaagtctcattaccaaatacaaaatatggtattccatcatattatgttattgcgtcatcagaggcttcagcaaatttagcgcgatttgatggtattagatatggatatcattctaaagaagcacaatcgttagaagaattatataaaatgtctagatcggaaggctttggtgaagaagtcaaaagacgtatcttcttaggtacttttgctttaagctcaggttattacgatgcatactataaaaaatctcaaaaagttagaacgttaattaaaaatgattttgacaaagtatttgaatcttatgatgttgtggttggaccgacagcacctacaacagcatttaatattggcgaagaaattgatgatcctttaacaatgtatgcgaatgacttattaactacaccagttaatcttgccggtttacctggtatttcagttccttgtggacaatcaaacggacgcccaattggtttacaattaattggtaaaccttttgacgaaaaaacgttatatcgtgtcgcttatcaatttgaaacacaatacaacttacatgacgcatacgaaaatttataa

SEQ ID NO: 1841 - DNA, 921 bp, Staphylococcus epidermidis
actattgacgcgaatattacaattgtaatattattgatttatagaaattacaactgtaatattggagggtatattttgaaaaagttaatacttttaattgcaattgctttagttttaagtgcatgtaattcaaccagttcacatgctaaagagttaaataatttagaaaagaaatataatgctaatattggtgtctatgcattagatactaaaagtggtaaggaagtaaaatttaatgccgataagagatttgcctatgcttcaacttcaaaagcgataaatagtgctattttgttagaacaagtaccttataataagttaaataaaaaagtacatattaacaaagatgatatagttgcttattctcctattttagaaaaatatgtaggaaaagatatcactttaaaagaacttattgaggcttcaatgaagtatagtgataatacagcaaacaataaaattataaacgaaatcggtggaatcaaaaaaattaaaaaacgtttaaaaaaattgggagataaagtaacaaatccagttagatatgaaatagaattaaattactattcaccaaagagcaaaaaagatacttcaacgcctgctgctttcggcaagactttaaataaacttatcgcaaatggaaaattaagcaaaaaaaataaaaatttcttacttgatttaatgttaaataataaaaacggagacactttaattaaagatggtgttccaaaagactataaggttgctgataaaagtggtcaagcaataacatatgcttctagaaatgatgtagcttttgtttatcctaagaaccaatctgaacctattattttagtcatttttacgaataaagacaataaaagtgataaacctaatgataaattgataagtgaaaccgccaagaatgtaataaacaaattttaa

SEQ ID NO: 1842 - DNA, 447 bp, Staphylococcus epidermidis
gggggcagagcattggcaagtattagagaagatgtccaatttagtaatccaaccatatcggaaagtagttttaaaataaatgaaaactttgactcagaaaatttcgaaggatttggtgatattaagttgaatctgaaaaaatattattatgaagaaaataatgagattgataataataataataataatggttcagcacttttaagtttagaaataataataggcgatattgactggaagtatccttttatgtttaaagtagaaatcgaatctttttttgaatgggaaaatttcaaaggaactgatatagataaatttttagaaattaatggagctgctattttgtattcatacagccgtgcacatataagtcatattactaatacaagcaaatacccttcatttgatttacctttttataatttcacagacaatgattatcaatag

SEQ ID NO: 1843 - DNA, 1113 bp, Staphylococcus epidermidis
ttaaaaggagcatttaatttgagacttggagctcggattttcaaaactggtatagccattatcttagctatgtctatcgcttctttacttcctgataatattggtctaaaaacgttagcaggtgtcagtgcagtagttgccatgcaaccgagtgtttatcgctcaatcaaaactgtttctgaacaagctattggtaatgtgattggtgcattacttgcagtaacaatggtaacgatattcagtaataatttcattatcatgggcgttaccgttattttactcattgcaattttgttccaatttaatcttgcccatgtagcaacacttgcaagcgtaactgcacttataattatggggcaacacactggttctttctatgttgccgcattttttagatttgtactagtgatgattggtgtattgagttcttctgttgtcaatctaatttttttacctcctaagtttgaaacaaaaatttattataattctatgaatatttcttctgatatatttgtttggtttaaacttgtactcaatgacacatcagaatttcataatattaaacaggatggtgatcaactaaactcacgcatcaataaattagaaaagattttcgactattacaatgaagaaagaccattaacaaaaaaacatatttatcaacagaatagaaaaaaaatactatttagagaagtagttagaacgaccagacaagcatatgaagtgctaaaacgaatgtcacgatatcaaaatgatttatatcaactaaataatcaattacttttacaaatcaaattagaacttgattcattagttactttacatgaacaaatatttaagagtctatcaaaaaaagctagatatgatgtcactcaattagattatgaagttgacaatcctcagaagaaaaacttgatggatgcttttcagcaagaattaattaaaaacccacatcagacgcaatattcttatagcaatatgatgcaaattattgctgaaattgaagaatacagatatcaacttgaacacttagatagaatccgtttaagtttctttacctatcaccgttctgatactgatatagacatttcagatgaggactttgacttataa

SEQ ID NO: 1844 - DNA, 318 bp, Staphylococcus epidermidis
ggaggcttttatttaatgactaaagtaacacgtgaagaagttgaacatattgctaatttagctagacttcaaatttctcctgaagaaacagaagaaatggctaatactttagaaagtattttagattttgcgaaacaaaatgatagtgccgatacagaaggtattgagccaacttatcacgtattagatttacaaaacgtattacgtgacgataaagcaatcgagggcattcctcaagaattagcattgaaaaatgcgaaagaaacagaagatggtcaatttaaagtgccatccatcatgaatggggaggacgcttaa

SEQ ID NO: 1845 - DNA, 648 bp, Staphylococcus epidermidis
gcatgctttctaaaaaatgttgcgcaaaattgtataatgacacctgaggagagtagtaaacaagtgaaaatcatcgataaaaaaattgagcaatttgctcaatatttacaacgtaaaaataacttagatcacatacagtttttaaaaattcgtctaggaatgcaggtactagcgataaatattgaaaagtctatagttgtgtatgggctagcaataatctttcatactttcttttacacacttttaactcatttaagttattttttaattaggagacatgcacacggtacacatgcaaattcgtcattgttatgtcatattcagaacataattttctttattatttttccatacttaataataaagttagatattaactattttgttcttttatctatggcattagtcggattaattattacgattttatacgcacctgcagcaactaagaaacaacctatacctagacgtcttgtaaagcgaaaaaaaatactctccatatttttatattgtactatcgtagttatttcattagtaactaaagaaccggtaaataaacttattttattcggtgtaattttagaatctttaacattactacccatctttttccctaaggaggatattaatcatggaaaacatttttaa

SEQ ID NO: 1846 - DNA, 300 bp, Staphylococcus epidermidis
gtcgtccttctggaagaagggttacaaaaattaatagataggcatcatattacagcaacaataaatcgaatctatggctcactgacattgtatttcacaaatgaaaaagttacacattatgaacaagttgaaaactctgatggagatgctttcgctcaattctttaaattaatgttgaaccaaggcattaatctcgcgccttctaaatttgaagcatggttcttaactacagaacatactgaagaagatatcgatcgcacactagaagcagctgattatgcatttagtaaaatgaaataa

SEQ ID NO: 1847 - DNA, 1083 bp, Staphylococcus epidermidis
caatacattcttatgaagctaatagagaggaaaggttttatgtatctagaaaattcttttaaaaaagatattgaagattggtttcataaaaatcaaagagatatgccttggagagaaacgactaatccttattatatatggctaagtgaagtgatgttacaacagacgcaagtaaacactgttatcgattactactatagatttatacataggttccctacaatacagtcgttgagcgaagctaatgaagatgaagtgctgaagtattgggaagggttgggctattatagcagagcgcgtaatttccatactgccgtaaaagaagttaataataattatgatggtgaggtaccatacgatcctgaatcatttaaaaagttaaaaggtgtgggtccatatactcaggcggcggtcatgagtatagctttcaatcatcctttagcaactgtcgatggtaatgtttttagagtatggtcacgattaaacaatgactatcgtgatataaagttacagtccactcgaaaagcattcgaacaagaattacacccgtatgtgttgaaggatgcgggaacatttaatcaagcaatgatggagctaggggcgttagtatgtacgccaaaatcaccattgtgtttgttttgtcctattcaagaacactgtgaggcatttcatatggggactacacaagaattaccagtaaaaaccaaaagtttaaataagaaaaccattgagcaaaaagtttttcttattcgtaatgataatggtcaatatttacttgaaaagcgtaaagaaaaacttcttaatggtatgtggcaatttccaatgagagaacaaacaaatgcaaacgatgtgatatctgatgatttaggaaaaagtatcgaaacaattaacgaaccagtatttaaattaaagcatcaatttacccatcttacatgggaaattaaagtatacaatgttacagcacctcttaatataaaggaaaatgatttacctaaacaaatgacgtggtttaatttagatgatagggagcagtatacatttcccgtaccaatggataaaatatataagtttattgaaggttaa

SEQ ID NO: 1848 - DNA, 291 bp, Staphylococcus epidermidis
agatacatctatcgatactttcgcctttcaatattatcagtcgcttgtgtgatgttcttctttagattgatgattgatattatacgtgtcatcttcattagagatatctacatctttgctatcttcatagtattcataagtcgtattttcgttatagtgattttcattgttatcatcatgtttaatagcggcttcttcaggcgtgtgaccagctatgacttttctttggtgaataattgcattgatttcagcaccgataataataataaagcttgtgatatacaaccataa

SEQ ID NO: 1849 - DNA, 336 bp, Staphylococcus epidermidis
cactctatatatcaaagtgctaaatcacatgtaaatgaaggaggaacaatcatgcttaaaccattaggaaatcgtgtgattattgagaagaaagagcaagaacaaacaactaaaagtggcatcgttttaacagatagcgctaaagaaaaatcaaatgaaggtgtgatcattgcagttggacaaggtcgtttattagacaatggcacacaagttgctcctcaagtcagtgaaggtgacacaatcgtcttccaacaatatgcaggtactgaagtaaaacgtggcgacaaaacatatttaattttaaatgaagaagatatattagctattatagaataa

SEQ ID NO: 1850 - DNA, 249 bp, Staphylococcus epidermidis
gagatatctctttcatgccataaaggtatattctcgtatgcagtagtaatatatcctcgaatcacacgagatatacctgtaatattttcagaaccgattggatttcttttatgtggcattgctgatgatcctttttgtccttttgcaaatgcctcttcgacttctctagtttcagttttttgtaaattacgaatttctactgcaaatttttccattgatgtagcaattagtgctaatgtagcaatgtaa

SEQ ID NO: 1851 - DNA, 339 bp, Staphylococcus epidermidis
tttatcttgtacatcattgttattatctttcttggaagttgttgtaatttcgtcttctttgtctttcttagttatttttgtgtctttctcgtctttgccgctttttggtattactgggcttttctcctctctatctttcttcaaagtttttgtgattttcttttctttgtctttttttggtgtttttgtgtcttcgtctttctcgactttaccgttacttggtattactggttttttctcttctctatctttcttcggagtttttatgtctttcttttctttgtctttctttggtgtttttgtgtctttagattctttctcatctttatctttctttag

SEQ ID NO: 1852 - DNA, 957 bp, Staphylococcus epidermidis
caatatatgtataaggagatattgaaaatgacaaaaacttttattttcgggcacaaaaatccagatactgatgctatttcttcagctttaattatggctgattttgagcaacaaactggtaatactgaagcaaaagcttatcgtttaggtgaaataagtgcggaaactcaatttgcactagattattttaacgtagaagctccagaattattaaacgaagatttaaaaggacaagatgttattttagtcgaccataacgagtttcaacaaagtgcagatactatttcaaacgctacaattaaacatgtgatagatcatcacagaatttctaactttgaaacagctggccctttatactatagagcagaaccagttggttgtagtgcaacaattttatataaaatgtataaagaacgtggatttgaaattaaaccagaaatcgctggacttatgatttcagctataatttctgatagtttattatttaaatcacctacctgcacaaaagaagatgtagatgctgctcaagcacttaaagatattgcaaatgttgatttagaagcatatggtttagaaatgttaaaagcaggtgcttcaactacagataaatctgctgaaacacttgtcaatatggatgctaaatcattcaatatgggagattatgtaacacgtattgctcaagtcaatactgtagatattgatgaagttttagatcgtaaagaggaatttgaaaaagttatgttagaaatgagtgccaatgaaaaatacgatttattcgttcttgtagttactgatattattaacagcgattctaaaatccttgtagttggtgctgaaaaagataaagttggagaagcatttaaagtacaactagatgatggtatggctttcttatctggcgttgtatcacgaaaaaaacaagttgttcctcaaatcactgaagttttaactcaataa

SEQ ID NO: 1853 - DNA, 492 bp, Staphylococcus epidermidis
tatatacagtatattcctgatgaaatagagatttctactaatttttcgaaatcactttacaaaagtgtgtatattgtatatattatgtatatacagaagaaaagggggacatcaatgaaaataattttgaagaacaatagtgaaagtcctatatatgaacagattaagcaacaaattaaagaaaatgttttgaaaggttatgtttcccctggtgaacatcttccatcaatgcgtgagttagctaaagatttaaaagtgagtttaataacgacaaaacgagcatatgaagatttggaaaaagatggatttgtaacaactattagaggtaaaggaacctttgtaaaggaacaagataattctattctaaaggaaaagcaattttttgttattgaaaatttagctcactctatgtcaaaagaagccaaaacaattggaatgcctttagaggaattaatagaaatattgactatgatttatgaggaggacgactaa

SEQ ID NO: 1854 - DNA, 192 bp, Staphylococcus epidermidis
gtggtagctcaaatgagcaaaaagtttagagttgaagataaagaaacaattgcagattgtctcgacagaatgaaaaaagaagggtttatgccaatacgtcgtattgagaaaccagtttataaagagaacaaagatggcagtatagagattttaaaacaggatattatatttgtaggtgctttaatccaataa

SEQ ID NO: 1855 - DNA, 1137 bp, Staphylococcus epidermidis
gcacacaatcattatttaaaatatatgaggagttataacatgtttatcaatgcaaaagatttcggattaaaaggaaaaagtaaatataaggatacaagagcgattcaaaaagcattaaattacgcaaaaaaaggcagacacactgtttatatacctaaaggaacttattatatcagaaaagctttagttatttatgattctacaacattgttattggaagaaggtgcaacacttttaagaaaagggaaagatgcattattaaaaaatggtagacgcttaaagctatatcatggctataatggaaatagtcacatttatattaaaggaggaacttttgatatgaatggaggcgaatatccatataataatacagccatgtgcatgggacatgcagaagacattcaaattttaggtgtaacattcaaaaatattgttggagggcatgcactcgacgcatgcggaatcaatggtttacacatatcagaatgtgaatttaaaggatttcttgatattgatggagatcgttctttttctgaagcagtacaattggacatacaagtacctggtgcttttcctaaatttggaactacagatggaacgattacgaaaaatgttgtcattgaaaaatgttattttggctgttcagatcatcctaaaatgaaagcgtggaatagagctattggctctcatgccagtagatataactgctattatgaaaacattcatatcaatcaaaacatctttgataatttaaatgagtatgctttaactcctctaaagtcaaaagacacatttattacaaaaaataaatttataaattgtaatggtggaataagatttcttggagtgaaggatggtaaaaatgctgccgatcctattacaggacaagtgatggaaactcaagctggtgagaatttcaatgtgataggtaatacttttattggtaagatgaaaagagatgcgattcatattagaagttatcatcacgtccaacatcaaaacgtttttatagcggcaaatcaatttgaagatgcttcacaatcaatacatttagaaaatattaatggacttactttaaatcaggaacaaacaaaaatcaaaatcaagagtattgatgtgaaaaacatcagtaattaa

SEQ ID NO: 1856 - DNA, 546 bp, Staphylococcus epidermidis
atgaaactacattgtgcatatgctatattaattagaacaagagtgaaagtggtgactcaggtgcgaattcaaagtagatggttaatattcgctatttttttaactggagctatttctttattgataggtttgacttattacaaaagtataaaatctgtggatttatctggttacagtgtgaatcaaattagtttaaatcatggttttaatcaaaaaggatttgtggttaataagaaaattaaattagatagatataccttttacaatgataaaaatcataaagattttacagtaaaagtaaaaaataaaacgcataaggttaaaggcatggttttagtcaaagatgataaagttgaaacaaattttggtattaaaatgggtgacccaattgataaagtcatcaataaattgggagaaaactacaagattaataaagtagggaaaaattatcactcaatgacttatgtagaccgttttaataaattaaaattaaacattttatataaagataacattgttaaaagaattgagttctttagtaaataa

SEQ ID NO: 1857 - DNA, 687 bp, Staphylococcus epidermidis
cagacttttaaattaacaataattttctggcaaggggtgagcagcaatatgaaagccactagagtatttaatgttgtagtatttttacaattttccacctatttactatttggtatgaatatacaacttctttttgacaagaaagaatctgattaccttttctttattatacctttattttttacatatatatttgataactcatatacagtattaatagatttttgtaaaccaactgaaaaattaaaaaaagttgaaagtaataacataagatttataaatataattatgcttctagctataattatatatgcgtatatatataaaaataaaaaaattagatggttcaaggatttagtagattcagccaatgaaaactggtgtttatcaataattttaataataattatgtcgcttttaatttcatatatttggtctaaatattttattaaatcagattatatagaaaaattaaaagaagaagattttgatattcttggaatagaaaatgttattaattggttaacaaaatcaaatattaaaagtaaagatatttcagaaggtacaaatgttgagattgaaaaaatagaattacttcttaaagatgaaaaaaatattgatgatttttcttatggagaagtaaaatccattttggcttatgttaaatatgttagagaaagtaaataa

SEQ ID NO: 1858 - DNA, 1305 bp, Staphylococcus epidermidis
aaagaggttaagacaatgatgaatccattagcccaaaaattgaatgatgaaataaagcaatcaagtccagaagtattagatatgatgtcacaattaggtaaagatatgttttatccaaaaggaattttatcgcaatctgccgaagcaaaacgcacaacatataatgctactattggtatggcaaccaaaaaagaaggtaaaatgtacgcaaattcacttaaccaaatgtttaatgaccttacaccggatgaaattttcccatatgcacctcctcaaggtgtagaggaattacgtgatttatggcagaaaaaaatgcttaaagaaaatcccgacttaaagtctaaatctatctctcgtcccatcgttacaaatgctctcacgcacggtctttctctagtagctgatttatttgtagatacagatgataccgtcttattaccgacacacaactggggcaattataaacttgtatttagcacacgtcacggtgctcatatcgatacgtattctatttttgataactcaggtcacttcactacatctgaacttgtaaaaacattaaaagaatataaaaaagacaaagtgattattattttaaattatcctaataacccaactggttacacaccaaataaagaagaagttaatactattgtaaatgcaattgaagaactagctaataaaggtactaaagtagtaactgttgtcgatgatgcatactatgggttattttatgaagaagtttaccaacagtcgattttcacggctttaacacaggtgaaatcttcaaaccttttaccagtgcgtttggatggagctactaaagaattcttctcttgggggttccgcgttggctttatgacgtttggaattgatcatgaaacgttaaaaaatgcgctagaagctaaagtaaaaggattaattcgtagcaatatttcaagttctccactaccttctcaaagtgcaatcaaacatgtacttaaacatcatgagcaatttgataaagaaatcgatcaaaatatcaatattttaaaagaacgctacgaagtaactaaacaagtagtgtatgataataaatatgccaaatattggcaagcctatgactttaattcaggatactttatgtcattgaaattaaatcaagtcgatccagaagaattacgtgaacatttaattaataactattcaattggtattattgctttaaatagcacagatattcgtattgcctttagttgtgtagaaaaagaagatattccttatgtctttgagtctattgctaatgcaattgatgatattaaataa

SEQ ID NO: 1859 - DNA, 534 bp, Staphylococcus epidermidis
tttatggctaacacaaatagaaaaagcaaaaaaatgtcagatgctaaatgcatcaaaacaagacaggtatatccacaagataccaatcatcatcacacaatgttcggtggaactttaatggcaaatattgatgaaatagctgctattactgctatgaagcacgctggcaacccagttgttactgcatcaacagattctgttgactttttaagacctattacaactggagatattttatcatatgaagcaatggtttcttatgcaggaacaagttcgatggagatatgtgttcaaattgttattgatgatgtttataaaaacgagcgccacttggccgctttaagttttttaacttttgtagcattggatagtgatggaaaaccaacatcagtacctgatgttgaacctgaaacatctgtagaaaaatggttccatgaaactgcgccacaacgtgttgctagacgtaaagaacgtcgtaaagaaagtatagatacaattgaatatttatctagagttagacatatcgaaaagtaa

SEQ ID NO: 1860 - DNA, 627 bp, Staphylococcus epidermidis
catgattataaaaagatgaaaacttcctatagaaatcaattagaaaaaaattatgactccagaattactggtaaaagattaaacgaagagactttattattcttgggaactggtgcgattgcacaaagggctgcttatttagccaaagcttttggaatgaaagtaataggggttagtaagtcaggaaaaaatgttgaacattttgatgaagtttatacaattgaagagttagatgatgttattgaaaaggcaaatattattgttaatgcattacctgaaacagaagaaacaatttacttattaaaaagaaaagatttcatacaaatggacaataatgccttatttataaatgtaggaagaggaacaattgttgatgaggaagtgctcatcaatgtactcaaagatcgattaatcagacatgcttatttagatgtttttgaaaaagaaccacttagtaaggacaatcctttatatgatttagataatgtgaccataactgctcatattacaggtaatgattctaataataatagagaagctacggacattttcaaaaagaatcttgagcattttctcaataattatgatgtaattgagaataaagtagacttagattatggttactaa

SEQ ID NO: 1861 - DNA, 381 bp, Staphylococcus epidermidis
atggccaataagcaagttgaaatatctatggctgaatgggatgttatgaatataatatggaataaaaaatcagtatcagctaatgaaattgtagttgagattcaaaaaaataaagaagttagcgataagacgattagaacattaattacaagactatataaaaaagagattataaaacgctataaatataataatatttatttttactcatcaattattaaagaagatgatattaaaatgaaaactgctaaaacctttcttaataaattgtatggaggggatatgaaaagtttagtgcttaattttgcgaaaaatgaagaattaaataacaaagaaattgaagaattgcgagacattttaaatgatattagtaaaaaataa

SEQ ID NO: 1862 - DNA, 297 bp, Staphylococcus epidermidis
aaatcttgtaaagaggtgattgaaatgaatttagaaaaaatatatgaagaaatttcaaacgaaattaaggcaatgacagatgatgaaataaaagaagtcagtgatattttgtatgaatctaaactcttgaatgtagattattcaaatctaaaaagtttcaaagcagatacaaagcatagttataaagttaaggaaaatgagtataatgtgattgaaaaaaatatcaatgagaagccgaatttagaaaatcatgaagttaaccaagttaaaaataataatataattattgcagcatag

SEQ ID NO: 1863 - DNA, 303 bp, Staphylococcus epidermidis
aagagaggtaattcaactatggaaaataaattagtacctggtattttaattggtgccgtaattggtggcgcggctgctcttgctgataaatctacacgtcattctttaaaacaatcattcaaagacatcaaagaaggaaatcgtacacgtaaaccttcaaaaataagtagcatcaaagatgaagtaatgtattggaaagatacattagatgaaatacgtcgtaataatcctgaattagaacgttctattaaagatgccaaagaaacttttgtaaatcgtaaaaatcaacgcttaggtaaataa

SEQ ID NO: 1864 - DNA, 1395 bp, Staphylococcus epidermidis
tttggaggtaattttatgacaataattagagataaatttaacaatagtaaagctttttttaatacgcataaaacaaaaaaccttaaatttcgaaaacaacaacttaaattactaagtaaaaatatcaaaaatcatgaaaatgaattattagatgccttatataaagatttaggtaaaagtaaggttgaagcatacgcaactgaaattggtatgcttttgaaaagcataaagctaatgcgcaaagagttaaaaaattggtcgaaaaccaaacaaacggatacaccactctacttattccctacaaagagttatattaaaaaagaaccttacggtacggtgcttattataggaccatttaattatccggttcaattagttttcgagcctctcatcggagcaatagctgccggaaatactgctatagttaaaccttcagagttaacacctcatgttgccattgtgatcaaggacatcattgaagatacatttgatgaagcatacgtttctgttgttgaaggtggtattgaagaaacccaaacgttattaagtctaccatttgattatatgttctttactggcagtgaaaaagtcggaaaaattgtctatgaagctgcagcaagaaaattaattccagttactcttgaacttggcggtaaatcacctgtcattgtcgatgatacagccaatatcaaagtagcgagtgaacgtattagttttggtaaatttactaatgctggtcaaacatgtgtcgctccagattatatattagttcagcggaaagttaaaaatgatttaataaaagctcttaaaaaaacaattactgaattttacggagaaaatattgaaaaaagccctgatttcggacggattgttaatcaaaaacactttaatcggttgaatgacttgattcaaattcataaagataatgttgtttttggaggtaatagttctaaagaagatttatatattgaacctactttattggataacataaccaatgacaataaaatcatgaaagaagaaatattcggtcccattttgcctattattacttatgataatttcgatgaagtacttgaaatcatccaaagtaaatcaaaaccactaagtttgtatctttttagcgaagatgaaaacatgacacatagagtggttgaagaattatcatttgggggcggtgcaattaacgatacgttaatgcatttagctaatcctaacttacctttcggtggtgtaggttcttcaggcataggtcaatatcatggtaagtattcttttgatacatttagtcatatgaaatcatacacatttaaatctacacgtctagaatcgagtttatttttccctccatataaaggtaaatttaaatatattaaaaccttcttcaagaactag

SEQ ID NO: 1865 - DNA, 201 bp, Staphylococcus epidermidis
accacactcaatagcatcactttatataatattgtttgcggtctatttagtacaatgttacaatttaattgtatccacgtattatactacacaaccccaagtctggtaccagcagacttggggttttttggtcatctatttgcctttccattttatttccaaccaaatacgaaagacaatgagtatgccaccggtaattaa

SEQ ID NO: 1866 - DNA, 588 bp, Staphylococcus epidermidis
cgctttttaaacacatattgggaggctgttctaatgagtaacaaagcattaatcattgtagattactcttttgattttattgacgataatggtaaattaacatgtggcaaacctggacaagaaattgaaacttttattactcagcgtataaaaaattatcataataatcaacaggaaatatttttcctaatggacttgcattatgaaaatgataaatttcatcctgaaagtaaattattccccaatcataatattcatcaaacaccaggtcgtgagttatatggcgaggtaggtagattatacaactcaattaaagaccaaatgaatgtacattatttagataaaacgagatacgattcattctacggtacaccattagatagtttattacgtgaaagacaaatcaatgatattgaaattgtgggtgtttgcacggatatttgtattttgcataccgctgtttcagcatacaatttaggttataacatcactatcccaattagaggcgtagcatcttttaatcaagatggtcatcaatgggcactctcccattttaaaaattctcttggtgcaaaagtagaagaataa

SEQ ID NO: 1867 - DNA, 387 bp, Staphylococcus epidermidis
  unsure (110): Identity of nucleotide at the above locations are unknown.
atgaaaataaaacagttttcttttcaacacatattatttctgatttggaaaaaattgcagattatatcgttttttctcagtgagggtgaaatcatattcaatgagtctanggataaactatcgcaaaaataccaaatccttaatggttctaatgaacacggacatgaagagttggacgaacttttgatttacaaagaaagtaagcaaacaggctatattggtttaacagaatattatcaaacatttaatgaattgtttggtagtggtgttgaaataaaagatgcatctatagaacaattgatgatttatttagaaaaaagtaaacataaacgaaatacaaattcaaaatacaaagtgagatttaactatgaagcaattaatgattag

SEQ ID NO: 1868 - DNA, 1623 bp, Staphylococcus epidermidis
actatggcaaaagatcttaaattctctgaagatgcgcgtcaagcaatgttacgtggtgttgataaattagcaaacgctgtaaaggttacaattggacctaaagggcgaaatgtggttctagataaggattacacaacacctttaattaccaacgatggtgtaacaattgctaaggaaatagagttagaagatccatatgagaatatgggtgcaaaattagtgcaggaagttgcgaataaaacaaatgaaatcgctggggacggtacaactacagcaacagttttagcacaatcaatgattcaggaaggtcttaagaatgttacaagtggtgcaaatcctgtaggcttaagacaaggtattgacaaagcagtgcaagtggctatagaagcgcttcatgagatttctcaaaaggttgaaaataagaacgagatagcgcaagttggagctatttcagcagcagatgaagaaatcggtcgctacatttctgaagcaatggataaagtaggtaacgatggcgttatcactattgaagaatcaaatgggtttaatacagaattagaagtagttgaaggaatgcaatttgatcgcggttatcaatcaccatatatggtaactgactcagataaaatgatagctgaattagaacgtccatatatattagtaacggataagaaaatttcatcattccaagatattcttccattattagaacaagttgtgcaggctagtcgaccaattttaattgttgcggatgaagtagaaggcgatgcacttactaatattgttttaaaccgtatgcgtggaacatttactgctgtagcagttaaagccccaggatttggtgatcgacgtaaagcaatgttagaagacctagcaatattaactggtgctcaagtcattactgatgatttaggtttagaacttaaagatgcatctcttgatatgctaggtactgctaataaagttgaagtgactaaagatcatacaacagtcgtagatggtaatggtgatgaaaataatattgatgctcgtgtaggtcaaattaaagcacaaattgaagaaactgattcagagtttgataaagaaaaaattacggaaagtttgggaaaactacctgggggggtagctgttaatcaagtatggggtggcagtgaaacagagcttaaagaacgtaaattaagaattgaagacgcattaaattcaacacgtgcggcggtggaagaaggtatcgttgctggtggtggtactgcgttagtcaatatatatcaaaaagtaagtgaaattaaagcagaaggtgatgttgaaacgggtgttaatatcgtattaaaagcattacaagcacctgttagacaaattgctgaaaatgcaggattagagggttcaattattgttgaacgtttaaaacatgctgaagcgggcgttggtttcaatgcagcaacaaatgaatgggttaatatgttagaagaaggtatagtagatccaactaaagtaactcgttcagcgttacaacatgcagcaagtgtagctgctatgttcttaacaactgaagcagtcgttgctagtattccagagccagaaaataatgaacaacctggaatgggtggcatgccaggtatgatgtaa

SEQ ID NO: 1869 - DNA, 354 bp, Staphylococcus epidermidis
aacaataaaaaatattctggagggttaattttgaaaattgttagcttaaatagattaaatgaaatagaaaatgaattaagaaaacaatttccaaacgaagaatttaaattttatgacaaagctataaatatccctattaatgatagaaaaactatggacattttaataggttatgatggcaaaatagatcgtacctttattgaacattgtatcaaccttaaatggattggatggtttgcaacaggtgtaaataatttaccgttaaattatattaaagagcgagatatcattctaagaaatggtaaaggtatacaagctaaacaagtgtctgaatatataaagacattcatttag

SEQ ID NO: 1870 - DNA, 840 bp, Staphylococcus epidermidis
agaatgaaaaagctttttattagtggtttaatcatatttattattttctttgctagtggtgctatgacgtggtttactatagataaaaataaatacgataatcgacattataccaaaacaataaatagcaaaattgaacatttatctataagtacagtaacaaccaatgttaatataatttctggaaaaaaattagctgtttattttactggagataataaaataaatgttacaaaaaataataaaaggttaagtattaaagaaaaacgtgcagtagatagaggatatggattaaattttaatccatttcactcaaacaatagaaagctaacaattgttgtaccagaaaaagaccttaaatctcttaatattcaatcgttattgggagaaattgatttaaatcaagtgaatttgaaacatgtttcattggaaacagatagaattatacaacttaaacgatctgaactcaatcaggtaaacatcgaatcttctaaagcaaatttttatattacagactgtttaatcagggaaggtcgtatgaagcttgataagggtataactcatgttaaaaatagtacattaagtgatactgttttcttggttaatagaggagatatttctatgacggacatgaaatctaacaatgatataaaagcttctacacaaagaggtaatattaattatcattttggcgaaaaacctaaaaacactttgcttaaacttcatcctggtcatggaaataaagaaattaaaaatcgatatttcgataaaggaaaagtgggaaatagcgataatatattggaattttacactgtagatggcgatattaaaattgaataa

SEQ ID NO: 1871 - DNA, 327 bp, Staphylococcus epidermidis
gaaaaagaaaaaacaaaggtaccaaacgaatatttaagaatttttgatactattcagaactcaacagataagtatataactaagtccaagatacttaacttaatggggtacgagtataattcatctaatgaaagatggttaagaaatgctataagcaaattgattgatgattatagttaccctataggatgtagctataaaaaacatgaacgtggttattacatcatcactactgatgaagaaaaacaacaagcaatgcaaagtattaaaagattagcagacggtagtatgaaacgttatgaggctttaaaacgtattaaattataa

SEQ ID NO: 1872 - DNA, 642 bp, Staphylococcus epidermidis
gaaaagaggaataatatgtcagcaattgctcaaaatccatggttaatggtcttagcaatttttataattaatgtatgttatgtcacatttttaacaatgagaacgatattgactttgaaaggttatcgttatgttgcagcagtagttagttttatggaagtcttagtttatgttgttggtttagggttagtaatgtctagcctagaccaaatccaaaatatttttgcttatgcattaggattctcagtcggtattatagtaggaatgaaaatcgaggaaaaacttgcgttgggttatacagttgtcaatgttacttcatcggaatatgagttagatttaccaaatgaattaagaaatttagggtatggtgtaacccactacgaagcatttggtagagatggaagtcgaatggtaatgcaaatattaacaccaagaaaatatgaattaaagttaatggatactgtcaaaaacttagatcccaaggcatttattatagcgtatgaaccaagaaatattcacggaggattctgggttaagggtgtacgtaaacgtaaactgaaagcttatgaaccagaacaactggaagttgtagtagatcacgaagaaatagtaggtggtagctcaaatgagcaaaaagtttag

SEQ ID NO: 1873 - DNA, 576 bp, Staphylococcus epidermidis
actgtaattgaaccatacaataaatataggagtgaaaatatgaagatttttaaattgacgtcattgacactagctgctttaacgttagcctttccgttttcacatgtcgcacaagcacatacttacttagaaaagcatcaccaaacaaacgaaaccaaacaatctcatagcttttctttagaaggtgaggctggtgaaaatccaacatttttaactcaacctcaatttattaattccctagataatggtcatttaaatattaatggttatcagattcagcaagatgatactaatgatattgaatacaaaaaggtttatgatcaagaaattagagctacaagcaatcatacagcgataagtgtacgtttcagtattaataatcaatcactatcacttgaaagtatgaaagatgcatacccaaatgagagattgaatcatattccacatacaagcaatgattcacaatatccagaagacggtatatatgtctatcacggtaaaatgattaaattacaatacaaagtgacacatggatttgttacgagcgtgacgataggtgaaggtgtagacgaatag

SEQ ID NO: 1874 - DNA, 432 bp, Staphylococcus epidermidis
aatgatgatgaggtggtaaacatgattccaaatcctaatgcgccagatgaatataaatatgaaactgattatagaaaaataccaagaaaatatttaaaccctaaaatccctcaagggcgtggaaaaatcaaatggcaagcttttgcgactctcccgcaacagtttgaaattttagaacaaattataaaggatcaaaataaaatagaaaaaccattgctaacacatgattcattagataatttagatcagatttttcaaataaaaattcaaaatgatgagttatgtacaatctcatattgggaagacggtaacatttcaaaatatacaggaaaaattttaaaaaaggatgaaattagtaatacattttccttttctgatactaacaataatatatataatttaaataatgctaacgtttgtagtatcacttaa

SEQ ID NO: 1875 - DNA, 1293 bp, Staphylococcus epidermidis
gatatggatgatattaatttatttccgtttgcaggcctacaaatctttttaatgatttgggttactaaagttatcattaatatgaaatttaattttagggattacataatcgtttttacgattgtaatcccttctgctataatgtattacttttggcaaagtaaagcattaatagttttggttataataatcataattttcttttatacaaaaataaaactttattcaatattagttgtattattcacgactatgatcttatatataactaatttcataactgtatacatacatttaactataaaagattatattccgtttaaatttgttttacagttaatacattttaccttttttgtaatcataactctaatcattgcttatttaactcaactattgttcaataaattaaaagtatcctatctgtcactcaataaaagatacttattcataataacaattgtactttttatatcatttattttactttatatggtgtcacaaactgatatgcgaggaaatgatacacttaaattatatgccatcttgttgatgggtattatggtttttttaagtgtagtgattttagtgatgtccaattttacacttcgtgaaatgaggtataaacgtaatgtaaaagaaatcgaagcatattatgaatacacgttacgtatagaaagcattaacaatgaaatgcgtaagttccggcatgattatgtgaatatcctcaccactctttcagattacattagagaagatgatatgcctggattacgtaaatattttaatgaaaatatcgttccaatgaaagataaattaaaaactcgctctattaaaatgaatggtattgaaaagttgaaagtgagagaaattaaagggttgattactactaaaattattcaagctcaagaaaaacgtattccaattagtattgaggttcctgatgaaattgatcgtatcgatatgaatactgttgagcttagtcgtattatcggtattatagttgataatgctattgaagcttcagaaaatcttgaggaaccactcataaatatcgcattcatcgataatgaggaagctgtcacttttattgttatgaataaatgtagtgatgatattcctaaaattcatgagttgtttgaacaaggtttttctactaaaggtgataatcgcggtttaggtttatcaactttaaaagaactgacagactcaaacgagaatgttttattagatactgtcatcgaaaatggttactttgtacaaaaagtagaaataaataataaggaatcataa

SEQ ID NO: 1876 - DNA, 1092 bp, Staphylococcus epidermidis
tgtttacgtttcatcattcattggagacgtagaggtgatttacagatgaatcactacataagagctataggctcaatgcttatattagtatatagtatgcttattgcttttttatttattgataaagtgtttgtaaatattatcttttttcaggggatgttttatacacaaatatttggaatacctgtttttctatttttaaatttattaattgttcttttatgtattatagttggatctgttttagcttataaaattaatcaacaaaatgattggattatttcacaaatagaaagatcaatagaaggacaaacagtaggtatcaatgatcaaaatatcgaattatatacagaaacgatagatatttatcatacactagttccattaaatcaagaattacatcgacttagaatgaagactcaaaatttaactaatgaaaactacaatattaatgatgtaaaagtcaaaaagattatcgaagatgagcgacaacgacttgccagggaattacatgattctgttagtcaacaattatttgctgcgagcatgatgctatcggcgataaaagagtcgaaattagaaccacctttaaatcaacagataccaattcttgaaaaaatggttcaagactcacaacttgaaatgagagctttgttattacatttaagaccgataggtttaaaagataagtctttaggtgaaggaattaaagatttagtcatcgatttacaaaagaaagtaccaatgaaagttgtgcatgaaattcaagattttgaagtgccaaaaggcattgaagatcacttgttcagaattacacaagaagctatttcaaatacattgagacattcaaatggtacaaaagtaactgtggaattatttaatcaagaggattatcttttactaagaattcaagataatggaaaagggtttaatgtagatgaaaaatttgaacaaagttatggtttgaaaaatatgcgagaacgagcgttagaaattggtgcgacgtttcatattgtatctttacctgattcaggtacacgaattgaagttaaggcaccattgaataaggaggagaattcaagtggcgattaa

SEQ ID NO: 1877 - DNA, 474 bp, Staphylococcus epidermidis
gaaataggtgagtatatgattagtaaaggtgaacaatttccctctttttctttagaaaatcaagatggcaattttatttcaaatgaaacaattaaaggtcgtaaaacgattctttatttttatccaagagataatacaccaacgtgtactactgaagcttgtgaatttagagatcacattgaagattttaatcaacttgatgtagatatatatggcataagcgcagattctaaaaagaaacatcaaaattttataaaaaaacaccaattgaattttgacttactcgtagataaagattatcaacttgctaataaagttggggtttaccaattgaaaaaatcatttggcaaggagaatatggggattgtaagaacaacatttattctcgatgaaaatggtaacattattgatgtgattgaaaaggtaaaggtaaaaacacaaattgaaacaataaaaaatattctggagggttaa

SEQ ID NO: 1878 - DNA, 1029 bp, Staphylococcus epidermidis
agtcttttcgaatttccttttcttaagaggagtcagtatgatatgaatgataaatggtatagacatataattggagcgcgaactattaaaactggtttggctactttttttacgtctttattttgtatgttgttaaacctcactccaatttttgccatacttactgcaattgttacaattgaacctactgctaaagcatcattaaaaaaggggtataaaaggttgccagcaacagttattggtgcgttatttgctgttgtctttacatatgtcttcggtgatcaatcaccgttaagttatgctttaagtgctacatttaccattctgatatgcactaaacttaatttacaggtaggaacaactgtcgcagtattaacttccgttgcaatgattccaggtatacatgaagcatatgtgttcaatttcttttcacggttacttacagctcttataggacttgttacagctggattagtcaattttatcatcttaccacctaagtattatcatcaacttgaagagcaattagcccttagtgagaaaaaaatgtatcgtttattttatgaacgctgtaatgagttattattaggaaaattcagctcggaaaagactagtaaagaattatcaaaattaaatattattgctcaaaaagttgaaacattaatgagttatcaaagggatgaacttcattatcataaaaatgaagataattggaaattattaaatcgccttacaaatcgcgcttataacaaccgtttatttatttcacatttatctaacattatttatttacccaaacatacgtctattgcttttgatgctaatgagaagatagcattgattaatattagtaatagtattaatggcatcattcaaaaaggaagctttgcacgtcaaaaaaaatctattgcaacactaaagtcttctgttaaacagatggatgagtttgaccaaaatcaaatgaaaagtacactcatatatgaaattctactcatatacaaaattttagattcacgttatgcaaaataa

SEQ ID NO: 1879 - DNA, 315 bp, Staphylococcus epidermidis
gggttgttcgagatgcaaattgaaaaattaagaggtcagtcattagatgaattatttgatgcgatcttagcactagaaaacagagaagaatgttatcagtttttcgatgatttatgtactgtaaatgaaatacagtcattatctcagagacttcaagttgctaaaatgattaagcaaggttatacttatgcaactattgaagaagagtctggtgcatcgactgcaacgatttctagagtaaagcgttcgttacaatggggtaatgatgcttatacaatgattttggatagactaaatattgaaacaaaggcataa

SEQ ID NO: 1880 - DNA, 1272 bp, Staphylococcus epidermidis
gacagcttagacaagatatggaggattaatatgacgaattatcataataagttaaaacaatatgcagaattattagtaagagtgggaatgaatgtacaaccacagcaacctgtttttatacgttcatctgttgaagcgttagaattaactcatttaatcgtcgaggaagcatataaagcaggggcagaagatgttcgagtgagctacacagacccgaaattaaaaagattaaaatttgaaaacgaatcagttgaacactttgaaaaacaagaactcaaacaatatgatattgaagagcgtctggattatgttaatcgtggcgcagcgaacttggcgctcattgctgaagatccagagctattaaatggaatagatgcgcaaaagttaaaagcgtatcaaactgtatactcaaaaggatttaaaccatatatggaagcaagtcaaaaaaaccaatttccatgggtagtggctgcgttccctactagggattgggcacgtcgtgtctatccagagttggatgttgaatcagcatatattaaattcattgatgaagtatttgatattgttcgtgtagatggacaaaatccaattgaaaattgggaaaaacacattaaagatttaagtgttcatgctaaacgattacaagagaaaaactatcaagctttacattacatatcagaaggcacggatttaatagtagggttacctaaaggacacatatgggaagatgcaacaagttatgtaaatggggacggtcaacctttcattgctaatatccctacagaagaagtttttacagctccagatagaaacaatgttaatggatatgtaaccaataaattacctttaaatcttaatggtaacattatagacgggtttacattgacttttaaagatggtgtgataattgatgtcaaagcagaaaaaggtgagaaattacttaaagatttaattgcaactgatgaaggtgcttgtagattaggtgaagtagcactagtgcccgatgattcaccaatatcaaatcgacgcacaatattctataacactctttttgatgaaaatgcatcatgccacctagctatagggtcagcttatagttttaatatcaaaggtggtactgaaatgactacagaagaaaaaattgcaaatggactcaatgattccaatattcatgaagatttcatgattggtagtcctgatttaacaatttatgggatattgcaagatgaaacaaaagaattagtttttaaaaatggaaattgggctaaatag

SEQ ID NO: 1881 - DNA, 1068 bp, Staphylococcus epidermidis
atgctaatagataaagcaagatcatttattcagaccatgtatagcgaattaaaatataatactaatgaagttgaaaatagaatgaaagagattgagcaagaaattaacttgactggtagttacacacatacttatgaagaattatcttacggtgcaaaaatggcatggagaaactcaaatcgttgtattggtagactgttttggggttctttaaatgttaaagatgcccgagatgtatgtgacgaaaaagaatttataaaatttatacatacacatattaaagaagctactaacggtggaaaaatcaaaccatatattacaatttttagtcctgaagatacacctaaaatttataataatcagttgattcgttatgctggttatgaaaatgttggcgatccatctgaaaaaaaggttactcgtttagctgaacatctaggttggaaaggtaaaggttcaaattttgatattttacctctgatttatcaattgcctaacgacactataaaaatacacgaacttccaagtgatattgtaaaagaagtttctatacatcatgaacactatcccaagctttcaaaattaggtttaaaatggtatgcggtacctattatttcaaatatggatttaaaaatcggtggtattacttaccctacagcaccttttaatggatggtatatggtaaccgaaattgctgtacgtaatttcacagacacctatcgttataatcttttagaaaaagttgcagaagcttttgaatttgatacacttaaaaataattcatttaataaagatcgagcactcgtagagttaaatcatgctgtgtatcattcatttaaagctgatggtgtttctattgttgatcacttaactgcagcgaagcaatttgaaatgtttgaacgaaatgaacatcaacaaaacagagatgttactggtaagtggtcttggctggcacctccactttcaccaactttaacttctaactatcatcatggatatgataatacaatgcatcatacgaatttcttctataaaaaagaagaacctatgaagtgccctttccattaa

SEQ ID NO: 1882 - DNA, 318 bp, Staphylococcus epidermidis
tttgtgatagagcagtatttccttagagatggtaagttcgttcaagatgtagatatgaaagatgggggaccagaggatagtactattcttactttacaaaaagatgactttaataaagctttagattctctttctgaaaactttaaagtacagcagtctcaaaaagaatcgggagaaattatcattaaagctcaaaatgattatagagagttacttaaatcgttatcccaactagatatttatccaaaatatattgaaacacgtaaaagttcactacgtgatacttactttaatattaatcaaagaggtgataaataa

SEQ ID NO: 1883 - DNA, 744 bp, Staphylococcus epidermidis
aacgagcaagacaagaaaaacttttacaagcaaattaaaaagaaagaggtatgtattatgacaacaactacttatcaaggtacatcacaagacgtatggaatgtattattcgataacagaaaatataaaggtctattagatgaagtaaataaattaattgaagatactaaacgtttatacaagcaaggctatcgtttagaggctatagacgaacaacaaaagcccaaagttactgaactcgaaaataaattcaaacagtttgctacagatagattaaatgaaatagagcaacgttgtaatgagattgagaaagaaagccaacaagataatgttaaagatccacaaaccgaaattattaaacgtcagaatttagaagctagattatctttctataacgataatgagattgtagactacatcaatagtaaagatgtaacgagcactgacatttatgaattaagcttgttgcaacaaaaatatgacaatcaattaaacgaatcacaacaacgtcaagttgcatttaaactcgaagaattaaaacaaggtgttttatatccatacactacaaatgaagagtacaagaacttaatgtttgaatatagtgtcataaaccaaactggaatggctaaaactggtgtagttattactaagaatgaacagtatggtggcgttgaaatcaaacaacttactgaacgttataaaaatgctattaacgaagtgaaacaaagtaataatagaagataa

SEQ ID NO: 1884 - DNA, 981 bp, Staphylococcus epidermidis
gcatttatggacacagccacacatatcgttatgggtgtgggtcttacagctttagcaacgcaagatccagttatggcagaatcatttgctgctactgcgacgactttaatcgcaggttctttaataccagacggtgatactgtattgaaattaaaggataatgcgacatatatttcacatcacagaggaatcacacattcattaccttttacaatattatggcctatattaattacattttttatatttgtaatatttagccaaacgaatcctttacatgtatggttatgggcacaactagcagtgtttttacatgtctttgtagatatttttaattcttatggtacacaagcattacgtcccataactaacaaatggattcaattaagcgtgattaatacctttgatccgataatattcattattttaagtaccggtgtcttattgtggatattaggtattcacccgtatattgttttctttccaattatattaattctcataggctattatattgtaagatttaagatgcaagcagcaattagaaaacaagcactccaaaaaattgagcaatcgcatacaccagtaaaagtattcgtagctccaacaataaaatttcatgtatggcgggtcgcaatacaaacagataagcatgattatgttggtgtttccaaatggaaaaatgtagatttcactgataaagttaaacgccagtctatgactcctgattcgatattatggaaagttaaaggtaataaagatatatatacatttttaaacttttcttcaatttaccgttggcaaactacaccattagatgatggcacaacagaaattcgacttatggatttacgatacttaaataaaggtcgttattcttttgtagctattgcacatttaacacttgaaaatgaaattgatcactcttatattgggtgggtatttagcgaagataaattacaacgtaaattattttcataa

SEQ ID NO: 1885 - DNA, 453 bp, Staphylococcus epidermidis
gtgagtgcggaacttgaatctattgatcatgaacttgaagagtcaattgcttcattaagaaaagcgggcgttcgcattacaccccaaagacaagcaattatgcgttatcttatatcttcacattcacatccaacagcagatgaaatatatcaagcactttcacctaaatttcctaatataagtgttgctactatctataataatctaagagtttttaaagatattggtatagtcaaagagttaacatatggtgattcatctagtaggtttgattttaatacacataatcactaccatattatatgtgaaaaatgtggtaaaatcgttgacttccattatccacaattagatgaagtagagcaattagctcaacatgtaacagattttgatgttactcatcatcggatggaaatatatggagtatgtaaagaatgtaaagaagaaggaaattga

SEQ ID NO: 1886 - DNA, 777 bp, Staphylococcus epidermidis
tttataaaggaacgggataaaatgattgttaaaactgatgaagaattacaagcgttaaaagaaataggttacatttgtgcaaaagtcagagatactatgaaagaagctactaaacctggagtgactacccgtgaattagatcacattgccaaagatttatttgaagagcatggggcgatatcagcgcctattcacgatgaaaacttcccaggtcaaacttgcattagtgttaacgaagaggtcgcgcatggaatccctggtaaacgagtaattcatgaaggtgacctagttaatattgatgtatcagctttaaaaaatgggtactatgctgacactggaatttcatttgttgtagggaaatcagatcaaccacttaaacaaaaggtttgtgacgtagccacaatggcttttgaaaatgctatgaaaaaggtgaaaccaggtacaaaattgagtaatattggaaaagctgttcatgcaactgcacgccaaaatgacttgactgtgattaaaaatttaactggacatggtgttggacaatcacttcatgaggcacctaatcatgtcatgaattattttgatcctaaagataaaacattattaaaagaagggcaagtcattgcagtagaaccattcatatcaacacatgctacatttgtaactgaaggtaaaaatgaatgggcttttgaaactaaagataaaagttatgtcgctcaaattgaacacacggttatagttacaaaagatggtccgttacttacaactaagattgatgattaa

SEQ ID NO: 1887 - DNA, 1197 bp, Staphylococcus epidermidis
aaagcaaaggagattgttatgtcaaaaaaagagaaaacaacttctaaatatcttaattcaatagaagataaagagcataaaaagaataaaaaaatagaagttgaccgtacatatatagaacctcaagaattccaatctaagaaacctaaaaaaaagaatcaagtattttttgtttcccggctgaataaaccagcaaaatacaccgaaaactctaatttcttttcttacctgatttataggataggtaaagatgacgctgcaggtttagcagcacagatgacatatcattttgtattagcacttttcccaatgctaatttttttacttacgctacttggtcaatttatcacgattgatgctaatcagattaatcaaaaagtaagtcaatatgtccctgatcaagaaacagctagcatcgttggtggaattgttaaagatatctctgacactgccagtggaggtattttgtcagttgggttaattttagctatttggtcagcatcaaatggaatgtccgctattattaactcatttaatgttgcttatgacgttgaggattctcgaaacggtgtagtagttaaattattaagtattctatatacacttgttttaagtgcagtatttgttgttgctgtagtacttataacactaggtccagtcattaataaatttttatttggaccactaggtattgataatcaaattgaatggatttttaatttagtacgaattgttattccattgattattattttcatcatatttactgtactttattcagttgcacctaatgttaaaacaaaattacgttctgttattcctggcgctattttcacttccattatttggttactagggtcctttgcattcggttactatatttcaaactttagtaactattcgaaaacatacggaagtttagctggtattatcattttattcttatggttgtatatcacaagctttattattattatcggtgctgaaatcaatgcaattattcaccaaagaaaagtcatagctggtcacacgcctgaagaagccgctattaaacatgatgataacaatgaaaatcactataacgaaaatacgacttatgaatactatgaagatagcaaagatgtagatatctctaatgaagatgacacgtataatatcaatcatcaatctaaagaagaacatcacacaagcgactga

SEQ ID NO: 1888 - DNA, 198 bp, Staphylococcus epidermidis
aaagatgaactaacaaattaccgttgttgttacacttcatttatgaatttttatagattacttttacaatataaaatattttattcttatttacatctattttgcttaataatctctaatttttttataacgttctttccatacctttataaagtcaggagcaaaaggcccctttttttgttctatccattgttgtaa

SEQ ID NO: 1889 - DNA, 624 bp, Staphylococcus epidermidis
ggaggacgactaatgaacgcgatagaacttaaagatgttaattatcgatctaacgcatttcaattgcaagatgtctccttcaatgttcctaaaggatatgttacaggttttataggtggaaatggtgcggggaaaactacaataatacgattaattatggatttaattcaatctgaaagtggtacaatctctgtttttgagaaagatataaaaattcatcctcgtgaaataaaaaataaaattggatttgtgtattctgagatttattttaatcaaaaatggacagtaaaaaaattagaaaatatcattgcccctttttatgatcgttgggatcatgaaatatttataaagtatttaaaattttttcagctgccatataaaaataaaataaaaactttctcaaccggtatgaaaatgaaactatcgttagcaattgcattcagtcatcatgcagaattatttatcttagatgaaccaacttcagggttagacccattaataagaaatgaattacttgaaattattcaacaagaattgatagatgaaaataaaacagttttcttttcaacacatattatttctgatttggaaaaaattgcagattatatcgttttttctcagtga

SEQ ID NO: 1890 - DNA, 1476 bp, Staphylococcus epidermidis
ctgatattacgcctgataagcaataaaattattacgacatcaaatttaaggttaggaatgccacacattatattcctaacctttttgtatgtgggagggaaaaaattggaaacaattaagaaaaacgaagttaaaacgggaaaggttattgatttaactcatgagggacacggagttgttaaagttgatcgatatccaatttttattcctaatgctttaattgatgaagaaattaaatttaaattaattaaagtgaaaaagaattttgctataggaaaattgatagaggtcataagtgaaagtgatgatagagtgacaccaccttgtatttattatgcaaagtgtggtggttgtcaattacaacatatgacatatagagcgcaattggatatgaaaagagaacaagtagttaatctttttcatagaaaaggcccttttgagaatacggttataaaggaaactattggcatggtcaatccctggcgataccgtaataaatctcaaattcctgtaggtcaaagtaactcgaatcaagttataatgggattctatagacaacgtagccatgacattatagatatggatagttgtcttatacaagatagacaacatcaagaagtaatgaatcgagtgaagtactggctcaatgaattaaatatatctatatataacgaaaaaacaaaaacaggtttaatacgtcatttagtagtaaggactggttatcataccgatgaaatgatggttatctttgttacaaatggagcaacatttaaacaatcagaactattagtaaacaagctaaaaaaagaatttccaaatataacaagtattaaacagaatataaacaatagccattctaatgttataatggggcgtcaatcaatgactttatatggtaaagataaaattgaagaccaattaagtgaagtaacttatcatatttctgatttatcattttaccaaattaactcatcacaaactgaaaaactttatcagcaagctctgaattatgctcaattaacaggaaaagaaatagtattggatacgtattgtggtataggaacgattggtctatatatggcaccactagcaaaacatgtttatggtgtagaagttgttccgcaagccataaaagatgcggaagacaatgcgactaaaaaccaacttaaaaatacgactttcgaatgtggaaaagcagaagatgttatcttaacatggaaatcacaagggattaaaccaggcgtagtcatggtagatccacctagaaaaggatgcgatgaaactttcttaactactcttttaaaattaaatccgaaaaggattgtttatatatcatgtaacccttcaacgcaacaaagagatgcgcaaatattggctgaacaatacgagttagtagaaattacaccagttgatatgttcccacaaacaactcatattgagactgtagcattatttgtacgtaaagacgaagagtga

SEQ ID NO: 1891 - DNA, 2190 bp, Staphylococcus epidermidis
atgaatgcgctagtaaaaaatatgaattcagagcaaagtgaagcggttagaacaacagaaggcccattgcttattatggcaggtgctggatcaggaaagacacgtgtgttaacacatcgcattgcgtatttattagatgaaaaagatgtatcaccttataatattttagctattacgtttacaaataaagcagctaaagaaatgaaggcgcgtgtcgaacatcttgtgggagaagaagcgcaagtgatttggatgtccacttttcactctatgtgtgtaagaattctgagaagagatgctgatcgtattggcattgaaagaaatttcactatcattgatcctaccgatcaaaaatcagtgattaaagatgtattgaaaagtgaaaatatagacagtaagcgatttgagccacgtatgtttattggtgcaattagcaatttgaaaaatgaattaaaaacacctgaggatgctcaaaaagaggcgaatgattttcactctcaaatggttgcaacggtttacaaaggttatcaaagacagttatcacgtaatgaagcactcgactttgatgatttaattatgacaactattaatttatttgaacgtgtacccgaaactctagaatactatcaaaataaatttcaatatatacatgtagatgagtatcaagataccaataaagcacaatataccttagtaaaactattagcaaacaaatttaaaaatttatgtgttgttggtgattctgaccaatctatttatggttggagaggagctgatatacaaaatattttatcttttgaagaggactatcctgaggcaaagacaattttcctcgaacagaactatcgttcaactaagaatattttaaatgctgcaaatgaagttataaaacataattctgaacgtaaacctaaaggtctatggactgcaaattctggaggagacaaaattcagtattatgaagctatgactgaaagagatgaagcagaatacgttgttaaagaaataatgaagcatcaacgcagtggtaaaaaatatagtgaaatggctatattatatagaacaaatgcccaatcacgtgtacttgaggaaacatttatgaaatcaaatattccttatacaatggttgggggtcaaaagttctatgaccgtaaagaaattaaagatttacttagttatttaagagttattgctaatagcaatgatgatattagtttgcaacgtattattaacgtgcctaaacgtggtattggaccttcatctgttgaaaaaatccaaacctatgcacttcaaaataatataagtatgtttgacgcattggctgaggtagattttataggtctctctaaaaaggtaactcaagaatgtatcagtttttatgaaatgattcaaaatttaatcaaagaacaagaatttctcgaaattagtgaaatcgtagatgaagtactacaaaaatcaggctatagagacatgcttgatcgagaacaaagtattgaatcacgaagtcgattagaaaacttagatgaatttatgtctgtacctaaagattatgaggaaaatactcctttagaggaacaatcacttattaattttctaacagatttatcattagttgctgatattgacgaagcagatacacagaatggtgtaacattgatgacaatgcattcagcaaaaggtcttgaatttcctatagtttttattatgggaatggaggagtcgttgttcccacatatcagagcaataaaaagtgaagatgatcatgaaatggaagaggaacgtcgtatttgttatgtagcaattacacgagcagaagagttgctttatatcacaaatgcaacgaccagaatgttgtttggtcgttctcaatccaatatgccatctcgatttttaaaagaaatcccagaagacctacttgatagtcataccggtcaaaaaagacaaactatatatcccaaatctcaacctaaaagaggttttagtaagcgtactacatcaactaaaaaacaagtttcatcatctgattggaaagtaggagataaagttatgcataaagcatggggtgaagggatggttagtaacgtgaatgaaaaaaatggatctgtagagttggatattatatttaaatcagaaggtccaaaacgattattagctcagttcgcaccaataacaaagaaggaggactcatag

SEQ ID NO: 1892 - DNA, 807 bp, Staphylococcus epidermidis
aacgataggcgggtgaatatattgaaaatccaaatacttcaattcaatgtagaacgtggaaatgttgataaaaatatgcaaaatatcaaaactaagtttaatcaatacttagataaagataccagtgtcgtcgtgcttccagaaatgtggaataacggttatgcattagaagaattagaacaaaaagctgataaaaatcttaaagacagctctctctttataaaagacttagcacatacatttaatgtagatatcattgcaggttcagtatcaaatataagagaaaaccatatatataatactgcttttgcaattaataaaaacaaagaattgattaatgaatatgacaaagtacatctcgtgccaatgttacgtgagccagactttttatgtggtggaaatgtagtccctgaacctttttatttatctgatcaaacacttgtgacgcaaatcatttgttatgacttacgatttccagagatattgcgctatccagctagaaaaggtgctaaaattgctttttatgtagcacagtggcctagctcaagactagatcattggttatcattactaaaagcgagagcaatcgaaaatgatatttttattgtagcttgtaatagttgtggtgatgatggtcacaccaattatgctggaaattcaattgtcattaatcctaatggtgaaattttaggccatttagatgataaagaaggtgtactaacaacacatatcgatgtagacttagtagatcaacaaagagaatatattccagttttcagaaatctaaaaccacatctttataaatag

SEQ ID NO: 1893 - DNA, 1749 bp, Staphylococcus epidermidis
gagggaaggcgcatgataaaacgatatttaaagtttgtaaaaccttatagatatcgtattattgcaacaattatagtagggattattaaattcggtattcccatgctcatacctttattgattaaatatgctatagatggcgtgattaataatcattcgcttacaaatcaagaaaaatttagtcaccttggtgtagcaataggaattgcattatttattttcttaattgttcgcccgccgattgagtttattagacaatatttagctcaatggacaagtaataaaatactatatgatattcgtaaacaattgtataatcacttgcaagcactaagtgttcgcttttatgcaaataatcaagtcggtcaagtcatttcaagagtgattaatgatgtcgaacaaacaaaagactttattcttactggattgatgaatatctggcttgactgtataacgattattatcgcactttctattatgttcttccttgatgtaaaattgacgtttgctgcaatttttatttttccattttatattttaactgtttattttttctttggaagattacgaaaacttacacgtgtgcgctcacaagctctagcagaagtacaaggtttcttacatgagcgggttcaaggaatgtctgttattaaaagttttgctattgaagacaatgaagctaaaaattttgataaccataacaagaattttttacaacgagccttccaacatacaagatggaacgcatattcttttgctgctattaatactgttacagatttaggcccaataattgtgattggcgtgggttcatatttggcaattacaggatcgattactgtcggaactctagcagcatttgtcggttatctagaacaattatttggaccacttagaagactagtatcttcatttactacacttacacaaagttttgcatctatggacagagtatttcagttaatggatgaggattacgacatcaaaaatggcattggagcacagccaattaaaatcagtaagggtcaaattgatttaaaacatgtgagtttcaaatataatgaaaatgaaaaagaagtattacacgatattaatttaacaattaacaaaggcgaaactgtagcatttgtaggtatgagtggtggtggaaaatctactttgattaatcttataccaagattttatgatgttactcaaggtgaaatacttatcgatcatcataatgttaaagatttcctaactggtagtttaaggaatcaaataggcttagtacaacaagataatattcttttttctgatacggttaaggagaatattttgttgggtaggcctgatgcgactgatgatgaagtcgtagaagctgcaaaaatggcgaatgcccatgattttatttcaaatttaccgaatggatatgatactgaagtaggagaacgaggagttaaattatctggtggacaaaaacaaaggttgtcaattgcacgtatctttttaaataatcctcctgttttaatattagatgaagcaacaagtgcattggatttagagagtgaagctattattcaagaagcacttgatgttttaagtaaggatagaacaacattaattgttgcacatcgtctatctaccattactcatgcagatagaatagttgtaatggaaaatggacgaattgttgagactggcacacaccaacaattaattaataaacgcggtgcttatgagcatctttatagtattcaaaatttataa

SEQ ID NO: 1894 - DNA, 414 bp, Staphylococcus epidermidis
agcttaatcagtgacgaggtgatatcattgaatattttagatttatatttacaacaatttataaaacgaattactaaaaaaagtatcaatgactataaaatgtcattagataagcaaattaaaaatattgatacttatattaattatttaagagaaaaaagattacaattaaagaagttaattgacaccctcacgctctcattagaaaataaatatatagatttagtaaacaatcaagcaatctattgtgctgaggaaatacatgataatgatattgatatgattaaatcacaattaaatgatgctgagtcttattatgcgagaattgaagcggatataaatttacaatctagaatgaaaataactactgaagaagcattccactttatatatcatatgagtgctgtagcatag

SEQ ID NO: 1895 - DNA, 591 bp, Staphylococcus epidermidis
atgggtaggctcattctagttataaggagtgatgatatggacaaattaacgccaaaacaagaacgttttgcgaatgagtatataaagacactcaacgttactcaaagcgctataaaggcaggatatagcccgaatagtgcacatgtaactggtagtcgattactacgcaaagagaaagtggataaatatattaaaagtaagaaagacgagattatggacgatactattttatcagccaaagagttactgtatctattaactcaagcagcagttggcgacgaaactgaaacaaaggaagctgtagtaaagaaaggtacatttgaacgtaatccagacagtggaagaatgaacctcgtatataatgagcatgtggaaactgttgaaatacctattaagccaagtgatcgattaaaagcacgtgatttgcttggcagataccatagcttatttacagaaaaggtagacttaaatgtagcaacaccagtatttattgatagtattgatgaagatgatgagaagaatgagagagatattgaaaatttaagtaaacaatatccgaatgcagagtttcatattgatgatattaggtag

SEQ ID NO: 1896 - DNA, 1521 bp, Staphylococcus epidermidis
ttgatgggaagctcaatagttttaaaattactcaaggtaacacattactatagaaatcataattcaaaaaaatggtatcgaccattaggttatgatgctgaggacatcaacctaaataatatttctttgcatatatatcaaggtgaagcattaggtataatcggagaacctggatcttctaaaactttgattggtagaattttaagtggttcagtgaaacctgataaaggtaaggtcgtccgaactaaaaacttatatttcggtgatattgatgatcgaaagattaataatttaactgtgagccaatatgtgagcgaactcgtacaactttttccttatgaagtaactgagcataaagttgaacaaattattcaatgggcacatttaggtgattacatagaagaaaaggtttctaatttaagcgaaaaatcatacgcacaacttttacttagtattgcacgttcttcaaaaaacgatattatcattttaaatcatgttttatcacatttagatgaaacatttatagaaagagctacagttttatcaaaagattatattgaggctaataaaacactagtcttaattgataatgatgtagaaaagataagcaaaacaagtaactacataacatgggtatcacacggccagatacgcaaggaaggttctctaaatcaggtattaccaacttttagagaacatgaaaaagatcgtactagtttaaaatcagaaatggaaattgagaactttgattatgattggaagcagaatcgctctcgtattcctgaaatgacttataattttaaaagaatagaacgttataatcatgctaagccaccaagatttctagtgagattttggaccttatttgtcagctttttgattgggcttgttttaatgagcgtacttttctttaacaacttaggtatggtcaaactagggaacattaatacccaagcatccatacagaatcagaataaagatacttacgaagaaaaacttgcatatggattagcattagatggatcagttactttaaacgggtctaaagatttaaaagtacctaagtatagtttaattacaattactggagaaaataacaaaagatatcgggtcgaaatgaatcaaaggagatatagtgttagtaaaaatcaagtgttttatttcaatccagctgggttatacgaatctcatacttttaagaaattgtcaccttatataaaatcaaattatagtacttacgtagagtactttaacagtcacttacatcaaaaacatgataaagtaacagaaacgcttagacctgataaagataaaaagtatgttgtaccgatcacgcaacaacctataaaaatgatatttggtgataatgataaactgtctggatttgttattccaatgacaaataaaacggaattgaaaaaaacatttaatatcacgaaagatgtatggattacaaaaagtggaagcggttattttatcgctgatatgaaagaagaaaaatggatttatattgaattgtag

SEQ ID NO: 1897 - DNA, 582 bp, Staphylococcus epidermidis
ttcagattgagagcgtgcgtaaatatggataaaataaccttcttaaatgaattagaattagctttagatgatttacctagggaagaaaaagatagtattatgcacaagtatgaaaacttgttctatgaagaagaattgaaagggattagtgaatcacaaattataaaaaagttaaatgatccttatcatatttccaaagaagtaaaagctagaagtgctattcattatgctagttacaaaccaaccttagcaaacatagtaagagcaatactagcatcgttaagtcttggtattttgtcgttatttattattttaataccggttgttatcattgcattacttattctattctgtttccttatttctatttgttttatctttgcaccatttgttttattattttattcagtattacatggtttcgaaaatgctataagtaatgtgtttttttcaatttcttttacaggtttaggaattatgtttattgttattactttgaaaattggtgaaataattcataaacttattttgaaatatcttctttggtatataaagactgttaaaggaagcgttaaagaatga

SEQ ID NO: 1898 - DNA, 735 bp, Staphylococcus epidermidis
ataatgaagagcttacaattagtcaaatatgatttaattagtatacttaaaagtccgtatacttatttagcatttatacttgtaattggaatgacggtattccaagctagcatgatggcaaattatagttctgcacataaagttaatatagatatggtttttaatttagctaattggcttttcttgtttgctggtcttttattcattataaaaacaataacaagagattactcacaaggtactatacaattgtttatgagcagaataactagcagaatgggctatatcattactaaaacagtatctattgtattaatttcattcttatttacaattattcactacttggtaataattattatacaatctacaactaaaagtgaaaaaatggatggagatagatttttaaataatatttggttttaccttattttctttttattctttggattattcttattactaatcactttaatagtagaaaaacctgctgtcatatttactctaggtatttttttaatactcatcgttccgtttattcagccatttattccaatgattccgaatattggcgatgatattcaggattcatttaaatatataccatttacgtatttaactgaaaaaatgactggtgagattaaattctctaattggcaatggtttatctctattgcatcaatagtggtcttatttattgcaaatatgttatatgcatcaaagagggatatttaa

SEQ ID NO: 1899 - DNA, 648 bp, Staphylococcus epidermidis
ataaggaggagaattcaagtggcgattaaagttttatttgttgatgatcatgaaatggtaagaatcggtatttcaagctatctttcaactcaagaagatatagaagtagtaggtgagggtgcttctggtaaagatgctatcaccaaagcgcatgagctaaaaccagatttaatattaatggatttacttatggacgatatggatggtgtagaagcaactactgaaataaaaaaagatttacctcaaattaaagtagtcatgttaacaagctttatagaggataaagaagtttatcgtgcacttgattctggagtagatagttatattttaaagacaacaagtgcaagtgatatagctgacgctgtgcgtaaaacgtatgaaggtgaatcagtatttgaaccagaagtgttagtaaaaatgcgcaatcgtatgaaaaaacgtgccgagctttatgaaatgttgacagaaagagaaatggagatcctattacttatagctaaaggatactctaaccaagagattgcaagcgcctctcatatcaccatcaaaacagtaaaaactcatgtaagtaacatactaagtaaattagaagtacaagatcgaacacaagcagtaatatatgcgttccagcataatttaattcaataa

SEQ ID NO: 1900 - DNA, 207 bp, Staphylococcus epidermidis
tacttaggtggtaagatgataaaattgactaatccagctgtaacaagtcctataagagctgtaagtaaccgtgaaaagaaattgaacacatatgcttcatgtatacctggaatcattgcaacggaagttaatactgcgacagttgttcctacctgtaaattaagtttagtgcatatcagaatggtaaatgtagcacttaaagcataa

SEQ ID NO: 1901 - DNA, 504 bp, Staphylococcus epidermidis
tataacattttaaattattcaagggaggggttttatataagaaatttagaaacttattttaataaaagtcaaacactcaatgaattcattaataaaatacaagaaagtaaagacaatttattatccatttataatttcttccacctgccacttaatgatgcacgtttaaatcaattaagagaatcgaattattataaggtgcttataattaaagaggattggtgtggcgatgccatgatgaacattccaatattaaagcatactattgaatttctgaacatcatagcaagagtatttcatagagatgatgatacacatctgattgatcaatatttaacaaatggtaaatcaagggctatccctatctttgtattcatgaacgattcattcgaacaattgacagtttggagaccaagagcaaaaaagtacaaagttttgtcaataaaattagaagtaataaattgccagataaaacccatcctaattttgatttttactcaataa

SEQ ID NO: 1902 - DNA, 2001 bp, Staphylococcus epidermidis
gggatgcaaggtgttaaaaagcgtgtggaaaaattacatgacttattgaatcaatatagttatgaatattatgtacaagataatccctcagtgcctgacagtgagtatgataagttattacatgagctgattgaaattgaagaaaaatatccagaattcaaatcgacagactctccaacagtgcgtgtgggtggcgaagctcagtcttcttttgaaaaagtaaatcacgacacgcctatgttaagtttaggtaatgcttttaatgaagaagatttaagaaaatttgatcaacgtattcgtgatagtattggtaaggtcgaatacatgtgtgaacttaaaatagatggtttggctgtttcgctcaaatatgaaaatggtcgttttgttcaaggacttacacgtggtgatggtacgacaggtgaggatatcactgaaaatctaagaactatacatgctataccactaaaaattaaagaacctctcaattttgaggtccgtggggaagcttatatgccacgtcgttcattcattcatttgaataatgaaaaagaacaaaatggtgaacaaccttttgcaaatccacgaaacgctgctgcaggctctttaagacaacttgactctaaactagctgcgaaaagaaagttaagcgtcttcttatatagtgtgaatgacctaaccgagtttaatgcaacaacacaaagtgaagcgctagaggaattggaccaattaggttttaaaactaaccaagaacgtgaacgagtatcagatattgagggcgtacttaattatatagagaaatggacaagcaaaagaggatctttatcttacgatattgatggtattgttataaaagttaacgatttatctcaacaagaggaaatgggttatacgcaaaaatctccaagatgggcgattgcttataaatttccagctgaagaagttattacaaaattattggatattgagctaagtattgggcgtacgggtgttgtgacaccaactgcaattctagaacctgtaaaagtagctggtactacagtttcaagagcctcacttcataatgaagatttaatacatgaaagagatatacgtatcggagatagtgttgttattaaaaaagccggggacatcatccctgaagttgtaaaaagtattttagatagacgacctaacgaatcggaaatttatcatatgccaacacattgtcctagttgtggacatgaattagttcgtattgaaggagaagttgctttacgttgtattaatccaaaatgtcaggcacagcttattgaaggacttatacatttcgtttcaagacaagcgatgaatatagatggtttaggtactaaaattattcatcagctatacgaaaatcagttaatcaaagatgtcgcagatattttctatttgaaagaagaagatttattaccattagagagaatgggaaagaagaaagttgataatcttttattagcgatagaaaaatctaaagaacagtcattagagcatttattatttggactgggtattagacatttaggtgtaaaagctagtcaagtacttgctgagcgatatgaaacgatggatcaactttttaaagtaactgaaagtgaattaattgaaattcaagatattggagataaacttgcacaatctgttgtaacatatctcgaaaatagtgatattcgttcattaattgaaaaattaagtaataaaaatgttaatatgtcttataaaggaattaaaacaactgaaatcgaaggtcatcctgattttagtgggaaaacaattgtattaacagggaaactcgagcaaatgacgagaaatgaagcatctgaatggttgaaaatgcaaggtgctaaagttacaaacagcgtgactaaaagtactgatattgtcatagctggagcagatgcagggtctaaattagccaaagctgagaagtatggtactgaaatttggactgaagcagcatttattgaaaaacaaaatggaatctaa

SEQ ID NO: 1903 - DNA, 822 bp, Staphylococcus epidermidis
tttaaacgaggtggcataatgcatttatattatctaggacctaaaggaactttttcatatctagccgctaagcaatttgaatcacatgaacagtatgacttcattccattatctaacttgcatgaagtcattcaatccgtatctaaagataaacaggctgtcggaattgtccctattgaaaactctattgaaggtactattaacattgtcgctgattcattagcacatcatgatgtatacgcacatggtgaaattcaactagatatagatttttcactttacggtcatcattcaaattcacttgatgatattcataaagtatattcaattgctccagcaatcagtcaaacaataaactacattcatcgtcaacagtttgactatgattatgtagatagcactattcaaagccttaacatgataaaagatggtattggagcaatagctcctcttgggagtggggaaacttatggctaccatactttagatcaacatatacaagattaccctcataatgtaactagatttttagtagtgaaaaatcatactcattttattgaacatccaaacacaactatcttccttatcacgcctaagtatgataagccaggacttttagctagtgttttaaatacttttactttattcaacataaatttatcgtggattgaatctagaccacttaaaactcaattaggtatgtatcatttttatgttcaagccgatactgctataaataatgatgtgaataaaattatttcaattttagagactttggattttcaagttaaaattatcggcgcttttaataagaaaaactaa

SEQ ID NO: 1904 - DNA, 561 bp, Staphylococcus epidermidis
agaactggaggggtgaatgtgcataaaatagatttatcaggcaacaaatttcaaatccaacgatttgttctgttgcaaattgtattggcgctatttacaatactatttacttataaatgggcttatcaaacaacgcatatcattgaacaaaatcttgtcatgaatcttatttttggatttgtaggtttcgcagtactagttattttgcacgagtttattcatcgtattttgttcattatattttctaaaggtgaaaaaccatctttaaaatatgataaaaacaaaattattgtacagttctctcagacttgttttcatcggtggcaatttacaattatcatgatagcaccacttgttatcataagtgcgaccttactagcacttattcaaatatattccttttcatctttaatctttatgtttagtatacatacaagttattgtatgatagatgtgtttttagtagcattggcattacaaagcaaattcaaatatatacaaacctatggagaaggtttgtatctttatcatcaaaagcctactcaaacctattatgaataa

SEQ ID NO: 1905 - DNA, 1047 bp, Staphylococcus epidermidis
ttttatggaggttttggtatgacattaggttatataggttcttatactaaaaagagtggtaaaggtatatatcgcttcaaactaaatgacgaaacaggagttattgaagcgttagaaactggttatgaaattgaagcgtcaacttatcttactcgtaatgaatcgtttttatatgcgattactaaagaaggtgaagaatgtggtgtagctagttttagtattaaagaagatggacaactggaattaattaataaatgtctagcatcaaaacagggaactggttgttacattcaagtgtctagtaatggtaaatatttatttgaagcggtttatggtgcaggacttgcaaggatttataaattaaatccaattacgggagcaatagagaaattaatagaagaacttgagcatgaatttccaactggctcacatgaaagacaagattcatcacatgttcattttttaaatgaaacacctgatcataagtatgttgtagctactgatttaggtacagatagagttgtaacatacaaatttggtgaggatggtttaaaacaatatgcagtttctcaattcaaaaattcagacgggcctcgccacatcgcttttagtaatgatggacgacacgcgtatatcgttcacgagctatcaaatgaggtgagtgttacagaataccaagacggtaagttcattgagctagagagacattcaactattccaagtgactttaacggggaatcgaaattagcagcagtgagactatcacatgatgggaagcacttatatataagtaatagagggcatgatagtattgctatatttgaagttttagaagatggcagatcactgagaagtattgaaatacaaccaagttacgatgcctttccaagagactttaatataactgaatcagataactatttaatttgcgcacatcaagaaggagaatcaaaagtttcaatttttgagcgtgataacataactggtaaactttcattaaaagataaaaaagctatagcaaatgaaggtgtttgtgtactactataa

SEQ ID NO: 1906 - DNA, 564 bp, Staphylococcus epidermidis
atagaaatggggaaattgggacaacaaattattggttatcattgtaatgatgaggttaaaatagataaattcaaaaatagagaagtatctttgcttataagttatgaagatgatatctggctaggtaatggaatgtatttttgggaaaataaaagcaacctggattattggaaaagaaacagggaaaggaattacccagacaaaaatttctccagtgtagaagtaatgttgtctttagactttttgttagatttaagtgataaagagcatagaaaattttgcaagaaagttttgagcgatttaattgaaagagggaaagataacggtatagatgaaagcattttcaataatgatttaggtgaggtaattaatgtattattttctaaaactgatattttagcatcacattttaatgtgttaagaacacatggtttatacaattggtcagaggacaaatttttggtaggaaatgataacaaataccaaagtgtaaacagaccaacttcaaatgttaaaactatctattgtgtaaaaaatgaaagggcgattttagaaatcttgtaa

SEQ ID NO: 1907 - DNA, 1557 bp, Staphylococcus epidermidis
ttaataaagggagtgttaattatgttaacattaggtacagctctcagtaatcaaattgatgcaaattggcagacttacgttatgattattgtctatttcataatccttctaattattggcttctatggttatcgacaagctactggaaacttaagtgaatttatgttgggaggacgtagtatcggaccatatatcacagctttatcagctggtgcctctgacatgtctggatggatgattatgggacttccaggttcagtatacagtacaggtttatccgccatttggataaccattggattaaccttaggtgcatacattaattattttgttgttgctccaagactacgtgtttatactgagattgcgggagatgctattacactcccagacttttttaaaaatagactagatgataagaaaaatattattaaaattatttcaggattgattattgtcgtatttttcactctatatacgcattcaggtttcgtttctggcggaaaactctttgaaagtgcatttggattgaattatcatgctggactcttgatagtggctattatagttattttttacactttctttggtggctatttagctgtatcaattactgatttttttcaaggtgtgattatgcttattgctatggtaatggtacctatcgttgcattgcttaaactcaacggttgggatacatttcatgatattgctcaaatgaaacctacaaacttagatttatttagaggaaccactgttttaggcattgtttcattattctcatggggactcggatattttggtcaaccacatattatagtaagatttatgtctatcaaatcacataaattactaccaaaagccagacgtctgggaataagttggatggcagtcggtctattaggagcgattggtgtgggattaacaggaatttcatttatatctgaaagacatattaaattagaagatcctgaaacactatttattgtgatgagtcaaatattatttcatccgcttgtaggtggatttttattagcagccatccttgctgcaataatgagtactatctcttcacaattactagtaacatcaagttctttaactgaagatttctataaactaatcagaggttcagataaagcatcatcacaccaaaaagagtttgttttgattggacgcttatcagttctacttgttgcgatagttgctattacgattgcttggcatccaaacgatacaatactaaatttagttggtaatgcttgggctggttttggagctgcatttagtcctttagtactctactctttatattggaaagatttaacacgtgcaggagctattagcggaatggtagctggtgctgtagttgttattgtttggatttcttggataaaacccttggctacaatcaatgcattctttggtatgtatgaaatcattccaggtttcatagttagcgtattgattacgtacatcgtaagtaaattaacaaaaaaacctgatgattatgttattgaaaatcttaataaagttaaacacgtcgttaaagaataa

SEQ ID NO: 1908 - DNA, 717 bp, Staphylococcus epidermidis
atgaaaatttttgtttgtgaagatgaccaaagacaaagagaacatatggtatcaatcattaaaaactacataatgattgaagaaaagccaatggagttagccttagcaacaaatgatccttatgaggtcttagagcaatcaaaagaacttaatgacattggttgttacttccttgatattcaattagaagctgatatgaacggtattaaattagccagtgaaattcgtaaacatgatcctgttggtaatattatatttgtaaccagtcacagtgaactgacttatttgacgtttgtttataaagtggctgctatggattttatttttaaggatgatccatctgaattaaaaatgagaatcatagattgtcttgaaacagcacatacacgactcaaattattatcaaaagaaagtaatgtagatacgattgagttaaagcggggaagtaattcagtatacgttcaatatgatgacattatgttttttgaatcatctacgaaatctcatagactcatcgcacatcttgataatcgacaaattgaattttatggaaatttaaaggaattagcacagcttgatgaacgtttctttagatgtcataacagttttgtgataaacaggcataatattgaatctattgattcaaaagaacgtattgtttactttaagaatggcgaaaattgtttcgcttcagtacgtaatgttaaaaaaatataa

SEQ ID NO: 1909 - DNA, 210 bp, Staphylococcus epidermidis
gataatattatcgtagtaaatacaagtaaaaaggagttccaatatttaatgagtgaacagcaaacgattgatcaaattaaaacacgattaaacaaatttattgaagacattgatcatgtaaatccggatgaggtacgtgtagaagatattgatgagtggattggtttacttgatcagttggaagaaaaagtgaaacaagtttcaaaataa

SEQ ID NO: 1910 - DNA, 528 bp, Staphylococcus epidermidis
tgtcacattatggcaaaaaaagtagcaattattctagcagatgaatttgaagatatagaattaacaagtcctaaagaagcattagaaaatgctggatttgaaacagaagtgattggtgatacagctaaccatgaagttgttggtaaacacggtgagaaagtcactgtagatgttagcattgctgatgctaaaccagaaaattatgatgcattattaattcctggtggattttcacctgaccacttacgtggtgatgaagaaggtcgctatggtacttttgctaagtatttcactaaaaatgatgttccaacatttgcaatttgtcacggaccattagtattagttgatactgacgatttaaaaggacgtacaatcacgggtgttattaacgtacgcaaagatttatcaaatgctggtgcgaatgttgtagatgaatcagtagtggtagacaacaacattgtaacaagtcgtgtacctgatgatttagatgacttcaatagagaaattgttaaaaaattagaagcataa

SEQ ID NO: 1911 - DNA, 669 bp, Staphylococcus epidermidis
gatttaactatgaagcaattaatgattagaaacttaaaattacgtacttggacactaattatttacgcattattgcttttattctttcccatttatcatttgttaaataaagatacaccactatattcaattatctcaggaccaatcggattaatactgacgatgatatgtttgatagatataggtcatttattcagagttaatcgtagattacgtggttcatcttcatattatttcttttatagtttgcctgtatcaaagagagatttgcttaacgctaattacatgacatgcattttattaacttttataggtgagcttatcattagtttatatggatactacacaagcacaataaaaacagattcgatttatttttcgacgactttttcattcatagtagggaatttcttttctatacctatagcgtttagtaagagtactgaacgtaaagatcgagatattccatatatagcttatattgtaggaattatggtggttctgccatttactttatcggtcatttttatcttaatcaattatcttacacacaatgatagccatatcccaatgatatactcatatttcttaaattatggtctattagttgtaagtagcattttcttagtcattaattatttgattcaaattaaaaaaataaagtattaa

SEQ ID NO: 1912 - DNA, 1401 bp, Staphylococcus epidermidis
tttttttatatacttgaactaacaaaagattgtaatggggaggtggttgaatttatgaaaaagtttaacattaaacattcatttatgcttacgggctttgctttcatggtaactacatcattattcagtcaccaagcacatgctgaaggtaatcatcctattgacattaatttttttaaagatcagattgatagaaatacagctaagagcaatattatcaatcgagtgaatgacactagtcgcacaggaattagtatgaattcggataatgatttagatacagatatcgtttcaaatagtgactcagaaaatgacacatatttagatagtgattcagactcagatagtgacttagattcagatagtgattcagattcagatagtgattcagattcagacagtgactcagattcagatagtgactcagattcagatagtgactcagattcagacagtgattcagactcagatagtgactcagattcagacagtgattcagactcagatagtgattcagattcagatagtgattcagattcagacagtgattcagattcagatagtgattcagactctggtacaagttcaggtaagggttcacataccggaaaaaaacctggtaaccctaaaggaaatacaaatagaccttctcaaagacatacgaatcaaccccaaaggcctaaatacaatcaaacaaatcaaaacaatataaaccataatattaatcatacacgtactagtggagatagtgcgccttttaaacgtcaacaaaatattattaattctaacttaggtcatagaaatcaaaataatataaatcaatttatatggaacaaaaatggcttttttaaatctcaaaataataccgaacatagattgaatagtagtgataataccaattcattaattagcagattcagacaattagccacgggtgcttataagtacaatccgtttttgattaatcaagtaaaaaatttgaatcaattagatggaaaggtgacagatagtgacatttatagcttgtttaggaagcaatcatttagaggaaatgaatatttaaattcattacaaaaagggacaagctatttcagatttcaatattttaatccacttaattctagtaaatactatgaaaatttagatgatcaggttttagctttaattacaggagaaatcggctcaatgccagaacttaaaaaacctacggataaagaagataaaaatcatagcgccttcaaaaaccatagtgcagatgagataacaacaaataatgatggacactccaaagattatgataagaaaaagaaaatacatcgaagtcttttatcgttaagtattgcaataattggaatttttctaggagtcactggactatatatctttagaagaaaaaagtaa

SEQ ID NO: 1913 - DNA, 501 bp, Staphylococcus epidermidis
gatgggcatataaatacatggtttggagtgatactaatgatacatgtagcatttgtatgtctcggtaatatatgtcgttctccaatggctgaggctatcatgagacaaagactacaagaaagaggtatttcagatataaaagttcattctagaggaacaggacgttggaatttaggcgaacctccacataacggaacacaaaaaattctacagaagtaccatattccttatgatggtatggtgagtgaacttttcgaacctgatgatgattttgactatattattgctatggaccaaagtaacgtagacaatatcaaacaaatcaatccaaatttacaaggacaattgttcaaattgctagaatttagtaacatggaagagagtgatgtaccagatccatactacacaaataattttgaaggtgttttcgagatggtgcaatcatcttgtgataatttaatagactacatcgtaaaagatgcaaatttgaaagagaggtaa

SEQ ID NO: 1914 - DNA, 1827 bp, Staphylococcus epidermidis
atcaataatattacaattgtaatattcgcgtcaatagtttattataaatatttgaaagaaggtgttgaaatggctaagttattaataatgagcatagtaagcttttgttttatatttctattgttattattttttaggtacatattaaaacgctattttaattatatgttaaattataaagtttggtatctaactcttcttgcaggattaattcctttcatccctattaaattctctttttttaaatttaataatttgaataatcaagagcccacagttgaaagtaattcacacaatttgaatcctaacataaataccactaaacctgttcatgagtttacaacagacatccataagtttaattgggattcaatagataatatctgcacagttatttggatagttttagttattattttaagttttaaatttttaaattctttattatatcttaagtatttaaagaaacagtcactttatctaaatgaaaaagaaaaagataaaataaacaagatacttttcaatcatcaatataaaagaaatattgtgattcgaaaagcagaatctattcattctccaataactttttggtatggaaaatatattattttgattcccagtttatattttaaaagtataaatgacaaaaaactaaaatatataatattgcacgagtatgctcatgctaaaaacagagatactttgcatttaattatctttcatattttttctattgctatgagttataatccactaatacaaattgtaaaaagaaagatgattcatgacaatgaagtagaagccgatagatttgtccttaataatattaacaaaaatgaatttaagtcttatgcggaagctattatggattccgtattaaaaacctcatttttcaacaaaaatatattaagccattcatttaatggtaaaaaatcattactcaaaagaagattaattaatataaaagaaggcaatctgaagaagcagtcaaaattaattctaatttttatttgtatttttactttttttatcatgataattcaaagccagtttttaatggggcaatccttaactgattataattataaaaagcccttacaaagcgattaccaaattttagatgaaagtaaaaattttggttcaaatagtggatctttcgttatgtacagcatgaagaaagacaaatactatatttataatgaaaaagaaagtagaaaaagatattctcctgattcaacttacaaaatttatttagcactgtttggacttgaccgtcatattataagtgataaaaattcacgtatgtcatggaatcataatcattatcctttcgattcttggaataaggatcaagatttaaatacggcaatacaaaactcagttaattggtacttcgaacgtattagtaatcaattatcaaagaactatacttctgatcaactcaagcaattaaattatggtaataaaaatttgggaagttataaagcctattggttggaagatagtttgaaaatatctaatcttgaacaagtaatagttttaaaaaatatgatggaacaaaataaccattttagtaaaaatgaaaagaaacaattatcttcttcgttattgattagaaaaaatgaaaattatgaattgtatgggaaaacaggtacaggtatagtaaacgggaaatataataatgggtggtttgtaggttacgtaattacaaatcatgataagtattatttttctacacatttatcagatgaaaaagcctctggtgaaaatgctaaattcataaatgaaaaaatattaaaagaaatgggtgttttaaatggccaataa

SEQ ID NO: 1915 - DNA, 1068 bp, Staphylococcus epidermidis
agtaaaaatataaggagagattataaaatgcaaaaagtacgttctgatataatgactcatcgtggttctcactatgatttaggagtaaagactgctctttggttacaaaccactcctttattaaaaaatcgaaataaagaatggcgaaagagaattccacgttttgatattgatgtcaaggaaacctatgatatatttcaaatctattcgccacagatttgggaagaaataattggtatgcaagatgtattgaatctacctacaaaacaaatgattttaaattttggccattatcgatttactgatttaaaggacagtggttgcacagtatataaaggtcgtgattttttagtccgaaattatgattatcatcctgcaacatatgatggtagatacttattatttcaacctaatgacgggggattatctcaaataggaccgacttcaagagtgactggtagaatggatggtatgaacgagtatggtttagttatggcatataattttatgcatcgtaaaaagcctgcaaatggatttgtatgttacatggttggtcggctaatacttgaaaattgcaaaaatgtaactgaagcaatcaaatttttaaaggaagtaccgcatcgtagttcattcagttatatactaatggatagacattcgaattatgccattgtcgaagttacacctcgatcaatagatgtaaggtatgaacatatatgcacaaatcattttgaattgcttacccatgaaaatagaaactatacaagagaatctaaagaacgcttaaatcgtgtaataaataaaacaactccttctacaaacaaagatatcgcattcaaattatttaacgacccgcaatacgaaatctatagcaacctatttaaaagttggtctggtacaattcatacttcactatatgaacctaattcattaatagcatggatggcattaggtcaaaacagtcatccaacctcaatcaatttttctaattggttaaaaggaaagaaattgaatataaattactttgaaggcgaaatagatacaccattaacttttgccacatactaa

SEQ ID NO: 1916 - DNA, 387 bp, Staphylococcus epidermidis
aataaaagtatagaggttaagatggaaaaatttaatagacaagaacaattaaaacagttgcatgcagaacgaaaagttaaaaccgagaaaaaagttgataaagcaataaatgatttagttcaaaaaaataaagaaattaactttaacatcgtttctaaacattcaaaagtttcgaaagctacattatataaaaataataaaattcgaaagaaaatagagaagttacgtgaacaaaacagagaaatatttgttcataaaaataaaaatgacggtaaagatgcgttaatctcctctttaaaaagaaaagtaaattctttagaaaaagagaaaaaaatgttgaaagaagaaattagcgttttatattctaggctgtatgaggatatttaa

SEQ ID NO: 1917 - DNA, 1383 bp, Staphylococcus epidermidis
ttgagaatcttttttgttataccatttacgtgttataattactcgagtgcaaattggaggaggaaacgcatgagacaatggactgcaacccacatggctaagttagcaaggaaagcaagtatagctgtaggtaaaaagggtacagacttgccgggacagattgcaagacgtgtggatcataatattttaagaaaattagctaaacaagtagatgacattgtttttataagtgggactaatggtaaaacgactacatctaacttaattggacatacattaaagaaaaatcaaataaacattattcacaataatgaaggagcaaatatggcagcagggataacttctgcttttattatgcaaagctctaagaatactaatattgcgataattgaaatagacgaaggatctattccacgtgttttaaacgaagtcacaccttctatgatggtgtttacaaatttctttagagatcaaatggatcgatttggtgaaatcgatattatggttgataatattgcaaaatcaataagtaacaaagggataaaattattattaaatgcagatgatccgtttgtgagtcgcttgaaaattgcaagtcattccattgtgtattacggaatgaaaaaatttgcgcatgactttgaacaaagtacaatgaatgaaagtaaatattgtcctaattgtggacgattattgcaatatgactatatacattataatcaaattggacattatcactgtgaatgtggatttaagcgagaagaacctacatatgaagtgtcatcatttgatgcttcaccattcttaaaaatgataataaaccaaagtgagtttaatatgaaaattgcaggagattttaattcttataatgcaatagcagcctataccgtattaagagaattaggattaaatgatgatgcaatacgcaaaggatttgaaacatatacgtctgataatggtcgcatgcagtatttttcaaaaaataagaaggaagctatgattaatctagcaaaaaatccagctggaatgaatgcaagtctatcagtaggcgagcaaattgatgataaaaaaatttatgttattagtcttaatgacaacgcggcagatggtcgagatatttcatggatatacgatgcagactttgaaaagctagctacccaagatatcgaagctatcattgtaagtggtacacgtgctgaggaactacaattacgtctcaaacttgctgaagttgaagtgcctattaaggttgaaaaggatatctacaaagcgactgcattaactatgaaatacagttcatttacggtagcaattccaaactatacatcattaacaccaatgcttgaacaacttaatcgctcatttgaaggagggcaatcgtaa

SEQ ID NO: 1918 - DNA, 306 bp, Staphylococcus epidermidis
tctgatttaataaaatatttagaccaaatatatgaaattaaaagcgacataattattattaaaattattgataaacaccagttttcattggctgaatctactaaatccttgaaccatctaatttttttatttttatatatatacgcatatataattatagctagaagcataattatatttataaatcttatgttattactttcaactttttttaatttttcagttggtttacaaaaatctattaatactgtatatgagttatcaaatatatatgtaaaaaataaaggtataataaagaaaaggtaa

SEQ ID NO: 1919 - DNA, 858 bp, Staphylococcus epidermidis
tgtgtcataatatatgtaagaaaaacgtttgaatatagaagtagggatagtaaaatgccaaaggtaactaaaatagaagtacaaaaaaagaataaagaacgctttaatctctttttagatggagaatttgaaatggggatagatattgatacattagttaaatttaacttaaaaaaagatcaaatacttgaaccgtcagatatgcagaatattcaagaatatgatcactaccgtcgaggtgttaatcttgcaattcaatacttgtcttataagaaacgtactgaaagagaagttatacagtatttagaaaaaaacgatattcaaagtaatgctattcaagatgtcattgactattgctataaggaaaaatttattgatcatgaagactacgcagaaagtttaaaaaacaccatgatacacactacagataaaggaccagaaatatatagacaaaaactctatcaattaggtattgaagttacgattattgaaaaatatgtcgaagcatatgaacaacaacaaccattagatgacgtcatcaaagttgctgaaaaagtgatgaagtctaaaaagggtcctgaagcaaaggtaaagcaaaaagtaacacagtcacttctccaaaaaggatataagtttgaaacaattcaactagttatgaatgaaatagatttttctcaagacgaagaaacattagaccatttattgcaacgtgatttagagaaagtctataataaaaattgtagaaaatatgacagtgataaaagtgttattaaaaccatagaggcactcatgagaaaaggctataattatgataaaattaaatctaaattagaagaaagcggtatatctaatgaataa

SEQ ID NO: 1920 - DNA, 582 bp, Staphylococcus epidermidis
cgaaaaataattgaaaggaatgaaataatggtacaaaatgcatttgttgcactggactttgaaactgctaacagtaaacgaacaagtatttgctctgtaggtatggttaaagttattgataatcaaataacagagtcatttcatacccttgtgaatccttttgactactttactgaaacaaatattactgtacatggcatccatcccgaagatgtgcaagatgctcctggattcaagcatgtctatccatatatgctaaaatttattgatcaacttcctgttgttgcccataatgctgcttttgatatgaatgtgttacatcaaagtttaaaaagtcataatatagatacaccttctttgacatacttttgttcatatcaattagctaaacgaacaattaatgcatatcgatatgggctaaaacatttaatgaatcattaccatttagattttcacggtcatcatgatgcgttaaatgatgctaaagcttgtgcaatgattacctaccgcttattgaaacattatgatgatcttcaaagcatgttgagtatatatggaaaaaatctcaaagataaaggctga

SEQ ID NO: 1921 - DNA, 1146 bp, Staphylococcus epidermidis
attatgataatatcaaacaaatcccctatttctatcaacaatgatccatgggaagcatataatgatattttagaacataaccaattaacattaagtaatatagaatttacaactacaaatttatgtaatatgcgttgcagtcattgtgcagttggttacactttacaaactaaagatcctgatcctcttccgatggatatcatctatcgacgtttggacgagatacctaacttaagaacattgtctattacaggtggagaaccaatgttttccaaaaaatcaatcaaaaacgtcgttaagcctctacttaagtatgccaaacatcgtggtatttatgttcaaatgaattcaaatttaactttacctcaagaccggtatttagatattgcagaatacatagatgttatgcatatttcacataattggggaaccattcaagagtttactgatgttggctttggtgcaatgagaaaacaacctcctctaaaagccaagttgaaattatatgagcaaatgcttgaaaattccagcactttatcagaccaaggcatgttcgtatcggcagaaacaatgcttaatcaaagcacagtcccttatctaagtaaaatacataacgaagtggtaaatgacatgaaatgtagccgtcatgagattcacccaatgtatccatctgattttgctagccaattaaatgtattatctcttaaagaaatgaaagaagctattcatcatttgttagatatacgtgatgaaaacacatggatgttgtttggtactctacctatctatccatgtttaaatgatgaatatgatcaacatttattgcaacgtttaagaaaatcgaagaatgttacaatgagaaatgaccctgatggtcgtagccgtttgaatgttaatgtatttactggcgatgttattgtgactgattttggtgatgaaaatggtacaatatctaatatacaaaaggataaattgacagatgtattcaaccagtggttaaatactgaccttgcacaatctttaaattgtcattgtgcagaatatcaatgtctaggtccgaatgttttagttaaaaatatgtattacccaaatactgatttcaagaaaaaagaacaaatcatgcatcaacatcaaatattttcataa

SEQ ID NO: 1922 - DNA, 1440 bp, Staphylococcus epidermidis
ggagtggaaatcatgcattttgaaacagtaatcggacttgaagttcatgttgagttaaaaacggactcaaaaatgttctctccatcacccgcacattttggagctgaaccaaattcaaatacaaatgttatcgacttagcttatccaggtgtattaccagtagttaatagacgtgcagtagattgggcaatgagagcttcaatggcattaaatatggatattgctacaaattcaaaatttgatcgtaaaaactatttctatccagataatccaaaagcatatcaaatttctcagtttgatcaacctattggagaaaatggctatattgatattgaagttgatggagaaacaaaacgtatcggtattacacgtcttcatatggaagaagatgcaggtaaatcaacacataaagatggttattctctagtagacttaaaccgtcaaggtacgccattaattgaaattgtatctgaacccgatattcgttcacctaaagaagcatatgcttatctagaaaaactacgttcaatcattcaatatacaggtgtatctgattgtaaaatggaagagggatccctacgttgtgatgctaatatttcacttcgtccatatggtcaaaaggaatttggtacaaaaactgaattgaaaaaccttaactcatttaactacgttaaaaaaggtttagaatatgaagagaaacgtcaagaagaagaattattaaatggtggagagattggtcaagaaacacgtcgatttgatgaatctactggtaaaacaattttaatgcgtgtgaaagaaggttcagatgattatagatatttccctgaaccagatattgtaccattatatgtagatgaagattggaaagcacgtgtaagagaaacaattccagaattgccagatgaacgtaaagctaaatacgtaaatgatcttggactaccagaatatgatgcgcatgtattaacattaactaaagaaatgtctgatttctttgaaggcgcaattgaccatggtgcagatgttaaacttacttccaactggttaatgggaggtgttaacgagtatcttaataaaaatcaagttgaattaaaagatacgcaactaacacctgaaaatttagctggtatgattaaattaatagaagacggaacaatgagtagtaaaatcgctaaaaaagtttttccagaactagcagaaaatggtggagatgctaaacaaattatggaagataaaggtttagtacaaatttctgatgaagcaacactacttaaatttgtaacagatgcattagataataatccacaatcaatagaagattataaaaatggtaaaggtaaagctatgggattcttagtgggccaaattatgaaagcttctaaaggtcaagctaacccacaaaaagttaatagcctattaaaacaagaattagataaccgttaa

SEQ ID NO: 1923 - DNA, 1080 bp, Staphylococcus epidermidis
ggtgagtcgatgactgaaagaagaattattcatatagatatggattatttttttgctcaagttgaaatgagagataatcctaaactaaaaggaaaacctgtcatcgttggcggtaaagcgagtcatcgaggcgtagtttctacggcatcatacgaagcaagagcttatggtgttcactctgctatgcctatgactcaagcacataagctatgccccaatggatattatgtaacaagccgttttgatacttatagagaggtatctggtcaaatcatgaaaatattcagaagttatacagaattagtagaacccatgtctttagatgaagcttatttagatattacacatttagtgagaccggatttaccagcatcaaccattgcaaattatattcgcagagatatatacgaagtaacaagtttaactgcgtcagctggcgtgtcttataataagtttttagcaaagttagcgagtggtatgaacaagccgaatggtttgacagtaattgattacaataatgtacatgaaatattaatgcaattagatattggagattttccaggggtaggcaaagcttcgaagaaaaaaatgcatcaacatcatatatatacaggtcaagatttatataataaagatgaatttgaattaatacgtttattcggtaaaagaggacgaggtttgtataataaagctcgaggtatagaccataatgaagtaaaggcgagtagagttcgtaaatctgttgggactgaaaggacattttctacagatgttaacgatgatgatgttattttaagaaaaataagagagctttcaggaaaaacagcagaacgtttaaataaaattcaaaaatcaggtaaaacagtcactgtaaaaataaagacctatcaatatgaaacaatctcaaagcaaaaaagtttgagagatcctattcgtactgaaactgatatctataatattgcctatactttatataacgacttaaaagatccagagattccgattcgattaataggtgtaacggtcgggagtttagagcaatctgattttaaaaatttaacaatatatgattttatttaa

SEQ ID NO: 1924 - DNA, 435 bp, Staphylococcus epidermidis
atatcttttgttttacctgtttccggtaatttatcttgtacatcattgttattatctttcttggaagttgttgtaatttcgtcttctttgtctttcttagttatttttgtgtctttctcgtctttgccgctttttggtattactgggcttttctcctctctatctttcttcaaagtttttgtgattttcttttctttgtctttttttggtgtttttgtgtcttcgtctttctcgactttaccgttacttggtattactggttttttctcttctctatctttcttcggagtttttatgtctttcttttctttgtctttctttggtgtttttgtgtctttagattctttctcatctttatctttctttagtgtttttgtgtcttcgtctttctcgtttttggtaatttgtgtatttgttactgaagtatttgcttga

SEQ ID NO: 1925 - DNA, 903 bp, Staphylococcus epidermidis
gcactaaatgttgggaaaataagcataagcgtatttttgaagttgctgaacacgttaaagagatggaggatgaaaatgagtagattgcaagatgttgtggttaatgaaatgaaagtaaaaaaacaaattgacagtgtagaggaaatccaggaaattaagcaatttattaaagcgtatgtaaaatcacattcatttatacaaactcttgttcttggaatatcaggtggtcaagactctactctaacaggtaagttagcacaattagcagtaaatgaattgaaagaagagggacgtaactgtaaatttatagcagtgaaattaccttatggtgtgcaacaagacgctcatgaagtagaagatgcacttgagtttattaatcctgacacaacatatacagttaatattaaaccagcagttgatcagagtgttcaatcacttagtgaagcaggcatcaaacttactgattttcaaaagggtaatgaaaaagcacgtgaacgaatgaaagttcaattttcaattgcttctaatactcaaggtatagttttaggaactgatcactctgccgaaaatattacaggattttacactaaatatggagatggtgctgcggatattgcgcctatctttgggttaaataaaagacaaggtaaacaattactagcttatctaggagcacctaaacacctttatgaaaaagtgccaacagctgatttagaagatgataaacctcagttaccagacgaggaagcactaggcgtatcttatcatgatattgatgattatttagaaggtaaagaaattcctggaactgctcgtgaaacaatcgaaaaacattatgttagaaatgcacataagcgtgaacttgcttatacacgatattcatggcctaaatataacaaatga

SEQ ID NO: 1926 - DNA, 846 bp, Staphylococcus epidermidis
attgtaggtgtgaaaatgatagataatttaattgtatatattaaaaacttaccacatctttttagtttttgtactcaaaggcttaagcaaacatggaagtggtttgcaattagcctaattataggactagtaattattctagcattagagggattttttaatttcaaccatactaccgatattgttcaagtgcgttggttattcagaatttcatcattcatcatattcagcattattatacaatctatttatatagcttataagtactatatcagagatttcgttgtcatgaagtcatttcatatatctgcagttacacctactatagttatagcgatgttaggtttaataacaatacttattctggggatagttattattattcttaagcctgtgaattttgaagcatcaatactttcatttttatattatttagtaattttagcaatttttatcagtgtgacttcgataatattgggcttgctgagttatgcaattaaacatgtaaaactgatatttattatagtaagtgctatcagcttctttatggttccaattacatacatccctaatacaaatttaaatgtggttaatcatattatgatgttaaatcctctgtattatttcgtaaatggtagttcgcaagctatagtatttggtacaatcagcatgagcaatttaccttatcatttatatattattattttaattggaatcatctgtgtgattaattatgcgcttgtgcgtcacatagcatttgataaatatcaaaaccaatctaaccaaaagaattattcaaaaaagaataaagaaaaggaatgtttaaacgtaaaattagataagtaa

SEQ ID NO: 1927 - DNA, 777 bp, Staphylococcus epidermidis
caccaatgcttgaacaacttaatcgctcatttgaaggagggcaatcgtaagatgaatgaactaacggtttatcatttcatgtcagataagcttaatttatacagtgatattggtaatatcatggcattaaaacaaagagctaaaaaaagaaatattaagataaatgttaaagaaatcaatgagactgagggagtcacatttgatgattgtgatattttcttcattggtggtgggagtgatagggaacaagcgcttgccacgaaagaattaagtaaaattaaaacttctttaaaaaatgcaattgaagatggtatgcctgggttaactatatgcggtggttatcaatttttaggtcataagtatattactcctgatggtaccgagttagaaggattgggtgttcttgacttctataccgagtctaaaaaagaacgcttaactggagatatcattatagagagtgatacttttggcacgattgttggatttgaaaatcatggtggtagaacatatcatccgtatggaacattaggccgagtaacgtatggttatggtaataatgataacgatcgaaaagaaggtatacactataaaaatctattaggttcttatcttcacggcccaattttaccaaaaaatcatgaaataactgattatctacttgagaaagcatgtgaaagaaaagggatactatttgagcctaagaagatcgataacacagaggaagaagctgctaagcaagttcttattaaacgtgcaaaagaaaataaaaaataa

SEQ ID NO: 1928 - DNA, 357 bp, Staphylococcus epidermidis
attcagatagtgattcagattcagatagtgattcagattcagacagtgactcagattcagatagtgactcagattcagatagtgactcagattcagacagtgattcagactcagatagtgactcagattcagacagtgattcagactcagatagtgattcagattcagatagtgattcagattcagacagtgattcagattcagatagtgattcagactctggtacaagttcaggtaagggttcacataccggaaaaaaacctggtaaccctaaaggaaatacaaatagaccttctcaaagacatacgaatcaaccccaaaggcctaaatacaatcaaacaaatcaaaacaatataa

SEQ ID NO: 1929 - DNA, 618 bp, Staphylococcus epidermidis
aaaaataaagtattaacatttttaaggaggtctatgatgaaattacaacatattaccaaaaaatatggtcaaaatactgttttagacgatatagattttgatttcggcgagagtcaaatcgttggtcttatcggtaaaaatggagttggtaaaacaactttgatgaaggtcatgaataataacatcattaactatcaagggaaagtcgacatgcctaaaagtgagaatgttggttatttaattgagcatcctaagttatatggaaacaagacaggtttatttaatttaaaattatttgcacaagtattaggcgatggtttcgataaggaatatgcaaatcatattattgaagcttttggaatgaaaccatatatcaagaaaaaagttaacaaatattcaatgggaatgaaacaaaaattatcaattgcagtttcattaatgaataaacctaaatacttaattttagatgaacctacaaatggtatggatccagatggttcgatagatgtattaaagacaattcaatcacttgttcaacaattagaaatgaaaatattaatctcaagtcataaattagaagacattgaattgatttgtgatagagcagtatttccttag

SEQ ID NO: 1930 - DNA, 537 bp, Staphylococcus epidermidis
catttgggagtagaacaaagatatgctgttattcaactcaaaacaaagtacaatgctacattcttaaaaagtgagtttgataaatgggaacaacacattgaagatatgtacgctttacattatccaagaatgtttattgatccatacactatgcagttgtcctatgaatcaaatcacattgaagatttggcattaagtattattgaagaacgtgagaagctagaaaaatttaagcataaatctaatcatgatttaaagaagtttaacattatactatctaactatagtgatagtgaacaacgtcagataaaaagatatcaaagagatgacatattagctgatgagagccttatattacgcatatgtgaggacataagcaacatagatagtaaggacaagaataatagaaatactgctatacaagaagaaattaaagctgataaagagcgacgtagggcagaaggtaaggcaagaaaagaaagaattaaagctcgtatgaaacgagcaagacaagaaaaacttttacaagcaaattaa

SEQ ID NO: 1931 - DNA, 333 bp, Staphylococcus epidermidis
aagaaagcggtatatctaatgaataaaaagaaaatgagtgaaatgtccgagcaagaactaagacatgaaatacaattatttaaagaaaaaatgcgtaaagcagagatgaatggcattatgaatgaatatgatgtttatcaaagcaaagtgattatagcagaaagctatcttgtggatcgcaataaaattgaacctggaaaaatctataaactcaatgatggtagtaaacagtactttaaagtagaacgactcaagggtgtatttgcatggggatttagaataaacagtagtgaacctgaggaaggtctaccattagcattattaaaattttag

SEQ ID NO: 1932 - DNA, 375 bp, Staphylococcus epidermidis
ggttaccaggtttttttccggtatgtgaacccttacctgaacttgtaccagagtctgaatcactatctgaatctgaatcactgtctgaatctgaatcactatctgaatctgaatcactatctgagtctgaatcactgtctgaatctgagtcactatctgagtctgaatcactgtctgaatctgagtcactatctgaatctgagtcactatctgaatctgagtcactgtctgaatctgaatcactatctgaatctgaatcactatctgaatctaagtcactatctgagtctgaatcactatctaaatatgtgtcattttctgagtcactatttgaaacgatatctgtatctaaatcattatccgaattcatactaa

SEQ ID NO: 1933 - DNA, 468 bp, Staphylococcus epidermidis
gaaggtctatttgtatttcctttagggttaccaggtttttttccggtatgtgaacccttacctgaacttgtaccagagtctgaatcactatctgaatctgaatcactgtctgaatctgaatcactatctgaatctgaatcactatctgagtctgaatcactgtctgaatctgagtcactatctgagtctgaatcactgtctgaatctgagtcactatctgaatctgagtcactatctgaatctgagtcactgtctgaatctgaatcactatctgaatctgaatcactatctgaatctaagtcactatctgagtctgaatcactatctaaatatgtgtcattttctgagtcactatttgaaacgatatctgtatctaaatcattatccgaattcatactaattcctgtgcgactagtgtcattcactcgattgataatattgctcttagctgtatttctatcaatctga

SEQ ID NO: 1934 - DNA, 948 bp, Staphylococcus epidermidis
ttgaaaatattaaataaaaagaggttgatagatatgaaatttactgaaagcgaacgtcttcagcaactttctaatgaatatattttgggaggtgtgaattcaccttcaaggtcgtataaagcagtaggtggtggggcaccagtagtaatgaaagaaggtcatggcgcttacttatatgatgtagatggtaataaatatatcgactatctacaagcttatggtccaataataactggtcatgcacacccacatatcaccgaagctatccaagatcaagcagcaaaaggcgtactttatggtacccctactgaattagaaataaatttctcaaaaaaacttagagaagcagttccttctttagaaaagattcgtttcgtgaactctggtactgaagcagttatgacaacaattagagttgctcgtgcttatactaaaagaaacaaaatcattaagtttgcaggctcttatcatggtcattctgatttagttttagtggcagctggaagtggaccttctcaacttggttctccagattctgctggtgtcccccaaagtgttgcacaagaggttattacagtaccgtttaatgatatagaatcatatagagaagctattgattattggaaagacgacattgctgcagtattagtagagccgattgtgggtaattttgggatggtcatgccacaaccaggtttcttagaagaagtatataaaatttctcatgataatggaacattagttatctatgatgaagttatcactgctttttcgttccattatggtgcagctcaagatttattaggtgttaaaccatacctcactgcttttggtaagattgttggcggtggtttaccaattggaggctatggtggtcgacaagatattatggagcacgttgcaccatttacgtccagccttatccagcaaggaacaatgggcgggtaa

SEQ ID NO: 1935 - DNA, 294 bp, Staphylococcus epidermidis
tatatacaattaaattatctatcattttcacacctacaattcaatataaatccatttttcttctttcatatcagcgataaaataaccgcttccactttttgtaatccatacatctttcgtgatattaaatgtttttttcaattccgttttatttgtcattggaataacaaatccagacagtttatcattatcaccaaatatcatttttataggttgttgcgtgatcggtacaacatactttttatctttatcaggtctaagcgtttctgttactttatcatgtttttgatgtaa

SEQ ID NO: 1936 - DNA, 1422 bp, Staphylococcus epidermidis
aagaagaaattagcgttttatattctaggctgtatgaggatatttaaaataatggacaataaaattgaaaagattctagaagatattaataaattacaaggctataaagtaacatatcaatatgctactgctataaatataaaagataataacatgaacccttggtttgaaaaaattgaggaaattctattgaatgtaaaaggagttatacgcattttatctcctgacaaccccccggtaaattatgattattggattttacctggaagatataaaagacatacaaaagaatatcacgaaaaactagaaaaatttttagaaaaatttgctactaatgcaaatattaatgatggattgtttgatcaaaataatatacatggatacaaatataaaaaatatatattcactccacatattgaaattactcatgagaacactttgaatttattttttttaaccttaactatatttaacaatggtacatttgttatagaaatcattgaagacttagagagtataaactttggaagcgacttgtatagtactttctcatgtgtaaaagataagatatatcctctaattaatcaagaaaaaaataatagacaaagacagtatcaattttatggtaatagacattgtaaaaatattagagatgtttctagacaaattaatagaattataaaaattaatagtaaggatatttttgaatataaagtatctaaaaatatgggttttgaagtttattatttagctaatgaaaatgaatttactgatgatcctttctatgaggacgtgaagattcaagagtggttagtaaatgcgcctattttttcatttgaaggaaaaagtaaacattttaggcaagatggttatagcgataattatataaacttcttgaataaagcatctgtttttgtagtttggatggatgagcaagaagaagatgttttagaaaaatgttctcaaatggcactttatttcaatagttctgctaatttctttttcttagaaactatgttaaatgaattacaattgtatgggtatcaacaatataatttaaatggaaaaaaagaagccctatattttagacaatggatactaaatttcaagagatctattgcaattatttatagaacagagcttttacctagtttatatttatatttgtatctaaagaataataatgattttaaatctccacaatatattgaagaattaaacaaagaagaattatcactaattgaattggagcagtcatataaggaagaagaaagaagcgaaaaattaaataaacttttgttaataataagtcttttatcaattttccaagtagtagaaatttttttcagtgataaaaataatatatttaatatcagtatgatacttataatgattttgctagaagtatttcgaaaaaggtaa

SEQ ID NO: 1937 - DNA, 975 bp, Staphylococcus epidermidis
gtatatgaatttgagggattaactatgagaaaacgtgcaagaattatatataatccaacatcaggaaaagaactttttaaacgtgtattaccagatgcactgattaaacttgagaaggcaggttatgaaacgagtgcatatgcaactgaaaaaattggtgatgctacttttgaagctgaaagagcactagaaagtgaatatgatttactcattgcagctggaggtgacggtacgttaaatgaggtggtcaacggaatcgccgaacaacccaatcggcctaaattaggtgtaataccaatgggcaccgttaatgactttggaagagcacttcatttaccaagcgatataatgggggcgattgatgtaatcattgatggtcacacaaccaaggtagatattggaaagatgaataatcgttatttcattaacctagctgcaggggggaaactaacacaagtatcttatgaaacaccaagtaagttgaaatcaattgtaggaccgttcgcgtattacattaaaggattcgaaatgttacctcaaatgaaagcagtagatgtacgtatcgaatatgatgataacatcttccaaggagaagctttactattccttttaggtttaacgaattcaatggctggctttgaaaaattagttccagatgcgaagcttgacgacggttatttcacgttaattattgtagaaaaagcaaatcttgctgaattgggtcatattatgacactagcgtctcgaggtgagcatacaaaacatcctaaagtcatttatgctaaagcgaagtctattaatatttcatcatttactgatatgcaacttaatgttgatggtgaatacggtgggaaattacctgcaaatttccttaatttagaacagcacatagaaatttttacacctaaagatgtatttaacgaagaactattagaaaatgatacgataactgatattacgcctgataagcaataa

SEQ ID NO: 1938 - DNA, 2055 bp, Staphylococcus epidermidis
ttcatcatgtcaaaagttcatcttattgagagcccatatgcattagataaaattaaaggtataggtccgaaacgtttagcgttgttagaagaattaaatattaaatcagttgaagatttagtattatatttaccaacacgttatgaagataatactgttattgacttaaatcaagcagacgatcaagcaactgtaacagtgcaaggtgaggtttattccagtccaactgttgctttttttggtcgtaataaatcgaaactaactgtccatcttatgataaatcatatcgctgttaaatgcgtattttttaatcaaccttatttaaaaaagaaacttgaactaaatagtattgtcactataaaagggaaatggaatcgtaataaacaagagattaatggtaatcgtatattttttaaagatcaaaaaaatcaagaggatactcatttagaaccaatatataggattaaagaaggaataaagcaaaagcagttacgcgataatattagacaggcgcttagtgatgttacaattcatgaatggttaactgatgacctcagagaaaagtataaattagaaactttagcttatacaatacaaacactacatcatcctattaataaacaaaatttgctaagagctagacggacttatgcatttacagagctatttatgtttgagctacgtatgcaatggttaaatcgcttagaaaagacatcagatgaggctattgaaattaattacgatataaataaagtaaaacaatttattgatagtttgccatttgagttaactgacgctcaaaaagttagtgtcaatgaaatatttcgtgatttaaaggcgcctattcgtatgcatcggttgttacaaggtgatgttggatctggcaaaactgtggtagcagcaatttgtatgtacgccttaaaaactgcaggctatcaatctgcattaatggttcccacggagattttagctgaacagcacgctgaaagtttaatacaactatttggtaatacaatgaacgtagctttattaactggttctgttaaagggaaaaaaagacgacttcttttagagcaattagaaaatggaactatcgattgtttgattggtacacacgccttgattcaagatgatgtagtcttcaataatgttggattagtcattacagatgaacagcaccgatttggtattaaccaacgacaaattctaagagaaaaaggtgcaatgacaaatgtattgtttatgacagcgacaccaatccctagaacactcgctatttctgttttcggtgaaatggatgtatcttcaattaaacaattaccaaaagggagaaaacctataaaaacaagttgggccaaacatgaacaatatgatcaagtacttgcacaaatgtcgaatgaattaaaaaaaggtagacaagcctatgtcatctgtccattaattgagagctctgagcatttagaagatgtacaaaatgttgtggcactttatgaatccttacaaagtgattatggtaatgaaaaagttggattattacatgggaaaatgtctgcagaagataaagatcaagtcatgcaaaaattcagtgaacatgaaatagatattttagtttctactactgtagttgaggtaggtgtaaatgtacctaatgcaacgtttatgatgatttatgatgcagatcgattcggtttatctacattacatcaattacgtgggcgtgttggtcgtagtgaacatcaaagttattgtgtattaattgcatctcccaagactgaaacaggtattgaacgtatgaccattatgactcaaactactgatggattcgaattaagtgaaagagatttagaaatgagaggtccaggggatttctttggagtaaaacaaagcggtcttccagactttcttgtagcaaatgtagtagaagattatcgtatgcttgaagttgctagagatgaagcagcagaacttatacaatctggccaatttttcgaacaacaatatagtcatttaagagagtttattaaacaaaacttacgccatattcgtttcgattag

SEQ ID NO: 1939 - DNA, 207 bp, Staphylococcus epidermidis
cttagcactttcatattatgtttagtacgtggattgttatacatatttacattcattgcgggtgcaacgaattttggtgttgttgtagcaagtaatgtagaagtaattaaatcatcagcaattccaacacttaattttgcgatagtattagcagttgctggcgcgactataatcgcatctgcccagtctcctaatgatacatgttga

SEQ ID NO: 1940 - DNA, 750 bp, Staphylococcus epidermidis
agacatatgttaaacgcacaatttttcactgatactgggcaacatcgtgagaaaaacgaggacgctggcggtatattttacaatcaaacacagcaacaaatgctagtattatgcgatggcatgggtggacatcaagctggagaaatagctagtcagtttgttacttatgaacttcaaaagcgttttgaagaagaaaatctaattgaaataaatcgtgctgaatcgtggttgcgttcgaacattaaagaaatcaattttcagctgtacaactatgctcaagaaaatgaagattacagaggtatgggtacaacgctcgtttgtgccatcatttatgacaaacaagttgttgtagcaaatgtaggagattcgcgcgcttatgtaattaatcagagacagatggatcaaattacgagcgaccattcatttgttaatcacttagtaatgactggacaaattactaaagatgaagcatttcatcatccacaacgtaatattattactaaagtcatgggaacagataaacgtgtttctccagatttatttatcaagagaactcatttttatgattatcttcttttgaactctgacggacttactgattatgtcagagattatgaaatccaagaactactaagttcaaataattcattagacgtccatggtaatgagttattggacttagcgcttgcccatgattcaaaagataatgtcagctttatccttttaaagttagaaggtgataaagtatga

SEQ ID NO: 1941 - DNA, 540 bp, Staphylococcus epidermidis
gatataatgttaagtgttgctttagatgacattaaaaagaatggaggcacttctttgaaaaagaaatactatattagcatctctttacttatgacaatcattgtattagttttcgatcaagtttctaaatggcttattacaatctcaatgaaggttggagattcatatgaaattatccctaactttttaaatattacatcccatagaaacaacggtgcagcatgggggattttgagtggtaaaatgctatttttctatattattactatcattattttaatcgttttagttattttttatattaaagaagcacaatttaatttgtttatgcaagttgcaataagcctattatttgctggagctttaggaaattttattgatcgcgtattacatggcgaagttgtggattttattgatacaaatatattcggatacgattttcctatctttaatattgcggattcaagcttaacaattggagttatattcgtaatcatcgcactcattaaagatgcaatcataaataagaaggaggtctag

SEQ ID NO: 1942 - DNA, 240 bp, Staphylococcus epidermidis
aaaaatgttactggaggtcaaaaaataatgttaaatccaccgttaaaccaacttactgcaaaagtgaattcaaaatatcttattgccactacggcggctaaaagagcacgtgaattagatgaaaaacgcgaaacagcgcttttagatcagtaccattcagctaaacctgttggaaaagctttagaagaaattgctgatggtaaaatagaacctgttgtaccgaaagagtatttaggataa

SEQ ID NO: 1943 - DNA, 564 bp, Staphylococcus epidermidis
agatatgagtttttttatattaaaagaggtgaaacaatgtctgaacgaattattttagatgaggcagcgatacaacgtacaattacacgaattgctcatgaaattctagaatataacaagggaactaaagatttagttctattaggcattaaaacaagaggtgcttttttagcacatcgtatacaagataaaataaattcaatagaacaacaattagtaccaacaggtactatcgatatcacgcattttcgagatgatgttgataaggtagtgcaacaagctgatcaatacgcttttgatattaatgtagatattaataacaaagtggttgttatcattgacgatgttttgtataccggacgtacagtaagagcctcattagatgcgattttattacatacaagacctattaaaatagggcttgcagcacttgtggatcgtggtcatcgtgaactccctatacgcgcagattttgtaggaaaaaatatacctacagcacgagatgaatctgtttcagtttatttagaagaaattgacgatagaaatgcagtcgtcattgaataa

SEQ ID NO: 1944 - DNA, 912 bp, Staphylococcus epidermidis
attaagctttatttctataggaggcgctttatggaacacttattatcaatggagcatttatctaattcagaaatttatgatttaattactatcgcttgccaattcaaatctggtgagcgaccattacctcaatttaacggtcaatacgtatcaaacttattcttcgaaaattcaacgcgaacaaagtgtagctttgagatggcagaacaaaaattaggattaaaacttattaattttgaaacaagtacatcatctgtaaaaaagggtgagtcactttatgacacatgtaaaacacttgaaagtataggtgttgatttacttgtcatacgtgactcccaaaattcttattacgaagaactggatcaattaaatattccaattgctaatgcaggtgatggaagtggacaacatcctactcagagtttattagacataatgacaatatatgaagaatatggttcgtttgaaggtttgaatattctaatatgtggggacattaaaaattctcgtgtcgcaagaagtaattatcatagtttaacatcattaggtgccaacgtaatgttctcaagtccaaaagaatgggtagataatacattagaggcgccttatgttgaaattgatgaagtcattgataaagtagatattgttatgttgcttagagttcaacatgaaagacatggaatttcaggtgaagctaactttgctgctgaagaatatcatcaacaatttggtttaacacaggctagatatgataaattaaaagaggaagccattgtaatgcatccagctcctgtaaatagaggtgttgaaattaaaagcgagctagttgaagcacctaagtctcgaatatttaagcagatggaaaatggaatgtatttaagaatggcagtaataagtgcgcttttacaatag

SEQ ID NO: 1945 - DNA, 195 bp, Staphylococcus epidermidis
tgggtagatttctcacactcatcttctccttttaacttctatcataaagattatacatttctcatagtaaacgtcatgctttcaatgacatttgttaaagcactggcagtatccagtgatgttaaacaaggtacaccattttcaactgttgtacgtcgaatttggaatccatctcgttcgatatcttttccttga

SEQ ID NO: 1946 - DNA, 933 bp, Staphylococcus epidermidis
gaaggaggtctagttttggaaaattataattttaatattatcgaacaatcacaagttggacaacgtatagataaacttgtttcagatttaaataaagattggtcacgtagtcaacttcaagattggattaaagaaggtttagtcaaggtaaatggtaaagtaattaaatcgaactataaggtcaagttaaatgacaaaattgttgtaaccgagaaagaagtcgtagaggcagatataaaacctgaaaacttaaatttagatatttattatgaagacgaagacgttgctgttgtatataaaccaaaaggtatggttgtacatccatctccaggccattatagtggaacattagtaaatggattaatgtatcaaattaaagatttatcaggaatcaatggcgaaatacgtcccggcatagttcatagaatagataaagatacgtctggtttattaatggttgctaaaaatgatgttgctcatcgtcatttagttgaacaacttatgtctaaaactgttaaacgaaaatacacggcgttagttcatggtaatatccctcatgattatggcactattgacgcaccaattggtcgaaataaaaacgatagacaatcgatggctgtggttgatgacggtaaagaagctgtgacacactttaatgtattagagcattttaaagattatacattgatagaatgtcaattagaaacagggcgtacacatcaaattcgtgtacatatgaaatatattggttatcctcttgtaggggatccgaagtatggacctaaaaaaacgttagatatcgatggacaagctttacatgctggtataattggtttcgaacatcctgtaacacatgaatacattgagaagcatgcaacattacctaacgattttgaaaagttactagatgatataagacgtagagatgcataa

SEQ ID NO: 1947 - DNA, 735 bp, Staphylococcus epidermidis
gtggaaaaacaaaaaagaacaagttacacattcattatcaaacactatttaaatagctatcaatcaaggaggattatcatgccttttacaccaagtgagattaagaataaagaatttacacgagtaaaaaatggtttagaacctacagaagttgcaaattacttagagcaactaagtaatgaaatcgaacgtttaaaagaagataaaaagcaacttgaaaaagtcattgaagatagagattctaatattaaatcatataaagatgttcaccaatcagtaagcgatgcacttattcaagcacaaaaagtaggagaagagacaaaacaagcagcaactaaagaagctgaagccgttttatcaaaagcacaagtacaagctgacagtattgtgaatgatgcaattgaaaaagcgcgtcgtctagctttccaaactgaagacatgaaacgacaatctaaagttttccgctctcgtttccgtatgcttgttgaagcacaacttgacttactcaaaagtgaagattgggattacttactcaattatgatttagacgccgagcaagtgacattagaagatattcatcatcttcatgataatgatttgacacctgaagaacgtgcaatgaaacaaaagcaaaatcaagaaatatcggctaatcagccttctacatcaagttcagaatctgtgagtcaatcaaatgcaaataacgaatcatcacaatcaacatcaaataattaa

SEQ ID NO: 1948 - DNA, 1203 bp, Staphylococcus epidermidis
ataatgaaacatattttattagctgttacaggcggtatcgcagcatataaagcaattgatttaacaagtaaattaatacaatccggctatgatgtaagagttatgctatctgatcatgctcaagagtttgttactccgctagcttttcaagcaatcagtagaaatcctgtttacacaaatacatttaaagaagaaaatcctgaagagattcaacatgtatcattaggagactgggcagatgcgattatagtcgcgccagcaactgctaatactatcgcaaaattaagtgttggaattgctgatgatttaattacttctacattacttgctacaacaacaccaaaattcgttgcacccgcaatgaatgtaaatatgtataacaatccacgtactaaacataatatgaaagtgctaagtcaagacggatattattttattgaacctggtagtggctatttagcatgtggttatgtagcaaaagggcgaatggaagaacccatgcaaatcctatctgttattaataaattttttactcaacagaagaatgttgtcaaaagctctttttctggaaagcgcgcattagttacagctgggcctacagttgaagttattgatcctgttcgatacgtatcaaatcgttcatcaggaaaaatgggatatgctatagctgaagcattacgagataagggagcaatcgtaactttaattagtggtcccacccacttatctctacctgaagggattaatgtagtaaaagttgagagtgcagatgatatgtttcaagctgtaaccgaacgctttgcgaaacaagatatagtgattaaagcagcggcggtgtctgattatacaccaatggacatacttgaacataaattaaaaaaacaagaaggaggattatctgttcaatttaagcgtacaaaggatattttaaaatacttaggagaaaataaaacgcaccaatatcttgttggttttgctgctgaaacacaaaatattgaacagtatgctctagacaaactcaaaagaaaaaatgcagatgttatcatttcgaacaatgtaggtgatacatccataggctttagttcagatgacaatgaattaactatgcattttaaaaataatgaaaaagtaaatattaagaaaggaaaaaaatcagctttagcacatcaaattatagaaattttagaaactaggtggcagtaa

SEQ ID NO: 1949 - DNA, 204 bp, Staphylococcus epidermidis
atggaagttaataaagtcatttatattttactagcagtctttcttggtagttttggcatccacaaattttatgctggtaaaccaattcaaggattattgcatattctattttgttggactgctatcccgcatgtgttagcaattattagtgcagttttaacattattcaaacctgccgacgcaaacgggaacgtcagaatgtaa

SEQ ID NO: 1950 - DNA, 741 bp, Staphylococcus epidermidis
gttgtggctaaccagaaaaagaaagaaatggtacatgattttcaacaaaaatttactgataaaatgaagtcgttaggattacattttaaaaatattgatttatatcaacaggcattctctcattcaagttttattaatgactttaatatgaatcgtttagaacacaacgaacgcttagaatttttaggtgatgcggtattagaattgacggtttcacgctatctttttgacagacatcctcatttaccagaaggtaatttgacaaagatgcgcgcaacaattgtttgtgaaccttcacttgtgatatttgcgaataaaattaaattaaacgaactgattttattaggtaaaggtgaagagaagacaggaggcagaacaagaccttcccttatttcagatgcatttgaagcttttgtaggtgcactatatttagatcaaggtttagattcagtatggacctttgctgaaaaagtcatctttccgtatgtagaagatgacgagcttgttggtgtcgtagactttaaaacacaattccaagaatatgtgcatagccaaaataaaggagatgtgacataccaattaattaaagaagagggtcccgcacatcatagactatttacatcggaagtgattttagaaaataaagcagttgcagagggtaaaggaaagacaaagaaagaatccgaacaaaaggcagcagaacaagcgtataaactaatgaaaaataaaaaatcattataa

SEQ ID NO: 1951 - DNA, 810 bp, Staphylococcus epidermidis
aaggaaaataagatgtttcataacaaaaatgcaaattttgtaaatggtgtaactatcaatattaaagataaagaaacaattaaaacattttatgagaatgttttaggatttaatcttatcaatgaatctgaaactgctgtacaatttgaagttggcgattcaaatcaatttattacttttattgaaatacagaatggacgagaaccgttaatgtctgaagcaggtcttttccatattggtatattgttgcctactttgactacattagctgatttactcgtacatttaagtgattttgaagtaccagtgaacggtggacaacaaagtgttgcaacatgtttatttattgaggatccagagggcaatgctataaagttttatgtcgatcgtgagacagaatcatggattgatgagaaagaaggcagaattagaatggatattgctccaattaatgtacctcgattactgcaaaacgtctctcatactcaatggcagggcataccagatgaaactaaattaggttcattacatattaagtccattcgaatttctgatgttaaatcatattatttaaattattttggactagaagaatcagcatatatggacgattattctctatttttatcttcaaacgagtattataatcatttggctgttaatcagtggttatctgcgacaaaacgagtagataatgaacatacctatggtttagctatgatagattttcactatccaaaaacaacacataaaaatcttaaaggacctgatggtatttattttagatttaatagaataaaagaagtgtga

SEQ ID NO: 1952 - DNA, 648 bp, Staphylococcus epidermidis
aggaatgataatgtgaagattaatttattatgttctcaacgtttattacctaatcatatttttgaaaaagaaaaagattctaattgggcaggtattgatagaggtgcgcttatactcgtaaaacaaggtattcaacctatattttctgtaggtgattttgactcagtgaataatgaagaacgtttgatgttgatgaaaaatcttcaaatcgaaccggttgaagctgaaaaagatgatactgatttagctttaggagtagctcaagcagttgaaagaggatacacagaaattacaatttatggtgcaacaggcggtcggttagaccactttatgggtgtgcttcaaattttacaaaaacctcaatacttacatcaatctataaaaataaaagtcattgatcaacaaaatcatattcaattattaaatgaaggtaagtatgtaatcaacagagatagtacttatccatatatatcgtttatccctctaaatgataaaactatattaactttacagggtttcaaatataatttaaatcaagaacacttaaatttaggctctacactcacaatttcaaatgaagtaaaggttaatgaagcaatcattcgagttgaacaaggaacagttttaaaaatacgtagtcgtgactaa

SEQ ID NO: 1953 - DNA, 633 bp, Staphylococcus epidermidis
gtaatagataaagaaagtgttatgatatttaaggaatatttaagacttggtactaaaatgaggggtgagcgtttgaaattaaagaaaaacgatagacgagtagccattaaagaggctatcgaattaaaccccttcatcactgattatgaattgtgtgagaagtttgatgtaagtattcaaactatacgtttagatcgcacgcatttaaatattcctgagttacgtaaaagaattaaattggtagctgaacaaaattatggacgaattaaatcaatagaagccaatgaaattataggtgatttgattcaagtgaatcctgatgttagcgcacaatctttaattgaaattacaattgattctgtttttgcaaaaagtgagattgctagagggcacgtcttatttgcacaagctaactcattatgtgtagctcttatacataaaccaatagtattgacacatgaaagtcaagttgaatttaaagaaaaagtaaaattaaatgatacagttcgagcagatgcccgtgtcatagatataacagataagcattatattattgaagtgaattcttatgtttcagatatgttagtttttaaaggtaaattcaaaatgtactatacaagtgaggatgaatga

SEQ ID NO: 1954 - DNA, 627 bp, Staphylococcus epidermidis
ggcatggataaggaaaaaggactgttaattgttctttcaggcccttcaggtgttggaaagggaactgttagaaagaagatatttgaagacccaactacttcatataagtattctatatcaatgacgacacgtcatatgcgtgaaggtgaaattgatggtgtagattacttctttaaaacaaaggaagaatttgaggcgttaattaaagacgaccagtttattgagtatgcacaatatgtaggtaattactatggtacacctgtacaatatgtaaaggatactatggaagaaggtcatgacgtctttttagaaatcgaagttgaaggtgctaagcaagtaagaaagaaatttccagatgcgttgttcatatttttagcgcctccaagtttagatgacttgaaagaacgtcttgttggtagaggaactgaatcagatgaaaagattcaaagtcgtgtgaacgaggcacgaaaagaagtagaaatgatgaatttatacgactacgttgtagttaacgacgaggttgaactcgctaagaatcgaattcagtcaatagttgaagctgagcatttaaaaagagagcgaatcgaagctaaatatagaaaaatgttactggaggtcaaaaaataa

SEQ ID NO: 1955 - DNA, 192 bp, Staphylococcus epidermidis
cacgaattcaaaatggagaagtgcaaattgtttttttttttttttattcaaggaaaagatatcgaacgagatggattccaaattcgacgtacaacagttgaaaatggtgtaccttgtttaacatcactggatactgccagtgctttaacaaatgtcattgaaagcatgacgtttactatgagaaatgtataa

SEQ ID NO: 1956 - DNA, 246 bp, Staphylococcus epidermidis
ctattactaaatgtaactttcaagttggacaaagaatttttgtctgatttcaagcttgttttatacgctattcaactattttataatttactagtaattaaaaaacctaggacaatttttatgtcccaggctctaccaatattaataaaactttatcctaaatactctttcggtacaacaggttctattttaccatcagcaatttcttctaaagcttttccaacaggtttagctgaatggtactga

SEQ ID NO: 1957 - DNA, 3114 bp, Staphylococcus epidermidis
aggatttcaaagaaaaggagcgtcaaatcaatgcctaaaagagatgatattaagacaattttagtagtcggttcaggcccaattattattggacaagctgcagaatttgactatgcaggaacacaagcttgtctagcattaaaagaagaaggctacagagttattttagttaattctaatcctgcaacaataatgacagataaagaaattgccgataaagtctacatagaaccattaacgcacgattttattgctcgtattattagaaaagaacaaccagatgcattattacctactttaggtggtcaaactgggttgaacatggcgattcaacttcatgatagtggtgtgttagaagctaataatgtaaagttgttaggcacagagctagagtctattcaacaagccgaagatcgtgaaatgtttagaacattaatgaatgatttaaatgtacctgtaccagaaagcgatattgttaatacagtagaacaagcatttgaatttaaagaacaagttggatacccgttaattgtacgtcctgcatttacgatgggaggtactggcggtggtatttgccataatgatgctgaattaaaagaagttgttagtaatggtttacactatagccctgctacacaatgtttaatagaaaaatcaatcgcaggttataaagaaatcgaatatgaagttatgcgtgataaaaatgataacgcaatcgtagtatgtaatatggagaacatagatcctgtaggcattcatactggagattcaatcgttgttgcaccgagtcaaacactgtcagatgtagaatatcaaatgctacgagacgtatctttaaaagtaattcgtgctttaggtattgaaggtggatgtaatgtgcaactcgcgcttgacccacattcattgaattattacatcattgaggtcaacccacgtgtgtctcgttcatcagcattagcttcaaaagcgacgggttatcctattgcaaaattagctgctaagattgccgtaggtttaacattagatgaaatgcttaaccctatcacaggaacttcatatgctgcatttgaaccaactttagactatgttatttctaaaattccacgtttcccatttgataaattcgaaaaaggtgaacgtgaacttggaactcaaatgaaagcgacaggcgaagtcatggcaatcggtcgtacatatgaagaatctttactgaaagccattcgttcacttgaatatggtgttcatcatttaggtttaccaaatggagaaagttatgaattagattacattaaagagcgtattggacatcaagatgatgaaagattgttctttatcggcgaagcaattcgtagaggaacatctcttgaagaacttcataatatgacaaaaattgactatttcttcctaaataagttccaaaacattattgatattgagcatgaacttaaaaatcatcaaggtgatttagagtatttaaaatacgctaaagattatggttttagtgataaagtgattgctcatagatgggataaggaagaaaaagacatatatcaactacgtatgagtcaaaatattaaaccagtttataaaatggttgatacatgtgcagctgaatttgaatccacaacgccatactattatggtacgtatgaatatgaaaatgaatctatagtaactgataaagagaaaattctagtactaggttcaggaccaattagaattggccaaggggtagaatttgattatgcaactgtacatgcagtatgggctattcaaaatgctgattacgaagctattattgtgaataataatccggagactgtatctactgacttttcaatttctgacaaattatattttgaaccactaacagaagaagatgttatgaatatcattaacttagaacaacctaaaggtgttgtagtacaatttggtggtcaaacagcaataaacttagctgataagttagcacaacatggtgttaaaattctcggaacatcattagaagatttaaatcgagctgaggatagaaaggaatttgaagcgttattacgtgaaatagctgtacctcagccacaaggtaaaactgctacatcacctaaagaagctcttgaaaatgcaagagaaataggctatccagttgtagttcgtccttcatacgtgcttggtggccgtgcaatggagattgtagataatgatcaagaacttgaaaattatatgactcaagctgttaaagcaagtccagaacatcctgtattggtagaccgctatttaacaggaaaagagatagaagtggatgctatttcagatggtgagactgtcgtgattccaggaattatggaacatatagagcgtgcaggtgttcacagtggagattctattgcagtttatccaccacaaacactgactcaagacgaaattaatacactcgaagactacacaattaaattggcaaaaggtttaaatattaaaggtcttattaacattcaatttgtcatagctcacgacggtgtttatgtgttagaagttaatccgcgttcaagccgtacggtaccattcttaagtaagattactgatattcaaatggcacaattagcgatgcgtgcaattatgggtgaaacgcttgccgaaattgggttcaaacaaggtatccaaccatactctgaaggcgtatatgttaaagcgcccgtatttagttttaataaattaaaaaatgtagatataacgcttggaccagagatgaagtctacaggtgaagttatgggtaaagacctaacacttgaaaaagcgctatacaaaggtctcactggtagcggatttgaagtgaaagatcatggtacagtattgatgactgtaagtgataaagataaagatgaaatagtcaagattgcacatcgattaaatgaaataggctacaaaatattggctactcgtggaacagcacaaaagttaaaagatcataatattccagttgaggtcgtaggaaaaatcggtggcgaggatgatttactgacacgaattcaaaatggagaagtgcaaattgtttttttttttttttattcaaggaaaagatatcgaacgagatggattccaaattcgacgtacaacagttga

SEQ ID NO: 1958 - DNA, 1014 bp, Staphylococcus epidermidis
aggagggcaaacgttatggcatttgaaggattatccgatcgcttacaagccacgatgcaaaaaatgcgtggtaaaggaaaagtaacagaagcagatattaaaacgatgatgcgtgaagtgagattagcgttattggaagccgatgttaacttcaaagttgttaaggaatttgttaagaatgtttcagaacgagcgctaggttctgatgtcatgcaatctttaacacctggccaacaggttattaaaatcgtacaagaagaacttactagtttaatgggtggagaaaatacttccattaagatggcaaacaaaccaccaactgttgtcatgatggtcggcttacaaggtgcaggtaaaacgacgacagcaggtaagttggcattattaatgcgtaaaaaatataacaaaaaacctttacttgtggcaggagatatttatcgtccagctgctattgatcaattacaaacagtaggtaaacaaattgatatccctgtgtatagtgaaggtgatcaagtatcaccacaacaaattgttgaaaatgctttaaaacatgctaaagaagaacatctagatttcgttatcattgatacagctggtcgtttacacattgatgaagcacttatgaatgagcttcaagaagttaaagaaatctctaaaccagacgaaattatgcttgttgttgatgcaatgacaggtcaagatgctgtgaatgtggcacaatcatttgatgaacaattagatgtttcaggtgtaacattgactaaattagatggtgatacacgcggtggtgcagcactttcaatccgttccgttacccaaaaacctattaaatttgtaggtatgagtgagaaattggatggtttagaattattccatcctgaacgaatggcctcacgtattttaggtatgggtgatgttttaagcctcattgaaaaagcgcaacaagatgtagatcaagaaaaggctaaagatttagagaagaagatgagagagtcatcttcttctctaaatctt

SEQ ID NO: 1959 - DNA, 417 bp, Staphylococcus epidermidis
cgctttaaaaataaaactctgaaattttcaggaggaacagatatgacattagaaatttcaaatgactacggtaaaattgatatttcaaatgatgtaattgcatcagtagttggtggcaaagccgttgaaagttatggaattgttggtatggcatcaagacaacaagttagagatggtatcgctgaaatccttggacacgataactatgctaaaggcattaaagttagagaagacaacggaattattgatgtagacatgtatatcatcgtgagctatggtgtgaaaatttctgaagtagcaagcaatcttcaatcaactgttaaatatactttagaaaaaacactaaatgtgaaagttaattcaataaatattttcgtacaaggtgtacgtgtaaatgagacagtgaaaaaggtttag

SEQ ID NO: 1960 - DNA, 612 bp, Staphylococcus epidermidis
atggctaaaaatattgctaaagcattgttagacatagaggcagtttcattatctccaaatgatttatttacttggagctctggaattaaatcgcctatatattgtgataatcgaataactttaggctaccctgaagtgcgtaatgcgattagagatgggttaattcaattaattaaagaacatttttctaacgttgaaattatctcgggtacggccactgctggtatccctcatgcagcttacatttctgaaaaattagaattacctatgaattacgttagatcaaaaagtaaaagccatggtaaacaaaaccaaatagaaggtgcaaaaagcgagaataaaaatgtcgttgtagtcgaggatttaatttctactggaggttcttcgattacagctgtcgaagcattggaagaagcgggagctaatgtgcttggggtcgttgctatattcacatatggtcttgcgaaagcagacaagacatttaataaggctcatattccgttttacactttaagtgattataatgagcttatagaagttgcgaaagatgaaggtaaaatctctttaaatgatatccaaacattagttgattggcgagataacttatcgtaa

SEQ ID NO: 1961 - DNA, 1122 bp, Staphylococcus epidermidis
caagataaaaagaaaggaaagttagagatgataactgcagaaaaaaagaagagaaacaaattcttacctaatttcgaaaaacaatcgatctactccttaagatatgacgagatgcaacaatggcttattgatcacggacaacaaaaattcagagcaaaacaaatttttgaatggttataccaaaagcgtgtgaatactattgatgaaatgactaacctgtctaaagagttacgtcaaattctcaaagatcattttgcaatgacgacattgaccactgttgttaaacaagaaagtaaagatggaacaatcaagttcttatttgaattacaagatggttatactattgaaactgttttaatgagacatgaatatggaaattctgtctgtgtaacaacacaagtaggatgtagaattggttgtacgttttgtgcttccactttgggcggattaaagcgtaatttagaggccggagagattgtctctcaagtattaactgtacaaaaggcactagacgaaacgaatgaacgtgtatcacaaattgtcattatgggcataggtgaacctttcgagaattatgatgaaatgatggatttcttaagaattgttaatgatgataacagtttaaatattggtgcacgtcatattactgtatctacttcaggaattattccaagaatttatgattttgccgaagaagatatacaaataaattttgctgtgagtcttcatggtgctaaagacgaaataagatcaagattaatgcctatcaatcgtgcttataacgttgataagttaatggaagctattcgttattatcaagaaaagacaaatcgccgtgttacttttgaatatggattgtttggtggtgttaatgaccaacttgaacatgcgagagatttggcacatttaattaagaatctcaattgccacgttaatttaataccagttaaccatgtcccagaaagaaattatgtaaagacaccaaaagatgatatttttaaattcgagaaggaattaaagagattaggaattaatgctacaattagacgtgagcaagggtcagatattgatgctgcgtgtggacaattaagagcgaaggaacgacaagtagaaacgaggtaa

SEQ ID NO: 1962 - DNA, 1101 bp, Staphylococcus epidermidis
atgcttgaaaaacgttatcttgtactggaagatggctcttattacgaaggatatcgcttagggtcagatgacttatctataggcgaaattgtattcaacactgctatgacggggtaccaagaaacaatctctgacccgtcttacacaggtcaaatcataacttttacgtacccactaattggaaactatggtattaatcgcgatgattttgaatcattaacacctaaattaaatggggtagtagtaaaggaagcaagtacacaccctagtaactttagacaccaaaaaactttacacgaaacacttgctcaatatcatattcctggtatatcgggggtagatactagaagtattactcgtaaaattagaaattatggtgttttaagagctggatttacagataataaagataacattcaggaacttgttgaacagttgaaaactgctgaattacctagagatgaagttcaaacggtttctacaaaaacaccatatgtatcaacaggttccgatttaagcgtcgttttactcgactttggtaaaaagcaaaatatcgttcgtgaattaaatttacgtggttgcaacgtcacagttgtaccatatgatacgtcagctgaagagattttaggcatgtctccagatggtgtcatgctatcaaacggacctggtgatccagacgaagttgacgttgctttagatatgatcagaggcatattaggaaagataccattctttggtatctgccttggtcatcaactttttgcattatcacaaggcgcaacttcattcaaaatgaaatttggacatcgtggtgcgaaccatcccgttaaagatttaagaacaggtaaaatagatatcacgagccaaaatcacggctattctattgattgtgactcgctaaaaaatactgaccttgaagttacacacattgctttaaacgatggtactgttgaaggactaagacataaagaacttccagcgttttcagtccaatatcatcctgaagcaagaccaggtccaagtgattctaattacttatttgatgagttcatagcaatgatgaaggatttcaaagaaaaggagcgtcaaatcaatgcctaa

SEQ ID NO: 1963 - DNA, 1692 bp, Staphylococcus epidermidis
gacagtgaaaaaggtttaggaggacaacgtgaaatgattagcaaaataaatggtaaattatttgccgatatgattatacaaggggcacaaaatttatcaaataatgcagacttagtggattcattaaacgtctatcctgttccagatggagatacagggacaaatatgaatttaactattacttctggtcgtgaggaagtcgaaaataatttatctcaaaatattggagagttaggtaaaacattttcaaaaggattacttatgggggctcgtggtaattcaggtgttattctttctcaattattcagaggtttttgtaagaatattgaagaagaaaaagaaataagcgtgcaacagtttgctgagagttttcaagctggagttgaaacagcttataaggcagttatgaaaccggtagagggaacgattttaacagtagccaaagatgcagcaaaagcggcaatggattacgtggatcaagctgaagattgcgttgatttaatggcacatctgattgaagctgcaagcgaatctctagataatacgcctaatttattagcagtacttaaagaagtaggcgttgttgatagtggtggtaaaggtttattatgcgtttatgaaggcttcttaaagggtcttaaaggcgaaaaaatagaagcacaagcacctaaacttgatactgaatcatttgttaatgatgatcatgattttcatggggttattaatacagaggatattgtttacggttattgtacggaaatgatggttcgatttggtaaaaataaaaaagcattcgacgagcaagaatttcgtaatgatatgagtgaattcggtgattcgttattagtaattaatgatgatgaaattgttaaagtgcacgtacatacagaacatccgggtgatgtatttaattatggtcaaaaatatggtgaactaattaaacttaaagtagaaaacatgcgtgaacaacatcgtgaagttattcgtaaggaacaagatggacttcaaagtaaagaagctaatgaatccaaaacagttgaaacagctattgttacaatttctgtaggcgatgggattgctgaattatttaaatctatgggagcaacgcacattattagtggagggcaaacaatgaacccttctactgaagatatagttaaagttattgaacaatcacaatgtaaacgtgcaattatcttaccaaacaataaaaatattatgatggccagtgaacaagcagctagtattgtagaagctgaaactgtagtgattcctactaaatctattccacagggaatatcagccttattccaatatgatttagaatctagtttagaagataataaacgccatatgagtgatgctttggaaactgttcaatctggttcaattacttttgcagttagagatactaaaatagacggtattgaaatcaagaaagatgaattcatgggtctagctgaagacaaaattgtgacaagtgatgttaatcaatttcatgcagtaaaaggtctactcagcaaacttcttaatgaagatagcgaaattttaacaatgatttcaggcgaagatgctgataattcaattacaaaccaaatcattaattggattgaatcggagtaccctgatgtagaagtggaacaacatgaaggtggacaacctatttatcaatatttcttcgcagtagaataa

SEQ ID NO: 1964 - DNA, 798 bp, Staphylococcus epidermidis
  unsure (32): Identity of nucleotide at the above locations are unknown.
aatattttgaaagagagatttattaagaaaantcattatttagactatgaatttgatgagggtagtgatattaagttaggtttcactactcgagaaaatgggttaagtccttatcctaatcatagttttaatatggcaagatatatcagtgacagtgcacatcatattacacatcatcaaaatatcttagcgaatcttattggttatacaagagatgaatgggtttttcctatacaaacacatgataatcgtatcgttgaagttacaagtgaacataaaggaacaaatattgatgaactaactgatgatttacatggcatagatggaatgtatacttttgattctcacattcttcttactatgtgttatgcggattgtgtacctgtatatttttatagtgaaccacatggctatataggattagcacatgcaggttggcgaggaacatatggtcaaatagtaaaagaaatgctaaaaaaagtggattttgattatgaagacttaaagattgtaattggtccagcaacttcaaattcttatgaaatcaatgatgatataaaaaataagtttgaggaattaaccattgattcaactttatatattgagaccagaggtaaaaatcaacatggtattgatttgaaaaaggctaacgcacttcttctagaagaagctggagttccatcaaaaaacatatacgttacggaatatgcaacttcagaaaacttagatttattcttttcatatcgtgttgaaaaagggcagacgggacgtatgttagcatttattggacggaagtaa

SEQ ID NO: 1965 - DNA, 963 bp, Staphylococcus epidermidis
atgaaactgaagtggaggcgtattttgacaatgagtaaaatcatttttatgggaacacctgatttttcaacgaaaattttagagatgttaattgctgagcatgaagttatcgctgtagtgacacaacctgatagaccagtgggacgtaagaaagtgatgacaccaccaccagtaaaaagagtagctacaaagcatcaaataccggtatatcaacctgaaaaacttaaagattctcaagaattagaatcgttactttctttagaatcagatttaatagtaacggctgcgttcggtcaactattaccagagtccttactcaatgcacctaaattaggagctattaatgtccatgcatcattgctacctaagtatagaggaggagcacctatacatcaggctataattgatggtgaagaagaaactggaatcacgattatgtatatggttaaaaaacttgatgcaggtaatatcatctcgcaacaatcaattcgtattgaagaagaagataatgttggcacaatgcatgataaattaagctttttaggtgccgaattattaaagaagacacttcctagtatcattgataataccaatgacagtatccctcaagatgatgcacttgcaacatttgcatctaatattcgtcgtgaagacgagagagttgattggaatatgagtgcacaagcaattcataaccatattagaggactgtctccatggccagttgcttatacaactatgaatgaaaagaatctcaaattatttagcgctttcattgtgaaagggaaaaaaggtaatccaggaacaattattgaaactactaagcatgaactcatcatagctaccggttctgatgatgccatcgcacttactgagattcaacctgcaggaaaaaaacgcatgaaagttactgattatttaagtggtgtacaagagtcgttagttgggaaagttctattatga

SEQ ID NO: 1966 - DNA, 1284 bp, Staphylococcus epidermidis
ttctacatgaaattaattaaaaacggaaaaatcttaaaaaacggtatcctaaaagacacagaaattttaatcgacggtaaacgtattaaacaaattagtagtaaaattaatgcttcatcttcaaatattgaagttattgatgcaaaaggaaatttaattgctcccggttttgtagatgttcatgtgcacctacgtgaaccaggtggtgaacataaagaaacaattgaaagtggtacaaaagccgctgcaagaggtggttttactacagtatgtcctatgcctaatacaagacctgtaccagatacagttgaacatgttagagaattaagacaacgaatttctgaaacagcacaagttagggtgttgccttatgctgctattactaagagacaagcaggtactgaacttgttgattttgaaaaattagcactagaaggtgtgtttgcatttactgacgatggtgtgggagttcaaacagcaagtatgatgtatgctgctatgaagcaagctgcaaaagttaaaaaaccgattgtcgcacactgtgaagataatagcttaatctatggtggtgcaatgcataaaggtaaacgtagtgaagaattaggcatacctggtattccaaatattgctgaatctgtacaaattgctagagatgtattattggctgaagcaactggttgtcactatcatgtgtgtcatgtttcaactaaggaaagtgttcgagtaatcagagacgctaaaaaagctggtatccatgtaacagcagaagttacaccacatcatttattattaactgaaaatgatgttcctggcgatgattcaaactacaaaatgaatccaccattaagaagtaatgaagatagagaagcacttttagaaggcttattagatggaacaattgattgtattgcaacggatcatgcacctcacgctaaagaagaaaaagcacaacctatgacaaaagcacctttcggcatcgtaggtagtgaaacagcattcccattactttatacacactttgtaagacgaggtaattggtcactgcaacaattagttgattatttcactattaaaccagctactattttcaacttaaattatggaaaattacacaaagatagttacgctgatttaacaataattgatcttaatactgaaaaagaaatcaaaagtgaagatttcttatctaaagctgataacactccatttattggtgaaaaagtttatggaaatccaacactaacaatgcttaaaggtgaagtagtattcgaggaggaaaagtag

SEQ ID NO: 1967 - DNA, 402 bp, Staphylococcus epidermidis
aacaaaatgaagatattcctgaagaaatctctagaaattcatccgttgaatctgaagaaggtaactaaaatgggacaaaatgatttagttaaaacattgcgtatgaattatctatttgatttttatcaaagtttgcttacaaataaacagaaaaattatctcgaattattttatttacaagattattctttaagtgaaattgctgatacatttgaagtgagtagacaagcagtttatgataatataagaagaactggcgatttagtagaagattatgaatcgaaattacgactataccaaagattcgagaaacgtcgtgaattatataacttaatgaaacaatcacttaatcaacctgagttgcttaaacaatatatcactcaattagaagaattagagtag

SEQ ID NO: 1968 - DNA, 486 bp, Staphylococcus epidermidis
aagaagtgtgatgatatgaaaaaagcaatcatagtcatgtttgttgttactgttatcttgacaatagcagcactcattgacgagtttatgattcaagatgcgaaacatggtcaaagtcgttttacgtcacatcatcctatgaaaatcaatacatataaaaaggggcagtgtacatattacgtctttgaacgtgttaaaaatgatggaaataagataaacaatacttggagcgacgccaagcattgggataaaaaagcaattgatgatggatacattgttgaccgtaaccctaaaaaaggatcaatattacaatcttctaaagggaaatacggtcatgttgcatatatagaaacaataaatgaagatggttctatgcaagtttcagaaatgaactatacacaaccttatgaaatcacaaaacgcacaattcatacctatgatattaaaaattattattatattcatccgcaaaagataaaaacataa

SEQ ID NO: 1969 - DNA, 777 bp, Staphylococcus epidermidis
ataaccatcgatatatatcagcattttagaaaggaagaacaagatgctctcgatcaattcatcgataaatgtaagcaggctgatgctaattatgctccagttctaacccatttcttggatccgagaggtcaatatatacttgaagtcattacgcgtagttatcaagatttacatgttacattttttggtggaccacatgcagaaagaaaacgtgcaatcatcgcaccattatattttaagccacagcctgaggactttgaattaactttatttgaacttcaatatcctaagaaatttgtaacaatacaacatcaacacgttcttggaacactcatgtcactgggaatacaaagagatcaactcggcgatattatagttggagaagatatacagtttgttttgacaaaacaattagaatcatatattatatctgaattaacgcgtattaagggagcctcagttaaacttaattctattcctactgaagatatgatacaatcagaagagaattggaaagttcatagtacaactgtgagcgctttgagattagatgtagttttaaaagagatgattcataagtctcgaaatattgcacaacaattaattataaaaaaaagagtcaaagttaaccatacagtaatagattctacagattttcaattagagcagaatgatttattgtcaatccaaggttatggtagagctcaaattgttgaaataggtggaaaaacaaaaaagaacaagttacacattcattatcaaacactatttaaatag

SEQ ID NO: 1970 - DNA, 336 bp, Staphylococcus epidermidis
tcacatcgagaatatggagcaacactacgaataaggagttcaactatggatattggtttgctaagtacaattttccgatttattatatttttagttcaaatatattattttggaatgattatatatttctttacttcttgggttccgagtataagagagtctaagtttggagaatttttaggaaagttatatgaacctttcttagaacctttccgtaaaattattcctcctattggctttatagacatttcttctatcgcggcaatcttcgttctagttttattccaaagtggtttagtaaaaatatttaatttaattcttgcatatttatcttaa

SEQ ID NO: 1971 - DNA, 1314 bp, Staphylococcus epidermidis
atcaacatggaaaatgagcaaatgtttgagcgtaccgttcagccagttcttgatgtaaaagataaaccaaaaccagcacaatgggcatttctgagtcttcaacatttatttgcaatgtttggatcaactgtacttgtaccatttttaacacatctgcctatatcagcagctttgttggcatcaggtattggtacacttttatacatattaatcacaaaagcgaaaattcctgcctacctaggatcgagttttgcctttattacacctatcattacagggttaagtacacatagtcttggagatatgctggttgcattatttatgagtggattaatgtacgtgattataggtattttcattaaattgagtggaacacattggttaatgcacttgttaccaccagtagttgtcggaccagtaataatggtcattgggttaagtttagctcctacagcagtaaacatggccatgttcgaaaattctgctgaaatgaaagggtataacttaagttacttaattgttgctttgattacattagcagtaaccatcatcgtccaaggattcttcaaaggatttttatcactaatacctgtacttataggtattatagtgggatatattgtatccattttcatgggcatagttaaatttgctccaatagcacaagcgaaatggatagattttcctcatatttatctaccatttaaagattacacaccatcttttcatttaggactcattctcgtgatgatacccgtggtgtttgtgacggtaagtgaacatattggtcatcaaatggtaattaataaaatagtaggacgcaatttctttgaaaatccaggtttagataaatcaatcattggtgatggtgtttcaactatgtttgcaagtatgataggaggtcctcctagtacaacttatggtgaaaatataggtgtactagcgatcaccaaaatatatagtatttacgttattggtggtgcggcagttatagctatcattcttgcatttattggtaagttcactgctttaatatcttcaatacctacgccagtgatgggtggtgtctcaattttattattcggtattatagcagctagtggtttaagaatgcttgttgaaagtcaagtagatttcgcaagcaatcgcaacttggttatagcatcagttgtgcttgttgtcgggattggtaatcttcttatcaatttaaaaggcataggtatcaatttacaaattgaaggaatggcattatcagcactttcaggaataatattaaatttaattttgccaaaagataaaaaccaaataaattaa

SEQ ID NO: 1972 - DNA, 240 bp, Staphylococcus epidermidis
agcgacgtggaaaacttcgataaagtaaaagacatcatcgttgatcgtttaggcgtagatgctgataaggtaacagaagacgcatcattcaaagatgatttaggcgctgactcacttgatatcgctgaattagtaatggaattagaagacgaatttggtactgaaattcctgatgaagaagcagaaaaaatcaacactgttggtgatgctgttaaatacatcaacagccttgaaaaataa

SEQ ID NO: 1973 - DNA, 207 bp, Staphylococcus epidermidis
aggcaactttggctaagcaaaagcatatccctcgtaaaaagagagcggaatagaattcataatgaattcattatcccaccatctcgcaatatgaccttaaatagagaatctaataaaattttcataacagaaactcagacccttaaacgttttattttaagtacatttcagggtagtcaatctactgcgaagagatttaatggctaa

SEQ ID NO: 1974 - DNA, 1353 bp, Staphylococcus epidermidis
ttatttaagtggtgtacaagagtcgttagttgggaaagttctattatgatgaaatcagtgcgaacatatgcattagaaacaatcaacgacgtcctaaataaaggtgcttatagtaatttgaaaattaatgaagttctatctacaaataacattaatacagtagataaaaatttgttcacagaattagtatatggaacaataaaaagaaaatacacgttagattatctactaaagccttttatcaaaactaaaatcaaatcatgggtgcgacaattactgtggatgagtttatatcaatatttatatttagataaaatacctaaccatgctattattcatgaagcggtagatatagcaaagaaacgtggtggctttcacacagggaatatagtcaatggtatattacgaacagtaatgcgcactgaattgccaagctttgaagatatagatgatactaaaaaaagaattgcaattcaatatagtcttcccaaatggattgttgatcattgggttacacattttggagtagaaaaaactgaaaacattgcacgatcttttttagagcctgtaaccacaaccgtgcgcgccaatatatctcgtgattctattgattcaattatctctaagttagaacaggaaggttaccacgttaaaaaagacgatatgttaccattttgtcttcatatatcaggtatgcctgtggttaattcaaacgcttttaaagaaggttatatctctattcaagataaaagttcaatgatggtagcttatgtaatgaacctagggcgagatgacaaagttttagatgcgtgcagcgcacctggtggtaaagcttgtcatatggcagaaattctttcaccagaaggtcacgtcgatgcaacagatattcatgaacataaaataaatcttataaagcaaaatattaaaaaattgaaattgaataatatcaaggcttttcaacatgatgctacagaagtatacgataaaatgtatgataagattcttgttgatgcaccatgtagtggattaggtgttcttagacacaaacctgaaattaaatatagtcaatcacaaaatagcattaagtctttagtagaattacaattacaaattttagaaaatgttaaagataatattaaacctggtggtacaatagtgtattcaacatgtacaatagaacaaatggaaaacgaaaatgtcatctatacttttttaaagagacataaagattttgagtttgaaccattccaaaatccagcgactggtgaacaggttaaaacgttacagatacttccacaagattttaattcggatggattctttattagcaagataaaaagaaaggaaagttag

SEQ ID NO: 1975 - DNA, 234 bp, Staphylococcus epidermidis
gttgataagcttggggctatattaacaattattaaaaattatcaatatagattaaagctttatatgataatcaatcatagattatcatatttttataattataatgattttttatttttcattagtttatacgcttgttctgctgccttttgttcggattctttctttgtctttcctttaccctctgcaactgctttattttctaaaatcacttccgatgtaaatagtctatga

SEQ ID NO: 1976 - DNA, 1722 bp, Staphylococcus epidermidis
aaaagtataaggtggcagataattatggcatatgatggcttatttactaaaaaaatgattgaatcattacaaggtttagtctcaggccgaattcataaaataaatcaaccagaaaatgacacaataattattgtaataagacaaaatcgtaaaaatcatcaactacttctatcgattcaccctagtttctctcgtttacaattaaccactaaaaaatacgacaatccatttaccccaccaatgtttgcaagagttttccgtaaacaccttgagggaggctttataaaagcaattcgacaggttggtaacgatagacgtatagagattgatatcgaaagtaaagatgaaattggtgatacaatatatagaactatcatattggaaataatgggtaaacatagtaaccttatccttgtcgatgatcaacgtaaaatcatcgaagggtttaaacatctaactcctaacacaaatcagtacagaaccgttatgcctggcttcaaatatgaagcaccaccaaatcaaaataaaatcaatccttatgaattaacaggacaagaggtattaaaatatatagactttaatgctggaaagattgccaaacaattacttaatatatgtgagggctttagtccgctaatcgctaatgaaattgtgaatcgtcgtcaatttatgactcaagaaacattacctgatgcttttgatgaagtcatggccgaaacaaaatcagcacctacccctgtctttcataaaaatcatgaaacaggtaaagaggacttctatttcatgaaacttaatcaattctatgatgatatagttgagtatcattcacttcatgaactattggatcgcttttatgatgcacgtggagagagagaaagagtcaaacaacgtgcaaatgatttagtcagatttgtacaacagcaactgcaaaaacaacaaaataaattgagtaaacttatcgatgagtatgaaagtgctaaaaacaaagaaactcagcaattatatggagagttgattacagctaatatatatcgtattcaacaaggtgacgattctgttatagcgttgaattactatactggtgaagaagtaaagattccacttaaccctacaaaatcgccatcaactaacgctcaatattattataaacaatataaccgtatgaaaacacgggagcacgaattgactcatcagattaaacttactaaagagaatattgattactttgataatattgaacaacagttaaagcacattaccgttgatgatatcgatgatattcgcgatgaacttgctgaacagggattcatgaagcaaagaaaacaaagtaaaaagaaaaaacagtctaaaattcaacttcaaacgtatcattctactgatggagatacgatattagtaggtaaaaataataaacaaaatgattatcttaccaataaaaaggcacgtaaaaatcatttatggtttcatacaaaggatattccaggatctcatgttgtcatactcaatgagagtccaagcgaaacaacgattaaagaagcggcaatgctagctgggtacttctctaaagctgggagttcagctcagattcctgtagattatacagaaattagacacgttcataaaccttctggagcaaaacctggattcgtgacatatgacaaccaaaagaccctatttgcaacacctgattatgatcatattcaacaaatgaaagaatcataa

SEQ ID NO: 1977 - DNA, 615 bp, Staphylococcus epidermidis
gagaataggagtgagccccccttggctttaaaggatttatttaataatttttttgtagttgaagaagaagaggaagttgaaggacctgaagaacgtgaatcttctagatcacgtgaacgtgttcaagaacgcgaagattacaatcgtaatgagaatcaagcgacaccacaaacttttaacaataagcaacaagcgattaagtctgtacctcaaaagaacactttgagatcgaatacaacttctgaagaaaggaattatcgtatgaataataattcaaaaaataattctagaaacgttgtaacaatgaaccaagcatcacaatcatatgctgctcaggaaagttcaaaaatgtgtctgtttgaaccacgtgtcttttcagatactcaagatattgccgacgaattaaaaaacagacgtgcaactttagtaaatttacaacgcattgatcaagtatcagcaaagcgtattattgattttttaagtggtacggtatacgcaattggtggagatattcaacgcgtgggtactgatattttcttatgcacacctgataatgttgaagtagccggcagtataactgatcacatcgagaatatggagcaacactacgaataa

SEQ ID NO: 1978 - DNA, 225 bp, Staphylococcus epidermidis
atggtgaggaggcgtctaatggaacaaaataatgataataatcatctttacactttaataaaacattgtaatgagtttctttatagacgagatgattatagaattccatctgattctcaatcagaccattctaataatgagaatattttaaaaacaatgaatgatgaagtatttaaacattcaattgaaatttttaaacgtgccaagaaaaatttaaatcattaa

SEQ ID NO: 1979 - DNA, 2007 bp, Staphylococcus epidermidis
agtatgataggtaaagtcataaatgaacgctatactattaccgataaactcggtggtggtgggatgagtattgtctacttagctgtagattcaatacttaacagaaaagttgctattaaagcgatttcgattcctccaagtgaaaaagaagagacatttaaacgttttgaaagagaagtacataattcttctcaactttctcatgagaatatagtcagtatgattgacgtagatgaggaagacgattgtttttatattgttatggaatacatagaaggtcctactttagcggaatatatacacagtcatggtccacttagtgtagaaactgctattcagtttacagaacaaattttgagtggaatcaaacatgcgcatgatatgagaattgttcatcgcgatattaaaccacagaatatattaattgataagaataaaaaattacaaatttttgattttggtattgctaaagcattgagtgaaacgtcgctgactcaaacaaatcatgttttaggaactgttcaatatttatcgcctgaacaggctaaaggcgaagctactgatgaaagtactgacatatattcaattggaattgtattatatgagatgttagttggagagccaccattcaatggagagactgcagtgagtattgctataaagcatattcaagatagtatcccaaatataacaacggataaaagagatgatgtacctcaatcattgagtaatgtcgttttacgtgctaccgagaaagataaatatcatcgctatcatactgttcaagaaatgtgtgacgatttaacaagtgctttacatgagaatcgtttgaatgaagaaaaatacgagctagataaaactaaaacggtaccactcactaaagatgatttgaatcataaaatctatgatgaacaaaatcaaaatgaccttaataaaaccatgcaaatacctattgttaacgattcaataaagcaacaagaatttcaatcgtctgaaccacgttattatcaaaaaagcgacaagaaacgttctaaaatgaaaattgcaattttatcaatcatttttgtaatattattaattggtttattttcttttgtagctatggctgtttttggaaataaatatgaagaaatgcctgaccttaaagggaaaactgaaaaacaagctgaaaaggtattagacagtcatcatctaaaagtaggtgacatatcaagaaattatagtgataaatatcctgaaaaccaaattattaaaacaaatccagatagtggagaacgcgtcgaacaagggaatagagttgatatcgttctatccaaaggaccagagaaggttaagatgccaaatgttttaggtatgtcgaaaaatgatgcgctaaaaaaattaaaggctatcggatttaaagatattcacgttgagcaagcttatagtcaaacatatgaaaaaggattaatttctgaacaaagcgttgtagctaatagtgaggttgccgttaataatcatcatattacaatttatgaatcattaggtgttcgacaagtatatgtcaataattatgaaaataagtcatatgagtcagcaaaaaaagaacttgaagataaaggatttaaagttcaagtgacaaaagaaaacaacgatgatgtcgaaaaaggtaatgtcatttctcaatctccaaaggataaaactgttgatgaaggttctactatactattagtggtttctaaaggagaaaagtctgaagaagatgatgatgaggaggacaaggatacaacgactaaaaatgagactgttaaagtaccgtataccggtaaaaaaagtaaaagtcaaaaagtagaagtatttattcgtgatattgaaaataaaggtgattcagcagttcaaacgtttaatattaaaagtgataaaacaattaatattcctttgaaaattaaaaaaggaagtgacgctgggtacaccataagagttgataataaaattgtagctgataaagatgtgagctatgatggctaa

SEQ ID NO: 1980 - DNA, 1248 bp, Staphylococcus epidermidis
ggttatgaaggaggaacaagcatgagtttttttaaacgtctgaaagataaattttctagtaaaagtgaagatgatattcaaaaagacctagatgaaactgtagattcaaatgctaatagtgactcagattcaatggacccgaatgattctgatgaacaagtcaaacccaaaaagaaacctaaaaaattaagtgaagctgattttgacgaagatggtttgatatcgattgaagattttgaagaaattgaagctcaaaaaattggagcaaaattcaaagccggtttggaaaaatcacgtcaaaacttccaagaacagttaaataatttaattgctcgatatagaaaagttgacgaagatttcttcgaagctctggaagaaatgcttattactgcggacgttggttttaataccgttatgaaattaactgatgagctacgtacagaagcacaaagacgtaatatacaagaaacagaagacttaagagaagttatagttgagaagattgtagaaatctatcatcaagaggacgattattctgaagcaatgaatattgaagatggacgtttaaatgtcatactgatggttggtgtgaatggtgtcggcaaaacaacaacaattggtaaattagcttatcgttatcaacaagaaggtaaaaaagtaatgttagccgctggtgataccttcagagctggagcaattcaacaattaaacgtctggggagaacgtgttggtgttgaagttgtgagtcaaaacgaaggttctgaccctgcagcagtagtatatgatgcgattaatgccgcaaaaaataaaggcgtagatattttaatttgtgatactgcaggacgcttgcaaaataaatctaatttaatgcaagagttagataaaatgaaacgtgtgattaatcgtgcaatacctgatgccccccatgaagctttattatgcttggatgcaacaactggtcaaaatgcactttcacaagcacgttcatttaaggaagttacaaatgtctcaggtatagttttaactaaattagacggtactgctaaagggggtattgtattagcaattcgaaatgagttacacattccagttaaatatgttggtttaggcgaaaaaatggatgacttacaaccgtttaatcctgaaagctatgtatatggattatttgctgatatgatagaacaaaatgaagatattcctgaagaaatctctagaaattcatccgttgaatctgaagaaggtaactaa

SEQ ID NO: 1981 - DNA, 222 bp, Staphylococcus epidermidis
tgtgtatttatatttattaaaggaggtactttcatgggtaaacaatgtttcgtaacaggtcgtaaagcttcgactggtaatcatcgttcacacgctttaaatgcgaataaacgcagatggaacgctaaccttcaaaaagttagaatccttgtagacggcaaaccaaagaaagtttgggtttctgcacgtgctttaaaatctggtaaagttactagagtttaa

SEQ ID NO: 1982 - DNA, 411 bp, Staphylococcus epidermidis
cacatggacataccaaaaattacgacgtttttaatgtttaatgatgaagctgaagaagcaattcaattatacacaagtttatttgaagatagtgaaattattacaatggtgaagtatggcgaagaaggaccgggcacacctggatcagtacaacactccatctttacgctaaatggccaagtatttatggcaatagatgcaaatagtggagaagagttgcctatgaatccagcaatgtcactatatgtcactgttaaggatactatggagatggaacgtttatttaatggtttgaaaaatgaaggcgccattttaatgcctaaaacagaaatgccaccatttagagagtttgcatgggttcaagataaatttggcgtgagttttcaacttgctttaccagaaaacaaatag

SEQ ID NO: 1983 - DNA, 3636 bp, Staphylococcus epidermidis
tttttaataattgttaatatagccccaagcttatcaactcaacacgactgtgataaggagaatacaatggtttatttaaaatcaattgatgccataggatttaaatcttttgccgaccataccaatgttcaatttgataaaggtgtgacagctattgttggtcctaatggaagtggtaaaagtaatattactgatgcaattaaatgggtactaggtgaacagtctgccaaatcactacgcggtgctaaaatggaagatatcattttttcaggtgctgaacatagaaaagctcaaaattttgctgaagtaaaacttaaattagataatcattcacaaaaactacaaattgattctgaggaattagttgtcacacgccgtctctatcgaagtggtgagagtgaatattatttaaataatgatcgtgcacggttaaaggatattatagatttatttctcgattcaggacttggaaaggaagcatttagtattatttctcaaggaagagtagatgaaatattgaatgcaaaaccaatcaatcgtcgacaaattattgaagaatctgccggagtacttaaatataaaaaacgtaaagctgaatcgattcaaaaacttgaccatactgaagataatcttaatcgagtcgaagatatcttatatgatttagagggacgagtggaaccgttaaaagaagaggcggccattgctaaagaatataagcaattatctaaagagatggagcaaagtgatgtcatcgttacagtatctgacattgatcattatactgaagataatcagcgattagatgagcgtttaaatcacctaaagagtcaacaggctgagaaagaaggtcaacaagctcaaatcaatcagttactacaaaaatataaaggtaaacgtcaacaaaacgattatgacattgaaaagttaaattatgaattagttaaagcaactgagaattatgagcaattatcaggtaagctaaatgtattagaagaacgaaagaaaaaccaatcagaaacaaatgcaagatatgaggaagaattagataatttagaatcacaaattgattctattaaaaatgaaaaagcccaaaatgaaaaattattagctgatttaaaaaataagcaaaagcaattaaacaaggaagttcaagaattagagtcacttctttatatatccgatgaacaacacgacgaaaaactagaagaaattaaaaatagttattatacattgatgtcagaacaatcagttgttaataatgatataagatttttagaacatacaatcaatgaaaatgaagcaaaaaaatcacgattagattcgcgtttagtagaggctttcaatcaacttaaagacattcaacaaaatattactcaaacacaaaaggaataccaaagttctaagaaatctatggaaaaagtagaacaaaatattcaacaattagaacaacagttgacagattctaaaagacttctatctgaatatgaaaataaactatatcaagcctatcgttataatgaaaagttaaaatcaagaattgatagtttagctactcaagaggaagattacacgtatttctttaatggtgtaaagcacattttgaaagcaaaagataaagaattaagaggaattcatggtgcggttgcagaagtgattaacgttccttcagaaatgacacaagcgattgaaaccgccttaggtgcatcgttacagcacgttattgttgataatgaaaaagacggtcgtcaagcaatccagtacttgaagcaaagaggtttaggtcgtgctacttttttaccattaaacgtgattcaaccaagacatgtagctgctgacattaaagatgtagctcgtggttcacaagggttcattaatattgcatctgatgccataaatgtatctgctaaatatcaaaacatcattgaaaatttattaggtaataccatcattgtagaaaatttaaaacatgcaaatgaacttgcacgtgccattcgatatcggacaagaatagtaactttagaaggtgatgttgtaaatcctggtggttccatgacaggaggaggagcacgtaaaacaaaaagtatattgtcacaaaaagatgaattatcaacaatgcgaaatcaacttgaagattatcaacgacaaacagcagaatttgaacgtcagtttaaagaacaaaaaacacaagctgaacaattaagtgaacaatattttagtgcaagtcagcagtacaacaatttaaaagaacaagtacatcatcacgaattagaactggatagactaaaaacacaagaagcacatcttaaaaatgaacatgaagagtttgaatttgaaaaaaatgatggatatcaaagtgataaaagtaaagaaacattaaaagaaaaacaaaatcatttaattgagatacaacaacaattgaagcaactagaaagtgatattgaaagatatacacaattatcaaaagaaggaaaagcttcgacacatcaaacacaacaacaactacatcaaaaacaatctgatttagctgttgttaaagagcgaattaaatcgcaaaagcaagtttatgaacgtttagataaacaacttagcgattcagaacgtcaaaaaattgaagtaaatgaaaaaattaaattgtttaattcagatgaaatgatgggtaaagatgcttttgaaaagttgaaagagcaaattcagcaacaagaaaatgtaagacaaaatttaaatcaacaacttagtgagattaaacaacaacgtaaagatcttaatgagaaaatcgaaataaatgaaagtcagcttcaaaaatgtcatcaagatatactttctatagaaaatcattatcaagatattaaagcaaaacaatcaaagctagatgtattaatcaaccatgcaatagatcatttaaatgacacgtatcaactcacagtagaacgtgcaagaatggaatatgattctgatgaaacaattgacaatttgcgtaaaaaagtaaaattaacgaagatgtcaatcgatgaattaggtcctgtaaatttaaatgcaatagaacaatttgaagagttgaatgaacgatacacatttttaaatgagcaacgaacagatttaagagaagcaaaagaaaccttagaacaaatcattcatgaaatggataaagaagttgaaggacgttttaagacaacatttcatgcggttcaagatcattttacgacagtgtttaagcaattatttggtggtggacaagcagaacttcgtttaactgaagatgactatttgtctgctggcgttgatatcatcgtacaaccgccaggaaagaaattacaacatctttcattattaagcggtggtgaacgtgctttaagtgctatagcattattgttcgccattctcaaagttcgttcagcaccttttgttatactagatgaagtagaagcggcattagatgaagcgaatgtgatacgatatgcccaatatttaaatgaattatctacagaaacacaattcattgtaattacacatcggaagggaacgatggagttttctgatcgtttatatggtgtaacaatgcaagagtctggtgtttctaagttagttagcgtcaacctaaatacaatagatgaggttatgaaggaggaacaagcatga

SEQ ID NO: 1984 - DNA, 2418 bp, Staphylococcus epidermidis
gtggcagtaatgattgcaaaagtaattgttgatattccgtcgaaaagtgtcgattttaaatttgattatatcgttcctaaaaatttagaacgtgtgattcaaattggcgttcgcgttgtggtaccttttggccctagaactatacaaggatacgttatgaatattcaacaagaaccagatggaaatatggatatatcgaaactaaaagaaataaaagaagtgcgtgatattaaacctgaattaacatccgaactgattcaattaagcgaatggatgagccattatcatgtgatgaaacgtatttctgttttagaagcgatgttgccaagtgccattaaagcaaagtataagaaagctttttcaattatcgatccaaaaaatttatcttcaaaaaccaaagcgctatttaacaatgacggttattacttatataaagaagctcagcaaaacaatgatttagaagaaatgttgactttgttaaatcaaggattgattgaagaggtcacgatactttctcaaaacacaaaaaagaaaactcaaaaagctgttggcgtagttaatacgttgaatggtgatgaagtacttgcaaaactcgagaaatatacaaaacaatatgatttgtatgcatttttattagaagagtctcatcgaacagtgtttttaaaagaaatcaatgatatgggcttctctcactcgagtttagattctttaatcaaaaaaggttatattgaaaaatataccgccgaggttttcagagatccttatgcaaatcgtatatttgaacaagaacaaaagaggatattaactaaagaacagcaagatgcatttgaagctattcaacattatattcatgatgaaaaagaaagaacatttttattacacggagtcacaggttcaggtaaaaccgaagtctatcttcaaacaatagaagaagttcttaataaaggtaaagaagccatgatgttagtgccggaaatcgccttaacacctcagatggtgctaagatttaaacgtcgatttggagatgatgtagcggtattacattccggactttcaaaaggtgaacgttatgatgagtggcaaaaaattagagacggtcgagctcgagtgagtgtaggtgctcgttcaagtattttcgcaccgtttaaaaatttaggcatcattataattgatgaagaacatgaatctacatataaacaagaagattatcccagatatcatgcacgtgatattgcacaatggagaagtcaatttcatcattgtcctgtagttttaggtagcgcaacaccgagtcttgagtcatatgctagagcagaaaaaaatgtttacgagttgttgtcattgccacatagagtcaatcaacaagcgttaccgcatattgatattatagatatgagagaagaattaagtgaaggtaatcgttccatgttttctatagcactaagacaagcgatacaagaacggttggataaaaaagaacaaatagtactattcttaaatagaaggggatatgcttcatttatgttatgtagagattgtggttacgttccccaatgtccccattgtgatatttcgttaacatatcataaaacaaccgatcaattaaaatgtcattactgtggttatcaagaaaatccaccatctcaatgtccaaattgtgaaggtgatcatatcagacaagtcggaactggaacgcaacgtgtagaagaattattacaacaagaattccctcatgctcgtattataaggatggatgttgatacaacttcaagaaaaggtgcacatgagaaattgttaaatgactttgaagcaggaaaaggagatatcttattaggtacgcaaatgattgctaaaggtttggattatcctaacattactctagttggtgtgctcaatgctgacactatgttaaacttacctgactttcgtgccagtgaacgaacataccaacttttaactcaggtatctggacgcgcaggtcgtcatgaaaaagaaggacaagttatcatacaaacgtacaatcctgatcattattcaataaaggatgtgaaattaaacgattatctttctttttatcaaaaagaaatgaattatcgaaaattaggaaaatatccaccttactattttttgattaactttaccatttcacatactgatataaaaaaggtcatgatggcttctaagcatatacatcaaattttagtacagcacttaagtgaaaaagcattcgtgttaggcccttcaccagcagcactagcaagaattaacaatgagtatcgttttcaaatactagtaaaatataagagtgagcctcaattacatccagcgttacaatatttagatgattattatcatgatcaatatgtaaaggataaactatcattaaaaattgatatcaatccacaaatgatgatgtga

SEQ ID NO: 1985 - DNA, 225 bp, Staphylococcus epidermidis
tcatttaaaattatttcaattataatcatcattgaaaagttacactacaaatttattattaatttatcattagttgttactcatttagccatcatagctcacatctttatcagctacaattttattatcaactcttatggtgtacccagcgtcacttccttttttaattttcaaaggaatattaattgttttatcacttttaatattaaacgtttgaactgctga

SEQ ID NO: 1986 - DNA, 645 bp, Staphylococcus epidermidis
atggttaaaattttaccatcacttttatctatagattttttaaatttaaaagaagagcttcaattgttagaaacagcaaaggtagacggattacactttgatgtaatggacggtaaatttgtccctaatatttcaatcggtattccgattttggatgctgttagacaacaatctcatttgccaatagatgttcatttaatgattgagcaacctgaaaattatattaatctttttgccgaacatggtgctgatatgatttctgttcatgttgagtcgacaacacatatacatagagcaattgaacaaattaaacaattagggaaaaaagcaggtgtcgtcatcaatcctggaacatctgtagaaacaattttacctatattgagtattgttgattatgttctagtaatgactgtaaatcctggttttggtggacaaacattcatagaacaatgcgtgactaagattgagcaattaaatcaacttaaacatgaaaatcatttaacttttgatattgaggtagatggaggcattaacgatcaaacgagtaaacgatgtgtagaacagggtgctacaatgttagtcactggttcatacttctttaaacaagaggattatgcaaaagtaacatctttattaaaggaatga

SEQ ID NO: 1987 - DNA, 936 bp, Staphylococcus epidermidis
gtgagtaaaatgggtaaaatagcagttgtcttccctggccaaggtgcacaaaaagtagggatggctagtgacttatataatgaagaggaacgctcgactcgagtattaaatttagctcaagagacagtagactttgatttgctagaaacgatgtttactgataatgatgggaaattaggagaaacagaaaatacacaacctgcactattaacacatagtgttgcgttactagaatcattaaatcatttaaaagtagattatactatgggacatagcttaggagaatattcaagcttagtttctagtgatgtattatcttttgaagatgcggttagaattgtgcgtaaacgtggccaacttatggctcaagcgtttcctaacggtgttggaggtatggcagcagtattaggtttggattatgatgatgttgataagatatgtcaaacgttatctacaaaagaacagttaattgaacctgctaatattaactcaccaggtcaaatcgtggtgtctggacataaatctttaattgatgaattagtagaaaagggcaaagaacttggtgctaaacgtgttcttccattagctgtttccggtccttttcattcttcaatgatgaaagttattgaagaggattttgctaatttcattaatcaatttgaatggcataatgctaattatccagttgttcagaatgttaatgcaaagggagaaaccgatgctgaagtaattaaacgcaatatggttaaacaattatattcacctgttcaatttattcaatcaacggagtggttgattaatcaaggtgtcgatcactttattgaaattggaccgggaaaagtattatctgggcttatcaaaaaaataaatcgagatgtaaaaatcacttcaattcaaacactcgaagatgtgaaaggatggaataatcatgaataa

SEQ ID NO: 1988 - DNA, 750 bp, Staphylococcus epidermidis
aaggatggaataatcatgaataaaagtgctttagttacaggtgcttctcgtggtattggtagaagcattgcattgcaattagcggaagaaggatataatgtagctgtcaattatgctggaagtaaagataaagcagaagcagttgttgaagaaattaaagctaaaggtgtagaaagctttgcaatacaagccaatgttgcaaaaggcgatgaagttaaagaaatgattaaagaagtggtaagtcagtttggttctgtagatgtattggttaacaatgcagggataactaaagacaacttacttatgcgtatgaaagaacaagaatgggatgacgtgattgatacgaacttaaaaggcgtgtttaactgtattcaaaaagtaacgccacaaatgttgcgtcaacgtagtggtgcaatcattaatttaactagtattgttggtgcaatgggtaatcctggacaagcaaactatgttgcaacaaaagcaggtgtcattggattaacaaaaactgcagcacgagaactagcatcacgaggtattacagtgaacgctgtagcacctggtttcatcgtttcagacatgacaaatgctttaagtgatgatttgaaggatcaaatgttagagcaaattcctttaaaacgttttggagaagatacagatatagctaatactgttgccttcctagcttctgataaagctaaatatattacaggccaaacaattcatgttaacggtggaatgtatatgtaa

SEQ ID NO: 1989 - DNA, 231 bp, Staphylococcus epidermidis
aatggtctgattgagaatcagatggaattctataatcatctcgtctataaagaaactcattacaatgttttattaaagtgtaaagatgattattatcattattttgttccattagacgcctcctcaccattcatatattacgataagttatctcgccaatcaactaatgtttggatatcatttaaagagattttaccttcatctttcgcaacttctataagctcattataa

SEQ ID NO: 1990 - DNA, 708 bp, Staphylococcus epidermidis
aaggagaagatgagtgtgagaaatctacccattatagcattagattttaaatcagcagacgaggttcatacatttttaaataaatttaatgaaccgttatgcgtcaaaattgggatggagttattttatcaaacagggccagctttaattaagtccattaaaaaaagaggtcatgatatctttttagatttaaaattacatgacatacctaatactgtgagtaaagcaatggaaggcttagcacgtttagatgtagatttagtcaatgttcatgctgccggtggtattaaaatgatggaagaagctaaaaaagggttaagaaaacataatgctgatattaaaatcattgcagttactcaattaacttcaactactgaaagacaattacatgaagaacaaaatattcaaacctcaatagaggaggcagttttaaattatgctcgtcttactaaaaaagctggtttagacggtgtcgtatgttctcctcttgaggctgagatgatttctaaagaactaggtactgactttttaaaagtgacaccaggtattcgcccgaaaggcgcagctcgtaatgatcaacaacgaattacaacaccagaggaagctaaaaccttggggtcaacacatatcgtagtaggtcgacctatcactcaaagtgagcatccaattgacagttatcataaaataaaagaaagttggttaagttaa

SEQ ID NO: 1991 - DNA, 492 bp, Staphylococcus epidermidis
gtgatgactgtaaagaaattagtaaaatcaacacatcctattttgaataaaacaattcaacctgtaagcacgtatgatcaaaaactaaaagtgttattggaagatttggaagatacattatatcatgaggaagctgctgcaattagtgcacctcaaattggagtagatcaaagtgttgcactcatcgatatggaacaagaagggttattacaacttattaatcctgtcgttaaaagtcaatctcaagagactgtttctgacttagaaggctcaatcagtttacctcatatatatggagaagttaaacgtagcaaaatgatcactgtacaaagctatgatatcaatggaaatgcagttgaattaactgcatatgacgatattgcacgcatgattttacatatgattgatcatcttaatggaattcaatttaccaaaagagcacatcatatattaaatgaaactgaagtggaggcgtattttgacaatgagtaa

SEQ ID NO: 1992 - DNA, 672 bp, Staphylococcus epidermidis
tttatggatgttaaagaaaatcttgctaagattgaaaaggaaattgatgcaagcattaaaaaaagtgcgcattcagcacaacctcacgtgattgcagtaacaaaatatgttacaatagagcgagctagagaagcgtataaagtaggaataagacatttcggtgaaaatcgattagatggattcaaagagaagaaagaatctctaccaagcgatgttaaattacatttcattggttctttacaatcaaggaaagtaaaagatattataaatgaagtcgattattttcatgctttagatcgtttaagtctagctaaggagattaataaaagagcaaatcatgttataaaatgtttcttacaagtaaatgtttctggagaagaatctaaacatggcatagctcttgaagaagtgaatcaatttataaatcaaattaaagaatatgaaaatatccaaattattggattaatgacgatggcaccattgactgatgatttatcgtacataagaaatttatttaaagaattaagacataaaagaaatgaaattcaacaattcaatttagcacatgcaccttgtacagaattatctatgggaatgagtaatgattatcaaatggcagttgaagaaggtgcaacctttgtcagaattgggactaaacttgtaggagaatag

SEQ ID NO: 1993 - DNA, 891 bp, Staphylococcus epidermidis
atgagaggtgtctttttgaagactggtcgaatcgttaaactaatcagtggtgtgtatcaagtagacgtagaaggtgagagatttgataccaaaccacgtggtttattcagaaaaaagaagttttcacctgtggtgggcgatatcgtagattttgaagttcaaaatacaaaagagggctatattcatcatgtacatgaccgaaataatgaactaaaacgaccacctgtaagtaatattgacgagttagttatagtaatgagtgcagtcgagcctgaaatttcaacacaattattagatcgctatttagtgattgctcattcttatcatctcaaacctagaattttaatcactaaacatgatttagcttccgaacaagaaattcttaaaatcaaagacacaataaaaatatatcaaaaaataggatatgctacgcagtttattggaaaagatagtaattatactgctactgttgatgaatggtctgacggtttaatagtattaagtggccaatctggagtgggtaaatctactttcttaaatagttatcagcctcagttgaagttagaaacaaatgatatttctaagtcattgaataggggtaaacatactacaagacatgtcgaattatacgatagaaaaggtggttacatcgctgatacaccggggtttagtgcgttagattttaatcatattgaaaaagaacaactaaaagatttttttattgatattcatgaagctggagagcaatgtaagtttcgtaattgtaatcatataaaagaaccacaatgtcatgtcaaagcactcgttgaaaaaggagaaattccacaattcaggtatgatcattatcagcaattatataatgaaatttccaatagaaaggttcgatactaa

SEQ ID NO: 1994 - DNA, 2784 bp, Staphylococcus epidermidis
agttcttttttatcattacaaggagtgaatttaatgaattacaaagataccctattaatgccgaaaactgattttcctatgagaggtggcttaccgaataaagaaccacaaattcaagaaatgtgggataatgatgagcaatatcgcaaagcgttagaaaaaaataaaaataatccatcattcattttgcatgacggaccaccatatgctaatggtaatttacatatgggacatgcattaaataaaatcataaaggattttattgttcgttataaaacaatgcaaggcttttatgcaccgtatgtgccaggttgggatactcatggtttaccaattgaacaggctttaactaaaaaaggcgttgatcgcaaaaaaatgtcagttgcagaatttagagagaaatgtaaagaatttgcattaaagcaaattgacattcaaaagaaagattttaagcgccttggtgtacgaggtgattttaataatccatacattacattaacacctgaatacgaagccgcacaaataagattatttggagaaatggcagacaaaggtttgatttataaagggaaaaaacctgtgtattggtcaccttcaagtgaatcatcacttgcagaagctgagatagaatatcatgacaaacgttctgcatcaatttacgttgcttttgacgtcaaagacagtaaaggtaaagttgattctgatgcccaatttattatttggacaactacaccatggacaattccatcaaatgtggcaattacagttcatccagagctaaaatatggtcagtataatgttgatggacataaatacatagttgcccaagcattatcagaagaagtcgcagaagcattaggttgggataaagattctatacaattagagaaagaattcacaggtaaagaattggaatttatagaggcacaacatccattcctagatcgtgtatcattagtaattaacggtgaacatgttacgacagacgctggtacgggatgtgtccatacagctcccggtcacggggaagatgactatattgtaggtcaaaaatatgatttaccagtaattagtcctttaaatgataaaggtgtattcactgaagaaggtggaccatttgaaggaatgttttacgacaaagcaaacaaagctgtgactgatcttttaaaagaaaaagacgcactacttaaacttgactttattacacatagttatcctcatgattggcgtacgaaaaaacctgttatctttagagctacaccacaatggtttgcatccattaataaagtaagacaggatattcttgatgcaattgaagacacgaactttaaagtagactggggtaaaacacgaatttacaatatgattcgcgatcgtggcgaatgggtaatttctcgtcaacgtgtatggggcgttcctttaccggtattttatgctgaaaatggcgacatcattatgactaaagagacagtaaatcatgttgcagatttatttgaaaaatacggttcaaatatttggtttgaaaaagaagctaaagaattacttcctgaaggatttagtcatcctggaagccctaacggtgaatttactaaagaaactgatattatggacgtttggtttgattctggttcatcacaccgtggtgtattagaaacgagacctgaactttcattcccagcagacctctattttgagggtagtgatcagtatcgcggttggttcaactcttcaattacaactgctgtagctactcgtggtcaagcgccgtataaattcttgttatcacatggctttttcatggacggtgaaggtaagaagatgagtaagtcattaggtaatgttatagttcctgatcaagttgttaaacaaaaaggcgcagatattgcacgtttatgggtaagtagtactgattacctttctgatgtgcgtatttccgatgaaattcttaaacaaacgtctgatgtatatcgaaaaattcgaaatactttaagatttatgttaggtaatattaacgatttcaaccctgaaacggatagtattgctgaaacaaatttacttgaagtagatcgctatttgttaaatcgtttacgtgaattcacagcgagtacgattaataactatgagaattttgattatttgaatatttatcaagaagttcaaaactttatcaatgttgaactaagtaacttctatttagattacggtaaagatatactttatattgagaaaaaagattctcataaacgtcgtagcatgcaaaccgttttatatcaaatacttattgacatgacaaaattactagcaccaattttagtgcatacagctgaagaagtttggtctcatacgcctcatgtaaaagaagaaagtgtacacctttcagatatgcctaaagttgttgatgtagatgaagaattgttagaaaaatggaatacatttatgaatttacgtgatgatgttaaccgtgcattagaacaagcacgtaatgaaaaagtaattggtaagtcattagaagctaaagtggttattggaaacaatgaaacatttaatacagcggaattcttacaacaatttaatgacttacaacaattattcatcgtttcacaagttgaagttaaagataaagtaaatgatggtgtatcctatcaatatggagatatccatattaaacatgctgaaggtgaaaaatgtgaaagatgttggaactatacagaagaattaggttcagtaggtgaacttgaacatttatgcccacgatgtcaagaagtagtaaaaactttagtataa

SEQ ID NO: 1995 - DNA, 1026 bp, Staphylococcus epidermidis
tttttaaaggtaaattcaaaatgtactatacaagtgaggatgaatgaaatggttaaaattgcagtagatatgatgggcggggatgatgcgcctggtattgtattagatgcagttaaaaaagctgtcgaggactttaaagatttggaaattattctttttggtgacgaatcacaatacaatttaagtcatgagcgaatagagtttagacattgtactgaaaagattgaaatggaagatgaaccagtacgtgcaattaaacgtaaaaaagatagctcgatggttaagatggctgaggcggtaaaatcaggagaagctgatggttgtgtatcagctggaaatacaggagctttaatgtcggctggattatttattgttggacgtattaaaggcgtagcgagacctgcattagttgtaacattgcccactactgatggcaagggatttgtgttcttagatgttggtgccaatgctgatgctaaagcagaacatttactacaatatgcgcaattaggaaatatttacgctcaaaaaattcgtggtattcaaaatccttcggtgtcacttcttaatattggcactgaagcagctaaaggaaattctttaactaaaaaagcatatgatttatttgagaaaaatcaatcatttaactttacaggtaatattgaagcaaaaacacttatggatggaaatgttgatgtcgtagtaacagatggttatacagggaacatggttcttaaaaatcttgaaggtactgcaaaatctataggtaaaatgttgaaagaaacaataatgagtagcttcaaaaataaattagctggtgcagtattgaaaaaagatttagaaacatttgctaagaaaatggactactctgaatacggtggatcagtattattaggtttagatggtacggttgtaaaagctcatggcagttcaaacgctaaagcattttattctgcaattagacaagcaaaaattgctggtgaagagaatatcgttcaaattatgaaagatacagtaggtgagtaa

SEQ ID NO: 1996 - DNA, 396 bp, Staphylococcus epidermidis
cgtaatacattatccgcttctttaaatgcttccatcattggcgtagatttgtcaacgatatctaataagcgatcatttggaataacaattaatgtatccactgctgctttcatagattctacgccagctgccgcttgtgtttggcgcttacgaccttcgaaaccgaatggacgcgtaacaacacctacagttaaagcacccatttcttttgctattttagcaacaaccggtgcagcacctgttccagtaccgccacccataccagcagttacgaataccatatcagcaccttggatagcgtcttcaatttgttctcttgattcttctgctgctttcttcccaatttcaggattagcaccagcacctaatccacgtgttaatttctcaccaatttga

SEQ ID NO: 1997 - DNA, 1185 bp, Staphylococcus epidermidis
atgttagaatttgaacaaggatttaatcatttagccacattgaaagttatcggtgtacgtggtggcggaaataacgccgttaaccgtatgattgaccatggtatgaataatgtagaatttattgccatcaacactgatggacaagctttaaacttatcaaaagctgaatcaaaaattcaaattggtgagaaattaacacgtggattaggtgctggtgctaatcctgaaattgggaagaaagcagcagaagaatcaagagaacaaattgaagacgctatccaaggtgctgatatggtattcgtaactgctggtatgggtggcggtactggaacaggtgctgcaccggttgttgctaaaatagcaaaagaaatgggtgctttaactgtaggtgttgttacgcgtccattcggtttcgaaggtcgtaagcgccaaacacaagcggcagctggcgtagaatctatgaaagcagcagtggatacattaattgttattccaaatgatcgcttattagatatcgttgacaaatctacgccaatgatggaagcatttaaagaagcggataatgtattacgtcaaggtgtacaaggtatttcagatttaattgcagtatcaggtgaagtgaacttagactttgcagacgttaaaacaattatgtctaatcaaggttctgcgttaatgggtatcggtgtgtcatctggtgaaaacagagcagtcgaagccgctaaaaaagcaatttcatctccattattagaaacatcaattgtaggtgctcaaggtgtacttatgaacattacaggtggagaatcactgtctttatttgaagctcaagaagcagctgatattgttcaagatgctgcagatgaagatgtgaatatgatttttggtacagttattaacccagagcttcaagatgaaattgtagttactgttatcgcaactggttttgaagataaaccttcttcacaaggtcgtaaagctacaagtactggttttggttcaagtgtaaatagtagttctaatcatcaatctggtgctagtgctaaagaagattcattctctgcacacacttctcattcacaatcaagtgaaagtgtaaatgaaagaagccacactactaaagatgatgatattcctagctttattagaaatagagaagaaagacgttctagaagaactagacgctaa

SEQ ID NO: 1998 - DNA, 228 bp, Staphylococcus epidermidis
tgtaataattcaatgaatgtgggtcaagcgcgagttgcacattacatccaccttcaatacctaaagcacgaattacttttaaagatacgtctcgtagcatttgatattctacatctgacagtgtttgactcggtgcaacaacgattgaatctccagtatgaatgcctacaggatctatgttctccatattacatactacgattgcgttatcatttttatcacgcataa

SEQ ID NO: 1999 - DNA, 684 bp, Staphylococcus epidermidis
atgtctcaatcatctaagcgaaaaaacgattctgtggtagaaacttttaaggacatcattcctttaacatttggagaagagattggtaatgcagcatcacatggtgctgctgcattacttacattatttattcttccatatgcagcagtgcatagttttaacaatggtggcacattagagtcaattagtgtgtcagtttatgtgattagtatttttatgatgttcatatcatcaaccatttatcattcaatgcaaaataatacgtctcataaatatatattaaggattattgaccatagtatgatttatgtggctatttcaggaacatacacacctgttttgttaagtgttgtcggcggttggttaggttggctcgtgacaatattattatggggaacgacattatgggggattttgtataaatcaatagcaactaaagtcaatcatagattaagtctcattgtttatttggtgatgggatgggtaggtatcatatttttacctattattattatgcgaacatcatggtggtttattttctttatatttcttggtgggttatcttatactatcggagcatggttttatgcccaaaaaaataaaccttattttcatatgatttggcatatatttattgttcttgcttctttcttacatatgataggcattttttattttatgtga

SEQ ID NO: 2000 - DNA, 981 bp, Staphylococcus epidermidis
aggggtgaatcgcatatgattaaacaaaacctgaagatgcgctataccattgtcttactgttattaatttttagtacaatctttagtctatgtataggatcagtaatgattaatcctattcatgcagttacaggcttctttttacacaatgactttattttaaatgaatatcgaattcctagaacacttttaggattacttataggcagtagtttagctatttctggctcggtgatacaaggggttataagaaatccacttgcttcacctgatgttattggaataacaaaaggggcaagtttagcagcagtaatgatcataatgatatttccatcagcacctctatttgttcttcctttaggttcatttatcggtgctttgacaataagtattattctttcagttcttatttcaaaatttgatgtaaagggatcaaaattagcattgataggtttagcgataggtgcaatttgtacggccattgtccaattcttgcttatacgtaatcctcttgatgcaaataatgcgttattatggttgactggtagtttatacggtcataatatagtcaatttttatagtttattaccatggtttattatcactgtacctatagtattgttattagggtatcaacttgatattttaaatttaggtgatcatgtagccattgcactaggagcacgtgtaaaaatcttaaaaatgattttacttgtattagcagtaatgttagcaggtgcttccattgcggtagtagggggtattagttttttaggtcttatagcacctcatattgcacgtcaacttgtcggccataaaaatatacatgttataatcatgtcaggtttggtaggagcaatattattaacttttggtgatggtttagcaagaggtatacaacctcctcttgatattcctgtaggtgttgtaatagcaattataggcgcaccttatttcttatttttattacgtaagatgtag

SEQ ID NO: 2001 - DNA, 414 bp, Staphylococcus epidermidis
gtaaagtttttagcttctcaattattcaaaagaggtttttttatcgattacttaggtgttgatattagtaaaagaagtagtgtagttgcacattataaaaatgaaaaattccaaaaagagtttttcatccaaaataataaaaatggttacaactatttactcaagtatttgaatgacttagaccacccacaactcatttttgaatctacaggtatctattcaagaagtatggaacgattttgttgtgtaaatcaaattaactatattcaaatgaatccgttagaagccaaatttaaaacgagcgctctaagatcatggaaaactgatcaggcagatgctcataagcttgcttgtttaggaccgacgcttaaacaaacagacaatttacctatatgtgccttaatgtccctgttt

SEQ ID NO: 2002 - DNA, 300 bp, Staphylococcus epidermidis; identical to SEQ ID NO: 233

SEQ ID NO: 2003 - DNA, 366 bp, Staphylococcus epidermidis
tatccttcaccatattgtctactagtaattaaaacaccaactgtaccatcacctataaatgaagctagattatcaactgtcgatctaccaggtaaagtaaacaaaggtcgcatgataggtctaaagatgggtccaagtaattctaatagaccatactccattaataaaggtaaaaagattgcagcaaataaaaatactgctacaagagtaggtaataaacttgaaaatactaatccacctgtatcttcagatttaatcatttcaggtccaatatttaaaaatgttaaccaagaaaagaagacagctaatactctcaaaacaagccatcctattttaacgttgaaagcactgctcattaaaccttga

SEQ ID NO: 2004 - DNA, 303 bp, Staphylococcus epidermidis
cgcttgccacctacgtattaccgcggctgctggcacgtagttagccgtggctttctgattaggtaccgtcaagacgtgcatagttacttacacatttgttcttccctaataacagagttttacgatccgaagaccttcatcactcacgcggcgttgctccgtcaggctttcgcccattgcggaagattccctactgctgcctcccgtaggagtctggaccgtgtctcagttccagtgtggccgatcaccctctcaggtcggctacgcatcgtcgccttggtaagccgttaccctaccaactag

SEQ ID NO: 2005 - DNA, 1080 bp, Staphylococcus epidermidis
gggggatttactttgttaacggtaaatcaagttaaagaaattgtaggggcattaaaggatccgattattgatgtgccattgagagaatctgaaggtattgttgatgtctctattaaggataatattaaccatgtgagtgttaaagtggcaatggcgcaattagggggacagccacaattagatcttcaaatggctatagtcaaagccttaaaagaaaatggtgcaaatactgtgggaattcgttttgaagaacttcctagcgaagtagtcgaaagatatataggaaaaggtagtgaaaagcccaaaaccattgaagaactattatcacaaaataatccagttgaattcatttctatagcttcaggtaaaggtggggttggtaaatcgacagttgctgtcaatctagccgtagcattagcaagagaaggtaagaaagtaggattagtagacgctgatatatacggttttagtgtgcctgatatgatgggaatagatgaaagaccaggtatagatggtaaggagattatacctgtagagagacatggagtaaaagttatttcaatggcattttttgttgaagaaaatgcaccggttatttggagaggtccaatgcttggtaagatgcttacgaatttctttacagaagtacagtggggagaacttgattacttacttcttgatttaccacctggcacaggagatgtagctttagatgtacattcaatgttaccatcaagtaaggaaattatagtaactacaccgcatccaaccgcggcgtttgtagcggcacgagcaggtgcaatggctaaacatacagaacatacaattcttggtgttatagaaaatatgagctattttgaaagtaaagaaacaggtaaaaaagagtatgttttcggaaaaggaggaggcaaaaagctttctgatgaacttgagacgcaattatttgctgaacttcctttagaacaacctacatggaatcccaatgacttttcgccttcgatatatcaatcggatgatcgtttaggagaattgtatactttaatcgcaagaaaagttatagtaagcacccaaaaacaataa

SEQ ID NO: 2006 - DNA, 603 bp, Staphylococcus epidermidis
tcaaatttcactagaagaaagaatgcaagagcgtggttggtaatgattaaaattggtgttttagccttacaaggtgctgtacgtgaacatatacgtcatattgaattaagtggttatgaaggcattgctataaaaagagtagagcaactagatgaaattgatggtctaatattacctggtggagagtttacaacattacgtcgtttaatggatttatatggatttaaagaaaagttacaacaattagatttgccaatgtttggaacatgtgctggattaattgttcttgcaaaaaatgttgaaaatgagtctggttatttaaataaattagatataactgttgagcgtaattcattcggtagacaagtcgatagctttgaatctgaacttgatattaaagggatagcaaatgatattgagggagtatttattagagcacctcatattgctaaagtggataacggagtggaaatacttagtaaagttggaggtaaaatagtagccgtcaaacaaggacaatacctcggtgtttctttccatccagaactaactgatgattatcgtatcactaagtattttattgaacacatgattaaacattaa

SEQ ID NO: 2007 - DNA, 294 bp, Staphylococcus epidermidis; identical to SEQ ID NO: 235

SEQ ID NO: 2008 - DNA, 351 bp, Staphylococcus epidermidis; identical to SEQ ID NO: 223

SEQ ID NO: 2009 - DNA, 195 bp, Staphylococcus epidermidis
tttaattatttaatagcaatgattgataatgctattaaaaattgcaattgtatcatgctttaccaagctgttcaaagtttaaataattacactataatggcatccaaaataataagaaatctctatattattctgagcattaagtttgtatcggtaattaaaatttggttgaatatggaattatcatttgaataa

SEQ ID NO: 2010 - DNA, 1479 bp, Staphylococcus epidermidis
atatggaattatcatttgaataaaaaggagtatatgtttatggccagttatgaattgtctaagactaagcgaaatttaattgtatctgtaatgttaattagcgctttcgtggccattttaaatcaaacattacttaatacagccttgccacacattatgcgtgagttaaatattaatgagaatacatcgcagtggctgattacaggtttcatgttagtgaatggtgtcatgattccactcaccgcttatttaatggataaagtaaaaacaagaccgctatatttaggtgcaatgggatcatttctgatagggtctatcgttgctgctattgcacctaattttggcgtgctcatgattgcacgggtaattcaagctgtcggtgcaggtatactcatgccattaatgcaatttacattgtttacattgttctccaaagaacaccgtggatttgcaatgggacttgcaggattagttatacaatttgcacctgcaattggacctacatttactggtttaatcattgacaatgcaagttggagagtgccatttattgttattgtcggtatagcattagttacatttatatttggttttgtatcgatttcaagttataacacgacgaaagaaacaaaactggataaaaaatccgttatatactctacattaggttttggcttaatgctttatgctttcagtagtgctggtaacctaggtttttctaacccaattgttctttgttcacttttaataagtttaatcatcattggcatttttgttaaacgacaaattacaatttctaatccattattaaatttgaaaatatttaataacaaaatattttgtttttctacaattacttctatgatcattatgttatctatggtaggacctgctttacttattccattgtatgttcaaaatgctttaggattatctgcgttgctatcaggattagtaattatgcctggcgcgattatcaatggtattatgtctgtgtttacaggaaagttttacgataaatatgggcctagaccgttaatatttactgggtttatcttattgatttcttgtacatttctattatgctttcttaaagtagatacatcctatacgtatttgatagtaatctatgcgattcgtatgtttgcagtgtctttactaatgatgcctatcaatacgaccgggataaatgcattgaaaactgaagacatttcccacggaacggcaattatgaactttggtcgtgttatggcgggatctctaggaactgctctaatggtcacttttatgagtataggtgctcaatgggttgtatcatcaagtgaacacgctagtaaagaaatgatccagcgacaaagtgttgctgtgggagttgatgtatcgttcgccttagtcactgtttttgtgattattgcttttgttctagcgttatttataaaggagcctaatcatttaactcacaatagtaggaaagtataa

SEQ ID NO: 2011 - DNA, 1215 bp, Staphylococcus epidermidis
aattacgtatacataaggagcgttatcatgttagacaaaaatcaattggaaaagtataaccaagagcatttgtatgaatatgaaaaattaatgagtagtaatgaaaagaatgctttagatgaaaaagtagatcagttaaatcttgcagaaattcaagatttatatcaagatttatatgttaatagaaaaactattgatgatgtatcttctgtatctgaagtcaaatatgaagtgaaatcgcgactcaatgaagaagaacgacatacatatgaacaaaaaggttatgaggcaatacgaaatggtgaatttgctgtattattgatggctggaggacaaggtacgcgtttaggatataaagggcctaaaggttcttttgaaatagagggtacgagtttatttgaacttcaggcgcgtcaactgattcgtttaaaagaagaaaccggccacacaattaattggtatattatgacaagtgacattaatcataaagatacaatagagtattttaaacaacataaatattttaactatgatgccaatcatattcatttctttaagcaagataacattgttgctttaagtgaagaaggaaagcttgttttaaatagagatggacatataatggaaacacctaatggtaatgggggtgtattcaagtctcttaagaaagcaggatatcttgataagatgcaacaagatcacgtcaaatatatcttcttaaataacattgataatgtcttagttaaagttttagacccgttatttgccggttttacagtgacacaaagtaaagacatcacatcaaaaacaattcaacctaaagatagtgaaagtgtaggtcggcttgtaaatgttgattgtaaagacactgtgttggagtattctgaattagatacagacatagcaaatcaatttaacaatgctaatataggtatccatgcttttaaactaggtttcattaccagtgctgttgatagagaattaccgtatcatttggcaatcaagcaattaaagcaattagatgaaaattttggtgtggttgaacgacctacattaaagtttgaattattttattttgatatatttaggtacggtacaagctttgtaacattacaagttccaagagaggaagaattttcacctttaaaaaataaagaaggtaaggatagtgtacatacagctacagaagatttaaaacgaatgggtttgatttaa

SEQ ID NO: 2012 - DNA, 429 bp, Staphylococcus epidermidis
ccaaaacttaaacctgcaaaaacaaccgcaaaagcaataagcaatgggagttttaagccaaacattatcatcagactactaactaataaaacaaaaaatgagcaaatatataatgtttttctagtaaaatgcgcttctattttacctaaattgaaattaagcgtaatccaagcaacagacaacgggaatattacaaatccactttgtaaaggtgataaactaagtttttcttgtaaatatactggtatatataaattatatcccatcagtgttatcgcaataagtaaatccgttataaaaactagaactattgatatgttaaattcttttgttggaagaaatggttgttcgatactattttctattttaaatagtagccataaaacagctaaagctaaaataattgagaatatgttaaaaataatatga

SEQ ID NO: 2013 - DNA, 228 bp, Staphylococcus epidermidis
catagtgataaatttaattctacctcttactatgtcaacttttttaaatccattcatatatattcaatccatttctatctttttatatccatatgtaatttaaagtatatcacattatatatatgcattattttgaataattacgtaaagaacactatacgctatttattaacttttagcaaatccattttaactctttttcatttaagcagttctattcgtatatga

SEQ ID NO: 2014 - DNA, 225 bp, Staphylococcus epidermidis; identical to SEQ ID NO: 237

SEQ ID NO: 2015 - DNA, 546 bp, Staphylococcus epidermidis
aatatgctaaaatatttttataaaggagaacaaaacatgacaggtaaaacacacgcatcatgtggctttttagtcggtgcaataaccacacaatattttcatacagatatatttacttctatatcagtgattgtactttcagtcatttcaagtatattgccagatatatgtcatacacaaagtaaaataggaagacgatttaggcttactagtttttttgtcagaattttatttggtcatagaacatttacgcattcacttttatttattataggaattagttttttactgtacttcatacaaactccgatgtattatatggttgcaattgttattggtatgttttcgcatgttatacttgatatattaacaccaagaggtgttaaactattatatcctttaccatttaatatcgtatcacccattcattttaaaactgggggactagtagatgtatctctagctactgcattaagtgttggtgcgatatatactttatttcaaccatatttaaatactatgatgcactattggttaatcaaataa

SEQ ID NO: 2016 - DNA, 1365 bp, Staphylococcus epidermidis
ttgaaagtaaatcaaccactttatttatcgttatatgaaaagttaaaaaatcaaattatcgaaggtcaatatcaatcaaatgatagatttccatctaaacgacagttaagtaactatttatctgttagccacactacaatagaacatgcatatcaattacttgtagatgagggtttcatttattcgaaacctagatctggctacttcgtttccgatatagaatcgttgccagtgatacatcgacaaacaaatcaattaaacactgataacttagaaaagaagcaacgacaatataaatatgcttttaatttagctgaaattgattctgaaagttttcctatgcacatttttagaaaatatgcgaaagacgtttttgaagaccatcagctatcactattacaacgaggcgagcgtcaaggggaatatattttaaggcaacaaatttcacattacttatttaatagtcgtggcgtcacttgtcacccaaatcaaattattgttggatcatcaacaagccagttactcgatatgataaccaatttactaaaaaaagaagaatttattattgaacagccaagttatccacctattaaacatacgcttgataaaaaaggtataagttatattcaagtcccagttgaacaaaatggaatacaaatcgaccctattttaaatacaaataacaatattttgtatataacaccatctcatcaatttccaactggttatgtcaccaatttaaaaaaaagaacacaattaatcaattggtcccatcaagctaagcaaagatatattatcgaagatgattatgattcagaatttagatattttggcaaacccatacctgcattacaaagtttagacacaaaaggaaaagtcatttatattagtactttctcaaaatctttatatccaagctgtaggattgcatatattgttttgccacaaaatttaatgcacaaatataataatcaaaaatataaagagggaaatacagtgcctgtgcatgttcaacacatggttgctcaattcatgataagtgggaaatttgaaagacatttgaataaaatgcgaaagatatatagagataaacttgattatattttaaaacgattaaagccctacaatactcaaataaagattgaaggcgcactaactggaatgcattttacaataactgttaataatggattgtcaatgaaacaatgtttaaaaaatgcgaaaaaaaataatttaaaattaaaaccttatcattacgaaaattattctaaagtttatccaaaatttattttaggatttggggggataaaaaaagaagaattagaagatcatgttaatgcattaattcattcactcgttatataa

SEQ ID NO: 2017 - DNA, 483 bp, Staphylococcus epidermidis
gggaggacaaaagtgatgaaatttttaaaaaataaatcatatcatttattagtaacacttattgttctcactatatttgttatttccggagcaatttttttaacatttttaggctttggtttgtacggtttgagtcgcatccttatttatttacacttaggcgattttagttacaataaaggcttttatgataatttaatatactacggtagttatatcgttttaggctattttactttattttcaattgagcatttaatggattattttaaaaagaatcttccaaaaaatccatactttcaaggtattaactttcatctcatctcctatattgttactacaattatgttttattttatagttcacatacactatgtacatgttaatatacatttttgggtaattatgattattataggatttttatttgtatgtaaagaagttttttatcctgaaagtaaaaatttgaataataaaaagtaa

SEQ ID NO: 2018 - DNA, 912 bp, Staphylococcus epidermidis
tcaataagaaaaggggtaagtagtatgtctaaaatagtaggatcagatcgagttaaaagaggaatggctgaaatgcaaaaaggcggtgtcattatggacgtcgttaatgcagaacaagctaaaattgctgaagaagccggagctgttgccgtaatggcattagagcgtgtaccatcagatattcgtgctgctggcggtgttgcacgtatggcgaatcctaaaatagttgaagaagttatgaatgccgtatcaattccggttatggctaaagccagaattggtcatattacagaagctagagttttagaatcgatgggtgttgactatatagatgagtctgaagtattaacgcctgcagacgaagaatatcatttaagaaaagatcaatttacagttccttttgtgtgtggctgtcgtaacttaggtgaagcagcacgacgcattggtgaaggtgcggcgatgttgcgtacgaaaggtgaacctggtactggtaatattgttgaagctgtccgtcatatgagacgtgttaattctgaagttagccgcttaacagttatgaatgatgatgaaattatgacatttgcaaaagatttgggtgcaccttatgaagtattaaaacaaattaaagataatggacgtcttcctgtagttaattttgcagctggtggtgttgctacgcctcaggatgcagcactaatgatggaattaggtgcagatggtgtatttgttggttcaggtatatttaaatctgaagatcctgaaaaatttgctaaagctatcgttcaagctacaacacattatcaagattatgagttaatcggaaaattggctagtgagctaggtacggctatgaaaggtctagatattaatcaaatttcactagaagaaagaatgcaagagcgtggttggtaa

SEQ ID NO: 2019 - DNA, 1380 bp, Staphylococcus epidermidis
atatatatgaatggatttaaaaaagttgacatagtaagaggtagaattaaatttatcactatgtcattgttagggattatattatttttagttcctataccagtcgttcaagatggaaagcagcaaacgacacttcctatagcttttttagctggtttattaaaagattggcttggtggtatcatgccaattttaattgtaaccatcataactgtatcaggtattttaacaatattatgctctacaatttataaaaataaattaaatcctcaaggtttaatgagcagtgctttcaacgttaaaataggatggcttgttttgagagtattagctgtcttcttttcttggttaacatttttaaatattggacctgaaatgattaaatctgaagatacaggtggattagtattttcaagtttattacctactcttgtagcagtatttttatttgctgcaatctttttacctttattaatggagtatggtctattagaattacttggacccatctttagacctatcatgcgacctttgtttactttacctggtagatcgacagttgataatctagcttcatttataggtgatggtacagttggtgttttaattactagtagacaatatggtgaaggatattactctagaagagaagcaacagtaatatccacaacctttagtgttgtatctattacgttcgctattgtcattgccgaaacaattagaatgcaagatcaatttttctatttttatttaacagttgtcatttcatgcttaattgcagcaatgattatgccaagaatttggccacttaaaaatattcctgacgaatatgctaaagaagtaagtgaagaggctcgtaatgaacagctaccagaaggcaaaacagcattaaaatatggttttgatttagcaactgaagttggaattaaatcgccagggtttaaagaatttttaatttcaggttttaaaacagttgtagatatgtggtttgtaattttaccagttgttatgagtataggaacaatagctaccattattgctaactacacgcctgtttttgaaattataggaaaaccatttgttccagtactagaattgttacaaattccagaagcacatgaagcatcacaaacaattttaattgggtttgccgatatgttcttaccttcaattcttattgaaggggttcaaaatgatgtaacacgttttgtaattggagcattgagtatctcacaacttgtgtatttatctgaagtaggcggcgtgattcttggttctaaaattccagttagtataagtaaattatttatgatttttttaattcgtactatcattacgcttccaataattgctttattagcgcatttatttatcggataa

SEQ ID NO: 2020 - DNA, 1047 bp, Staphylococcus epidermidis
gtaaggtggaaaacaatgactatggtgaataaagatagtcaatccgctattgaacaaaaaaagaaaaagcgcactacactcacttttattgtgggtgtgtgccttctttttatttcagtatatttgaatttagcgattggttcttcaaaaatacaatttaatgatattttaagttatgtaactggacacacgaatacaaaggcaactttcttaatacacaatgtacgtatgccaagaatgttagctggtttaattattggtggcgctttagcaattgcaggtttattgatgcaagcaattaccaaaaatcctttggcttcaccacagatttttggtgtgaatgcaggtgcttccttcgttattgtacttataactgtacttataccatcactaggctcttactctacaattttagcgataattggtgccttcttaggaggttttactgtttatacattgtctggctctactaagtcgattacaccgattaaattagcacttgcaggtatggctattcatctgttctttagtagtatgactcaaggtataattattttaaatgaagattctaatgatacagtgatgttctggttagttggttcattagccggtataaaatggcaacagattatattcatcttaccatttttactccttgctatttttgtgaccatatttatgggaagacaattaactatattagagttaggtgatgatattgccagaggattaggacaaagaacagaaatcgtcagaatgattgttggaatattggtcgttgttcttgctggtgtttctgtttctattgctgggcctataggatttgtaggtttgatagttccacacatagtgaaaagatatataaataaaaattatgtattgatgatacctttaacatttatattcggcgctactttattacttatttctgatgtattgtgtcgcttaattacttatccattcgaatcgccagtaggtattgttacatcatttgttggtgctttttacttcttattcataactgttagaggggtgaatcgcatatga

SEQ ID NO: 2021 - DNA, 1353 bp, Staphylococcus epidermidis
aaagggagtttttttatgaatcttaagtctatcattactgtaatggcactcatactaataatgtttatggcagctatagaaacatctattatttcattagcattaccaacaataaaaaatagtttgaatgccggtaatctagtttcattagtatttaccgtatattttattgctttagtcatagctaaccctatcgttggtgaacttatgtctagatttaaaattatttacattgctgttgtaggggtattattgtttgccttaggtagtttaatgtcgggattaagtcagacgtttacttttttaattatctctcgaacagtacaaggttttggagcaggagttatgatgtcactctcacaaatagttcctaagttggcttttgaaattcctttgagatataaaattatgggtatagttggaagtgtttggggaatttcgagtattattggcccattattaggtggtgcgattttagagtttgcttcatggcattggctattctatatcaatattcctattgctatagtggcaataatacttgtacttatgacttttcattttcctgatgagacacaagtacaacagagtcgttttgatataaaaggattgattatcttttatatctttatagctttattaatgtttggtttactcaaccaacatcatattatttttaacatattctcaattattttagctttagctgttttatggctactatttaaaatagaaaatagtatcgaacaaccatttcttccaacaaaagaatttaacatatcaatagttctagtttttataacggatttacttattgcgataacactgatgggatataatttatatataccagtatatttacaagaaaaacttagtttatcacctttacaaagtggatttgtaatattcccgttgtctgttgcttggattacgcttaatttcaatttaggtaaaatagaagcgcattttactagaaaaacattatatatttgctcattttttgttttattagttagtagtctgatgataatgtttggcttaaaactcccattgcttattgcttttgcggttgtttttgcaggtttaagttttggttatatttatacaaaagatagtgttattgtccaagaggaaacttctccaaaaaatatgaaaaagatgatgtcattttatgcattgacaaaaaatttaggttcgtcagtcggatctacgattatgggctatatgtatgcactaaatgttggtttatttggttctaatttacacaatgtattaggattagtcttaataattgcagtatgtttaattgtaatgtggatgacattatataaaagcaatactattcaatcttag

SEQ ID NO: 2022 - DNA, 225 bp, Staphylococcus epidermidis
gcacacggtttcaagttctctttcactccccttccggggtacttttcacctttccctcacggtactggttcactatcggtcactagagagtatttagccttaggagatggtcctcccagattccgacggaatttcacgtgctccgtcgtactcaggatccactcaagagagaatatgttttcgactacaggattattaccttctttgattcatctttccagatga

SEQ ID NO: 2023 - DNA, 183 bp, Staphylococcus epidermidis
cgagcttcttggcagattagaaaaagacctgtatggaagaaattaaacgctgtgaaaaatcaacgtgttgatattttagaccgtgacttatgggcaagatcacgtggtttaatttcttcagaagaaatggcaaaagaacttgttgaattatctaagaaagatagtaaaaaagataataagtaa

SEQ ID NO: 2024 - DNA, 207 bp, Staphylococcus epidermidis; identical to SEQ ID NO: 239

SEQ ID NO: 2025 - DNA, 231 bp, Staphylococcus epidermidis
acatacaatggaataagtaaagcaggtcctaccatagataacataatgatcatagaagtaattgtagaaaaacaaaatattttgttattaaatattttcaaatttaataatggattagaaattgtaatttgtcgtttaacaaaaatgccaatgatgattaaacttattaaaagtgaacaaagaacaattgggttagaaaaacctaggttaccagcactactgaaagcataa

SEQ ID NO: 2026 - DNA, 360 bp, Staphylococcus epidermidis
atgataaatattatattgaagaaaatagacttggaggtaattagaatgttcgttgttacaaatagaatcactgtaaaaaaaggatatgcaaaacaaatggcgcctaattttactaaaggaggacctattgaatctttaaagggctttgaaggtattgaagtttggcaaattgataaagatgattatagcgaagatatgtatgtaaatagttggtgggaaactgaagaagattttaaaaattgggtgaatagtgatgtatttaaacaagcacataaaaatactggaaaatccgaagattcaccagtcattaaaagcgaaattgttaaatcaaatgttttatcttctttgaacagaagataa

SEQ ID NO: 2027 - DNA, 279 bp, Staphylococcus epidermidis
ttaaaggaagtgttttcaatggcaatgacagttaagaaaaacgataatgaagttcgtattcaatggagagtagcagatatcaaaattccaaataatgaaattaaaaatgttactcaagatcaagatattcatgccgtaccagaagagaatggtaaagaaatctctcgtattggttctactttcggaaaaacaaatcgcgtattaattgataccgatcaacacttatatattatttacactcaaaatgatcaaaaagtatataatgagttaacaaaataa

SEQ ID NO: 2028 - DNA, 189 bp, Staphylococcus epidermidis
gcagttctattcgtatatgatttatatttttattttttaatgggccatcaaaatgatattgtgacatcaataagagcctgtacattaatttgtaatgtatcaggctctataactaaaaaatacgatattgaaactatcaaatttactacatcttacgtaataaaaataagaaataaggtgcgcctataa

SEQ ID NO: 2029 - DNA, 516 bp, Staphylococcus epidermidis
tctaatggctccaaatactctaaagaatcttcaaaatcatcgtttaaatcatctttcacaaaacgttttgttacttcgtgttgtggattctcaaatactttacttaccgctccctgttcgataactttaccgttttccattacagcaacttcatcacaaattcttcgtataacatgcatttcatgtgttataagtacaatagttaaattttgttgttcccttaccttcaataataaatctagaatttcatctgtagtttgtggatctaatgcacttgttgcctcatcgcataacaatacatctggatcattagctaatgctctcgcaatacccactctttgtttttgtccgcctgataattcagacggatacgcactttctcgaccttttaggccgacaagttcaatgagttccaatgctttttgtttagctagaccacttggaacgccagcaatttctaatggaaatgttacatttttcaatacatttcttgaccatagcaggttaaaatgttga

SEQ ID NO: 2030 - DNA, 249 bp, Staphylococcus epidermidis
cttatgtttccgttagtggagttctgtatttcaaatatggccaaaggtagtgatgttgtatttgaaaaattagaaaatgatcctaacatagatgtccttgaatacggttgtctacaaaattgtggtctatgcgcaagtagcttgtatgcccttgtagatggtgatattgttgaaggtaacacaccagacgatttattaaaaaacatatatcaacatatcgaagataatgatataacgaatttgttataa

SEQ ID NO: 2031 - DNA, 762 bp, Staphylococcus epidermidis
atgtcatcaacattagagattaaggacctacatgtgtctatcgaggataaagaaattttaaaaggtgttaacttaacaattaacactggtgaaatacacgcaattatgggacctaatggtactggtaaatcaacattatcgtcagcaattatgggacatccaagttatgaagttacacaaggtgaagtattattagatggcgttaatattttagagttagacgttgatgagagagctaaagcaggcttatttttagctatgcaatatccatcagaaattacaggggtaacaaacgcagattttatgcgctcagcaattaatgcgaaacgtgaagagggacaagaaattaatttaatgcagttcatcaagaaattggataaacaaatggactttttagatatcgataaagatatggctcaacgttatttaaatgaaggtttctctggtggagagaaaaaacgaaatgagattttacaattaatgatgttagaaccgaaattcgctattttagatgaaattgactctggtttggatattgatgctttgaaagtggtttctaaaggtattaatcaaatgcgtggtgaagagtttggagcattaatgattacgcactatcaacgacttttaaattatattacaccagataaagtacatgtgatgtacggtggtaaagttgtgaaatctggaggtccagaattggctaaacgccttgaagaagaaggctatgaatgggttaaagaagaatttggtgctgctgaatag

SEQ ID NO: 2032 - DNA, 294 bp, Staphylococcus epidermidis
cttaatgcgacttctgcgccatctactatattttttccaaaaacattaattactttttctaaattcatacctgatattaatccaccgacaagtgcactaataaataagctaatgaccacatttaatcgacataaacatagtatgatcattaatatgactgcgattacaacagcatttatcattctgcctcaccctttatcactctatcgaactaaagtatttataaaatatatactagcaagacatatatttaatgtcaatgttaaaaaagactcaacgattatatacatttag

SEQ ID NO: 2033 - DNA, 198 bp, Staphylococcus epidermidis
atggtgaatcaacacaagatttccaatatgttaaccgtggaaactgtatgttcattaggtgctaatgatggtgttggaattgtatatggtagagatatcgctggtaaaaaagcagcattcttgaagaaagttattgatactcgtgcgatttacaaacttggtggcataggattagcctttaaaaaaggaaaattttaa

SEQ ID NO: 2034 - DNA, 225 bp, Staphylococcus epidermidis
aatggattccactgtaaaagtgttgaagatattacagaaacacaagctattgcaaataatgaagttaaaggtaaagatttgattaagcatatcaaaattactttgggtgacttcaaagattttcaagttaaacatgattttgatgatgcgaacttattgaatatgattgcacctgtagctacaatggcttcaaaagtgaaagatatgccgagtgattgctactaa

SEQ ID NO: 2035 - DNA, 783 bp, Staphylococcus epidermidis
ctagtgaaacattatcaggcatacttaatcgatttagatgggacaatgtataaaggcacagatgaaattgacggtgccgcacaatttatagattatttaaataataatcatatcccgcatctatatgtaactaataattctacaaagacacctgttcaagttactgagaagttacgtgagatgcatattgatgctaaaccagatgaagttgtaacttcagcattggcaacagcggattatatctctgaacagcatccaaatgcaactgtatatatgattggtggtcatggactcataactgcactaactgatgcaggactttcaataaagaatgatgaacatgttgattatgtagttattggtttagatgaaaaggtaacatatgaaaaattatcaatcgcaacattagctgtacgtaatggagctaaatttatatctacaaatccagatgtatccatacctaaagagagaggttttttacctggtaatggtgctattacgagtgtggtcagtgtctctactggcattcagccagagtttattggtaaacctgaaccaattataatgtctaagtctttagatatacttggattagaaaaatcagaagttgcaatggttggtgatttatatgacacagacattatgtcaggtattaacgtgggtattgatacgatacatgttcaaactggtgtgagtacgtatgaagatattcaatctaaagaaataccgcctacgtattcatttaaagatttaaatgtagctattgcagaattagaaaaataa

SEQ ID NO: 2036 - DNA, 1362 bp, Staphylococcus epidermidis
agtacaattaagtatataaattttaaagagggggatcatgttatggaattaacaatatatcacacgaatgatattcatagtcatttaaatgaatatgctcgtattcaagcttatatggcaaaacatagaccgcaacttgaacatccctccctctatatagatataggtgaccatgttgatttatcagcacctgtgacagaagctacggtaggacataaaaatatagaacttttaaatgaagcacattgtgatattgcaaccattggaaataatgaaggaatgacaatttctcatgatgctttacaaaatctatataacgacgcggattttaaagtgatttgcacgaatgtcatagatgaagagggacatcttccacatcatattacctcttcgtatatcaaagaaataaaaggaacacgtattttatttgttgcagcaacggcaccgttcacacctttttatcgagcactggattggattgttactgacccattagcggcaatcaaagatgaaatcaatgcacatcaaggtgaatatgatcttttaatggttatgagccatgtcggtatcttttttgatgaaaagttatgccaagagattccggaaatagatgttatctttggtagtcatacgcatcatcattttgaacatggagaaataaacaatggtgttttgatggcagctgccggaaaatatggctattatttaggtgaagttaatattacgattgaaaatggaaaaatcgttgataaaatcgccaaaattcatcctattgaaacacttcccttagtcgagacacattttgaagaagaaggaagagcacttctaagtaaaccagtagttaatcatcatgtgaacttagtcaaaagaacagatgttgttacaagaacatcgtatttactggctgaaagtgtatatgagttttcaagggctgattgtgcaatcgtaaatgctggacttatagttaatggcattgaagctgataaagtgacggaatatgatatacatcgcatgttaccccatccaatcaatattgtaagagttcgattaaccggtaaacaattaaagcaagtgattcaaaaaagccaaaagcaagaatatatgcacgaacatgcacaaggtcttggttttagaggggatatatttggaggatatattttatataatctaggctttattgagtcagaagaccgttattttataggcgatgaagagattcaaaatgataaacaatatacgttaggtactgttgatatgtatacatttggaagatatttcccattgctaaaggggttatctacagattatattatgcctgaatttttacgtgatatttttaaagagaaattactaaaattataa

SEQ ID NO: 2037 - DNA, 699 bp, Staphylococcus epidermidis
aacatgggtaaatcttatggtgaaatatttcacgaaatggtgacaatgccaaatgttcagtggccagaggtttggcaggcaattttagaaactctatatatgactgttgtttcgacgctttttgcatttgtctttggacttatattaggggtattactctttttatctgcgaaaagtaactcattggctgctaagattttctacacgattgtgtcattcattgttaatttatttagagcaattccatttatcatattaattttactgttaattccatttacaagtatacttctcggaacaatcagtgggccaactggtgcattaccagcacttattattggtgcagcaccattctacgctagattggtcgagattgcttttaaagaaattgataaaggtgttatagaggctgcttggtcaatgggagcgaacacttcgatagttgtgagaaaagtgctacttcctgaagcaatgcctgctttaatttcaggtattaccgttactgcaattgctttggtaggttctacagctattgcaggtgttattggcgcaggcggtttaggtaatttagcatatttaacaggatttactcgaaatcaaaatgatgtcattttagtttcaacagtatttattttaattattgtatttataatccagttcctaggggattggcttacaaataaaatcgataaacgctaa

SEQ ID NO: 2038 - DNA, 450 bp, Staphylococcus epidermidis
agaggtgacaagcgaatgtattttgtagataaagataaactaactcagaaaatcacttacttacaaaagctcactgaagattacaatgataataaaaggaacctatatgcttttgaacgaattggtcaaatgttaattgaatcttctgtagatattggcaatatgattatagatgggtttattttaagagatcctggtaattataaagatgtaatagatattttagaattggaaaatgttatttcaaaagaaacacaatcacatatcaatcgaactattgatgttagaaaacagtttgcacatcactatatcgatttaaatatgaataaaattgagccgttatttgatgatgcactaccatactataagcaatttattcaagaagtaggacaatttttagaaaatgaaaatgtaccaattaccgcatttggaaaaggagcgaataactag

SEQ ID NO: 2039 - DNA, 1056 bp, Staphylococcus epidermidis
tacgaactaaatcttaaggagaaatgcatcatgattattgcaattatactattaatatttgtttcatttttcttttcaggtagtgagacagcattaacagccgcgaatcgcactaagtttcaaactgaagctaaaaagggtgatcgtaaggcgcaaggtttaacaaagttattagataaaccaagtgaatttatcactactatattaatcggtaacaatgtagcgaatattattttacctacactcgtgacaatcttagcgattgatattggagtgaatgtgggaatagcatcagcaattgtaacaattgtgattatacttatttctgaagtgattcctaaatcaattgctgcaacatttcctgataaaatttcaaaacttgtgtatcctatcattcatatatgtgttattgtactcaagcccattacaatcttattaaacaagatgacagatggtattaatcatttactatctcgaggccaacctgttgaaaaaagattttctaaagaagaaattcgtacattattaaatattgcgggtagagaaggtgcatttaatgagatagaaaatactcgacttcaaaacgttatggactttgaacaattgaaggttaaggatgttgataccacgcctcgtattaatgttgtagctttttcaaaggaagtaacatatgacgaagcttatgatacagtgatgaataacccatatacaagatatccagtatatgatgaaaatatagatgatatcatcggcgtattccactcaaaatatttattagcttggagtaaacataaagaggagtcaattactaattatgcatcaagccctttatttgtaaatgaacataatagggcagaatgggtattgcgtaaaatgaccgtttcacgaaaacatttagcgattgttttagatgaatttggaggtacggatgctatcgtatcgcacgaagatttaatagaagagctacttggtatggatattgaggatgaaatggatcgtgaagaagaaaataaattaaaacatcaaaaatttccgcaaagcatgatgcatcgttaa

SEQ ID NO: 2040 - DNA, 1068 bp, Staphylococcus epidermidis
tcaatgaaaaacttagtattactaggcgggggctatggtaatatgcgaattatgtcgcgcattttacctcattcaattcctgagggatatcacttaactttaatcgaccgcatgccattccacggtttaaaacctgaattttatgcacttgcagcaggaactaaatctgacaaagaggtgcgaatccaatttccagatagcagtcaaattaatacggtttatggggaaatcagtgatatagatttggacgaacaaatgataacagttggaaattcaaaaatagattatgacgaacttatcattggtctagggtgtgaggataaatatcataatgtccctggtgctgaagcatatacacatagcattcaaacattatctaaatcgcgtgaaacataccatagaattagcgagttacctaaaggggcacgtgtaggtatcgttggggcaggtttaagtggcattgaattagcgagcgagctacgtgaaagtcgatcagacttggaaattttgttatatgatagagggcctcgaattttaaggaattttccagagaaactgagtaaatacatatctaattggttttctaaacacaatgttactgtagtacctaattcagtcatcgacagagtagaacccggaaaaatttataataatggtaaaccagaaaatattgatttagtcgtttggacagcaggcatacaacctgttgaaattgtgcgtaatcttcctattgatatgagtaccactggacgcgtgattattaatcagtaccatcaagtcccaacctatagaaatgtttatgtcgtaggtgactgtgctaatttaccacatgcacccagtgctcaactagcagaactacaaggtgaacagattgctgaggtgttgaagaagcaatggaataacgaaccacttccagataaaatgcctgaaattaaagtacaaggctttttaggctctttaggtgacaaacaaggttttgcttatatcatggatcgaacagttaccggacgattagcctctattctaaaatcaggtgttctgtggcgctataaatatcataatggttaa

SEQ ID NO: 2041 - DNA, 840 bp, Staphylococcus epidermidis
acgctaaagaaaaggggattatattctatgaaaaaattattcggaattattttagtattggctttaacgattgccttagctgcatgtggtggaggtaaagataaggaaaaaactatcacagtaggtgcatctccagcaccacacgctgaaattttagaaaaagcaaaaccattattgaagaaaaaaggttatgatttaaaaatcaaaccaattaacgattacacaacgcctaataaattattagacaaaggtgaaatcgatgcgaacttcttccaacatacaccatacttaaatactgaaagtaaagaaaaagggtataaaattgaatcggctgggaatgttgaattagaacctatggctgtatactcaaaaaaatataaaagcttaaaagatcttcctaaaggtgcaacagtatatgtatcaaataacccagctgaacaaggacgattcttaaaattctttgtagatgaaggtcttattaaacttaaaaaaggcgttaaaattgaaaatgctaaatttgatgacataactgaaaacaaaaaagatattaaatttaacaacaaacaatcagcagaatatttaccaaaaatctatcaaaatcaagacgctgacgcagtaatcattaattctaactatgcgattgaccaaaaattaagtcctaaaaaagattcgattgctttagaatctcctaaagataacccatatgcaaatttaattgcagttaaaaaaggtcataaagatgataaaaatatcaaagtattaatggaagtgctacaatctaaagaaattcaagattatattaaagataagtatgatggagctgtcgtacctgctaagtaa

SEQ ID NO: 2042 - DNA, 1287 bp, Staphylococcus epidermidis
tacctcctagaggggaaactcatatatagaaaggtcgtgactataatggccgaacattcttttgatgtcaaggcagtcattaaagactttccaatacttgagcaaaaggtaaataataaacgtttagcataccttgattcaactgcgactagccaaacacctgtacaagttttaaatgtactagatgattactacaaacgctataattctaatgtccatcgtggtgtacacacattagggtctttagctacagatggctatgaaaatgcaagagaaacagtaagacgttttatcaatgcgaagtactttgaagaaattattttcactcgaggaacaactgcatcaataaatatagtagcacatagttatggtgacgctaatattagtgagggtgacgaaattgttgtaacagaaatggaacatcatgctaatattgttccatggcaacaattagctaaacgtaaaaatgcaacactaaaatttattccaatgacaaaagatggtgaattgcaattagatgatataaaagcaaccatcaatgataaaactaaaattgttgctatcgcacacgtttccaatgttttaggaacaattaatgatgttaaaactatcgctaaaattgcacatgaacatggtgcagttataagtgtggatggtgcgcaatcagctccacacatggctttagatatgcaagatatcgatgctgatttttatagttttagtggacataaaatgttaggtcctactggcattggagttttatatggaaaaagagaattattacaaaatatggaacccgttgaatttggtggagatatgatagacttcgtaagtaaatatgacgccacttgggctgacctaccaactaaatttgaggctggcacaccacttattgctcaagcaataggtttagcagaagctatacgttatattgaaaatttaggttttaatgcgattcatcagcatgaaaaagaattgacagaatatgcatatgaacaaatgttaactatagatggtcttgaaatttacggtccaccaaaagatagacgtgcaggggtcattacttttaatttagcagatatacatccacatgatgtagctacagctgttgatacagaaggtgttgcagttcgtgcaggccatcactgtgcgcaacctttgatgaaatggttaggtgtttcttcaacagcacgtgcaagtttttacgtttataatacgaaagaagatgtagatcaattagttcaagcattgaaacaaacgaaggagtttttctcttatgaattttaa

SEQ ID NO: 2043 - DNA, 1176 bp, Staphylococcus epidermidis
gactataaagaaagagacaatttggcttgtcatatgtttatagcctttatctacattgttggttggttaaaatattatgaaagcttaggtgaattagagatggctcaagatcgtaagaaagtgctcgtattaggtgcaggttatgctggtttacaaactgtaactaaattacaaaaagaactttctgctgatgcagcggaaattactttaattaataagaatgaatatcattatgaatcaacttggttgcatgaagcttctgccggtacgattaattatgaagatttattgtatcctgttgagaaaactgtcaacaaaaataaagtgaattttgttgttgctgaggtaacaaaaattgatcgtaatgctaaacgtgtagaaactgataagggtgtttatgactttgatatcttagttgttgcactaggttttgttagcgaaacatttggtattgatggtatgaaagaacatgctttccaaattgagaacgttttaacttctcgtaagttgtctcgtcacattgaagataagttcgcaaattatgctgcttctaaagaaaaagatgataaagatttatctattttagttgggggagctggatttacaggaattgaatttctaggtgaattaactgatagaattcctgaattatgcagtaaatatggtgttgatcaaagtaaagtgaagttaacatgtgttgaagcagcacctaaaatgttaccgatgttctcagacgacttagttagttatgcagtaaaatatttagaagaccgtggagtagaattcaaaattgcaacacctattgtcgcttgtaatgaaaaaggtttcgttgttgaagtcaatggagaaaaacaacaattagaagccggaacttctgtatggactgctggagtgcgtggaagtcatttaatggaagaatcatttgaaggtgttaaacgtggacgtattatcaataaacaagatttaacaattgaaggtcataatgacatctttgttataggagattgttcagcgtttattccagctggtgaagagcgtccattaccaacaacagctcaaattgctatgcaacaaggtgagcatactgctagcaacattaaacgtttattaaatggtgaatcaacacaagatttccaatatgttaaccgtggaaactgtatgttcattaggtgctaa

SEQ ID NO: 2044 - DNA, 192 bp, Staphylococcus epidermidis
atggctgaagataaatttgaacaagctaaaggtaatattaaagaaacagtaggtaatgctactgataataaagaattagaaaaagatggtaaaggtgacaaagcttctggtaaagcgaaagaagctgtagaaaacgttaaagaaaaagcaaatgacgttattgataaatttaaaggtaataaaggtgactaa

SEQ ID NO: 2045 - DNA, 243 bp, Staphylococcus epidermidis
ttaattatggaatttagagaacaagtattagatttattagcagaagtagctgaaaacaacattgtgaaggaaaacccagatgtagaaatctttgaagaaggtattattgattcatttcaaactgtaggtttacttttagaaattcaaaataaattggatattgaagtgtcaattatggactttgatagagatgagtgggcaactcctaataaaattgtagaagctttagaagagttacgatga

SEQ ID NO: 2046 - DNA, 258 bp, Staphylococcus epidermidis
aaggagacatgtcacatgcctactgagaatccaacaatgtttgatcaagtagcagaagttatagaacgtttgcgtccattcttattacgagatggtggcgattgtacgcttgtagatgttgaagatggtattgttaagctacaattacatggcgcttgcggaacatgtcctagttctacaattaccttaaaagctggcatcgagcgtgcacttcatgaagaagttccaggtgtaatagaagtagaacaagtattctaa

SEQ ID NO: 2047 - DNA, 1050 bp, Staphylococcus epidermidis
agatttaaatgtagctattgcagaattagaaaaataaaatatcatctatctgtttttgaaattaatagaggtgtgcatatgaataaaatactcgtaacacgtcaaattccacaacactacgtagagcaacttaaaaaaataggacaagttgtcatgtgggaacacgatttaacgcctatgtctagagaatcatttcttgctaacgttgaagatgcaacagcatgtgtgatcacattgagtgagcatattgatgaagaagtatttctcagggcacaacaacttaaagtgattgctaatatggcagtaggttttgacaatattgatatttcattagcaaagaaacatggtgtagttgttaccaatacacctcatgtactgacagagacaactgccgaactagggtttacattgatgcttactgtagctcgtagaatcattgaagcgacatcatatattcaaaagggtaagtggaaaagttggggcccctacttattatcaggaaaagatgtatacggtgcaactgttggtatttttggaatgggtgatataggaaaagcgtttgcacgtcgcttacaagggtttgatgcacggataatatatcacaatcgcaaacgtgacttaaatgctgaaagagatttaaatgctacatatgtaacgtttaaatctttacttgaacaaagtgattttattatttgcacagcacctttaactaaggaaactgagaatcaatttgatgctcgagcttttaataaaatgaaaaatgatgctgtcttcattaatattggaagaggtgcaattgtagatgaggaagcacttttagaagcgttaaaaaatcatgagatacaagcctgtggtttagatgttatgcgtcaagaacctattcaacctaatcatccaatactgaaattacctaacgctgtggtgttacctcacataggaagtgcatcccaagtcactagaaatcgaatggtacaactttgtatagataatattaaagcagtattaaataatgatgcaccaataacccttgtaacctctttacacttttaa

SEQ ID NO: 2048 - DNA, 1239 bp, Staphylococcus epidermidis
gaaaattgccgaggttgtaaacggatgataccttatggcacatttacatttttcttaattgcatttatcgttcttatacctgtgataatacttggattcttaggtaagcgaagttatatttacaatggtataagtacagcaatcatgattgtcattatattcgcatcagataaacataatctgttagggcaaaaatatctaagtgcacaacttttttgttttattatttatgtcatatggcaggttgccctcattatgtactactatcaatcacgacaaaagaagaatacttttacaaaatttgtaacaattatggtgttgtctattctccctctagcaattgttaaaatattacagagttcatggttaggtggacatcaaattcacttccatgaaagtaaattaattgaatttgtaggatttttaggtatctcatacgtcactttcaaaagtgttcaattaattatggaaattcgtgatggttctattaaagaaatcaaggtagggaaattgatacaattcatttcattcttcccaaccatttcatctggacctattgatagatataaacgttttgtgaaagatgataagaaagtacctagcggtgcagagtacagagaacttgttgtcaaagcaattcatatgattatgttagggttcttatataaatatattattgcgtatttgattcagacttacgctgttaatcctttacaacttaacctgcatggatttactcatatgtggctatatatgtacgcttatagcttatatttattctttgattttgctggatacagtttattcgcaattgcagtgagttatttatatggtattaagacaccgcctaactttaaacaaccgtttaaagccaaaaatattaaagatttctggaatagatggcatatgactttatctttctggtttagagattgtatctatatgagatctttattctacatgtcacgtaagaagttattaaaaagtcaatttgcaatgtcaaatgtagcgtactttttaaactttttcataatgggagtatggcatggtcttgaagtatattacattgtatatggattataccacgcagcgttattcataggttatggttattatgagcgttggcgtaaaaagcatccaccacgttggcaaaatggtttcactacagctataagtattatcattaccttccattttgtaactttcggattcttaattttctcaggcaaatttatttaa

SEQ ID NO: 2049 - DNA, 255 bp, Staphylococcus epidermidis
cgaatcatcagtaatatcgacacaaatatcataaacacgccaaagtataagttaaacgaatcaagtgtaaggtatctacttaaaaaagaaccaaccaaagatccaggtagtagtccaaatagaaatatcgaaccattttttatatctacttgtttggtttttaaatatcctaatgaggaagataatccagtaacaatcagaataactgaagaagtacctattgcaatttgcgtcgtaataccatgtagaagatga

SEQ ID NO: 2050 - DNA, 282 bp, Staphylococcus epidermidis
aggagcgtcagagttatgatagatatgtacttatatgatgatgaagaacaaagccaagtacagttcgtcggctttgttggtgagcatagtcgttacgacttaatgcttgtacaaacggatagacattatggtaaaactttagttttaaatatgcagacaaatcaatttggcattataggttcagatgatatagaagaagaaggttacatttctcatattttaggagtatcaaaggaagaagcggatgaaattattgaatatttaaatgaagttattcaatag

SEQ ID NO: 2051 - DNA, 213 bp, Staphylococcus epidermidis
tcaacatcaaggcaacaaataatattattaaccgaaataaaattaagtgagctaggtacagaattcgttatttcatcccgtgtaacgagatttataaaggaaatacctcgacgtaatgtatttttcgtttacttctttgatagccagtatataaaatgcttaggaacaatgttttgtatcctaagcattttattgttttatttagcatcatag

SEQ ID NO: 2052 - DNA, 489 bp, Staphylococcus epidermidis
aacaaacgaaggagtttttctcttatgaattttaataatttggatcaattatatagatctgtaattatggatcattacaaaaaccctagaaacaaaggtgtcttagacaatggctcaatgactgttgatatgaataaccctacatgtggtgatcgcatacgtttgacatttgatattgaagacggaatcattaatgatgctaagtttgaaggagaaggatgttcaatttcaatgtctagtgcatctatgatgactgaagcagttaaaggtcattcacttggtgaagcaatgcaaatgagccaagagtttactaaaatgatgctcggtgaagactacgagattacagaagaaatgggagatattgaggcgcttcaaggtgtctcacaattcccagctagaattaaatgtgcaacgcttgcatggaaagcattagaaaaagggacagtcgaaaaagaaggtaagtcagaaggtacaacggaagaagattaa

SEQ ID NO: 2053 - DNA, 1266 bp, Staphylococcus epidermidis
aattgtagaagctttagaagagttacgatgaaactgaaaccattcttacccattataatcagtggcgtcatatttattatatttttatttttaccagcaagttggtttactggtcttgtgacaaataagacgttagctgataatagaatttctttaactgatcaagttttaaaaggcacgctcattcaaaataaattattcgagtcaaataagtattacccgatttatggttcaagtgaactggaaaaggatgatccttttaatccaggtatagcgctaaataaacaaaatgctagtaaagaaacgttccttattggtgcgggaggttcgacagatttaattaatgcagttgaacttgcagcgcaatacgacaatttaaaaggaaagaaatttacatttattatttctccacagtggtttacgaatcatggattaacaaatcaaaactttgatgctcgtatgtcacaaagtcaaatcaatcagatgtttaatcaaaaagatatgccagctaatttgaagaaacggtatgcacaaagattgttacagtttccgcatgcacacaataagtcataccttagagaacaagcaaaacatcctaatgatgtctctggaaactacatttcttcatttaaagaaaatcaattaactaagattgaagctattaaatcattattctcattcactaagccacctctagcagaagtaaaacctgcaacaagagaagatgcttcatgggatgagatgaaacataaagctgccgatataggcaaagcaaatactcaatctaataaatatgatataagagatccatattggaaattgataaaacaaaacaagcgtaaaatcaaaagggattatgagttcaacattaactcacccgagttccaagatttaaaattattagtgcaaacgctacatgctgctggagctgatgtacaatatgttagtataccttcaaatggaagatggtatgatcatataggtatcaaaaaagatagacgtgaagctgtatataaaaagattcactcaactgtagttgataatggtgggaaaatttatgatttgacaaacaaggactatgaaaagtacgtaattagtgatgctgttcatattggatggaaaggttgggtttacgtcgaccagcaaattgcaagacatatggatggtcatgcgcctaaaaatcatgaagtcgattattctaaaaataaaccaccgcacaaacatcacaacgatcgtcaagatgatcaacatcaaggcaacaaataa

SEQ ID NO: 2054 - DNA, 1074 bp, Staphylococcus epidermidis
gaaagcatttttaatttgattactaagcaacataaggaggctattaacgtgattaagctaaaccaaattgttaaacgctatcataccaaggataaagatgttcttgctgttgatcacgttgatttaaacattgaatccggctctatttttggtgtgattggtttctcaggagctggcaaaagtacgcttataagaatgtttaacaacttagaatctccaacgtcaggtgaaatcattatagatggtgacaatataagtcaattatctaaatcacagttacgaaaaaaacgacaaaaagtgagtatgatttttcaacattttaacctgctatggtcaagaaatgtattgaaaaatgtaacatttccattagaaattgctggcgttccaagtggtctagctaaacaaaaagcattggaactcattgaacttgtcggcctaaaaggtcgagaaagtgcgtatccgtctgaattatcaggcggacaaaaacaaagagtgggtattgcgagagcattagctaatgatccagatgtattgttatgcgatgaggcaacaagtgcattagatccacaaactacagatgaaattctagatttattattgaaggtaagggaacaacaaaatttaactattgtacttataacacatgaaatgcatgttatacgaagaatttgtgatgaagttgctgtaatggaaaacggtaaagttatcgaacagggagcggtaagtaaagtatttgagaatccacaacacgaagtaacaaaacgttttgtgaaagatgatttaaacgatgattttgaagattctttagagtatttggagccattagatcatgatgcatatatcgtgaggttaaactttactggtgaaaatacgactgagcctatcatatcttatatgacgaagacgcataacatagatgtgaatattcttgaagcagatattaagaatactaaaaacggttcgcttggatttttagttattcacataccacatataagtgaagaacatttcaagcaatttaaacataatcttcacgaacaacacgttaatgtggaggtgctaaaacatgggtaa

SEQ ID NO: 2055 - DNA, 1524 bp, Staphylococcus epidermidis
cttataattattgttatacagaatgaggaacggaggatctatatgcaattttttattaatcaagatacgccaacatcaattgaaacgattgtggtgggtgtgccagatcacctcaaccaattaggtgagataaaatatcataagacgttaattaaagaacgattagaaacattaaaacaatatcatgtcatcaatagctcaatcggcaaaatatcatcaacgcttatctacattgatgaaaagcctaaaagattattaactgtaggactaggaaacttaaaaatcttatcatatcaacgtttattaaaagtttggggtcagttgtttcaatatttaaaagacgttcatgtcacggattgtgaattattgttagatactttcaaatctaaacatggtaacattgttgaaatttgtcaaactttaggtttacaaagtgcacaatctatctttgaatttgaccattataaatcggataaaaagcctccatatcaaggtagagtctatatacaaacgacagagcataatatagaaacgaagattaacgaaggccaacaattgggtgaatctataaattatgctcgtgaactaagtcaaatacctccgaatattttaacaccccaatattttgccgaagaaataaaaaaacatttcgaagggagttccgttagtgtagatatcaaagatcaccgacaaattatagatgaaggatttggattaatacatgcagtaggtaaaggttctaatcatggtccgagattaattacggtatcatactatggtgcagaagctgatgaaccacctatttcattagtgggtaagggtattacatatgattccggtggatatagtattaagtctaagataggtatgcaaactatgaaatatgatatgtgcggtgcggccaatgttattggtatgattgatgtgatctctaagcaaaacctacctgtaaatattgtaggaataatcgcttcagctgaaaatatgattggtgaatcttccatgaaaccagatgatgtatttactgcgcttaatggggaaacagtagaaatgttgaatagtgatgctgaaggtagaatggttttaggtgacgcagtattctatgcaacacaatttaaaccacaactaattcttgattttgctacattaacgggtgcagcgattgtagctttaggtgatgacaaggcggctgctttccaatctcatgctgaaaatgaacttaaaaacttattaacagttgcacgtcatgtagacgaaaaagtattcgaattacctattacagagactgaaagacatttaattaaacaatcagatgtagcagatttagtcaatcatacgaacggtcaaggaaaagcattgtttgcagcagcatttatttcgcattttagtggtgacatcccacacattcactttgatatcgcgggccctgcaacaactaaaagtgctacatataaagggccaaagggtccgacaggttacatgatacctacagttgtagagtggttacaacaaaaatataaataa

SEQ ID NO: 2056 - DNA, 873 bp, Staphylococcus epidermidis
aaggagattattatgaaaaaattcaaatggataaatatatttaaaggttttggtatgggtacaagtgatctcgtcccaggtgtaagtggagggactatcgctttattacttggaatttatgatgactttattagctcaattagtggtttgttttcaagacgattttggcctagcttaaaatttttactacctattttagtagggatgctaatagctataggactattaagtcaattatttaattatttgcttagtcaacatcatattcctactatgttattttttacaggtttgattctcggtatcatcccttatttattaaccatctcaaatttcaaaaaaaatttcagtataatacattattttattctattattaggtattgctattatagtcgttttcgcattgcttaatcatggagacaagcattcaggtgaaacacttactttatctttcagtcttatcattaaatattttatcgcaggtgttttcgcttcaagtgctatgttattaccaggcatttctggatcatttatgttacttgtcttcggagtatatgggacgctaatgtatgctatttctgaactacttcattttaatttaaatgcattacctatcatattaatagtaggtttcggtattgtaactggttttatgatttcaagtcgattaattcaatattgtctacatcaacaccctacaatgacatttgctttgataataggctttgtaatcggatcgttgtatgcagttttccctggattcccgaaagacttaatccaatggatcatatcatttttcctattgatcactggcttcttagtaagttatgttcttggtaaaattacagcaaaaaatgaagcatcattttga

SEQ ID NO: 2057 - DNA, 399 bp, Staphylococcus epidermidis
ggtgaaaatatgattaaagtcgaccaacaatattttgaattgatagaagaatatagagaatgttttgatgaggaaatattttcagctaggtattcggatatattagacaaatatgattatgtcgtaggtgactatggttacgatcaattacgcttaaaaggattttataaagatagtaataaaaaggcagaaataagtaaacgattttcaagtatacaagattatatactagaatattgtaattttggttgtccttattttgtagtcagacgattgtcaccaaatgaatttattgaagaaatagatgataaagaagatatcattgataaattacatgatgttaagattcaacctactattcaagacacagaaaaacatacccaagctatagatcaatag

SEQ ID NO: 2058 - DNA, 876 bp, Staphylococcus epidermidis
tgtggtatcatgttgttggtgataaatatgatagaaataggtcttactggctggggtgaccatgatacattatatgaggatttagagcgtaaaacagataagttaaaaacgtatgctagtcacttcccaatagtagagttggatgcttcgtattatgcgatacagccagagcgaaatataattaaatggataaatgaaacgccgaatagatttcaattcgttgttaaaattcatcaagcattaacattgcatgctgactatagagattatgcagagtcgagagatatattatttaaacagtttaaagaaatgatcaatccgttaaaagagcataataaattggcgatggtgctcgtacaatttccaccttggtttgattgtaacgtccaaaatataaattacatcttatatgtgagaaaacaattaactgatattccgatgagcattgaatttagacatcaatcatggtttgacaatcagtataaagaacaaactttatccttcttaacacaacatcaaatcattcatgcagtggtagatgaacctcaagttaaagaggggagcgttcctttagtaaataggattactagtgaaattgcttttgtacgttatcatggacgtaatcattatggttggactaaaaaagatatgactgatcaagaatggcgagatgtaagatatttatatgattatagcaatgatgagttagctgacttggctcgtaaagtcgaaatacttaatcaaaaggctaagaaagtatatgtaatttttaataataactctggcggtcatgcagctaataatgctaaaaagtatcaaaatattttagacattgattatgaaggtttagcaccgcaacaattaaaactattttaa

SEQ ID NO: 2059 - DNA, 330 bp, Staphylococcus epidermidis
gggattttaatgactaaaattagtgttgtcgtatatggagcagaagtcgtttgtgcgagttgtgtaaatgcacctacatctatagatacttatcaatggcttcaagcattacttttaagaaagtttcctcaacatcattttgaatttacatatattgacatacgaaatgatactgaaaatttaactgatcatgatatgcaatttatagaaagaattaatgaagatgaattgttttacccattagttacgatgaatgatgaatatgtagcagatggttacatacaatataaacaaataacccgttttattaaatcatattttactatgtaa

SEQ ID NO: 2060 - DNA, 354 bp, Staphylococcus epidermidis
ttgctactaatagcaagaaactttagttttattaagcagttatacactacttatttgaaaaataaccaattcgttcaattgaaaatggaattaaatggatatcgcgatgctttatacggtggtggtaaatctgctaaatccctgatgactaaaaaagatattaagatgagtaataaaattgccaatgcaatgaaaaggttagaaaaagttatagataactcacatgaaaaaattgacgccagagcaatacgagagtatgtcaataaatatccaattatcgagggtcaagttatacatatcaatagttgtcttgataatgatatttctggcacatatatttactacagtgcctga

SEQ ID NO: 2061 - DNA, 273 bp, Staphylococcus epidermidis
ggcagaatgataaatgctgttgtaatcgcagtcatattaatgatcatactatgtttatgtcgattaaatgtggtcattagcttatttattagtgcacttgtcggtggattaatatcaggtatgaatttagaaaaagtaattaatgtttttggaaaaaatatagtagatggcgcagaagtcgcattaagttatgcgttacttggtggttttgctgccttgatttcctatagtcgtataactgattatctaatagtgtcctacaccacggggaat

SEQ ID NO: 2062 - DNA, 969 bp, Staphylococcus epidermidis
tgccgatatgttataataaacgaagatatattaaacaggagggtatgcgttgttatggcgactagaaatgaagaaattttacgtaaaccggattggttaaagattaagcttaacacaaacgataattatactggtcttaagaaaatgatgcgtgagaagaatttacacacagtgtgtgaagaagctaaatgtccaaatattcacgaatgttggggtgcgcgtcgtacagctacatttatgattttaggggcagtatgtacaagagcatgtcgattttgcgcggtaaaaactggtttacctaatgaattagatttaaatgaaccagaacgagttgcagaatcagtagaattaatgaatttaaaacatgttgtaattactgctgttgcacgtgatgatttaagagatcaaggctcaaacgtgtatgcagaaacagtacgtaaagtaagagaaagaaatccatttacaacaatagaaattttaccatctgacatgggtggcgattatgaagcccttgaaacattaatggcttctagaccagacattcttaatcacaacattgaaacggttcgtcgcttaacaccaagagttcgagctcgagcaacttacgatagaactttacaatttttacgtcgttctaaagaattacaacctgatattccaacaaaatcaagtttgatggttgggttaggtgaaacgatggaagaaatttatgaaacgatggatgatttacgcgctaatgatgttgatatcttaactataggtcaatatttacaaccgtctcgaaaacatttgaaagttgagaaatattatacgccattagaatttggtaaaatgagaaagattgcaatggaaaaaggatttaaacattgtcaagcaggacctttagtaagaagctcatatcatgctgatgagcaagtgaatgaagcagctaaagagaaacaacgccaaggtgaagaacaactcaattaa

SEQ ID NO: 2063 - DNA, 840 bp, Staphylococcus epidermidis
gaggcgaatgtcatgttattaacaattattctattaatattaatagggggattatcagcgattttaggatctatcgttggtattggtggtggaatcatcatcgtccccacacttgtttatttaggcgttaaccatcatcttctacatggtattacgacgcaaattgcaataggtacttcttcagttattctgattgttactggattatcttcctcattaggatatttaaaaaccaaacaagtagatataaaaaatggttcgatatttctatttggactactacctggatctttggttggttcttttttaagtagataccttacacttgattcgtttaacttatactttggcgtgtttatgatatttgtgtcgatattactgatgattcgtcacaaaatcaaaccttttaaaatttttgacaaacctaaatatgcgcgtacatatgttgatgctgaagggaaaacataccgttatagtgtaccacccctgtttgcttttataacaacgttatttattgggctattaacaggactgtttggcataggtggaggtgcattgatgacccctcttatgctcatcgtctttagatttccaccacatgttgcagtaggcacaagtatgatgatgattttcttttcaagtgtgatgagttcaatagggcacatctttcaaggacatgtggcttggggctattctatcattctcattatttcaagtgttataggtgcacaaataggtgtgagggtcaatcgatctatgaaatccgacacagttgtaatgttattgagaacagtaatgcttatcatgggtgtatatttaatcattaaatcttttatttaa

SEQ ID NO: 2064 - DNA, 197 bp, Staphylococcus epidermidis
cttaatcacgttaatagcctccttatgttgcttagtaatcaaattaaaaatgctttctcaatttttagaaaatttgagaaagcatttgttgaaatgttctttctctcatcttctaaagttatactttatgtgaattggcaccatctctattttagacagtttgcaagggccttcacaaacgggattgcccgaaaggg

SEQ ID NO: 2065 - DNA, 1470 bp, Staphylococcus epidermidis
gggagagtagttatggcagacttaattaatattctaaaccacttcgttcaggaacaacctgaagcagttgcggttagacatacaaatgatgagctaacatataaacaacttgatgaagaatcaagtaagctagcacatctattacaagatagtaaaaagccaatgattttatatggtcacatgtcaccttacatgattgttggtatgattggagcgattaaatccggttgtggatatgttcctattgatacttctgttcccaaagaacgtgtgaatatgattattgataaagtacaaccggaaatcatttttaatacttcagatgagactttagaacagacaaatgcacaagtgcttaaggttagcgatattcaggattcacaatatccaattgtctttgatagtcaaatgaagcaaaacgatgtagtatatacaatttttacctcaggatctacaggagaacctaaaggtgtgcaaattgaatatgcaagtttaaatgaattcgcagaatggatggtatctttaaacaaaactggtactggtaaagaatggttaaatcaagcgccattttcttttgatttatcagtaatggcaatctatccttgtttaacatcaggtggtactttaaatcttgttgataaagatatgattaaaaaacctaaactattgaacgaaatgttagttcaaacaccaatgaatgtttgggtttctacaccttcttttatagaaatgtgtttattattacctaatttaaatgaacaacaatatagtagtttaaagcaattctttttctgtggggaaatcttaccacataaaacagctaaagccttagttgaaagatttccgaattcaatgatttataacacatatggaccgactgaagctactgttgcagtcacaagtatacaaatcacagaagaaattttaaatcaatataaccctttaccagttggtgtggctagacctggtacaaaattatttgctactgaagaaggagaacttgtcattgaggggcaaagcgtcagtttaggttatttaaagaatgaagaaaagacaactgcagtatttaattttgaagacggtgtcagaacatatcatactggggataaagctaaaattgaagatggattgtggtttattcaaggacgtattgattttcaaattaaattaaatggttatcgtatggaattagaggaaattgaaacacaattacgccagtcaaaacatgtaagagaggctgttgttgtgccggtttataaaaatggaaaggtcatacatttaataggagcagtagtacctactgaacctgtagaagataatttagcaatgacaactcatattaaacacgaacttaaatcacgcttaccagaatatatgattcctagaaagttcgaatggatggaacaactaccactcacatcaaatggtaaattagatcgtaagaaaattgccgaggttgtaaacggatga

SEQ ID NO: 2066 - DNA, 1320 bp, Staphylococcus epidermidis
gaggaaaaagtgatgacaactaaaactttgaacatttctgaagaacaacttgttgattattctaaagcgcacaatgaaccttcttggatgacagagttacgtaaaaaagcgttgaaattaacagaaactttagaaatgccaaaacctgataaaacgaaattaagaaaatgggattttgatacgtttaaacaacaccatacaacaggagatgcatacactcagttaactgatttaccaaaatctgttaaagaaatcattgatgttgaaaactcagaaaacttaatcattcaacataataatgaattggcatatacacaagtatcggatcaagctaaacatgatggtgtgattattgaaggtctatctgaagcactagtcaaccatagtgatttagttcaaaagtactttatgactaaagcagtagatgttgatgaacatcgtttaacagcattgcatactgcattagtaaacggtggtatttttgtttatgtacctaaaaatactgttgtagaacatcctatacagtacgttgttttacatgatgatgaacaagcgagcttttacaatcacgtcatcattgttacagaagaaagtgcagaagttacctatgtagagaactatctttctactactagtggtgaagataaccaacttaatattgtgtcagaggttatcgctggcgcaaactctaacgtcacatatggttcagttgattatttagataaaggatttacaggtcatataattcgtcgtggttctgcagatgcagatgcttctatcaattgggcactaggtttgatgaatgaaggtagccaaattatagataatactacaaatctaaacggtgatcgttcaacaagtgcattgaaatcagttgttgttggcacaggtgatcaaaaaataaatttaacttccaaaattgttcaatacggtaaagaaacagatgggtatatattgaaacatggtgttatgaaagaaaatgcatcttctgtatttaatggaattggctacattaaacatggtggtacgaaatctattgcgaaccaagagtcacgtgtattgatgttatctgaaaatgctcgtggtgatgctaaccctattcttttaatagacgaagatgatgttgaagcaggacatgcagcctcagttggtcgtgtcgatcctgagcaattatattatttaatgagccgtggtatttcaagagctgaagcagagcgtctagttatacatggtttcttagatccagtagtacgtgaattaccaattgacgatgtaaaacgtcaacttagagaagtaattgagcgtaaagtttcaaaataa

SEQ ID NO: 2067 - DNA, 1416 bp, Staphylococcus epidermidis
aatcaaggagtgattaaaatggcaaaacaagcacctgatgttggggattataaatacggattccatgacgaagatgtttccatttttagatcagagcgtggtttaacggaaaatatagtaacagaaatctctaaaatgaaagaagagccacaatggatgttagatttccgtttgaaagcattaaaactattctataaaatgccaatgccacaatggggtggagatttatctgaattagattttgatgatattacgtattatgttaaaccttctgaacatactgaacgttcatgggatgaagtgcctgaagaaatcaaacgtacttttgataaattaggtattccagaagctgagcagaaatacttagctggagtttctgcacaatatgaatcagaagttgtttatcataatatggagaaagaactggaagaaaagggtattattttcaaagatactgatagtgcattacgtgaaaatgaagagttatttagagaatattttgcgtcagtggtacctgctgcagataataaatttgctgcattaaattcagcagtatggtctggtggttcattcatttatgttcctaagaatgttaaattagatacaccactacaagcatatttccgtattaactctgagaatatgggacaattcgaacgtacattaataattgctgatgaaggtgcatcagtaaactatgtagaaggttgtactgcacctgtatactctacaagttcgctacactcggcagttgttgaaattatagtacacaaagatgcacatgtaagatatactactatccaaaactgggctaataacgtatataatttagtaactaaacgtacctttgtccatgagaatggtaatatggaatgggtagatggaaacttaggctctaagttaacgatgaaatatccaaactgtgtacttttaggtgaaggtgccaaaggtagcacattatccattgcatttgctggtaaaggtcaagttcaagatgctggtgctaaaatgattcataaagcacctaatacatcttcaactattgtttctaaatctatctccaaaaatggtggtaaagtcatttatcgtggtatcgttcattttggacgtaaagctaagggagcacgttcaaatatcgaatgtgatacattaattttagataatgaatcgacttcagatactatcccttataatgaagtgttcaatgacaatatttcattagaacatgaagctaaagtttctaaagtatcagaagagcaattattctatcttatgagtcgtggtatttctgaggaagaagcgacagaaatgattgttatgggattcattgagccgttcacaaaagaattaccaatggaatacgcagtagaaatgaaccgtttaattaagtttgaaatggaaggctcaattggttaa

SEQ ID NO: 2068 - DNA, 408 bp, Staphylococcus epidermidis
tataacgaatttgttataaaggttaaaaaattatgggaggttttttatatgccaacagtcattttaactgaagcggcagcatttgaagttagagacatgttaaaaaataacgacatgtctgatggttatttaaaaattaaagtaaatggtggaggatgcacaggattaacttatggtatgtcagccgaagcagaacctggtgaaaatgatgaaattctcgaatactatggtttgaaagttctagtagaccgaaatgatgctcctgtattaaatggaacaacaattgattttaaacagtcacttatgggtggaggatttcaaataaataatcctaatgctattgcctcatgtggttgtggaagttcatttaaaacagctaaagtcgctggaaatccagagcaatgttaa

SEQ ID NO: 2069 - DNA, 396 bp, Staphylococcus epidermidis
atcatgcgttctatcttattaccgtattcgatagattcatcatattcgaatgttaactcaggtataattcttaggcgcattcgagaaccaagttcagattttataaacccagttgctttatgcaaagctttaaacgtattatcaacttctttatcattccctaacactgttaaatatacctttgcttgtgaaaggtcattggttagttcaacatcagtaattgttaaaaaaccaactctagggtctttaactttattattaacaatgtccatgatttcctgtttcatttgttctcctacacgttctgctcttatattattcatcatctcacctctctttatttttactttactcacaaataaatgtgaaatatcagatttaatgattaactattga

SEQ ID NO: 2070 - DNA, 195 bp, Staphylococcus epidermidis
cgttcattatccaaaacgagacctcctactacagaaagttatctgtataatatcttatacttactatacaagcattttaagcaaaatacaagtcttttgcgaatatttgttcgcatttattgtgtgatagctgatacaaaaacgaacaaacgtacttatattttttgcaaaaatttaaaatatactatttattaa

SEQ ID NO: 2071 - DNA, 2121 bp, Staphylococcus epidermidis
gagaggagattcataatgtctcaagagaagaaagtttttaaaactgaatgggctgggcgttctttaactattgagacaggacaattagcaaagcaagctaatggtgctgttttagtgcgttatggagatacagttgtcctatcaactgcaactgcttctaaagaacctagagatggcgattttttcccattaactgtaaattacgaagaaaaaatgtatgctgctggtaaaataccaggaggattcaaaaaaagagaaggtcgccctggtgatgaagcaacgttaacagctcgtctcattgatagacctattcgtccactgtttccaaaaggatatagacatgacgtacaaatcatgaatattgtcttaagtgctgatccagattgctcaccagaaatggcagcaatgattggttcttcgatggcgttaagtgtttcagatattccattccaaggtcccatcgcaggtgtaaatgtaggttatatcgatggcaaatatgtcattaatccttccgtcgctgataaagaaatttctagattagatttagaagttgctggtcataaagatgcggtaaacatggttgaagcaggcgcaagtgaaattactgagagtgagatgcttgaggctattttcttcggacacgaggaaatcaaacgacttgttgcattccaacaagaaatcatcgatcacattcaaccgataaaacaagaatttgtaccggtggaaagagacgaagatttagttgaaaaagtaaaaagtttaactgaagataaaggacttaaggacacggttttaactttcgataagcaacaacgagatgaaaacttagatgctctgaaagaagaagttgttggtcattttctagatgaagaagatcctgaaaatgaaacgcttgttaaagaagtttatgcaattctaaatgacttaattaaagaagaagtaagacgtctaattgcagatgaaaaaatacgacctgatggacgtaaagtagatgaaataagacctcttgaatcagaagttggtttgttaccaagagctcatgggtcaggtttatttactcgtggtcagacacaagcactttcagttttaactttaggcgcacttggagattatcaattaattgatggtttaggacctgaggtagaaaaacgttttatgcatcattataactttcctaatttctctgtaggagaaactggccctgtacgtgcacctggtagacgtgagattgggcatggtgcgcttggtgaaagagcattacgttacattatacctgatactcaagatttcccttatacaattcgtattgtaagtgaagtattagagtctaacggttcatcatctcaagcatcgatttgtggttcaacattagcattaatggatgccggtgtaccaattaaagcgccagtcgcagggattgcaatgggactagtaacgcgtgacgatagctatacaattttaactgatattcaaggaatggaagatgcattaggtgatatggacttcaaagtagcaggtactaaagacggtattactgcgattcaaatggatattaaaattgatggtttaactcgagaagttattgaagaagcactagaacaagcgcgtcaaggacgattagctattatggatcatatgcttcacacgattgaacaaccacgcgaagaattaagtgcttacgcaccaaaagtggtaactatgagtattaatccagataaaattcgagacgtgattggaccaggtggtaagaaaatcaatgaaattatcgacgaaactggagttaaattagatattgaacaagatggtacaatctttataggtgctgtagatcaagcgatgattaaccgtgcaaaagaaattatcgaagatattacacgcgaagcggaagttggacaagtatatcatgctaaagtaaaacgtattgaaaagtatggtgctttcgttgaattgttccctggtaaagacgcgttattacacatttctcaaatttcacaagaaagaattaataaagtagaagatgttcttaaaattggagatacaattgaagtgaaaattactgaaatcgataaacaaggtcgcgttaatgcgtcacataaagtattagagcaatctaaaaattaa

SEQ ID NO: 2072 - DNA, 906 bp, Staphylococcus epidermidis
tggaggggattgattttggataaaatccaagaaacatttttatatatgttaaaggttgaaagaaacttttcagagtatacgttaaaatcttatcatgatgatttagttcaatttaacaactttttagaaagagaacatttacaacttgagacttttgaatataaagatgctagaaactatttggcttttttatattctaatcaattaaaaagaactacggtgtcaagaaagatatcaactttacgtaccttctatgaattttggatgactcaagataattcaattattaatccctttgttcaactagtgcatcctaaaaaagagaagtatttacctcaattcttttatgaagaagaaatggaagcactttttcaaactgtagagcatgataataaaaaaggcatacgagacaaagttattattgaattgttatatgcaacaggaatacgtgtgtctgaattaataaatattaaactaaaagatatagatatgaacttaccaggtgtaaaagttttaggtaaaggaaataaggaaaggtttatcccttttggagagttctgtagacagagtatagaaagatacttagaagaattccaacctaaacaattagccaatcatgattatttaattgtaaatatgaaaggtgatcctatcaccgaaagaggagtaagatatgtacttaatgatgtcgttaaaagaaccgctggcgtcaatgacatacatcctcataaattaagacatacttttgctacacatttattaaatcaaggtgctgatttaaggactgtacaatctttacttggtcacgtcaatttatcgactactggacgttatacacatgtttcgaatcaacaactgagaaaggtgtatttaaacgcacatcctcgagcaaaaaaaggagagtaa

SEQ ID NO: 2073 - DNA, 447 bp, Staphylococcus epidermidis
aagcggttgttgaagaacttggtggcgaaaaaatcgatatcgtccaatgggatgaagatcccgaaagtatttgttcgtaatgctttaagtccatcacaagttttagaagtaattgttgatgaagagaatcaatcaactgtagttgtagttcctgattaccaattatccttagctataggtaaaagagggcaaaacgcacgtttagctgctaaattaacaagttggaagatagatattaaatcagaatctgatgcccgagaagctggaatttatcctgttattgaatcagaagaagttgcagatgaaattgttaattccggtgacgaagatgttgagtttgataatgttaacttggaagagacaaacttaactagtacagaattagctgctgaaaatgatgaagataaaaaagataaaacagaagaagataatgacacagaatcatag

SEQ ID NO: 2074 - DNA, 336 bp, Staphylococcus epidermidis
agaagagatcccaaaataatgactaaaatgaaaatttttaatttgcttggtttagctatgagagctggtaaaatcaaaagtggcgaatcggtcatcttaaatgagcttaaaaagaatcaaataaaacttgtcatattagctagcgatgcatctagtaacactctaaaacaaatgaataataaatgtaatagttaccaagtgccattaaaagtgtttggtactagaaatgaattagggttagcaataggtaaaagcgatagagttaatattggtataacagataatggttttgcaaaaaaattgttatcaatgatagatgaatatggtaaggagtga

SEQ ID NO: 2075 - DNA, 1581 bp, Staphylococcus epidermidis
aataatgattatgggcatatagaaaggattttcaaagtgaatgaagagcaaagaaaggctggaacgataaatattctagcagaacgtgatcgtaaagctgagaaagattatagtaaatactttgaacaagtgtatcagccacctagcttaaaagaagctaaaaaaagaggaaaacaagaagttcaatataacagagattttcatatagatgaaaaatacaaaggtatgggtaaaggtcgcacttttttaattaaaacatatggatgtcaaatgaatgcacatgacactgaagttatggcaggaatattaaatgcattaggatatagtgctacttcggatattaatgaagcggatgtgattttaattaatacatgcgccattagagaaaatgctgaaaataaagtctttagtgaaataggaaatttaaaacatttaaaaaaagaacgcccagattgtttaattggggtgtgtggttgcatgtctcaagaagaatcagtcgtaaataaaatattaaaatcttatcaaaatgtagatatggtttttgggacacacaacattcatcatttacctgagattttagaagaggcatatttatctaaagcgatggtagttgaagtatggtctaaagagggagacatcatcgaaaatttacctaaagtgcgtgacggtcacattaaagcttgggttaatattatgtatggttgcgataagttttgtacttattgtattgttccatttactagaggaaaagaacgtagtcgtcgtccagaggacatcattgatgaggttagagaattagcaagagaaggttatcaagaaattaccttattaggtcaaaatgtaaattcatatggtaaagatatcgaaggtctggattatgaattaggtgacttattggaagatatttctaaaattgatatacctcgtgttcgttttacaacaagtcatccttgggactttacagatcgaatgattgaagttatagctaaaggtgggaacatagtaccgcatatccatttaccggtacaatcaggtaataaccaagtattaaagataatggggcgtaaatatacaagagagagttatcttgatttagtttcaagaataaaggaagctatccctaacgtagctctaactactgatatcatagtaggttatcctaatgaaactgaagaacaatttgaagaaacattatcattatatgatgacgttcaatttgagcatgcatacacatatttatattcacaaagagatggaacaccagcagctaaaatgaaggataacgtacctttagaagtgaaaaaagaacgtttgcaaaggcttaataagaaggttggaatatattctcaacaagcaatgagtcagtatgaaggtaagattgttacggtattatgtgaaggttctagtaaaaaagatgagaatgttctagcaggctatactgataaaaataaacttgtgaattttaaaggaccaagagagagcattggtaaactcgttgatgtcaaaattgacgaggcaaaacaatattctttaaatggaacatttatacaagaacatcaacgttcaatggtgacacaataa

SEQ ID NO: 2076 - DNA, 2676 bp, Staphylococcus epidermidis
atttatacatataatataaataaagatataagaataagggttgtgaaaatagaaatggctaacattacaccaatgatgcaacaatatttaaagataaaatctgaatatgatgattgtttgctattttttagactcggagatttctatgaaatgttctttgatgatgctaaagaagcatcaagagtacttgaaataacattgacgaaaagagatgctaaaaaagaaaatcctattccgatgtgtggcgtaccatatcattctgctgataattacattgaaacattgattaataatgggtataaggtcgctatatgtgaacaaatggaagatccaaagcaaacaaaaggaatggttagaagagaagttgtaagaatcatcacaccaggaactgttatggatcaaaatggtatggatgaaaagaaaaataattatattttaagttttatcgaaaatgaagaatttggattatgctattgtgatgtttctacaggcgaactcaaagtaactcatttcaaagatacagcaaccttgcttaatgagattacaacaattaatcccaatgaaatcgtcataaagcaagctctatctgaagaattaaaaagacaaatcaacatgataactgagacgattactgttcgcgaagatatatctgatgaagattatgatatgaatcagttgacacatcagttaatgcatgacacaactcaattattgttagattacattcatcacacacaaaagcgagatttatctcatattgaggaagtaattgaatatgctgcagttgattatatgaagatggattattatgcgaagcgaaatttagagctgacagagagcatacgattaaaatcaaaaaaagggactttgttatggttaatggatgagacaaaaacaccgatgggtgctagacgtttaaagcagtggattgatcgtccattaattaataaacaacaaatcaacgacagattaaatattgttgaagagtttatggaccgttttattgaaagagatacattacgtaatcatttaaatcaagtgtatgacatagaacgactagtaggaagagtgagttatggaaacgtaaatgcaagagatttaatacaacttaagcattctatatccgaaatacctcacattaaagcattactcaatgaattgggtgcacaaactaccacgcaatttaaagaattagaacctttagatgacttgttacaaattttagaagaaagtttagttgaagaaccacctatttccatcaaagatggaggattatttaaaaatggcttcaacgcgcaacttgatgaatatttagaagcttcaaaaaatggtaaaacttggcttgcagaattacaagctaaggaacgtgaacgtacaggtattaagtcattgaaaattagttttaataaagtgtttggttattttattgaaattacacgtgcaaacttaaataattttcaacctgaagcgtttggctataatcgaaaacaaacattatctaatgctgaacgatttattacggatgaattaaaagaaaaagaagatataatacttggtgctgaagataaagcagtagagttagaatatgaattatttgttaaattacgagaacacattaaaacgtacactgaacgtttacaaaagcaagcgaaaatcatttcagaacttgattgtttacaaagttttgctgaaattgctcaaaaatataattatgtcaaacctacatttagtgatgataaagttttacatttagaaaactcaagacatcctgttgttgagagagtgatggattataatgattatgtacctaatgattgccatcttgatgatgaaacgtttatttatctcattacgggacctaatatgtcaggtaagtcaacatatatgagacaagttgctataataagtatcatggctcaaatgggagcatatgtaccatgtgattcagcaacattacctatatttgatcaaatttttactaggattggtgcagcagatgaccttgtatcaggtaaaagtacatttatggtagaaatgttagaagctcaaaaagctttaacttatgctactgaaaatagtttaattatctttgacgaaataggaagaggtacatctacttatgatggtcttgcgttagcgcaagcgatgattgaatatgttgctcaaacttcccatgctaagacacttttctcaacacattatcatgaattgacatcacttgatcaaatgcttaagtgtttaaaaaatgtacatgttgctgcaaacgagtatcaaggtgaactgatatttttgcataaagtcaaagatggcgctgtggatgatagctatggtattcaagtggcaaaattagcggatttacctaatgaagtcattgatagagcgcaagttatattaaatgcatttgagcaaaaaccttcgtatcaactctctcatgagaatactgacgatcaacaaacggttccgtcgtataacgattttggtcgaacagaagaagagcaatcagttatagaaacacatacatcaaatcataattatgagcaagcgacctttgatttatttgatggttacaatcaacaaagtgaagttgaatgtcaaattcgagaattgaatctatccaatatgacaccattggaagccttaatcaagctgaatgaattacaaagtcaattaaagtag

SEQ ID NO: 2077 - DNA, 1758 bp, Staphylococcus epidermidis
aatcacaaatatcatggaaagtgggcggtcagcaagggcgaaggtattgaatctaccggtgaaatctttgctactgcgatgaatagaaaaggttattttttgtatggatatagacacttttctagtcgtataaaaggtggccatactaataataagataagagtttcaaaatcgcctgtgcatgcgattagtgatgatttggatatactcattgcttttgaccaggaaacgattgaattaaatcatcatgaaatgagagaagatagtattataattgcggatgctaaagcaaaaccccaaaagccagagaactgtgtggctcaattaattgagttaccattcactagcacggcaaaggaacttggaacagcattaatgaagaatatggtggcaattggtgcgacatctgcactgatggatttaaatacatcaacttttgaaactttaatcgataacatgttttcaaaaaaaggtaataaagtcgttgatatgaatatacaagcccttaatatgggttatgatttaatgaagcaacaagttaccaacgttaatggagactttacattagagaatggtagcggtcatcctcatttatatatgataggtaatgacgcaatcggattaggagcaatagcagctggatcaagatttatgtccgcttatccaattacgccagcttctgaaattatggaatacatgattgccaatctacctaaagttgatggtactgttgttcaaactgaagatgaaatagcagcagcaacgatggcgattggagctaactatgctggcgtacgaggctttacagcgagtgcgggtccaggtctttctttaatgatggaatctattggattgtctggtatgactgaaacgccattagtcattattaatactcaaagaggtggtccttctactggcttaccaacaaagcaagaacaatcagatttaatgcaaatgatttatggtacccatggtgatattccgaaaattgtcgttgctcctacagatgctgaagatgcgttttatcttactatggaagcatttaatttagctgaagaataccaatgtccagtcattctgttaagtgatttacaattatcattaggaaaacaaactgttaaaacactcgattataataaaatcgatattcgtcgtggagaaataatacagtcagatatcgagagagctgaagatgataaagcatactttaaaagatatgcattaacagctagtggcgtatcaccacgaccaataccaggtgttaaaggtggtatacatcatgtaacaggtgttgaacataatgaagaagggaagccaagtgaggcgcctatgaatcgtcagaatcagatggaaaaacgaatgcgcaaaactgaaagcttggttatcaataatcctgtgttactcaatgaacatgaagacgaagcagatatactgtatataggatttatatctactaaaggtgctattggagaaggtgcagaaagactagaacgacatggtgtaaaagtgaatacgatgcatattcgacaattacatcctttccctaaagatattgttcaacaagctattaataaagcttcgaaagtaatagttgcagaacataattatcaaggacaattatcaagtattttaaaaatgaacacacaagttaatgataaattagttaatcaaacaaaatacgatgggaaacctttcttaccttatgaaattgaagaaaaaggtttggaaattgctaaagagttaaaggagttggtgtaa

SEQ ID NO: 2078 - DNA, 1332 bp, Staphylococcus epidermidis
atgagtgattttaggaggggcaaaatgacgcaaaaagtaaacgttgtaggagctggtttagctggctctgaagctgcatatcaattagctcaacgtggaattaaagtgaatttaattgagatgcgtccagttaaacagacaccggcgcaccatacagataaatttgctgaattggtatgttcaaattcattgagaggtaatgcacttacaaatgctgttggtgttcttaaagaggaaatgagacatttagactcgttaattatcacatcagcagataaagcacgtgtgccagcgggtggtgctttagcagtggatagacatgattttgctggctatattacagataccttaagaaaccaccctaacatcactgtattaaatgaagaagttaatcatataccagaaggttatacgattattgcaactggccctctaactactgagcatttagctcaagaaattgttgatattactggtaaagatcaattgtatttttacgatgctgccgcaccaataatagaaaaagattcaattaatatggataaagtatatttgaaatcacgttatgataaaggtgaagcagcgtatcttaattgtcctatgactgaagaagagtttaaccggttttatgatgcagtattagaagctgaagttgcaccagtcaatgagtttgaaaaagaaaaatattttgaagggtgtatgccttttgaagtcatggctgaaagagggcgaaaaactttgttatttggtccgatgaaacctgttggacttgaagatcctaagactgggaaacgcccttatgcagttgttcaattaagacaagatgatgcagctggaacattatataatattgttggctttcaaacacatttaaaatggggtgcgcaaaaagaagtcattcgtttaattccaggattagaaaatgttgatattgtaagatatggtgtgatgcaccgaaatacctttattaattcacctgatgttttaaacgaaaaatatgaattaaaaggacatgataatttatattttgctggacaaatgactggcgttgaaggttatgttgaaagtgctgccagtggattagttgcaggtattaatcttgcgcataaaattttagacaaaggtgaagttattttccctagagagacaatgataggtagtatggcttactacatatcacatgccaaaaatgagaagaattttcaacctatgaatgccaattttggtcttttaccatctctcgaaaaacgtattaaagataaaaaagaaagatatgaaacacaagccaaaagagcgttagagtatttagataattacaaacaaacgctgtaa

SEQ ID NO: 2079 - DNA, 420 bp, Staphylococcus epidermidis
tacttaatccattattttgatttttatttaaatcaacctacctggttcctcaccaaattctctgcactaagattttccgttaccattctgttctcatatttatattttcaattgaaatatctatcaaaaattaaactattcttctatttaagtattcaacaaatgatgatacacctatatgggatggaatacttaccaacatatgtatatacctttgcttcaattattttacaattttccactcacatcattgacacaagggatttcctataccttatttcttttccatatatcactagcctgctatatctgggctcaaaaacaatgtgctacttacaatttcattatgtatgtgctaaactgtttgtgtcggatgacattaaaaagcatctcttcgtgttgaatattttggttggctga

SEQ ID NO: 2080 - DNA, 2397 bp, Staphylococcus epidermidis
gtattgccacaagcaaaaaaaagaacatcgacgaagagaaagggtaataaaaaaacgaataaaaaaaagcaaaatgaaacgcctttaagatatatattctcaataattgtagtaattcttattatactaggcgcttttcaattaggaatcattggtagaatgattgatagcttttttaattatctttttggtatgagtcgatatttaacttatattttagtacttattgcaacaatttttataacatactctaagcaaatacctagaactcgacgtagtatcggtgcaatagttttacaattagctttgttatttatagcgcaattgtattttcatttttcacataatatcacttctcaaagagagcctgtactgtcctttgtttataaagcttatgaacaaacacattttccaaattttgggggaggcttaataggtttttatttacttaaactatttatacctctcatatctattgtaggtgtaataataattactatcctattactagcttcgagtttcattttattacttaatttaagacatagagatgttacaaaaagtttattcgacaacctcaagtcatcaagtaatcatgcatctgagtcaataaaacaaaaaagagaacaaaataagattaaaaaagaagaaaaagcccaattaaaagaggcaaaaattgaacgaaaaaaacaaaaaaaatcacgtcagaataataatgtcattaaagatgttagtgattttccagagatttctcagtcagacgatattccaatatatggtcataatgagcaagaagataaaagaccaaatactgctaaccaacgtcaaaaacgtgttttggataatgaacaatttcaacaatcattaccaagtaccaaaaatcaatcaataaataataatcagccatctacaaccgctgaaaacaatcaacaacaaagtcaggctgaaggctcaatatctgaagctggtgaagaagccaatattgagtatacggtgccacctttatccttattaaaacagcctactaaacaaaaaactacttcaaaagctgaagtccaacgtaaaggtcaggttttagaatctacactaaaaaactttggagttaatgctaaagtaacacaaattaaaatcggtcctgcagttacgcaatatgaaattcaaccagcgcaaggtgttaaagtaagtaaaatagtcaatctccataatgacattgcattagctttggctgcgaaagatgtacgaatagaagcacctattccaggtcgctctgcggtaggaattgaggttcccaatgataaaatctcacttgtcactctaaaagaagttttagaagataagttcccatctaagtataaattagaagtcggcattggtagagatatttctggtgatccaatatcaattcaattaaatgaaatgcctcacttactcgttgctggttcaacaggaagcggtaaatcagtttgtattaatggtattataacgagtatattactcaacacaaaaccgcacgaagttaaacttatgttaatcgatcctaaaatggtagagttaaatgtttacaatggtattcctcatttacttataccggttgtaacaaacccacataaagcgtctcaagctttagaaaaaattgtttcagaaatggaacgtcgttatgatttgtttcaacattcatcgacacgaaatattgaaggatataaccaatatatacgcaaacagaatgaagaacttgatgaaaaacaacctgagttaccgtatatcgtcgtaatagtggatgaattggctgatttaatgatggttgcaggtaaagaagtagaaaatgctatccaacgtattactcaaatggctagagcagcgggtatacacttaattgtagctactcaaagaccttccgttgatgttattactggtattattaaaaataacattccatcaagaattgcgttcgctgtaagttctcaaactgactctagaacaataattggtgctggtggagctgaaaagctacttggtaaaggtgatatgctatatgttggtaacggagaatctactacaacccgaattcaaggtgcttttttaagtgatcaagaagtgcaagatgttgttaattatgttgtagagcaacagaaagcaaattatgttaaagaaatggaaccagatgcacctgtagataaatcagaaatgaagagtgaggatgctttatatgatgaagcttatttatttgtaatagaaaagcaaaaagctagtacttctttattacaacgacaatttagaatcggttataatcgagcttcaaggctcatggatgatttggaacgtaaccaagttattggtccacaaaaaggaagtaaacctagacaaatattagttgatttagaaaatgacgaggtgtaa

SEQ ID NO: 2081 - DNA, 873 bp, Staphylococcus epidermidis
ttgatacaacatacgatgttaaaactatattgggcaaatttcactacggcacaacttcatcatcttacaagtacatatcctgactttctatcagaaaacgtatttcatcaacatgacatgataaaaaggtggcttacagagcgtaattctgaaaggctatggaacaaatatgaacgtttcaaagaattaaagctgatggacattattaaagaaatgaaaaaagcaaatgttagttttacaacatactttgatgataactacccttctctttgcaaagaaatgtatgattatccttatgtgatattctacaaaggaaatccacagttctttaatcattctcactctttagctgtaattggctcacgtaatgccacacaatatacaagtcaatctttaaactatctttttccttcatttagacaattaaatatggcgattgtttctggattagcgcgcggtgcagatagtgtagcacatcaaaccgcacttaaatacctattaccaactattggcgtacttggatttggccattgttatcattatcctaaagcaaccttaaatttaagaactaaagttgaaaggaatggcttagtgataagtgaatatccaccattttctcctataagtaagcataaatttcctgaaagaaacaggcttataagtggtctgtccagaggggtacttataactgaggctgaagaaagaagtggtagtcaaatcactatcgattgtgctttagagcaaaatagaaatgtttatgttctacctggttcaatgttcaacaaaatgactaaaggtaatttaagaaggataaatgaaggtgctcaagttgttatagatgaaagtagtatattatatgattatctattttag

SEQ ID NO: 2082 - DNA, 810 bp, Staphylococcus epidermidis
gaggatgaacagagaatgagaatattgtttataggcgacatcgttggtaaagtgggcaggaaaatgattactacttatttacctaaaattaaacaaacttatcacccaacagtttctatagtaaacgctgaaaatgccgcacacggtaaaggattaacagaaaaaatttacaaacaacttttgagagaaggcgtggatttcatgactatgggtaatcatacatatggtcaaagagaaatttacgattttattgatgatgctcatcgaatggtgagacctgcaaattttcctgatgaagctccaggaacaggtatgagaataataaaaattaacgatattaaattggctattattaatttacaaggccgttcatttatgcaagacattgatgatccatttaaaaaggctgaccagctaatcgaagaagctcaaaaatctacaccatatatatttgtagattttcatgctgaaactacatctgaaaaaaatgctatgggttggtatttagatggtagagtgagcgctgttgttggtactcacacacatattcaaacttctgatgatcgtatattacctcatggcacaggatatatcacagatgtcgggatgacaggttattacgatggtattttaggtatcaatagagatgaagttattcaacgttttattactagtttgccacaaaggcatgttgttccagatgatgggcgaggcgtattatcaggagttatcatagatttagataaagaaggtaaaacgactcaaataaaaagactgttaataaatgaggaccatcctttccaaatttaa

SEQ ID NO: 2083 - DNA, 1596 bp, Staphylococcus epidermidis
tatacaaagcaaaccctagataaaggaggtgtttatgtgaatttattaagcctcctactcattttgctggggattattctaggcgttgttgtagggtatattgttgcccgaaatttattacaccaaaaacaagttcaagcaagacaaactgccgatgatattgttagctatgctaataaagaagcagacaatattaaaaaagaaaaattacttgaggcaaaagaagagaaccaaattttaaaagaacaagctgagaatgaactgcgtgaaagacgtggtgaacttcaaagacaagaaacccgacttcttcaaaaagaagaaaatttggatcggaaatctgatcttttagataaaaaagatgagattttggaacaaaaagaatcaaaacttgaagaaagacaacaacaagtagatgcaaaagagagtagtgttcaaacattaataatgaagcatgaactagaattagaacgcatctccggtctcactcaagaagaagctgtgaaagaacagcttcaaagagttgaagaagaactgtcacaagatattgcaatacttgttaaagaaaaagaaaaagaagcgaaagaaaaagttgataagacagctaaagaattacttgctacaactgtacaaagattagcagccgaacatacaactgaatcaactgtttcagtcgtaaatctgcctaacgatgaaatgaaaggtcgtatcataggtagagaaggtagaaatatacgcacattagaaacacttactggcatagatttaattattgatgacacaccagaagcagttattttatcaggttttgacccaattagacgtgaaattgctagaactgcactagttaatttggtttctgatggacgtattcatcctggacgtattgaagatatggtcgaaaaagctagaaaggaagtagacgatatcattagagatgctggagaacaagctacctttgaaataaatgtacacaatatgcatcctgatttagtgaaaattttgggtcgattaaattatcgaactagttatggtcagaatgtacttaaacattcaattgaagttgcccacctttcaggtatgcttgcagcagaattaggagaggatgttactttagctaaacgtgctggattattacatgatgttggtaaagccattgatcatgaagttgaaggtagtcacgtagaaataggtgttgaattagctaagaaatataatgaaaataacataattattaatgctattcactcacatcatggtgatgttgaaccaacctctatcatttctattttagttgcagcagctgatgcattatcagcagcgcgaccaggtgcacgtaaagagacacttgaaaattatattagaagacttgagagactcgaaacgttatctgaaagttatgatggggtagaaaaagcatttgctatacaagctggtagagagattcgtgtagtcgtctcacctgaagaaattgatgatttaaaatcatatagattggcaagagatattaagaaccaaattgaagaagagttacaatatcctggacatatcaaagtgacagttgttcgagagactagagcaatagaatatgctaaataa

SEQ ID NO: 2084 - DNA, 801 bp, Staphylococcus epidermidis
gaggaatttaaaatggcagtaatttctatgaaacaattacttgaagccggtgttcacttcggtcaccaaacacgccgttggaacccaaaaatgaaaaaatatatcttcactgaaagaaatggtatttatatcattgatttacaaaaaacagtgaaaaaagttgaagaagcatacaactttgtaaaacaaatctctgaagaaggcggaaaagtcttatttgtaggtacaaaaaaacaagcgcaagaatcagttaaagctgaggcagagcgtgctggtcaattctacgttaaccaaagatggttaggtgggattttaactaactacaaaacaatctcaaaacgaattaaacgtatttctgaaattgaaaaaatggaagaagacggattatttgaagtattacctaaaaaagaagttgttgaacttaaaaaagaatacgaccgtttaattaagttcttaggcggtattcgcgatatgaaatcaatgcctcaagcattattcgttgttgatcctcgtaaagagcgcaacgctattgctgaagctcgcaaactaaatattcctatcgtaggtattgttgacactaactgtgatcctgatgaaattgattacgttatcccagcaaacgatgatgctattcgtgccgttaaattattaactggtaaaatggcagacgctatcttagaaggtcaacaaggtgtatctaatgaagaagtagctgcagaacaaaacatcaatttagatgacaaagaagaatctgaacaagcagaaacaactgaagaaaacacttctgttgaatcaaactaa

SEQ ID NO: 2085 - DNA, 417 bp, Staphylococcus epidermidis
ttaatcattaaatctgatatttcacatttatttgtgagtaaagtaaaaataaagagaggtgagatgatgaataatataagagcagaacgtgtaggagaacaaatgaaacaggaaatcatggacattgttaataataaagttaaagaccctagagttggttttttaacaattactgatgttgaactaaccaatgacctttcacaagcaaaggtatatttaacagtgttagggaatgataaagaagttgataatacgtttaaagctttgcataaagcaactgggtttataaaatctgaacttggttctcgaatgcgcctaagaattatacctgagttaacattcgaatatgatgaatctatcgaatacggtaataagatagaacgcatgattcaagagttacacaaaaatgataaataa

SEQ ID NO: 2086 - DNA, 255 bp, Staphylococcus epidermidis
tatgaaactaataaaaatataggagttgtttattcattcatgtctattaatattgatcctgaaaaatttgctgaattagttgtaacttcaaatccagccaaatctgatgacgctgaagatatcgctaaagaaagtttaattttatacattaatgcttatcgtttagcagagaaatatgcaaatatcgctacaaattgctatgatacagctgaaattttaaaagaaataaatgaagttgatttacaattaaaataa

SEQ ID NO: 2087 - DNA, 258 bp, Staphylococcus epidermidis
gctaaaaataagacaacgagtaataccatcattgaggtacgtgttaacaacgatttatatttaataaatataaataacactatgattaaaatcaatgcaacaaacatccactttactgatctttccgacagtgcgataaatatgaaaccgtatatgaatactggtatagcaacaaaggtgtattctttaattgatatttcacttaaatgttgtatgaacaatgcaattaatacacttgttgataatgctaaaaagtaa

SEQ ID NO: 2088 - DNA, 987 bp, Staphylococcus epidermidis
aggagaaataatattatgaaagtgatagaagttacacatcccatacaaagtaatcaattcataactgaaaatgttgctatggcttttggtttcttcgatggtatgcatagaggtcacgacaaggtgtttcaagtgcttgatgaaaaagcaaaagagcatcaacttaaaaaggctgttatgacgtttgatccacacccctcagtcgtattaaaccctgagcgtaaacgtacaacctatcttacaccactttcagataagttagaaatgatagcagaacacggtatagactattgtatcgttatcaatttttcatcaagatttgctaatgtgacatctgacgatttcataaaaaattatattattaataatcatgttaaagaagtgattgcagggtttgatttcacctttggtaaatttggaaaaggaaatatgacggtacttcaggaatcaaaagcttttaatacgactattgtaggaaaacaagagatggattctgaaaaaatttctacaactgcaatacgccaagcgcttacagatggtcatttacagaaagcaaatgacgaattagggtatatatataggattaaaggaactgtagtacaaggtgaaaaacgtggaagaacaattggttttccaacagctaatgtgcaacccagtgatgattatgtactaccaaaaaaaggtgtttacgcagtgagtatggaaattggtccagagagtaaattacatcgtggtgtagctaacgttggagttaaaccaacattccacgatccaactagggctgagttagttattgaagtgaatatatttgattttaatgaaaatatttacggtgaacgtgtgactgtgtattggcatcactttttaagaccagaagttaaatttgatggtatcgatccattagttaaacaaatgaatgaagataaagcgcaggctaaacatttattatctattgatttcgatgatgatatatcatataatatataa

SEQ ID NO: 2089 - DNA, 546 bp, Staphylococcus epidermidis
tttatggataattctttacacgctacaacaatttatgctgtacgccataatggtgaagcagctatggctggtgatggtcaagtcacattaggtcaacaagttattatgaaacaaactgctagaaaagtaagacgtttatacgaaggaaaagtattggctggttttgcaggtagtgttgctgacgccttcacacttttcgaaaaatttgagacaaagcttcagcaatttagtggtaatttagagcgcgcagctgttgaactagcacaagaatggcgtggagataaacaattacgacaattagaggcgatgcttatcgtaatgaataaagatgccatacttattgttagtggtacaggtgaggttattgcacctgatgatgatttaattgccattgggtcaggtggtaactatgcacttagcgcaggtcgagcactaaaaagacatgcagcacaactttctgctagtgaaatggcatacgaaagtttaaaagttgcagctgatatttgtgtgtttacaaatgacaatataattgtagaaacgctataa

SEQ ID NO: 2090 - DNA, 930 bp, Staphylococcus epidermidis
aggtgtgacaacatgtataatggcatactaccggtatttaagaaacgaggtttaacaagtcacgacgtcgtttttaaattacgtaaaattttaaaaatgaaaaaaattggtcatacaggaacattagatcctgaagttaatggtgtgttaccaatttgtttaggcgatgcgacaaaagtcagtgattatatcatggaaatgggaaaaacttatcacgctatgataacgctaggaaagagtacgactactgaagaccaaactggagatattttagaaactagggctgttgataagaatgatattaatgaagatacgattgaccaagtgttgcagcaatttgaggggcatattcaacaaattccgcctatgtattcttctgttaaagtaaatggaagaaaattatatgaatatgcgagaaataatgaaactgtcgaacgccctaaacgacaagtttttattaaagatatacatagaatatctgaagttactttccaggagcagacatgtcattttgaagttgaagtaacatgtggtaaaggaacttatattagaactttagctacagatattggacttaaacttggttttccagctcatatgtcacgtctaactagaattgcttctggcggttttcaattagaaagtagtttaacgattgatcaaattaaagaattacatgagcatgattcattacataatgaattgtttcctatagaatatggcttaaaaggtctgaaatcattccaagtgaaagattcaaattttaaaaagaaaatctgtaacggtcaaaaatttcataaaaaagtgttaagtcaaaatgttaaagaaccttttatatttgtcgatagtagcactcaaaaagttttagcaatatatatagttcatccagataaaccttatgaaataaaacctaaaaaagtttttaattaa

SEQ ID NO: 2091 - DNA, 726 bp, Staphylococcus epidermidis
cgaggtgtaaaaatgtcggaaatgagtgcaatctatagagtaaaacaatacattttaaatttaatcaaagatggtgaactaaccaatggaagtaaattacctagtaatttgtcaattgcgagagcattaaatgttaaaacagatgatgtttatgatggtatagatgagttgattactgaacaagtagtaacggataattttgaagaggggactagcgtaaaagtaaagccccctttctattacccgttaaataaaattattagtatagggactatgattaaagaagcgggttatgaagcaggaacagaatatctgaatcttgacgagcaacctgcaactattttagatgctgaacatttaggtatagaaacaaaagaacctataacaattattgagagactaaggactgctaatcataagcctgtcgtatattgtttagacaaaatagcaaaaacttatctaacttgtacagattatcaacagagtagtggttcaatgttagaagctattaaagcatctacaaatcatcaaatcatgcatgcagaaatggatttagaagcaattagttacgaaccccatatctctgaagtgcttaatgcttcacctcacgaagggcttatgttacttaaagtagtacattatgacgaaaagcatcaaccaattttgtattctttaaattatattaagagtagtttagttaaattcactattactaaaagtgaataa

SEQ ID NO: 2092 - DNA, 870 bp, Staphylococcus epidermidis
ggaggaaaaaacgtgtcaagtaatgaattattattagctactgaatatttagaaaaggaaaagaaaattcctagagaagttttaattgatgcaattgaagcagctttaattactgcgtacaagaaaaactatgatagtgccagaaatgtaagagtagaattaaatatggacgaaggttcatttagagtgattgcacgtaaagaagtcgtagaagaagtgtttgatgacagagatgaagttgatttaagtactgctttagtcaaaaatcctgcctatgaagtaggagatatttatgaacaagatgtaacaccgaaagacttcggacgtgtaggagctcaagcagctaagcaagctgtgatgcaacgacttagagacgcagaaagagaaattttatatgatgaatttatcgataaagaagaagatattctaacaggtgtgattgaccgtgtagaccatcgctatgtatatgtgaatttaggaagaattgaagctgtgctgtcagaagctgaaagaagtcctaatgagaaatatattcctaatgaacgtatcaaggtgtacgtaaataaagttgaacagactacaaaaggtccacaaatttacgtatcaagaagtcatcctggattactaaaacgcttattcgaacaagaagttccagaaatttatgatggtactgttattgttaaatcagtagcgcgtgaagctggagatcgttctaaaattagcgtgtattctgataatcctgatatagatgctgttggcgcatgtgtaggttctaaaggagcacgagtagaagcggttgttgaagaacttggtggcgaaaaaatcgatatcgtccaatgggatgaagatcccgaaagtatttgttcgtaa

SEQ ID NO: 2093 - DNA, 2601 bp, Staphylococcus epidermidis
atgagaagaaaagcatgtttcattatattattaattacattatcattaattggtcatagttatattatttttcgcttccatcatgatggtgttctttcaactggcccaaatgatggtatggaacagatgattcctattcaaatgtatctttatcatcaatggactcaagggaacttattttattcaacacatttgggtcttggcggagattttttcactgacttaagttattatttttcaacaaatttaatatttattttaaatgtccctatcatcaaattatgtgaaatattcttttcattgaacacaaatcaaattcttctttggatgtacaacgcactaattgtttcaattattaaatcaactattgctctgttttgcacttatttatttagttattatatttctaaaaataaaataatcagtttattgatttcatttatctttgttatgtcacctttgtactttagatttacaatttactggccattctttagtgatactttcatttggttaccactcttattattagggattgaacgtttattaagggattttaaagcaggtttatttatactaactgtaagtctaattctaattaataacttttattttgcatattatttcctcattattggtataggttataccctgattagaattatttacagacatcctaaagatagtttaactcgttggcaagcttctcttacaattatatgtagtgctctgctcgctttaggaaatagtatgtttgtgttctttcatggtgttcaaagttttcttaataatcgtcgacaatcatttacaggacaagtgaattggattgaacatttaaataaagataccaatatatttttcgataattacttgattgttgtgatatttttatctattcaagctcttttgacaatcaaattatacaaacatttttattataaattatttgcattgttattattggcaacaattatttttgcatttctcccatttgttgaccaactatttaatgggttttcagcacctcaaaaacgatggcattttatcttagcttttaatagttcaattttaattgggttatttgtaaaatattttaaaacaattcgaccaaagacttatatttatactaatctgatagctcaaagtgtcatctacataagttcaattagctacaatacttttttaccttggctctctttagttccagtagtgtcagtgattggactattaattttattaataaaagagaaaaaagtacgttattatcttacttacctttatagtatttcaatcgctgctctcagtcttatgattactttcgtattcataaaaaatcaaattttctttcaagatcatatcaatcgtgcgaacaagcgatacattaattcaagtttctataactcggctatacaaagatcgttagtaaaagaaatgaaccaaactaagaatgacgatcaacgaataaattggcgtgtcgatgaacaagataatacccctatgtatcaaaattttaaaggacttagtatttactctagtatatttcatcacaacattctcgatttctattatgatgccttaaaaattaatttagctgaagaatctgtcagtcgataccagtctactaatgctcggcaaaatatcgagagtctgttttcagtaaaatatttaatgatgaaagattatcaaaattttattccatcttattttaagaaagttaagtcacgtggacaatatattatttataaaaatcaacttccactaccaagtgtaaaagtaacacaaaacatttataatcataaaagtttaaaaaaacctatagatagagagcatgcaatgattaatggtgctattgtgacatcaaaaggtacagcatatcactcaaaagttaaaaatttgttagaccaaacacgtgtatcaacacaaaatataacacgatattcaaacaatgaactaaccgttaataaagagagcggaataatcaaattacatttacctaagaatataagagacaaatacaaagatttttatctcactatgaatattaaacgaggcgatcctgacagtaattacactgtgagcatcaatcaatatcataatcatcgtctatacaatgattctatatatcgcacgggaataagcaaagtgctttatcgaagtttaccagacaaaaatggtgatattacgattcaactatcaccgaaaggtaagttcaatttggaactgttagaattaaacggtgaaaattatgatacgctaaaacaagcacaccatcatgctaactttaatatgcgttataaagatataaaaaacggggtaaaagttaacttagatcaccattctaaaggacttgcagtcattaatattccatatcgtaaaggtatgcgtgcatacgtggatgaccgacaaagcaatatcaaaaaggtgaattatatgatgacaggtgtcccagttaataaaaatgataaaacaattacgattcaatatcgaccaccttttctaaaaacgatgttttctatctcaatatttagtatagtggtgagtattgtattcattagattaaagaatataaggaaaagaaagatgaggattcgccatgattaa

SEQ ID NO: 2094 - DNA, 528 bp, Staphylococcus epidermidis
ctcaggcagaagagtgggcataaacccgctcttttctatttgccaaaaaaggaggcctgtatgagtaaaattactgagcaagttgaagcattgattcaaccagttttaaatgatttgaactttgaattagtagacattgagtatgttaaagaaggtaaagaccattttttaaggatttccattgataaagaaggtggcgtagatcttaatgattgtactatagcttcagaaaaaattagtgaagttatggatgaaaatgatccaatacctgaaatgtattatcttgatgttgcatcgccaggggcagaaagaccaataaaaaaagaaacagatttttataatgctatcaatcaacccatttttgtatctctttatgcaccaattgaaggagataaagaatggttaggtgttttaaaatctgtaaatgatgaatcaattaatatggaagttaaagaaaaggcaaaaacaaaagaaattgaaattccaagaaataaaatagcaaaagcacgtcacgctgtaatgatttaa

SEQ ID NO: 2095 - DNA, 288 bp, Staphylococcus epidermidis
ttaaggaggaaattgataatggcaatttcacaacaacgtaaagatgaattaattaaagaatatcgtgtgcacgaaactgatactggttcaccagaagtccaaatcgctgtattaactgcagaaattactgcattaaatgagcatttacgtgaacacaagaaagaccaccattcacgtcgtggtttattgaaaatggtaggtcgtcgtcgtcacttattaaactacttacgtagtaaagatattcaacgttaccgtgaattaattaaatcattaggtattcgtcgttaa

SEQ ID NO: 2096 - DNA, 1722 bp, Staphylococcus epidermidis
atagggaggaaaaagagaatgaaacaatctaaagtatttataccaacgatgagagaagtccctgcagaggcggaagcattaagccatcgtttattattaaaagcagggttaattaaacagagtacaagtggtatatatagttacttaccacttgctacacgtgtactaaataatatatctaaaatcatacgtgaagaaatggaaagtatagatgctgtagaaattcttatgccagctttacaacaagcagaattatgggaagagtcaggacgttggagtgcatatggtccagaactaatgcgtttaaaagacagaaacggacgtgaatttgcattaggacctactcatgaggaagtagtcacttctttagtaagagatgaattaaaatcatataaacagttaccccttactttatttcaaattcaatccaaatatagagatgagaaaagaccacgctttggattattaagaggacgcgaatttcttatgaaagatgcatattccttccattcagatgaagcttcattagatgcaacttatcaagatatgtatcaagcatatagtcgcatattcaaacgtgtaggcatcaatgcaagaccggttgtggcagattcaggtgcaatagggggaagtcatacacacgagtttatggcattgagtgaaattggggaagatacaatagtttatagtaatgagagtgactatgcagcgaatattgaaaaggctgaagttgtttatcatccttctcataagcattctgcacttgcggaattgactaaagttgagacgcccaatgttaaaacagctcaagaagttgcagaatatttaaagagaccattagatgaaattgtaaaaactatgatctttaaaatagatggcgaatttattatgtttctagttcgtggacatcatgaattaaatgaagtgaaattaaaatcatatttcggcacggaacatgttgaaatggctactccagatgaaattgttaatcttgtagatgccaatccggggtctcttggtcctatttttgataaagatattaaaatttatgccgataattacttacaagatttaaataactttgttgtaggagctaatgaagatcattatcactatataaatgtcaatattggtagagactttgatgtaacagaatacggtgactttagattcattacacaaggtgagatgttaagtgatggctcgggagtagcacaatttgctgaaggcattgaagtaggacaagttttcaaattagggacaaaatattctgaatcaatgaatgcaacttttctagataatcagggaaaagctcaaccactcattatgggctgttatggtattggagtatcaagaacattaagtgcaattgttgaacaaaacaatgacgagaatggaattatttggccaaaatcagtaacgcctttcgatatccatctaattactatcaatcctaaaaaggatgatcaacgtactttaggtgatcaactttatcaaaaattaatggattcatacgatgttttatatgatgaccgaaaagaacgtgctggtgttaaatttaatgattcagacctaattgggttaccggtacgagttgttgttggtaaaagagctgaagaaggtattgttgaggtaaaacaacgcattaacggtttaagtgaagaagtgcaaattgatgaattagagtattacttacaagaattatttaagaatattaagtaa

SEQ ID NO: 2097 - DNA, 981 bp, Staphylococcus epidermidis
acgatggggaaaataaaagaacttgagacgtctctagctaataaaatagctgcgggtgaagtggttgaaagaccaagttccgtagttaaagagctcttagaaaatgcaattgatgcacaagcgacagaaattaatattgaagttgaacagtctggagtttcatcaataagggttgtagataatggcactggtattgctcaggaagatttagggttagtatttcatagacacgcaacgagtaaaatagtcgcagatgatgatttgttccatattcgtactttaggttttaggggagaagctttagctagtatttcatcagtagcaaaggtgacattaaagacctgtactgataatgaaaatggacatgaaatatatgctgaagatggtaaaattattcatcaaaaacctgcaaaagctaaaaagggtacagatatacaagtggattcattattctacaatacacctgctcgattaaaatatataaaaagtttgtataccgaactgggtaaaattacggacattgtaaatagaatggcgatgagtcatcccgaaattagaatttctttagtttcagatggtaaaaaacttttaagtacgaatggctcaggaagaacaaatgaagtaatggctgaaatttatggaatgaaagtagcaaaggatttagtgcatatttcgggtgatactagtgattatcatcttgaagggtttgtagctaaacctgagcattctagaagtaataaacattacatttctattttcatcaatggtagatacatcaaaaactttgtactcaataaagcaattttagagggatatcacacattgcttacaataggaagatttcctatatgttacattaatatccaaatggatcctattttggttgatgtaaatgttcatccaacaaaattagaggtgagactttctaaagaagatcaactttatgatcttatcgtaaccaaaatcagagagggcttttaa

SEQ ID NO: 2098 - DNA, 786 bp, Staphylococcus epidermidis
agagtgaatgatagtatgtctctaacaattaaagaaatcaaagaaaaactatctcgaattgaaacgttggaagagttacataaacatgaagcaaataatgattcacgtaaaggtgttataaatgcgattaagtctagggaaaaaaatattcttaagcaacaagcattagaagagcactatttatccatgaatcaatacgaaaacaacattatgtcctctaacagggatgcattaatttgtggaattgatgaggtagggcgtgggcccttggctggaccagttgtggcttgtgcagttattttagagaagaatcatcattatattggtttagatgactctaaaaaagtgtctcccaaaaatagagcacgacttaatcaaaatttaaaagaaaatgtctatcaatatgcatatggcatagcgtcctcagttgaaatagatgaattgaacatttatcgggcaactcaattagctatgctacgtgctataaatcaattagatgttacaccgacgcatttattaatagacgcaatgacactagatattgatattccacaaacctcaattattaaaggtgatgctaaaagtgtgtctatcgcagcagcaagtatcatggctaaagaataccgtgatcaatatatgagacaactatctaaacagtttccagaatatggttttgataaaaatgcaggttatggaactaagcaacatttaaaggctattgatcaagtgggcataatcaatgaacatcgtcaatcatttgaaccaattaaatcaatgatgaaataa

SEQ ID NO: 2099 - DNA, 558 bp, Staphylococcus epidermidis
aaaatgagtgacataatcaaagatacaaagtctagaatgcaaaaatcaattgataacttatctcgtgaacttgctaacattagtgctggtagagcaaactctaatttacttaatggtgttacagttgactactatggtgcacctacaccagtgcaacaattagcaagtatcaatgtgcctgaagcacgtctattagttatttcaccatatgataagtcatcagttgctgatattgaaaaagcaattatcgcggctaatcttggggttaatccaacgagtgatggtgaggttattcgtatctctgtaccagctttaactgaagaaagacgtaaagaattagttaaagaagttaaaaaaattggtgaagatgctaaagtctcaattagaaatattcgtcgtgatattaacgatcagcttaaaaaagacgaaaaaaatggtgacattactgaagacgacttaagaagtcaaactgatgatgtacaaaaagctacagataattcgattaaagaaatagatcaattggttgccgacaaagaaaaagatattatgtcagtatag

SEQ ID NO: 2100 - DNA, 984 bp, Staphylococcus epidermidis
ccaaaatcagagagggcttttaaagacaaaatcctcatcccacaaaacgatttaaatcacgcgcccaaaaagaataaggttttagatacatttgaacaacaaaaaattaatttcgtgaagcaacaatcacaaattggagaaacatctgcaccatatgtacatgatcacaaagataagaatcatgacgtagagtcgcataagaataatttagattcaacttcatcgacaaataatgaaagtacggaagtttctaatgaattacacaattacattgatgatagttacttacaaagtcaaaaagaagtattttttgatatggaacaaaacacatctaacgaatatgagatatcaaatcagcaatcaaacgatattaaaggaacagtgagtcagacacctcatcgtagggtgccttatatggaaattgtaggtcaagtacacggtacgtatatcattgcacaaaatgaaaatggaatgtttatgattgaccaacatgctgctcaggaaagaattaaatatgaatattttagagaaaaaattggcgaagtgaccaatgaagtgcaaaacttattaataccacttactttccatttctctaaagatgaacaaatgattattgatcagtacaaagatgaattagataaagtaggagtacatcttgaacattttggtgggcatgattatattgtaaatagctatccagtatggtttccgaaagaagaagcggaagaaattattaaagatatgattgaacttgtcttaaaacacaaaagtgttgatgtgaagaaaataagagaagatgcagcaatcatgatgtcttgtaagaaatcaattaaggctaatcactatttaaaaaataatgaaatggcagatttaattgatcaactaagagaagcagaagatccttttacttgtcctcatggtagaccgattattatcaatttttcaaattatgaattagaaaagttatttaaaagagtaatgtag

SEQ ID NO: 2101 - DNA, 2073 bp, Staphylococcus epidermidis
actttggcagataatttagtcattgttgaatcgcctgcaaaagctaaaaccattgaaaaatatttaggcaaaagatataaagttattgcttcaatgggacatgttcgtgacttaccaagaagtcaaatgggtgtcgacactgaagataactatgaaccaaaatatattacaattcgtggcaaaggtcctgtagttaaagatttaaaaaaacatgcgaaaaaagcaaaaaaaatatttttagctagtgaccctgaccgtgaaggtgaagcgattgcttggcatttatcaaaaattttagaattagaagatagcaaagaaaatagagtagtatttaatgaaattacaaaagatgctgttaaagatagttttaagcatcctcgtggtattgaaatggatttagttgacgcgcaacaagcacgtcgtattttagatagactcgttggttataatatttctccagtattatggaagaaagttaaaaaagggctgtctgctgggagagttcagtcagttgctttacgtttagtcattgatcgtgaaaatgaaattcgtaattttaaacctgaagagtattggtccattgaaggtgaatttagatacaagaaatctaaatttacagctaaatttctacactataaaaataaaccttataagctaaacaacaaagacgatgttcaaaggattactgaagcattaaatggtgatcaatttgaaatcacaaatgtgaatcgtaaagaaaaaacacgttatcctgctcatccatttactacatcaaccttacaacaagaagctgcacgtaaactaaattttaaagcacgcaagacaatgatgttagcacaacaattatacgaaggtattgacttaaagcgtcaaggtacagtaggtttaattacgtatatgcgtaccgattctactcgtatctcaacttctgcaaaatcagaagcgcagcaatatataaatgataaatatggtgaacagtacgtgtctcagcgtaaatcatcgggtaaacagggcgatcaagatgctcacgaagctattagacctactagtacaatgcgaactcctgatgacatgaaagcttttcttactagagatcaacaccgtctatacaaattaatttgggaaagatttgtagcaagtcagatggctccagctattttggatacagtagctttagatgtaactcaaaacgacattaaatttagagctaatggtcaaactattaaatttaaaggttttatgacactatatgtagaagcaaaagatgataaagagaatgataaagaaaataagcttcctcaactagataaaggagataaggtaactgcgacaaagattgaaccggcacaacactttacacaacctcctcctcgttatactgaggcgcgtttagttaaaacgcttgaggaacttaaaattggaagaccttcaacatatgctccaaccattgatacgattcaaaagcggaactacgtcaagttagaaagtaaacgcttcatcccaactgaattaggagaaattgtttatgagcaagttaaagaatacttcccagaaattattgatgtagaattcactgtaaacatggaaacattacttgataaaattgccgaaggtgacatgaattggcgtaaagtaataggagacttctacaacagttttaaacaagatgttgaacgcgcagaatctgaaatggaaaagattgagattaaagacgagccagctggtgaagattgtgaagtctgtggttctccaatggttattaaaatgggaagatatggtaagtttatggcatgttcgaactttccagactgtcgtaacaccaaagcaattgtcaaaacgattggtgtcacatgtccgaagtgtaatgaaggagatgtcgtagaacgtaaatcaaagaaaaatagaattttctatggttgttctagatatccagaatgtgattttatttcttgggataaacctgttggaagagattgtcctaagtgtcatcattaccttgtgaacaagaaaaaaggtaaaagtagtcaagttgtgtgctccaactgtgattatgaagaagaagttcaaaaatag

SEQ ID NO: 2102 - DNA, 294 bp, Staphylococcus epidermidis
agcatgcaagatacattaatgagtattcaaattattccaaaaacaccgaacaacaacgatgttattccatatgttgatgaggcaattaaaattattgatgattcaggtttgcattttagagtgggaccgttagaaacaacagttcaaggtgaaatgagtgaatgtcttattttaattcaaaaattaaatgatagaatggttgaattagaatgtccaagtattattagtcaagttaagttttatcacgtacctgaaggaatagaaattgagacgcttacaggaaaatacgactaa

SEQ ID NO: 2103 - DNA, 285 bp, Staphylococcus epidermidis
gtgtggaaagaactttcccattacacacgcctaaaatcgaaaaaattgaagttaaacgtcgtggtaaagtacgtcgtgctaaattatattacttacgtagtttacgtggtaaagctgctagaattcaagaaattcgctaatcagtatattcgacaatttataaaaggccagtctataagcactatagttgccaatttcaacttattgcttaagatttgccataatgaaaaaagctttcaaacttctgttttaccagagtttgaaagcttttttattttatcttaa

SEQ ID NO: 2104 - DNA, 792 bp, Staphylococcus epidermidis
ctgaaaggagacaatcgtgtcttctttacttatatatttacatatttttacgatagagaggataagaaaatggcacaaacttctaaatataaacgtgtagtattaaaattgagtggcgaagctttagcaggtgataaaggattcggcataaatcctatcattatcaaaagcgttgcacagcaagttgctgaagttgccaaaatggattgtgaaattgctgtcattgtcggcggtggaaatatttggagaggcaaaactggtagcgacctaggtatggatcgtggtacggccgattacatggggatgcttgctactgttatgaatgctttggcattacaagacagtttagaacaattagattgtgatacacgtgttttaacttctattgaaatgaaacaagttgctgaaccatatattcgtcgacgtgcaattagacatttggagaaaaaacgtgttgttatatttgccgctggaattggtaatccttacttctcaactgacacaactgctgctttacgtgcggctgaagtagaagcagatgtaattttaatgggtaaaaataatgtagatggtgtttattcagctgatccaaaagttgatgcaaatgcaattaaatatgaacatttgacacatattcaaatgcttcaagaaggtttacaagtgatggattcaacagcttcatcgttctgcatggataataatattccgttaaatgttttctctattatggaagaaggtaatattaagcgtgctgtaatgggtgaaaaaatcggaacattaattacaaaataa

SEQ ID NO: 2105 - DNA, 1722 bp, Staphylococcus epidermidis
atagtgagtttatatatggacgggtcactatttataggaggtaacattttgagtttaataaagaaaaaaaataaagatattcgtattattccactcggtggagtaggcgaaatcgctaaaaatatgtacatcgttgaagtagacgatgaaatgtttatgttggatgcaggattaatgttcccagaagatgaaatgcttggggtagatatcgttattcctgacattcaatatgtcattgaaaacaaagaaagattaaaaggaatatttcttacacacggtcatgaacatgctataggcgcagtaagttatgtgttagaacaaatcgatgcaccagtttatggttctaaattgacaatcgcacttgttaaagaagcaatgaaggcccgaaatattaaaaagaaagtacgttactatactgtaaaccatgattcaattatgagatttaaaaatgttaacgtgagtttctttaatacgacacatagcattcctgatagcttaggcgtatgtattcatacttcgtatggttctatagtttatactggagagtttaagtttgatcaaagtttgcatggacattatgctccagacttgaaacgaatggcagaaattggtgatgagggtgtgttcgcattaatcagtgattcaacagaagctgaaaagcctggatataacacgcctgaaaatattattgaacatcacatgtatgatgcttttgccaaggttaaaggtagacttattgtatcatgctatgcttcaaacttcgttcgtattcaacaagtgcttaacattgcaagtcaacttaatcgtaaagtgtcatttttaggtcgttcacttgaaagttcgtttaacatagcacgtaaaatgggatactttgatataccaaaagatttattaatacctattaacgaagtggaaaattatcctaaaaatgaagtgattattattgctacaggtatgcaaggtgaaccagtagaagcattaagtcaaatggctcgcaaaaagcataaaattatgaacatagaagaaggagattcaatattcctagcaattactgcttcagctaatatggaggttattattgcagatacattaaatgagttagtgcgtgctggagcacatataattccaaacaacaagaaaattcatgcgtcaagtcatggttgtatggaagaattgaaaatgatgttaaatattatgaaacctgaatattttgtacctgttcaaggtgaatttaaaatgcagattgcacatgccaaattagcagcagaaaccggtgtagcacctgagaaaattttcttagttgaaaaaggcgacgtgattagttataacggtaaagatatgattttaaatgaaaaagttcaatcaggtaatatacttattgatgggattggcgttggtgacgtaggtaatatcgtattaagagacagacatctattagccgaagacggtatttttattgcggttgtgacattagatcctaaaaatcgacgtattgctgcaggacctgaaattcaatcaagaggcttcgtctatgttagagaaagtgaagaacttttgaaagaggctgaagaaaaagtacgtaaaattgtagaggaaggtcttcaagaaaaacgaatagaatggtcagaaatcaagcaaaatatgagagatcaaatcagtaagttactatttgagagtacaaaacgccgtccaatgattattccagtcatatcggagatctaa

SEQ ID NO: 2106 - DNA, 822 bp, Staphylococcus epidermidis
agatttaagtgcatttattttataaatatatatagaaggagaaaaattatgagcttattatctaaaacaagagaattaaacactttattacaaaaacataaaggtattgcagtagattttaaagatgttgctcaaacaattagtaatgttacagttactaatgtatttattgtgtcgagaagaggtaaaatcttagggtcttgtttgaatgaattattaaaaagtgaacgcattaaagatatgttagaagatcgacatataccgcgtgaatatactgaagagttgatgaatgttaaacaaacagaatcgaatatcgatattgataatgaattaactgtatttccgccagagaatagagaggtatttttaaatagtagaacaactattttcccaattttaggtggtggcgaaagacttggtacgctagtcttaggtcgagttcaagacgacttcaatgaaaatgacttagtattaggagaatatgcagccactgtaattggaatggaaattttacgagaaaaacataatgaagtcgaaaaagaagctagagataaagctgctataacaatggcaatcaactcactttcatattcagaaaaagaagcaattgaacatatatttgaagaacttggtggtacagaaggtttacttatagcttcaaaagtagctgacagagtgggcattacacgatcagtcattgtgaatgctttacgtaaacttgaaagtgctggtgtcatagaatcacgttctcttggaatgaaagggacatttattaaagtaaaaaaagataaattccttgatgaacttgaaaaaaataagtaa

SEQ ID NO: 2107 - DNA, 522 bp, Staphylococcus epidermidis
ataattattttagaggagttaagtacaatgaatattagaaagttgaccatcacagcattcttaatagctattaatgtcgtgttaagtagtttaattgtcattcctttaggtccaattaaagccgcacccgttcaacattttgtaaatgtattatgtgctgtatttgttggaccatggtatggtttagcgcaagcttttatttcttctgtactacgaatttcatttggaactggaagcgcatttgcttttccaggaagtatgataggtgtcttactttccagtctgttttatatgtataggaagcatatttttatggcttcagttggtgaagtattagggactggtgttattggtagtttaatgtgtatacctttagcatggtttttaggacttcaagatttctttattaaaccattaatgcttatgttcatagtatcaagttttattggggctttaattagttatatattgcttattattttgaaaagaagaggtttactagatagatttaacaaaaattaa

SEQ ID NO: 2108 - DNA, 315 bp, Staphylococcus epidermidis
ctcatggtccgtactgatttaactagtttccgttcaggagacactttacgtgtacacgtaagaatcgttgaaggttctcgcgaacgtatccaagttttcgaaggtgttgtaattaaacgccgtggtggaggaatttcagaaactttcacagttcgtaaaatttcttctggtgtaggtgtggaaagaactttcccattacacacgcctaaaatcgaaaaaattgaagttaaacgtcgtggtaaagtacgtcgtgctaaattatattacttacgtagtttacgtggtaaagctgctagaattcaagaaattcgctaa

SEQ ID NO: 2109 - DNA, 705 bp, Staphylococcus epidermidis
atgaaagcgctagtcataggtggttctggaacaataggtcgtgccattgtaaaacgactgctatttgaaggttatgaagttttcttacattatcattcagctcaatattctgatttaagtaatcaatttaaaaatagcaaagttacatttattcaatgtgatttaaccaaagatatagagctcgaagattactttggacacattgacgagctagattgtctaatttataccagtgggacagcattatatggcatgttacaagatatgagtgattgtgacatcgataatagttatgcattaaatgtaagacaatttatacgtttgactcgctactttattgatattttaaggcagagtaacaatggacgtatcattgttatttcatcaatttggggagaaactggagctagtttagagacaatctattcagcgatgaaaagtgctcaaattggttttgttaaagcattaagtcaagaattagctttaacttcagtaactgtaaatgctattacaccaggtatggtaaaagggaaaatgagcgatgtatggtcgaaagatgagttatcgaatatagtatcagagttacctcagcaaagaatgattgatccttctgaagtggcacatgcttgtgcatacttgtgtagtactatgtcaaaaagtattacgggtacagtacataaagtgaatggcggatggtatatttaa

SEQ ID NO: 2110 - DNA, 294 bp, Staphylococcus epidermidis
acaagtaagcgaagaagaatcaatcatgaaagagaagtattaaaacaacaagcattaaacgaaggtaaaccagagaaaatcgttgaaaaaatggttgaaggtcgtttacgtaaatatttacaagaaatttgtgctgtagatcaaaacttcgttaaaaatccagacgaaactgttgaagctttcttaaaagctaaaggtggtaaacttactgatttcgttcgttatgaagttggagaaggtatggaaaaacgtgaagaaaactttgctgaagaagttaaaggacaaatgaaataa

SEQ ID NO: 2111 - DNA, 1338 bp, Staphylococcus epidermidis
agctgttctagatacaatttatgtactaacgaaaggagaccaacactgatgaaaacacatcaatatgaacttatagatgagaaagttttcgaacatgagtttgataatggattgaaattatttatcattcctaagcctggttttcaaaaaacgtatgtgacctacacaacacagtttggttcattggacaatcattttaagcccataggtagtcagcaatttgtaaaagttcctgacggtgtggcacattttttagaacataaattgtttgaaaaagaagatgaagatttatttactgcatttgccgaagagaatgcgcaagctaatgcttttacaagctttgatcgtacgagttatttatttagcgcaacaagtaatattgaaagtaacattaaacgtctcctcaatatggtagaaacaccttattttactgaagaaacagttaataaagaaaaagggattatagctgaggaaattaaaatgtaccaggaacaaccaggatataaattaatgtttaatactttaagggctatgtattccaagcacccgatacgggtggatatcgctggtagtgttgaaagcatttatgaaataacaaaagatgatttatatctatgctatgagacattttatcatccctctaatatggtgttgtttgtggtaggcgatgttagtcctcaatcgataattaaacttgtagaaaagcatgaaaatcaaagaaataaaacttatcaaccacgtattgaacgtgcgcaaattgatgagcctagagagataaatcaacggtttgtttctgagaaaatgaagttacagtcaccacgattgatgctaggttttaaaaatgaaccattagatgaaagtgcaactaaatttgttcaaagagatttggaaatgacatttttctacgaattggtttttggagaggaaacggagttttatcaacaacttttaaataaagatttaatagatgaaacattcggttatcaatttgtattggaaccgagctacagtttttcaattattactagtgcaacacaacagcctgatctatttaaacaattaataatggatgaattaagaaaatataaaggaaaccttaaagatcaagaagcatttgatttgttgaaaaagcaatttattggagaattcatatcaagtttaaattctccagaatatattgctaatcaatatgcaaaactctatttcgagggagtgagtgtatttgatatgcttgatatcgtagaaaatattacgttagagagtgtaaatgaaacttccgaattattcttgaactttgaccaacttgttgatagtcgtttggagatggaaaatagatga

SEQ ID NO: 2112 - DNA, 318 bp, Staphylococcus epidermidis
ctcaccgacagttatgccttcttgataagtgattttagagggcatttcttttgtttctgctacctcattttgaggtttattatttttattattctttttatttttattgtttttttgattcttattagttttattgtttttattttgctgttttcctttgttgttttgttcttttttcttcgttggtttactattattcttactttgttgtttttctttatcgttagaattttgtttattattagatttttggtgattattttgagtattttgtttattagtgtctttcgcttgagaggctttaaattttttatctaa

SEQ ID NO: 2113 - DNA, 1275 bp, Staphylococcus epidermidis
attttgaagagattcaatcaagataacacaaaagttcgagtcaatgttttgcctaccgataaatttaaaacaacgacaattacatttaaatttatggcaccattaaactataaaacaattacttcacgttcaattttaagtaaagtattagttcgtgcaacacaacaatggcccaccgataaaactttaaataaacagttatcagaattgtatggcgcctatgttaatagttttgtttctaagtttaaagataagcatgttattacaatctcattagaagtagttaatgaaaaattcttaaaagataaaacccctttatttgaaaagggattagatacgttaaaagaaataatttggaatccattaatcaaagatagatgctttgatcatacatatgtagctcaagaaaagtctttacttagcaaaaaacttgaagcaatggaagataataaagcacagtattcatttcttcagttaatgaattatatgtttaaacaagaaccctatcgatatatagcgacaggtcaattagaacaaattccacaagtgacttctgaaagtctatacgatacatatctatccatggtacaaaatgatgattgtgccatatatgttgtaggaaatattaacaaagaggaagtaacgcaactaattctagataagtttgcaattaagcctttctatttagaaaataaagaaagtactgaaatcacaccttcttttgatcaaccgcaatatataattgaaaaagacgatgttgaccaagctaaattgaatttgggatatcgctttccatcttattatgggaaaagtaattactatgcatttatagtattaaatatgatgtttggaggagatccttcctcagtactatttaatgaagtcagagaaaagcaaagtttggcatactctatacattcacaaattgatggtaaaaacggatttttatttgttttaagtggtgtttctgctgagaaatatgagcaagcaaaagatactgtcatcaaagagtttgataagataaaaaatggagattttgattctaataaaattgaattagctaaaaaaatcattatttcccatagacacgaagcatcagatagacctaaaagtataattgaaatactacataatcaattattattaaaccgacagcaaactgatcaagattttataaatgcagttaatcaagtgacgaaaaaagatgttattaaattggcaaatgaagctgttctagatacaatttatgtactaacgaaaggagaccaacactga

SEQ ID NO: 2114 - DNA, 1167 bp, Staphylococcus epidermidis
atatcagggagtatatcattgatgaatatttcaattgtagctgttggctctgaattattactaggtcaaatagctaatacaaatgggcaatatctttcaaaactttttaatagtattggtaaaagtgtagtagaacacacagttattggtgataaccctcaaaggttagaatatgtaataaagcaatgtctatctagatttgataccattgttttaacaggtggcttaggaccaacaaaagatgatttaactaaacatactgtagctaaagtattaggaaaaaatctagtgacggatgaagcatcgttaaactttatcaaaaactattttaaagaacaaggtcaagatatgacctctaataataagcaacaagcattagtaattgaagatgccatagttttaccaaataaaaatggtatggctcctggtatgcttgtagaattaggtaaacaaaaaataattctactaccaggtccaccgaaagagatgcaacctatggcgaagaatgaattattaccttatcttatggataaagatgaagttattttttctgaattacttagatttgctggtataggagagtcgaaattagaaacactattaattgatctaatagatgatcaaactaatccgacaatcgcacctcttgcaggtacgcatgaagtatattttagattaacagccaatgctgaaagtaaggaacgatgtcaactgcttattaagcctattcgagatgaaattttaaatagggttggtacttattattttggctcagacgaagttaatattgaagaatcggttataaatagtgcaaaacagaattttgctatttatgacggtgtaactaatggagctttgtttactcgattaaaaaatgctgacagtaaaaatctagttaaaggtatgctaccacattctaatcaatttattgatgtgacttctgagtttaatgccgtgttattcaatgcagcacaatatgtcagggatttgtaccaaacagatttgggtattgtacttttaaataaagataacattgtatatttaggaatttatgatggaaataatttcgatatcgaaacatttaagatgtctcaaagtcgtaatttattgagaagcagaagtcaaaattatgcaatgattagattattaaattggtttaataaatag

SEQ ID NO: 2115 - DNA, 930 bp, Staphylococcus epidermidis
ggaaaggatgggagcactaagatgagtgtatttattgataaaaatacgaaagtaatggtacaaggtatcacagggtctactgcccttttccatacaaaacaaatgcttgattatgggacacaaattgttgcaggggtaacacctggtaaaggtggacaagttgtagaaggtgttccagtatataacactgttgaagaagctaaaaatgaaacaggagctaatgtatctgttgtatacgtaccagcaccattcgctgctgattcaattattgaagcagctgatgccgatttagacatggttatttgtattactgaacatatacctgttgttgatatggttaaagtaaaaagatatttacaaggtcgtaaaacacgtttagtaggaccaaactgtcctggtgtgataactgccgacgagtgtaaaatcggtattatgccgggatatatccataaaaaaggccatgtcggtgtcgtgtctcgttctggtacattaacgtatgaggcagtgcatcaattaactgaagaaggtatcggtcaaacaactgctgtaggtatcggcggtgatccagtaaatgggactaactttattgatgttttaaaggcgttcaatgaagattctgaaactaaagccgttgtaatgattggagaaattggtggtaccgcagaagaagaagcggcacaatggattaaagaaaatatgaacaaacctgtagtaggttttatcggcggtcagacagcacctccaggtaaacgtatgggtcatgctggagctattatttcaggaggtaagggtacagcatctgaaaagattaaaacattaaacgattgtggtgttgaaactgcagatacaccttctgaaataggaacaacccttattgatgcagctaaaaaagcaggcatttatgaagagttattaactattaaaaaataa

SEQ ID NO: 2116 - DNA, 1425 bp, Staphylococcus epidermidis
caatatggaggaatgttaaatatggatacaaatggaattaaattaaccccaaaagacatcgtatctaaattgaatgagtatattgtaggacaaaatgacgcaaaacgtaaggtggctattgcactaagaaatcgttatcgtagaagtcttttaaaagaagaagagaaacaagagattgcgcctaaaaatattttaatgataggtccaacgggagttggtaaaactgaaatagctcgacgcatggcaaaaattgttggagcaccatttattaaagttgaggcaactaaatttacagaagtcggttacgtcggaagagacgttgaaagcatggttagagatttagttgatgttgctgtacgtttagtaaaagacgggaaaaagtcattagttaaagatgaggcaactaagaaagcaaacgacaaattagttaaattacttgttccgagtttaaaaaagaaggcagcacaaggtaacaaccctttggaaaatttattcggtggagcaattccaaacttcggtcaaaatcaagatgaagaggaagaaccgccaactgaagaaattaaaaccaaacgttctgaaataaaaaaacaacttgaacagggcaaacttgaaaatgaaaaagtaagaattaaagtagaacaagatcctgcatcaatgggtatgttagggactaatcaaaatcaacaaattcaagatatgatgaatcaattgatgcccaagaaaaaagtcgaaagagaagtttcggttgaaacagctagaaaaatcttagctgatgattttgcagatgaattaattgaccaagaaactgcgaatcaacaagccttagagcttgcagaacaaatgggtatcatatttattgatgaaatagacaaggttgctactaacaatcaaaatagcggtcaagatgtgtcaagacaaggcgtacaacgagatattcttcctatacttgaaggtagcatgattcagacaaaatatggtactgtaaatactgaacatatgctatttataggtgctggtgcattccacgtatcaaaaccaagtgatttaattcctgaattacaaggtcgatttccaattagagttgaattagaaagtctttcagtagaagatttcgtgagaattctgacagaaccaaaattatcgcttgtcaaacaatatgaagcattgcttcaaactgaagaagttacagtaaatttctcagaagatgccattcaacgattagctgaaattgcatatcaagttaatcaagatactgataatattggtgctcgtagattacacactattctagaaaaaatgcttgaagatttatcatttgaagcaccaagcatgccgaatgctgttgtggatattactccacaatatgtagatgacaaattaaaatcaatctcaacaaataaagatttaagtgcatttattttataa

SEQ ID NO: 2117 - DNA, 1185 bp, Staphylococcus epidermidis
gaaacaggaggatggaagatgaatatccacgagtatcaagggaaagaaatatttcgttcaatgggcgttgcagttccagagggacgagtagcatttactgctgaagaagcagtggaaaaagcgaaagaattaaattcagacgtatatgtggttaaagcgcaaattcacgctgggggtagaggtaaagcaggcggcgtgaaaattgctaaatcattatctgaagtcgaaacgtacgcaaatgaactgctaggtaaacaattggtcacacatcaaactgggccagagggcaaagaggtcaaacgtttatatatcgaagaaggatgcgatatccaaaaagaatattatgttggttttgttattgatcgtgctactgataaagtgactttgatggcatcagaagaaggtggaactgaaattgaagaggttgcagctcaaacacctgaaaagattttcaaagaaacaattgatccagtagtaggattatcaccttaccaagcgcgacgtatcgcttttaatattaacattccaaaagaatcagttggaaaagcaactaaatttttattagcactatataatgtctttatcgaaaaagattgttctattgttgaaattaacccacttgttacaactggagacggtcaggtattggctttagatgctaaattaaactttgatgataatgcattatttaaacataaagatattttagaattacgagatttagaagaagaagatcctaaggaaatagaagcttctaaatatgatttatcatacatcgctttagatggagatattggttgtatggttaatggcgcaggtttagccatggcaacaatggatacaattaatcattttggtggaaatccagccaacttcttagatgtaggtggcggtgctacaaaagaaaaggtaactgaagcatttaaaattattttaggtgatgacaatgttaaaggtatctttgtaaatatttttggtggaattatgaaatgtgatgttattgccgaaggtattgtagcagcggttaaagaagttgaactaacattaccattagttgttcgtttagaaggaactaatgtcgaacgtggtaaagcaatattaaacgaatcaggtttagctattgagccagcagcaactatggctgaaggtgctcaaaaaattgtgaaacttgttaaagaagcataa

SEQ ID NO: 2118 - DNA, 4089 bp, Staphylococcus epidermidis
caattgatttttcaattaaagataccaacaatcaagatgagtttcgctttaaaatatttcggacattgtattgatcaaacacgattgtcgccaaaagtgaaaggtcaattgaaacaaaaaaaactcattatgagtggaaatgtgttaaaagtcttagtttcaaatgacattgagagaaatcattttgatagggcatgtaatggtagcttggttaaagcatttagacagtgtggctttgaaattgataaagtcgtttttgaaacagattcaacaaatcacgatgatgaccttggctcgttagaagcacatattccacaagaagatgaacaaagtgcaagagaagcaactgaaaaattagaaaaaatgaaagcagaaaaagcgaaacaacaagataataatgaaagtacagtggaaaaatgtcagattggaaaaccaattcagattgaaaatataaaaccaattgaatcaattattgaagaagaattcaaagtagctattgaaggtgttatatttgatattaacctaaaagaacttaaaagtggacgtcatatagttgagcttaaagttactgattacacagattcacttgtattaaaaatgtttacaagaaaaaataaagatgacttggaccactttaaggcacttagtgttggtaaatgggttagagctcaaggtcgtattgaagaagatacttttgttagggatcttgtcatgatgatgtcagatattgaagaaattaaaaagacacctaaacaagataaagcagaagataagcgtgtagagtttcatttacatacgtctatgagtcaaatggatggtattcctaatattagtgcatatgttgaacaagctgctaaatgggggcaccaagctttagcagtaacagatcacaacgtagtacaagcttttcctgatgcacataatgctgccgaaaaacatggtattaagatgatttatggtatggaaggtatgctagtagacgatggtgttcctatagcttataaaccaacagaccgtaatttaaaagatgcaacatatgtggtgtttgacgtagagacaacaggtctttctaatcaatatgataaaattattgaattagctgcagtaaaagtgcataacggtgaaattatagataagtttgaacgttttagtaatccacacgaaagattatctgaaaccattatcaatcttacacatatcactgatgatatgttaactgatgctcccgaaattgaagaagtgttaactgaatttaaagagtgggttggagatgctatatttgtagctcataatgcttcatttgatatgggatttattgacacaggatatgaaaggttaggctttggaccttctacaaacggtgtaattgatacacttgagctttcacgtacaattaataccgaatatgggaaacatggtttgaatttccttgccaaaaaatatggtgtcgaattaacgcaacatcatagagcgatttatgatacagaagcaacagcttatatttttataaaaatggttcaacaaatgaaagaactaggtgtgaacaaccatctagaaattaataaaaaattaactaatgaagatgcatataaaagagctcgtccatctcacgttacactcattgttcaaaatcaagaaggtcttaaaaatttatttaaaatagttagtgcttcattagttaagtattattaccgtacgccaagaattccacgttctcttttaaatgaatatcgagaagggatcttgattggtacagcttgtgatgagggtgaattattcacagcagtaatgcagaaggatcagtcggaagtagaaaaaatagcaaagttctatgattttatagaagttcaaccgcctgcgctttatcaagatttaatggatagagaattaatacgagataatgaaacgttaacacaaatttacaagcgattaatagatgctggtaaaagcgctaatatcccagtgattgctactggtaacgcgcattatctatatgaacatgatgctatagccagaaaaattttaattgcatcccaaccagggaatccattaaatcgttcaacattaccagaagctcactttagaaccactgatgaaatgttagatgattttcacttcttaggtgaagaaaaagcatatgaaatcgttgtaacaaatacaaatgagctcgctaataaaattgaaaaagtggttcctataaaagataaactatttacgccaagaatggatggggctaatgaagaaattcgtgagttgagttattctaatgcgaaaaaactatatggtgaagatttaccacaaattgttatagatcgccttgaaaaggaattagatagtattattggtaatggcttttctgttatttacctcatatctcaacgtttggtgaagaaatcgctagatgatggttatttagttggatcgcgtggttcagttggttctagtttcgtagcaacaatgactgaaattacagaagttaatccgcttccaccacactacatttgttcacattgtaagacaagtgagttctttgatgatggttcggttggatctggattcgatttaccagataaaaaatgtcctacttgtggtaatgaattaattaaagaaggacaagatatcccttttgagacattccttggatttaaaggagataaagttccagatattgatttgaactttagtggtgaatatcaacctaacgctcataattacacaaaagtattgtttggtgaagataaagtatttcgtgctggaacaataggtactgttgctgaaaaaacagcttttggtttcgtaaaaggttacttaaatgatcaaggtattcacaaacgtggtgctgaaattgatcggttggttaaaggttgtacaggggtcaaacgtacaactggtcaacatcctggaggaatcattgttgtaccggattacatggatatttatgattttacaccgattcaattcccagcagacgaccaaagtgcagcgtggatgacaacccatttcgacttccattcaatacacgataatgtcttaaaattagatatattaggacatgatgacccaacgatgattcgtatgttacaagacttatcaggaattgaccccaaaactataccagtagatgataaagaaacaatgcaaatatttagtggtcctgagagtttaggtgttacagaagacgaaatattatgtaagacaggtacatttggtgtaccagaatttggtactggatttgtacgtcaaatgcttgaagatactaagccaacgacattctcagaattagttcaaatttcaggtttatctcatggtacggacgtttggttaggtaatgcacaagagttaattcgtcaagggatatgtgacttatctagtgtgataggctgtcgtgatgatatcatggtatatctgatgtatgctggacttgaaccgtcaatggcttttaaaacgatggaatttgtacgtaaaggtcgtggcttaacagatgaaatggttgaagcgatgaaggaaaataacgtgccagattggtatttagattcttgtcgtaaaattaaatatatgttccctaaagctcatgccgctgcttatgtactgatggctgtaagaattgcatactttaaagtacatcatccactatattattatgcagcatactttaccataagagcttccgattttgaccttataacaatgattaaagataaaacgagtattcgtaatacagttaaagatatgtattcacgatatatggatttagggaaaaaagagaaagatgtattaactgtattagaaataatgaatgaaatggcgcatcgaggttttcgattgcaaccgattagtttagaaaaaagccaagcttttgacttcatcattgaaggggatacattgattcctccattcatttcagtgccaggacttggagaaaacgttgcacaaagaattgttgaagcgagagaagagggaccatttttatccaaagaagatttaaataaaaaagccggcttatctcaaaaggttattgactatttagatgaattaggctcattgccagatttacctgacaaggcacaattgtcgatatttgatatgtaa

SEQ ID NO: 2119 - DNA, 591 bp, Staphylococcus epidermidis
ggatttaatatgaatataccgaatcaaataacggtatttagagttattttaataccattttttattttatttgctttagttgattttggttttggacaaatttcaattttaggtggaaatcatattagaattgaaatattaattagtgctatcatatttgtggttgcatcattaagtgattttgctgatggttatcttgcccgtaaatggcaattagttactaatatggggaaattcttagatccacttgcagacaaattattggtcgcgagtgcattaattgttatggtacaacttggttttactaattctgtcgttgctatcataattattgctcgagaatttgccgtcacaggattacgattactacaaattgaacaggggtttgtaagtgctgcaggacaactagggaaaataaaaacagcagtgacaatggttgcaattatatggattttattgggcgatcctttcttacactatctacatttcccaattggagtgtggttattatacattggagtattctttactattctttcaggtattgaatatttttataaaggaagagatgtatttaaacattctaaataa

SEQ ID NO: 2120 - DNA, 375 bp, Staphylococcus epidermidis
cacaataatatgtatagtgaaaaagaaatcatacgaaaagtcgaaagtttagcagagaaaattggaaaactagaagttgttcaagattatcataatgtagaaaaacaaattcataataatcaagcaataaaacaaaagatgaatcgtttgaaagcgcaacaaaaacaatcggttaattttcaaaattatggaaaacaaaatgcactcgagcaatctgaagttaaaattcagaatctaaaagatgaaattaatgaattacctattgttgaagaatttcgttcagcacaatatgaagcgaatgatttactacaaatgatggtcaaaacaatggaagatagactcaatgaatataataaaaaagaacacaatgaataa

SEQ ID NO: 2121 - DNA, 315 bp, Staphylococcus epidermidis
cacagaatcataggttggagtgataaattaatgagaaagaaaaaaattccaatgagaaaatgtattatatctaatgaaatgcgtccaaaaaaagatatgattcgagtggttattaacaaagaaggcgaaatctttgcagatgcgacaggaaaaaaacaagggcgcggtgcatatgtgtctaaagatgtagctttagttgaaaaggctcaacaaagagaagttttagaaaaatattttaacgctactaaagatacacttgatcctgtttataaagaaataataagactgatttatagagaagagatcccaaaataa

SEQ ID NO: 2122 - DNA, 2613 bp, Staphylococcus epidermidis
ggattcgccatgattaaaaatatatggaataaacctattaaacgttttacactaatcgttttagttagttgtatattgtcatttattctatatggcccttttctctatcaatttataactaaaggtatagtatttagtggtagtggagatggcttcagacaaatgatgccttttcaaatgtacctttatgaacacttcacatcattaaaaggattttatgatgcttcatttggattgggaggcgactatgttaaatcactggcatattattattcactatctccattgatgtggatcaacttctccatgatatggatattagaacaaactatcaatgtgaatcctcatgacatcagcttttggccaataaaccaattaatcatggcatatgtgcgcactgtaatcacatttattttttcattttatttatttagttatttgcgacttaaacccgcaccaatgtttatcgcaactattttatatggtatgtctactgttgttacatattataattttacttggtctttttacggtaatcttttaattatgttacctatgtcactttgggctatagaaagattctttaaagaacgtaaaataggttggtttattttcgcgattgcttatacattattctcaaacttttattttagttactatgaagcaattgtcataggtttctattttatttatcgattcgctattcctcatgagaaagatattgtgaatcgttggcagaaattatacatactcgtatgtgccactttgttaagtgtattagtaagtatttatggactatatactggtatatcttcctttttagataatgaccgagcgcaaaatcctaatttcaaaattacttttttcacaaatttatttgaaaccaattataatatttttgctgatggtttttacattacaatttcttttattgctatcattgcattattttgttttaaattatatcaacactattattataaattgttcgcaattgcaacttggattttacttatcggttccttttctcaatggtttgacagtgcatttaatggtttttcattaccccaaagacgttgggtttactttttagcattatcaacaagtgtattaattgcattgttcatacaacatttaagtgaaatatcaattaaagaatacacctttgttgctataccagtattcatatacggtttcatatttatcgcactgtcggaaagatcagtaaagtggatgtttgttgcattgattttaatcatagtgttatttatatttattaaatataaatcgttgttaacacgtacctcaatgatggtattactcgttgtcttatttttagctcaacaagtcttaatgactaatgattccagaaaaattactatcgaaccttatcaaacgactatcaaaacaattaatgattcgagctatagaagccctgtcctaaataaaaaaattaagtatatgcatcaaagctctacagatccattgaaaagattagattatttttcatactatgcattaaactcacctttgatatatcactacaacggcacatcattgtattccagtattttcgatggagatatattgaaatactatgaccagacgttacaaattaatatgcctgtagataaaaatagtacttatcgatatttaaataatcgtgcaaacttaatgtctctttgggatgttcaagatcgattacgacatcctgatgatttaaatatgccttatggttttaaaaagaaagaacttataactgataaaaaagatcaatggattcactctgttaatacaataaattatcctagtgcacacattactaataaaatttatgatgcaagaaaactaaaatctccccttgatagagagcaagctatgcttaaaggtgtcgtattgaatcataaatcccaagccaatactgattttaaacctaatcctaatttactttctaatgcaaaacaaaacttaaatcatgcgaattggattgatagtaaacatttaaaagttaaacagcacaatggtggcgtcaccctcaatttacttcgcaatatagttaaaaattataaagatatgtatattgaaatggatgttgaattactgtctcttgacaaagagcataaagtaggggttaatgaatattcgcaagaaagaaaccgtttgtcatacaaataccgtcgttttgtttcgccagtgacgatgcgtgctaaagcttcaaatcaacttaacattaagatgtcaaaaggagtttatcgttttaaagtaaaaggaatttatggtgaaaactatcaaacattaaaaaaagcttctcaacagctccaaccagttaaagtaaaaaaagaaagaaatggtttcacaattattaaaaagaaaaaagaacatggttatcttgtcttgccaatggtatatgctaaaggaatgcatgcaatggcaaatggaaagcctctaaaggttcaacaaggaaacggtattatgactactattcctgtaaaagagggacaaacaaagataaaattaagttatacccctccttatttttatttattaatcactgtcagttgcattgggatcattttaagcattcttttcactcattacgtaaaaagaaaataa

SEQ ID NO: 2123 - DNA, 1290 bp, Staphylococcus epidermidis
aacatgagcattttaattacgattatttcatttatcatcgtatttggtgtactcgtaactgttcacgaatatggacacatgttttttgctaagcgagcaggaattatgtgtcctgaatttgcgattggtatgggtcctaaaatttttagttttcgtaaagatgaaacattatatacaattcgtctattaccggtgggtggttatgtcaggatggctggtgatggtcttgaagaaccaccagttcaaccaggtatgaacgtaaaaataaagttaaataaccaagacgaaatcacacatataattctagatgaccaacataaattccaacaaattgaagccatagaagttaagaaatgtgattttaaagatgacctatatattgaaggtatcacttcttatgatgatgaaaggcatcacttcactatagcgaaaaaggcattttttgtcgaaaatggaagccttgttcaaattgctccaagagatagacagtttacacataagaaaccattgccaaagtttttaacattatttgcaggtccgttatttaattttattttagctttagttctatttattggattagcatactaccaaggtacgccaaccaatgtcataggagaagttgtgaagaaatctccagctgatgaagctggattgcacaaaggtgataaaatagttcaggtaggtaatcataaaattaaaaattttgatgatatcaaacatgttcttgaccaaaataaaacggcgaaaacaactgtaaaaattaaaagggatggccaaaacaagtctgtagatctccaacctaaaaaagtagagagaaagataactaaaactaaaactcaaacaacttatcaaattggttttgcccctactacagaacacagcgtttttaaaccaataagctacggtatttataactttttcgataaaggtaagcttatttttacagctgttgttggtatgttagctagtatatttacaggagaattttcatttgatatgttaaatggccctgttggtatttatcacagtgttgattctgttgttaaatctggaattattaatttagtaggatacaccgctttattaagtgttaacttaggaataatgaatttgctacctattccagcgcttgatggtggtcgcatattatttgtactatatgaggctatttttagaaaaccagtgaataaaaaagcggaaacaggaattattgctgtaggcgcactttttgtggttattattatgattttagtcacttggaatgatatacaacggtatttcttataa

SEQ ID NO: 2124 - DNA, 393 bp, Staphylococcus epidermidis
gtgaaaacgattggtgaagtgttgaaaagtagacgtgaaagattgggtatgacactaagtgaattagaacaaagaactcagttaaagcgtcaaacgttaatacatatagaaaataatgattttaatgaactagccaagagtgattatactgaaggttttattagaaaatacgctaaagttgtaaatatcgaaccaaatcaacttattgaagcacatcaagatgagattcctgaaacacaatatcaaattgatgatgtgatacaaacattttctaatgggtatgaacccccttaccgacgtcaatctaaggaagcgtttcaattgttgatgtggatgggtttcattattttaatatctttaatcgtttggatactcgcagtattaattatataa

SEQ ID NO: 2125 - DNA, 801 bp, Staphylococcus epidermidis
acagagacgatcaggctcggaggaaagaccatgtttaaaaagctgaaaaataaaaataaaactgagacaaaccataataatgacttagacatacataatatacctgaacatgtggctattatcatggatggaaatgggcgttgggcaaaaaaacgtaaaatgcctagaattaaaggccattatgaaggtatgcaaacaatcaaaaaaattactcgcgaagcgagtgatataggtattaagtatttaacattatacgcattttcaacagagaattggtctagacctgaaagtgaagttaattacattatgaatcttccagtgaatttccttaaaacatttctaccagaattaattgaaaagaatgttaaaattgaaacaatagggttttatgaaggtttaccacaatctacaattgatgctattgattttgctaaagctaagactcagcacaatactgggttaactcttgtgtttgctataaattatggtggacgagctgagattattcagagtatgaaagcaatatataacgaattacaattaaacggacaaggatctgaagtgattgatgaggcgttaataaagcgtcatttaatgactcatagttatccagatccagacttattaatacgcacttcaggagaacaaagaataagcaatttcttaatatggcaagcttcatatagtgaatttatttttaatgaaaagctatggccagattttgatgaaaaagagttaagagagtgtttgaaaatatatcaatcacgccaaagacgttttggaggattaagtgaggagtaa

SEQ ID NO: 2126 - DNA, 867 bp, Staphylococcus epidermidis
ctcatggcgatacaatggtatccaggtcatatggctaaagccaaaagacaagttagtgaacaactgaaaaaggtagatgtagtttttgaactcgtcgatgcacgtattccatacagttcgagaaaccctatgattgatgatgtcattaaacaaaaacctcgagtagtaattttaaataaaaaagatatgacgaatttaaaagaattagaaaaatgggaaatttattttaaaaatgaaggtttctatccggtagctgtagatgcaaaacatggcaagaatcttaaaaatgttgaagttgaagctataaaagcaactcaagaaaaatttgatcgtgaaaaagccaaaggtttaaaacctagagcgataagagctatgattgtaggcattcctaatgtaggaaaatcaacacttatcaataagttagcaaaacgtagtatcgccgaaactggaaataaaccaggagtaacaaaacagcaacaatggattaaagttggaaagtctcttcaattactagatacaccaggtattttatggcctaaattcgaagatgaagaggtcggtaaaaaattaagtttaactggtgcaattaaggatagtatcgttcatttagatgaggtagctatttatggtttgaattttatgattaaacatgatgtttcagctttaaagagacattataatattgatacacatgaagacgctgagatactcgattggtttgatgcaattggaagaagaaagggattgttacaaaaaggaaatgaagtagattatgaatctgtcattgagttgatcatcaatgatatgagaaatgcaaaaattggaacttattgttttgatattttaaaagaaatgaagagtgaatga

SEQ ID NO: 2127 - DNA, 348 bp, Staphylococcus epidermidis
tgtttaatagttttaaatttagtattaattaaggtggttattattttggcaatgacaaatcgagaaaagtttaaagtgcttgccgatcaaataaaaatatcaaatcaactagaacaagatattcttgaacaaggtgaactcactcgtatagatgtttcaaataaaaacagaacatggactttccaaatatcactcccacattttttatctcatgaagattatcttctttttacacatgcaattgaagaagaatttaaagaaatagctacagtagcaattgatttttcaattaaagataccaacaatcaagatgagtttcgctttaaaatatttcggacattgtattga

SEQ ID NO: 2128 - DNA, 1074 bp, Staphylococcus epidermidis
ctttctgtagtaggaggtctcgttttggataatgaacgtcaaaaagctttagatacagtaattaaaaacatggaaaaatcttttggtaaaggtgccgttatgaagttaggcgataataaaggtcgcagagtatcaagcacttcaagtggttctgtcacagttgataatgcattaggggttggaggttatcctaaaggaagaattatcgaaatatatggacctgaaagttcaggtaagacgacagtagctttacatgctatcgctgaagtacaaaaaaacggtggtgtagcagcatttatcgatgccgaacatgctctcgatccagtatatgcacaagcattaggtgtagatattgataatttatatttatctcaacctgatcatggtgaacaaggtcttgaaatcgccgaagcttttgttcgtagtggtgctgtggacattgttgttgtcgattcagtagcagcattaacacctaaagctgaaattgaaggtgaaatgggagatactcatgttggtttacaagcaagattaatgtctcaagcattaagaaagttatcaggggctatttctaaatctaatactacagctatatttattaaccaaattcgtgaaaaggtcggtgtgatgttcgggaatcctgaaacaacgcccggtggtagagccctaaaattctatagttctgtacgtttagaggtaagaagagcagagcagttaaaacaaggtcaagatattgtaggtaacagaaccaaaataaaagttgtaaaaaataaagttgcacctccatttagagttgcagaagtagatattatgtatggtcaaggtatctctaaggaaggagagctcattgatttaggtgtagagaatgatatcgttgataaatcaggtgcttggtattcttataatggagatagaatgggccaaggtaaagaaaacgtcaaaaattatcttaaggaaaatccacaaatcaaagaagaaattgaccgtaagttacgtgaaaagttaggtattttcgatggtgatgtggatgaaaatgagaatgaagacgattcaccaaaaactttatttgatgaatag

SEQ ID NO: 2129 - DNA, 786 bp, Staphylococcus epidermidis
aaaatgaaagtaagaacattaaccgcgattatagccttattaatattcttgcccatcttgctcaaaggtggcttaatattaatgcttttcgcattcttattagctttgatagccttaaaagaactacttaatatgaatatgatcaaatttttatctatacctggtctgattagtgctttagccctaattattatcatgttacctcaagatgcaggtgaatgggttcaagttatccaacttaaaggtttaattgctatgagtttcatagttttaagttatacagtgctatctaaaaacagatttagttttatggatgctgcattttgtttgatgtctgtagcatacgtaggaattggcttcatgtatttttatgagacacgttctgagggcttgagatatattttatttgcatttttaatagtttggctaacagatacgggtgcttatatttttggtcgccttatgggtaaacataagttatggccagtcattagccctaataaaacaattgaaggtttctttggtggtattttatgtagcattttagtaccattagtgatgcaaatgtttgtagatttacatatgaatatttggcttttactattagtcacaattgttttaagtatgtttggtcaattaggtgatttagtagaatctgggtttaaacgtcattttggtgttaaagattcaggacgtatactaccaggacatggtggtatattagatagatttgatagcttcatgtttgtattaccgctattaaatattttactgatacaaacttaa

SEQ ID NO: 2130 - DNA, 552 bp, Staphylococcus epidermidis
tgtaggggagttttaattatgaaagagaatattttgccagctattagaaatatgagagatttagaaaagttaattaaaacagactacaaagcatgtgttgtgttagatatgcatataggtcatttgaaaagcattatggagttacttaaaagtcattcgattgaatgttatgtacatatcgatttaatcaaaggactcagtcatgatgaatttgcttgtgagtacattattcaacaatataaacctaaaggtattgtttctacaaaagctaaggtcatcaaaaaagctaaaatgttaaatactttgacgatatttagagtgtttatcatagatagtcaagcattaacaagaagtattgaactcattaaaaaagtagagcctgactatgttgaagttttacctggtgttgcaagtaaagcagtgagtaaaattcaacaagaaacatcagcgtcagtaatagctggtggtcttatcgatgaacaatcggaaattagagaagcaatttccaatggcgctaagtacgtcactacaagttacgagaaactttggtaa

SEQ ID NO: 2131 - DNA, 2187 bp, Staphylococcus epidermidis
atgaatatggtaaggagtgattatatgagtaaaaaaagaatttacgaatatgcgaaagaattaaatctaaagagtaaagagattatagatgagttaaaaagtatgaatgttgaagtgtcaaatcatatgcaagctttagaagaagaacaaatcaaagcattagataaaaaatttaaagcctctcaagcgaaagacactaataaacaaaatactcaaaataatcaccaaaaatctaataataaacaaaattctaacgataaagaaaaacaacaaagtaagaataatagtaaaccaacgaagaaaaaagaacaaaacaacaaaggaaaacagcaaaataaaaacaataaaactaataagaatcaaaaaaacaataaaaataaaaagaataataaaaataataaacctcaaaatgaggtagcagaaacaaaagaaatgccctctaaaatcacttatcaagaaggcataactgtcggtgagttagctgaaaagctaaatgtagaatcagctggtattattaaaaaattgttcttactaggtattatggctaatatcaatcaatcattggatgaagaaacattagaattaattgcagatgactatggcgttgaaatagagaaagaagtagtcgttgatgaagaagatttatcaatttattttgatgatgagactgatgattctgatgcaattgaacgtccagcagttgttacaatcatgggccacgtagaccatggtaaaacgactttattagattctattcgtaacactaaagttacagaaggagaagctggcggaatcactcaacatattggtgcttatcaaattgaaaattcaggtaaaaaaattacgttcttagatactcctggacatgctgcatttacgactatgcgtgcacgtggtgctcaagttactgatattacaattttagtcgtggccgctgatgatggtgtgatgcctcaaacaattgaagctataaatcacgctaaagaagcagaagtacctacgattgttgcagtaaacaaaattgataaaccaactgctaaccctgatcgtgttatgcaagaactcactgagtatggattaattccagaagactggggcggtgacacaatctttgtaccactatctgcattgagtggagacggtattgatgatttattagaaatgatcggtttagtagcggaggtacaagaacttaaagctaatcctaataaacaagctgtaggtactgtgattgaggctgaattagataaatcacgaggtccagctgcatctttacttgttcaaaatggtactttaaacgttggagatgcaattgttgtaggtaatacttatggacgtatacgtgcaatggttaatgatttaggaaaaagaattaaatctgccggtccttcaacacctgtagaaattactggtattaacgatgttccacttgcaggtgatcgttttgttgtatttggtgatgaaaaacaagcacgtcgaattggtgaagcacgtcatgaggcaagtgtcatacagcaacgtcaagaaagtaaaaatgtttcattagacaatttatttgagcaaatgaaacaaggtgaaatgaaagatttaaatgtcatcattaaaggtgatgtacaaggttcagttgaagcattggccgcatctctaatgaaaatagatgttgaaggtgtgaatgtacgaattattcatacagctgttggtgctatcaatgaatcagatgttacattagcaaatgcatcaaatggtattattattggttttaatgtacgcccagatgcaggtgcgaaacgtgcggctgaagctgaaaatgtagatatgcgattacacagagttatctataatgttattgaagagatagaatcagctatgaaaggtttacttgacccagaatttgaagagcaagtcattggacaagctgaagtgcgtcaaacatttaaagtttctaaagttggtacaattgctggtagttatgtgactgaaggtaaaatcactcgtaacgctggtgtacgcgtaattagagatggtatcgtgttatttgaaggtgaacttgacacattaaaacgtttcaaagatgatgctaaagaagtagctcaaggctatgaatgtggtattacaattgaaaaatataatgatctcaaagaaggagacattattgaagcgtttgaaatggtagaaattcaaagataa

SEQ ID NO: 2132 - DNA, 867 bp, Staphylococcus epidermidis
ttggctacatttaaagattttagaaataatgtgaagccaaactggtgccctggttgcggtgacttttcagttcaagctgctatacaaaaagcgacagcgaatattggtttagaaccagaagatgtagcaatcattacagggattggttgttctggtagactatcaggttatattaattcttatggcgtacactctattcatggacgtgcattgcctctagcacaaggcgttaaaatggcaaacaaagatttaacagttatcgcttctggtggtgatggagacggctatgcaataggaatgggacatactattcatgctcttagacgtaatatgaatatgacgtatattgtcatggacaatcaaatatatggattaactaaaggacaaacatcaccttcctcagctaaaggatttgtaactaaatcaacacctaaaggaaatatagaaaagaatgtagctccattggaattggcactgtcctctggtgcaacttttgtagcacaaggattctcaagtgatataaaggcattaactaaaatgattgaagatgcgattcatcatgatggtttttcttttgttaatgttttctcaccttgtgttacttacaataaagtgaatacttatgactggtttaaagaacatttaacaagtatcgatgatattgagggctatgacatcacagataaacaacttgctatgaaaactgtgctggatcatgagtcactggttaaaggtatcgtttatcaagatacaacaacaccttcttatgaatcgcaaatttcagaactagaacatgaggcgttagctaaaagagatattcatattacagaagaaactttcaacgatttaactgcacaatttttataa

SEQ ID NO: 2133 - DNA, 639 bp, Staphylococcus epidermidis
gatgatttttcggaggttaatatggacaaatttaaatctatgacagaattaaaagaattgactaaagaaggaaaagattgggaaatagagtgtgaaaatcgttctagcatagtcactatattagcattacatggcggtggaattgaacctgccacaactgaattagcctatacaattgcacattgtggcgactataactatttttcctttaaaggtatgagaagtaaggggaataatgagttacatgtgacttccacacattatgatgaccaaattgcattagatttagtgagaggtagccaaagaactgtagccatccatggttgtgaaggtaatgaaagtgtggcttatataggaggtagtgatgacagactaattgagttaatcaccgaatctcttgaagatataggaattagcgtgcgagaagcaccacatcatatttctggaactcaagaaaataatattgttaatatgactcaaacccaaggaggagtgcaattagaactgacagctcagttaagaaaggagctatttaaaaatagaaaaagttcacgcaaaaaccgtgaaaataaagataattgggatgatttaatgtacgactttgctgatgcaatgaaaaaagctatagaacgtgcataa

SEQ ID NO: 2134 - DNA, 627 bp, Staphylococcus epidermidis
  unsure (502): Identity of nucleotide at the above locations are unknown.
atggcaatttcagcaaaacttgttaaagaattacgtgaaaaaactggcgcaggaatgatggattgtaaaaaagcgctaactgaaactgatggtgacatcgataaagcgattgactacttacgtgaaaaaggtattgcaaaagcagctaaaaaagctgaccgtatcgcagcagaaggacttgtacacgttgaagtaaaagataatgaagctgcaatcgttgagattaattcagaaacagacttcgtagcacgtaacgaaggtttccaagaattagttaaagaaattgctaaccatattttacatagcaaggtagaaacagtagacgctttgatggaatctaaattatctagcggtaaaactgttgatgaaagaatgaaagaagctatctcaacaattggtgaaaaattaagtatccgtcgtttctctatcagaacaaaaactgataatgatgcatttggtgcatatttacacatgggtggacgtattggtgtgttaactgtantggaaggtactactgatgaagaagctgctaaagacgtagcaatgcacattgcggcaatcaaccctaaatatgtttcttctgaacaagtaagcgaagaagaatcaatcatgaaagagaagtattaa

SEQ ID NO: 2135 - DNA, 873 bp, Staphylococcus epidermidis
acaaagatttcatgtgcttcgttgttaacaaggggtgatcaagaaatgacttttgcaaaaaggaaagagtggtacttagaatatgagataactgtaaatcgtgctggcttactcggtgatatttcaagtttgcttggaatgctcggcattagtattgttacaattaatggtgttgatcagggaaaaaggggattgttaattaaaacagatcaactagaaaaggtcgaaaggttcgaacaaattgtaaaagaaattaatgaaatagaaattacaaagttaagagttcctgaattacgagatagactcgctgtacgacacggtagatatattgaacaagatgctgatgataaaaagacttttaaatttgaacgagaagatttaggattacttgttgattttttagctgagttatttaaagaagaaggacataaattaatcggaatacgtggaatgcctagagttggtaaaactgaatctattgtagctggaagtgtttgtgcacataaaagatggttattcataagctcaactttaattaaacaaacagtaaggcgttcactatttaaaggtgaatatgattctaatcacgtatatatcattgatggtgcggtaacagcacgtgaattgaaccctgagcaccaagaattggtgagagaggttatgacgttaccctcaataaaagtagttgaacatccagatttatttgtagagtcgtgcaattataatatggaagattttgactatattattgaattgagagaaaatgaagatcaagagattcgatatgaagaaatgaagaaacatacggttcaaagcaagaataatttagattttggagatccatttggtggagggtttggtttctttgaataa

SEQ ID NO: 2136 - DNA, 342 bp, Staphylococcus epidermidis
agtgttcgctcatgtgaaattaattcaatctgtaggtcatcactcgaacatcctacaaagcgtgtgcttgctccctgttgtggtaaatgtagagccttttattttcaaaatgatgtagttattgccaaaacatcaatgacaactattcaacttcaacccaaacaagttattaatatgatgacgcaattacaggatgcaagtattattttcaaacaaacggattgtctccataatgctgctatcagtgatgtaaaagattttttgaacatcaccacgatatcgtacgtcataacactcttgataaattatacggttattatattcaacgacatataccggtga

SEQ ID NO: 2137 - DNA, 213 bp, Staphylococcus epidermidis
tgtaaaagattttttgaacatcaccacgatatcgtacgtcataacactcttgataaattatacggttattatattcaacgacatataccggtgagagataagattttgatttttagcggtcgtatttcattagaaattttaatcaaagcagctaaaattgatgtaggaattatattctctaaatcttccctacttcacttcaatacaacttga

SEQ ID NO: 2138 - DNA, 1242 bp, Staphylococcus epidermidis
gtaaagtttttagcttctcaattattcaaaggaggtttttttatcgattacttaggtgttgatattagtaaaagaagtagtgtagttgcacattataaaaatggaaaattccaaaaagagtttttcatccaaaataataaaaatggttacaattatttactcaagtatttgaatgacttagaccacccacaactcatttttgaatctacaggtatctattcaagaggtatggaacgattttgttgtgtaaatcaaattaactatattcaaatgaatccgttagaagccaaatttaaaacgagcactctaagatcatggaaaactgatcaggcagatgctcataagcttgcttgtttaggaccgacgcttaaacaaacagacaacttacctatacatgagttaatattctttgaattaagagaacgcgtccgttttcatctagaaatcgagaatgaacaaaatcgacttaaatttcagatccttgaattattccatcaaacattccctggtttagaaagattattcagtagtcgatattcaatcattgcactcaacatcgcagaaatctttactcatccagacatggttcttgatatcgacaaggaggtactgattacacatatattcaattctacagataaaggaatgtcaatggataaagctacaaaatatgcacttcaattaagagtgattgctcaagaaagctatcctaatgtcgatagacattcctttctagtcgaaaaattacgcttacttattcaacaattaaaacaatctattcatcatctcaaacaattagatgatgccatgattcaattagcacaacaactcgattattttgaaaatattcattcgatacctggtattggtaagctaagcacagctatgattattggggagattggtgatattaagcgatttaaatcaaataaacaactcaatgcttttgttggcattgatatcaaacgatatcaatcaggtcatacacactgtagagataccatcaacaagcgtggtaataaaaaagcgagaaaacttttattttgggtgattatgaatataataagagggcagcatcattatgacaatcatgtcgtcgattattactacaaactaagaaagcagcctaatgagaaacctcataagactgccatcattgcttgtataaatcgattattaaaaacaattcattatcttgtaatgaatcataaattgtacgattatcaaatgtcaccacattag

SEQ ID NO: 2139 - DNA, 282 bp, Staphylococcus epidermidis
ttagtaatgttattaaatatcatagaaggagtgacgcatatcaatcctaaagtattaaaagctctagcaatcacatctaatgtactattagttattggaatcatctgtttaattatgctaaagctcatgttagctattgcattttttgttgtatcattaacaattagtctcgtcatttttaatgttatgttcagacaccgtacaggtatgaaaattgcaattaatgtctcgttctttatagtgatgattgctatcgtaatagcctattttgtattatcttaa

SEQ ID NO: 2140 - DNA, 198 bp, Staphylococcus epidermidis
tttccgtcaccattagctgaattggttaataaatatagttattcattaatacctaataaactttcatccaccgcccttttccaacttcggaaatacaaaaacaaccctctaaccattgctgttaaagggttgttgcattattatattatattctattcccactcaattgtacttggtggcttagaggtaatgtcatag

SEQ ID NO: 2141 - DNA, 498 bp, Staphylococcus epidermidis
ttacatccacctgaattaatcagtattcaaattattaaaattgctccaatctattcttgtgtaagaatagattggattttttatttaatagtaatgtttgtgagaggccattgcctcgaagttacgaatttgagaaaatggttctattactttaataggaggaataaaagaatgcaatggcttaaagttatattagccggttttattgaaatcatctgggtcactggacttgatcaagcgcactcattgtttacatggatattcaccctcttttttattgctttaagcttttttctagtcattgatgcttcgaagcacttaccagttggtacggtatatgcattttttgtcggaataggtgctgttggtacagtgttagttgatatgattttcttcaaccaaccatttactttcactaaaatatttttaataatgacccttattttaggaataataggattaaaactgacaactgatgcaacgaaagaagggagataa

SEQ ID NO: 2142 - DNA, 579 bp, Staphylococcus epidermidis
gtggagtcgttaggacgaaaagtcaaagaagatggcgttgtcatcgatgagaaaattttgaaggtagatggatttttaaatcatcaaattgatgcaaagttgatgaatgatgtaggtaaaacattttatgagtctttcaaagacgctggtattactaaaattttaactattgaagcttctggtattgcgcctgctattatggcttcttttcattttgatgttccttgtctatttgctaaaaaagctaaacctagtactttgaaagatggcttttatagcacggatattcattcatttacaaaaaataaaacgagtacagtcattgtatctgaagaatttttaggtgcagacgataaagtacttatcattgatgactttttagctaatggtgatgcttcgctaggtcttaatgacattgtaaaacaagcaaatgcgacgacagttggcgtgggtattgtggttgaaaaaagtttccaaaatggtcgccaacgtttagaagatgcaggcttatatgtatcttcactttgtaaggtagcttcattaaaaggcaataaggtaactcttttaggtgaagcgtaa

SEQ ID NO: 2143 - DNA, 411 bp, Staphylococcus epidermidis
gcaattgagttttatcacacaaacacaacatccaagaatcaacttaggaggcatattattatgagtaacaaagtacaacgttttattgaatcagagagagaattaagtcaattaaagcattggcttaaaacgacatatcgtatttctattgaagaatttgtagttctttacaaggtctatgcagacactaaaattagtggtaaagagttacgagacacattacatttcgagatgttatgggatacaagtaaaattgatgtgattattcgtaaaatctataagaaagaactcatttctaaattacgctcagaaaccgatgaaagacaagtttactatttcttcgatgcaaagcaaaagaaattattggacaaaatgactggagaaattgaaacaattagtattgcaaattaa

SEQ ID NO: 2144 - DNA, 279 bp, Staphylococcus epidermidis
ccaagccatactttttatctcccttctttcgttgcatcagttgtcagttttaatcctattattcctaaaataagggtcattattaaaaatattttagtgaaagtaaatggttggttgaagaaaatcatatcaactaacactgtaccaacagcacctattccgacaaaaaatgcatataccgtaccaactggtaagtgcttcgaagcatcaatgactagaaaaaagcttaaagcaataaaaaagagggtgaatatccatgtaaacaatgagtgcgcttga

SEQ ID NO: 2145 - DNA, 438 bp, Staphylococcus epidermidis
cagtccatcacccaatcgtttaaggaggctatatcaatgattcctggtgaaattattgttaaaaatactgaaatagaagtcaataaacatcatcccgaaacggtgattgaagtgaaaaatacgggcgatagacctatacaagtaggttcacatttccactttttcgaagcaaataaggcattagaatttgatcgtgagaaagcatatggtaaacatttggatattcctgcaggagctgcagtgagatttgaacctggagatgaaaaaaaagtacaacttgtcgaatattctggacgacgtaaaatttatggattccgtggtttagtcgatggcgatattgacgaagaacgcgtattccgtccaaatgattcaaatcaaaacgccgccgttaaaaacgatgcaggcgaagacaatgcgaataaaaaaggtggtaaataa

SEQ ID NO: 2146 - DNA, 189 bp, Staphylococcus epidermidis
actaaattaacaaggtgccttatgtatagagattataacaagactcaacttactctaccaatggaaacttcagtacttatccccacaaatgatattacacgatatgtacataatattgtagaaacaattctagagactgaattcagacatcatcgtgattcaacatcataccatccaaaaatgatgtaa

SEQ ID NO: 2147 - DNA, 666 bp, Staphylococcus epidermidis
tatagtccaaccaggagatacaattgcgctcattccaccggtcagtgggggttgatcaagatgaaagcaattattttagcaggtggagaatctagccgatttggtaaagctaaagcttttgctaaaattgataatcaatatttttatcaaaaaattatagaaacgttaaaatctacaaatatgtttaatcgcattatcattagcactaattcccaattagcttctcagtttgaatatgaatatgtgattattgatgacgaacatcatcaaaataaagggccgctaacaggaatttactcagtgatgaagcaatacatggatgaagaattgtttttcattgtatctgttgatacaccaatgattacaagtaaagcagtgaatgggttatatcatttcatggtatcaaacttaattgaatcacgtttagatattgtcgcgtttaaagaaggagaaatatgtataccgacgattggtttttatactctatcgacgtttccttttattgaaaaagctttaaattcaaatcatttaagtctaaagcatgtcattaaacaattatcgacagattggttagatgttactgaaattgactcgcctcattattggtataagaatattaattttcagcatgatctggactctttaaaaaagcagataaatgaataa

SEQ ID NO: 2148 - DNA, 444 bp, Staphylococcus epidermidis
ccatgtaagacaacatttttaaaaggggcgataatcatggcaaaaattactgtagtgaataaccaagatgaattatataaagtcatcaatcaaataaaatctgaaggttatttagagacagaattagctgttatcagtaaaagtaagttgcacttagatgatttacacaactctcaaatctcgttaatggctacaagtggctcatttagtgaccgtatgtctcgtttacttacaggtgaagatggagaagaaacagtattatctcgttatgatttaactgacaatgaactagaaggatataaacaagatattttaaacgataaaatgctcgttgttgctaacagtgaccgttcttctcatgatgaagttgaagataataatgctgcatataaagaagtggatattactcattatgccgcagagtctgaagggcctaaagcataa

SEQ ID NO: 2149 - DNA, 264 bp, Staphylococcus epidermidis
agaggtttttatatgagaaagtttattttattgttatttattatcctaaatctcgtggcaatcattattacaatcaatcacccactaacaatttcatattttagtcttcgtgtcatcttcgtagcatttatatttattatatccattttttttatttttttacgtaccacaaactatgaattgattctaagtattttatctaccgttttcgctttcatacacatcggtttaattattcacagtgcctatctatatttatactag

SEQ ID NO: 2150 - DNA, 369 bp, Staphylococcus epidermidis
aggagtgctcatatgaataaagcgcttgttatacgtgcaatcaaattttctttaatatttatgactgcatttttaattcttaatttattgactatgaaagaggcttcaatatcgtctattattgtacgaactgtcattgcagctattgttttctttgtcatttatatcattgtatttacaattttaagttcgtcagaacgtaaaattatttatggtacaactttacctattgcgctttttatatgccttatattcggagcaattttcttcactccgcgtataggtatcattgccggactaattataggtgtgtttgctggtgtcatatgggagttcttaaatagaaaaaatggaggtcgctcatcttga

SEQ ID NO: 2151 - DNA, 210 bp, Staphylococcus epidermidis
tgtggctatcataaaatcaaaagcctacttataaaacgattaatcgattcaaaaccaaataaaaaaataatgaggaattatagttgggaatatttcaatgcccaaattaaaaaaagctttcagaaccaaaacaaaaccatctacagtcaaagtaaaattgatgtggagcctgattttggattttcactcgtatgtccgttcgagggatga

SEQ ID NO: 2152 - DNA, 360 bp, Staphylococcus epidermidis
ttattcaatcatatgggaggctttatgaattatttagaaatttcactacatattgaacaacaacttgttaaattactctctctgagtgaaaatgcgaaatactatgcactcatacatcataacaaatttgaatcttttatagatgatttcaaccttactgtaaatcaagagatgaaatgggcaatgtctcatcaattgttgttgaattctaatgatacgcttttatcgtactgccaattgattcgaaggttaaacgattctccacttttaactttaaaccaaggacatataatttattacattaatacacaacaaacactcattcaccgacagttactcaaacataaacaagctctttag

SEQ ID NO: 2153 - DNA, 891 bp, Staphylococcus epidermidis
caaatgaatcatttaactactgaaacgagaaatatacaaacgatgcatctggatgaaatgaatctaagtgatgcattaaaaactatgaatcaagaagatcaattagtacctaaagcgatagaacctgttattcctaatttaacaaaagtgatagagagtgcaattcaacgctttaataatggaggacgaattatttatattggtgcaggtacaagtggaagacttggcgtactagatgcagcagaatgtgttccaacttttaacgtttcaccaaatgatattattggaatcatcgctggtggacaaaaagctatgacggtagctattgaaggtgcagaagatgatgctgaacaaggtgcacaggatttaaagaacatccatcttcaatccaaagatattgttgtgggtatttctgctagtggacgtacaccatatgtaaaaggtgcactagtttatgcaaataaaatgaatgcagaaacagtcgcactctcttgtaacgttcacagtgatataagtaaaaattcaaatcacgtattagaaatcaatgtgggacctgaagtattaacaggctctacgagattaaaatcaggtactgctcaaaaattagttttaaatatgatttctacaatgacaatgattggcgtgggtaaagtttatgataatttaatggttgatttacgacctacaaatcaaaagttaatccatcgttctattcgcataattcaagatgtgtgtgatttaaatcatcaagaggctatagaattatatgaaaaatcagaccacaatatcaaaatagctatcgtaatgcacttatgttccacaactcaacaagatgcaagacttcgtttaaaacaaaataatggagtgattaagcaagctatcaacacttaa

SEQ ID NO: 2154 - DNA, 642 bp, Staphylococcus epidermidis
agatggggtcaagttatggaaaataatgagttgcaaaggggattgaatgcacgtcagatgcagatgattgctcttggtggaacaattggtgttggtctttttatgggagcaacaagtacaattaaatggacaggtccatcagttattcttgcatatttaattgctggtatttttttatttttaatcatgagagccatgggtgaaatgatatatattaatccaaccactggttcttttgcgacgtttgctagtgactatattcatccagcagctggctacatgactgcttggagcaatgtatttcaatgggttgtcgtcggcatgagtgaagtgattgcagtaggagaatatatgaactactggttcccaagccttcctaattggataccaggagtgatagcagttctctttttgatggctgctaacctagtttcagtaaaagcgtttggagagtttgaattttggtttgccttaattaaagttgtaactattgtattaatgattattgcaggattacgattaattttatttggtataggcaatggagggaatccaatagggatttctaacttatggtcacatggtggatttatgccaaatggattcattggatttttctttgctttatctattgtgatttga

SEQ ID NO: 2155 - DNA, 867 bp, Staphylococcus epidermidis
gcacgacgtcttactgaaagggttaacttaatggctgagcaacgttggaccggtcaactagatttaacagttttcaataatggtcaaagctcaaaagcacgaaatatattttttgaaaaggcgctcaaagtactacgacctatatatttagaacaatctcctgtaccaacattctatattgtcaatgttggtggaggttatctagatggagatagataccgtgtcaacgtcaacttagaagataacgcacaagtgacgcttacttctcaaggtgcaactaaaatatataaaacgcctaatgaccatgtagaacagtatcaaacgtttaatttatcaaatcaatcgtatatggaatttgtagcagatcctattattgcctatgaaaacgctaaatttttccaacataatacgtttaatcttaaagaagatagtgctatgttttacactgatatattgactccaggctattcatctaatggccaagatttcacgtataattatatgcatcttattaatgaaatttacattgacaatcaattagttgttttcgataacatgatgttaagtcctgataaaagcagacttgacggcattgggtatatggaaaattatacacacttaggatcagcttattttattcatccagatgtaaaccaaagtttcatagaagatatttacacggcggttgctgattttcaaaaacaatacgactgtagaataggtatcacacaattacctactcatggattggccgttcgtattttgactaaaagaactcaaataatagaagaaattttgactcgtgttcaatcatatatcaatcaaacgatttatcatcgacaaattaacttcttaagaaaatattaa

SEQ ID NO: 2156 - DNA, 387 bp, Staphylococcus epidermidis
accttgctacaacaagatgtgcatcagaggagtggttttataatgggaaaaattaaagacatcaatgatttggttaatgcgacatttcaagtaaaaaaattttttagagatactaaaaagcaatataatttaaattatgaagaaatttatattcttaatcacattttgaaaagtgaatctaacgaaatatcttcaaaagaaattgctacatgttcagagtttaaaccgtattatttaactaaagcattacaaaaattaaaagatttaaatttactatctaaaaagagaagcgtgcatgatgaaagaacagtaattgtatttgtatcagatgaacaacgagaaaaaataaaaaaattgattttagaattagaaaactatatcaaataa

SEQ ID NO: 2157 - DNA, 537 bp, Staphylococcus epidermidis
ataaacatgcacaaacatcaacatcagaatattcatttaaacagaccgattcatgtagcaattttgactgtatcggatacgagagattatgattctgataaaggtggtcaactgattcaatctttgataaatcaacatgagaatcatgttgatattaaccactatcgaattgttaaagatgatatagaagctattacacaccaacttaagctttggttaacttcgtcaaatcaactagatgtcattattacaacgggaggaacaggtatctcacaaagagatgtgacaatagaagctgttcgcccattgttaactaaagaattagaaggttttggtgaattatttagatacttaagttataccgaagatgttggtacaagagcattattaactcgagctattgcaggtacctgtgatagcaccttaatttttgcacttcctggctcaactggtgcaattaaacttgcaatagaaaaattaattaaacctgaattgagtcacttagtgtttgaattaaataaagacattaggtattaa

SEQ ID NO: 2158 - DNA, 309 bp, Staphylococcus epidermidis
ataacacctaaaccgccttgtcgagccatagcaattgccatttttgattcagttactgtatccatacctgctgagataacaggaatgtttaacttgatcttatctgataatttgacacttaagtcaacatcgcttggtaaaacatctgatgcagctggaatgagtaacacgtcgtcgaatgttaaagattctttagcaaatttattttcccacattaaaaacagcctccaattttatttatacttagttacattatttcacattttcttcagtttgtttatactttataccattaaaaaagaaatttaa

SEQ ID NO: 2159 - DNA, 975 bp, Staphylococcus epidermidis
gttattcataaaaaaacgttaggagtatcaactatgaccaaagtatattttaatcatgatggtggcgttgatgatctagtgtcactatttttattattacaaatggaaaatatagaacttgttggtgtaagtacgattggtgcagactgctatttagagccgtcattaagtgcttcattaaagattataaatcgtttttcagacgttgaaattaatgtagcaccatcatatgaaagagggaaaaatccttttccaaaagaatggagaatgcatgctttctttatggatgccttaccagtgctaaatgagtcttgtatacccaaaagatgtaaggctagtgaggacgaggcgtatatagatattattcgtaaggtgaagagttgtgatgagaaagttacattgttatttactggaccgcttacagatttagctaaagctataaaatatgacaactcaattttaaaaaatatagagaaattagtttggatgggtggaacgtttttagacaaaggaaatgttgaagaaccagaacatgatggtacagctgaatggaatgcattttgggatccagaggctgtaaaagttgtattagatagtgatatgattgtcgatattgttgctttagaaagtacaaatcaagtccctctaacaatggaagttcgtcaaatgtgggcagataaaagacaatatttaggcgttgattttctgggcacaagttacgcagcagtaccaccactcacacattttgtgaccaattcaacatactttttatgggatgtattaactactgcttatgtgggttctccaaatttagttgaatcaacgaaattgaaaattgatgtagtcagtcaaggacctagtcaaggaagaacattccaatctgaaaatggacgtgaagttcaagtcattacggatgtaaataaacaagcattttttaaatacataacggatttagcaaagaaaatcgagacctaa

SEQ ID NO: 2160 - DNA, 1107 bp, Staphylococcus epidermidis
tataagcataaaaatttagtgaaaagaggtaaaaaaatgaaaatagctattgtaggttcaggtaatggtgcagtaactgctgcagtggatatggtagataaaggtcatgatgtacgattatattgtcgtaacgaatctattagtaaatttgatgtagccctagaaaaaggtggctttgatttttataatgagggagaagagaagtttatagagtttactgatattagtgatgatatggagtatgttttagatggtgcagacattgtccaggtaatcattccttcatcattcattgaatattatgctaaagtgatgtcaaaatttgtgacgaacgaccatctcattttctttaacattgctgcttcaatgggttcaatacgatttatgaatgtattagaagatcgccatattgatgtccatccacactttgcagaagcaaatacattaacatatggtacacgtgttgactttaacaatgctaaagtagatttatctttaaatgttcgtcgtgtgttcttttcaacatttgatcgtagtgagttaaatgaaagttatgaaaaggtatctaaaatttacgattatcttgtaaaagaagaaagtttacttaaaactaaccttgaaaatggtaacccagaagtacatcctggaccaacattattgaacgttggacgtattgattattcagaagagttttctttatataaagaaggcataacaaaacatactgtgagattattacatgctattgagatagaacgtttaaatttagggagaaaattaggttttgaattatcgactgccaaagaatcacgtattcaaagaggttatttagaacggaaagacgaggatgaaccgttaaatcgtctttttaatactagtcctgtgttttctcaaattccaggaccgaatcacgttgaaaatcgttatttaactgaagatatcgcatatggattagtattatggtctagtttaggacgtgtcattgatgtcccgacacctaatatcgatgctgttattatgatagcttcaactattcttgaacgcgatttctttgaagagggcctcactatcgaggaattaggcttagataaattaggattagagtaa

SEQ ID NO: 2161 - DNA, 792 bp, Staphylococcus epidermidis
ctaataaataataatgaagttgatgaggcgatgtttatgtcgaaaataacttttaaagatatttatattgatggaaataaaataactgaagatactagaaaggtgatttatctcttaccttctcaacctttaaaatatgctagtaacacgtggatttataaaacgatgccaacaatgaaccagtggcttaaagacattgaagttcaaaagaaaatgcatctaaatcaatcatcctatcatctttcattttcatttccagctaatgaaaagatagatgaagtattgttggaaaaaatacgtgaactaggttttcagataggagtacttgagctctatgtcattgaagctaaagcgttaaaggagctctcccgcaaaagagacgtagatattcaacttgtatcaagcaataatatcaatgattaccttcatgtttatgatgtgtttgcacggccttttggtgatagctatgccaacatggttaaacaacatatttatagctcatataacttggacgatattgaacgtttagttgcatatgttaaccagcaaccagttggaatagtcgatactataatgacggataaaacaatagaaatagatggttttggggttttagaagaattccaacatcaaggtatcggttctgaaatacaagcttacgttggacatatggctaatgagcgacctgttattcttgttgcagatggagaagatactgctaaagatatgtatctaagacaaggatatgtatatcaaggttttaagtatcatattttaaaagaaaatatttaa

SEQ ID NO: 2162 - DNA, 1218 bp, Staphylococcus epidermidis
agcaatgataaaggaggagcagtaatgaatcagtctacaataattaaagaccccatctttacgaagagttttaatattaactttgctattaacttttttgtttatctatgtatgtatttattaattgtcgttatcgcgagctatagtaaatcagaataccatgcttctgattctgttgctggactcgtagtcggactttttatagtaggatcattaataggtcgatttgtaacaggtaaatacgtaaatcgatttggtccaaaaaaaattctcatttttggtttaatatgtttagtagtaacacagctactttattttatacctggttctgtttggttcttaatgatggtgcgtttactgaacggcttagcaacagcggttgctacaactgctacaggaacaatagcagcatatattacaccacctacacgcaaaagtgaaggtatcagtttattctcattaagtttggtgttgggaaccgctattggcccattttttggtatgttattgatgaattccttttctatcaatattttatttactatttgtgtaattttaggtgtcataagtggtctattatcactgttaattaaaattaatttcacaacagttaaagaaaacacaattacacataaacgattcaatttggctcattttgtagccaaagaagccattccggtagcattcgtcatgctattaatcggtgttacttacgctgctattttaacttatttacaggcttttgctgttgaaagagatctagttacatcagcaagttactttttcattttttatgctattgcgtccctcataacaagacctattgctggaagattgatggatgataaaaacgaaaatgtagttgtttatccagcatttatctttttagtattatcttttgttctactgatgcttagttttaacggttgggtattacttattgcaggtatcgcattaggaattggttatggtaacttgtcatcttgtatgcaagctatcgcaataaaagtatctccatcaaataaatatggcttagctacatcaacttactttattggtttagatatagggattggatttggaccatccttactaggtcttttcacacatatgatttcttatagtcaattatatggaatcatgggtattttaggatttgcaactttagtcatctatatttttgtgcacggacgtaaggtttacagcacttcatattaa

SEQ ID NO: 2163 - DNA, 573 bp, Staphylococcus epidermidis
aatctatgtaaggaggatgaacaagtgactacaaaacatttagtatatacagctttaatgactgctatcatttgtattttaggtttagtaccaagtgtacctctgccatttatgccagtccctattgtattacagaatataggaatctttttggcaggaattattttagggcgaaagcttggtactacaagtgttattgtctttttattattagtagctacaggtttgccagtgctttctggaggccgtgggggaattggcgtatttgcaggaccttcggcaggattcttattcttatatcctgttgtagcttactttataggtattattcgtgatgcatatttgcataaaattaatttcttagtgatttttatagctacactagttatcggtgtattaggattagatatattaggtacactcattatgggcttcattatacatatacctatctctaaggcatttatattatcatttacatttatgccaggtgatattattaaggctattattgcaagtttaataggtgcagcaattttaaatcattcacgtttcaagactcttattcaataa

SEQ ID NO: 2164 - DNA, 1656 bp, Staphylococcus epidermidis
ataaagagcaataaagataaacatatattagttatcataattaagggaagtgggaggtattcaaaaatgaatgcaattaaacgatttggtagtgcaatgatagtacctgttttaatgtttgcttttttcggtattgttttgggattcgctacattatttaaaaatccaaccattatgggaggattagctgatcagcaaacattttggtttaaattttggtctgttattgaatcaggtggttgggtaatatttacacatatggaaattgtctttgtagttggcttaccattatctcttgctaaaaaagcaccaggacatgcagctttagcagctctaatgggatatttaatgtttaatacttttatcaatgcaattttaactcaatggccacatacttttggcgctaatttaaaaaaaggtgtagaaaacacaacaggattaaaatcgattgcaggtattgaaacgttagataccaatattttaggtgcaatcattatctcaggaataataacgtggatacataatagatattacagtaagcgtttacctgaaatgttaggtgtatttcaaggattaacattcgttgtaacaatctctttctttgtcatgctaccagtggcagcaatcacttgtgttgtttggccaacgattcaacacggtattgcttcaattcaatattttattgttgcatcaggttatataggtgtttggttatatcatttcttagagcgtgtactaatacctacaggattgcatcattttatctatgcaccaatcgaagtaggtccagtagttgttaatcatggtttgaaagcagaatggcttcaacacttaaaccagtttgccgaaagtaataaaccacttaaagaacaattcccatatggatttatgttgcaaggaaatggaaaggtttttggttgtctaggtatagcattggcaatgtatgcaactacaccaaaagaaaatcgtaaaaaagttgctgcattattaataccagcaacacttacggcagtagtagctggtattacagaaccacttgaatttacattcttatttattgcgccatttttattcgtattacatgcactactagcagcaactatggatacactgatgtatggatttggtgttgtaggtaatatgggtggcggtgtactagattttattgcaactaactggataccattaggaaaagcacattggatgacatatgtctttcaagtagtaattggtttaatctttgttgcaatttactacttcttatttaaatatttaattttaaaatttgatattccattaccaggacgtaagaaaggtgaagaagaagttaaattattttccaaacaagattataaagataaaaaaggagattcaactcgcaatcattcacctaatagtgaatatgaagaaaaggcgatgtactacctagaaggtcttggaggaaaagaaaatattaaagacgttacaaattgtacgacacgtctacgtttaactgttaaagacgaaagtaaagttcaagaaagtgcctattttacacataatcaaatgtctcatggtttagtaaaaagtggcaaaagtgttcaagtcgtcgttggaatgtctgtacctcaggtaagagaagcatttgaaaatattgtaaatgatgatctatcttag

SEQ ID NO: 2165 - DNA, 222 bp, Staphylococcus epidermidis
aaacttctaaagccatattctctagattatatgagtcatataaattattttatgataatagcaaatttttgttgtattttcaatataattaaagagatgttcacgattcaaaaagcatcaaaattcagtgtaagcgttatattaaaggatgaattatcattgaaatgttttaatacaaaattatataattatctgtgtaatagttttattaaattagactag

SEQ ID NO: 2166 - DNA, 735 bp, Staphylococcus epidermidis
aatccaataaagctaaacaaattcttaaagaatatcaattttctgtataaggagttcagagctatgcctgatttaacgtccttttggatttcttttcgtgttgctttaatcagtacaatgatagttactatttttggcattttgatttctaaatggctatacaataaaaatagatattgggtaaatctattagaaagttttatcattttaccaattgtgttaccacctactgtccttggttttatactattaattatattttcaacaagaagtcctgtaggagaattctttactaatatcttacacttaccagttgtatttactttgacaggtgcagtgattgcatctgtcattgttagttttcctcttatgtatcaacatacagtgaatggttttcgaagtatagattcaaagatgttaaatactgcaaggacgatgggagcaagtgaaacaaaaatattttttaaattggtgttaccattatctaaacgttctattcttgcaggtattatgatgagctttgcaagagcaataggtgaatttggtgctactttgatggttgctggctatatcccagacaaaacaaatacattgcctttagaaatttattttttagtggagcaagggaaagaaaatgaagcatggttatgggtgcttgtattagttgcgtttgcggtaactgtcatagcgaccataaatctggttaatcgtgatacgtttagggaggttgattaa

SEQ ID NO: 2167 - DNA, 1035 bp, Staphylococcus epidermidis
ggaggtccaaaaatgaaagcgctaatacaagataaattaggccgtccaatacgggatttaagaatatcggtcactgatcgatgtaatttcagatgtgattattgtatgccaaaggaaatctttggagatgattacactttcttacctaagaatgaattgcttacttttgaagaattgacacgaatttcaaaaatttatgctcaattgggagttaagaagataagaattactggaggagagcctctcttacgacgcaatctttataaacttgtagagcaattaaatctcatagatggtatagaggatattggattgactactaatggcttattattaaaaaaacatgggaaaaatttatatcaagctggtttacgacgtattaatgtaagtttagatgcgattgaggataacgtttttcaagaaattaacaatagaaatattaaagcgtctacaattttagaacaaattgattatgcaatatcaataggttttgaagttaaagtaaacgtggttattcaaaaaggggttaatgataatcaaattattccgatgattgattattttaaaaataaaaatattgaagtacgttttattgaatttatggatgtaggtaatgataatggatggaatttcaataaagttgtaactaaagaagaaatgcttaatatgatagaacaacattttgagataagtcctgtaacacctaaatattatggggaagttgctaaatattttcgacataaagataatgatgcacaatttggtctaattacgagtgtatctgaatcattttgctccacatgtacgcgtgctcgattatcttcagatggtaaattttatggttgtttatttgcctcctcagagggatttgacgtaaaagccttaatacgcagtggagctacagatgatgatttaaaagcacaatttaaacgattgtggagtattagaaacgatcagtactctgataatcgtacgatgcaaactattgagaataatagaaagaaaaaaattaatatgaattatataggtggataa

SEQ ID NO: 2168 - DNA, 3156 bp, Staphylococcus epidermidis
atgattaaaaaattattacaattttcgttaggtaataaattcgctatttttttgatggtagttttaattatattaggtggcgtttattcaagcgccaaattaaaacttgaattattaccagatgttgaaaatccagttatttcagttcaaactacaatgtctggagcaacaccccagtcaacacaagatgaaataagtagcaagattgataatcaagtacgctcgttggcctacgtaaatagtgtacagactgaatctatacctaatgcttctatagtaactgtagaatacgataatggtacagatatggataaagctgaagaacaattaaaaaaagaaatcgacaaaattaagtttaaagatggcgttggtgaacccgaattaacaaggaactctatggatgcttttccaattgtggcatattcttttacgagtaataatcaaaagttaaaagacgttactaaaaagttaaatcaacagctcgtaccaaaattacaaaccattgatggtgtacaaaatgcacaattaaacggtcaaactaatcgtgaagtatcgttaaagtttaaacaaaaaaatttagatgaaaaaggtttaactgcaaatgatgttgagaactatataaaaacggctacacgtgaaacgccattaggacttttccaatttaataagagtaataaatctattgttgttgatggtcaatttaaatctgtagacgcttttaaaaatcttaaaatccctttatctatttctggacaagctgcacaaaatgatagcgattccgacagtgatagtctaatgccaagtgataatactcgctcgactaatagttcaactcatatggcacagaaaggccaaatgccatctgtaccacttaaagatttagcagatattagtgtcggtgatgaacgtacttctatatccaagacaaatggaaaagatgctgttaacttacaaattatgaaatcacaagatgctaatactgtgcaagttgcgagagaagttcagaaaaaagtagatgaatttgtacgtaatgagagtggaatgaaatctattaaaacaatggatactgctaaacctattgaagactctctttatactatggttgaaaaggccgctctcggtacgattgttgctattatcgttattcttctgtttttaagaaatataagaactacagctatttcaattgtatctataccaatgtcaatattaattgcgctcatagcattaaaattaagcaacgtatcattaaatattcttactttaggtgcattaacggttgcaatcgggcgagttatagatgattctatagttgtcgttgagaatatatttagaagattatctgatccgaatgagaagctcaaaggtgaaaatttaattataagcgctactagagaagtatttaaacctattatgtcatcgacccttgttactatagtagtgtttttaccactagtgtttgtgtcaggttcagtaggtgaaatgtttagaccatttgcgctagccattacttttagtttattagcttcactacttgtttcgattaccctagtgccttctttaggtgcaacattttttaaaaatggcgttaaaaatagggaacaaaaagaaggtctaggaacagttgggagagcctatagaagcgctttgaattggtcacttaatcataaatggattgtgcttatagttagtatttttattttagttggaagtgtggtcataggcgcaagaaatctaggaacgagttatatttcaactggagataataaatttttagctctaacatatactccaaaacctggagaaacacagaaatctgtgacacaacatgctgaaaaagtacaaaattatttagataaaaaagataaagtagaaactgttcaatattctataggtggtcctacaccacaagatcctaccggtagtaccaacagcatggcaattatgattaaatatcaatctgacacgcctaattttgatgaagagcctgataaagtacttaaacatatcgagacatttaaacaacctggagaatggaaaaatcaagatttaggaacaggagcaggtaataattctgttgaagtaactgtcaaaggacctaatacaagtgcaatgaaagatacagtcaaccgtgtagagaaaatgatgactgatattaaaggcataacgaatgttaaatctgatttatcacagacgtatgaccaatatgaaataaaagttgaccaaaataaagctgcagataatggtatttctgctgcacaacttgcgatgaatcttaatgaaaacttacctgagaaaacaatttctacagttaatgaaaagggtaaatctatagatgtaaaggtcaaacaaaataagcaaacagattggtcttctcaaaaaattaaaaacattaaactaaataagcctacgggcggtacgattaaacttagtgaaatagcatctcttaaaaaatcatatacaccaagtaaactgactcaagaagatggcgattatgctacgactgttacaggtaaagtgactgataaagatgtgggtggtaaatctcaacaagttatggctaaagtgaaagaccttgagaaacctagtcatattaaaattaatgtcggcggtgcaactgatgacattgataaggctatttctcagcttgctatggcgatgatagcagcaattatcattgtttatttaattttagttattacatttagaggtggtctggcaccatttacaatcttgttctcattaccatttacggttatcggtgtagtacttgcactcatcattaccggagaaactatttcagttccaagtttaataggtatgcttatgttaattggtatcgttgttacgaatgctatagtattaatcgatcgtgttattaacaatgaaaaacaaggtatgccgatgaaacaggcattgatagaagcgggtggtacacggataagacctatattaatgacagcaattgcaacaataggtgcactagtgccgttgttatttggtcatgacagttcaatattaatttcaaaaggtatggctgcaacagtaataggtggattaatttcttcaacgctactcacactctttgtagtaccggttatatacgaaattttattcactttaaaaaataaaattactaaaaagtttaatatgtaa

SEQ ID NO: 2169 - DNA, 1254 bp, Staphylococcus epidermidis
accatggaaaagatgaacatcactaatcaacaacatgacgcatttgtgaaatctcatcccaatggtgatttattacaattatctaagtgggcagatacgaaaaaattaacaggatggtattcaagaagaattgctgtcggtgaaaatggtcaaattaaaggtgttggccagctactattcaaaaaaatacctaaacttccatacactttatgctatgtatctaggggatttgtagctgattataataataaagaagtgttagaagctctacttagctatgctaaagaagtagcaaaagatgaaaagtcgtatgctatcaaaatagatcccgatgtcgaagtagataaaggtgcagaagcacttaaaaatctacgtgagcttgggtttaaacataaaggttttaaagaaggactgtctaaagactatattcaaccaagaatgactatgattacgcctattgacaaaacagatgatgaattagttcaaagtttcgaacgtcgaaatcgttcaaaagtaagacttgcactgaagcgtggaactaaagtagaacgatcaaatcgcgaggggcttaaaatctttgctaatttaatgaagataactggggagagagatggttttttaactcgagatattagttattttgaaaatatatatgatgcacttcatgaagacggtgatgcagaactcttccttgttaaattagagcctaagccagtattagatacggttaatcaagatcttgaagcacaattagctgagaaagagaaattacaatcaaaaaagcaagataaaaagacacttaataaacttaatgatattgataataaaattaagaaaacaaatgaattaaaatcggatttaacagaacttgaaaaaagcgagccagaaggtatttacttgtcaggagcgctcttaatgtttgcaggaaacaaatcttactatctctatggcgcttcctcgaatgactatcgtgatttcttaccaaaccatcacatgcaatttgaaatgatgaaatatgcacgtgagcatggtgcaacaacctatgactttggtggtacagataatgatcctgataaagattcagaacattatgggttgtgggcttttaaacgagtttggggtacatatttaagtgaaaaaattggagaatttgattatgtattaaatcaaccgctatatcatttagttgagaaagtgaaacctcgtttaacgaaagctaaaattaaaatatcacgtaaacttaaaggtaaataa

SEQ ID NO: 2170 - DNA, 696 bp, Staphylococcus epidermidis
ctttcattgaataaattagaacgtcaaaatcgaattattcaaactattcaaagttctgacaaaattactgcatcccagcttgcaaaacaatttaacgtatctaagagaactattttacgtgatattgatgaattagaagatcaaggggtaaaagtatatgctcgtcatggcaaattaggcggttatcaaatcaaagatgcacatgctaaaatcaccttatcgttaactgaacagcaactttcggcattatttttaacactaaatgaaagtcagtccaattccactttaccttatcaaaatgaaattcgagcaataatcaagcaatgtttaaatttacctcaaacacgattacgtaaaatgctaaaaaaaatggattattatattaaatttgaagattctaatcatgtcacactacctcaattattttctgatattttaatttattgcacggagcgtaatgtgatgttagtagatttaaatgaaaataatcaaattcaagctgaaaatgtgatttttataggcttaatatgcaaaaatgctgtttggcatgctgttgtatttgaaatcggtagaggttacactcgtgaattatctatcctggatattcaagatatctcatattcttttgaaaaaacgatacaaacccaagatatctcaattgaaaattatcgacagtttttagcgccttctgaatga

SEQ ID NO: 2171 - DNA, 792 bp, Staphylococcus epidermidis
gctatcatgaaaattaaacatatttttattattattttaacattgtgtgtagtattagcaggttgtaccaacgagaaaggtcagaataaagaacagaatgaaaaacaatcgacaaaaggtgataaacaagaacttcaagtttctgctgcagcaagtttgactgaagtcagtaaagcattaggaaatgaatttaaaaaggaccatccaaatgtagaaattaaatttaactatggcggatcaggtgcgttaagacaacaaatagaagcgggtgctccgtcagatgtcatgatgtcagctaacactaaagatatagacctgttgaagaaaaaaaacaaagcacatgacacttataattatgcaaagaatcaacttgtattaattggtgataaaaataaaagttatacctctgtaaaagatttaaatcaaaacgacaaactcgcactaggacaaataaaaacagtgcctgctggtaaatatgcaaaacaatatttagatgatcaacatttatatggtgatgttaaagataaaattatttttgctaaagacgtaaaacaagtattaaattatgtggaaaaaggaaacgcacaggaaggattcgtttacaaaacagacttatatcaacaaaagaaaaaagcaaataaagttaaagtcatcgaagaaattaaattaagcaaaccaattacttataaagcaggtgcaacttcagataaaaaattagctaaagaatggattaacttcttaaaatccaataaagctaaacaaattcttaaagaatatcaattttctgtataa

SEQ ID NO: 2172 - DNA, 1275 bp, Staphylococcus epidermidis
agcgtaatgaaaaatttcatattaagtgtgcaacatttgttagcgatgtatgcaggggctattcttgttcctattattgtggggacaagcttaaaattttcagctgaagaaattgcttatctagttactgttgatatatttatgtgcggggtagcgacatttcttcaagcaaataaagtcacagggactggattaccgattgtactaggatgtacgtttactgccgttgcacctatgatactcatcggtcaaacgaaaggacttgatgttttatatggttcgcttttaatatccggtatcttagttgttttaattgcaccttttttctcttatttagttaaattctttccacctgttgtaacaggaagtgttgtgacaattattggaatcaatttaatgccagttgcaatgaattacttggcaggtggtgaaggagcgaaaaactatggcgatactaagaatttaatattaggtggtgttacactactcattattcttattttgcaaagatttacaaagggcttcttgaaatcaattgcgatacttataggattagcaataggtactgctttagctggtatatttggaatggttgatatcaaacaagtgggtgatgcacattggtttggtttccctgtgccattcagattttctggcttcggatttgatgtcagctcaatacttgtatttttcattgttgcagttgtaagtttaattgaatctactggtgtctatcatgcactgagtgaaattactggtagaaaactagaaagaaaagattttcgaaaagggtacactgcggaaggtctagcaatcattttaggttcaatatttaatgcgttcccttacactgcatattcccaaaatgtaggtcttgtttctttatcaggagctaaaaagaacaatgtgatatatggaatggttattcttttactaatttgcggttgtatacctaaattaggtgctttagctaatattattccattgccggttttaggtggggcaatgatagcaatgtttggaatggttatggcatacggcgttagtattttgggtaacattaatttccaaaatcaaaataatttattaattattgcaatttcagtagggttaggtgctggtattagtgcagtacctcaagcatttaaaggattaggagaacaatttgcttggttaactcaaaatggtatagtgcttggcgcaatttctgcaatcatcttaaatttcttttttaatggtataaagtataaacaaactgaagaaaatgtgaaataa

SEQ ID NO: 2173 - DNA, 492 bp, Staphylococcus epidermidis
agaagaattgatactatgattttacaaattgtaggtatgaaaaattcagggaaaactacattgatgaaccatgcgatatcatttttaaaagaacgaggctattcagtagcaacaattaaacatcacgggcatattggtgaagaaattgaattacagtcatctgatgttgaccacatgaaacatttcgctgcgggtgcagaccaaagtattgttcaggggcatcatttacagcaaacagtgacacgtaaaaagaaacaatcgcttagagaaataatagaaaattctgttacaattgattatagtatcattttagttgaaggctttaaagaagcaaattatgataaaattatcgtttataaaaataatgatgaattaagaagtctacaaggactttctcacgtcatagggaaaatagaaaccaatcatccacgtgcaaataatcaacttgagcacttactcaacaaattaattaaggataagggaatgaattaa

SEQ ID NO: 2174 - DNA, 789 bp, Staphylococcus epidermidis
gagttagttgaaatgttaaagaatactcggcttcgaatgacgacattgttcataattagcatactcgtcattttagcaatactttttcttatatttgatacaaacctttttaaaaatgatgttaaacatacatttaaagaagcggtgtctcttcaaacaagtgagggaaatatccatactaaagaagttaatggtaagtttatatatgcttccaaacaagatatagagaaagctatgcaaataaaacatagtgataatgatttgaagtacatggatatatcagaaaaagtacctatgtcagagaaggaagttaaccatatcttaaaaggaaaaggtattttagaaaataagggatcaacgtttattaaagcccaagataaatatgaagtgaatatcctatatctcatcagtcatgcactagttgagacaggaaatggtcaatcagatttatcaaaaggaattaaagaaggtaactatcactattataacttttttggtattggtgcttttgatgaagatgctgtaaagactggtaagagttttgctaaacagaagaagtggaccactcctgaaaaagcgataatgggtggcgcgtggtttgtgagataccattactttaaaaataatcaattgagcttatatcaaatgcggtggaacccacaaaatccaggccaacatcaatatgctagtgatattcagtgggccaataatatagctgatttaatggagaaatactatgataaatatggaataaaaaaagatcatataagaaaaaaatattacaaataa

SEQ ID NO: 2175 - DNA, 627 bp, Staphylococcus epidermidis
gaggcatatgagatgtcaaacccaattaaaattggtatcgggggtcctgttggtgcaggtaaaacccaattgatagaaaaagtggttaaacgccttgcgaaagaaatgagtattggcgttattactaatgatatctatactaaagaagatgaaaaaatactagttaatactggtgttttaccagaagatagaattatcggtgtggaaactggaggttgtcctcatacagctattcgtgaagacgcttcaatgaacttcgcagctatagatgaattattagaacgtaatgatgatattgaacttatttttattgaatcaggtggcgataacttagcagctacttttagtccagaactcgtcgacttttcaatttatatcattgatgttgcacaaggcgaaaagattccacgtaaaggtggacaaggtatgattaaatctgatttcttcattattaataaaactgaccttgcaccatatgtaggtgcttcattagatcaaatggctaaagacactgaagtatttcgtggaaatcgcccattcgcttttacaaatttaaaaactgatgaaggtttagaaaaagttattgagtggattgagcacgacgtcttactgaaagggttaacttaa

SEQ ID NO: 2176 - DNA, 237 bp, Staphylococcus epidermidis
ttaaaatatgaagggactttttcaatgttaactaaagaatttgctcaacgtgtagaactaactgaaaagcatgtccgaaaaattgtacaacatttagaggaacgaggctatcaccttagtaaaacagaatatcgtggtcgtgaagccacagactttaaagaagatgacatcgaattatttacagatatcgctaacaaagttaaacaaacaaatagttatgatttatcatttgaatag

SEQ ID NO: 2177 - DNA, 453 bp, Staphylococcus epidermidis
tatgacaatgaggtgttaaatattttaaccaatgaatttttcaatagttttataggtatatatagaccctatattaaacttacacaacctatattagatcagcatcagattcataccggccaatggcttgtgctaagagatattgccaattatcaacctactacacttgtaaaaatttctcatcgtcgttcaatagaaaagcctacaacacgaaaattgattaaagtattgttagacaatggttgggttatgacaaaaacaggagttgataagagagagaaattattaagtttaactgacaaaggccaaatcctctttgaaactattaataaaaaggtcactgtcattcaacaagatattataaaaaaaactggattaactgatgagcaagtatttgatattacaaatgcgatgtctcaaattcatgaagcaatgataaaggaggagcagtaa

SEQ ID NO: 2178 - DNA, 831 bp, Staphylococcus epidermidis
aatgaaggtgaaattatgacagaactttatttaaaaaaattagatgaatacatatgtcaatggatacgtggtttagacgatatcattccacgtttggttgagaaaatggaaacatcaacaaaaaaagataggtttgatttagttactaatgttgataaacaaattcagaatcattttcaaaactttcttcaggaacattatcctacacatcaattactagctgaagagaaagataactcagatataacaccttacgagggtcacctctggattatggatcctatagatggaacaagtaatttagtgaaacaacaagaagattactgtatcataataggatattttattgatggggaacctaaactttcatatatttatgattatccacatcaaagattatatagagcaattgctggtataggagcctacgaaaacaatcaattaatgacaatgccaaaaagaattggtttaagagaggcaattatttcatttaaaccacaagtgttaaaagaagagacggttcaatctttatttcaatcagcctttgattttagaagtattgggtcttgtggtcttgattctattcgagtgataaaaggtcagtttggggcacacattaatacgaatcctaagccatgggatatttcagcacaatttctttttgcaagagaactaggtttgattatgacacaaataaatggtgaacctcttgattttagtaaggcgggcccatttattattagtaatcctggttgttacgatgatatgatacgtatcttaaatgaaggcggaggttattcaaagagtagtcatcatatcgagcgtggttaa

SEQ ID NO: 2179 - DNA, 813 bp, Staphylococcus epidermidis
ttaaagttagattttgttaaaatgagcaataacatgtggagggggataaagttgaacttaaaattagaccatatcattcactatatacatcaattagagtcatttaagtttcctggagaaatattagaattgcaaaatggtggaagacatcatcatttgggcacctttaatcaaatagcaccgattaaaaatagttatatcgaattgctagatgttgaaaatgagtcaaaacttaacaatgtagctaaaactgaagaaggtcgtgtatcatttgctacaaaaatagtgcaggatcattttaaacaaggctttaaaggtatttgctttagaacaaaggatatagatcaggttaaaagttccttagaaaatagaggcgttgatgtgataggtcctattgatatggaaagagaaaataaaaaaggtcatcaattaagttggagattgctatatattgctaaccctgactatagagtcaaaccacctttctttatagaatgggataacagcaaaaagcaaaacctatcacaaatacataatttcaacttgtcatcgtttaaaattaaagaggtgattattactagcactcaacgtgaaacaacagtaagtctttggaaagaatggtataacctgaaaatagtaaatgaaacggctacatctactgatctcaaattagaaactgatgaagttatctataaaatagaagacggcaaagattcaggttttcatacattaataatgaccgatatcaatgccacagcaccatattcaatatttatacgtggtgctaaatatcgttttgagccacccaactag

SEQ ID NO: 2180 - DNA, 195 bp, Staphylococcus epidermidis
ccctttgaagaggagaatgatacgatggacttgaattcaaagttatcagaacttaaatatgattatacacgattacaaaacgatttagaaaaacgtgagtcgcttcatcaagatattgaccctctacttaaacaacttgaaaatattgaacaagaaatctcctatatacgttcaaaattaaatcaacaatcttaa

SEQ ID NO: 2181 - DNA, 750 bp, Staphylococcus epidermidis
ctaagaaaggattatcatcaaatgcaacaacagaagattaaacgattcttagcccattttgtattagatcacgtcacaatagaatatttgaaatatggccaccagttgacaattgaacagcttaaattattaatatttatattacatttcactgaaaatcataaagaagatttaagtttaaatatgatcatcttttacaaaaattatcaaaaaaaccaattgttaaaaagtattacacatctatatgaatttaattggatttcaaaaaaacgacatccatacgaccaacgtagactagttattacattaactcaaaatcaatgtagtaaaataactcaattaattgatgaattagaacacttcttagaggtgaaatctacattaataaacgaaattaatcattcaactttattatcgtattatttaaagtgccatagtcaatttagggtaattgaacaatcttgcacatctcaacatttaacattagaagaattataccttcttgggttacttatcgttagtgataacaagactacatttaaaagcataaaagtacatgctttgaagggaatcattgcaatgggacctattattaagaccttacagtcaaaaggttatctcattaaaagtcggagtagagatgatgaacgctatattgtattaacacttagaaaagaaaaaattaatgtgattcagtcagaaatcgaggaatgttacaataaattagaacagggaatacagcatgtgtaa

SEQ ID NO: 2182 - DNA, 213 bp, Staphylococcus epidermidis
agaatgaattggaggtattcaaaaatgggctatattatcctatttttcatagcaggtccagtaattataggagtgggtaatcttatattgggaccgatatttaataaacgtacacctttacatgttcaatttcgatcgtttattattggctctcttgtgtaccttattctcgccacgatctgctattttttgtttcttcaaggcaaattataa

SEQ ID NO: 2183 - DNA, 786 bp, Staphylococcus epidermidis
attacgttctgcaaaagtaaatttaaaaatggtgatccatttactattgcactttttggcgtagattctgatgaaaagcgaaagcaacaaggcggtggggaacgaagtgatacaatcatggtactttccattaatccgaaagaaaagaaaactgagctagtaagtattccacgtgataccaaagcagaaatagcaggtcgaggtactgaagaaaagattaaccatgcatacgcttatggcggtcctaacatggctgttaaaacaattgaaaaattaatgaatgttccaattgaccattacgctacgattgacatggatggactacatgacatgattgatacattaggtggcgttgatgtcgtaagtaatagtacatttacaatgggggctaatcactttgttaaaggtgaaaaaacacacgtagatggtgatgctgccatggactttattagaagtcgtaaagaagatggggcaggaggcgattttggtagacaagagcgtcagcaacttatcttagaagcgatggcagataagttgacaagcgcttcttcaatcactcattttaatacattaatgaatcaaattcagaaaaatgttaaaacagatttaaaattaggtgatcttaatacaattagaactaagtataaagatgctaatgaccaagttaatcgacatcagttagagggtgaaggtggtatacaaaatgacggtttgtactatttcataccaagtgatgcatctaaaaatgaaaatacacaattactaagagataatttaaatttataa

SEQ ID NO: 2184 - DNA, 1008 bp, Staphylococcus epidermidis
ttgtttgcgctttcttattttactatactattcataaaagaaggagtgatggttatgacaaaagtttatattgcaggcgcaatacctgaagtgggacttaacttattgaaagaacattttgaggtagacatgtatgatggcgaggggcttatcgataaagaaaccttaaaaaaaggggtagaacatgcagatgcattagttagtttactatcaacttctgttgataaagatattattgatagtgctaataaccttaaaattatagcgaattatggtgcaggttttaataatattgatgtcgaatatgcaagacaacaaaatatagatgttacgaatacaccacacgcttcgacaaatgcaactgctgatttaacaatcggtttaattttatcagtagcgcgtagaattgtagaaggagatcatttatccagaacaacaggttttgatggttgggcacccttattcttccgaggcagagaggtatcaggaaaaactattggtattataggtttaggtgaaattggaggtgcagtggctaaacgcgcacgcgcatttgatatggatgtactgtacactggtcctcatcgtaaagaagaaaaagaacgagatatcggtgcgaaatatgtagatttagatactttacttaaaaatgcagattttattacaatcaatgcggcatataatccatcactacatcatatgattgatactgaacaatttaataaaatgaaatctactgcctatctaattaatgcaggacgtggtccaatagtaaatgaacaatctttagttgaagcacttgataataaagttattgaaggtgctgcattggatgtatatgaatttgagccagaaatcactgatgcattaaaatcatttaaaaacgttgtgcttacacctcacattggtaatgcaacatttgaagctagagatatgatggctaaaattgttgcgaatgatacaataaaaaaattaaatggtgatgaacctcagtttattgtcaattaa

SEQ ID NO: 2185 - DNA, 549 bp, Staphylococcus epidermidis
tacaattatagttgcattaagtcattttttttacaaatggaggtaaaacctattatggacaaacacacgaattacaatgaattagaatctaagaatgtgtctgatcaaacttcatcagacaatttatcgaatgacaatatagtacaccagcaatcaactattcaaaatgaggaaagtcaagataatcgtttaatggcaatgttaatttatttattaagtttatttactggtatcattggtcctttgattatttggttaatcaaacgtaaagagtcccgacttgttgatgtatctggaaaaacgtatctaaactattttatttcttatactatctattcaacagtaggcgtgatatgtatgtttatgattgttcctttaatgaatataagtgaaagtttagccatcttttcattgattttgttgctggtggtagtttttatcttattagcattgttaataatgtcatttgtgtgtacaattattgcttgtgtaaaatatatgtcaggcaaaacttacactatcccactcacgataccgtttataaaataa

SEQ ID NO: 2186 - DNA, 333 bp, Staphylococcus epidermidis
aaagggtggctctttatgaaactttatcttattttattgcctgttttatacttaattgtttcgtacattagtatttttaaaatgcattctgtcataactcgaatcttgagaattgttatgggcatattgttactatttgtagttgctttgacaacgttacaattccctaaagaaaattggtgggtatttgtcgttttattgcttttagttggtaatgttgaagtgactggttttaaagaattaaaagatgataaaaaaggtgttagtatcttgaatatcttatcacttttattatttgttatatttattattttaatttttatactatattaa

SEQ ID NO: 2187 - DNA, 1485 bp, Staphylococcus epidermidis
aattggaggctgtttttaatgtgggaaaataaatttgctaaagaatctttaacattcgacgacgtgttactcattccagctgcatcagatgttttaccaagcgatgttgacttaagtgtcaaattatcagataagatcaagttaaacattcctgttatctcagcaggtatggatacagtaactgaatcaaaaatggcaattgctatggctcgacaaggcggtttaggtgttattcataagaatatgggcgtcgaagagcaagctgatgaggtacaaaaggttaaacgttcagaaaatggtgttatttctaacccgttcttcttaacaccggaagaaagtgtgtatgaggctgaagcattaatgggtaaataccgtatctctggtgtacccattgtcgataatcaagaggatcgcaagttgattgggattttaacaaatcgtgatttacgttttattgaagatttttcaattaaaatatcagatgtaatgacgaaagataatttaataacagctccagttggtacgactttagatgaagccgaggctattcttcaaaaacataagattgagaaacttccattagtagaaaatggtcgtttagaaggattaatcactattaaagatattgaaaaagtacttgaattcccatatgcagctaaagatgaacatggcagattgttagctgcggcagcaatcggtacgtctaaagatactgaaattcgtgcacaaaaactagttgaagctggcgtagatgcattaattattgatacagctcatggtcattctaaaggcgttattaatcaagttaaacacatcaaggaaacatatcctgaaattactgttgtcgctggtaacgtagcgactgcagaggcaacacgtgctttatttgaagcgggtgccgatgttgttaaagtaggtattggtccaggctcaatttgcacaacacgtgttgttgcaggtgtaggtgtgcctcaaattacagcagtttatgattgtgctacagaagcccgtaagcatggtaaggctattattgctgatggtggtattaagttctcaggtgatattatcaaagcattagctgctggtggtcatgcggttatgttaggtagtttgttagctggtacagaagaaagtcctggtgcaactgaagtattccaaggtagacaatataaagtttatcgcggcatgggatctttaggtgctatggaaaaaggttcaaatgatcgttacttccaagaagataaaacaccaagaaaatttgttcctgaaggtattgaaggtcgtacagcttataaaggaccattacaagatacaatttatcaacttatgggtggcgttagagctggcatgggttatactggttcagaaaacctaaaaaaattacgtgaagaagcacaatttacacgtatgggaccagctggcttagctgaaagtcatcctcataatgttcaaattacgaaagaatcaccaaactattctttctag

SEQ ID NO: 2188 - DNA, 345 bp, Staphylococcus epidermidis
tgcaacgaaagaagggagataaaaagtatggcttggttatttctaatgatagccggaagttttgaaattttgggtgttgttctgttaaatgaactgtcacgtacaaagaataaaatttatgtcatttttttaggattagcatttatattaagctttagtactttaaaatttgcaatggtatctattcctatggggactgcatacgctatatggacaggaattggtacagctggtggtacattaattggaatgattttttatggagaatctacacgtttaagtagaattttatgtattttattaatcatcatttcagttgttggattacgtttaataagttattaa

SEQ ID NO: 2189 - DNA, 1722 bp, Staphylococcus epidermidis
ataagcatgagttttaaaatgacacaatctcaatacacaagtctttatggaccaactgtaggagactctgtgagattaggagatacgaacttgtttgcacaagttgagaaagactatgcaaattatggagatgaagctactttcggtggcggaaaatcaattcgtgatggtatggctcaaaatcctaatgtgacaagagatgataaaaatgtagccgatttagttttaactaacgcattaattattgattatgacaagattgttaaagcagacatcggaattaaaaatggttatatttttaagatcggtaaagctggaaacccagatataatggataacgttgacatcatcattggtgcaacaactgatattattgctgctgaaggtaaaattgttactgccggcggtatcgatacacacgtgcactttatcaatcctgaacaagctgaagttgcacttgagagtggtattacaacgcatatcggtggaggaactggtgcttctgaaggtgctaaagcgactactgtaacaccaggaccttggcatattcatcgcatgttagaagcagcagaagagatgcctattaatgtaggatttactggtaaagggcaagctgtcaatcatactgcacttattgaacaaattcatgcaggcgctataggtcttaaagtacatgaagattggggagctacaccttcagcattaagtcatgcattagacgttgcagatgagtttgatattcaagtcgctttacatgcagacacattaaatgaagctggatttatggaagatacaatggctgctgttaaagatcgtgtattgcatatgtatcatactgaaggagctggtggtggtcatgcacctgacttaatcaaatcagctgcatattcaaacatcttaccttcttctacaaacccaacattaccttacacgcacaacactgtagatgaacatttagacatggttatgatcactcaccatcttaatgcttcaataccagaagacattgcatttgcagattctcgtatacgtaaggaaactatagcagcagaagatgtattacaagatatgggcgtatttagtatggtaagttcagattcacaagcaatgggacgtgtcggtgaagttgtaacacgtacttggcaagttgcacaccgtatgaaagaacaacgcggaccactagatggtgactttgaatatcacgataataatcgtattaaacgttacattgcaaaatatacaatcaatcctgccattacacatggtatttctgactatgttggatctgtggaagcgggtaaacttgccgatttagtaatgtgggaaccagaattcttcggtgccaaacccgatcttgttgttaaaggtggcatgattaactctgcagtaaatggtgatgctaatggctccataccaacatcagagcctttgaaatatcgcaaaatgtatggtcaatttggtggtaacattacacatactgctatgacttttgtttctaacactgcatatgaaaacggtatttatcgtcaactcaatctaaaacgaatggttcgaccagttagaaatattagaaatttaactaaggcagatatgaaaaataataatgctacacctaaaatagatgtagatccacaaacatatgaggtattcgttgatggtaataaaatcacaagtgaagcagcaacagaattacctttaacacaaagatacttcttattctag

SEQ ID NO: 2190 - DNA, 774 bp, Staphylococcus epidermidis
ttattggtgagtggaaaggatacaatgatgaaaaaagataaaaaaaggcaaagttataggtttaaagatatagtatggcgtgatttcagtttaattgcgataggctttctatgtatatttatatttagctttataggtttaacaattgctgctatagcttttcaaagtattaatgaattacaacttactatgattggaactctaggacaatttatgtcatatattttagtgatattagctttttattttttacatatcaattcatttgtagatagagttaagagtggttttgattatttgaaaaagcattggttgtttataattatcgtcatgtgtgcatcttttattatttctaatgtttatgacaaattaattgaactattacctaaatatttgcaatatagtgaaacgcaaaatgaacttgaactcaatgaattatttaaaagtggtatatttattccttttgcatttgtacttattgtaattgtaggacctattgttgaagaattggtatttagacatttgttaataggtgaactaggtaaaaagtttaactttattgtgatgggggttatatcagcattgtcttttacatatatacatgtgagtgatgctaagtccccatttgaatttggagcatatttaatactggcaatagcattagtatatgtttacttaaaatcgaatagaaacttagcttcatcaattagcttacatatgttaaataatttcatatcattcatttggacaattatagttgtattcagtaaatga

SEQ ID NO: 2191 - DNA, 207 bp, Staphylococcus epidermidis
aaaaaatggaggtcgctcatcttgactattattatcggactcattgtaattattttgttaatcattagtttacttccaaattataaagcaatggtattagctaagcagcaaggccaaaaacctacacgatatactattatggtaggcattgatttattattaattatacttattatagtaacattagtattaaaattgattatgtag

SEQ ID NO: 2192 - DNA, 690 bp, Staphylococcus epidermidis
ataatattagggagaggatataacatggaatttaaagtgatagaatcagctaaagatccattatttaacgaggcactcaaattatatgatgataaattggatattggtttagatgaagatagtaaaatttttaaacgctcacttgaaaataataaaacagaaaatgattacgcctttatcgttggaattgaaaaccagactgtagttagcttagcaactgcacattacgaagcaacaaccaattctgcatttttaatttacttaatcgcaaaagaaagccccaatcatgatgaaagaatgtccttaactttagaggcaatagaaaaacaattaaaccttttatcacaagaagttcataatagagatattaatttcatcatgttagaagttccaaaagaaccctcgactgctaacatcgatgacaagctcagaaatgcactagaacatcgtcgtcaattcctctttgaaaatcaatttgaaaagcaggacgacattgactatattcatccaaaccaaaatcaaaaggaaacgccacaaaaagtagatttatttattaaagctaacattgaattaacaaaggacatttatggtacaagtgtcaaatctaattatattcttaaatatgtttttgcaaatggcatttcaagagaaattatttaccctctcctaaaagaaatgaatttaagatag

SEQ ID NO: 2193 - DNA, 750 bp, Staphylococcus epidermidis
tcataccaaggtgttgaattgattggcatctcagcaggtgaaaccaaaaatcctcaaacaaatattgtaaaggcagtcaacggagtgatatggagaattttaattttctatattggtgcaatttttgtcattgtatcagtatatccttggaaccaattaggtagtattggtagtccttttgttgcaacgtttgctaaagtgggcattacgtttgctgctggtttaataaactttgtagtcttaacagcagcattgtctggttgtaattcaggtatttttagtgcaagtcgaatgatttatactttggcaaaaaaaggacaaatgcctaaagtatttactaaagtaatgaaaaatggcgtacctttctacactgtatttgcagtatctatgggaatattaattggtgctttattaaatgttatacttccattaattattgatggagctgatagtatctttgtatatgtatatagtgcctctattttaccgggaatgataccttggtttatgattttatttagtcatctaagatttagaaggttacatcctgaaaaggttcacaatcatccttttaaaatgccgggaggggcaattgccaattatttaactatcatgtttttactcctagtattagtcggtatgttacttaacaaagaaactgtagtatcggttgttattggtatcgtgtttttaacagctgtgacactttattatcttattagatatcacaaaaaggaacgacaaatataa

SEQ ID NO: 2194 - DNA, 255 bp, Staphylococcus epidermidis
agcaaaaaaggggaaagcaagatgaaaattttatattttgcagagttaaaagagttgctcaatcaatctactgaaacgatacatttagatacgacattaactgttcaggaattcgagtcatatttattaaaacaccatagtgaacttaaatctaaaaaatttcaaattgctgttaatgaagaattcgtcagacaggatgatatagtccaaccaggagatacaattgcgctcattccaccggtcagtgggggttga

SEQ ID NO: 2195 - DNA, 657 bp, Staphylococcus epidermidis
atattgaaaggagatgacaatatgtataaagctgtagtgtttgattttgatggtactgtcattgataccgaaaagcatttgttcgatttaataaatacacatttaaaaatccatcaagtagcgccgatttctttagaattctataaacaatttattggcggtgaagctactgaattacatacatatttagaagatgctattggtttcaaaaataaagaaaaaatttatgatcaatattatcaaacaagtgttgaattgccggtaaatcctacaatcattcaattgatgcaatatttaaaaaaacgtcatatcccaatggcgattactacaagtagttataaaaagaatatatatcctatatttaaacaattaggactagatacatatattgatgttgttgttggtcgtgaaaatgtcgatagtgttcaacctaatccggaaatttttttaaaagccgtacaagagcttaattataatcctacaaattgcttagcaattgaagattctgtcaatggtgctactgcagcgatgctagcaggattagatgttgtcgttaatacgaatataataacgaagaatcaagatttttcgacagttcaatgtgttggacaagatatggaatttgaagatataaagaattttttatttaaagaatga

SEQ ID NO: 2196 - DNA, 237 bp, Staphylococcus epidermidis
ctagtagaaggccatactaagccaagtgattgtttgaaagttcgtgatgatatgcttgggaaatgccataaactatttactgagagaaaagagtttacaggtgatacgccagtaattgttaatattggcgaatgggatgagggcgatgaagaagataaacagagagctctagataaaataaaagaaaactatcctaatagaactatgattgtggatgatataccgttagaggattaa

SEQ ID NO: 2197 - DNA, 378 bp, Staphylococcus epidermidis
tacataagaggaaaactaacaatgacagatgcaatcactgcacctgtcaaagtaaatacaactggtaagtgtaagatattagtaaagaattctcctacaggacttcttgttgaaaatataattaatagtataaaaccaaggacagtaggtggtaacacaattggtaaaatgataaaactttctaatagatttacccaatatctatttttattgtatagccatttagaaatcaaaatgccaaaaatagtaactatcattgtactgattaaagcaacacgaaaagaaatccaaaaggacgttaaatcaggcatagctctgaactccttatacagaaaattgatattctttaagaatttgtttagctttattggattttaa

SEQ ID NO: 2198 - DNA, 795 bp, Staphylococcus epidermidis
ttttcaggaggatatttaacaatgaaaaaaatcgctacagctacaattgcaactgcaggaatcgctactttcgcttttgcacaccatgatgcacaagcagcagaacaaaacaatgatgggtacaatccaaacgacccttattcatatagctacacttacacaatcgatgctgaaggtaactaccactacacttggaaaggtaactggagtccagatcgtgtaaatacttcatataactataataattataataactacaactactatggttacaataactatagcaactacaataactataataactacagtaattacaacaactatcaatcaaacaacacacaatcacaaagaacaactcaaccaactggtggtttaggcgcaagctattcaacatcaagtagtaatgttcacgttacaacaacttctgcaccatcatcaaacggtgtatctttatcaaacgctcgctcagcatctggtaacttatacacttcaggtcaatgtacatattatgtatttgacagagtaggtggcaaaatcggttcaacatggggtaacgcaaacaactgggcaaacgctgcagcacgttctggttacacagtaaacaattcaccagctaaaggtgcaatcttacaaacgtcacaaggtgcatacggacacgtagcatacgttgaaggtgtaaacagcaatggttcaatcagagtttcagaaatgaactacggtcacggtgcaggtgttgtcacttcacgtacaatctctgcgagccaagctgcttcatataactatattcactaa

SEQ ID NO: 2199 - DNA, 1164 bp, Staphylococcus epidermidis
gtcatagggggcgtaaatgtgatggagtcttttttaattcacactgacattcaaaagaagtggattcgtaaatttaaaaagattgaaagtgaattcaaagcacgtgcagctgaaaatgatattcaatctagatttccatatgaaaatattgagtggctgataaaggaaggatatactaaactaactttgcctgtagagtatgggggtgaaggtgctactattgaagatatggtaattttacaaagttatttgggtactattgatggagcaactgctttatctatagggtggcatttgagtgtaattggtcaattgtacgagcaacatatgtggacaccatcaatgttagattcctttgctaaagaagttgttcacggtgcactgatcaatagagcagtcagtgaagcggaaactggtagtcctactagaggtggtcgcccatctacacatgctgttaaagctgaaaatggttatgttataaacggtgttaaaacctttacatctatgagtaaggcgttgacacattatattgttggcgcgtatgttgaagaaactaaatcgatgggattctttttaattcctcagtcaactaaaggtgtaagtattgctgacaactgggatatggttggtatgagagcgactgagagccatgatttaattcttgatgatgtttatgttcctaatgaaaattttgtagaatcaaaacgtgaatcaagacctaatggttggcttcttcatataccgagctgttatctaggtattgcacaagcagctcgtgactatgcagtagattttgcaaaaaattatcgtcctaacagtattacaggtacgattgatagtttacctacagtgcaacaaaatttagggaaaatggaaagtttattactttctgcaagacattttctatggagtacagctagagggtatcaatcatatacagaggatgcacaaatatggaatgaaacctcagcaagtaaagtggtggtaatgaaccaaagtatagaaatcgttgatttagctatgagaatagttggagctaagagtctagaaatgagcagacctcttcaacggtactatagagatatacgtgctggattacataatccaccaatggaagatatggcttacactaatattgctaaaagtattacaaacaaactttaa

SEQ ID NO: 2200 - DNA, 456 bp, Staphylococcus epidermidis
gtcatgattatagaagaaattcaaggaaatattgctaatttatctcaagatgaaaagcaaaaacatgtcgaaaaagtttatcttgaaaactcagatttggttaaacgtatacaacgtgttaaaacagatcacggtaatgaaatagggatacgtcttaaacaacctattgacctacaatatggtgatattttatatcaagacgatacaaacatgattattgtcgatgttaatagcgaagacttattagttattaaacctagaaatttaaaggaaatgggagacattgctcatcaactaggtaatcgccatctacctgcacaatttacagaaactgaaatgcttattcaatatgactatcttgttgaagatttattaaaagagttgggtatcccctactcacatgaagacagaaaggtcaatcaagcatttcgacatataggacattcgcatgattga

SEQ ID NO: 2201 - DNA, 918 bp, Staphylococcus epidermidis
atggaggctataaaattgaaattgataaaagtaattttaagtagtatctctcaagtggttttaattaataatccatatactgggttattcattttaattggactgtttgcagtgaattggaaagtaggaatcagtgccatgattgcaagtgtaatgacttggatattggcaccatatatgaattacacaaaagaagaaatcgaaagtggattagccgggtttaaccctgtattaaccgcaattgcacttactttatttttggatagcaattggagcggtatattaatcacattcgtagccactattttaacgctaccgattggagcagcgattagagaagtattgaaaccacataaaatagcatttctaactagtccgtatgttattatgacgtggattacattattaatacctaatcaacttaaaacgttacatactcagattgatattattccggagcatatagaaaaggtatctttaaataatgaccacaccagtgttcatttttttcaatcagttttagatggatttggacaaatatttttaatgcccagcataataggtggtttgttaattctaatagggatttttataggttctaaaaaagctggaattgtttctataattgcaaacattattgggttcctaataattatattactgggtggagactatagtagtataaatgaaggcatatttggctataatgtagttttatctgcgattgcgctaggtgtcacttttgagacagcaattcatagttatctcgcaatgattttaggaatagtactcactgcattcatacatttaggtttgagcacattgctcgcaccactaggtttaccaactttaacatggccatttatttttgctacatggattatgttgtttgcaggaattaaaaatcaaactgtataa

SEQ ID NO: 2202 - DNA, 1983 bp, Staphylococcus epidermidis
ggaagacatatgagagaaaattattcgatacgtgtttttaataatttagccattaatacagaaaatgcactgagtgtaaaggtattttattgtttgaaagggaaatgtgaagtcactatcaatgttcagaaacatatattagaaaaagatgatatagcatttgttgtaatgaatgatacgtattcactgttaagtaatacagagaccatgtgttgtattatcgatatacctatacatcgatatcttagtcagaaggatactcaatttttaataagtggtacaaagattgatgaaagtagtagagatagaataaaatattggatattaaaaatattagagctccattgtttatcttataatgatgtgtccgagatacaaaggttgatacaatttttacttattgaattgagttatctaaagaaaccaaaacttgatgtaaataaagatttttatttatctgaagatatacatcaatatttagtggatcatcatgacagtaaaatcaacaaacatgaactagctgaagctgttaacctatcaaatcaagcacttacatctatgtttaaacaaacgccatttcaaacatttaatcaatatttaaatcaacttagattaaaattttgtcttatagatattttgacaacccataaacctatcgaagaaatagctatagatcatggttttcatcattattctcgatttatacaattattcaaaaatacatatggttacacacctaaattgattagaagagattatatagcgacgtctatcttcaaaaatactgctgaagaaattgatttagatagacattttcttatgaacattcacgaattacaagatttagattcaaaaataataagtaaaaaatatattaagatgtcagataaaggaaaaaaatatcgatcttatgatatttatattgaagataaccgaagtactattcttgatcaggagcagatagttcatataaagcgtaatttaagtttaagtcaaaaatcaatgcgttatgtaatagaacttaactacacttctatgattgaaaacaaagagttatgtcgttatgagatgttgaaaattttacgtttttgttccggtttgaatttaattccaacatttaaaatcattaccgatcgacatgatacttttacatcaaaggaaaaaatggctctgaagttaacatttcaaatgttattcatcatgcttagggaatttaatcaacttgagattgaatttatagtagaggacatgatgttaaaacaagtggtgcagttaaaaaagatgattagctcttattttgaatattataaattaaattatcgtattaaaaatgagaaaattggaaatgttaattatcaaaatttagaaaaacaagtgactcaaattttcattcctattgatcaattacatttatatattaaagagatatcatttgaaaaagtcattttggaaaccagctatttgaccgatttaaaaagtgagattgtagaatattcatggattcaacatattcatacattaattaaaatgagtggagaagtgaggggagttttaatacaaccgtcctatgattacgctgccacatacacatatcattcaaatttaaaaccgtatcatatcttgtcttatgtaataagaatgtttaaccaattaaggggtacaatcgtctataaagatgatgcaatcattatgactaaatataagtatgaatatcaggccattgctatctttttaaaaaataggattaaggaaaatgtaaaccatcaacaattaattttttcagatattcaatcactcaaccatgcagaatatgaatatatagaaatgatgccacttttaatgaatgagaataatgagctagatagtcatataccatacccacatcaatattggttagcaaagttgaagagtaaagaaagccaacaagcaatagttgatcttcctaaaatgagtattgctcatttaacatttctttgttcgtag

SEQ ID NO: 2203 - DNA, 1557 bp, Staphylococcus epidermidis
aggagattcatgactatggaaatggcgaaagagcaagagctgattcttgttttagactttggtagccaatataaccagttaattacgcgtcgtatccgtgagatgggcgtttatagtgaattacatgatcacgaaatttctattgaagaaattaaacgaatgaatcctaaaggtatcattctttcaggtggtccaaattcagtgtatgaagaggggtcatttaccatcgaccctgaaatttacaatttaggtattccagttttaggtatatgttatggtatgcaattaacgactaagcttttaggtggtaaagttgagcgtgccaatgagcgtgaatatggcaaagctacaattaacgctaaatcagatgaacttttctttggcttaccttctgaacaaacagtatggatgagtcattctgataaagtaattgaaattcctgaaggatttgaagtgattgcagatagtccaagtactaattatgcagctattgaagataaaaaacgtcgcatttacggtgtacaattccatccagaagtacgtcacactgaatatgggaacgacttactaagaaacttcgtccgccgtgtttgtaattgtacaggtgaatggacgatggagaatttcattgaaattgaaattgagaaaatccgtcaacaagtaggtaatcgtaaagtattatgtgcaatgagtggtggagtagattcatccgtagttgctgtacttttacataaggcaatcggcgaccaattaacatgtatttttgtggaccatggtctattacgtaaaggtgaaggtgacatggtcatggagcaattcggtgaaggttttgatatgaatattattcgtgttaatgctcaagaacgcttcatgagtaagctaaaaggtgtgtctgatccagaacgtaaacgtaaaatcattggtaatgagtttgtatatgtctttgatgacgaagctgcgaaattaacagatgtagatttcttagctcaaggtacgttatatacggatgtgattgaatcaggtactaagacagctcaaacaattaaatctcaccataatgtaggtggattacctgaagacatggaatttgaacttattgaaccaatcaatacattattcaaagatgaagtgcgcgcattaggaatagaattaggtatacctgaacacttagtttggagacagccgttcccaggacctggattaggtatccgtgtacttggagaaattactgaagataagcttgaaattgttcgtgaatcagatgcgattttacgtgaagtgattcgtgaggaaggtcttgaaagagatatctggcaatactttacagtacttccaggtattcaatcggtcggtgtcatgggagactaccgtacgtatgatcatactgtaggtattcgtgcggtaacatccatcgatggcatgactagtgactttgctagaattgattgggaagtcttacaaaaaatttcaagtcgaattgtcaatgaggtggaccacgttaatcgcgttgtctatgacattacctctaagccaccaagtacaattgagtgggaatag

SEQ ID NO: 2204 - DNA, 207 bp, Staphylococcus epidermidis
tctttatacataaggcacctcgttaaattagtttattggtatttattaaattatacgaaagggccatattttttaaagtattttaatataaaattacatataagcacaaagtattttggcgagactcttgagggaacaggacaagctgaagactacaggctgaagctgtccgataagaaagcgagccaacaatacgaagtattgtaa

SEQ ID NO: 2205 - DNA, 804 bp, Staphylococcus epidermidis
ggaggtaacatagtgtttgaagaattagaaaataaagtggttcttattaccggagctgccactggaattggtaaatctattgcggaaaactttggtaaagctaaggccaaggttgttataaattaccgttctgatcgacatcatagtgaaattgaggaaattaaacaaactgttgctaaatttggtggtcaaacattggcagttcaaggtgatgtttcaattgaagaagatattaaacgaatgatcgaaacaacaattaatcactttggaactttagacattataattaataatgctggattcgaaaattcaatcccaactcatgaaatgtcgattgacgactggcaaaaagttattgacataaacttaactggcgcctttgtgggttcaagagaaaccatcaatcaatttttaaaggaaaacaaaaaaggtactattattaacatttcgagtgttcatgacactattccatggcctaattatgtacactatgccgcaagtaaaggtggcttaaaattaatgatggaaacaatgtcaatggaatatgcccaatacggtattcgtattaataatatatctcctggggcaattgttactgaacacactaaagaaaaattttctgacccaacgacacgtgaagaaacaataaaaatgatacccgcacgtgaaattggaaatgctcaagatgtagctaatgcagtactattcctatcttcagatcttgcaagttatatacacggtacaacattgtacgttgatggtggcatgatgaactatccagcatttatgggtggtaaaggttaa

SEQ ID NO: 2206 - DNA, 873 bp, Staphylococcus epidermidis
ttgccaaacattttgtataagattgacaaccagtatccctatttcactaaaaacgagaaaaaaattgcgcaatttattctcaactatcctcataaagttgttaatatgacttctcaagaaattgcaaatcaattagaaactagttctacttctatcatacgtctaagtaaaaaggtaacacccggtggctttaatgaacttaaaacacgtttgtctaaatttttacctaaagaagtcacacaatataatgttgagttagttgataacgaaagtacaatttcacttaaaaacaaattgcattctcgctctaaggcagcgttaagtaatgctaatgaaaccattaacgctgctatcatcgatgaaatttgtgatctaattaaaaattctgaaaccatatttatttacggctatggtgcctcatttgttgtagcaacagatttatatcaaaaattatctcgcatcggtctaaatattcaactagtgcatgaaactcatattttcaccactatgttagcaacacgtaactctaatgattgtgttatatttatatctaacaatggtactcaaagtgaaatgcaatctattgctaaagtcattgcagactatcacattcccattgcgactatttcaagcacttctgataatccagttgcaaagcaatctaatattgttttaacctatggacaaaccgatgaaaatgagatgcgtatgggagccacaacttcgttatttgcacaaatgtttactattgatatattgtactatcgatatattgcgctaaattatcaatcatctttagattttattactcaatcaaaaattgcattagataattaccgtaaacatctctcgaatatagattttaaacattaa

SEQ ID NO: 2207 - DNA, 699 bp, Staphylococcus epidermidis
gacattcgcatgattgatcaccaacatttaagactttttcagttctgtgattctcagtttcctacaggtgcatttagtcattcttttggacttgaaacatatattcaacgagaaactgtacatgatactgagacatttattaaatggttacatttgtttataaacgaacaattaacttattcagatgggttagctatgagaattgtctaccacgcattaattaacaatgacaaagataaaattttagatattaaccaaaaactcttcgtacaaaacctacctaaagaaacgcgtattggcgctaagcaaatgggtacacgcatggtaaaattagctttagatctttatgatagtgaatggattcaatggtattataatcaaatgaaaaaccataaaattaagcttcatcctgctgtgtgctttactatgctaggacattttttaggtgtagatgtggaatccatcattgattattatttatatcaaaatatctctagccttacccaaaatgcagtaagagcgattcctttaggacaaacagctggacagcaagtcgtaactgaaatgatagcccatattgagaagacacgaaatcacatactagaattggacgaaatcgattttggtatgactgctcccggcttggaacttaatcaaatggaacatgaaaatgttcatgttcgaatctttatttcatag

SEQ ID NO: 2208 - DNA, 588 bp, Staphylococcus epidermidis
aatataagcattcatatcattttcatacatatattgttaacgattggaggtccccatatgttgattgataaatttgaaacctacatcattaatgttgcaggtttgaaatctcgctcaacgcgaaaaaaattaatacatttatgtaaagaaattactttttgtgaatcttttcagtattctatcattaagcaaaacaatgtgttcgcattggaagttagcctccccaagctacaactaccttatctgataagtttcttaagtttccacaattatgctatttatcaaatacttttacccaaccgtgtaaatgaacttcttgattcagaacaactttaccaatctattaaacgctttgatttagcgatcgatggtttacaagatgccttcattaaagataaagtcatcgatattatgaatatgtttgcgaatcatcataatgtgaattatacattaaataataattgcgcgagcgtcacatgtcctcctgagattttcacaaagctgcttcaaactattgcaacgcgtaatattgatatcctatcagcaagttatagagcaaaaatgctacataaagcacgcatttcatga

SEQ ID NO: 2209 - DNA, 186 bp, Staphylococcus epidermidis
gtaagtataatcatcttacctaagtcgtttttttacatattaaactttttagtaattttattttttaaagtgaataaaatttcgtatataaccggtactacaaagagtgtgagtagcgttgaagaaattaatccacctattactgttgcagccataccttttgaaattaatattgaactgtcatga

SEQ ID NO: 2210 - DNA, 621 bp, Staphylococcus epidermidis
atgctcacaattaaagtgaatggtgttctttatcagacgaaaattaatataaatatagaggatcaacaccctaagatatatgcgatacagggaccatctggaattggaaagacaacaattttaaatataattgccggtttgaaatctataaattattcatatataaaggttggtaaacgtgtattaacagattcacaacaccatttgaatgttaaggttcaacaacgtcgtataggatatttatttcaagattatcaacttttccccaatatgaatgtttataacaacataacgtttatgactaaaccttctgaacatatcaatgaacttattcatactctaaaaatagagcatttacttgaaaagtatcctgtgaccttatcaggaggtgaagctcagcgcgtcgctttagcaagggcgctaagtacgaaacccgatttgattttgcttgatgagcctttttcaagtttagatgataagacaaaaaaagaaggtatcaaattaattttaaaaatattcgaagcatggcaaattcctattatatttgtaacgcattcaaattatgaagcgcaacaaatggcgcatgagattataacaattgaagattgtatacaaatatag

SEQ ID NO: 2211 - DNA, 690 bp, Staphylococcus epidermidis
  unsure (498),(499),(500),(501),(502),(503),(504),(505),(506),(507),(508): Identity of nucleotide at the above locations are unknown.
  unsure (509),(510),(511),(512),(513),(514),(515),(516),(517),(518),(519): Identity of nucleotide at the above locations are unknown.
gtcgcaacaatatcttcagcaagaatatgtcctaaactttcatctaaattaacattgatattcttcacttcaacctgttgtttcataatacgtttaattgcttctttaactgatattggcgttcttttctctatagacatacactcatctccaaaaaatattaattttcatgatatacttactcctaacaggagggaaaaaatgactcatttcacacatattaataaacaaggtaatgctaaaatggttgatgtttctaataaggaaattacaaaacgtgtagcagaagcacactcaagtataattgttaatgaaaaaatttatagacaaattactcaaaatactaatagtaaaggaaatgtacttaatactgcgcaaattgctggtattatggcagctaaaaacacttctacaatcattcctatgtgtcatccattaccacttacaggcatagatatatccttcaaatgggattcaaataatgatgattcatatcgnnnnnnnnnnnnnnnnnnnnnntctacaacaggtaaaactggtgttgaaatggaagcattgactgctgcttcagttacagcacttacaatctatgatatgacaaaagctatagacaaaggcatgataattggagaaacgtacttagaatctaaatctggtggtaaatctggcgacttccacagaaaaaattga

SEQ ID NO: 2212 - DNA, 399 bp, Staphylococcus epidermidis
ttagataaaattatcaaagtattatacttgtatacttcattaaatagttttaatataaaattcgcaagacaaattaatatgaaagaagggatagttttgcactttacacaacgtgaacaagacaaattgatgatagttgtagctgctgaggttgcacgtcgtagaaaagcaagaggacttaaacttaatcatcctgaagcacttgctttaatcagtgatgaattattagaaggcgcgcgtgatggtaaaacggtagctgaacttatgagctatggaaaaacaattttaaacgaggaagatgtcatggatggcgtagctaacatgattacagaacttgaaattgaagcaacttttccagatggtactaagttaataacagtccatcacccaatcgtttaa

SEQ ID NO: 2213 - DNA, 1128 bp, Staphylococcus epidermidis
aacatgaaaatagcaatagtaggcgcaggtataggtggtttaactgctgctgcgttattagaagaacaaggtcatcaagttaaagtgtttgaaaaaaatacttctataaacgaattaagcgctggtattgggataggagataatgttttaaaaaaattagggcatcatgaccttgctaaaggcattaaaaatgctggtcaaaatcttaccgcaatgaatatttatgatgagcaaggcaccccattaatgagcgctaaattgaagtctcattccctaaatgtcgcattatctagacaaactttaattgagatcatacagtcatatgtcgaagaatcatctattcacacaggatttaaagttactaaaattgaacaaacgagttgtaaggttaccctacattttaccaaacaggaaagtgaatcgtttgatttgtgtattggtgctgatgggttacattctgtagtaagagagtctgtaggtgcacgaactaaaattcgttacaatggttacacatgttttagaggcatggttgaagatgtacaatttaatgaccaacatgttgcgaatgaatattggggtgttaaaggacgagtaggtatagtcccattaattaatcaacgtgcttattggtttattactgttcatgctaaagaaggagatccaaaatatcaatcttttggaaaaccccatcttcaagcatattttaatcactttccaaatgaagtgagaaatgtgttagaaagacaaagtgaaacaggtatattacttcatgacatatatgatttaaaaccactgaagacattcgtttatggacgtactattttaatgggcgatgctgcgcatgccactacgcctaatatgggacaaggtgctagtcaagctatggaagatgcaattgtattagtgaattgtttagaaaaatatgattttaataaagcgattgagcgttatgataaacttagagttaaacataccacaaaagtgattaggcgttcgaaaaagataggtaaaatggctcaaaagcatcataaattaactgttaaacttagaaataccgcgatgaaattaataccaaatgctttggcatcagctcaaacaaaatttttatacaaatctaaagaaaagtaa

SEQ ID NO: 2214 - DNA, 924 bp, Staphylococcus epidermidis
aaagaaggaatcaatgtgactgaacaatttgtcataattatattattaatagcacttggttattttcttaaacgtatgaattacttgaaagcaactgatagtcaagtactttcaactttagtgttaaatgttacattaccttcactcgttatagttaacttaaatagtgcaaaattagatgtatctttttcaatattacctataatgatgattatttacggtatagtagctaaaattattgtaatttggttctttagaaaatatgataaccatatgcgtggttctgttggtatgatgactggatctatgaatattggtttgtttgcttatccgttggttgaagcgatatggccatctaaaggtatgatatatttcggaatggttgatattggtggggccattatcatgtttggtattacttattttgtaggaagttattttagcgaaggtagtgaccaatttaacttcaaatttttaggaaaaaaattagttcaatcagtcccattagtaacctatatgattatgtttggattgaacatgtctcatattcatatatggcaaccagctattgatttctttagtgtattatcaaaggcgaatatgcctttatccatgatattattaggtgtaatgcttaattttagtattgagagagaatacctccctgtaacaattaaatatctttgtttacattacgggttaggtatgttagctggaacactagttcactttttattacctgtatctgatgatatgattaaaacaaccttgcttataacgtggttattaccagtaggagtagcaatcataccatattcgattcaattcaaatataagacattaccatttgttggaatggtaactaatttaaccattattattagcattatcattttgtatatttatcaagctgtatttgtataa

SEQ ID NO: 2215 - DNA, 849 bp, Staphylococcus epidermidis
ccattgttgatagagattacattgaatttagcaatttacaacgacaaacgctcttttatagagcgtgatgcagaagatgtactaccaaaagtaatcgctgcacagaaagttttaaaagagatacgtaaagatgtagagatagatgcttatattgagcatgttaattacaatttcttagagcaacatggcatgcatgtcgatatcatattagatgcaactgataattttgatacacgtcagttaattaatgactttgcttataaacatcagattccttggatttatggtggtgttgtacaaagtacatatgttcaggcaacgtttattcctggtgaaacaccgtgttttaattgcttaatgcctcaattaccatctattaatttaacatgtgatacggttggagttattcaaccagctgtaacaatgacaaccagtttacaactcgttgatgcattgaagttgctgactggtaataaggttaataaacacttcacttacggggatatttggacaggagatcattatacatttggttttagtcgtatgcaaaatgaagattgtaaaacttgtggtaatgctccaacatatccacaccttaatcaacatcaacaagattatgcgaccttatgtggaagagacactgttcaatataaaaatgctgatatttctcaggaaatattactatcatttctcgagcgaaatcatattcaatatcgcacgaatttatatatgacaatgtttaggtttagagaacatcgaattgttgcattttctggaggtagatttttgatacatggaacgacggaacctaaaaaagcaattcaattaatgcatcaactatttggttaa

SEQ ID NO: 2216 - DNA, 1089 bp, Staphylococcus epidermidis
ttagccatgattaggtatcaagaaggagtgtttaaaatgcttggtttctcagtctatctaggacagaatttagatcgagattatattttaaatatggctgacttaggctatgatgtagtttttacttcactacagatacctgaggaagacaagaaaaatcaaatggcttatttgggagacttatgccaactattatcagcctatcaaatcacttatattatcgatgtaaccccttcattacttaatcaaactatttacagttatttgaaccaattacctcatggggatttttatattcgtatagataatcaattaaatattgaccttatcaaagacattatcagtcacggcttcaaatgctgtcttaatgctagtacattaactgatagcatgttagcgcacatatattgtactgattttaataatcaacttttatactgtcataattattatcctagacctgatactggtttatctatctcatttattgaagaaaaaaatcaactcataagaaaatacgatgcgcatgcaaaaatttgtgcttttatacctggcacgcagaagagaggccccttattcaaaggtcttcctacagttgaaaaacatcgttttgaacaccctcttattgctgcacaagaccttcaattaacgggtatatctgacattataattagtgatacgctattatcacacatttatgcggaacaattatctaatatgtggctatatcgacactttattttacacttagatcaactagactcctcatttacatcacaagttttaaagatacacacatcaagattagattcacctgaacatgtaattcgatctcaatattctcgtacagataatcaacagactgtcccaatgataggatcggcacatagagatcaaggagatatcacaattgataatcacttgaatggtcgttatgaaggagaaattcaagttataaaagctcctatgccaggtcattcccacatcaattgtattggtcatgtttgtgataaagatgttccattgttatcactgattcaacctggagatacttttaaatttgtatatacgaaggagaataacaaatga

SEQ ID NO: 2217 - DNA, 771 bp, Staphylococcus epidermidis
ggtgttaagatgattttagatgaacgtgtaaactctaatttcgatcaattaaatgataatgatatacaaattgcacattatgttaatacacatatagatgtttgcaaaaatatgaaaatacaagatttagcctcacagacacatgcttcaaatgctacgattcatcgcttcactcgtaaactaggttttgatggttatagtgactttaaatcctttttaaaatttgaagatagtaagaatcatcaacttccttctgattctatggagcaatttaaacaagaaattgaaaatacattcaactatttagaacgtattgattatcgtttattaactcacaaaatgcatcatgctacaacaatatacttatatggtactggacgtgcacagatgaatgtcgctgaagaagcacaacgtatactgttgactatgcataaaaatattatattgttacatgatgttcatgaactaaagatggtgttaaacaagacaattccagaagatttgtttttcatcatttcactttctggcgaaacacatcaacttaaagaagtcacacaattgcttcaactgagacaaaaatattttatttccgtaacaacaatgaaagacaatacattggcacaacaagctgattacaatgtctatgtttcaagcaataccttctatttaaacgatggtactgattattccagttttattagctatcacattttctttgaaacactactaagaaaatataacgaatataaagagaatcatgaattaacatag

SEQ ID NO: 2218 - DNA, 864 bp, Staphylococcus epidermidis
gtgcaaattgtagattttttgatagcacttttaccagccctgttttggggtagtgtagtcattataaatgtttttgtaggtggtggaccatataatcagattcgaggtacaactttaggtacactttttatcggattttctctacttgctactggacacgcagcgtttgataacctaacagtaattattgtcggtttagtatcaggagctctatgggcttttggtcaaggtaatcaattaaaatcagtgcatttaataggtgtatctaaaacgatgcctatttcaacgggtatgcaacttgtcggtaccactctatttagcgctattttcttaggtgaatggagcacgattgttcaagtagtgatgggacttatagcaatgatcttattggttgtaggtatttctttaacatcacttaaagccaaaagcgaaggcaaatccgataacccagaatttaaaaaagcaatgggaatattacttctatcaacaatcggttacgtaggttatgtcgttcttggagatatttttggagtaagtggtacagatgctctcttcttccaatcaattggtatggcaattggaggattaatcctttcaatgaaccataatacttcaattaaatctactgctctaaatcttataccaggtgttatctggggtatcggtaacttatttatgttctattcacaacctaaagttggtgtagcaactagtttctcattatcacaactccttgttattgtttcaactttagggggtatctttattctaggggagaaaaaagatcgtcgccaaatgattggtatttggtcaggtattatcgttatagttatagcttcaatcattttaggcaacttaaaatag

SEQ ID NO: 2219 - DNA, 342 bp, Staphylococcus epidermidis
ctaaaaggagttgaaagaatgattttagacaatgtgaatcctgatgatttatttcctaccgagaaaaaagggccctctgtattaggtatgattgagtataacgtgcagggtcagactaaatttgaaggtgccttcatagctacaaatgaacggttaattatgaatgtagatatgaatggacaattttattatcgaaatatacgttatgatgaaattaatcaaattcattttgatggttcagatattatatttgagttcaatattggaacagttccaatgcgtgaaattaagacagaagatgtacaagcttttgttgattatataaaacaacaaattcaataa

SEQ ID NO: 2220 - DNA, 339 bp, Staphylococcus epidermidis
ggatttttggtttcacctgctgagatgccaatcaattcaacaccttggtatgatcaaatcacaatagataaagcaaagaaaaatccaatgaatccatttggcataaatccaccatgtgaccataagttagaaatccctattggattccctccattgcctataccaaataaaattaatcgtaatcctgcaataatcattaatacaatagttacaactttaattaaggcaaaccaaaattcaaactctccaaacgcttttactgaaactaggttagcagccatcaaaaagagaactgctatcactcctggtatccaattaggaaggcttgggaaccagtag

SEQ ID NO: 2221 - DNA, 243 bp, Staphylococcus epidermidis
ataggagtggtagggatgcaaagatcagataaaagaaaaatgagcctgccgatgaaaatactactatgggtagtgggaattttatttctattagcaatcattgcagttatttatgttagtgcaaaaatatttattacaggagacaaaatacataatccgttaaatagaaatcattctgaattacgttctgcaaaagtaaatttaaaaatggtgatccatttactattgcactttttggcgtag

SEQ ID NO: 2222 - DNA, 1287 bp, Staphylococcus epidermidis
aaattaatattttttggagatgagtgtatgtctatagagaaaagaacgccaatatcagttaaagaagcaattaaacgtattatgaaacaacaggttgaagtgaagaatatcaatgttaatttagatgaaagtttaggacatattcttgctgaagatattgttgcgacctatgatataccaagatttaataaatcaccctacgatgggtttgcaattagaagtgaagattcacaaggtgcaagtggcgaaaaccgtattgaatttgaagtaatagatcatatcggtgcaggttcagtttcagaaaaaacaattgataaaaaccaagcaattcgaataatgactggtgctcaaattccttctggagctgatgccgtagtaatgtttgaacaaactattgaatctgaaacaacttttacaattagaaaatcctttaaacatttagaaaatatttcgctacaaggtgaagaaataaaagctggtgatattgtactgcataaaggtatgcgtattaactctggtgtgatagcagtcttagctacatacggttatactaaagtgcgagtggctcgaaaaccaactgttgcagtaattgctacaggtagtgaattgcttgaagtagaagatgagcttgaaccaggaaagatacgaaattcaaacggaccgatgattaaagcattagctaaacaatttggaatacaagttggaatgtataaagttcagcatgataatctcgaaaagagtatggaggttgtaaaaaaagctttatcagagcatgatttagtaattactactggaggtgtgtcggtaggagattttgattacttaccagaaatatacaagtctatccaagcgcagatactatttaacaaagtggctcaaagaccaggtagtgttactacggttgcatttgcagatggtaaatatttatttggcttatctggaaacccttcagcctgctatacaggatttgaattatatgtcaaacccgctgtaaataagctcatgggaactaaagcttgttatccgcaaataatcaaagctacacttatggaagactttaataaagctaacccatttacacgattgattcgtgctaaggcaacattaacaaaagctggaatgacagtaataccatctggatttaataaatcaggtgcagttgtagccattgcgcacgctaatgctatgattatgcttcctggtggcacacgtggatttaaagcgggcaacattgttgatgtgattttgaccgaatctaatagttttgaagaagaattgatactatga

SEQ ID NO: 2223 - DNA, 2172 bp, Staphylococcus epidermidis
catgatgtattttataaatgtgaaaggaaaattaaaatgaaatctttaatcttagctgaaaaaccatctgtcggaagagatatcgctaatgctttgaatcttcaacaaaaaagtaatggttatatagaagggaaacagtatatagtaacttgggcattggggcatcttgtgacaaatgcaacgcctgaacaatataacccttcatataaagaatggaatttagaagacttacctatcattcctaagaaaatgaaaacagtagtgattagtaaaacaaatagacaatttaaaattgtaaaatctttaattttagataaaaatgttaaagaaattattatagcaacagatgctggacgagaaggtgaacttgtagctcgtcttattttagatagagtaggtaataaaaaaccaatcaagcgtttgtggattagttcggttacaaaaaaagccatacaagaaggatttaaacggttaaaaaatggaaacgcgtatcaaaatttatatgaagcagcacttgcacgaagtgaagcagattggatagtagggattaatgcaacacgtgcactaacgacaaaatatgatgcacaattatcattaggtcgtgtacaaactccaacaatacagttagttaaatcaagacaagatgagattaactattttaaaccagaaaaatattacacgttatccattaatgttgatggttacgatttaaaacttaaccaacaaaagcgatataaagataaaaaagaattagaattgattgaacatgaaattaaacaccaagaaggaaaaatattagaagttaaaggaaaaaataagaaatcttacgcgcaacctttatttaatttaacagatttacaacaagaggcatataaacgttacaagatggggccaaaggagacactaaatacattacaacatttatatgagagacataagttagtaacctatccccgtacagattctaattatttaacagatgatatggtcgatacaattcaagaacggttaagagcaattttagctacagattataaatctcatgttcgagatttaatttctaagtctttttcttctaaaatgcatatttttaataatcaaaaagtttcagatcatcatgcgattattcccacagaagttagaccatctattgaacaattgagtcaacgagagtttaaaatttatatgctaatagcagaaagatttttagaaaatttaatgaatccttatttatatgaagttttaacaatccatgcacaactgaaagattaccattttgttttaaaagagaaaatacctaaacaattaggatataaagctttaaaagatcaactctcttcgcatactttaacgcattcttttaaagaaggtcagttatttaaagtacatcgtattgagattcatgaacatgaaacaaaggcaccggaatattttaacgaaggttcattacttaaagccatggagaatccacaaaatcatattgatttgaatgataaaaagtatgcaaaaacactcaaacatacgggggggattggaactgtagcaactagggctgatattatagaaaagttatttaacatgaatgctttagagtcgcgagatggcaaaattaaagttacatcaaaaggaaaacaaattttagaattgtctccaagtgaattaacctcacctatactaacagcccaatgggaagaaaaattaatgcttatcgaaaaggggaaatataattctcagaaattcatacaggaaatgaaaaactttacatttaaagtggtaaataaaattaaaagcagtgagcaaaaatataaacatgataatttaacaacaactgagtgtccaacatgtggtaagtttatgataaaagtcaaaactaaaaatggacagatgcttgtatgtcaagatcccaaatgtaaaactaagaaaaatattcaacgcaagactaatgcacgttgccctaattgtaagaaaaaaatgaccttattcggtaaagggaaagaagctgtttatagatgtgtatgtggccacacagaaactcaatcacaaatggacaaaagaatgagagataaaacgaatggtaaagtttcacgtaaagaaatgaaaaaatatataaataaaaaagaagaaatcgacaataatccatttaaagatgctctgaaaaatctcaaattgtag

SEQ ID NO: 2224 - DNA, 417 bp, Staphylococcus epidermidis
atattacaatttttggaggcgttaaatattatgaaaaaaatcaaaacaatctcgacattggtagctggacttggtatagcatttctaggtcacacaacacatgcagatgcggctgaaaataacaatcaacaacaaagtacatataactatagtacaactgaagtatcattttctaattcaggaaatttatatacttctggccaatgtacttggtatgtttatgataaaactggtgggaaaatcggatcaacatgggggaatgcaaatagctgggcaactgcagctcaagcagcaggattcactgtaaataatacacctgaagaaggtgcaattatgcaatcatctgaagtgctttcggacatgttgctttcgttgaaagtgttaataatgatggttctattactgtatcagaaatga

SEQ ID NO: 2225 - DNA, 453 bp, Staphylococcus epidermidis
atgaagcaatttgaaatcgtgactcaacctattgaaacagaacaatatagggattttacgattaacgaacgtcaaggtgccgtagtcgtatttactggtcacgtaagagagtggactaaaggtattcgtacacaacacttagagtatgaggcttatataccaatggctgaaaaaaaattagctcaaattggtaaagaaattgaagaaaagtggcctggaacaataacaacaattgtacatcgaattggtccgttacaaatatcagatattgcagttttaattgcagtatcttcaccgcatagaaaagcagcatatgcagcgaatgaatacgccatcgagcgcataaaggaaattgttccaatttggaaaaaggaaatttgggatgatggatctgaatggcaaggccatcaaaagggaacatataatgaagcaaaaaaggggaaagcaagatga

SEQ ID NO: 2226 - DNA, 1455 bp, Staphylococcus epidermidis
caattaaaatttaagaaaagaggttttgtttcaaatcatactgaagggagcaaaagtatgactcaaaagtatagatatcctacttttttagaatctatttctactattttagttatggttgtcgttgtagtaattggttttgttttctttaatatcccgatacaaatattattattaatttcttcagcttatgcagcatttattgcacatagagtgggattaaaatggaaggatttagaagaggggattactcatcgattgagcacggcgatgccagctatctttattattttagctgttggaatcattgtaggaagttggatgtattctggaacagttccagcgttaatttactatggacttaaatttttaaacccaagttatttattagtatctgcatttataatcagtgcaatgacttcaatcgctacaggaactgcttggggatcggcatctacagcaggcattgcactcatatcaattgctaatcaattaggtgtgccagcaggtatggctgctggtgccattattgcaggggcggtttttggtgataaaatgtctccattatctgatactacaaatttggcagctctcgtaactaaagttaatatttttgctcacattaaatcgatgatgtggacaacaatccctgcttctataataggattggctatatggtttattgttggattacaatttaagggagacgcaaatacacaacaaattcaaaatctattaaaagaattaacaacaatttataacttgaatttttgggtatggattccacttattatcataattttatgtttaatatttagaatctctacagtaccgtcaatgcttatctctagtatcagtgctttagttattggaacattcgatcatcaatttaatatgaaagatggttttaaagcttcttttgatggatttaatcatacgatgctacaccagtctcatatttcagataatgctaagacgttgattgagcagggtggtatgatgagtatgactcaaatcattgtaactatattttgtggttatgcttttgctggtattgttgaaaaggcaggttgtttagacgtaattttagagacaatagctaaaggcgtaaagtcagttggaacactaatattaataactgtagtttgtagtattatgctagtatttgcagcaggcgttgcttcaatagttattattatggtaggtgtacttatgaaagatatgttcgaaaagatgaatgtctcaaagtcagtgttatcgcgtacacttgaagattcaagtacaatggtattgccactcattccatggggcacatctggtatatattatgcacaccaacttaatgtttcagttgatcagttctttatatgggcaatcccatgttacttatgtgcattcattgcaataatttatggctttacaggtataggaattaaaaaaataagtagaaaataa

SEQ ID NO: 2227 - DNA, 261 bp, Staphylococcus epidermidis
tttgtatattcaaaatataaagagaggtttagagatctaatgcaagaaagatactcgagacaagtgttgtttaaggaaattggtttaaaaggtcaaagtctacttgagaaaaaacatgtgcttatagtaagtatgggtgcgttaggaacacacttagctgagggattagtgagagcgggaataaataagttaaccattgttgatagagattacattgaatttagcaatttacaacgacaaacgctcttttatagagcgtga

SEQ ID NO: 2228 - DNA, 1437 bp, Staphylococcus epidermidis
ggaggagattccatgagtaaagaagaacgtcttgccaaagacattacccacgcattaggcggttctcaaaacataagcaatatcatccattgtatgactcgagttcgtattaaagtacacaatgatgcaaaagttaattatgatgaattaaaatcaatcaatggcgtattaggcgttgttgaagatgaaagaattcaagttgttgttggaccggggattgttaataaagttgctaaacttatggctgaccagtcaggagcaactctagctgaagagacgactgaaaatcaaagttataaatcacaggcagaaaaacgtgcgtatgaacataaaaaacaattccaaagtcaacgaaaacaaagtaaatggaataaagtgttaaaatctattgctaatatctttatacctttaataccagcatttataggtgcaggattaatcggtgggattgcagcaatacttagtaacttgcttacagcaggttccatttcaggtcaatggattcaacaaattgttactgtcttaaatgttattaaagatggtatgttattttacttagctattttcactggtattaactcagcgaaagtattcggtgctacaccaggtttaggtggagtaatcggtggtactacattactaaccggtatcacggatgaaaatccaattaaaaatattttcactggagaacatctagctgctggacaaggtggtattattggtgttatcttcgcagtttggttattaagcatggttgagaaacgactacataaaataatacctaactctattgatatcatcgtaacgcccacaataaccttactacttattggtttgttaactatatttataatcatgccactagctggctttgtctccgatggtcttgtttatgtaattaactggattattggagtaggaggcattttcagtggattcattataggagcattctttttacctttagtcatgctaggattacatcatatcttcaccccaatccatatcgaattaatcaatcaaactggctccacttacttgttacctattgccgctatggctggtgctggacaagtcggtgcggcgattgcattgtgggtgagatgcggtaaaaataaagaattacgtaatacgctcaaaggtgcccttcctgtagggttcttaggtataggtgaacctttaatttatggtgtaacacttccattaggtcgccctttcttcactgcgtgtataggtggcggtgttggtggtgctgtcattggtggtatcggtcatattggggcgacagctgtaggaccaagtggtatttcattattaccattgattgctaataatatgtatctcggttacatcgtaggtttactagctgcttatacgggtggctttatctttacttatttcttcggcacaactaaagaaatgagaaatcctgaataa

SEQ ID NO: 2229 - DNA, 504 bp, Staphylococcus epidermidis
gaggcgtttttaatggattggattttaccaattgcaggaatcattgctgcgatagcgtttttaattttatgtatcggtatcgtcgtggtacttatttctgttaaaaagaatttagactatgtggctaaaacactagatggtgttgaaggtcaagttcaaggtattactcgtgaaacgactgatttacttcataaagtgaatcgcttaactgaagatattcaaggtaaagttgatcgtttaaattctgtagttgatgctgttaagggcattggagactcagtacaaaacttaaatggatctgtagatagagttacaaactcaattacgcacaatatttctcaaaatgaagataaaatttctcaagttgtacaatggtcaaatgttgcaatggaaattgctgacaaatggcaaaacagatacaatcgtagaggaagtgcaaactacaaaacaaacactgtagcagatgatgcaaatcatagctacaattcacgtgttaataaataa

SEQ ID NO: 2230 - DNA, 1101 bp, Staphylococcus epidermidis
ggagtgagattttatatgactattgataactcaaaaacattggaacgaattaaaatattaacagagcttcatggagcacctggttttgaagatgaagtgagaagttatatgaaaagtgaaatggaaccatacgtggataagtttattcaaaataagatgggtggtttctatggtataaaaaaatcaaataaagaaaacgcacctcgagttatgatagcagcacatatggatgaaataggttttatgattactcatattaatgataatggaatgattcaatttacgaatttaggtggcgtggctaatgatatttggcaaggacaaagattaaaaataaaaaatagatacggtaaagaaatcataggtgtagttgctaatattcctaaacattttagaacaggaaatgaaagcatacctcaaatcaaagatttaatgctagatattggtgcttcttcatcagaagaagtgcgcaatcggggtgtagaggtgggcgatacaatagttcctcacacaataatgactcagttgtcaaaaaacagatacagcgcgaaagcctgggacaatcgatatggttgtgtcttagctattgagatattagaattattaaaagacgttcaactagatgttgacttatatgttggtgccaatgtacaagaagaagttggacttagaggagctaaagctgccgcaaagcaaattgatcctgatattgcattcgttgtcgattgctcccctgcaaatgatatcaaaggtaaacaacaactttctggtgtgttaggggaggggactttaattcgtatcaaagatggtactatgatacttaaaccattatttagagattatctccttaagctagcagaagaaaatcagattgcatatcaatattatatatcaccaggtggtacagatggtggggagattcataaagaaaatgaaggtataccaacagctgttattggagtatgtgcgcgttatattcatagcactgatgcggtctttgatattagagattatttttctgcacgtcacttgctaaaagaaagtattattcatttaacaagtggacaaattcaacaattacaatatggaaaggaattttga

SEQ ID NO: 2231 - DNA, 627 bp, Staphylococcus epidermidis
aagtcaactttcaagatatggtatactatatctaactttaggaggtatctaatgcatttcaacaagtatcaaatactaactacagataaatatactaaatttgaacatttatataagaaggtcaaacatatatgtgtcgtaatttttttggtggtttttttgattggttttattatactgttgtcattagtattatacttccaacaactaactaaagatgcttcgtcaataagtgatcgagagttgaaagcaaaaatccttcatatacctggcgatgagctaataaatcataataatcaaattttagaagaatatgatcattcacaaaatacactcatagttggaccgaaccatgtaaattcaaatattatacatgcacttacagcctctgaagatacattattttataaacataacggtattatgcctaaagcacttttaagggcgatgcttcaagatatcacaaattcaaaccaatcttctggtggtagtactatcacgcaacaattagtaaaaaatcaagtgctctcaaataaaaaacttatagtcgtaaagcaaatgaaattatcttggctacacgggtcgaaaatttattatcaaaagatgaaatcatatatacgtatttaa

SEQ ID NO: 2232 - DNA, 639 bp, Staphylococcus epidermidis
atgtctatgtttacaggtatcattgaagaaataggtactgtacaacaagttcgctctgagcaatcagtaagaacgcttgaaattaaagcacaaaacattttagttgatatgcatattggtgattcaataagtgttaacggtgcatgtttaactgtgatagatttcactgactcaagtttttcagttcaagtcatcaaagggactgaaaacaaaacatatcttggaagtgttcaacgtaatacagaagttaatctcgaaagagccatgagtggaagtgggagatttggtggacatttcgtgttaggtcatgttgatgagcttggaacaatttctaaaatcaatgaaactgctaactcaaaaattatttctattaaaacaactaaaaacattttgaatcaaatggtaaagcaaggttctataactgtagacggagttagtcttactgtatttgatttacatgattatacttttgatatacatcttataccagaaacacgtcgatctactattctttcatctaaaaaagtgggcgacaaagtgcacttggagtctgacgtactattcaaatatgttgaaaacatcatgaatcaaaatcaatcgcagttaacagaagaaaagcttagagcatttggtttttag

SEQ ID NO: 2233 - DNA, 741 bp, Staphylococcus epidermidis
cctttcacgttcaggaggagaaatgacatgacaaaattaaatgttaaagtgtttgcggatggtgcagatattgaagaaatgaaatcagcatataagaatcaactcgttgatggttttacaacgaacccaagcttgatggctaaagcgggtgtaactgattataaagcttttgcagaggaagtggttagtgaaatacccgacgcttcaatttcttttgaggtgtttgctgacgatttacctactatggaaaaagaagctgagattttaaaacaatatggtgataatgtatttgtaaaaattcctattgttacaacaactggtgagtctacactaccattaattaaacgtttatcatcgaaacaggtaaggttgaatgtcacggctgtctatactatagagcaagtaaaagcaattactgacgctgtaactgaaggtgtgccaacatatgtgtcagtatttgcaggacgcattgcagatactggggttgatccacttcctttgatgaaagaatcagttaaggtaactcatagtaaagaaggcgttcaattattatgggcaagttgtcgtgaagtatataatgtaatccaagctgatgaaattggagctgatattattacttgcccagctgatgttgtaaaaaaggttaataacaatttaggccgggatataggagaactttcagtagatacagtcaaaggttttgccaaagacattcaaagttccggtttgtcaattttataa

SEQ ID NO: 2234 - DNA, 1524 bp, Staphylococcus epidermidis
aacgtaactactaataataaatacataaggatgatttacatgcgtgtagcaataataggtatgggaacagctggtgtaagtgtgttacgccaactcgttaaacatgaaaacttttctcaattaaaagtagatgtatatgacgatgatagaaatatgggccaaggtgttccatttcaaaatgatagtagcgaactacttattaacatgccatcaaaatccatgagcttaaatcttgatgatgatcaagagttttggaagtggtatcaaaatcagacggaatttaattttagtaatcctcaatatttgcctagatttgtatttggtcattatatgaagtcttatttatcttattataatgaccaatttgataatttaactattatcaatgataaagtacaagaaatttttacacaatccgatgttgatgacacagatttaaaatatcatgtatgtacatgtgatgatgaaaaagaatggcgtgaatacgattatttatttttaacttttggaacttttagttaccatgacccttatgatttgaagggaactaaaggctatatacaaacgccgtatcctacatatcatacacttgataatgttaaagattcagatcgaatcgtgattattggaacagggttggctagtttagatgctgtgagatatgtagctgcacatcatccatctttacccattactatgacaagtcgttctgcagcattgccaagtgttagagggaaaatgactaaaattcagtttacgcatttaactaaatcacgatttaatggaattatgaaaaatcactttggtaatgtaccattagaaaaagtagtttcattatttttaaaagaatgtgaagattatggaatagattttaaaaaacttatttatcgtagaaccggaaaccatgtcaaagacttggagtatgatttaaatcatgaagaagaaatggggatattccaaagtatcattgaacatttaaaagaaaatttaaactggatttggaatagtttgagcgttaaagatcaagaaacttttaatcgtaaatacactaaaattattcagttaaattctaatccaatgcctcctagaacagctcgtttacttatcaagttaatacagaataatgaacttgtcattaagaaagggctagaagacatagtccataaaaataatcaatttatgttgaagtataacgacactacgcaaaattatgagttgtttgacatcgttattaatgcaacgggctctaaaacacatctttctcaattagatgaggatgatcaattaattttaaacttagaaaatagacaaattgttcaacgtcatcctatgggtggcattcaaattatcccagaaacaaatcaagtcataagccctagatatggaaccttaaaaaatgtgattgcaattggacaaatgaccaacggtgtcaataaacttagaaatggcgtaaagatgattgttaatcaagttgttgatacagtatctcaattatatataacacaggaaaatagaaataagtaa

SEQ ID NO: 2235 - DNA, 186 bp, Staphylococcus epidermidis
aaaagacatacgaaagcaagtgttcaaaaattaaataattgcttttcacaagcttttaaagatgcgttaaatgaggaaataattgaacgtgatcaaacttggaacgaccctatctatgaaaggaaacctacaaaaaaagaagaagataaattcatgtctttaactgaatacaggaaattaaaataa

SEQ ID NO: 2236 - DNA, 663 bp, Staphylococcus epidermidis
gcatgtaacactcttttttgttttttcataacaacaaaaaagaaaaaggaggagtctcacatggctcgattcagaggttcaaactggaaaaaatctcgtcgtttaggtatctcattaagcggtactggtaaagaattagaaaaacgaccatatgcaccaggacaacacggtcctaaccaacgtaaaaaattatcagaatatggtttacaattacgtgaaaaacaaaaattacgttacttatatggaatgactgaaagacaattccgtaacacatttgatattgctggtaagcaatatggtgtacacggtgaaaacttcatgattttacttgctagtcgtttagatgcagttgtttattcattaggtttagctcgtacacgtcgtcaagcacgtcaattagtaaaccacggtcacattgaagtggatggtggacgcgtagacatcccatcttactcattaaaacctggtcaagtgattacagttcgtgaaaaatcacaaaacttagatattattaaagaatctgttgaaattaacaatttcgtaccagaatatttagacttcgatgctgacaacttaaaaggtactttcgttcgattccctgaacgtagcgagttaccagctgaaatcaatgaacaattaatcgttgagtactactcaagataa

SEQ ID NO: 2237 - DNA, 231 bp, Staphylococcus epidermidis
aaaggaggaacttttatggattatgcacatttaaatctcgagcacttttttgcaagaaatgatgatttggatattattagagatcgatctgattttgtgatgattaataatttcaccaatgagatgaaataccgtgaaggtgaaattgaaggaactatagatttgaatcaatactattataaaaatagatcacaagctgtaagtttcataatgatgaattataagaactaa

SEQ ID NO: 2238 - DNA, 1098 bp, Staphylococcus epidermidis
gtagaaatgactaataaattagaacagtatagagaagaaattgtttccttaaatgatcaagtattagaattactatcgaagcgaggagaattagcacagaaaattggtgaagaaaaaattaagcaaggtacacgagtatatgatcctcagcgtgaaaaggaaatgattaatcagctattagataaaaataaaggtccatttaacgacaatgtgattaagcaattatttaaagaaatttttaaagcctctacagatttacaaaaatcagaaaatgaaaaacatctttatgtatcacgtaaattgaaacctgaagatacgatcgttaaatttgataatggtggaatcattggtgatggtaataaatcatttgtatttggtccttgttctgtagaatcacaagaacaagttgatgctgtagcacaagatttgcaggctaaaggcgagaaatttattcgtggcggagcgtttaagccgagaacttctccttatgatttccaaggtcttggagtagaaggtctcaaaattttgaaaaatgttaaagataaatataacttaaatgtagtaagtgaaatagttaacccaaatgatttcgaaatcgcttcagattatttggatgttttccaaattggtgctagaaatatgcaaaattttgagttactcaaagaagctggtcgtacagataaacctattttattgaaacgtggtttatcagcaacgatagaagaatttatctatgcagcagaatatattgcttcacaaggtaaccgaaatattattttatgtgagagaggtattcgtacatacgaaaaagcaactagaaatacattagatatctctgctgtacctattttaaagcaaggaacacatctacctgttatggttgatgtaacgcatagtacaggtagaaaagatattatgttaccgacagcgaaagcggctttagccgttggtgctgatggagttatggctgaagttcatccagatccttctgttgcgttaagtgatgccggtcaacaaatggatcttaatgaattcaatcaattttatcacgaattaaaaccacttgctgatatgtacaattcgaagaaactgaaatag

SEQ ID NO: 2239 - DNA, 228 bp, Staphylococcus epidermidis
acagccgtgacattcaaccttacctgtttcgatgataaacgtttaattaatggtagtgtagactcaccagttgttgtaacaataggaatttttacaaatacattatcaccatattgttttaaaatctcagcttctttttccatagtaggtaaatcgtcagcaaacacctcaaaagaaattgaagcgtcgggtatttcactaaccacttcctctgcaaaagctttataa

SEQ ID NO: 2240 - DNA, 1248 bp, Staphylococcus epidermidis
ctctcatatttaaagagaattttcgtaatttatttaaaggagaaaatgatgacatacaataaacgattatttacctcagaatcagttactgaaggccatcctgataaaattgctgaccaagtttcagatgccattcttgatgaaatattaaaggatgatcccaatgctcgtgtagcatgtgaaacaacagtaacaacaggaatggcacttatttctggagaaatctcaacaactacttatgtagatattcctaaagtggtgagagaaacgattaaagatattggttatactagagcaaaatatggttatgattcacaaacaatggcagtgttaactgcgattgatgaacagtctcctgatattgcacagggtgtagacaaagctcttgagtatcgaaatgatatttctgaagaagaaattgaagcaacaggtgcaggtgaccaaggattaatgtttggatatgcaactgatgaaactgatacgtatatgcctctacctatattcctgtcgcatcaacttgctaaacgattggctgatgtacgaaaagatgaaattttagattatcttcgtccagatggaaaagtacaggtgactgttgaatatggtgaagatgacaaacctagacgtattgataccattgtagtttctacacaacatgctgaagatgtagagttagcacaaattgaaaaagacattaaaacgcatgttatttacccaactgtagataaagctttattagatgatgaaactaaattttacattaacccgactggacgtttcgttattggaggacctcaaggagatgctggtttaactggacgtaaaattatagttgatacgtatggtggttatgcccgtcatggtggaggttgttttagtggtaaagatcctactaaagtagatcgttcagcagcttatgcagcaagatatgtagctaaaaatattgttgcagctggtttagctaaacaatgtgaagtacaacttgcatatgcaattggtgtagcagaacccgtttccatttcaattaatacgtttgatactggaaaggtttcagaagcacgtttagttgaagctgtaagaaagcattttgatttaagaccagcaggtatcattaaaatgttagacttaaaacaaccgatatatagacaaacagcagcgtatggtcattttggacgtacagacgtattgttaccatgggaaaaattagataaagtcaatgttttaaaagatgctgttgaaattcaatga

SEQ ID NO: 2241 - DNA, 588 bp, Staphylococcus epidermidis
aatgaacaagcagagtatacaatcatgaaactagaacgtattttacccttctctaaatcgttaattgattctcatattaatcataatagtattgtaattgatgcaacatgtggtaatgggaatgatactgcttattttgctcaacatgttccaaatggatttgtctatggattcgatatacaagaacaagcaattttgaatacgcacaaaaaaacaaaagattattcgaatgtaaaattaatccaatctggtcatgaaaatgctaaattgcacattcccgcccaacatcacggttgcatagatgctgctatttttaatttaggttatttaccgaaaggtaacaaagaaattgtcactaaacctgaaacaacaattatggctattaatgaaatctttgatatcttaagtattgaaggaattattatattagttatatatcacggtcatgaagaaggtaaagtagaaaaagaagcactacttgaatttttacaaaactttgatcaaaataaagctcatatattacaatatcaattcataaatcaaaagaataacgctccttttatctgtgctattgacaaacgtaattaa

SEQ ID NO: 2242 - DNA, 1128 bp, Staphylococcus epidermidis
ggcatgaaggctatattatttgatgtagatggcgtatttttaagtgaagaacgatgttttgatgtttcagcaattactgtagctgaacttttatcgagtccagattttttaaattgtgacatagatattcattttgatggtaatttaactgaaaatgatataaacaaaatacgtagaaacgtatttaataatgaccgaatattaaatcaactaaagtcacttggtttaaattcaaattgggatatgctatttattgtatttagtattcatttaattgataaagctaaacaattaaaaccatcattacgagatcaattacttgatgaattattgtttaccaaagagactttaaaggaaatagcaaaggatttaactgataaaacgataaattatagcttaccttacgatgtgatagcttcgtttagaaatggtaaagatgctatttacgaagatttggaagtttacgctaaaaatcaattagaacttaacaacactagtttatttaaattgaaaagtgctttatggacattagcaaaagatatatatcaagaatggtatttaggaaaagctttatttaatcaagttgaatataaaaaagatattcaagattttaagaaaggtttcatttatgatgaggtcattcttaaacctatagaagaaattcaattattacttcaaaatctaatagaagcgggatatcaaattgcgatagcaactggtagacctcgaactgaaacaattattccatttcaatcattgggattaaaatcttattttaaagatgaacatatcgtaacggcaagtgaggtgttgctagcagagaaacaatttcctcaatatcaacctttaggaaaacctaacccgtttagttacatcgctacgttaaatggaaattataatgaccaatatgaacgatatgcgacaaagcaagaagatatcgtaaataaagatgaggtttacatagtaggcgactctttagctgatttattaagtgcgaagaagataggggctacgttcattggtactttaactggtttaaaaggtaaagctgctcactctgaattagttgcaaatggagcagatcatgtagtagaggatataactaagattcgaaaaattctattatag

SEQ ID NO: 2243 - DNA, 11091 bp, Staphylococcus epidermidis
gaggccaatttaatgaatctatttagaaaacagaaatttagtattagaaaatttaatataggtattttttcagcattaatagctacagtcgcatttttagctcatccggggcaagcaacagcatcagaactggaaccttctcaaaataatgacactacagctcaatctgatggagggttagaaaacacatctcagtctaatcctataagtgaggaaaccacaaatacattatctgggcaaacagtaccttcatctactgaaaataagcaaacacaaaatgttcctaatcataacgctcaaccaattgcaataaatactgaagaagctgaatctgctcaaacagcatcttataccaatatcaatgaaaataatgatacgagtgacgatgggttacatgttaatcagccggctaaacatcatattgaagcccaatctgaagatgtaacaaatcacacgaactcaaatcattcaaattcatcgattccagaaaataaagctacaacagaatcatcaagtaaacctaaaaaaagagggaaaagatcattagatacaaatagcggaaatgacacgacaagtacaactcaaaatacggatccaaatttaagtaatacaggtccaaatggcattaacactgtaattacatttgatgatttaggaattaagacaagtactaatcgctctcgacctgaggtaaaggtagttgatagtctaaatggctttacaatggttaatggtggtaaggtcggtttattaaatagtgtgttagaacgtacaagcgtgtttgatagtgccgatccgaaaaattatcaagcaatagataatgtcgtagccttaggacgtattaaaggaaatgatccgaatgatcatgatggtttcaacggtatagaaaaagaattttcagtgaaccctaattctgagataatattttcatttaatacaatgactgctaaaaacagaaaaggtggaactcaattagttttaagaaatgcagaaaataatcaagaaattgcttcaactgatattcaaggaggcggcgtatatcgtttattcaagttacctgataacgtacataggttaaaagttcaatttctacctatgaacgaaatacactcagattttaaaagaattcaacagctacatgatgggtatagatactattcttttatagatacaattggtgttaattctggttcacatctatatgtgaaatcaagacaagttaacaaaaatgtaaagaatggtaaagaatttgaagttaatactcgtatagagaataatggtaacttcgctgctgctataggtcaaaatgaacttacttataaagtaacactaccagaaaatttcgaatacgttgataattcaactgaagtttcatttgttaacgggaatgtgcctaattctacggtaaatccgttttcagttaatttcgatagacaaaatcatactttaacgtttagtagtaatggtttaaatttaggaagaagtgctcaggatgttgctagattcttgcccaataaaatactaaatattagatacaagcttagacctgtcaacatctcaacgccacgtgaagtgactttcaatgaagcaattaaatataagacattttctgaatattacattaacactaatgacaatactgttactggtcaacaaacacctttcagtattaatgtcatcatgaataaagacgatttatcagaacaggtcaataaggatatcatcccatcgaactatacacttgcttcttataataaatataataagttgaaagaacgtgctcagactgttctggatgaagaaacaaacaatacaccttttaaccaaagatactctcaaactcaaattgatgatttgttacacgaattacaaacaacactaataaatcgtgtgagtgcttcgagagaaattaatgataaagctcaagaaatgactgatgctgtatatgatagtacagaattaactactgaagaaaaagatacattagttgatcaaattgaaaatcataaaaatgaaatttctaataacattgatgatgaacttacagatgatggtgttgaaagagtcaaagaggctggattacatactctagaaagtgatactccacatccagtaacaaaaccaaatgcacgacaagttgtgaataacagagcagatcaacaaaagacgcttatacgtaacaatcatgaggcaactaccgaagaacaaaatgaagcgattagacaagttgaggcacattcatctgatgctatcgccaaaataggtgaggcagaaacagataccactgtaaatgaagctagagacaatggtacgaaattaatagctacagatgttccaaatccaactaaaaaagcagaagctagagcggcagttaccaacagtgcaaattcaaaaattaaggatatcaacaataatacacaagcaacattagacgagagaaatgatgctatcgcacttgttaatagatcaaaagatgaagcaattcaaaatattaacactgcacaaggtaatgatgatgtcactgaagcacaaaataatggaacgaatacgatacaacaagtaccattaactccagtgaaaagacaaaatgcaatagcaactatcaatgctaaagcggatgaacaaaaacgtttaattcaagcaaacaataatgcaacgactgaagaaaaagctgatgcagagcgtaaagttaatgaagcagtcataactgcaaatcaaaatattaccaatgcaactactaatagagatgttgatcaagcacaaacaactggaagtggtatcatatctgctattagtcctgcaacgaagattaaagaggatgcacgtgcagcagtagaagctaaagctattgcacaaaatcaacaaattaattcaaataatatggcaacaactgaagaaaaggaggatgcattaaatcaagtagaagcacataagcaggccgcaatagcaactatcaatcaagcgcagtcaactcagcaagtttctgaagctaagaataatggcataaatactattaatcaagatcaacctaacgcagttaagaaaaataatacaaaaacaatattagaacaaaaaggaaacgagaaaaagtcagcaatagctcaaacacctgatgctaccactgaagagaaacaagaagctgtcagtgctgtttcgcaagctgttaccaatggcattacccatatcaaccaagcaaattctaatgatgatgttgatcaagaacttagtaatgcagaacaaattattactcatactaatgtcaatgttcaaaaaaaacctcaagccagacaagcattgattgctaaaacaaatgaaaagcagagtgcgattaattctgataatgaaggcactatagaagaaaaacaaaaagcaattcaaagtttgaatgatgctaaaaatttagctgatgaacaaattacacaggctgcttctaatcaaaatgtcgacaacgccttaaatataggtataagtaatatcagtaaaatacagactaatttcactaaaaagcaacaagctagagaccaagtaaatcaaaagttccaagaaaaagaagctgagttaaattcaacacctcatgcaactcaagatgaaaaacaagatgcgttaactagattaacacaagcaaaggaaactgcactcaacgacataaatcaagcacaaacaaatcaaaatgtggatacagcacttactagtggaattcaaaatattcaaaatacacaagttaatgttaggaaaaagcaagaagccaaaactacgattaatgatattgttcaacaacataaacaaagtatacaaaataatgatgatgctacaactgaagagaaggaagtcgcaaataatttagttaatgcatcacagcaaaatgtaattagtaagattgataatgctacaacgaataatcaaattgatggtattgtgagtgatggtagacaaagcataaatgcaattacacctgatacatcaattaaaagaaatgctaaaaatgatattgatattaaagcagctgataagaaaataaaaattcaaagaataaatgatgctacagatgaagaaattcaagaagcgaatcgtaaaattgaagaagctaagattgaagcaaaagataatattcaacgcaatagtactagagatcaagtaaatgaagcgaaaactaatggaataaataaaatagaaaatataacaccagcaactactgtgaaatctgaagctagacaagcagtacagaataaagcaaatgaacagattaatcatattcaaaacacgcctgatgcaactaatgaagaaaaacaagaggcaataaatagagtaagtgctgaattagcaagagttcaagcacaaataaatgcagaacatacaacccaaggtgtcaaaactatcaaagacgacgcgataacttctttatctcgaattaatgcacaagttgttgagaaagagtctgcaagaaatgcaatcgaacaaaaggcaacacaacaaacgcaatttattaataataatgataatgctacagatgaagaaaaagaggtcgccaacaatttagttatcgctacaaaacaaaaatcattagataatattaactccttatcttcaaataatgatgttgaaaatgctaaagtagcaggaataaatgaaatagctaacgttttaccagcaaccgctgttaagtcaaaagcaaaaaaagatattgatcaaaaactcgcgcaacagattaatcaaattcaaacgcatcaaactgctacaactgaggaaaaagaagcggctattcaattggcaaatcaaaaatcaaatgaagcaagaacagcaattcaaaatgaacatagtaacaatggtgtcgcacaagctaaatctaacggcattcatgaaattgaattagttatgccagatgcgcacaaaaaatctgatgctaaacaaagtatcgataataaatataatgagcaaagtaatactatcaacactacaccagatgcaacagatgaagaaaagcaaaaagcattagataaattaaaaatagctaaagatgcaggatacaacaaagttgatcaagcgcaaacaaaccaacaagtatctgatgcaaaaactgaggctatagatacgataactaatattcaagcaaatgttgcaaaaaaaccatccgctcgagtggaattagattcaaagtttgaggatttaaagcgtcaaatcaatgcaacgcccaatgctacagaagaagaaaaacaagatgcaattcaaagattgaatggtaaaagagatgaagttaagaatctaataaatcaagatagacgtgacaatgaagttgaacagcacaaaaatattggacttcaagaattagaaacgattcatgctaatccaactagaaaatctgatgcgctccaagagttacaaactaaatttatttcacaaacagagttaattaataataacaaagatgcaactaatgaagaaaaagatgaagccaaacgacttcttgagattagtaaaaataaaactataacaaatatcaatcaagcgcaaactaataatcaagttgataatgctaaagataacggcatgaatgagattgctaccataataccagcaacaacaattaaaacagatgcaaaaacggctattgataaaaaagctgagcaacaagttacaatcatcaatggtaacaacgatgcaacagatgaagaaaaagcagaggctagaaagctggttgaaaaagcgaaaattgaagccaaatctaatattacaaatagtgatactgaaagggaagtcaatggtgctaaaaccaatgggttagaaaaaataaacaatattcaaccatcaactcaaactaaaacaaatgctaagcaagaaataaatgacaaagctcaagaacaattaatccaaattaataacacgcctgatgcaaccgaagaagaaaagcaagaggcaacaaatagagtcaatgctggattagcacaagcaatacaaaatattaataatgcacatagtactcaagaagtaaatgaatctaaaacaaatagtattgctacaatcaagagtgtacaacccaatgtgatcaaaaaaccgactgctataaatagtttgactcaagaagctaataatcaaaagacgttaataggtaatgatggtaatgctactgatgatgaaaaagaggctgcaaagcaattagtgacccaaaaattaaatgaacaaattcaaaaaattcatgaaagtacacaagataatcaagttgataacgtaaaagcacaagctatcactgcaattaaattgattaatgcaaatgcacataaaagacaagatgccattaatattttgactaatctagctgaaagtaaaaaatcagatataagagccaatcaagatgcaactactgaagagaaaaatacggcaatacaatctatagatgatacgttagcacaagcacgtaacaatattaatggtgcaaatacaaatgcgttagtggatgagaatttagaagatggtaagcaaaagttacaacgtattgtgttgtcaactcaaactaaaacacaagctaaagcagacattgctcaagcaataggtcaacaaaggtcgacaatagaccagaatcaaaatgctacaacagaagaaaaacaagaagcccttgagagacttaatcaagaaacaaatggagtcaatgatagaatacaagcagctttagcaaatcaaaatgttacagacgaaaaaaataatatattagaaacaataagaaatgttgaacctattgtaattgtaaaaccaaaggctaatgaaataattagaaaaaaagctgcggaacaaacgactttaataaatcaaaatcaagatgcgacactagaagaaaaacaaatagcacttggcaaattagaagaagtaaagaatgaagcgttaaatcaagtatcacaggcacactcaaataatgatgtgaaaattgcggaaaataatggaattgctaaaatttctgaggtccatcctgagactataattaaacgtaatgctaaacaagaaattgaacaagatgcgcaaagtcaaattgatactatcaatgcaaataataaatcaactaatgaagaaaaatcagccgctatagatagagttaatgtagctaaaattgatgctattaacaatattactaatgctacaactacacaattagttaatgatgctaaaaatagtggtaacacgagtattagccaaatattaccaagtacagcagtcaaaactaatgcattagcagctctagctagcgaagctaaaaataaaaacgctataatagatcaaacaccaaatgcgacagcagaagaaaaagaagaagcaaataataaagttgatcgtcttcaagaagaagcagatgctaatatcctaaaagcgcacactactgatgaagttaataatattaaaaatcaagctgttcaaaatattaacgctgttcaagttgaagttatcaagaaacaaaacgttaaaaaccaattaaatcaattcattgataatcaaaagaaaattattgaaaatacgcctgatgcaacactagaagaaaaagctgaagctaatagattgcttcaaaatgtactaacttccacatcagatgaaattgctaatgtagatcataacaacgaggttgatcaagctttagataaagctagaccaaaaatcgaggaaattgtaccacaagttagtaagaaacgagatgttttaaatgcaatccaagaagcatttaattcacaaactcaagaaatacaagagaaccaagaagctacgaatgaagaaaaaactgaagcattaaataaaataaaccaattacttaatcaggctaaagtaaatattgatcaagcacagtcaaataaagatgtagatagtgcgaaaacacgtagtattcaagatatagagcaaattcaaccacatccacaaacaaaagcaaccgggcgtcacagattaaatgaaaaagctaaccaacaacaaagtactattgcaactcatcctaattcaacaattgaagaaagacaggaagcaagtgcaaaactacaagaagttcttaaaaaagccatagctaaaatagataaaggtcaaaccaatgatgatgtagaaaagactgtagtaaacggaatagctgaaattgaaaatatattacctgctactacagttaaagataaagctaaagctgatgtaaatgctgaaaaagagcagaaaaacctacaaattaatagtaatgatgaagcaacgactgaagaaaaattagttgctagtgacaatttaaatcacgttgtcgagacaacaaatcaagctattgaggatgcaccagataccaaccaagtgaatgtagaaaagaacaaaggtataggtacaattagagatattcaaccacttgtagttaaaaaacctactgccaaatctaaaattgaaagcgcagtagaaaaaaagaaaactgaaattaatcaaacacaaaatgcaactcatgatgaagtaagagagggtttaaatcagttaaatcaaattcatgaaaaagccaaaaatgatgtaaatcaatctcaaactaatcagcaagttgaaaatgctgagcaaaatagtttagatcaaatcaataacttcagaccagattttagtaaaaaacgtaatgcagtagctgaaattgttaaagcgcaacaaaacaaaattgatgaaatagagcaagaatttagtgctacacaagaggaaaaagacaatgctttacaacatttagatgaacaggttaaagaaatcattaattctataaatcaagctaatacagataatgaagtagataatgctaaaacttctgggttgaataacataactgaatacagaccagaatataataaaaagaaaaatgctatattaaaattatatgatgtttcagatactcaagaagctataattaatggttatcctgatgcaactgaagatgaacttcaagaagctaatagtaagttaaataaaatacttttagatgcaaaaaaacaaattggtcttgcgcacacaaataatgaagttgatgatatttataatgaagtttcccaaaaaatgaaaactattttaccacgtgtagatacaaaagcggtagcacgttctgtacttaatgcacttgctaaacaattgattaaaacttttgaaaatactgcagatgttactcacgaggaacgtaatgatgcgattaatcatgtaaaagaacaattatctttagtattcaatgccattgaaaaagaccgaaaagatatacaagttgcgcaagatgaattatttggattaaatgaattaaatagtatatttatcaacataactcaaaagccaactgccagaaaagcaattagtggtatggcgagtcaattaaacaactctatcaataatacgccatatgctacagaagaagaacgacaaattgcactgaataaagttaaggcgattgttgatgatgcaaatgaaaaaatacgagaagctaacactgatagcgaagtacttggaacaaaaacaaacgcaataacattgttacaagcaatcagtgcggatgtacaagttaaaccacaagcatttgaagaaatcaatgcacaagctgaaattcaaagagaacgaattaatggaaatagtgatgcgacaagagaagaaaaagaagaagctttaaaacaagttgatacattagtaaatcattcatttattacaattaataatgttaataaaaatcaagaagtttatgatactaaagacaaaacgattgaagctattcataaaatcaaaccaatatcaactatcaaaccacaagcattaaatgaaatcactattcaactagacactcaacgtgatttaataaagaataataaagagtctacagttgaagaaaaagcctcggctatcgataaattaattaaaactgcagcaagaatagccgaagcaatagataaagctcaaacaaatgaagaagttaaaaatattaaaaaacaaagtattgatgaaatttctaaaatactacctgttattgaaattaaatcagctgcaagaaatgaaattcatcaaaaagcagaagttattcgcggattaattaatgataatgaagaagcgactaaagaagaaaaagatatcgcattaaatcaattagacacaactctaacacaagcaaatgtttcaattgaccaagcattaacaaatgaagctgttaatagagctaaagaaatagcaaattctgaaattaataaaatttctgtcattgccattaaaaagcctgaagctatagcagaaattcaagaactagcagataaaaaattaaataaatttaaacaaagtcaagaagctactattgaagaaaagcaatcagctatcaatgaattagaacaagctttaaaatcagctattaatcatattcatcaatctcaaaataatgaatcagtgagcgctgcattaaaagaaagtatatctttaatagactcgattgaaattcaagcacataaaaaattagaagctaaagcatacattgatggatatagtgacgataaaattaatgacatatcttctagagcgactaacgaagaaaaacaaatatttgtaagtaaacttaaagcattaatcaatcgtacacataaacagattgacgaagctgaaacatttgtttcagttgaaacaattgtccgaaactttaaagttgaagcggataaattaaactcaattgtacgtaaaaaagctaaagcatcgaaggaaattgaattagaagcagaccatgtaaagcaaatgataaatgcaaatttaagtgctagtactagagtgaaacaaaatgctcgtacattgataaatgaaattgttagtaacgctttaagtcaacttaataaagtaaccacaaataaagaagttgatgaaatagttaacgaaacgattgaaaaacttaagtcaatacaaataagagaagataaaatattgagtagtcaacgttcatcaacatctatgacggaaaaatctaatcaatgttatagttccgagaataatacaattaaatctctaccagaggcaggaaatgctgataaatcactaccattagcaggagttactttaatatctggtttagcaatcatgtcctcacgtaaaaagaaaaaagataaaaaagtaaatgactaa

SEQ ID NO: 2244 - DNA, 201 bp, Staphylococcus epidermidis
cttatcatttatatcaaatcaacttttatgtttaaaattatcatgaaagttgtttttttacaaaaagccccaaatgattttaaatataaattcatttggggcgaagttattgtgataggtttttattattattatataatatcaattttacctcagagttcaattatatcaatgatttgtcctgacacagcatctgcataa

SEQ ID NO: 2245 - DNA, 357 bp, Staphylococcus epidermidis
ttcagcacttactctatttattgcctcttgtttttcttcattagttgcatcaggcgtgttttgaatatgattaatctgttcatttgctttattctgtactgcttgtctagcttcagatttcacagtagttgctggtgttatattttctattttatttattccattagttttcgcttcatttacttgatctctagtactattgcgttgaatattatcttttgcttcaatcttagcttcttcaattttacgattcgcttcttgaatttcttcatctgtagcatcatttattctttgaatttttattttcttatcagctgctttaatatcaatatcatttttagcatttcttttaattga

SEQ ID NO: 2246 - DNA, 849 bp, Staphylococcus epidermidis
aggagagattatatggagacggttcaattttataacggaagaacaatgccgaaaatagggctcggcacttatagagtaaaagatggcgatgaatgtagagaatctgtaaaatatgctatcgaacggggttatagaagtatagatacggcaatgatttatggtaacgaagaaacggtaggtcaaggtattaaagaaggattagaatcgactggtttaagtcgtgaagatttatttataacttctaaattatggctaactgattttggacgtcaaaatgtggaagatgcctatcgacaatctgttgcaaaattaggactggattatttagatttatatctgatgcattggccaggtacaaatgaagcggtaatgattgatacttggagaggtatggaagacttgtataaacaaaatcaggtgaaaaatattggtgtgagcaattttactccagaacattttgaagcattgcttgcccaagtttctattaaaccggtcattaaccaagtagaatttcatccttatttaacacaaaataaattacgaaagtatttagaagctcaaaatattatcatggaatcatggtctccattaatgaattcacaaattctccatgatgaagtcataaatgaagtagctaatgaagtaggaaaaactccagcccaagttgtaataagatggaatattcagcacgatgttgttgttatacctaaatccgtaacaccacatcgcatagaagaaaatttagacgtatggaattttgaattaagcgacaaccaaatggaaagaatcgatcaattaaatcaagataaaagaattggacctaaccctcttgaatttgacggtaagtaa

SEQ ID NO: 2247 - DNA, 219 bp, Staphylococcus epidermidis
ttgtcaattcttacaatacgtaacgtttcttcttctctatcaaacttgaattctacgtctaaatgttttaaacgcgctttcaatttatctctcatttggaagacattcattattaacactccctattttcgcacctttttacagtttacaataaataatgttgagttaacagaaaaaactcagataatcacattaatttgttattataaattaatgtag

SEQ ID NO: 2248 - DNA, 747 bp, Staphylococcus epidermidis
ggaggaattctaatgagaaaattatttctatcaattttatctattataataatttcaagtttttgtgttgcaacagggtttcaaaacgttaatgctgcaaataatgaggtgagcaaacctcaaagtaatgtggatagtaaaactaaacaaaatattattaaaaaaataaaaaaatctaatgcttataaaaagcacgctaattcaacttctattgactcaataaaagatgacgatattattgttcatttggataaaggtaaaaacaccaatgtatattctattaactatgtatttggtaaaaaattagctaaaatgaatgataaccttgcaatgattgaattaaaatataacgaagcaaacaatgaagttttctacaatcatatgatgtattcaaaatttgttaaatataataataaagaatatattaatatgaaaggcattttaaatggcaaaccttattatgaatttaatatagatcagaaaggtcattactacgataaaaactttaaacatacctctaaagatgaaatcgaaaaagattctgctaaaaacttaccacctaaagagcgtggttggtgtgaatgggcagtaggagctttatgtggtaccggtggagctgcaggttgttgggcaactgctacagctttaggtattactactggttggggaggcttttcattaactacaatttgtggtctgataagctctctaggctgtactggtgcaaccaactatatttgtaaataa

SEQ ID NO: 2249 - DNA, 306 bp, Staphylococcus epidermidis
aaagtagcgtataagacaatgcaacttaaatacaatgaaataaataagaaccaactcatttcgtctgaaacaccgtttctagaaaactttcaagattgtataaaaattaataaaaagaacaaaatatcacaatcaactttaaactgttattataatgcattaaatatctttgatgaaaagtttggcaatacagctattaaaaatttttcacaacttaaatatagcgaaatgttaaaagagtatgcagaaggtcacattattggtggacataaaaaagacatacgaaagcaagtgttcaaaaattaa

SEQ ID NO: 2250 - DNA, 366 bp, Staphylococcus epidermidis
atgcaatatctatatatttttgtaggtggtgctttaggtgcattgataagattctgtttatcaatgcttaatgaaggttcaaccattccgttggggacatttgttgcaaatttattaggtgcttttttaatgggtagtatcggcgcattaagcctttcactttttaaaactcatcctaacataaaaaaagggcttactactggtttacttggtgcgttaactaccttttcaacatttcaatttgaacttgtaacactatttaatcagcatcattttatactatttactatatatggtgtgacgagttatattctaggaatactaagctgttacctcggtgtcaaaataggaggtagattttcttga

SEQ ID NO: 2251 - DNA, 210 bp, Staphylococcus epidermidis
ttttatcatctatattattctaaatctagtagtataaaaatttatcttaatatatttttaaatgatatcagaatttgttttttgagatccacattgaattatttaatgatttttatatcaaaaaaagtacgactaagatttcaaataaaaatcttaatcgtactcagtgaccacatttgtgatttacagtgtaattccagaatttactag

SEQ ID NO: 2252 - DNA, 1725 bp, Staphylococcus epidermidis
tatctaattcaaagtatgttgtcaattttatacattgtcactatttctattttaaagtggataaattcaatcggtatgttatactatctaaatgtaagggcttacataaattatcgtatggagggattgggtatgtctatagatacatacacagaaacacttaagataaatcagctaatagaaaaagctacatcacattttcaactatcatcaacacaattatacaaaaaaattttaaaaaatcatgagggtgagttaactgaactgggggcaataaatgttaaaacaggtaagtacactggtcgttcacctaaagataaatttatagtcactgaaccatcgtataaggataatataaattggggagatatcaatcagcccatggatgaagaaacatttctaaaactttacaataaagtactcgattatttaaatcagaaagaggaactttacatatttagtggatatgcagggagcgataaagagtcacgtcttaaacttaaggtgataaatgaattagcttggcataatttatttgctcgtaacatgtttattcgtccagaatctatagatgaagctcaaaatataaaacccaacttcacaattgtttcagcacctcactttaaagctaatcccaaattagatgggacacatagtgaaacatttgtcattatatcttttaaacataaagtgattttaattggtggcacagaatatgctggtgaaatgaaaaaaggtattttctctgtaatgaactatttgcttccaatgcaggatatcatgagtatgcattgttcagctaatgttggagaaaaaggagatgtagcactattctttggattatcaggaactggtaagacgacgctttctgccgatccaaaacgtaagttaattggtgacgatgaacatggttggaataaaaatggcgtttttaatattgagggtggatgttatgcaaaagcaattcatttatctaaacagaaagagcctcaaatttataatgctattaaatacggaacaatattagaaaacacagttacaaatgatgacggtacggtagattttgatgataacacctatactgaaaacactcgcgccgcctaccctattgactatatagagaatattgttacaccttcaaaggcagcacatccgaatacgattattttcttaaccgctgatgcatttggagttatccctcctatttctaagctaactaaagatcaagcaatgtatcatttcttaagtggattcacgtctaaactagctggaacagaacgtggtgttactgaacctcaaccttcgttttcaacttgctttggtgcaccattcttacctttaagtccaacaaagtacgctgatttacttggaaatttaatcgatattcatgatgtagatgtatatctagtaaatactggatggacaggtggtaaatatggtatagggcgaagaattagtctacactatactcgtgaaatggtagatcaagctatatcaggtaaattaaaaaatactaaatatattaaagatgatacatttggcttaaatattccagttcagattgacagtatacctacaactattctgaatcctatcaatgcttggaacaataaagataactacaaagcacaagcttacgatttgattcaacgctttaataataactttaaaaaattcggcaaggaagttgaacatattgccaacaaaggtgcatttaatcaataa

SEQ ID NO: 2253 - DNA, 252 bp, Staphylococcus epidermidis
ccgcttgaccaaggagccatggctccacaggtaggattcgaacctacgaccgatcggttaacagccgatagctctaccactgagctactgtggataaataaaatggagcgggtgatgggaatcgaacccacaacatcagcttggaaggctgaggttttgccattaaactacacccgcttaatgaaatacgattatggggcggttgaagggaatcgaaccctcgagtgtcggaaccacaatccgatgcgttaa

SEQ ID NO: 2254 - DNA, 525 bp, Staphylococcus epidermidis
acacctgcacaaaaagaagatgaaaagtttatgagcatagaaaattttgtaaatttaaagaagtatgtatctgatccccctattcaatcatatgtatttgtttatattttaatcgtcactggaggtcgctttggagaagttcaaaaactaagtagaagtgatttagattataaaaataatacaatacacttaccaggaacgaaaacagaaacttcagatagaactgtagatatacctgctgcagatatgaatatgttaagaaaaacattatctaaaatgccagtgagtttatcaaatcaattattcagtacaggtgtaggattgattacacacaatgctgtatctaaagtgttacaaaaattttgtttagaaaataaaataggtaaatatactttgcatagtataagacacacgcattgttcttatttactactcaatgacgtatctatctattacacttcaaagagattaggttacaaaaatattaaaactactatggatgcatatttcgcatctattagatga

SEQ ID NO: 2255 - DNA, 201 bp, Staphylococcus epidermidis
agaataaaacagccacaagtattgcaacaattaagccaattactgtcggtgaagaaaaatccattaaaacaacgctcctttatcagtttcaataactctaattataatagaaaaaaggcttattttcgacatatattttataattatttattttctattttacaagtcattgaatttcaacagcatcttttaaaacattga

SEQ ID NO: 2256 - DNA, 1194 bp, Staphylococcus epidermidis
gaggaatataacatgcaattcgatacaattgagttggctatagaggctttaagaaatggagagagcattattgtagttgacgatgaagatagagaaaatgaaggagatcttgtagctgttacggaatggatggatgataataccattaattttatggctagagagggtcgtggtctgatttgtgcaccaattgataaatctatagctgaaagattaaaactacaatctatggagcaaaataacactgatatttatggcacacattttactgtaagcattgatcattataaaactactacaggaatcagtgcacatgaacgtacacaaacggctagagcactcatagatgaaaatactaatcctgaagattttcatcgtccggggcacttatttccacttatagcaaaagagaatggtgtgttaacacgtaatggtcatactgaagctgccgtagatttggcacggttaacaggagcacaaccagctggagtaatctgcgaaattatgaatgatgatgggacaatggctaagggtgaagatctccagtcatttaaagaacgccaccatttaaaaatgattactataaaaagtttggttgcttttcgtaaggctgttgaacttaatgttaatcttaaggcaaaggtcaagatgccaacagattttggtcattttgatatgtatggatttacaacggattatagcgatgaagaaatcgttgctattgttaaaggagatttaaaaagcaatcctaatgtacgtatgcattctgcttgtctgactggggatatttttcatagtcaaagatgtgattgcggggcacaacttgaagcgtcaatgaaatatattgacgaacatggtggaatgattatttatttacctcaagaaggtagaggaatagggttaattaataagttgcgcgcatatgagttgatagaaaaaggttatgatacagttactgcaaatcttgctcttggttttgatgaggatttgagagattatcatgttgcagctgaaatattaaagtattttgatataagtgaaattaacttgctcagcaataatcctaaaaaatttgaaggtttagaagattacggcattgagatcgtagatagaattgaacttatcgttccagaaacacaatataaccatagttatatggaaactaaaaaaaataaaatgggacatttaatatag

SEQ ID NO: 2257 - DNA, 198 bp, Staphylococcus epidermidis
gttcgaatcctacctgtggagccatggctccttggtcaagcggttaagacaccgccctttcacggcggtaacacgggttcgagtcccgtaggagtcatacaaacagaagtgaaatatcgcttctgtttttttattattatattctatcatggagagttgtccgagttggccgaaggagcacgcctggaaagtgtgtag

SEQ ID NO: 2258 - DNA, 1011 bp, Staphylococcus epidermidis
aacgtttacaaggaggaaattatgacagttacaatttatgatgtagcccgagaggctagggtatcaatggcaactgtttcacgtgtagtaaatggaaaccaaaatgttaaaccagaaacacgtaataaagtaaatgaagtcattaaaaggttaaactatcgacctaacgcagttgcaagaggtcttgcaagtaaacgtacaacgacagttggagttataattcccgatatttcaaatgtttattattctcaacttgcaagaggtttagaagatattgcaacaatgtacaaatatcactcaattatctcaaactcagataatgatccagaaaaagaaaaagaaatttttaataatttattaagtaaacaagtcgatggtattattttcttaggtggaactatttctgaagaaattaaaagtcttattaatcaatcatctgtaccagtcgtagtttctggaacggatggtaaggatgatcatattgcatctgtaaatattgattttaaacaagcagccgaagaagcaacacaatatcttatagagaagggtgctaaaacattttctttaataggtggagaatactctataaaggcacaagatgatgttttagagggccttaaaaatgttttaagtcagcatcaactaaaattagacgatacattacatttaactggcaatgaaagttacaaatcaggtataaaaacatttgaacaattgcaatcgaatttaccagatgctgttctttgtattagtgatgagcaagcaataggtatattgcatagtgcacaagatgctggagtgaaagtacctgaagacttacagattattagttttaacaatacacgtttagtagaaatggtgagaccacagttatctagtgttattcaaccattgtatgatattggtgctgttggaatgagattactgactaaatacatgaacgatgaagaaattgaaaatcctaatgtcatattgcctcatagaatagaataccgtgggacaactcagtaa

SEQ ID NO: 2259 - DNA, 882 bp, Staphylococcus epidermidis
tttaacaacaatgacctaagaggtgtgaatatgactaagcacaagaaaggctcaatattagctatcataggtttgctaattgtatttgttgttacaggttttatcttcttttcaatgatttcagatcaaatatttttcaaacatgtcaaaccagttgaaaaggttgaaaaattagataaaactttagataaagcatctaaaaagcaaatacacaattatacgagccaacaagtatctaacaaagcaaatacagcttggcgtgatgcgtctggtacagaaattaaagaagctatggatagtagtaaattcatagatgatgataaacaaaaatatcaatttttagatttgtctaagtatcaaggcattgataaaaacagaattaaacgcatgttgtttgatagaccagtactactaaaacatacagatgattttattaatgctgcaaagtctaaacatgtcaatgaagtatatcttatttctcatgctctattagaaacaggcgcagctaaaagtgaactggctaatggtgtagaaatagatggtaaaaaatattacaatttctatggtgttggtgcattagatagtgaccctattaaaacaggtgccgaatatgctaaaaaacatggatgggacacaccacaaaaagctatttatggtggcgctgattttattcataagcatttcttatctcatgacgatcaaaatacactttatagtatgagatggaaccctaaaaacccgggtgaacaccaatatgctactgatataaaatgggctgaaagtaacgcgaatatcattgcagatttctacaagaacatgaaaacagaaggtaaatacttcaaattatatgtttataaagatgacgataaacaccaaaaataa

SEQ ID NO: 2260 - DNA, 783 bp, Staphylococcus epidermidis
ggcaaattaaataagtttaaaagaaaggtgactttgatgaaatttcgacgtccaaatcaacatttccaaatcgtagcgcatagaggattacctgaagattatcctgaaaatactattatcgcttatcgacatgcgctcatgttacatatagatatgttggaaattgatgtacattacacaaaagataaagaacttgtcgttatacatgatgatactatcgatcgtacgtcaaatggtaaaggtaaggtttctgattttactttaaaagaattaaaagcgttagattttggtttctataaaggagagaaatttaaaggggagagtataccgacttttgatgaagtgttagatttagcagataacttttcacaaaaattattaatagaaataaaaaagcctagtcagtatccaaatattgaaaatatgattgttgataaattgaaggaaagacaaatatctaaatctaaagtgattttacaatcattcgattttgattgtgtaaaaaaattgtcagcaatgaatttagattatgaattaggtttattaattagtaagaaaaaatattggcacaagttaccaaatttcaaaaaaattgccaaagttgctgattatgctaatcctaattatcaaattgtttcgaagaaatttatgcaacttgctcatgaggaagagttaaaagtattaccttatactgtaaataaattaaaagaatcacaaaaattaatagatattggtgttgacggtattatttccgatgtacctgaagatttatttgagctataa

SEQ ID NO: 2261 - DNA, 552 bp, Staphylococcus epidermidis
ttattttcaaacaataagttaacttctatttatccggaaatcattttatgtgcacaaataggagttaattacatgtcatttgaggaagcatataaaaaatacaacaatatcatacattatttgttaaaaagttatcaaatcacttataattatgatgaattttatcaacaaatgctcattaaaatgtggcaacttacactcgattttgatgaacaacaatcttcttcttttaaatcttatctatttatacgcctaaaattctatcttatagatttatttagacaaaaagacaatacgcttaatatatgtagcattgacgccctttcagaactttctccgtcattttcaatcaacgaaatcgatttacttattaaagatatttcacaacagttacttccacgcgaacgagattggttaaccttatatttacaaggatacaaacaatatgaaatttcccaaattttagatttttcacttacaacgattaaaaaaataaaatctaacgcaatacgaaaactacgtcgttatttaaattcatctacaaaggattga

SEQ ID NO: 2262 - DNA, 453 bp, Staphylococcus epidermidis
gaactaacaaaggagagatgtaaaatgggaaaaagtactaatttatttaaaattgcattaggcattggtggtgcaattactgttgtagcattatcacgtaaagaaagtcgagataaacttaaacaagaatataataaatataaagaaaatcctgaatcatataaatctagcgctaaagatttagcaactcaaataggtaataaagctaatgaaacaattcaagaagttaagaagaaccctaaagactatgttgaacgtatcaaaagtaatcctaaagaatttttagaagaagaaaagtctaaaattattggcaaaaatgatcagacacaagatgatattgaagaaggaaaatttgatgctgaaggcggcgcaactgtcaataacaatttaagagttgttactgaagatgacttaaaaaataataaaaatgcattacaagataaaaaagaataa

SEQ ID NO: 2263 - DNA, 852 bp, Staphylococcus epidermidis
tttatgacaaaagtttttataaatggtgaatttgttaatgaagaggatgctaaggtttcatatgaagatcgaggctacgtgtttggggacggaatctatgaatatatacgggcatatgatgggaaattgtttaccgttaaagagcattttgaaagatttttaagaagtgctgaagaaataggactagatttaaattatactattgaggaattaattgaattagtacgccgattattaaaagaaaataatgtggtgaatggcggtatttatatacaagctactcgtggtgctgctcctcgaaatcattcatttcctacaccacctgtaaaacctgttattatggcgtttacaaaaagttatgatagaccttatgaagaattagaacaaggagtttatgccattacaactgaagacattagatggttacgttgtgatattaaaagtttaaatttattaggaaatgtattagctaaagaatatgctgttaaatataatgctgcagaggctatacaacaccgaggtgatattgtcactgagggtgcatctagtaatgtttacgcaattaaagatggagtgatatacacgcatccagttaataattttatattgaacggaattactcgccgtgtcataaaatggatagcagaggatgaacaaataccattcaaagaagaaacatttacagtagaatttcttaaaagtgctgatgaagttatcatttctagtacttctgcagaagttatgccaattacaaaaattgatggtgaaaatgttcaagacggacaagttggtactataacacgacaattacaacaaggatttgaaaagtatattcaatcgcatagtatttaa

SEQ ID NO: 2264 - DNA, 1248 bp, Staphylococcus epidermidis
attgagaaaaatataaagagagggactcatgatatgaatatacctaaatcagtatggtggctagttataggtatggcacttaatataaccggcgccagttttttgtggcctttaaatacaattttcatgaaggaagaacttcataagagtttaacaattgcaggtatcgttttgatgattaattcatttggaatggttgtaggtaatttgttaggtggttctttgtttgataaacttggtggttacaaaacgattttaataggtacatttacgtgttatgttagtaccacattactcaacttgtttcatggctggccatggtatgcaatttggttagtactacttggatttggtggcggaatgatagttcctgctatttatgcgatggcaggtgccgtttggcctaatggaggaagacaaacttttaatgctatctacttagcacaaaatataggggttgctttaggcgcggcattaggaggttttgtggctgaatttagtttcaattatatttttatggcaaacctcattatgtatgtactttttgccatcgtggcgattacacagttcaatttagagattaatgctaaatttaaaccacaagattcgatagatttaaaaagcaaagaaaataaaaaacgatttactgctatgatgctagtatgtgcaatgtttgcaatttgttggattgcatatattcaatgggaaacaacgatagcttcattcacacaatcaattaatatttcaatgtctcaatatagtgtattatggacaatcaatggaattatgattttagtagctcaacctttaataagaccaattattatcttattaaaaggtaatttaaaacatcaaatgtttgtaggtattttaatttttatgagttctttcctagtgacgagttttgcaaatcactttgctatatttgtagttggcatggtcattttaacttttggagaaatgtttgtttggcctgcagtaccaactatagcaaatcaacttgcaccagttggaaagcaagggcaataccaaggatttgttaattcagcatctacagtgggtaaagcatttggaccatttattgggggtatacttgtagatacatttaatatgagtatgatgtttattgggatgattatattattaagttttgcactgttatttttaagtttctatgataaagtgttacccaagaattttaaaaatcaacatcaatcaagaagacgacgaaatcagaatggtatttaa

SEQ ID NO: 2265 - DNA, 471 bp, Staphylococcus epidermidis
ctaattttgaaaagaggtacctatcaaatgagtaaaaatgaattcatcaaaagagtaaataagcaattatggtttttaaatgctaaagaggaggatgcacttaacaaatatattgactcagttgatcagaataaaagtattgatacccataagcccataagattttcaaatgaatatttaaagaaatttatatttaatcataagaaaaaatcgacttctcatgtgttcgtacttttaatttgtatggttttagcttatgcatttttgctcggactttttattttagggttagtggccagcttagctattgtgcatgcctatatcaacccaaatattgatttatcagtttttgttatattaactgttttgattgtcgcgataattataatgattgctagtttatatgctattaaacatacgactgcattgtttactaagaagcttttagaatataaatttaataaaaggtag

SEQ ID NO: 2266 - DNA, 474 bp, Staphylococcus epidermidis
gaggactcgaaaatgaattttgaaggtaaattagttggtaaggatttaaaaattgcgattgttgttagtagatttaatgattttattactacacgtttacttgaaggggctaaagatacacttattcgtcatgaagtagaagatacaaatattgatgtagcttatgtgcctggcgcattcgaaattccactcgttgcaaaaaaattagctcaaaaaggtgaatatgatgctgtgataacattaggatgtgtgattagaggcgcaacttcacattatgactatgtatgtaatgaagtagctaaaggtgtttctaaagcaaacgacatttcagatactccggtgatttttggagttctaacaactgaaagtattgaacaagcagttgaaagagctggtactaaagctggaaataaaggttcagaagcagcagttagtgcaatcgaaatggctaatctaattaagcaaatcaattaa

SEQ ID NO: 2267 - DNA, 498 bp, Staphylococcus epidermidis
cgcaatacgaaaactacgtcgttatttaaattcatctacaaaggattgacatctatgaaatgtatatcaacgcattcacttttatatattcaaactgcgttttcaacaaatgttgaaacctatattcagtatgaacattacgctattcatttaccatgtacacctgaaaaaacattacattatttattggaattacatcaaaaatcctatcataatcaatgtatgttatctaaaaatattttaaacattaaaaaattcatacctatctatattaatgaggaaaccatattatttccagttacgcaaaaacgtgcaccgattaaatattttatcaatgcacgaaatattataggaattcattcttcaattcataccacaatgattgtttttgaagatggtacgactatcgaactgaacatcccctatacacttgtaacaaaaaaatggcagagaaatcttaccgtaggtcatatcataaaaaaaactaccttttattaa

SEQ ID NO: 2268 - DNA, 2508 bp, Staphylococcus epidermidis
ctgttagcgaataagggtggtaacgcggcacaggtcgtccctttcaaatcattaatagtagagatgtctttttatgaattaggaggaaatgtgttgaattataatcataaggaaattgaaaaaaagtggcagaattactgggaagaaaataagacctttaaaacgaatgataatttaggacaaaagaaattttatgcattagacatgtttccttatccatctggtgctggtttacacgtaggtcatccagaaggatatacggcaacggatatcatctcacgatataaaagaatgcaaggttacaatgtattacatcctatggggtgggatgcttttggtttgccggcagaacaatatgctttagatactggtaatgatcctcgtgaatttacacagaaaaatattcaaactttcaaaagacaaattcaagaattaggatttagttatgattgggatagagaagtgaatactacagatcctgaatattataaatggacgcagtggatatttattcagttgtataataaagggttagcttatgttgatgaagttgctgtcaattggtgtcctgcattaggtactgttttgtcgaatgaagaggttgtcgatggggtatcagaacgtggcggtcatcctgtttatcgtaagcctatgaaacaatgggtactcaaaattacagaatatgctgatagattactagaagatttagatgagttagattggcctgaatcaattaaagacatgcaacgaaactggattggacgttcagaaggtgccaaagtaacatttaaaattgagcaatctgaccaaaatattgaagtgtttacgacacgaccagatacaatctatggtacttctttcttagttttaagcccagaacacccacttgtgaatgaaattacgacaagtgataaagaacaagaagtcaaattgtatcaaaatgaagcatcaaaaaaatctgatttagaacgtacggacttagctaaagaaaaaacaggtgtgtttactggaacatttgcaattaatccgctctctggcgataaattacctatttggatagcagattatgttttatcaacttacggtactggtgcagtaatggctgtgcctggacatgatgagcgagatcatgaatttgctacgaagtttaatttaccaattatcgaagttatagagggtggcgaagttcaaaaatatgcatacacaggtgaaggaaaacacattaattctagagaattagacggtctagaaaatgaagcggcaataagtaaagcgatagaattgcttgaatctaaaggtgctggtgagaaaaaagtcaattataaattacgtgattggttatttagtaggcaacgttattggggagaaccaattcctattatacattgggaagatggatcaatgactacagttcctgaagatgaattgcctttactacttcctgaaacagatgaaattaagccatcaggtaccggtgaatctccacttgcaaatatagatgcgttcgtaaacgttatcgatgaaaagacaggtatgaaggggcgccgagaaaccaatacaatgcctcaatgggctggcagttgctggtactatttacgttacattgatccacataacgaaaaaatgatagcagatcctgaaaaattaaagcattggctacctgttgatttatatattggaggcgtggaacatgcagtacttcacttattatatgcaagattctggcataaagtgttatatgacttaggtgttgtaccaacaaaagaaccattccaaaaactatacaatcagggaatgattttaggcgaaggcaatgaaaaaatgagtaagtctaaaggtaatgtgattaatccagatgatattgttgcatcacatggtgctgatacattacgactatatgaaatgtttatgggacctttagatgctgcgatcgcatggagtgaaaaaggtttagatggttctagaagattcttagatcgtgtttggagacttatcattactgatgaaaattcaatcaataaaaaaattgtagattctaacaatcattcacttgataaggtttacaatcaaactgtgaaaaaagtaacagaagattttgatacacttagttttaatactgcaatcagtcaattaatggtgtttattaatgagtgttataaaaccaatgaagtttacaaaccttatatcgaagggtttgtaaaaatgttatcgcctattgcaccacacattggtgaagaattatgggatcgattagggcatgaaaataccattacttatcaaccatggccaacatttgatgaaagtttattagtagatgatgaagttgaaatcgtagttcaagtcaatggtaaagttagagcaaaaatcaatattccaaaagatttatctaaagaagaaatgcaagacttagccttgtctaatgataatgttaaaatgagtattgaaggaaaagaagttaaaaaagttattgctgtacctcaaaagctagttaatatagttgctaaataa

SEQ ID NO: 2269 - DNA, 3534 bp, Staphylococcus epidermidis
ataattaagaaaggtagtgtaattatgagctggtttgataaattatttggcgatgacaacggttcgaatgacgatttgttacgcaaaaataaaaatagacgtcagtctcagcaatcaaaacaaaataatcaagactcattactgcctcaaaataatgatatttatagtcgaccaagaggtaaatttagatttccaatacaagtttctgaaaatgaatatacgcaaaaaaatgaaaattataatgaacataaccaagaagaaacaaacgatataatgagatcatataaccagcatgataatcctgaatttgattcttctggtaaaagacatcgacgccgacgccaagcgtattcaaaacacgatcaatctaagattacacaacaaaagcaatttgcagataacaattatacaaataataacagtgtttttaatcaaaacgacaataagaaatcttcacaacaacgtaaatcaatacaatctgaaaatatcaaaaacaaagcaaacactaagaatacgtcgacatctcctgaatttacatatttaaatcatagttttaaatcaagcgaggtaccctcagcgatttttggtacaaaaaaacgaagaccgattgagaatggtgtcataccgccagaacataaggaattaaatgataaagagattgttcaacaggatgaagtctcgcattcaacgaaatcaatagatgcatcaaaaaatgtttctaatagtaacgataacaatattgaaaaaaatcaacagaaaaaacaacaaacaactgctcaaactgagtcatcatcagaaaatatgcataatgttgaaaagtcaaattatcaaactactaagcgtaaaacaccaaattactctaaagtagataatacgattaatattgaaaatatctatgcttcacaaattgtagaagaaatcagaagagaaagagaacgtaaagttctacagaaacgacgttttaagaaagccttacaacaaaaacgtcaacaaaatcaacagtcagaagaggattcaattcaaaaagctattgatgaaatgtatgctaagcaagcccaacattacacaggcgaaagttcattggatttagaaaatgaaagtaatcaagattcgtcatctaatagtctagagaaacaatcaaatagcagcaacattgacaataaagaagcccaaaataacacacctttatttaactacgaagaaattgacttagatacgacatcagatgtatataaagttaatgaagaagaaactgaatctaaaaatgatgaagatttagtatcatcaaatcattatcattctaatgatgatgcggaagtagaagatgccgaatatcacgaattagatgataaccgacaacaaaaccaaagtaactctcaagacgatataattagttcaaaatcaagtacttcaaatatgtatgataatgcaatcagtgcaagtgtagataataacactgaaagagctaaatcaaatgaagataaaaatgatacagaaattacacacttagatggaacaacaagtgcaaaagttagtgacgagaaaattgaatctaatacaaacaatcatttagaacaagataagaatgtaaaattaaaaaatgtaaattcattaaaatcttcaaattctgatacaggtcaaacaagaaaacaacgttttggtggtagtagaccgtttaatgttttaatgacaccatcagataaaaagagaatgatggatcaaaaccacaaaaaagtaagtgttccagagcttaaacctgaaaaacaagcgaatgcaaatcatagaaaagacagcgaatctaataaatctgaagaatttaaacaaatcaatactaatagagaaaccgattctaatagttatgaatctaatggcatagagcatgatatgaattcatcaagtgatgagcacgtatatgaaacaccatccaaacaacaggatgagcaaatacaaaagctacaagatgattttcattttgaaaacgcaaatcatgctaaaattaacaattcaaatgaaactggcaatcaaagtaatataagtcattcaaaacggtcacaatattcaacaaatgaaagtaaaaatattgatacacaaacttcaaattcaagtacatcaaatcaaaattttcaacgtattcgtaaaggaccgaatattaaattgccgagttatcaattattggaagccccagaaccacatgaaaaagatcaagattggatagataataaaaagcaagaattaaacgacgcattatattatttcaatgtgcctgcggaagtgaaaaatgtaacagaaggaccgagtgttactcgattcgaattatctgttgaaaaaggtgtcaaagtatcaagaatcacggcattacaagatgatataaaaatggctttagctgctaaagatattagaattgaagcaccaattccaggtacaagtttagtaggtattgaagtgccaaatcaaaatcctactaaagtgaatttaaggtcaattattgaatcacctaaatttaaaaatacagagtccaaacttacagttgcaatgggttatcgaattaataatgaacccttattaatggatatcgctaaaacgcctcatgcacttatcgctggtgctacagggtcaggcaaatcggtatgtatcaatagtatcttaatgtctttactttataaaaatcatccagaagaattgcgtttattactcattgatccgaaaatggtagaacttgcaccgtataacgatttaccacatcttgtatcacccgtaataacagatgtaaaagcagctacacaaagtttaaaatgggctgttgaagaaatggaaaaacgttataaattgtttgctcaatatcatgtcagaaatattactgctttcaataaaaaagcaccttatgagcaaagaatgcctaaaattgttatagtaattgatgagttagctgatcttatgatgatggcaccacaagatgtagaacaatcaattgcacgtatagctcaaaaagctcgagcttgtggtatccatatgttagttgctacacaacgaccatcagtgaatgtaatcactggtcttattaaagctaatatacctactagaattgcatttatggtttcatcgagtgttgattctagaacgattttagacagtggtggcgctgaaagattattaggttatggtgatatgctttatttaggtagcggtatgaataaacctatacgtgttcaaggtacatttgtttcagatgacgaaatagatgaagttgttgactttattaagcaacagcgtgatcctgaatatttatttgaagaaaaagaattattaaagaaaacacaaactcaagcacaagatgatttatttgatgatgtatgtgagtttatggttgaagagggacatatttctacttctcttatccaaagacatttccaaattggttataacagagcggcaagaattatcgatcagctagaacaattaggatatatttcaggtgctaatggttctaaaccaagggatgtttatattacagaagcggatttaagtaaagaataa

SEQ ID NO: 2270 - DNA, 831 bp, Staphylococcus epidermidis
aaaatgtggaagtgggaaacagaaaatgacgcaaaaggcgttgttgtcattgctcataatattttagaacatacaggtagatatgcatatgttatcacgatgttcagacgaaatggttatcacgttatcatgggcgatttaccgggacaagggcaaacttcacgagctcaaaagggacaaatagatgattttaatacgtatcatgaaaatatattagagtggataaaaatagctaatgaatataaaattccaacatttgttttaggtgtgggactaggtggtctcatcattttaaatctgcttgagaaaacagaattacctattgagggtatcttgttattttcacctatgttagaactaaagagagactataaagggtgcaaaaataaattgatttctaatgttggtaaaatttctaaagatactagatttaaagttggtataactcctcaagatttaacacgtaatgatgaaattattgaagaaacagcaaatgatggactaatgcttaaaaaggtaacatatagttggtataaccttataaatgaaaagatgaaagaaacaatggatcatatcagagatattaaacctatttcagcattgataatgtatggtaccaatgataaaattttagaaactcaatctattaatgaaatgaaagataaattaaagtcgaaagagatgtactttaaagtttgggatggattatatcatgaaatacataatgaacctgaacgcgatttggtgatgagatatgttctatcatttttgaataatagtgtaaatactatgggttttatagtaaatgaagaggaaattgaagacatttaa

SEQ ID NO: 2271 - DNA, 222 bp, Staphylococcus epidermidis
aacgatgacctaccattggtaattgtacggcactcaagatttgttccggtacaggagttggtccaggtgttaataataaaggttggtaatactgcattgtacattcctcccataataagatttatttattttagcaaaaattctgaatatttaaaacccttattatatagctatcacataattaaaacgtttacatgtttaaaatttgtgatagctatatga

SEQ ID NO: 2272 - DNA, 1665 bp, Staphylococcus epidermidis
gttatgagtgaaagtaaagaaatggttcgtggaacctttttaattacaataagtattttaattacaaaagtattaggtgtcttatttattattccgtttactgctttaataggtggacaagccaacatggcaccttttacttatgcttatgcaccatacaatatagctatagctatagcaacagctggtgttccgcttgccgcgtcaaaatatgttgctaaatataatgcactaggtgcatataaggtcagtcagaagttttataaatcaagttttgtagtcatgagtattacaggaattgtaggtttcctagttttatatttattagcaccatacatagctgaactaaccttatcacgtaatactcatggtaatagtggatggacagtagctgatatcacttggattattagaataataagtatggtagttatatttattccagttctcgcaacttggagaggaatatttcaaggatacaaatcgatgggacctactgcagtgtcagaagttacagagcaaattgcaagaattgtatttattttagtaggtagttatttaacgctcaatgtatttggaggtacagttcttcaggcaaatggtattgcaacgtttgcagctgcaataggtgcaatcgcaggaatacttacattatggtattactggattaaaagaagaaaaaatattaaaaaaatggtcgactcagatacagcgaatctaaatgtttcatacgggaaaatgtataaagaaattattgcttatagtataccgtttgtcatagtaagtttgaattttccactatttaatttggtcgatcagtttactcataatggtgcgcttaaccttgtaggtgtcaaacctggtttgcaagatatattctttaacatgttaaacatgtctacaaacaaaatagtaatgattccaacatcattaagtgctggatttgctgtcagtttaataccatttataactaaaacctatgaagaaggtagatatgcagagatgcatcgacaaattagaacttcgattggagttttaatgttcattactgttccagctagtattggtatcatggcattagcgcaacctttgttcacagtattctatggttttgatccagttgttcacggtcacgatccaaatttcgatggaagtagattattattttattatgctcctgttgcaattttaatttcattattaagtgttacagcatcaatgttacagggtatcgataaacaaaaactaacagtttttgttattttaggatctgttttaattaaactgattctcaattatcctttaattatgttattacacacacctggcgctgtattaagtacagcaatagctttattatttgcaatttgttgcaatttctatattcttaaaaaatatgcaaactttaaatttagttacagttggatacatttagctaagattattctaatttcaatcatcatgatgattggggttgaggtgattttcttcattttaagattattcttggaaccaactagatttaattacttgattattgttgcaattggtgtcattgtgggagcaatcatttatggtggtattacaatcaagactaaattagctgatgaatttttaggtgatattcccgctaaaataagacgtaaagtgaagatgttgcgatga

SEQ ID NO: 2273 - DNA, 258 bp, Staphylococcus epidermidis
atgaccttagatatgcccgcttcaatgattttatccacacaaggtggcgttgaaccatggtgtgtacaaggttctaatgaaacgtatatggtagcaccttgggtatttaaacctgccatttcaatagcctgtacttcggcatgtttatctcccttttttaaatgtgcacctaaacctacaatcctaccgtttttaacaacaacggatcctactggtggattaacacctgtttgtccatttaccatttttgctaattga

SEQ ID NO: 2274 - DNA, 1242 bp, Staphylococcus epidermidis
caaatgtcagaacaagaaaagaatcaacaccactatcgtaattcttcacagaagcgacacacttttccatggattaaaacaattattgttgcaataatcgctggaattattggagcacttctcgtcttaggtattggtaaactcctaaataaaactggttttaacaatgaaggtgctactgttcatcaagtttcaaatagtcatggtggcaatcagctagatggtaaaagtaatcaatacaaatcagtacatgacatgattaaagacgtttctcccgcaattgtcggcgtgataaacatgcaaaaatctacaaaccttgatgatttattcaacggtaaggcatctaaatcaaaagaagcgggaattggttccggtgtgatttatcaaataagtgatggttccgcatatatcgttacaaataatcacgttgttgatggtgcttcggaaattaaagttcaactacataattcaaaacaagtagatgccaaattaataggtaaagatgccctaacagatattgctgttctaaaaataaaagatacaaaaggaataaaagcaattcaatttgctaattcgtcaaaagttcaaacaggagatagtgtttttgcaatgggtaatcctctaggattagaatttgcaaattctgttacatcaggaattatttcagctagcgaacgtacaattgacgccaatacttctgctggtaatactaaagttaatgttttacagacagacgctgcaataaatcccggtaattcgggtggtgcattagtggatattaacggaaatctcgttggtatcaattccatgaaaattgcggcagcacaagtagaaggtataggttttgctatacctagtaatgaagttagagtgaccatcgaacaactcgttaaacatggtaaaatcgaacgcccttcaatcggtataggtcttataaatttaagtgatattcctgaaaactatcgtaaagaactacatactcataaagacaaaggcgtttatgtagctaaagtagacagtgaaaatgccattaaaaaaggtgatattattactggaatagatggtaaacaaataaaagatgatacagatttaagaacttatttatacgagagcaaaaaaccaggtgaaatggttactctaaaagttatcagagatggtaagacacaagacattaatgtaaaattaaaaaaacaagcatctgcatctgaatcatctcaatcacaaagtcaatttgctcaataa

SEQ ID NO: 2275 - DNA, 792 bp, Staphylococcus epidermidis
aaacacttggattttattaaggaaaagcgcatgccaatcgaatatgaaactcatttttttaatgaagtaacatatcttgtagattatttaaaagtcaaggctctgatgatgattccgaaaaataaaaaagatatcaaacgtatcgttatatacttaagaggtggtaaagggcaagttggaagagtgagagctgcaagacttatgcaatttgcaaatgaatatactttagttataggtccttactatagaggaaataatggaagtgaaggaagagatgaattttaccgcggtgatttaaatgatgtaacgcatttgattcgacttttaaatcaaaactatccttctgcatttatacatatggtaggattttcacgtggaggtctacaaggattacttacttttaatgatttgcctgtagatagttatatgatttggggtggcgtatctgatatacatttaatgtatgaagaacgagttgacttgagaggtatgctacgacgaatggttggacatccaaaaaaagatgcgaaagcttataaaagcagagatgcaatgcaatttataaaaaaagatagtcctcctattctcattattcatggtggcaaagatattcaagttggaatacatcaagcttatgatttagaaaaaaaattaaaatccaaaggaatttattatcaaacctattatcaattggatgaaggtcatgtaccacgacctcctgcgatgagagacgtaattcgatatatacatcaatggatgaacgacgtcgaaaataaaaatttaaatatatag

SEQ ID NO: 2276 - DNA, 1284 bp, Staphylococcus epidermidis
aaaggtatggaggttatcatcatgtatcaaacaattgttatcggaggtggcccaagtggggctatggctgcggttgctgcaagtgaaaaaaataaatcagttttattaatcgaaaagaaaaaaggtcttggacggaaactaaaaatctcaggtggtggtcgttgcaacgtaactaatagacttccatatgatgaaatcataaaaaatattccgggtaatggtaaattcctatatagccctttttcagtttttgataatctttctattataaatttttttgaaacccgtggagtcaaacttaaagaagaagatcatggtagaatgtttccagtttcaaataaatctcaagatgttgttgatgtgcttattaaccaactcaaagaaaatcatgttgaggttaaggaagaaacaccagttgtcagtgtttcgtatgaccataattttaaagttaaaacacaaataggtgaatttgaaagtcacagtttaattattgctacaggcggtacatcagttcctcaaaccggttctactggagatggttacaaatttgcaaaatctctaggtcattctataacagaattattccctactgaagtgcctatcacttcatcagaaacttttatcaaatcaaatcgcttaaaagggttaagtttaaaagatgttaatttatcggtcttaaagaaaaatggtaaaaaaagagtaagtcatcaaatggatatgatattcacacattttggaattagtggtcctgctgctcttagatgtagtcagtttgtttataaagagcagaaaaatcaaaaaaagaaaaatatccatatgcaattagatgtttttcctgaactaaacgtagatcaactatctcaaaaagtgagaaaaatacttaatgcagaaccagataaatatattaaaaatagcttgcgaggattaatagaagagcggtatttattgtttattctcgaacaatctggtattaatgatgaaatgactgcacatcatttatcaaatcaacagtttcaaacttttattaatcttctaaagacttttacctttacagtagatggcacacttccattagacaaagcttttgtgacaggcggcggtatttctttaaaagaaatagaaccaaaaactatgatgtctaaattagtgccaggattatttttatgtggcgaagtcctagatattcatggatacactggaggttataatataacaagcgcattagttacgggtcatgttgctggaatgtttgctggtgaatttaaaatagatcaaaacaaataa

SEQ ID NO: 2277 - DNA, 1494 bp, Staphylococcus epidermidis
gctcaactactgatatttaataagcaagtaggtataattatacgtgtatataatttggaggaatgcattgtgaatttttggttacaggaacaagctcaatcaaatggaaatcgattagcgattgttacaaatcagttatctttaacgtacgaagaattatatcatcgtgcaaaaacaatcgcggaatatttaacttctttaaatcagaaaaggattggtttatatataagcaatgatattgattcagttgttttgattcatgcttgttggttagctcatattgaaatagctatgataaatacacgtttaacgcgacatgagatgataaatcaaatgaattcagtcgacatagcaacgattgtacacacgttgcctttagaattagaagggtttaatttatatcattttaatgatttaacacaattagataaacatgatgtttcaggttacaaatttaatttagaatcgattgcatcaattatgtttacgtctggaacgacgggacctcaaaaagctgtgcctcaaacgtttaataatcatttagccagtgctaaaggctgtaaacaaagtttaggattcgaacaaaatactgtgtggctttcggtcttacctatatatcatatttctgggctcagtgttattttgcgcgcagtgatagaaggattcactgtcagacttgttaaaaagtttcaaactgatgatatgttaacacaaataaagacttatccaatcacccatatgtcccttgttccacaaacgttaaagtggttaatggatgcaggattgactcaaccattttctttagaaaaaattctgctaggtggtgctaaattatcaccacaattaattgagcaagcattgacttatcgtttacctgtatataattcttttggtatgacagaaacttgctctcagtttctaacagcctcacctcaaatgctcaaagaacgtttcgatactgttggaaaaccaagtgaaaatgtcgaagtgaaaataaaaaatcccaacgcatatggacatggagagttattaattaaaggtgaaaatgtgatgaatggttatttatatcccaaatatttaaaagacacatttgataatgatgggtattttcaaactggagatatagctgaaatagatgatgaaggttacgtcataatatatgatcggcgcaaagatttgattataagtggtggagagaatatttatccttaccaaattgaaacaatcgcaaaagactttgaaggcattgaagatgccgtatgtgtaggaatatcagatgatacttggggtcaagtaccaatattatattatgtgacaaatcaagatattaatcaaactgaattaatagaacattttgagaatcatttagctagatataaaattcctaaaaaatattatcaggtcaaatctttaccttatacatcgacaggtaaattacaacgtaaaaaggtcaaaagtgaagacttgaatgagggaaagaataatgaaagttaa

SEQ ID NO: 2278 - DNA, 372 bp, Staphylococcus epidermidis
cccattggttttagcaccattgacttccctttcagtatcactatttgtaatattagatttggcttcaattttcgctttttcaaccagctttctagcctctgctttttcttcatctgttgcatcgttgttaccattgatgattgtaacttgttgctcagcttttttatcaatagccgtttttgcatctgttttaattgttgttgctggtattatggtagcaatctcattcatgccgttatctttagcattatcaacttgattattagtttgcgcttgattgatatttgttatagttttatttttactaatctcaagaagtcgtttggcttcatctttttcttcattagttgcatctttgttattattaattaa

SEQ ID NO: 2279 - DNA, 1473 bp, Staphylococcus epidermidis
atgtataaacttttgcaacatttgggtaggtctctcatgttacctgtagcagttctgccagcagccgcaattattgtaggcataggtcatgttttagatgctttaaatatacttcctcaagctgcactctttttcacaagtgttgggaccactatattagagcaattaggtatattatttgctattggtgtagctatcggtatggctaagaagaatgatggcgcagtagcattagcggcagcgttaggattttttatagttacagtagtactatctccagaaaaattagcaactttgttacaaattaaagaatctaaaattgatttagcattcagtcaaatgaataatggaaatgtgtttgtagggattattataggtttgattgctgcatatagttataacaaatttagtgaaacgaatttacctatggccttatcattcttcagtgggaaacgacttgttccaatcatgacagcattcttttgtacaattttagcgattattttattattgatttggcctccagtttataatgggatagttacttttggtaagtggattgttggtatgggtccattcggtgcattattatatggtttttttaatagattgttaatacctactgggttgcatcatgcgctcaataatgtattttggtttgatactgctggaataaatgacataggtaaatttcaaagtggtaaaaatgccattaagggaattactggcagataccaagcaggatttttccctgttatgatgtttggtgtaccggcagcagctttggcgatgtatcatactgcaaagacgaatcaaaaaaaacaagtttatgcttggtttttagcaagttcagtttcggcattctttgtaggtgtaactgaacccatagagtttgcattcatgtttgtagctccagttttatttgttattcatgctgttttaactggattatcattatttatagcagcaatgtttcattggacagcaggattttcatttagtgcaggtcttatagattatgtgctttcattggttaatccgatatctaatcaaccttggatgttattattgcagggtgtagtcttttttattatctattacgttatctttagagttgtcatacaagtctttaatttaagtactataggtaggggagataatgaacttatcgatccaacatcaaatgatacttctgaaatggaagtattacagaacaaaaccactacaagtaaatattatcaaaacgcaaaacgtattttagacggattaggtggtaaagaaaacattattagtttaaatcattgtgcaacaaggcttagattggagcttaaagataattcgattatagatgagcagaaaattaaaaatgctggagctattggtataactcaaaatggacaccattatacccaagtgattattggaacacacgtacaacaagttgccaatgaaatggatcaccaaatgaattag

SEQ ID NO: 2280 - DNA, 276 bp, Staphylococcus epidermidis
atatttagttggaggcctttatcaatgttgaaaaaaatattattatctctagttgtattttatcaacgttttatttcgccacttacaccaccaacatgtcgattttatccaacatgttcacaatacactagagaagccatcgaataccatggtgcactaaagggactttatctcggtgtacgacgcatacttaaatgtcatccattgcataaaggtggctttgatcctgttccattaaaaaaagataaaaattctaaaaccacacatcatcattaa

SEQ ID NO: 2281 - DNA, 1620 bp, Staphylococcus epidermidis
ctcaatttatggaggttattagacatgagtcataagatattagtatcagacccaatttctgaggatggtttacaaagtattttaaaacatccagaatttgacgtagatatacaaacagatttatctgaaaatgatttagtaaatatgatttcaacttatgatgctcttatcgtacgaagtcaaacccaagtaacagagcgaattattaatgctgcaacaaatttgaaggtcattgcaagagctggtgtaggtgtggataatattaatatagaagcagcgactttaaaaggtattttagtaattaatgctcctgatggtaatacaatttctgctacagaacattcagtagctatgttgcttgcaatggcacgaaatattcctcaagcacaccaatctttacgtaacaaagaatggaatcgtaaagcatttagaggggttgaactttatggcaaaaccttaggtgttatcggtgctggtaggattggtttgggcgtcgctaaacgtgcgcagagtttcggtatgaaaattttagcgttcgatccttatttaacagaagataaagcgaagtcattagatattcaaattgcaactgttgatgaaattgccgaaaaatccgactttgtaacagttcacacaccattaacacctaaaactcgaggaattgttggttcatctttctttaacaaagctaaacaaaacttacaaatcataaatgttgccagagggggtattatagatgaaactgcacttattgaagcattagataataacttaatagatcgtgcagctattgacgtatttgaacatgaacctcctactgattcccctctcattcaacatgataaaattattgtcacaccacatcttggcgcctctactgtagaagcgcaagagaaggttgcagtctctgtatctgaagaaataattgaaattctaactaaagggaatgttgagcatgctgtgaatgctccaaaaatggatttaagcaaagttgataaaacaactcaaagctttataggtttaagtacaactattggtgagtttgctattcagcttctcgatggtgctccgagtgaaattaaagttaaatatgctggtgacttagcgcaaaatgacactagtttaattacaagaacaattataacgaacatcttgaaagaagatttaggtaatgaagtcaatattattaatgcattagcaatacttaaccaacaaggtgtcacgtataatatagaaaaacaaaagaaacattctggctttagtagttacattgagctagaactagttaatgatcaagataaaatcaaaattggcgcaacggtattcgcaggttttggcccaagaatagtacgtattaatgattactcacttgattttaaacctaaccaatatcaattagtaacatgtcataaagataaacctggtatagtaggacaaacaggcaacctattgggaagtcacggaattaatattgcgtcaatgactttaggacgtaacgatgctggtggagatgctttaatgattctttctattgatcaacaagcaagtgaggaagttataaaaattttaaatgaaacaagcggattcaacaaaattattagcactaagttaacaatttga

SEQ ID NO: 2282 - DNA, 1188 bp, Staphylococcus epidermidis
atcttattatgggaggaatgtacaatgcagtattaccaacctttattattaacacctggaccaactcctgtaccggaacaaatcttgagtgccgtacaattaccaatggtaggtcatcgttctactgactttgaggaaattgctagtgaagcatttaaaggtttaaagccagtatttggtagcaaaaacgaagtacttattcttacatctagtggcactagcgtattagaagcaagtatgcttaacatcgcgaatcctgacgatcatattgtgataattgtttctggtgcatttggaaatcgctttaaacaaatcgcacaaacttattataatcatgtacatgtatatgatgttaactggggtgaagctgtaatagttgatgactttatcacttatttaaagcaattaaacgttccagtcactgcagtattcactcaattttgtgaaacatctactggtgtcatacatccagttcaccaattaggtcatgcacttaaagcttttgataattccttatattttattgttgatggtgtaagctgtatcggtgcagtggatgttgatttaacaaaagataaaatcgatgtattagtttcgggaagtcaaaaagctatcatgctaccaccaggtctagcatttgttgcttatagcgatagagcaaaaaaacgatttgctgatgtaaaaacaccgagattctatttagatttaaataaatacataaaatcacaagagcaaaattcaacgcccttcacccctaatgttggtctatttagaggaataaatgcttatgtagaacttgtaaaaaaagaaggattaaatcacgttatttcacgccattttaaaatacgtaatgccttaagagcagcactaaaggcacttgaattagaattattagtaaaagatgatgctcatgcctcacctactgtgacctcatttgttccaaaaaatcaagaagaacttaatatcattaaaaatcaacttaaatctcaattcaatataactattgctgggggacaaggacacttaaaaggacaaattttgagaattggtcacatggggaaaatatctccttttgatattttagcagtcgtgtctgcattggaaattattttaacttctaatagaaatgtcaattatattggaacagggataactcaatttatggaggttattagacatgagtcataa

SEQ ID NO: 2283 - DNA, 969 bp, Staphylococcus epidermidis
aaaggaaaatgtattatgggtaactatttcccgtatgcctttgaagataaacgctatcacacatggaactatcatttaaaaaacaagtttggtcagaaaatatttaaggtcgcattagacggaggttttgattgcccaaatagagatggtactgtagctcatggaggttgcacattttgttctgcagcaggaagcggtgactttgcaggtaatagagctgaaccaattgaagttcaattcaaaaaaataaaagaacgtatgcatgaaaaatggagtgaaggtcaatatattgcatactttcaggcgtttacaaatacgcatgcacctgttgaagtactaaaagaaaaatatgaacctgtcttaaaagaagatggcgtcgttggtttatcaatcgcgacaagacctgattgtttgcctgatgatgttgtagaatatttagctgaacttaatcagcgcacttacttatgggtagagttgggcctacaaactgtgcatcagtcaacttccgatttaataaatcgtgctcatgatatgcaaacatactatgacggcgtaacaaaattacgcaaacataatataaatgtttgtacgcacataatcaacggcttaccaggtgaaaattatgacatgatgatggagactgctaaagaagtcgctcagatggacgttcaaggtattaaaattcatttattacacttgctaaaaggaacgcctatggttaaacaatatgaaaaaggtatgctcgagtttatgagtcaacaagattataccaatcttgtttgtgatcaacttgaagtattacccccagaaatgattgtgcacagaatcactggagatggacctatagatctaatggttggaccaatgtggagtgttaataaatgggaagtattaaatgaaattgataatgagcttgctagacgaaactcctatcaaggtaaaatgaacaagcagagtatacaatcatga

SEQ ID NO: 2284 - DNA, 201 bp, Staphylococcus epidermidis
ggaatatttcgtgccattgcaagcaacatagctactgaatgttctgtagcagaaattgtattaccatcaggagcattaattactaaaataccttttaaagtcgctgcttctatattaatattatccacacctacaccagctcttgcaatgaccttcaaatttgttgcagcattaataattcgctctgttacttgggtttga

SEQ ID NO: 2285 - DNA, 225 bp, Staphylococcus epidermidis
attggtatgctgctttacaattacgttcctcaaaacaaatggtctcagtggtttaaaacttatggcgttgaagaaagtgtcaatttgaataaacgtatgaaatggtacacagttattcaagcaataggtcttattcaatggtatgaagaacaaaaacgctatagagatatgaatacatggctgaaatttttaaatgaagtaatgaatagtaacttatttatataa

SEQ ID NO: 2286 - DNA, 330 bp, Staphylococcus epidermidis
tgtttatctaggaggcagtttatggctcggtcaaaaaagtacttttatcttagtctattaatgataattttaagttttttctttaataccaataattcattattgagtaatatatttcaatcgtttatgaaaattgttgtagttacaagtatcgttaatattataatacttattttatcgattgtttttgccgataaatctataaagtatgctaaggaaagttcagattggattagatttgcaagcaaaatattaccattgattattttaatcactattattatccatattctttcatctttacatacttttggttacatttttaaataa

SEQ ID NO: 2287 - DNA, 420 bp, Staphylococcus epidermidis
aaaacttatagtcgtaaagcaaatgaaattatcttggctacacgggtcgaaaatttattatcaaaagatgaaatcatatatacgtatttaaatatcgtcccatttggtcatgactacaacggtgccaatataactggtatatcgtctgcttcatatagtctgtttggtatacctgcaaaagatttgaacattgcacaatcagcttatctcattggcttactgcaaagtccatacggctatacgccttatgacgaacacggcaaagtaaagccttaccatcttttaaaattgagcatgaaacgtcaacaatacgtacttaaacgtatgcgtgttgaaggaaaaatttctaaacaacaatacgaaaacgctaaaaaatacaatattaaacagcacttgctgaaacaatcgaaagacgaataa

SEQ ID NO: 2288 - DNA, 1341 bp, Staphylococcus epidermidis
caaagcatcagagatgattctaaagccactgctgatgcacctgtgggaccaggaccgagagaagctcttgattacatgtacaatttaggtaaaagagatggtttttcaacgcatgacgttgatcatatagctggtagaattgaagctggtaaaggagaagatgtattaggtattttatgtcatgtcgatgtagtacccgcaggcgatgggtgggattcaaacccattccaaccagtagtgacagacaatgcaattatagccagagggacactggatgataaaggacccaccattgctgcctattatgcagttaaaattttaaatgagatgaaggtagattggaaaaaacgtatacacattattatcggaactgatgaagaatcagattggaaatgtacagacagatatttcaaaacagaagaaatgcctaccttaggttttgctccagatgcagaattcccagcaatacatggtgaaaaaggtataacaacctttgatttagtacaaaatgaagtgacagaagatacagatgaacctgactatgagttattaaaatttgaatctggtcaaagatacaatatggttcctgattatgctaaggcagaagtgctcgtcaaagaaaatatgacagatgtcattcaaaactttgaaaactttttacaacaaaatcaactacaaggtgaaagtacagttgacagtggtattttaatattaacaattgagggtaaagcagttcatggcatggatccatctttaggtgttaatgcaggattgtttttacttaaatttttagcaagtcttaatctaaataaaagcgcaaaagatttcgtagaattcaatgagcgatacttatttgaatctcactttggtgaaaaaatgggtatgaagttccatactgatattatgggagatgtcactactaatatcggggttatcagttatgataaagaaaaagcaggcagttatggtattaatctaagatatcccgaaggatttaaatttgaagacgcaatcgatagatttagaagtgaaattaatgaactaggttttaatttagaacttggcaaagttcaaaaaccacactatgtcgataaaaatgatccatttgtaaaaacacttgtaaacgcatatagaaatcaaacaggtgatatgactgaaccatatacgattggtggaggaacatatgcgagaaatttagataagggtgtcgcatttggtgcgatgtttgcagattcagaagatttaatgcatcaaaaaaatgagtatataactaaaaagcaattgatcaatgcaacaagtatttatttagaagctatttacgctttatgtgtggaggattaa

SEQ ID NO: 2289 - DNA, 630 bp, Staphylococcus epidermidis
  unsure (616): Identity of nucleotide at the above locations are unknown.
aatatatggctcacgaaaaactatttcttgagccattttctagttgaaagtgaggtgaacgtgttggagcagttttatcagttagggtggacacttgattcggcaggaggagcttctggtgaagcatatatggctgaacaagatggacaaaaattatttttaaaacgaaattcaaatccttttattgctgcgctatctgcagaaggaattgtacctaaacttgtttggacgaaacgtattgaaacaggtgaagtagtaacagctcagcattggaaaaatggcagagaattaaatgaagatgaaatgaaccaaacaagagtcgctgaactactacataaaattcacggttcaagacctttattaactatgctaaagcgtatggagatggaacctattacgcctgacattatgttgaataaaattaacgcatcactttcaagagaagttttgacacatcatgttgtgagaagagctttaacttaccttgaagatcatttaccgaatttagaaccccgtttctttactgttgtacatggaagagttaaacataacaactggttattatcagaatcggatgaactttaccttgtggattggggaaggtgcatgattgccnaaccagcgaattga

SEQ ID NO: 2290 - DNA, 216 bp, Staphylococcus epidermidis
gttttaaaaagtgaaaggcttaatgcgccgatactacccattaaaaaagcacctaataaatttgcaacaaatgtccccaacggaatggttgaaccttcattaagcattgataaacagaatcttatcaatgcacctaaagcaccacctacaaaaatatatagatattgcatctatatttcacctcaaaatataaaagagttgattattattatttaa

SEQ ID NO: 2291 - DNA, 1017 bp, Staphylococcus epidermidis
atgagggaaagaataatgaaagttaaggcaatcaatctatatacttataaggaaccttttaaatcaccaatttcaacaccgaaagtgaagttaacgcatcgagaaagtttgtttacggaaatagtaacttatagtggagaaacttattatggagaatgtaatgcatttttaactaattggtatgataaagaaacaatactcacagtcgtaaacagattaagacagtggataccgcaagtacttcataaagatatgacatcttttgattcatggttaccttacctaaatcaaatgaatgatgtgccagctgctagatcaatggttgtcatggctgtttatcaaatgtataacgacttgcatgattttgaagtacaatacggtgctacagttagtggcttaactaatagtcaaattgaaacattattagaaacaagaccgaaacgtataaaacttaaatggtcaacatcactcatcaaagatcttgaaactatacgtttattaaattttgattgtgatattgctatagatgcaaatgaatcattaacaaagccatcatttttacaattagccaacgtaaatacatcagatattatatatattgaagaaccttttaaaattctagaagatttaaatgatattgatatgtctatttttcctagaattgccatcgatgaaaaggcactttctatagaaaaaatacaatcaataattcagcaatatcccatacaagtcgtcgtgttaaaaccatttagacttgggggaatagatagaatgttaaacgccatgaaaattttgaaagaaaaaaatataaggtttgtagttgggggcatgtatgagtttggtctaagtagatattttacagcaatgttagctaaagaaggaagttatccgggtgatattacgccacacggttattatttttctaacgatatcgtagagacaagtggcatattaaaagggggaatgatttatttcactccccctaaagtcaaacgttctttacttaacaaagtttaa

SEQ ID NO: 2292 - DNA, 654 bp, Staphylococcus epidermidis
ttaatgatgagagttcgttacaaaccgtgggccgaagattatttaaagaaccatcctgatttagtagacatggatggtgctcacgcaggtaaaatgtctgagtggttcgaaaaagaacaaccgatttatattgaaattggttcaggaatgggacaatttataacaacattagcagcacaatatccagagattaattttgtatcaatggaacgtgaaaaaagtgtgatgtacaaagttcttgataaaacaaaagaaatgggtcttaaaaatttaaaaatgatttgtaatgatgctattgagcttaatgagtatttcaaagataaagaaatatctagaatttacttaaatttttcagatccttggcctaaaaagcgccatgcaaaaagacgtttgacgtatcatacataccttgcattatataaacaaatacttaaagatgacggtgaaattcattttaaaactgataatcgtggtttgttcgcatttagtatagaaagtatgtcgcaatttggaatgtactttactaaaatgaatttaaatttacacgatgaagatgatgaagataatatagtgacagaatatgagaagaaattctctgaaaagggatctcgtatttatcgaatggaagctaaatttcataaatgtttcgaatag

SEQ ID NO: 2293 - DNA, 483 bp, Staphylococcus epidermidis
gaggaagtgaggaacgtggagtttgaggataaagatggaaggattgtaacattgaactataaaaatgaaaatgatatgcctaatggcaatcacgttcttgcaattccggtatacaataatcagttattatttacaaaccatcaacatcgtgggatagagtttcctggtggtaaagttgaaataagcgaacaaagtaaagaagcagtaattagagaactatacgaagagacgggggcaatcgcaaaatttatctattattttgcacagtatagtataaaaatggagcatgatgagccgtttataaaggacgtttacttcgttgaagtaagtcatttggaatatgtagatacctattacgagactttaggcccttgtctttatcatcaaattaatgatattcctttaaataaaagaagttttttaatcaatgataaggcgattcttcattgtttggaaagggtgaaaacacttggattttattaa

SEQ ID NO: 2294 - DNA, 462 bp, Staphylococcus epidermidis
ttaaattggaggtcaattcatatggttagacatgattttaaagttaaaactgaatggctaggtggacgcgaagaagtaggtaaacttcgaggagatattatcaatgaaaatatatccatcccctcttcactcggtggccaaggagaaggcacaaatccagatgaattactagtaagtgcagcatcatcttgttacatcatttcactcgctgcaacactagaaaagagtggttttactaatgtaaaaattaatcaacagtcaataggtacagcctcgtttgaaaataaaaaatttaaaatggaacgtattacacattatccctcaattaaagtaccctcttctcaaacagaaaagcttaaaagtattttagataaattattagtgattgcagataataattgtatgatatctaatgcaatacggaataatgtcattatttcaattgaacctaatttaatataa

SEQ ID NO: 2295 - DNA, 351 bp, Staphylococcus epidermidis
actaatgatatgaattatgtaagaggagaatttgtgatgaagtcagttaattttaaaaaaataactatattgtttttttctacagcttttttaatattaatcttttctctcatttttttgacgaagaaaaaactgtataacgccgaattattactaaatgaagtcaaaacttattttagagaagtaaaaggttcctatattgtgcaagaaccaatcgttttagaaaatataaatcataatcaaccaatataccaaggtggtatcacagtattaaaaaatgaccatcttattaattatgaattttatgcagatgctgtgtcaggacaaatcattgatataattgaactctga

SEQ ID NO: 2296 - DNA, 1329 bp, Staphylococcus epidermidis
gtaaggagtattgaaatgacacactatcattttgtcggaattaaaggctcaggcatgagttcattagcacaaatcatgcatgacctcggtcatgaagtacaaggttcagacatagaatcatacgtttttacagaagttgcattaagaaataaagggattaaaattttaccttttgatgcaaataatattacaaaagaaatggttgtcatccaaggtaatgcatttcctgataatcatgaagaaattgttagggcacatgaattaaagcttgatattataaaatatcatgactttcttggtcatgttataaatcaatatacatctgttgctgttacaggtgcacacggtaaaacgtctacaactggtttgttgtcacatgtgatgaatggagataaaaagacatcattcctaatcggtgatggtacaggtatgggactaccaggaagtgactattttgcttttgaggcttgtgaataccgtaggcacttcttaagttatcatccagattatgcaattatgactaatattgattttgaccatccagattattttaaaaatatcgatgatgtttatgatgcattccaacatatggcgttaaatgttaagaaaggaattattgcttggggtgatgatgaatatttacgtaaattagatgtagatattccggtttattattatggctttaaagaaacagatgacatctatgctaaaaatattcaaattactgaaaagggtacgcaatttgatgtatatattaaaggcgaattttatgatcaattcttatccccacaatatggaaatcacaacattctaaacgcacttgctgtaatagcaattagttatttagaaaacatgaatgtagaaaatattaaagaagcactgataacatttggtggtgtaaaacgtcgttttaatgaaacaaaagtatcaaatcaagtaatagtagacgattatgcacaccatccaagagaaattagtgctacaattgagacagcgcgaaaaaaatatccgcaaaaagatgttgttgccgtttttcaaccacatacgttctcaagaactcaagcatttttaaacgaatttgctgagagtttaagtaaggcagaccaagtatttttatgtgaaatattcggttcaataagagaaaatacgggagatttaactatagaagatttaatcaatcgtattgacggctcgacgcttatagatgaaaatagtattgatgtattagaaaaatttgataacgctgtaattttatttatgggcgctggtgacattcaaaagttactaaaagcttatttcgaaaaattaggcgtaaaaaatgatttttaa

SEQ ID NO: 2297 - DNA, 198 bp, Staphylococcus epidermidis
ttgtttttcattacgaagttttattctgttaatttagtaacattaaacattatcagttacagtttaaattctctttattcctattggaatgttagaatgagtgagttttgtagcttcatctatttcccttcaatctatagtttattattcggtgaaatatctcggaaaaagtatttaacaatttcggtactcatataa

SEQ ID NO: 2298 - DNA, 240 bp, Staphylococcus epidermidis
ttaggtttcatcactagtaaaaaagacatggactatataactaagaacatcaacagttttactaagagacttgcagaggctatcaatggtagacaaataaacgcactaaaaagcaacccatctagcaaaaagataacttggaactggggaggtactttctaccctaacgcacctaaaagtggtattagagttagaaggtcgctaggtatcaatggcgctattgttgaaagtggctcgtga

SEQ ID NO: 2299 - DNA, 636 bp, Staphylococcus epidermidis
gcaggtgacattatgtacaattttataagtaagattttagatgttattttagtgaaaatgtctaaatcattatatgttattggtaaggaaaatattcctaaagatagtaaatatgttgtaacttgtacgcatgaaagttataacgaagtaatcatgttaggaatggcattactacctaatcaaatccattatatggctaaaaaagaattatttaagaatcagtgggctggtaaatttttgaaatcactaaatgcatttccagttgatagagaaaatcctggtccaagtacattaaaaaaaccagtgaatttacttaaagaacataaaactataggtattttcccaactggtcatcgtacttcagtagagggagccccattaaaacgtggtgcagctactatagcaatgcttgggaaagcacctatcttaccagcagcttatgtgggtccaaaaaaaattcatggtttgattacaggtcaagcattaatcaaaattggtaaaccaattgagatggatgatattccaaaggatttgaagcggaacgagaaagttgatttcttaaccaaagaaatcgaaagacgcacaactcaattacaaaaagaacttaatgaaatttcatgtagtttaaagaaatag

SEQ ID NO: 2300 - DNA, 867 bp, Staphylococcus epidermidis
ggagtgttaataatgaatgtcttccaaatgagagataaattgaaagcgcgtttaaaacatttagacgtagaattcaagtttgatagagaagaagaaacgttacgtattgtaagaattgacaatcacaaaggtgtaacgattaaacttaacgctatcgtcgcaaaatatgaagaacaaaaagaaaaaattatagatgaaatttgttattatgtcgaggaagcaatcgctcagatgggtgatgaagtgattaataatgttgaggacatacaaattatgccggttataagagctacaagtttcgacaaagaaactaaggaaggtcatgcatttgtgttaacagaacatactgctgaaactaatatatattacgctcttgatctagggaaatcttatcggctaatagatgaaaatatgttacaaacgttaaatttaactgctcaacaagtgaaagaaatgtcactatttaatgttcgtaagttagagtgtcgctatagtacggatgaagttaaaggtaatattttttacttcatcaacacaaatgatggatatgatgcaagtcgtattttaaatacttcttttttaaatcatattcaacaccaatgtgaaggtgaaatgcttgttggtgtgccacatcaagatgtattaattcttgcagatattagaaataaaacaggttatgatgttatggctcatttgactatggaattctttactaaaggacttgttccgattacttctttatcatttggttatgataacggacatctagagccaatatttattttggggaaaaataataaacaaaaaagagatcctaacgttattcaacgtttagaagcgaacagaaaaaaattcaaaaaagattaa

SEQ ID NO: 2301 - DNA, 312 bp, Staphylococcus epidermidis
atggagtcaataacagtagatgaattaaagaaaaaaatattagattcaaatccagttaacattgtagatgttcgcacaaacgaagaaactgaaatgggtgttattcctggagcaaaaacaattcctatggatgaaattcctgataatttaaaagaattcaataaaaatgacacgtattatattgtgtgtgcagcggggtcacgcagtgctaaagtagtttcatatttagaagaacaaggtgttcatgctgtaaatgtcgaaggtggaatgaatgcatggggcgatgaaggtactgtaattgataatatttaa

SEQ ID NO: 2302 - DNA, 1695 bp, Staphylococcus epidermidis
ttatataaaatcaaggggctgaatattttggcacaattatcagatttagaaatagcaaacttatcaaaacttaaaccaataagtgaaattgcaagaaaagtagggattactgaggatgctttagaaccatacggccactataaagctaaaatagatattaatcagatacaagaacagaagaaaaaagggaaagtcgtattagtaactgctatgagcccaacaccagctggtgaaggaaaatccacagtaactgtaggtttagcagatgcatttaacaagttgaatcataatgttactgttgcattacgagaacctgccttaggaccaacttttggtattaaaggaagcgcaacaggtggtggttatgctcaagtacttcctatggaagatattaatttacattttaatggtgattttcatgcaattactactgcaaacaatgcactttccgcatttatcgacaaccacctacatcaaggaaatgaattgggaattgatcaacgaagaattgaatggaaacgtgttttagatatgaatgatcgtgcgttacgtcatgttaacgtaggattaggtggtacaactcacggagtacctagagaagatggttttaatataacagttgcgtcagagataatggctattttatgtctaagccgaaatatcaaagatttaaaagaaaaaataagtcgaattaccattggttatacacgtcatcataaacctataacagtttctgatttgaaagtagaaggtgcattaactttaatacttaaagatgcgattaaaccaaatttagttcaaacaattgagggaactccagctcttgttcacggaggcccttttgccaatattgctcatggttgtaactctatattagcaactgaaactgctagaaacttatctgatattgttgttacagaagcaggatttggttctgatttaggtgccgagaagtttatgaacattaaagctcgtgaagcaggtttcgatccatcagcagttgttgttgtagcaacgattcgtgctttgaaaatgcacggtggtgttgcaaaagaccaacttcaacatgagaacatagaggctgttgaagcgggacttgttaatcttgaaagacatgtgaataatattaaaaaatacggtgtcgaaccaatagtagctttaaatgcatttattcatgacacaccttctgaaacagcgtgtgtgaaacaatgggctaaagataatcaagtacgtattgctttaacagaagtatgggaaaaaggtggagaaggtggaattgaacttgctaaccaagtgttcgatgtaatgcagaaacctcaaaactttaagcatttatatgagttaaaacaaccactcgaagctaaaattgaaacgattgttaaagaaatttatggaggttcaaaagtaaatttcagtagtaaaacacaaaaacaattaaagcaatttaaagagaatggctgggatgaatatccgatttgtatggctaaaactcaatattcatttagtgatgatcagacattgttaggtgccccgaatgattttgaaataacaattagagaacttgaagccaaaacaggcgctggattcatcgttgcattaactggtgctataatgactatgcctggtttaccaaagaaaccagctgcactaaatatggatgttactgatgatgggaaagcaataggtcttttctaa

SEQ ID NO: 2303 - DNA, 360 bp, Staphylococcus epidermidis
attttcttgattactattttgctcgttatgttaggtggaggaataggtgctgtacttagagcccttatcacaaatatatgccaacgcttattcaatagtaaaattcctattgcaacatctatagtaaatattacaggtagcttaattatcgggtttatgatgggacacgcactcgatagccatcatatgtttcctttctttgttacaggtgttctcggaggtttaactactttttcaacattatcatctgaacttgttaatatgttaagccctcaatttaaaccaatacgttttgtagtttattccctattacaatttattttaggtttcattgcttgcttttatggatatcgcatctaa

SEQ ID NO: 2304 - DNA, 1284 bp, Staphylococcus epidermidis
tttaggaggattttatcaatggctaatgctttaatagaagatttaaaatggagagggttaatttatcaacaaacagatgaagagggtatcgaagaattattaaataaggaacaggtcactttatattgcggcgcagatcctacagctgatagtttacatattggtcacttgttaccttttttaacattaagacgcttccaagaacatgggcatcgtcctatcgtcttaattggtggaggtactggtatgataggagatccttctggaaagtctgaagagcgcgtgttacaaacagaatcacaagttgaagctaacgtcaaaggcctgtctaatcaaatgcatcgattatttgaatttggcagtgataaaggggcaaaattagttaataataaagattggcttggtcaaatttcgttgattagttttcttagagattatggtaaacatgttggcgttaactatatgctaggaaaagattctattcaaacacgtttagaacatggtatctcttatacagaatttacttatactattttacaagctattgattttggctatttaaatcgtgagttaaattgtaaaattcaagtaggcggatctgatcaatggggtaatattacaagtggtattgaattaatgcgacgaatgtatggacaaactgaggcatatggcctaacaatcccattagtaactaaatcagatgggaagaaatttggtaaatcagagtctggagctgtgtggttagatcctgaaaagacaagtccatatgaattttatcaattttggattaatcaatctgacgaagatgtaattaaattcttaaaatattttacttttttagaaaaagaagaaattaatcgattagaacaatcaaaaaatgaagcgcctcacttacgtgaagcacagaaagcactagcggaaaatgttacgaaatttattcatggtgaagcagctttaaaagacgctatacgtatttcaaaagcactgtttagtggagatttaaaatcattatctgctaaagaacttaaagaagggtttaaagacgtacctcaagtaacgttatctacaaaaacgacaaatatagttgaagcacttattgaaacaggtattgcttcatctaaacgccaagcacgtgaagatgtaaacaacggtgcaatatatattaatggtgaacgtcaacaatcagtcgattatgagttaagtagtaaagaccttattgaagatgaaattacaataattcgacgaggaaagaaaaaatatttcatggttaattaccaatcataa

SEQ ID NO: 2305 - DNA, 708 bp, Staphylococcus epidermidis
acctgctacttttcatcaaatagatacacaggaggacgttttatgcaacaagaaacgacatcatggtacaaacaagaatggtttatagttttatcacttttattcatttttccactaggtttatttctcatgtggaaatttagcaagtggccatctattgcaagaacaatcattactgttgcaatttcagttatcgtattagcaagcattacctattatggtaatctacaaatgattgtaccagcaacatcaaattcaaataacgaaactaaagaaactacagagaataatgtaaatgataaagacgagcgaaatcataaaactgcagtagaagaaacaaaaactaattatgactccaccaaagaaaatactaaagaacctggaaaagaaaatgaatctgcaacacgattggagaactctgcgcttgaaaaggcaaagtcatattatgatgattttcacatgtctaaactaggaatttatgatattttaacatctgaatatggagaaaaatttgataaagaagatgcacaatatgctatagatcatctagaggctgattatgaaaagaatgcacttgagaaagcaaaatcatatgccaaagatatgcatatgtctaatgactcaatttacgatcttttggtgtctaactacggtgaaaaatttacagaatcagaagcaaaatatgctattgagcatttggataattaa

SEQ ID NO: 2306 - DNA, 1284 bp, Staphylococcus epidermidis
caaatgcacttaaatgaggcttttacttatttaagtgcttttgttttaggaggaaagtttatggaacattataatcgtgataatttcgagaaaagccatacaagcgaagaattgtatcatcgcacatctcgttcacaatctaactcattgaagcgtaaggattttgtagttagtttcatagcaagtgcgatagtaggttctgctgttggattgtactataaaaataaaatatataaaaaaacggatgaattgaaagaaaaagaacaagatttacgtagtaaagttgaaaactatagacaacgagcggaagatacagtggtttctgttaaatctaaagttgagcaattaaaatatgattccaaagataatatccatgcagatgaattacaagctcaaaaagctgctattcaacgcgaaacagacttagcggatgaatcaccggaagcgcaagcaattcaagaagcaaaaaaagaaacaaaacaagtggatgatgtgagaccatcagcaacagaattagcagctcaacaaaatgctattcaacacgaaacagacttagcggatgaatcaccggaagcgcaggcaattcaagaagctaaaagtgaagttgattcaaacaataaaacatctacgacgcacatagatagtgagaaagaaccttctgctgaagaaattgcaattgctcaaacggcagttaaagaagaagcacgcaatcatgatttagcaaacctttctgcaagtggagaagatactaaaagtaagtcagaaactgaaacagaaaaattagctgcagcggcaaaagcaaaaaaagatagaataaataataataatgaagttgctagtaacacgaaaaatctaatgcaagaagaagctataaaagcttcaaataactctgatgttccaaatcttgtaactaatttaaatcaatctcaagcatcagatactaattcagttgcttatcgcttagcacaggcagcaaaagaaaaaagatctaagctcacaaatggctctaaagaaacacaacttacagaagcgttgttaaaagaaccatcaattgctaaagctcaaacaaaattgaagcgtatccctacacttattactgaatctaaaaaacattcaaataatccgcacagccaaaaaaattcgaatcagactaagaatataacagcaactaaagaggattccaaaggcaaacagcaacatacacctaaccaaaacaaacgtaataaacaacaaaaagtagaaaaaactagtagcaaaattgaaaaacgaacatttaatgattaa

SEQ ID NO: 2307 - DNA, 924 bp, Staphylococcus epidermidis
aggagcgttgttttaatggatttttcttcaccgacagtaattggcttaattgttgcaatacttgtggctgttttattctttatactcttcttaatagcgaaccatagtaagaagaaagtgaagaatcaaacagaagcacattataaagaaaaagaacaacatctaaaagaatctcatgaagaagctttagaaaaagagagagttgagaataaaaaagttgttacaaaacaaaaagaagattttgacgtgacagttagtaacaaaaatcgtgaaattgatgcgttgaaactattctcaaaaaatcatagtgaatatgttacagatatgcgattaattggtattcgtgagagactagtaaatgaaaagagaatacgccctgaagatatgcatattatggcaaatattttcttgcctagtaatgagttaactaatattgaacgtgtgagtcatcttgtacttacacgaactggcttatatataattgattctcaattattaaaaggccatgtttataatggtattagtggtgcgcaatttaaagaattacctacgatgtcacaagtttttgacacgctcgacttagattcatcacagccacagacattggtcttagatcaaaatgaagatcaacattcattatcttttgttaattattcagataagattaaacatattgaaaaattagcaggagatttacaaaatgaattgaataccaaatatacgcctacatcaatactgtattttaatcctaaaaaggataatgatgttacaatttctcattatacgcagtcatcaaatgttaaagttttagttggtcctgaacaattagatgaattcttcaacaagtttgttttccatggacgcatacagtacaatgtggatgatttacaagatatcatggttaaaatcgagtcattcaattaa

SEQ ID NO: 2308 - DNA, 708 bp, Staphylococcus epidermidis
agtgaagatgttgcgatgagattagataaatttctagctaatatgggtgttggaacgcgatcagaagttaaacagttactcaaaaaaggatctgttaaagtcaaccaaaatatagttaagttacctaaacttcatgttaatcctaattctgatgagataatggtaaatgatgaagtagttagttatatcgacaaagtgtatatcatgttaaacaaaccaaaaggttatatttcagcgacagaggatgaggtgcatcctactattattgatttgatacctgaatatgcacatttaaatatttttccggtcggacgtttggacaaagatacagaaggattactccttgttacaaatgatggacagtttaatcatgaagtaatgaatcccaataagcatgtttcaaagacttatgaagtctattcaaaacacccaataactcaattcgatattgataaatttaaatccggaatagaattatcagatggaaaattaaagcctgcaattttaaagaaagttgataattatgtatcacatgtcactatttacgaaggaaaatatcatcaagttaaaagaatgtttcatagtatcgaaaatgaggtattagaattgaaacgcataaagattgctcaactagaactagatcataatttagatttgggtagttaccgtttgttaacacaaatagattttgataatcttaagaactaa

SEQ ID NO: 2309 - DNA, 189 bp, Staphylococcus epidermidis
ttcctatgtgtttattatcatttcgtagatgtcgatatcaaaattttaaccattttactaaaaggtatgttttttattttggcagaaatctgtaatagtctgtttaaaacattttgtatatgtttcatatcttttatagcaattgaaatgattttattagctgattttgtcatagtacttcttaaatga

SEQ ID NO: 2310 - DNA, 411 bp, Staphylococcus epidermidis
agattatttttctgcacgtcacttgctaaaagaaagtattattcatttaacaagtggacaaattcaacaattacaatatggaaaggaattttgatatttatgattaaacttgaatcagaacaacaatttgaagaattaaaaaaagggtatacagtatttgaattcactgctggatggtgtccagattgtaaagtaattgaaccggatttacctaaattagagaaaaaatacagtcaattacaatttgtgtctgtagatagagatcaatttatagatatttgtgttcaaaatgatattttaggcattcctagttttcttatctttaaagaaggtcaacttttaggaagctatataggtaaagagagaaaatcaattgatcaaattgatcaatttttatctcaacacatttaa

SEQ ID NO: 2311 - DNA, 567 bp, Staphylococcus epidermidis
atgaacttattttacaatcctaaaggtgttggagatgttgcatttattcaaattgaaccttcagttggtccttttgaatatgaacaaaaacatggtgtggtagaaatcaaaaaagaaaatgaggtagtaggttataatatatttaatgtgtctaataatgtgacaataaatgataatggacatattaaactaactactgaattaatcaaagatttacaacaactgattactgaagcaggttttgattatcaacttgatactgatgtatcgcctaaatttgtagttggttacgtaaaaactaaagaaaaacaccctaatgcagacaaactaagtgtgttgaatgtaaatgtcggtactgaaaaacttcaaattgtttgtggggctccaaatgtaaaatctggtcaaaaggtcgttgttgcaaaagttggggccgttatgccaagcggaatggtaattaaagatgcccaattacgtggggtagattctagtggtatgatttgctcaatgaaagaattaaatttgcctaatgctcctaaagaaaaaggaattatgggtactaaccgatga

SEQ ID NO: 2312 - DNA, 1110 bp, Staphylococcus epidermidis
aaatactctttaagtgttcaaactctttatgtaaacgctttcttaaacttaattttcatgatacactatttaaaaatatcatactctagtataacggaggtattgcatatgtcattatttaaagattttttcattgcgttatctaatcatacatatcttaataaaatagctaaaaagatgggacctcaaatgggagcaaatcgtgtagtcgcaggaaatacgattcatcaattaattgagactatacaatatttaaatgattataatatttcagttactgtcgactcattgggtgaatttgttaatactagagaagaaagcattaaagctaaagaagagattttagaaattatcgatgcaatatataacaataatgtaaaggcacatatgtcagtcaagataagtcaacttggaagtgagtttgatttaaatcttgcttatgaaaacatgagagaaattttacttaaagctgataagaatgggaagatgcatattaatattgatacagagaagtacgatagtctttctaaaattcaacatattattgatagattgaaaggtgaatttaaaaatgtgggtacagtcgttcaagcctatctgtatgaagccgatgatataattgataaatatcctgaattacgtttgagacttgtgaaaggtgcttataaggaagatgcgtcaatcgcttttcaatcaaaaaaagaaattgacgcaaattatattagaattattaaaaaacgactactaaattcaaagaactttacatcggtggctacccatgacaatgaaataatcaaccaagtcaaacaatttatgaaagaaaatcatatcagcaaagataaaatggaatttcaaatgttgtacggtttccgcacggaattagcacaaaaaatagctaatgaaggttatttttttacagtttatgtaccatacggtaatgattggtttgcgtactttatgagaagactagcagaacggcctcaaaacttgtcattagctataaaagaatttactaaacccaaaatcttaaaaaaggcaaccttgggtataggtatatttgcaactttattgacgtctcttattcttggcattaaaagacataaaaaataa

SEQ ID NO: 2313 - DNA, 1053 bp, Staphylococcus epidermidis
ggtgatcaattgagtagatttatggatgatgctattcaattagcaaaaatggtaaatggacaaacaggtgttaatccaccagtaggatccgttgttgttaaaaacggtaggattgtaggtttaggtgcacatttaaaaaagggagataaacatgccgaagtacaggctattgaaatggcaggtttaaatacccaaggtgctaccatatacgtttcattagaaccttgtacacaccatggttcaacgccaccttgtgtggataaaatcattgaagcgggcatatctaaggtcatctatgctgttaaagatactactttagtaagtaagggtgacgagattctgagagaagctggtatagaggttgaatttcaatataatgaaaatgcagctgcattataccgtgacttttttactgctaaaagaaacgaagttccagaagtaactgtaaaggtctcatctagtttagatggtaaacaagcaacagactttaatgaaagtaagtggataacaaacaaagaagttaaagaagatgtttatcaattaagacatgagcatgatgcagttattactgggcgtagaaccattgaagcagacaatccattgtatacaaccagggttcctgatggaaagcatccgattcgagttattctttctaagaaaggtcaactcgattttaatcaacaaatatttaaagatactgcatcggagatatggatttacactgaaaatgaaaaattaaaaacaaataaaagttttattaaaataataaatataagtaattgtgatacaacgacaatattacaagacttatatcaaagaggtattgggaaactgctagtcgaggcaggcccaaatattacatctcaatttctccaatccaaacatctaaatgaactcattttatatatagccccgaaattaattggtggttctggcaaacatcaattttataagactgacgaggtcattgatttgcctgaagcaactcaatttgaaattgttgattccaagttaattaatcaaaatttaaaattgaaattacgaaagaagtga

SEQ ID NO: 2314 - DNA, 450 bp, Staphylococcus epidermidis
aattcacaattttttatttgggaaatgttaattttggctaatagtgaaaaaaacagggtttatggtattttacaattaaaaacattattcaaaaaaattgattcaatttttaatacaatcaaaaaaaaatatggaatgtctaaagaggaaattttgattttacttacacttttggaaaaaggctcaatgactttaaaggaaatggataaatatgttcatattaaaccgtataaacgtacacgtacttataataatttagttaatcttgagtggatttacaaagaaagacctcaagatgatgaacgtacagttattattcattttaatgacaagcaaaattctaaaaaagaagatttgttaaagtttattgatgactcaattaaaatcaagtctgaaccaatgcaatctattttacaatctattttagcagttgaatttaacgtgctttaa

SEQ ID NO: 2315 - DNA, 192 bp, Staphylococcus epidermidis
atgaattcttcaacaagtttgttttccatggacgcatacagtacaatgtggatgatttacaagatatcatggttaaaatcgagtcattcaattaaattattaaagaaatactttatttttcatatgagtgcttattatagtcttcaaaacaattactacaaattaattgttttgaaggcttttttgatttga

SEQ ID NO: 2316 - DNA, 915 bp, Staphylococcus epidermidis
attggccttcccgtggctgaaggacgattaagtattagaaattgcccgggaaagatttcaaacactagttatcaaacgttcataaaagatacgcaactctactcacttaaaaatgacgaagccattatattagtaagtctgcctttcaatgcgagttggcttaatcagcgatattcagaaattatgcaggctattatttatgatgtcatcggttatgaagtgaaaccacattttatttctgaagatgaacttgcatcctacaacaatgtaaatacacaagaagttcaagaaccccaagtacaacattcttctatagatgataagacttggggaaaagaacaatttaatatgcacaatacattcgatacatttgtcattggacctggtaaccgtttcccacatgctgcaagtttagctgttgcagaagcaccggcagaagcttataatccattatttatatatggaggcgtaggtctaggtaaaacacatttaatgcatgcaattgggcaccatgttcttagcaacaaacctaatgctaaagtcatttacacttctagtgagaaattcacaaacgaatttattaaatcaatacgtgataatgaaactgaagcatttcgtgaaaagtatcgtaaaattgatgttttattaattgatgatattcaattcattcaaaataaagaacaaacgcaagaagagttcttccatacttttaatgaattacatcaaaataataaacaaatcgttatttcaagtgatcgtccaccaaaagaaattgctaagctggaagaccgtctacgttctcgttttgagtggggactaatagttgatatcacaccacctgattacaaaacaagaatggcaatattacaaaagaaattgaagaagaaaatcttgatattccgccagaagctttga

SEQ ID NO: 2317 - DNA, 729 bp, Staphylococcus epidermidis
ttttattattttattggagagactggggctgataatatgactcaccttacgtttaaacaaggtgtgaaagagtgtattcccacgttacttggttatgctggtgtaggactatcgtttggaattgtggcagcctcccaaaatttcagtgttttagaaattattttattgtgtctgattatttatgctggtgcagcccaatttattatttgtacattagtgattgcaggcacccctatttctgcaattgtgcttacaacacttatcgttaactctcgaatgttcttattaagtatgactttagcacccaattataagcaatatggattttggaatagggtagggcttggaacgttattaacagatgaaacttttggagttgctataacgccatatgtcaaaggtgaaaaaattaacgatcgatggctacacggactaaatattactgcttacttattttggactgtttcatgtgtaatcggtgccattttcggagagtatatttcaaatcctgatgcgcttggcctagactttgccattaccgcaatgtttatttttttatgtatatctcaatttgaagggattaagaaatcacgattgagaatatatattgtactcattgtatgtgtgattgtgatgatgcttcttctaagttcaattctaccttcatacgtagcaattttaatagccgcaattgttgctgcattgttaggggtggtgatggaaaaatga

SEQ ID NO: 2318 - DNA, 1017 bp, Staphylococcus epidermidis
tcacaccatcaaatgaaacgaggtgtaacaatattgaattggcaacgtaaatgtatactaactactttattggttttaagtagtttatttttagtattttcgactatcacatatgcgagtgaacgtgattctaaagacagtcttaaaatcactacacataacgtgtatttcttacctactgctatctaccctaattggggacaatctcagcgcgctgatttaatttcaaaagcagattacattcaaaatcaagatgtcgtgattctaaatgaattatttgataaaaaagcttcaaatagattgttaacacgtctacattcacagtacccttatcaaacacctatcgttggtaaaggtacagaaggttggcaaaatacttctggtacttatagaaaaattaaaaaagtaagtggtggcgttggtattgtgagtaaatggcctatcgtacaacaagaacaacacatttataaaaaaggctgtggggctgatatggcaggtaataaaggctttgcctacattaaaattaataagaatggcaaataccaccatattatcggaacacatctacaagctgaagatccaacatgctttaaaggaaaagataaagacattagacagagtcaaatgaatgaaattaaacagtttatcaaagacaagaatatccctaaaaatgaacccgtctatatcgggggtgacttaaatgtcattaaagattcagatgaatatcaacaaatggcaaataacttaaatgtttcattacctactcaattcgatggtaatgcatatagttgggatactagcagtaatagtattgcgaaatataattatcctaaattagaacctcaacacttagattatattttattagatcgtgaccatgcacaaccaagctcatggcataatgatacacatagagtgaagtcaccagaatggtccgtaaaatcttggggaaaaacatacaaatacaatgattactcagatcattacccactctctggctatgcatcaaatgaatag

SEQ ID NO: 2319 - DNA, 1407 bp, Staphylococcus epidermidis
atagggtggcaacgcgtagaccacgtcccttgtctgggatgtggtctttttttattgttttatcacacgaagtcatccataaaattgaatatattttatttgggaaaggatgaaggttacatgttagacattcgtttatttagaaatgaacctgagaaagtgaagagcaaaattgaattaagaggcgacgatcctaaagttgtcgaccaagttttagaattagatgaacaacgccgtgaattaatcagtaaaactgaagagatgaaggcgaaaagaaataaagtgagcgaagaaatagctcaaaagaaacgtaataaagaagacgctgatgacgtcattgctgagatgcgtcatttaggtgatgaaattaaagatatcgataatcaacttaatgaagtagataataaaattagagatatcttaattcgtattcctaacttaattaatgaagatgtacctcaaggtgattctgacgaagaaaacgttgaagttaaaaaatggggtacgccacgtgattttgaatttgaacctaaagcgcactgggatttagttgaagaattaaaaatggctgactttgaacgtgctgctaaagtatctggtgctcgtttcgtatacttaactaaagatggcgcattacttgaacgtgctttaatgaactacatgttgacaaaacatacaacgcaacatggttatactgaaatgatgacacctcaattagtgaatgctgatacgatgtttggaacaggtcaattacctaaatttgaagaagatttatttaaagttgaaaaagaaggcttatatacgattccaactgcagaagtacctttaacaaacttctatagagatgaaattattcaaccaggtgtactacctgaattatttacagctcaaactgcatgtttccgtagtgaagcaggatcagctggtagagatactagagggttaattcgtttacatcaatttgataaagttgaaatggtacgtattgtacaacctgaagattcttggaatgctttagaagaaatgacacaaaatgctgaagctattcttgaagaattaggtttaccataccgtcgtgttatcttatgtactggcgatattggtttcagtgctagtaaaacatatgatttagaagtttggttaccaagttacaatgattataaagaaatcagttcttgctctaactgtactgatttccaagcacgtcgcgcaaatatcagattcaaacgtgatgctgcttctaaaccagaattagtacacacattaaatggtagtggtttagctgtaggtcgtacatttgcagccatcgttgaaaactatcaaaacgaagatggtacattaacaattcctgaagcattagttccatttatgggtggcaaaactaaaattgaaaaaccaatcaaataa

SEQ ID NO: 2320 - DNA, 2709 bp, Staphylococcus epidermidis
actgaacttttgaaggaggatctcttgatggctgaattacctcaatcaagaattaatgaacgaaatataaccagtgaaatgcgtgaatcattcttagactatgctatgagtgttatcgtttctcgtgcattacctgatgttagagacggattaaagccagtacatcgtcgtattctttatggtttaaatgaacaaggtatgacgcccgataaaccttataagaaatctgcacgtatagtcggggatgtcatgggtaaatatcaccctcatggtgattcttcaatttatgaagcaatggtaagaatggcccaagactttagttatcgttatccacttgtagatggtcaaggtaactttggctctatggatggtgacggtgcagctgcaatgcgttataccgaagcacgtatgactaaaataacattagaacttttacgtgatattaacaaagacacaattgattttattgacaactatgatggtaatgaaagagagccgtcagtcttacctgcacgtttccctaatttactagtaaatggtgcggcaggaattgccgtaggtatggctacaaatattcctccccacaatttaactgaagttattgatggtgtgctcagtttaagtaagaatccagacatcacaattaatgagctgatggaagacatacaaggtcctgattttcctacagctggtttagtactagggaaaagtggtattcgtcgagcttatgaaacaggtcgtgggtcaattcaaatgcgttctcgtgctgaaatagaagaacgtggtggtggccgtcaacgtattgtcgtaacggaaatacctttccaagtcaataaagcgcgtatgattgaaaaaatcgcagagttagttagagataagaaaatcgacggtattacagatttacgtgatgaaacaagtttgcgtacaggtgtaagagtagttattgatgtacgtaaagatgcaaatgcgagtgttattttaaataatttatataaacaaacgccattacaaacctcatttggtgtgaatatgattgctttagtgaatggtagacctaaactaatcaatttaaaagaagcacttattcattacttagaacaccaaaaaacagtggttagacgacgtactgaatataatcttaaaaaagcaagagaccgtgcacatattctagaaggtttacgaatagcactagatcatattgatgaaattatcacaacaattcgtgaatcggacactgataaaattgcgatggcaagtttacaagagcgttttaaactaactgaacgtcaagctcaagcaattttagatatgcgtttaagacgtttaactggattagaaagagataaaatagaatctgagtataatgaacttctagaatatattaaagagttagaagagattttagctgatgaagaagtactattacaattagttcgtgatgaattgactgaaattaaagagcgtttcggcgatgaacgtcgcactgaaattcaattaggtggtctagaagatcttgaagatgaagacttaatccctgaagaacaaattgttattacattaagtcataataactatattaaacgtttaccagtatctacatatcgttctcaaaatcgtggtggtcgtggcatacaaggtatgaacacgttggatgaggacttcgttagtcaattggtaacaatgagtacacatgatcatgttctgttctttacgaataaaggtcgtgtatataaactcaaaggttatgaagttcctgagttgtcacgtcaatccaaaggcatacctattattaatgcgattgaactcgaaaatgacgaaacaataagtacgatgattgcagttaaagaccttgaaagtgaagaagattatctcgtattcgcgacaaaacaaggtatcgttaaacgttcatcattaagtaacttctcccgtattaacaaaaacggtaaaattgcaattaactttaaagaagatgatgaattaattgcagtacgtctaacaacaggtaatgaagatattcttattggaactgcacatgcatcattaattagattttctgaatctacattacgcccattaggccgtacagcagcaggtgtgaaaggtatttctctacgtgaaggggatactgtcgttggtcttgatgttgcagattcagaaagtgaagatgaagtattagtagttactgaaaatggttacggtaaacgtacacctgttagcgaatatcgtttatcaaatcgtggtggtaaaggaatcaaaactgcgacaattaccgagcgtaatggtaacatcgtttgtatcacaactgtaaccggtgaagaggatttaatggttgtaactaacgctggtgttattattcgtcttgacgttcatgatatttctcaaaatggacgtgcagcacaaggtgtacgccttatgaaactcggagatggtcaatttgtttctactgttgctaaagtaaacgaagaagacgataatgaggaaaatgcagatgaagcgcaacaatctactactactgaaacagcagatgtagaagaggtagtggatgatcagacaccaggcaatgcgattcatacagaaggtgatgcagaaatggaatctgtagaatctcctgaaaatgatgatcgtattgatatcagacaagattttatggatagagtgaatgaagatatcgagagtgcttcagataatgaagaagatagtgatgaataa

SEQ ID NO: 2321 - DNA, 267 bp, Staphylococcus epidermidis
attcatagtaatagtagtaggcactgtggattggtggataagtctaaaaaacttacgaatagcacagttatacacatgtggataaactgtgtatgttgtgtattattttttcacattatccacaattgctattttttattcagagggacaactccccatctttttaagtgtttaggaattgatttacatagtaattattccctaaaagacagtttacaatctgctaattttcaatttattcaatatggatttatttcccattactga

SEQ ID NO: 2322 - DNA, 516 bp, Staphylococcus epidermidis
ttacaaaacaagaatggcaatattacaaaagaaattgaagaagaaaatcttgatattccgccagaagctttgaattacatcgccaaccaaatccaatcaaatattcgtgaacttgaaggcgcattaactcgacttttagcgtactccaaattacaaggaaaacctattacaaccgaactcactgcagaagcgttaaaagatatcattcagtcacctaagtctaaaaagattacaattcaagatatccaaaagatagttggtcaatattatagtgtaagaattgaagattttagtgccaaaaaacgtacaaagtcaattgcttacccacgacaaatagctatgtatctatctagagaattaactgatttttcattacctaagataggtgaagaatttggaggtcgcgatcatacaacagttatccatgcccatgaaaagattgcaaatgatatcaagtctgatcctacatttaagcaagaagtagaaaacttagaaaaagaaattagaaatcagtaa

SEQ ID NO: 2323 - DNA, 453 bp, Staphylococcus epidermidis
agacgcatgaaagtaattttcacacaagatgttaaaggtaaaggtaaaaaaggcgaagttaaagatgtaccagtaggttacgcaaataacttcttacttaaaaataaatatgctgtagaagcaactcctggtaacttaaaacaattagaacaacaaaataaacgtgccgaagcagatagacaacaagaaatcgatgatgcaaaagcacttaaagaacagttaaaagatatcgaagttgaagtatcagctaaaacaggtgaaggcggcaaactatttggttcaatcagtacgaaacaaattgccgaagcactaaaaaaacaacatgatattaaaatcgacaaacgtaaaatggacttaccgcatggtattcatgcactaggatatactaatgttccagtgaaattagacaaagaagtcgaaggtacaatccgtgtgcacactgtagaacaataa

SEQ ID NO: 2324 - DNA, 1947 bp, Staphylococcus epidermidis
agtaacgagaaagtgatggtgaatacattgtcagatgtaaacaacacagataattatggtgctggacagatacaagttttagaaggtctcgaagcggttcgtaaaagaccgggtatgtatattggttcaacttcagaaagagggttgcaccatttagtatgggaaattgttgataatagtattgacgaggcattagcaggttatgctagtcatattgaagttgtaattgagaaagacaattggattaaagttactgacaatggccgtggtattcctgttgatattcaagaaaagatgggacgccctgctgtcgaagttatcttaactgtacttcacgctggaggtaaattcggaggtggcggatacaaagtatctggcggtcttcacggtgttggatcttcagttgttaatgcactctcacaagatcttgaagtttatgtacatcgtaatggcacgatttatcatcaagcctataaacaaggtgtgccacaatttgatcttaaagaaattggcgatacagataaaacaggtacagctattcgattcaaagccgataaagaaatctttacagagacaacagtttataactatgaaacacttcaaaagcgtatacgtgagcttgctttcttaaataaaggtattcaaattactttaaaagatgaaagagaagaggaagttagagaagactcatatcattatgaaggcgggattaaatcctatgtagatttattaaatgagaataaagaacctcttcacgatgaacctatatatatccatcagtctaaagacgatattgaagtggaaattgcacttcaatataacagtggatatgcaaccaacttattaacgtatgcgaataatattcatacatacgagggtggtacgcatgaagatggctttaaacgtgctttaacacgcgttttaaatagctatggtacgcaaagtaagattattaaagaggataaagatagactttcaggtgaagatacacgagaaggtttaacagcagtcgtatcaattaaacatggcgatcctcagtttgaaggacaaacaaaaacaaaattaggaaactctgaagtacgtcaagttgttgatagattattttctgaacactttgaacgtttcttatatgagaatccatctgtaggacgcattattgttgaaaagggtattatggcttcacgcgcacgtgtggctgccaaaaaagcacgtgaagttacgcgtcgtaaatcagcattagacgtttcaagcttaccaggtaaattggcagattgttctagtaagaaccctgaagaaagtgaaattttcttggtagaaggtgactctgccggggggtctactaaatctggtcgtgattcaagaacacaagccattttacctttaagaggtaaaattttgaatgtggaaaaagcacgtttagatcgtatcttaaacaataacgaaattcgtcaaatgattactgcatttggtacgggtattggaggagaattcgatatatcaaaagcacgttatcataaaatcgtaatcatgactgatgccgatgttgatggtgcacatatacgtacgttattacttacattcttctatcgtttcatgagacctttaattgaagcgggctacgtttatattgctcagccgcctttatataaactaacacaaggaaaacaaaaatattatgtatttaacgatagagaactagacaagttgaaacaagaattaaacccgtcaccaaaatggtcaattgcacgttacaaaggtcttggtgaaatgaacgcagaccaattatgggaaacgactatgaatcctgaacatcgctctatgttgcaagtgagacttgaagatgcaattgatgcagaccaaacatttgaaatgttaatgggcgatgtagtagaaaatcgcagacaatttatcgaagacaatgcagtttatgccaacctagatttctag

SEQ ID NO: 2325 - DNA, 186 bp, Staphylococcus epidermidis
tgtagcagttttatttatttaattaaaaatattaatatagaaatagaacgtaaggtgacattacaagcagttaattataataatgttgaaattctctcgcctctcatccgagaaaaattgtatgtatatcgtcacaatgtatctactattacacagaacaaaatatttagtttcaacaagttgtag

SEQ ID NO: 2326 - DNA, 1119 bp, Staphylococcus epidermidis
acaatgaaacttaatacactccaattagagaattatcgtaactatgaacaggtgacattagattgtcatcccgaagtgaatatccttattggtgagaacgcacaaggaaagacaaatttacttgaatcaatttataccttagcgcttgctaaaagtcatcgtacgtcaaatgataaggaactcatacgtttcaagtctgattatgctaaaatagagggtgagctaagttatagacatggtacgatgccgcttacgatgtttataactaaaaaaggtaagcaagttaaagtaaatcatcttgagcaaagcagactaactcaatatattggacatttaaatgtcgtcttatttgcacctgaagatttaaatatcgttaaaggttcaccacaaatacgtcgacgattcatagatatggagttaggacaaatatctgctgtctatttgaatgatttagctcaatatcagcgtattctaaagcaaaagaacaattaccttaaacagttacaaattgggcagaagacagatacaacaatgttagaagtcttaaaccaacaatttgctgaatatgcactgaaggttacgttacgtcgagagcactttataaaggaattagaaacacttgcacaacccattcatgcaggtatcacaaatgatcgagagacactgacactcgattatgttccaagtttgaagttaagtaattatgaagccaatcaatctgagttaattgaagaagtattagcattgttaaatgacaatttacaaagagaaaaagaacgaggcgtatgtctctatggcccacatcgtgatgacttaagtttcaatgtaaatggcatggatgctcaaacgtatggttcacaaggtcagcaacgtaccactgcgctgtcaattaagttggcagaaattgaattaatgaatattgaagtaggagaatatccaatcttacttttagatgatgtcttgagtgagcttgatgattcacgtcaaacacatttgttaagtacgattcaacataaagtacaaacatttgtgacaactacgtcagttgaaggaatagatcatgaaataatgaataacgctaagttataccgtattagtcaaggtgaaatactaaagtaa

SEQ ID NO: 2327 - DNA, 1989 bp, Staphylococcus epidermidis
aaagtgattagaggtggaagaatgaaccgtcaatccactaaaaaagctttgctcataccgtttattttaatggtactcactgccatagcacttgtcgtcgtgtggtttatttttaaccaactagtggcaggtattgctacagctatactcattgtgatgattattattagtggcgtgttattgagaaaagcatttctaaaaatggataattatgtggatgatttaagtggtcacatctcggcaagtagtaataaggcgattaagcacttgcctatagggatgattgtgttagatgaagataatcacattgagtggatgaaccaatttatgacagatcacattgaaacgaatgtgatttctgaaaatgtcaatgaagtcttccctaacatcttaaaacaactggaaaaagttcaagaagtagaaatagaaaacaacaattattattatcatgtacgatattcagaaaacgagcattgtttatacttctttgatatgactgaaactgaacgtacaaatgaactatatgaagattccaagccgattattgcaacaatatttttagataattacgatgaaatcacacaaaacatgaacgatacacaacgttctgaaattaactctatggtgacacgtgtgattagtcgttgggcgcaagattacaatatttacttcaaacgttacaactcagatcaatttgtagcttactttaaccaaaaaatactggctgaactagaagattctaattttgaaatcttaagccaattaagagagaagagtgtgggttaccgcgcacaactaacattaagtattggtgtaggtgaaggcactgagaaccttattgatttaggtgaattatcacaatctggtttagacctcgcgttaggtcgtggtggtgaccaagttgcaattaagaatatgaacggcaatgtaagattctatggtggtaagactgaccctatggaaaaacgtacgcgtgtacgtgcgcgtgtgatttcacatgccctcaaagatattcttactgaaggcgataaagttatcgttatgggacataagcgaccagatttagatgctataggtgcagctatcggagtttcgcgctttgcatcaatgaataatttagaggcatttatcgttcttaatgattctgatattgatccgacattacgtcgtgttatggatgagattgataagaaaccggaactaaaagaacgctttgtaacatcggatgaggcttgggatatgatgacttctaagacgactgtcgttgttgtagatacacataaacctgaaatggtcttagatgaaaatgtcttaaataaagcaaaccgcaaagtagtcattgatcatcatagacgtggcgaaagctttatttcaaatccattacttgtgtatatggaaccttacgctagctcaactgctgagctcgtaacggaattactagaatatcaaccaactgaacagagattgactcgtttagaatcaactgtcatgtatgcaggtattatagtagatacaagaaactttacgttaagaacaggttccagaacatttgatgctgcaagttatttacgtgcacatggcgctgatacaatcttaacgcaacatttcttaaaagatgatgtcgatacgtatatcaatcgttcagaattgataagaacagttaagatacaagatcaaggtgtagccattgcacatggttcagatgataaaatttatcatcctgtaacggttgcacaagctgccgatgagttgttaagtttagaaggcattgaagcatcttatgtagtagctaaacgtgaagacaacctgattggtatctcagcacgttcattaggttccataaatgttcaattaacaatggaagcgttaggtggcggtggccatctgacaaatgctgcaacacaaataaaaggtgcgacaatagatgaagcaatagaacaattacaacaagcaattacagaacaaatgagtaggagtgaagacgcatga

SEQ ID NO: 2328 - DNA, 291 bp, Staphylococcus epidermidis
tggcacctaagacagattgttcagcttcattgctatgtggcatttgattttgctcatacattccatccattatctacttacacctcttatttcaatccatcttttattttatcgtcatctgatattgtcacgagatacactacagatatttcagaggttaacaaattgtataagtcatacatcttatataattgcacctataatagtaatcatgtactatcctcgcgtcatatctttaaattattgttctacagtgtgcacacggattgtaccttcgacttctttgtctaa

SEQ ID NO: 2329 - DNA, 1158 bp, Staphylococcus epidermidis
acgactggaaggagtttaaatttaatgatggaattcacaattaaaagagattattttattaatcaacttaacgacacattaaaggctatctcacctagaacaactttaccgattttaacaggtatcaaaattgatgctaaagaaaatgaagtcattttaactgggtcagattcagaaatatcaatagaaatcactattccaaaacaagttgatggtgaagaaattgttgaaattacagaaacaggatcagttgtacttcctggtcgtttcttcgttgatattattaaaaaacttcctggaaaagaagttaaattatcaactaatgaacaattccaaacgttaatcacatcaggtcattcagaatttaacttaagtggcttagatcctgatcaatacccattattacctgaggtatcacgagatgacgctattcaattgtcagttaaggtactaaaaaatatcattgcacaaactaattttgcagtgtccacctcagaaacacgaccagtacttactggtgtaaactggcttatacaagataatgaattaatatgcacagcaacagattcacaccgcttagctgtaagaaagttacagttagaagatgaatcagaaaataaaaatgtcatcattcctggtaaagctttatctgaattaaacaaaattatgagtgacagcgacgaagatattgatattttctttgcttctaaccaagtgttattcagagtggggaatattaatttcatctcacgtttacttgaaggtcattatccagatacgacacgtttattcccagaaaattatgagattaaattaggaattaacaatggagacttctatcatgcaattgatcgtgcatctttattagcacgtgaaggtggaaataatgttattaaattaagtacaggtaatgaattagttgaactttcatctacttctcctgaaattggtactgttaaagaagaagttaacgctaatgatgtagaaggcggaaacttgaaaatttctttcaactcaaaatacatgatggatgctttaaaagccattgataatgatgaagtagaagtagaattctttggtacaatgaaaccatttatcttaaaaccaaaagatgatgattctgtaacgcaattaattctgcctattagaacatattaa

SEQ ID NO: 2330 - DNA, 987 bp, Staphylococcus epidermidis
aggaggtatggaactattatgacgaattacacggttaatacattagaactaggtgagtttataactgaatctggtgaaacgattgatcatttacgtctacgttatgaacatgtaggacttcctggtcaaccccttgtcgttgtttgccatgcacttactggcaatcatttaacatacggtaccgatgcgcaacctggctggtggcgagaaatcattgatggtggctacattccagttcatgattatcaatttcttacattcaatgtcattggaagtccatttggttcgagttctaaattaaatgatgacaacttcccagaacatttaacattgagggatatcgttagagctattgagttaggtatacaagcattagaatttaagaagattaatattctcattggaggcagtttaggtggcatgcaagcgatggaattgctttataatcgtcaattcgaggtggaaaaagcaatcatattagccgctactgataaaacgtcctcctatagtcgtgcttttaacgagattgcaagacaagctatacatataggcggtaaagaaggtttaagtatcgcacgtcaactcggcttcctcacgtatcgatcgtctaaaagttatgatcaacgttttacaccagatgaagtagtgagctatcaacaacatcaaggtgataagttcaaagaatatttcgatttaaattgttatttaacactgctagacgtcttagatagtcatcatttagatagagggagagatgatgttgatgaagtctttcaatcgttggaaacgaaagtactaactatgggctttattgatgatttactttatcctgatgatcaagtaagagctttaggagaacgttttaaatatcatcgtcatttcttcgtaccagataatgttggacatgatggttttcttctaaattttaatgattgggcacctaatttatatcatttcttaaatctgaaacaattccgacgtaaatag

SEQ ID NO: 2331 - DNA, 1404 bp, Staphylococcus epidermidis
ataatggatggaatgtatgagcaaaatcaaatgccacatagcaatgaagctgaacaatctgtcttaggtgccattattatagatccagaactcattaatactactcaggaagtcttgcttcctgagtcgttttatagaggcgcccatcaacatatttttcgagcaatgatgcacctaaatgaggataataaggaaattgatgttgtcacattgatggatcaattatcaagtgaaggtagcttgaacgaagcgggtggccctcaatatcttgccgaactatcgacgagtgtaccgacaacacgaaacgttcagtactatacggatatcgtttttaaacatgcgttgaaacggaaacttattcaaaccgctgatagtatagcgaatgatggctataatgatgaattagaattagatacgattttaagtgacgccgaacgacgtattttagaactatcttctactagagaaagtgatggttttaaagatattagagatgtcttaggacaggtatatgagaccgcagaagaactcgatcaaaatagtggtcaaacaccaggtattccaactggttatcgtgacttagatcaaatgactgctggttttaaccgtaatgatttaatcattctagcggcacgtccttcagtaggtaagactgcctttgccttaaatattgcgcaaaaggttgccacacatgaagatatgtatactgtcggtattttctcacttgagatgggcgccgaccaattagcaacacgtatgatttgtagttctggtaacgttgattccaatcgtttaagaactgggacgatgactgaagaagattggagtcgctttacgattgcggtaggtaagctatcacgaactaaaatcttcatagacgatacgccaggtatccgtatcaatgatttacgttctaaatgtcgtcggctcaaacaagagcacggtcttgatatgattgtgattgattatctacaattgattcaaggaagcggatcacgtttctcagataaccgtcaacaagaagtttcagagatttcacgtacacttaaggcgattgcacgtgaattagaatgcccagttattgcactgagtcagttatcacgtggcgttgaacagcgacaagacaaacgtcctatgatgagtgatattcgtgaatctgggtctatagaacaagatgccgacattgtcgctttcttatatcgtgatgattattataatcgtggtgaaggtgatgaagatgatgacgatgctggttttgaaccacagacaaatgatgataacggtgaaattgaaatcatcatcgccaagcaacgtaacggtccaacaggtactgtgaaacttcactttatgaaacaatataataaatttacagacattgattatgctcatgcagatatgtcataa

SEQ ID NO: 2332 - DNA, 840 bp, Staphylococcus epidermidis
catgttatgggaggttatgtcgttatgaaaacgttagattctgttaatattcctataagaaaagacgaaacacataaaggtgactatggtaaaattttattaatcggtggatcagccaatatgggtggcgcaatcatgcttgctgcacgcgcttgcgtttatagtggaagtgggctcattactgtagcaacacacccaaataatcatgctgcgctacattctcgttgtcctgaggcgatggttatagatattaatgatactaaaatgcttacaaaaatgattgaagcaactgatagtatccttatcggtccaggtcttggagtagatttcaaaggtaataatgccatcacgtttttacttcaaaatatacaaccacatcaaaatttaattgttgacggagatgctataacaatattcagtaagttaaaacctcaaattcctacatgtcgtgttatattcaccccacatcaaaaggaatgggagcgtttgagcggtatacctattgaagaacagacatatgaacgtaaccttgaagcggtagaacgtattggcgcgacagtagtattaaaacaacatggtacggaaatctatttctgcaatgatgatgtctataaattacctattggcacacctgctatggctacaggtggtatgggtgatacacttgcgggcatgattacaagcttcgtaggccaatttgataattttaaagaagctgttacaagtgcaacttacatgcatagttttatcggtgaaaaattatctgacacaatgtatgttgttccaccttcacgtctaattagtgaaataccgtatgtgatgaaacaacttgaaggttaa

SEQ ID NO: 2333 - DNA, 1365 bp, Staphylococcus epidermidis
tgttcgatttttatttgcaaattcaaaatcatattggtaaaatacctagtggttaaacgagaaaaacttggaggtgctcatatgtcatcaatcgtagtagttgggacacaatggggagacgaaggtaaaggtaaaataacagactttttagcagagcaagcagacgtaattgctagattttctggtggtaacaatgcgggacatacgattcaattcggtggagaaacttacaaattacacttagtaccatcaggcatcttttataaagataaattagcagtaatcggtaacggtgtagttgtagatccagtcgcattattaaaagaactagatgggttaaatgaacgtggcatttcaactgacaacctacgcatctcaaatcgtgcacaagtcattttaccttatcacctagctcaagacgaatatgaagaacgtcgtcgtggcgataataaaattggtacaacgaaaaaaggtatcggcccagcatacgtagataaagcacaacgtatcggtattcgcatggcagacttattagaaaaggaaacattcgaacgccgacttaaagaaaatattgaatataaaaacgcatactttaaaggcatgtttaacgaaacttgtccaacattcgatgaaatctttgacgaatattatgctgcaggtcaacgtttaaaagactatgtgacagacacagctaaaattttagacgatgcaaatgtggctgatgaaaaggtattattcgaaggtgcacaaggtgtcatgttagatatcgaccatggtacatatccattcgttacatctagtaatccagttgcaggtaacgttacagtaggtacaggtgttggccctacatcagtgtctaaagtgattggtgtatgtaaatcatatacatctcgtgtaggtgacggtccattcccaactgaactttttgatgaagatggccaccatattagagaagtgggtcgtgaatatggtacaactactggacgtccacgtcgtgtaggttggttcgactcagttgtattacgtcattcacgtcgtgtaagtggtatcacagatctttcaattaactcaatcgacgttttaacaggattagacacagttaaaatttgtactgcttacgaattagatggtgaaaaaattactgaatacccagcaaacttagatcaattaagacgttgtaaacctatcttcgaagagcttccaggttggactgaagacattacaggttgccgtagtttagacgagcttcctgagaatgcacgtaattacttagagcgtatttcagaattatgcggtgtccatatttcaatcttctcagtaggtccagaccgcgaacaaacgaatttattagagcaactttggtag

SEQ ID NO: 2334 - DNA, 936 bp, Staphylococcus epidermidis
tcaaaaagtatgggagtggcgtatgtgttttcaaaaatacaacctaaagcaactattttagcaattatttcattattagtagtcgctttagtaacacatgtattacctgttctcggcttgattttatgtttatttgcaacgattcctggtattgttttgtggaatcgttccatacaatcattcggaattagtgcattagtaacagtcgtacttacaacattattaggtaatacatttgtcttaagtatgatggtcttaatcttattattaagtgcgattatcggacaattacttaaggaaagaacatctaaagaacgaattctttatatttcaacagcttcattaagtttagttacacttattggatggatgttattacaaacattcgataaaattccgacggcagctgtattaattaagccttttaaaaatgcaatgcatgaggctttcttaacaagtggaatcgattcaaactatagacagattcttgaggaaagtttccgacaaatgacggtccaactccctagttttctaattatagttattttcatttttgtcttaattaatctgattattacatttccaattttacgcaaatttaaagtagcaacacctatttttaaacctttattcgcatggcaaatgagccgtaatttactatggttttatcttatagtacttatttgtgtcatgattgcaagtgaaccaagtacgttccaaagcatcgtgttaaactttgatgttgtgttatcattagtgatgtacatccaaggattaagtgtcattcacttctttggtaaagctaaaagatggccgaacttcgcaacaattcttgttatggtagtagggacacttcttacaccagcaacgcatattgttggattacttggggtaattgatttatgtattaatttaaagaaaataataaaaaaatga

SEQ ID NO: 2335 - DNA, 471 bp, Staphylococcus epidermidis
gaaatcacgattgagaatatatattgtactcattgtatgtgtgattgtgatgatgcttcttctaagttcaattctaccttcatacgtagcaattttaatagccgcaattgttgctgcattgttaggggtggtgatggaaaaatgacgacagatttacatacattagtacttattgttttatgtggcgtggtcacattactcgttcgagttattccatttattatgatatcacgtgtcaacttaccagcaattgtaattaaatggctttcttttattcctatcactttatttacagctcttattatagatggtgtaattcaacaacatgatcatgcatttggttatacgcttaatttaccttatattattgcaatcgtgccaactgtgatgctcgctattttcacacgtagtctaacagtgacaattctcggaggtatatttgttattgcttgcttacgtttaatcttttaa

SEQ ID NO: 2336 - DNA, 207 bp, Staphylococcus epidermidis
aatcaaaatgtttacaaccttacttttaaagattatcaaaaaataataatgactaaacttttgcaactctttaagacatcattgatttttaattttttattaaaattttatttagaaatagtaattttcaaaagatacttaattttgtttgatataatcacaccatcaaatgaaacgaggtgtaacaatattgaattggcaacgtaa

SEQ ID NO: 2337 - DNA, 243 bp, Staphylococcus epidermidis
gaaattttggttcaagaagttgttgtagaaggaaatatcactttaggtcaatttcttaaaactgaaggaatcatagaatcaggtggacaagctaaatggtttctacaggattttgaggttttaattaatggacaacgtgaaacaagacgtggcaaaaaattagaacacaacgaccgcattgatattacagatatccctgaagatacgggttcctttttaatcatccatcaaggtgaacaatga

SEQ ID NO: 2338 - DNA, 636 bp, Staphylococcus epidermidis
agaagaatctctatgatagttaaattttgtggttttaaaaccgaaagtgatattaagaaaattaaaaaattagaagttgatgcagtagggtttatacattatcccgatagtaagagacatgtctcactgaaacaattaaaatatttggctaaaatagtgccagatcatatagagaaagtagtggtcgtagtaaatcctcaaatgtccaccataaagagaataattaatcaaactgatattaacacaatccaattacatggaaatgaaagcattcaattaattagaaatattaagaaacttaattcaaaaataagaatcataaaagcaattccagcaacaagaaatttaaataataacattcaaaagtataaagatgagatagacatgtttattatagatacaccatcaatcacatacggagggacaggtcaaagttttgactggaaattattaaaaaaaataaagggcgttgattttctcattgcgggtggtttggattttgaaaagataaaacgattagaaatatattcatttggacaatgtggttatgacatctcaactggcattgagtcatataatgaaaaagattttaataagatgactcgaatattaaaatttttgaaaggagacgaatga

SEQ ID NO: 2339 - DNA, 189 bp, Staphylococcus epidermidis
attcagacatcatcgtggcttaatataagaaaagtaacagctcaacgagctgaaaataatcaaaaaaattataaaaaagacaatttctatattttttcaatagaaattgtcttttttacttatcttgaacctttttgtcccagcctcttcagggattcattttttaattatcttcaaagaaatttttga

SEQ ID NO: 2340 - DNA, 327 bp, Staphylococcus epidermidis
atagctgctcctaaaccaatcggaactgctacgattgtagcaataacagtaattttcaatgtgccgatgatgagtgcccaaattccaaattctggtgatgaaccagttgggttccaagtaccagataaaaagaatttagataatggcactcgtgtgaaaaacgtaatcgtctcggttaaaagtgtaaataaaatagcaattgtagttaatatagatatagctgaaataatggctaaaataattgggacaattttatcacttagcccgccctttttagcattattcttagctatcatttctctcacctttgtttgtgaagccatgtaa

SEQ ID NO: 2341 - DNA, 3033 bp, Staphylococcus epidermidis
gatttgaagcctttacatatagttatggagaactttggcccttttattaaagaaactattgattttgagcaagttgaaactgatcaactctttttaattagtggtaaaactggatctggtaaaacaatgatttttgatgctatagtatacgcattatacggtatggcttcgaccaaaactagaaaagaaggagatttaagaagtcattttgcagacggtaaatcgccaatgtctgtaatttatcaatttaaagttaataatcaaacttttaaaattcatagagaagcgccatttattaaagaggggaatataactaaaacacaagccaagttaaatatatatgaattagttgataatcaatttgaattaagagaaagtaaagtgaatcaaggtaatcaatttatcgtacaattattaggcgttaatgctgaacaatttcgtcaattatttattttgcctcaaggagaatttaaaaagtttcttcagtcaaatagtaaagacaaacaatcgattcttagaacactttttaatagtgagcgatttgatgagattagacatctacttgtagaaaatgtaaagcaagaaaaagtacaaattgaaaatagatacactcaaattgaaaatttatggaatgatatagatacatttaataatgatgaattggccttatataaagaattagagagttctcagacagataaaatgattgaaaaattcccacaatttaatgattatggatgcaaaattctcaagtcatttgaagaagctaagaataaaataactaaggaattagatgatttaaatcataaatataaagtgaatgttgaattaagtgagaatactaaaaaattaaaagcggaaaaaatcaaatttgacgatttgaaaaaagaacaaaattatattgataaattaaagcaagaattaaaaatgattcaggaatctaaagtattaatcacttattttactaggttacaaagtttaaaaaaagataaagatgaattagtgtcacttcatgagcaatcaaaattaaacgaaacaaactatcacaatgaaattaaaggttttcaaaaacaactcgaacatttatcaacacgagaaaatgaaataactcaatttaatcagtatctagaaaaaaaccaagttttcttcaatcaattagataagattattagtagttatcaacaaaaaccggtaattgaagaagaaataaaaagattatacagtgaatataatgatttaataaccaaaaaagaagaattgacgaaagaaatgaacaacaagaacaaagattttgcaattattgaacattacactgaagagatttataagctgaaaaagattatagatgaatctgaaagacaaaaaaaggatgagaaattatttgataaattacaactagataaatcatcttatcttagcaaattaaaagagaagaaagaacagttaaatgaaattgaatcatcaatcaccaatatagatgcgactttaattgatttgaatgacaaaaaggattttgtaaatgaaataaagtccgctatgtcaattggagatacctgtccaatttgtggtaatgaaatacattcattgggagaacatattgattttgaatcaattgctcaaaaaaataataaaataaaacggttagaaagtaagaaggtaaaaattcgtgatgaaataatcaaaatagaaactcgaattgaagaattaaatcatagagaaaatgaattaaattttgagaaacaagaaaagaaggatattagtgagcttcaaaaacagcttaatcatttgaatcaactaaaagacgagcaacaaagcataaataagttagtagaaaattttgagaaacaagaaaaagaaatagttaataaaatacatcagtttgatttagatttgagtcgaaagaacacgcaaaaagaaaaactggaaattcaaattaatgattttgaacgacattcacaattttcatcagtaaatgattttgaaacttattattctcatgctaaaaaacaagttgagacgtatgagtatgagaatgagaaaactaaagataaattgaacgagttgaataataagttaaagatagaaatgaatgatcaaaaacatttaactgagaatttaactcaaacaagtaaggaaataaataatttagaattaaaaatggaaaaagaaatgcaacaacttggttttgagtcttatgatcaagtcaaaagcgctgcagatttaagtgctcaaaaagatgaaatagaaagagaaattaatatttataataagaactatcaaagttatgaaatagagattaacagactcaaagaattggttaagggcaaaaaattattaaatttagaagaattacgacaatctatagaaaaaacaaacttgaaactagatgaaacgaattcacaaatagctacgattagctataaaatagataataactctaacaaatttaataaaataaaaaatataattcagattctcgatgatgaattaaaagtgcaaaaagaaattttcttgctatcagaaatattagctggtaaaaatgattataaattaacactagaaaattatgttttaatttattacttggaaaaaataatttttcaagcgaatcaacgactttcatttatgagtggaaatagatatcaactgattagaagagagaccatttccttagggttaagtggattggaaattgacgtgtttgattttcattcaaataaatcgagacacataagttcactttcaggaggagaaacatttcaagcatcactagctttagctttaggattaagtgaagttgtacaacaagaatcaggtggaatcactttagattctatgtttatagatgaaggatttggcactttagatcaagaaacactcgaaactgcgatagatacattaattaatttaaaatcatctgggcgcatggttggtataatctcacatgtaagcgaacttaagcaacgcatacctttgattttagaagtgacaagtaaccaatacgaaagtcatacacaatttagaaaaaattaa

SEQ ID NO: 2342 - DNA, 270 bp, Staphylococcus epidermidis
gcgaataagtttatgtcaaaagagggtgtcaatttgacttatttagtcttttccattgtatttgcatttctaatgggtgctgtcgttatagtgataagaatgaaagcacaacagtttccagtcaatgaaaagaaaattatcttaccacctttttccatgctaccgtgcattgatgtattgtacccatactttcgattaactggtatggacaatgttagaatcattgatattaggtgttttgttttctactgttttaatctggacttctag

SEQ ID NO: 2343 - DNA, 564 bp, Staphylococcus epidermidis
aagatatttactctggtaaagctaaaacatggaaagaccgttaactctagttggccagataaaaaaatcaatgctgtttcacctaactcaagtcatggtacttacgacttctttgaagaagaagttatggacaaacaagatatcaaagctgagaagaacgctgatactaacgcgatcgtatcttcagtaactaaaaacaaagaaggtatcggttacttcggttataatttctacgaacaaaataaagataaattaaaagaagttaaaatcaaagatgacaatggcaaagttacagaaccaactaagaaaacaattcagaacggttcatacgcactaagcagaccattatttatctacgctaaagacaaatcattaaaagacaataaagtaatgtcagaattcatgaaatttgtacttgaagatgaaggtaaagcagctgaagacgctggttatgtagcttcacctaagaaaacttataaatctcaattagatgacttaaaagattttttagataaacatcaaaaatctgataagaaagacgacaaaaaatcagaagataaataa

SEQ ID NO: 2344 - DNA, 309 bp, Staphylococcus epidermidis
ttaaatcatactctaatcttaaatcttcttggaatctttttaactgatttattcttaatttgctatgttgttattttttctgtgaaatttaattctgggataactattattagtatgattttatgttacgtggtcataaagattacagacaatattaataaaatcaagttttccccttcaaatttcacaaatttagataccgataaaagttttattttcaacttatcaataatgagctctattactattgtttatatattcattatttacctcttagcaattacgattttcagaaaaattcaattttaa

SEQ ID NO: 2345 - DNA, 1023 bp, Staphylococcus epidermidis
cggcttgatacatatcccttgatgtatcaagccgctttatttttggcaagatttaaagtattgatgtcattgattcaatctctatataacagtaaaaaatttcaaaatagattccttttcaatttaggtattaagcattataattttaataatgatattagaaaggtgattatgatgagcaagtatgtaataacgaaaacactcaataacaatgtcatcatatgcacaaaaaatcatcaagaggttgttttaattggtaaaggtattggttttaataaaaaggttggtatgacagttcaagagaatgcttcaatagaaaaaatttataaattagaacaacaagagcaacaagaacactacaaaacacttttggagctcggagaagatcatgttgttcaagcggtgatagaatcagttaatattatcaatgaatctggtctaattacagatgataaaaatttggttgttgcacttacagatcacatcatttatgcctataaaagacttaagcaacatcaaatgattacaaatccatttgtgattgaaacaaaacatctctatagtaatgcatacaatgttgctcgaaaggtaatcgataaattaaataaaaccttagacgtacattttccagaagatgaaattggattcatcgcattacatattgcatccaactctgaaaaattatcaattcacgatatttcagtaataaacaagttaatcaataagagtattacaattattgaaactgatttacaacattcaattgataaacaaacaatacaatatcagcgttttataagacacatacaatttttaatatatcgattaactaaaggtgagtatttagaagcacaggagaattttatatcgatgataaaaactatgtatcctcgtagttttaatacggcttataaaatattaaaaatgattcaacgtgagtttagtgtgtatgtatacgaagcggaaatagtttatttaacattacatatcaatcattttgaagttcaaattagtagtgaataa

SEQ ID NO: 2346 - DNA, 309 bp, Staphylococcus epidermidis
ggtgataacactatgaatataaaattaactcaaaaggcagtagaatggtttaaaaacgaattggatttacctataagcaataaagttcttcaattttatgtaaaatatggaggagaattccaattaaaacaaggatttagtccagcgttcaccgtagaaaataaagatgctattgatataggttttgaacaaacattctatgaaataaatgtcgttattgcggaaaaagatttatggtattttcaagatgaaaaactaactgtagatgcaatcgatcatgaagatgagatcatctacaaacgaaattaa

SEQ ID NO: 2347 - DNA, 183 bp, Staphylococcus epidermidis
gaattcctaacaacattagaaagggtgtttaacgtgcgcgtaaatattacattagcttgcacagagtgtggcgatcgtaactatattactactaaaaataaacgtaataatcctgaacgcattgaaatgaaaaaatattgtccaagattaaataaatatacgttacatcgtgaaacaaaataa

SEQ ID NO: 2348 - DNA, 942 bp, Staphylococcus epidermidis
gagagagggttttacatggcttcacaaacaaaggtgagagaaatgatagctaagaataatgctaaaaagggcgggctaagtgataaaattgtcccaattattttagccattatttcagctatatctatattaactacaattgctattttatttacacttttaaccgagacgattacgtttttcacacgagtgccattatctaaattctttttatctggtacttggaacccaactggttcatcaccagaatttggaatttgggcactcatcatcggcacattgaaaattactgttattgctacaatcgtagcagttccgattggtttaggagcagctatctaccttaatgaatatgcatctgatcgttcacgtagaatcattaaaccaatattagaaattttggctgggattcctacaattgtatttggcttctttgctttgacatttgttacacctatattgagaaatctaattcctaacttgggagagtttaattcaatcagtcccggtattgttgtgggtataatgattgtccctatgattacaagtatgagtgaagatgcaatgtcatctgtacctgataaaattcgtgaaggtgcatttggattaggcgcaactaaatttgaagtcgctacaaaagttgtattaccagctgcgacttctggcgttgttgcttcaattgtattaggtatatcaagagcaataggtgaaacaatgatcgtttctttagctgctggtagttcaccaacatcatctctaagtttaactagttcaattcaaacgatgacaggatatattgttgaaattgctacaggtgatgcagcatttggttctgatatttactacagtatttacgctgtaggttttacacttttcattttcactttaattatgaatttattatcacaatggatctctaaacgattcagagaggagtattaa

SEQ ID NO: 2349 - DNA, 282 bp, Staphylococcus epidermidis
aataacagaacgaatttagtaaaatgcataaggataaagaaagcgggtgaaacaatggcaatttgggtagcaattattctaatcgttatagcacttattgcaggtttaattggtggtttcttattagctagaaaatatatgaaagattacttaaagaaaaatccacctatcaatgaggaaatgctacatatgatgatgatgcaaatgggacaaaaaccatctcaaaagaaaattaatcaaatgatgacaatgatgaataaaaatatgaatcaaaaaatgtaa

SEQ ID NO: 2350 - DNA, 933 bp, Staphylococcus epidermidis
acgttattgacctataacatcacatctaggtctcaatatataaaggagtttttaattatggctaattcacaagtagcagaaaaagagaaactagacgcacaaacaaataatcaagactcagttgccacaatagtaactactgaaaacaataagaaaaatacaattccagacagtgaaaagaagattgtttattcaactcaaaatctagatttatggtatggagaaaatcatgcgttacaaaacattaatttagatatattggaaaataatgtaactgcaataatcggaccttctggatgtggtaaatctacatacatcaaagctttaaatagaatggtcgaattagttccatctgtgaaaactgcaggtaaaattttgtatcgtgaccaaaatatatttgatgcaaagtattctaaagaaaagctacgtactaacgttggaatggtctttcaacaacctaacccattccctaagtcaatttatgataatattacttatggccctaagactcacggtattaaaaacaaaaaaattctagatgaaatcgtagaaaaatcattacgtggcgctgcaatatgggatgaattaaaagatagattgcatacaaatgcttatggattatcaggtggacaacaacaacgtgtttgtatagctagatgtttagcaattgaaccagatgtcattttaatggatgaacctacatcagcattagatcctatttctacgttaagagttgaagaacttgtacaagaattaaaagaaaattactcaattatcatggttacgcacaacatgcaacaagctgcgcgtgtttcagataaaactgctttcttcttaaatggatatgtcaatgaatatgatgatactgataaaatcttttcaaatcctgccgacaaacaaactgaagattatatatctggtcgttttggataa

SEQ ID NO: 2351 - DNA, 996 bp, Staphylococcus epidermidis
gtaaatatgactgaacagaaggatattaaagaaacagagtatcgacgacagaaaggaacaacttcgacaccttttaggcgaagaaataaaaaaagaatgcggaagttaccttttatcattttagtcatccttattattttaatttctatcattgtgtatattacccatcagtataacagtggtatgaagtatgctaaagaacatgctaaggatgttaaggtgcataaatttaatgggaatatgaaaaatgatgggaagatttcagttcttgtccttggcgcggataaggctcaaggtggtaaatcacgtactgactcgattatgattgttcaatatgattacgtacataaaaaaatgaaaatgatgtctgtcatgagagatatttatgctgatattcctggttatgataaatataaaattaatgccgcatattcacttggaggcccggaattgttaagaaaaacacttaacaaaaatttaggtgttaatcctgagtattacgctgtagtagattttactggatttgaaaaaatgatagatgaactacagcctaatggtgtcccaattgatgtggaaaaagacatgtctgaaaatataggtgtgtctttgaaaaaaggacatcataagttaaatggtaaagaattacttggttatgctagattccgtcatgatccggaaggcgattttggtcgtgtgagaagacaacaacaagtgatgcaaacattaaagcaagagttagttaatttcaatacagttgcgaaactaccaaaagttgctggtattttaagaggttatgttaatacaaatatgcctaactctgcgatttttcaaacaggtataagttttggaattcgtggagataaagatgtgcaatctttgacagtccctattaaaggaagctatcaagatattaatacaaataatgatggtagtgcgcttcaaatagactctgagaaaaataagcaagcaatcaaaaatttctttgaagataattaa

SEQ ID NO: 2352 - DNA, 300 bp, Staphylococcus epidermidis
ctggtatggacaatgttagaatcattgatattaggtgttttgttttctactgttttaatctggacttctagattcgaagttaaagatgataatatttatatgaaacggtctaaagcatttccaattattttaatatcattattaataataagaacagttattaaaatatttataagtagcgaaattgatccaggtgaaattgctggtatgttttttttactcgcattttgtatgatagtaccttggagatgtgcaatgctttataaatataaaaaattgcaaaagaatcttattaagtaa

SEQ ID NO: 2353 - DNA, 732 bp, Staphylococcus epidermidis
aagcaagctgcaaaaggaggacaacatctaattatgattcaatttgatcatgtagattattcatatcatcgaaaacagcctgttttaaaagatattaatataagtattcaacgtggtgaaaaaataggggttttaggggaaagcggtgctggaaaaagtactattggttctttaatattaggtcaattaaagccaacaaaaggaaaaataagtatcgattcaggaaaggttctacctatttttcaacatgcgacagaaagttttgatcgtcaattcacgattgaacagtctttgagagagccacttttattttatcgacaattaatacgacaaaatatcaaaaatatcattcttaactatttaattgaatttaatttgtctacagatctaataacaaagtttcctcaagaggtaagtggtgggcaactacaaagattaaatattatacgttctctcttagcacaaccagatatattggtttgtgatgaaataacttcgaacttagacgtcatggccgaacaaaatgtaatcaatattttacttaacgaaaaaaacattcaaaataaaacactaatcgtcatctcgcatgatttatctgttttacaaaggttaacgaataggataatagttatcaaagacggtcaaatagtagatgattttaaaagtaaagatttatttagccataaaagacatccatatacaaaactattaattcaaacgtatgaatattga

SEQ ID NO: 2354 - DNA, 390 bp, Staphylococcus epidermidis
tttgattattttttaagcaagtctctaatttctgttaataaaacagtattttcttctacttcttcttctttctcttcttttttcataactgtattagctatcttaacaaagataaataaagcaaaagcaattatgatgaagtcaattattgattgtatgaaaagtccatacttaatcccccaaaaagaccaatcttcagcaaaattaactgaaccaaataatttaccaattaatggcatgatgatgtattggactagggatgtaactattttattaaacgctgctcccataactacagcaatagctaagtctaaaacattgcctttgagtgcaaactctttaaattcttttaacataaagcataacccttcttttaaaatatatttctga

SEQ ID NO: 2355 - DNA, 243 bp, Staphylococcus epidermidis
gttggtaacgcagagaattggtcgagtaatccacttggtgttgctaaaagtatcgtaggtatacctatcattacaagtggtgctgtttctcctaatgcgcgtgataaagataaaatgaaacctgttaaaataccaggtaatgctgcaggtaaaacaactcttctaattgtttgccatttattagcaccaagaccatatgatgcttctctgactgaactaggaactgctctgatagcttcctga

SEQ ID NO: 2356 - DNA, 654 bp, Staphylococcus epidermidis
gatgcaatggcaattattagacaaaaatatgaaggtcagctagatggattaattaaagatttacggcgtcttggtcttcgtgtatattttaatattaacaatgcactagtatctttaggggaagaaaagaaatcattcgcaagacaaaccattgagaaagacaaagaaattaaccatttagatcatgaaattaacgagaaggtaatcatgctaattacgagacaacaacctattgccaaagatttacgtatgatgatggcagcactcaaaatctctactgactttgaacgaatgggggataatgctgctagtatcgctcatatacgtttaagagttaaaataaatgataactatgtgtttacacgtttaaaaaccatgggtaaattagcgatgctcatgttagaagatttaaataacgctattagaaataaagatttaccactgataaaagaagtcattgagagagatgaagatattgatgatttatacgttaacatcgtcaataccagttacttaattgataatgacccattcgtagctggtcaagcacacttagcagctagacacttagaacgaataggtgatcatataagcaatattgctgaaagtgtttattattatttaacaggccaacattttgaaacttttgattaa

SEQ ID NO: 2357 - DNA, 438 bp, Staphylococcus epidermidis
gtattgttttatctatcattgcattattgcttatcgcttctttgctttgttacttcagctgactcagcaacattcgtattaggtatgcaaactacatttggatcattaaatccaagtagtctagttaaagtaacctggggagttgcgcaagcacttattgcctttgtactattattagctggtggaggagatggctctaaagccttgaatgctattcaaagtgctgccattataagtgccttcccattctcattcgtcgtcataatgatgatgataagtttctacaaagatgcaaataaggaacgtaaattccttggattaacacttacgccaaataaacatcgcttacaagaatatgttaaatatcaacaagaagattatgaaacagatattcttgaaaaaagagaagttagaagaaataaagaaaaagaagaatag

SEQ ID NO: 2358 - DNA, 1272 bp, Staphylococcus epidermidis
gaagggaattatctaattatgaaatttacagagttaacagttaaagaatttgaaaactttgtacaaaatccatcattagaaagtcattatttccaagtgaaggaaaatattgctacacgtgaatcagatgggtttcaagtagtgttattaggtgtaaaagacgacgacaatagagtgatagcagctagcctgttttctaaaatccctacaatgggcagttatgtgtattattccaatagaggccctgtaatggactattcagatttaggtttagtggatttttatttaaaagagcttgataaatatttacatcaacatcaatgcttatatgtaaaattagatccttactggttgtatcaagtttatgataaagatattaatcctttaacagaaaaaaatgatgctttagtaaatctatttaaatcacatggttatgatcatcacggatttacaacccaatatgattcttccagccaagttagatggatgggggtattagatttagaaggcaaaacccctgcatctctaaggaaagagtttgatagtcaaagaaaacgaaatattaataaagcgataaactacggtgtgaaagttagatttcttagtaaggatgaatttgatttattcttagacttataccgagagactgaagctagaactggatttgcttctaaaactgacgattatttctataactttatagagcattatggcgataaagtattagttcctttagcttacatagatttaaatgaatatatacaacatttgcaagaatcactaaatgataaagaaaatcgacgtgatgatatgatggcgaaagaaaataaaacagataaacagttaaagaaaatagctgagttagataaacaaattgatcacgataaaaaagaattgcttcaagctagtgaattacgtcaaacagatggcgaaattttaaatttagcttcaggagtatactttgctaatgcatatgaagtgaactatttctctggagggtcttcagaaaaatataatcaatatatgggaccatatgcaatgcattggcacatgattaattattgttttgataacggttatgatagatataatttctatggcttatcaggtgattttactgaaaacagtgaagactatggtgtttatcgctttaagagaggttttaatgttaggattgaggaattaatcggtgatttctataaaccaatcaataaagtgaaatattggttattcaatacattagatcgcatacgtaataaattgaaaaagtaa

SEQ ID NO: 2359 - DNA, 1041 bp, Staphylococcus epidermidis
tattttttatattcgttgaaagtgaaaggatgccaacatatgtttaaaatgataatttataaactttcacaaatgattgtcgtactatttatattaactacaatcacatttatattaatgaaactctctccaggtaatcctgtagacaaaattttacatcttgatatttcgcatgtatctaatgagcaaatagaaacgacagagaataagcttggcttaaataatcctatttttattcaatggtgggactggttaaatcaattgtttcattttgatttaggaacaagttatcaaacaagcgagcctgtaattagggaaatagcaaattatcttggtcctacacttattattacttttggtacgcttatagtgtcattagttatttctataccattagggattatagcagcggtttactaccataaaatttgggataggataatccgtgttatgacatcattatccgtaagcctaccatcattttttatcggtcttatcttattatatatatttagcttgaagttgaatattttaccaacttcagatgaggggcgtttcgtttcatatattttaccaataattaccatgagtattggaatgtgtgcttattatattcgatttattcgttctactttattagaacaatatcaaacacctatagttgaatcgtctcgtctcagaggtatgcccgaaagatatatactttttcaagatatccttaaacctacgatactaccaatcatacctctattaggattatccattggtagtttgataggtggaacagtagtcattgaaaatttatttgatattcctgggttaggctattttttagttgacagtataaagtcgagagattatccagtcattcaaggttgtgtattatttattggtttctttgtagtgattataaacacaattgcagatttactttcattacttatcgatcctaaacaacgttatgctattactcagaaagaaacatcaaagtttaaatggtttaattcacatagaaaagaaggtcgtaacgatgaagtttaa

SEQ ID NO: 2360 - DNA, 810 bp, Staphylococcus epidermidis
ctattgtcatatatgttaaaaatttatatttgtattttaaaatcatccaatatcactcctagaacatttgtttgtataagtaatttatcagaacataaattctgtgtcaacaacattacgaacaaatgtgtgttagaaaatgtaattaatgatataataatctcaaacaacaataaggagtgcctatttatgagagaactcactaagcgacaaagtgaaatatatgattatattaagaaaattgttcagacaaaaggttatccaccaagtgttcgagaaattggcgaagctgtcggtttagcttcaagttctacagtacatggacatttatctagattagaagaaaaaggatatataagaagagatcctactaaacctagagctatcgagatagttagtgaacaattagatgaggtaaatgtagaggaaacaatacatgttccggttatcggtaaagttacagccggcgttccaattacagctgtagaaaatatagaagaatattttccactaccagagcacttaacttcaacacataacagcgatatatttattttaaatgtagttggggaaagtatgattgaagctggaatattagatggcgacaaagtaattgtacgaagtcaaactattgctgaaaatggtgatattatagtagctatgactgaagatgaagaagctactgttaaacgcttctataaagaaaaaaatcgttatagactacaacctgaaaatagtactatggagcctatttacttagataatgtcattgtagtaggtaaagtaataggattatatagagaaatgtaa

SEQ ID NO: 2361 - DNA, 1029 bp, Staphylococcus epidermidis
ttttataaatatagcaacgagaggaagttgaaaatgacccttcttgagaaaattaaacaaaataaatctttatctaaaaaagatatgcaatcatttattgttacactgtttgattcaaatatagaaaccaatgtaaaggttgaattattgaaagcttatacaaataaagacatgggtcaatatgagctaacgtatttagttgaatattttatccagacaaactatccaaaccaaccattttataataaagctatgtgtgtttgtggcacaggtggagatcaatcaaatagctttaatatttctacaactgtagcttttgttgtagcaagtgcaggagtgccagtcattaaacacggtaataaaagtattacttcacattcaggaagtacagatgtattacatgaaatgaatataaaaacaaacaaaatgaacgaagtagagcaacaattaaatttgaaaggattagcattcataagtgcaactgattcttatccaatgatgaaaaagcttcaatcaattagaaaatcgattgcaacacctacaatttttaacttgattggaccattaattaatcctttcaaattaacttatcaagtgatgggggtatatgaagcttcacaacttgaaaatatagcacaaacattaaaggatttaggtagaaaacgagcaattttaattcatggtgcaaatgggatggatgaggccacgctttctggtgaaaatatcatttatgaagttagcagcgaaagagcattaaaaaaatatagtttaaaagcagaagaagtcggtttagcttatgcaaataatgacacgttgataggtggttcacctcaaacaaataaacaaattgcattgaatatcctaagtggcacggatcactcaagtaaacgagatgtagttttgttaaatgctggaattgctttatatgttgctgagcaagtggaaagtatcaaacatggcgtagagagagcgaaatatctcattgatacaggtatggcaatgaaacaatatttaaaaatgggaggttaa

SEQ ID NO: 2362 - DNA, 954 bp, Staphylococcus epidermidis
atttattatcacaatggatctctaaacgattcagagaggagtattaatatgtctacacattcaaatactgctaacaaaacattgattgataaagatgccgtagaaaaaaatatttcttctcgtgataggaaaaactcggtaaacaaatggttatttttattatgtacattaattgggctcattgttttagtagcactattaattcaaactttcgttaaaggggcgggacatctaactcccgaatttttcactaatttttcatcttcaacaccagcagatgctggtattaaaggggctttagtaggttctatttggttaatcttaagtattattccaattagtatcattttaggaataggtacagcaatttatttagaagaatacgcaagagacaatatttttacacaaatcgtaaaggtgagtatatctaatttagctggtgttccttcaattgttttcggtttactaggttatacattatttgtaggcgcggcaggtttaggtaatagcgtgctagccgctgcgcttacaatgtcactactaatcttgcctgttattatcgttgctagtcaggaagctatcagagcagttcctagttcagtcagagaagcatcatatggtcttggtgctaataaatggcaaacaattagaagagttgttttacctgcagcattacctggtattttaacaggtttcattttatctttatcacgcgcattaggagaaacagcaccacttgtaatgataggtatacctacgatacttttagcaacaccaagtggattactcgaccaattctctgcgttaccaactcaaatttatacatgggcaaaaatgcctcaagcagaattccaaaacgttgcatcagcaggtattatcgttctactcgttatcttattattgatgaacactgtagcgatacttcttcgtaataaatttagtaaaaaattctaa

SEQ ID NO: 2363 - DNA, 972 bp, Staphylococcus epidermidis
acacaattgcagatttactttcattacttatcgatcctaaacaacgttatgctattactcagaaagaaacatcaaagtttaaatggtttaattcacatagaaaagaaggtcgtaacgatgaagtttaagttgtcaaagaaaaacactatatttttcatttttacggtctatattatatgtcttattgtattgcaatttataatcaatgatgaagctgcgtatcaggtacatttgtcaaactcatttgaacctatgagtatgaatcatttacttggcacagatgattacggacgtgatttattcagtcgtttagtcgtgggctctcgtgcaacattgtttgttacactacttactttacttttcactgtagtggttggagtacctttagggttacttgcaggctataaaaaaggttggattgatacgattatcatgcgaattattgatataggattaagcataccagaattcgttattatgattgccttagcaagtttttttcatcctagtctttggaatttagtaatagctattacaatcataaaatggatgaattatactcgcgtgacaagagggattgtcaataccgaaatgaatcaatcgtatatacagatggcacaattttttaatgtctcaactttgaatatcttatttaaacacttattaccaaaagttttaccatctatatttgttattatgatagttgattttggaaaaatcattttatacattagttcattatcatttttaggtttaggtgcacaaccaccatctccagagtggggggcaatgttacaagcagggcgtgaatttattacttcacatcctatcatgattatcgctccagcatctttgatatcaggtacaatattgatatttaatttaactggtgatgctgtaagagatcgtttattagaacaaagaggtgtaaaagttgaaacttttaacaataaaaaatctaaacatcaatga

SEQ ID NO: 2364 - DNA, 1266 bp, Staphylococcus epidermidis
atggtagttaattataatgataatggcgaactgacaatgggaggtacaagcttaaaaactattgcacaaagttttggtacaccttcgattgtttacgatgaagaccaaattcgtaatcagataagaagatatcataaagcatttgaagcaagtggtttaagctacaatatatcttatgcctcaaaagctttcacttgtattcagatggttaaattaattgatgaagaaaatttacaattagatgttgtttctgaaggtgaactttatactgctcttgaagcaggatttgattcgaaacgtattcacttccatgggaacaacaagacgaaacgcgagattcaatatgcattagataatcagattggttattttgtagtggatacgctcgaggaaatagagcttattgataaatatgctgatagtaatgtagatgttgtattacgtgtaaatcctggggttgaagcccatacacatgaatttattcaaactggacaggaagatagtaaatttggattatcaatcaaacacggtctagcattaaatgcagttaataaagtaaaagcaacgaaacatttgcaacttaaaggtatacatttccatattggctctcaaatcgaaggcactgagccgatgattaagacagctaaaattgtgcttaattggttagcaagtgaacgaattgaagtgagtttactaaacataggcggtggtttcggaattaaatatgtcgaaggagatgaaagtttccctattgagcaaggaatatctgaaattactgaagctattaaagaaactgcgcaagcattgcagtacaatattcctgaaattgggatagaacctgcccgttcaattgttggagaagcaggtatcactttatatgaggttggtacaattaaagatatccctggagttaataaatatgtatcagttgatggcggaatgagtgatcacatacgaactgcactttatggtgcacagtatgaggcgttgttagttaacagaaatgaaaaagctaatgaatctgtaacaattgcaggtaaactctgtgaatctggtgatattatcgtacgagatgccccattaccctcttctgttcatagaggtgattacctagcaatactttctactggtgcgtatcattattcaatggcttcaaattataatcaaatgcaaaaacctccagtatttttcttgaaagatggaaaagcacgtgaagtgattaaacgtcaatcattgagacagttaattattaatgatacgaaataa

SEQ ID NO: 2365 - DNA, 1167 bp, Staphylococcus epidermidis
gggatggataattttatgaacgagttagaattcgttacattgcacagaagacatttacatcagtatccagaattaagtttacatgaatttgaaacgacatcgtatataacatcatttttagaggatttaggcgtaccttacgaccgaccacttaaaactggtgttattgcttatttggaaggtaatagtcaccacactattgcattcagagcagatatagacgcgttaccaatttatgaagaaaatgatattgattttaaaagtaagaatgataatgtcatgcacgcgtgtggtcatgatggtcatacgacagcacttatgctttttgttaaaaggtgtaaagcattgtatgacaaatctgaattacctcataatgtagtgtttatatttcaacctgccgaagaaaccggtggaggagctaatcgtttaatcaaagctggcgcttttgacaagtaccctattgaagcggtgtttggttttcacgttaatccgtttgaaaaagaaggtaaaattgtaattcgagatgaagaaatcactgcaagtgccactgaatatcgcttctttttaaaaggattatctagtcatgttgctgataaggagcaaggtcattcatgtggtgaggggttacagcatgtcttaagtcaaatcggccaaatccaacaatttcatttgaatggattgaaacgtaacattattcatatgggtcattttgaagctggtgaagctattaatacagtaccgagtcatggttatcttgaaggtacaattcgtacatatgacacagaagatttagctattgtaaaacaccaaatgcataaaattgcgaaaagtgttcaattattatttaatgttgaatgtgaggttaaatttgaagaaggatatccaccaacaatgaatcatccacaattacgtcaagccgttgagaacgctataaaaggtgcaaatttagaaatagttgaaaaaaaactacccttcctgttcggtgaagattttagtttttatggtcaacaacttgccccttcatattttgtatttgttggtacacaaaacaatgaaaaaggttttgtgactggtcttcatactgcccatcttaattttgatgagaaaatattaattgacgttgtaaattattacgagcatttgttaagaaattataaagaggtgtaa

SEQ ID NO: 2366 - DNA, 1287 bp, Staphylococcus epidermidis
tgtttttgtaagggaggatcagttatgtatgattacaatttattagaagatagggatgtactctgcatagaccaaaaaagcttttttgcgagtgtatcatgtatggaaaaaggattggacccattaacaactaaactagcagttgtagcagatacgaaaaggcaaggttcggtcgttctagcagcaactccaaagttaaaagaattaggtattaaaacgggatcaagactttttgagataccacatcgtaatgacatttatattattaatccaagtatgagaaagtatttaaatgtatctgttgcaatttcaaagattgcactgcggtacgttccacctgaagatttacatcagtatagtattgatgaatttttcatggatgtaacggatagttaccatagatttaattcaacagtttttgctttttgtaaaagatttcaaaatgaaatattagaagaaacaggtattcactgtaccattggaataggctcgaatatgctattgagcaaggttgcaatggatattgaagctaagcattcggaaaacggtatagctgaatggcgttatcaagatgtacctgaaaaattatggccaattcaaccacttagagatttttgggggattaataagcgtacagaaaagaaattgaataaaagaggaatatttacaataggagatttagcaaagtatccatatcattatttaaaaagagattttggagttttaggtatagatatgcatctacatgcaaacggtattgatcaaagtaaagtaagagaaaaatataaagtaacaaatccttcaatatgtaaaagtcagattctaatgcgagattatcaatttgaagaatccaaagttgtcatgcaagaattgatagaagatgtagcaagtcgtttaagagcagaaaagaagcttgctcgaacaattcatttttctttcggttatgctgaaggtggtggcatacataagcaatatactttggaggatcctacaaatttagaaagagatatattcaaagtcattaattattttgcaaatcgtctgtgtgacaaaaaagcattgtatagaacgttaagtgtatcgttaactcagtttattaaagaaagcgatcgacaactcaacttattcattgatgaatatgaacgtaagaaagatgtaaaacttgctaaaaccattgatcacttacatttaaaatatggaaaaggaattgtgtcaaaagcgacttcatacaccgaagctggtacaaagcatggtcgattaggactaatggctggtcataaaatgtag

SEQ ID NO: 2367 - DNA, 1002 bp, Staphylococcus epidermidis
ttctattgtaaggggttaaaaaagatgaaaatttttgattatgaagatatacaattaattcccaataaatgtattgttgaaagcagatctgagtgtaatacttcggttaaatttgggcctcgtacttttaaattgccagttgttccagcaaatatgcaaacagtcatgaatgaagaacttgcacaatggtttgcagaaaacgattatttttatatcatgcatagatttaatgaagaaaatagaattccatttataaaaaaaatgcatcatgcagggttatttgcttctatttctgttggagttaaagaaaacgaatttaattttattgaaaaattagcttcttcatcgctcataccagaatatataacaattgatattgctcatggtcactcaaattcagttataaatatgattaagcatataaaaaaacatttaccaaatagttttgtgatagctggtaatgttgggacgcctgaaggagtaagagaacttgagaatgccggtgcagatgctacaaaagtaggtattggtccaggaagagtatgtattactaaaattaaaactggatttggtacaggaggttggcaactttctgcgttaaatctttgtaataaggcagctagaaaacctattattgcagatggagggttaagaacccacggtgatatagccaaatcaattcgttttggtgccactatggtaatgattggctctttatttgctgcccacgaggaatcaccgggtgaaaccgtcgagctagatggcaaaaaatataaagaatattttggtagtgcctcagaatatcaaaaaggtgaacataagaacgttgaaggtaaaaaaatgtttgtagaacacaaaggatctcttaaagatacccttactgaaatggaacaagatttacagagttcaatttcatatgcaggaggaaaggacttgaagtcattaagaacagttgattacgtcatagtaagaaattcaatctttaatggtgatagagattag

SEQ ID NO: 2368 - DNA, 516 bp, Staphylococcus epidermidis
atgaatatcaatactgcatactttgctggtggctgtttttggtgtatgactaaaccttttgatacattcgatggtatcgaaaaagtcacgtcgggatatatgggaggacacttagttaatccttcttatgaagaagtaaaaactggatctactgggcattatgaagtggttaaaattgagtatgatgttgctctattttcatatcataaattattagaaattttcttttcagttatcgatcctttggatgatggtggtcaatttcaagatagaggttctcaatataagactgctattttctattcaaatgaacatcaaagacagttagcagaacaatatatatgtgaactccaagatagttttaacgctgataaagcaattgcaacaaaaattttaccggcatcaactttttatgaagcggaagcataccatcaagatttctacaaaaagaaccctgaacgttatgaacaagaacaacaagatcgtgctagttatgtcaaaaataatcatatgtaa

SEQ ID NO: 2369 - DNA, 378 bp, Staphylococcus epidermidis
ataataaccaaggtggaggcccacattattatcctaataatcaaggtatatatgagtcacagcctgaacacaagaaacccaccattcccgacagatggtgatggttatgaatataattatcgccaggatgatgacaattactttgaacagccaggtaaattattcagattacagtctgaagatgcaaaagagcgtatcttcacaaatacagctaatgcaatggatggggtttctaaagatgtcaaagttcgccacattcgccattgctataaagctgatccagaatatgggaaaggtgtagcaaaagctttaggtattgatatcaatcaaatagatttagagacaaatcaagacgaaacatatgaaaactttaaataa

SEQ ID NO: 2370 - DNA, 318 bp, Staphylococcus epidermidis
gtattattaaaactaacagaatatttgttaattattatgatagcaataataaaatttaatgcattaagaaagaggtttcaaatgagtaaagaaaatttaaatattgatagaataaatgaattagccagaaaaaagaaagaacatggcttaaccaatgaagaggctaaagaacagactaaattaagaagacagtatttagaagaatttagaaaagggtttaagcaacagatagaaaatactaaggtcattgaccctgaaggaaatgatgtgacacctgaaaagttaaaaaagatacaagaagagaaacacaataaataa

SEQ ID NO: 2371 - DNA, 2745 bp, Staphylococcus epidermidis
cggcatataaatatatataaatatcaagggggatataaaatggcttctaatattaaagaacaagcaaagaaacaattcgaattaaatggccaatcatatacttactatgacttacaaacattagaagaaaaagggctagctaaaatttctaaattaccatactcaattcgcgtattgttagaatctgtgttacgacaagaggatgattttgttataacagatgatcatatcaaagcattaagtaaattcggaaatgcaggtaacgaaggtgaagttccattcaaaccttctagagttattttacaagactttacaggtgtgccagcagtagtagatttggcttctttacgtaaagctatgaatgatgttggtggggatattaataaaatcaacccagaagtacctgtggatttagttatcgaccattcagttcaagttgatagttacgctaatccagaagcattagaacgtaatatgaaattagaatttgaacgtaactatgaacgttatcaatttttaaactgggcaacaaaagcttttgataactataatgcagtacctcctgctacaggtattgtccatcaagtaaacttagagtatttagcaaatgtagtacatgtaagagatgttgatggtgaaaaaacagcatttcctgacactttagtaggtactgattcacatactacaatgattaatggtattggtgttctaggttggggcgttggtggtatcgaagccgaagcaggtatgttaggacaaccatcatatttcccaattcctgaagttatcggagtgcgtttaactcactctttaccacaaggctcaacagctacggatttagctttacgtgtgactgaagaattacgtaaaaaaggtgtagttggaaaatttgttgaattcttcggtccaggtgttcaacatttaccattagcagacagagctacaattgctaacatggctccagaatatggtgcaacgtgtggtttcttcccagtagatgaagaatcattgaaatatatgaaacttacaggccgtgacgaagaacatattgaattggttaaagaatatttacaacaaaaccatatgttctttgatgtagaaaaagaggatcctgaatatacagatgttattgatttagacttatctacagtagaggcatcactttctggtccaaagcgtccacaagacttaattttcttaagtgatatgaaaaaagaatttgaaaaatcagtaactgctcctgctggtaatcaaggacatggacttgatcaaagtgaatttgataaaaaagcagaaattaattttaatgatggatctaaagcaacaatgaaaacaggagatatagcaattgctgctattacctcatgtactaacacttctaatccatatgttatgttaggtgctggtttagttgctaaaaaagctgtagaaaaaggattgaaagtaccagagtttgttaagacgtcacttgctccaggttcaaaagttgttacaggatatttaagagattctggattacaacagtatttagatgatttaggtttcaatcttgttggttatggttgtactacatgtattggtaactcagggccactattaattgaaattgaaaaggcagttgcggatgaagatttattagtaacttcagttttatcaggtaatcgtaattttgaggggcgaatccatccattagtgaaagcaaactatttagcctcaccacaacttgttgtagcttatgcgcttgctggtacagtagatattgatttacaaaatgaaccaattggtaaaggtaaagatggtaaagatgtatatttacaagacatttggccttcaatacaagaagtttctgatactgtagataaagttgttacacctgaactattcttagaagaatataaaaatgtatatcataacaatgaaatgtggaatgaaatagatgtaaccgatgaaccattatatgatttcgatcctaattcaacatatattcaaaatccaacatttttccaaggattatctaaagagccgggtaaaattgaaccacttaaaagtttgagagttatgggtaaatttggtgattctgttacaacagaccatatttctccagcaggtgctatcggtaaagatacaccagcaggaaaatacttattagatcatgatgttgcaattcgcaactttaactcttatggttcccgtcgcggtaaccacgaagttatggtacgtggtacatttgccaatattcgtatcaaaaaccaacttgctccaggtactgaaggcggatttacaacatattggcctaccggagaaataatgcctatatatgatgcagcaatgaaatataaagaagatggaactggcttagttgtcttagctggtaatgactatggaatgggatcttctcgtgactgggctgcaaaaggtaccaatttattaggagttaaaactgtcattgcacaaagctatgaacgtattcatcgctctaacttagttatgatgggtgtactaccgcttcaattccaacaaggagaatctgcagaagcactgggtcttgatggaaaagaagaaatatctgtagatattaatgaagatgtacagccacatgatcttgtaaatgtgactgcaaaaaaagaaaatggtgaaatcattaatttcaaagctattgtacgttttgattcactagtagaattagattattatcgtcatggtggtattttacaaatggtactaagaaataaacttgcgcagtaa

SEQ ID NO: 2372 - DNA, 1089 bp, Staphylococcus epidermidis
agaggtgtaaagcaattgacagcaatttggtcattagacacagaagcattttatcagaatgcagtaaaagtaaaaaataacgaaccaataatggcagttgtaaaaaacaatgcatatcattatggacttgagtttgcagtgaaaacatttttaaaagcggaaattaatacatttagcacaacttcattaaatgaagctatacgagttagaaaaatagcacctgaagcaactatatttttaatgaatcctgtttatgattttgatttagtaaaacgttatgatattcatatgacactcccctctttaaactattattataaatataaacaagatttaaaaggcattcatgtacatttagaatatgaaaatttattacatcgttccggttttagaaatatcgaagaaatacgtgaagttttaaaagatcatgatcaaaataatcaagataaaatgattatttcaggaatatggacgcattttgggtatgcagacgaatttgacgtagatgaatataaaatggaacgtgatgcttggttaaacttgataaatacacttttaaatgaaaattatcattttgatatgatacattcacaaaatagtgcaagttattttcgtgagaatcaaatgttacttcctcatcacactcatgctagagttggaattgccctttatggttcaagaccatatagtcttataaatgaagaacgcattactcaatctttgactgttaaaggtaatgttatacaagttcgtgatgtaaataaaggtgattattgtggatatagtttcgcctttgaagtaaagaatgaccacactcaattagctgttgttgatataggttatggcgatggtattctaaaatcaagagcaaaacacgaagctataattaatggcaagcgatatccaattagagcactaatgatgagtcatatgtttattgaagttgatgacgaagttcatgcacaagacgaagtcatattatataataaggatatacgtatagatgaatttacatttaaaggtgttggcgcaaattcagaacaattaagcgcaatgaatcacgattctcttatgaaggagtatttataa

SEQ ID NO: 2373 - DNA, 1272 bp, Staphylococcus epidermidis
ttaattatgaattcttcttcacaagagaagaaaaataaaaagttttcttcggttttcatctatagttcaattattgcagctatagtagtgattatcggtgctgtttggcctgagaaattcgatagcgttactaatacggctaagatgtggattactaataatttgggttggtattaccttattttaacaacagtaattgtattcttctgtgttttcttgattttcagtccaattgggaaacttaaattaggtaaacctaatgacaaaccagaatttaatacaatttcttggttcgcaatgctattcagtgctggtatgggtattggtttagtattctatggtgcagctgaacctatggcacattttgctgctccaccaacagctgatcctgaaacgacaaaggcctacactgagtctttaagatctacatttttccattggggattccatgcttgggcaatttatggcgtggtagctttagcacttgcttattctcaattccgtaaaggtgaacctggattaatttctagaaccttacgtccattattgggagataaagttgaaggaccaataggtactcttattgatgtactttctgtttttgctacattagttggtgtagctgtgtctctaggtatgggcgcacttcaaattaatggtggcttgcattatttatttggtgtgccgaacaacacttttgttcaaggtattattattgttgtcgtaacaattttatttattgctagtgcttggtcaggtttaagcaagggaattcaatatttaagtaatttaaatataggtcttggtacgatattaatgattgtaaccttaattgttggaccaactgttttaatcttaaatatgatgacaagttctacgggtagcttattaaattcattcttatttaacagttttgatactgctgcgttaaacggtcaaaagcgtgattggatgtcaacttggacattatactattggggttggtggctaagttggagtccattcgttggtgtattcatcgcacgtgtatctaaaggacgttctataagagaatttatttcaggtgttttattagtaccggcacttgttagctttatatggttcagtgttttcggcgtattaggcattgaagctggtaaaaaagattcgggtctctttaaaatgtcacctgaaacacagttatttggtgtattcaaccatattccgttaggtattgttttatctatcattgcattattgcttatcgcttctttgctttgttacttcagctga

SEQ ID NO: 2374 - DNA, 771 bp, Staphylococcus epidermidis
ctaataatgaattttatttttgatattgatggtacgatttgttttgatggatgttccatcgattcatctattaagcaacgacttttcaagctacgtcaagctaatcacaatgtaatatttgcttcagcacgtcccattagagacttgcttccagtcattcctgaatttgcggatgataccttgattggtggtaatggctcaattatctctaaaaatggacaaatcgaaattgtttcggtaatcaatgagcatgatatcagtctaattaaaaaaattataaagaaatatcaattatcatacatcattgatgataaatttaattatgcttcaaatttggatagtaataatgaactgtatcaacgcattgatcctgatggtaaagcacaatctctagatatggatgagattcgaaatcctataaaagcaattctattaaatatagataacaaagattttgacatgattgctcatcaattagtaagtcagtctcatggtattgaattaattcgtcattacagtgagtcctatattgatgtaacggcacgtggcgttgataagtatactactattcaatatattttaggaactaatagtgattatatcgcttttggtaatgatcacaatgatgttcatatgcttgaacatgcgagccaaggttattttgtgactaatcaatttatagaacacacatcattttttaaaaataaaaatattacagttattgatgacacaatatatgcaatatgtgaggttttagatcgatatctgtaa

SEQ ID NO: 2375 - DNA, 729 bp, Staphylococcus epidermidis
acaataatgaacatactattaattggatatggtgcaatgaatcaaagagttgcacgattagctgaagataaaggtcatgaaattgttggagttatagatagaacttcaaaagcgtcgacaccttattcacaatatcaacacattagtgaatgtaaagaagctgatgttgctattgacttttcaaatcctgaattgctctttcctctattagaagaacaattcaatttgcctcttgtcatagcaactacaggtgaaaaagaaacgttaatacaaaaattggaaacgctaagtcaaagaacacctgtattttttagtgcaaatatgagttacggtgtccatgcattaactaaaatattagaaactgcagttcccctactacaagatttcgatatcgaactaacagaagcgcatcataataaaaaagtcgatgctcctagtggcacattagttaaattgtatgatgtcattaaagaattacgtgacaatgtctcacctgtttatgatagacacgaaaaaactgagaagagaactcatgatgagataggtatacatgctgttcgtggtggtacgattgtcggggaacatgacatattatttgcaggtactgatgaaacaattactatctcacataaagcacaatcaaaagatatctttgcaaatggtgccattggcgctgcagaaaaattaattcacaaaaacccaggtttttatacttttaataatctataa

SEQ ID NO: 2376 - DNA, 1233 bp, Staphylococcus epidermidis
ggcgtggtgaatttaatgaaaaatgaaaaagaaataaatggaaaaaaaagccatttttttagtttgtcagagtctagatttatgaggtttttaggcggaaatgaccttatttatgctttaattgcattggttcttttaggtattgtcatttttatctttgataaaatttcatatgtctttcaaccatttattattgtatttaatacaatagcagcacctattattgtttcattagtgctattttatttattcaatcctattgtaaatatgatggagagatatcgtattccaagactattaggtataacaattatttatgttgcaattgttggtattattacattaatagttaatttacttattccaattattggatcacagatagaaagttttatcaaaaatacacctaattatttacataaaattacgcgttcacttgataaacttaataataataccattttatctggttacatgggacaagtgaacgaatggttagaatctgctcagaaaaagataccatctatggtttcagattactcagacggatttggatctaaactcgcaacttttgctgaggcagtcgcaaatatcggtattgttattgggactacaccttttgtgttattctttatgttaaaagatggtcataaatttaaagattatactacaaaaattatgccacctaaatttagaaaagattttcatgacttgttagaaaagatgagtgtacaagttggttcatacattcaaggtcaaattattgtgtcattttgtattggattattactatttattggctattcaattattggtcttaagtacgccttagttttagcaagtattgctgcagtaactagtgtggttccttatttaggaccgacaatagcaatatcacctgcgattgttatcgcgattattacttcacctttaatgttattaaagttagctgttgtatggacgcttgtccaattctttgaaggccactttatctctcctaacgttatggggaaaacattgaaaattcatcctttaacaattattttcattttattatgtgcaggaaatttaatgggcattgttggtgtgattattggtattcctctatacgctgtacttaaggtattggtttcacacatatttatgttatttaaacgaagatacaatcgctactatggaaatgatgctggtgagtacattatcactgaagaagaaaaaggaattaaacaataa

SEQ ID NO: 2377 - DNA, 273 bp, Staphylococcus epidermidis
tatatggcgaagaaatctaaaatagcaaaagaacaaaaaagacaagaattagtaaataaatattacgagttacgtaaagaattaaaagcaaaaggggactatgaagcattaagaaagttgccaagagattcatctccaactagattaactagaagatgtaaagtaactggtagacctagaggtgtgttacgtaaatttgaaatgtctagaattgcatttagagaacatgcgcataaaggtcaaattccaggtgtaaaaaaatctagttggtaa

SEQ ID NO: 2378 - DNA, 912 bp, Staphylococcus epidermidis
attaaggagaatagaatggcactagataaagatatagtaggttcaatagaatttttagaagtcgtaggattacaagggtcaacatatttacttaaagggccaaatggtgaaagtgtcaaactcaatcagtcagaagttgctgatgaagataattttgaattaggtgaggaatatagttttttcgtttatccaaaccgttcaggagatttatttgcgacgcaaaacatgcctgatattacaaaagataaatatgattttgctaaagttataaaaaccgatagagacggtgcacatattgacgtaggacttcctcgtgaagtcttagttccatgggaagatttaccgaaacttaaagaactttggcctaaagcaggtgattacttgctagttactttgagaatagacagtacgaatcaaatgtttggacgattagctagcgaaacgattgttgagtcaatgttcaccccagtaaatgacgatagcaaacaaaacgaatatatttctgcacgcgcttatagattactcagagtaggtagcttcttattaagtaatgagggttataaaatctttgttcacgaatctgaacgtaaacatgagcctcggttaggtgaggcagtagaggtccgaattataggtcataatgaaaaaggtgaattaaatggttcgtttttaccattagctcatgaacgccttgatgatgatggacaggtcatatttgatttacttgttgagtatgatggtgaattacctttttgggataaatctagtcctgatgcaatcaaagaagtctttaatatgagtaaaggctcgtttaaacgtgcaatcggacatttatataagaaaaagataatcaatatagaaacaggaaaaatcactcttaccaaaaaagggtggagccgtgtagatgattaa

SEQ ID NO: 2379 - DNA, 495 bp, Staphylococcus epidermidis
gttaaagttgaaagaaggattattccaatgatatacagtttgactgaaattgaagcaagatatcaagaaaccgataaaatgggggttatctatcacggtaactacgcaacatggtttgaagttgcgagaacagactatataagaaagcttggcttcagttatgcctctatggaagaacaaggtgttatttcaccagttgtagatttaaaagtgcaatataaaaaatcaatttactatcctgaaaaggtgacagtaaaaacatgggtggaaaaatattctagattacgttcaacttattgttataaggtttataatgaaaatggagagttagctactactggttcaacagaacttatctgtattaaagcagatacatttaaacccatacgcttggatagatattttcctgagtggcatgagacttatagtaaagttaaccagttaaataaagaaggtaaagatgctgaggttacgtttggcattaatcatttataa

SEQ ID NO: 2380 - DNA, 495 bp, Staphylococcus epidermidis
aatcgaagtgaaaacatgacacaagaattaaaaagtaaattactttctttttttaaatttattttcgccactgctttatttatctttgtaatttttacactctatagagaattatcacatatcaattttaaagagacattcatacagttcggcaaaattaatagattatggctcgtactactatttgctggtgggggactgtcactcatcttattatcactgtacgatattattttagtaaaggctcttaaacttaaaatgccgttgattagagtctttagagtgagttatattatcaacgcccttaattctataattggttttggagggtttataggtgcaggcgtaagagcttttgtgtataaaaattatactaatgacacgaaaaaacttgtacaatatatttttattattttagtatctatgcttacgggattaagtttattatccattttagttgtcctgcgtatatttaatgcttcttcacatgattga

SEQ ID NO: 2381 - DNA, 2415 bp, Staphylococcus epidermidis
ggaggaaacgaattgagtgagataattcaagatttgtcacttgaagatgttattggtgaccgatttggacgttatagtaaatatatcattcaagaacgtgcattacctgatgtacgtgatggtttaaaaccagtacaacgacgtatactattcgcaatgtattcaagtgggaatacgtatgataaaaatttccgtaaaagtgcgaaaactgtcggtgatgtaataggtcaatatcatcctcatggagactcttcagtatatgatgctatggtgcgcttaagtcaagattggaagttacgtcatgttctaattgaaatgcatggtaataatggtagtatcgataacgatcctccagctgctatgcgttacacagaagctaaacttagtcaattatcagaagaactattaagggatattaataaggaaacagtatcatttattccaaactatgatgacacaactttggaaccaatggtattaccagcgagattccctaatttattaattaatggatctacggggatttcttcaggatatgctactgatatcccgccgcataacctcgccgaagtaatacaaggcacattgaagtatatcgatcaacctgatattacaattaatcaactgatgaaatatatcaaagggcctgactttcctacaggtggtatcattcaaggaatagaaggtataaaaaaagcgtatgagaccggtaaaggaaaggttgtcgtgcgttcacgagtagatgaagagcctttaagaagtggacgtaaacaattaattgtgactgaaattccgtatgaagtgaataaaagtagtttagttaaaagaattgacgaattacgtgccgataaaaaggttgatggtattgtagaagttcgagatgagactgatagaactggattacgaattgcaatcgaattaaaaaaagatgctaatagcgaatcaatcaaaaactatttatataagaattcggatttacaaatttcatataattttaatatggttgctattagtgaaggtcgccctaagttgatgggattacgtgaaattatagaaagttatttaaatcatcaaattgaagtggttacaaatagaacgcgttatgacttagagcaagctgaaaaacgtatgcatattgtggaaggattaatgaaagctttatctatacttgatgaagttattgcattgatacgtaattctaaaaataaaaaagatgctaaagataatttagttgcagagtatgactttactgaagctcaagcagaagctattgtcatgttacagctgtatagattaacaaatactgacattgaagctttgaaaaaagaacatgaagagttagaagctttaataaaagaattaagaaatatcttagataatcatgaggcacttttagcagtaattaaagatgaactaaatgaaattaaaaagaaatttaaagtggatcgactatctacaatcgaagctgaaatttccgaaatcaaaattgataaagaagttatggtgcctagtgaagaagtgattttaagtttgacgcaacatggctatataaaacgtacatctacacgtagttttaacgcaagtggtgtgactgaaatcggtttgaaggacggcgaccgtttattaaaacatgaaagcgtgaatactcaagatactgttcttgtatttacaaataaaggtagatatttgtttatacctgttcataaattagccgatatccgttggaaagagcttggtcaacacatatcacaaattgtgccaatagatgaagatgaagaagtggtaaatgtatacaacgaaaaagattttaaaaatgaagccttttatattatggctacaaaaaacggcatgattaagaaaagtagtgcttcacaatttaaaactactcggtttaataaaccactcataaatatgaaggttaaagacaaagatgaacttattaatgtcgttcgattagagtctgatcagttaattactgttctaacccataaaggcatgtcattaacttattcaactaatgaattatcggatacaggcttaagagcagctggtgttaaatcaattaatcttaaagatgaagactatgttgttatgacagaagatgtgaacgactcagattccataataatggttacacaacgtggtgctatgaagcgtattgattttaatgttcttcaagaagctaaacgcgcacaacgtggaattactttactaaaagaattaaagaaaaaaccgcatcgaattgtggcaggtgcagtagttaaagaaaatcacacgaaatatattgtattctctcaacatcatgaagaatatggtaatatcgatgatgtacacttatctgaacaatatactaatggatcatttattattgatactgatgattttggagaagtagaaagtatgattctagagtaa

SEQ ID NO: 2382 - DNA, 2028 bp, Staphylococcus epidermidis
ttaaaaatagatattaattgtagaagggaagacacaacgatgtttaatgaaaaagatcaattagctatagatacgatacgtgctttaagcattgatgcaatcgaaaaagcaaattcaggacaccctggattacctatgggagcagcacctatggcgtatactttatggacgcgccaccttaattttaaccctcaatctaaagatttttttaatagagatagatttattctatcagcaggtcatggttcggctttattgtatagcttattacatgtctctggtagtttagaacttgaagaacttaaacaatttacacaatggggttcgaagacgcctggacatccagaatatatacatactgatggcgtacaagttactactggtccattaggtcaaggttttgccatgtctgtacggatggcgttagcagaaagtcatttagcaggtaaatttaataaggaccaatttgatatagttaatcattacacttatgtattagcgtcagatggtgacttaatggaaggtatctcacatgaagctgcatcttttgcaggtcataatcagttagataaattaattgtcctttatgattcaaatgatatatctttagatggagatttatataaatcattttctgaagatacaaaacagcgtttcgaagcctatggttggaactatattctagttgaaaatggtaacgatttagatgagattgataatgcaatcactcaagctaaatcacaacaaggacctactattatcgaagttaaaactattatcggttttggttctcctaataaagctggttcaaatggagttcatggtgccccacttggtgaagaagaacgtgcacttacatttaaagaatatggattagatcctgaaaaacgttttaatgttcctgaagatgtatacgaaatatttaaatcaacaatgttaaaacgtgcaaatgaaaatgaagaggcttggaataatatgcttaaaaattatagtgaagcctatccggaattagctgaagaatttaaattagcaatgagtggtaagttaccaaataattacgctgatgccttaccagaatatgatttaaatcacagtggtgcttctagagctgattcaggagaaataattcaaaaattaagcgagtttgtaccttcattctttggtggatcagcagacttagcaggttcaaataaatctaacgttaaagaagctaaagattataataaagatactccagaaggtaaaaacgtatggtttggtgtacgtgaatttgcaatgggagcagcaataaacggcatggcagcacatggtggacttcatccatatgcagcaacattctttgtattcagtgattacctaaaaccagctttacgattatcatcaatcatgggactcaattcaacgttcatctttactcatgattcaattgctgtaggtgaagatggccctacacacgaacctattgaacaattagcaggtcttcgtgctattcctaacatgaatgttattcgtccagctgatggtaatgaaacacgtgtagcttgggaagttgcacttgaatcagaacacacaccaacatcattagtgttaactcgtcaaaatttaccaactttggatgttgataaacaaacagttgaaaatggtgtgagaaaaggcgcatatattgtttttgaaacagaacaacaacttgaatatttattattggcatctggatcagaagttaatttagctgtagaagccgcaaaagaattagagcaacaaggtaaaggtgtacgagttatttctatgccaaactggtacgcatttgaacaacaatcttctgaatataaagaatcaattttaccttctgatgttactaaacgtatagctatcgaaatggcatcaccacttggttggcataaatatgttggaattgaaggtaaagtcattggtataaatagttttggcgctagtgctcctggagatttagtagttgaaaagtatggattcactaaagaaaatattttaaaacaagtccgttcattataa

SEQ ID NO: 2383 - DNA, 699 bp, Staphylococcus epidermidis
tgtcagatagaggtatgcccaaaaggattccgaaatatgcatggattcggttctcataagtattctatgtataatgataaaggtgaacgtgtatgggtaaaatatcatttccgtacacaacaaggaattgaaaactatactgacgaggaagcagctaaaattgtaggtatggatagagattcttcacagagggatttatataatgctatcgaaaatggagattatccaaaatggaaaatgtacattcaagttatgacagaggaacaagctaaaaatcatccagacaatccttttgatttaacaaaggtatggtataaaaaagactatccactgattgaagtgggagaatttgaattgaatcgtaatcctgagaattattttcttgatgtagagcaggcagcgtttacgcctacaaatattgttcctgggttagattattcaccagataaaatgctacaaggacgtttattctcatatggagatgcccaacgttatcgtttaggagttaatcattggcagattcctgtcaatcaacctaagggagttggagttgagaacttatgtccatttagtcgtgatggacaaatgcgtttcttagataataaccaaggtggaggcccacattattatcctaataatcaaggtatatatgagtcacagcctgaacacaagaaacccaccattcccgacagatggtga

SEQ ID NO: 2384 - DNA, 900 bp, Staphylococcus epidermidis
aaggagcaagataatatgacacacatgtttgaaggcgttggtgtagcattagcgactccctttaccaataatgaggttgatttcaacgcattagaaagacatgttcaatttcttttaaataacaatattcaagcaattatagtgaatggcactacagcagaaagtcctacattaagtgacgaagaaaaagagaaagtattggcgacagtagttaaactcgtgaatcatagcgttcctgttattgcgggtactggcactaataatacgtataaatcaattcaagcttcaatacgtgctaaagaaattggtgcagatgcagtcatgttgattacgccctactacaacaaaacgaatcaacgtggtttaattcaacattttgagacaatcgcaaatgaagtgaaattaccagtaattctttacaatgtgccatcacgaacaaatatgacgatagaaccagaaacagttggaattctcagtcataatccatatatcgttgctttaaaagatgcgacaaatgattttgattattttgatcaagtaaaacaacgtattaatacaaatgaatttgcattatatagtgggaatgacgacaatgttgtgaagttctatcaacgtggaggtaatggtgtcatctctgtaattgcgaatgtaattccacaagaatttcaatatttatatgaccaaagacaaaatgaaaccgatattactaattactttaaacctatcgagaaattgttagaagcgttgtcacttgacgttaacccaatacctattaaagttcttaccgcatatttgggttatggtcactacgaagtgagattaccattagtgcctttagaagaagcacaatgtaaacaagttgaacgagcatttgaacaatttaaagcaggtgaacaataa

SEQ ID NO: 2385 - DNA, 780 bp, Staphylococcus epidermidis
aagttgaaacttttaacaataaaaaatctaaacatcaatgataaagaagggcaagcaattattaaaaatgtcgacttaaatatatataatcaatctctaaatgtcattataggtgaaagtggtgctggaaaaagtttgactgttaaagcaatattaaatcatttacctactcagttacatatgagtttcgatgaatttaaaatgcaaggtcaaaatacttctggtatcaagcaacttttaggtaaacatatcggctatatctctcaaaattatgctcaaagttttaatgaatatactcgtttggataaacaacttatagctatatatcgttatcattttaatgtttctaaggataatgcattgaaaaagataaaaaaagctttaacttgggttaacttaaatgatgaatcaatcattaataaatatagtttccaactttcaggaggacaattagagcgagttaatattgctagcgttttaatgttagatccagaattaattattgcagatgaacctgttgcatctttagatgtagtgaacggtcatcaaataatgcaactccttcaacacattgttaaagatcatcataatactgtattacttatcactcataacatgaatcatgtcctcaaatatgctgattattttaatgtaatgagaaatggcatgatgattgaatctggagaaatagacaaattatttaatcaccatcatcttcatcggtatacagaacaattattaaactatagaagcaagctgcaaaaggaggacaacatctaa

SEQ ID NO: 2386 - DNA, 204 bp, Staphylococcus epidermidis
aaaaatatttttatcaaaattcttcattcatattttttattctcaagatggaatgatatattcaaaatgaatcatggtccaatctattatttacatatgattatttttgacataactagcacgatcttgttgttcttgttcataacgttcagggttctttttgtagaaatcttgatggtatgcttccgcttcataaaaagttga

SEQ ID NO: 2387 - DNA, 588 bp, Staphylococcus epidermidis
aagtttattggaggtaactccatgatattaataatagataactatgattcttttacctacaatcttgtagatattgtagaaaaacaatgtgaaacgattgttaaatatcccgatgatacagatatatgtaatctgaaaggtattacagcagttattatttcaccaggacctggacatccattagacaatcaattattaattaaattaattgaaaatttcgaaaatttacctattttaggtgtttgcttaggtgcacaagcgctcacttgttattacggtggcgatgttatacaaggtagttgtgtcaaacatggaaaagtagatactttaactattgttaatcagtcaccactatacaaaggaattaagtcaagtttcaaagttatgcgttatcattcattaattagtgatccatgctcatttccagaaagtttattaatcactggccaaacatatgatagtatacaatctttccaacacaaaaacagaaaacattatggcatacagtttcatccagagtcattcgctacagaaaatgggaaacaaatcattattaattttataaatatagcaacgagaggaagttga

SEQ ID NO: 2388 - DNA, 1275 bp, Staphylococcus epidermidis
aacaagttcggcattccgaacttgttcttttttatactgtgtatgtctcctctaattataggaggactgaaattgaatagaagtgttttaaaatttggcggttcttccgtcagtgattttaaaaaaataaaaaatatcgctgaaatgcttaaaacacgcattgaagatggtgaagaattaatcgttgttgtcagtgctatgggtaagacaactgatcaattgatgaataatgtatcaagtcttacttctacccctaaagatcaagaacttgcattgctattaacaacgggtgaacaacaaacggtttcttacctttctatggtactcaatgatataggtgtaaatgctaaagcgatgacaggttatcaagctggcattaagactgtaggacatcacttaaaaagtaaaatagcagaaattaatcctaatatttttaatgaggcttttaaaaatcatgacattttagttgtagctgggtttcaaggtataaatgaagatttcgaacttactacacttggacgaggtggttctgatacaacagctgtagctttagcagcaagtaatcagacaccttgtgaaatttacactgacgttgatggtgtgtatgcaacagatcctagaatacataatgaagcgaagcgtttagaatatgtctcttatgaggaaatgatggaaatgagcgcgcttggtgcaggtgtacttgaaacgagaagtgttgaattagctaagaattatgatattccactttacttaggaagaacgttatcaaatgtgaaaggaacatggattatgtctaaaagtgatttattagagaaaaaagcagtaactggtgtcgcattggatacacacatgatgcacgtcacgataagttatcccctaccggataatcagttactgacacaattgtttaccgcattggaagaagaatctgtaaatgttgatatgatttctcaaattgtaaatttagaaggtttacaattatctttttcaattaaagatagtgatgcacatcaaatttcttcaattctggaaaatttatcaacacacttttcagcacttgattataaaattaatgaagcatatgtcaaaatatctttaattggatcaggtatgagagatatgtcaggagtagcatcaaaagcttttacgacacttatcaattcagatattccattttatcaaacgacgacatcggaaattagcatttcttatgtaatagacgaagaaaatggtgaaaaagcagtagaagaattgtatcatgccttcgaaatttag

SEQ ID NO: 2389 - DNA, 1812 bp, Staphylococcus epidermidis
atgagtgaaggtttacctttgagagaagaagttccggtaaaagaaacttgggatttgaaagatttatttacaagtgatcaagcattctatcaaacattggaacaagtagtacaaatgtctttagattttaatcatacatattatcagaaacttaataacatagaaacaatagaaaaggcattagatgaatatgaaaggatacttatagaaatagatcgtttatataattatccagaacttagattaagcgttgatacgtctaatgaagaagcacaaaaagttaacgcaaaacttaatacgacttctggaaaacttgctggtttattatcttttgttgattccgagattttggagttacccgatgagataataagcgaattgaggtctcaaacaaaataccctcattttattaaacaacttcaagatcgtaagccttatcaattatctgctgatgttgaaaaagtattagctacattaacaccaacattgagaagtccgtttgaattgtatggtactacaaagagtttggatattaattttgaatcgtttgattatgagggtgttacctatccattggattatgcaacatttgaaaatgaatatgaagatcatccatctcctgaatttagacgtaaaagttttagagcttttagtgatgcattacgacaatatcaacatacgacggccgcaacatataatatgcaagtccaacaagaaaagattgaagcggatttacgaggatatgattctgttattgattatctactacaagatcaagaagtaacaaaagatatgttcgatagacaaattgatgtcattatgagtgatttagccccagttatgcaaaagtatgcaaaaattattcaacgtgtacataacctggataaaatgcgatttgaggatttaaaaatttcaatagaccctaactttgaaccagaaatatcaattgaagaatcgaaaaaatacatttatggagcgctcaaagtacttggtgatgattatgtcaaaatgttagagtctgcctatgattaccgttggattgattttgctcagaataaaggaaaagatactggagcatattgtgcaagtccatacattacacattcatatgtatttatttcatggactgggaaaatggctgaaacattcgttcttgcgcatgaattaggacatgcaggtcattttacattagcgcagaatcatcaaaatttgttggaatctgaagcgtctatgtattttgtagaagcaccttccacaatgaatgaaatgttgatggcaaattacttatttaatagtagtaataatcctcgatttaaacgttgggttattggttcgattttatctcgaacttattatcataatatggttacccaccttttagaagcagcttatcaacgtgaagtgtatagccgagtcgacaatggagagtcattaactgccccactgctaaatgaaataatgttgaacacttataaagcatttttcggtgacactgttgaaatgacagatggggttgaattaacatggatgagacaaccacattattatatgggattgtactcatatacgtactctgctggattgacaattggtacagttgtatcacaatgtatcaagaaagaaggtcaacctgctgttgatcgctggttaaaaacgctacaagctggtggtagtcaatctccaattgaattggcgcaaatagctggcgttgatattacgactgacgcccctttaaaagagacaattaactatatttcaaatttagtagatgaattagaagtattaacatatcaaataaaagaaaattcataa

SEQ ID NO: 2390 - DNA, 900 bp, Staphylococcus epidermidis
aagaaaaagggccaattatctaaatcattagttaaaaaagcaattaaagctcaacaagcacgcgaggctgctcgtaaagctagagaagatgcacgctccggaaagaaaaataaacgtaaagatacattgttatcaggtaagttaactcctgcgcaaagtaaaaatactgataaaaacgagttatatctagttgagggtgattcagcgggaggttctgcaaaattgggacgcgaccgtaaattccaagctattttacctcttcgtggaaaggttattaatacagaaaaggcacgtttagaggatatttttaaaaatgaagaaattaatacgattattcatactattggtgctggtgttggtactgactttaaaattgaggatagtaattacaacagaattattatcatgacagatgctgatacggatggtgcacatattcaagtattattgcttacatttttctttaaatatatgaaaccacttgttcaagctgggcgtgtctttattgcgttaccgcctttatacaaattagaaaaaggcaaaggtaagaataaaaaagttgagtacgcttggactgatgaagaattagaaaatttacaaaagcaattaggaaaaggtttcatattacagcgttataaaggtcttggtgaaatgaatccagaacaattatgggaaactaccatgaatccagaaactcggacattaattagagttcaagttgaagatgaagttcgttcatcaaaacgtgtcactactttgatgggggataaggttgccccacgaagagagtggattgaaaaacacgttgaatttggtatgcaagaagatcaaagcattttggataataaagaagtccaaatactagagaatgaaaaatatattgaggaggaaacgaattga

SEQ ID NO: 2391 - DNA, 360 bp, Staphylococcus epidermidis
atattacttataggagcacgtgcaatgacaatatttgatatgccaaactatttgtggattaccattcttggtatgattttattaactgtattttacacacttgtattaaataaatggttccagtctgcaatcattacttttgtagttttagcagtacttgccttttttataccaaattttcaaaacatttcatatcaaccactgcttggatatgcaggattcttaggcataatgagcttaatcataagctttcttatttggtatttttctagaaactggagaaaaaatcgtagaaaaataaaattggaaaaagagattcgcaaatatgatgatgaagagtcacttcgtcgtcataaataa

SEQ ID NO: 2392 - DNA, 999 bp, Staphylococcus epidermidis
ctatttattatgacaagattagcagtagccggagcaaccggattagttggaacaaaaatgttagagacactagatcgaaaacaaataccttttgatgaattagtattattttcttctgctcgctcagcaggaaaaaaagttgaatttcaaggacaattgtatactgttcaagaattaactgatgaagcagcaagtgaacattttgattatgttttaatgagtgcaggaggtagcacaagtgagcactttgctccactatttgaagcggctggagccattgttattgataattctagccaatggagaatggctgaagatgtcgatttaattgttccagaagtgaatgagcctcaatttacacgtggtattattgctaatccaaattgctctacaattcaatcagttgtacctcttaaaattttacaagatgcatatggtttaaaacgtgtcgcttatacgacttatcaagccgtatcaggttctggtgttaaaggtaaaagagatttagctgaaggtgctaatggaaaagaacctgaagcatatccgtatccaatttacaataatgtattaccacatatagatgtttttcttgaaaatgggtatacaaaagaagaacaaaaaatgattgatgaaacgaaaaaaattctcaacgaccaagacttaaaagtgactgccacatgtgtacgtgtaccagtacaagatagtcacagtattgaaatcgatgtgactttaaatcaagacactacagttaaagagatacaagaattatttgcacaagatcaacgtgttgttcttgtagataatccaagtaaaaatgaatatccattagccattcattctactggcaaagatgaagtatttgtaggacgtatccgccgagatgactctcttgaaaatacgttccatgtatggtgtacctctgataatttgctcaagggcgcagcattaaatgcagttcaagtgttagaacaaattttaactttgaaaggagcaagataa

SEQ ID NO: 2393 - DNA, 1269 bp, Staphylococcus epidermidis
atgggagttatgaagatgaagtttacgaatttgacagctaaagaatttagtgactttactgatcgtatgacatatagtcattttacacaaatggaaggtaattacgaattaaaggttgctgaaggtaccgagtcacatttagttggaattaaaaataatgataacgaagtgattgcagcttgtttattaacagctgttcctgtaatgaaaatatttaaatatttttattccaatcgcggtccagtaatagattataataataaagagcttgtacattttttctttaatgaattgagtaaatatgtaaaaaaatataattgtttatatttaagagttgacccataccttccatatcaatatttaaatcatgagggagaaataactggaaatgcaggtcatgattggatttttgatgaattagagagtttaggatataaacacgaaggattccacaaaggatttgatcctgtattacaaatccgatatcattctgttctaaatttagcaaacaaaagtgctaatgatgttttaaaaaacatggatggtttaagaaagcgtaatactaaaaaagttaagaaaaatggagttaaagtccgctttttatctgaagaagagttacctatatttaggtcatttatggaggatacctctgaaactaaagattttgcagatagagaagatagtttttattacaacagattcaaacattataaagaccgtgttttagtaccactagcctatattaactttgatgagtatatagaggaactaaataatgaaagaaatgtgcttaataaagattataataaagctttaaaagacattgagaaacgtccagagaataaaaaagcacataacaaaaaggaaaatttagaacaacaactcgatgcaaatcagcaaaaaattaatgaagctaaaaacttaaaacaagaacatggcaatgaattacccatctctgctggcttctttataattaatccgtttgaagtagtttactacgctggtggaacttcaaatcgttatcgccattttgcagggagctatgcggttcaatggaagatgattaactatgcaattgaacatggtattaatcggtataatttctatggtattagtggtgactttagtgaagatgctgaagatgctggcgtagttaagtttaaaaagggctatgatgccgatgttatagaatacgttggtgactttattaaacctattaataaaccaatgtataacatttatagaacacttaaaaaactaaagaaatag

SEQ ID NO: 2394 - DNA, 792 bp, Staphylococcus epidermidis
gtaatgactattttaaatgaaattattgagtataaaaaaactttgcttgagcgtaaatactatgataaaaaacttgaaattttacaagataacggaaatgttaagaggagaaagctgattgattcacttaactatgatagaacattatcagttattgctgaaataaaatcgaaaagcccatctgtacctcaattaccgcaacgtgatcttgttcaacaagttaaagattatcaaaaatatggtgctaatgctatttcaatattaactgatgaaaaatactttggcggtagttttgaacgattaaatcagttatcaaagataacatcgttaccagttttatgtaaagattttattattgataaaattcaaatagatgttgcaaaacgagctggtgcatctattattttattaatagtaaatattttaagtgatgaccaattaaaagaattgtattcatatgcaacaaaccataatttagaagctctagtagaagttcatacaattagagaacttgaacgtgcacaccaaattaaccctaaaattattggtgttaataatcgtgatttaaaacgatttgaaaccgatgttctacatacaaataaattacttaagtttaaaaagtctaattgctgctacatttcagagagtggcattcatacaaaagaagatgttgagaaaatagtagattcaagtattgacggtttacttgtaggggaggcattaatgaaaacaaatgacttaagtcagtttttgcctagtttaaagttaaagaagaatctctatgatagttaa

SEQ ID NO: 2395 - DNA, 405 bp, Staphylococcus epidermidis
aatatttatatgttgtataatcagaaatatattttaaaagaagggttatgctttatgttaaaagaatttaaagagtttgcactcaaaggcaatgttttagacttagctattgctgtagttatgggagcagcgtttaataaaatagttacatccctagtccaatacatcatcatgccattaattggtaaattatttggttcagttaattttgctgaagattggtctttttgggggattaagtatggacttttcatacaatcaataattgacttcatcataattgcttttgctttatttatctttgttaagatagctaatacagttatgaaaaaagaagagaaagaagaagaagtagaagaaaatactgttttattaacagaaattagagacttgcttaaaaaataa

SEQ ID NO: 2396 - DNA, 1497 bp, Staphylococcus epidermidis
atatattatattctgctaataaaggtggtaccgcgcgtcagcgtccttataacgaaggaggctgatttttttcggaaaaggaggaaatcaatggatattgtatacaaaaaggtgaatgctcaaattacgccagaagctttagcaaaattaaaacaaaaaaagatcatttttgaaagtacaaatcaacagaaacttaaaggtaggtactcgatagtagtattcgatcattatggcaaaattacattagataattctcaacttttaattaagttagacaatcattgtgaaatagttaagaatcaaccgtatcaacgacttaaggaatttgtagataaatattattttgaaatcaaagataaatatttaaaagatttaccttttatttcgggctttatagggacatgtagctttgatttagtacgacatgaatttaaaaaattacaagatattaaattagaagatcatcaaactcatgatgtccaattttatctagtggaagatgtatttgtttttgatcattataaagatgaattatatattatcgcaagtaacttattttctgatagaacaaaagagagattaaaggaatctattgaacgtaaaattgaagatttaaaaaacatacatttttcggttgaggatataaattataaatccatccctcgacatataaccaccaatatatcagagcaacaatttgttcaaactattagaattttaaaaaagaaaattactgaaggagatatgtttcaagtagttccttcaagaatttatagttataaacaccattttcaacacaatttacatcaattaacttttcagttatatcaaaatttaaagcgacaaaatcctagtccatatatgtattatattaataaagatgtaccgattgtaataggaagttctcctgaaagttttgtaaaggtaaaagatggaaaagtttatacgaatcctatagctggaacaattaaaagaggtcaaaataaaaaagaagatgaaaataatgaaaagacattaatgaaagatgaaaaggaattgagtgaacatcgtatgctcgtagatttaggaagaaatgatattcatcgaataagtaaaacaggcacttcacaaattaccaaactaatgacaatagaacgttatgaacatgtcatgcatatcgttagtgaagttattggagaattaaaaccccatctatctcctatgagcgtcatcgcaagtttgctaccaacgggtactgtctcaggtgcacctaaacttagagctatacagagaatatacgaatcttatccttataaaagaggtatctatagcggtggtgttgggtatatcaactgtaatcatcatttagattttgcattggctatacgtaccatgattatcgatgaggaaaaagtcagtgtcgaggcaggatgtggagtagtatatgattctattccagagaaagaacttgaagaaacaaaacttaaagctaaaagtttattggaggtaactccatga

SEQ ID NO: 2397 - DNA, 1176 bp, Staphylococcus epidermidis
aaaaagcatatagaattaaaacgaacaaacgttcttatcaggaggataattatgaaaattgtacataccgctgattggcatctgggtaaaattttaaatggaaaacaattgcttgaagatcaaaaatatattttaactcagtttaaacaacatatggagaaagaacagccagatttaatagtaattgcaggtgatttgtatgatacctcatatccaagtaaagaagcgataggtttacttgaagagactattgaatacctaaatatagaacttaaaattccaataatcatgataagcggtaaccatgatggtagggaaagattgaattatggctctaaatggtttgagaataatcaactttacataagaactcaactagaaaatattgatgatccaatagaattgagtggtgttcaatttttcactttacctttcgcaactgtgagtgaagtacaaaattattttaaagataagcaaatagaaacatatcaacaagcattaaacgaatgcttagagcaaatgtctagttccatagataataataaggtgaatatattaattggtcatttaactattgagggcggtaaaacttcagattcagaaagaccattaactattggaacagtagaatcagttgatatgcattcttttcggttgtttgattatgtaatgctcgggcacctacatcatccatttagtataaataactcttttatcaaatatagcggttcgattttgcaatactctttctctgaagtaaatcaatctaaaggatatagagttcttgatattgaaaacaaccaactattaaatgaaaccttcgttcctttaaaacctctaagagaactagaagttattgaaggtgattatgaggatattattcaagaaagaattaaagtaaaaaataaaaataattattttcattttaagttaacgaatgtttctcatattactgatccaatgatgaaactgaaacaaatttatcccaatatattagcactatcgaatgtagtatttgatcatagtgagaattttagccatgttgaaatcaaaaaacaagatgatcagacaattatagaaaatttttataaaaatatgacagatcaacatctgagtcaagttcaatcagacaaaataaagcacttgttaagttttatattggatagggaggggtaa

SEQ ID NO: 2398 - DNA, 1026 bp, Staphylococcus epidermidis
gtgaatacaattaaaagatttcttttattgattacagttttactttgcatcgttatttttacgccagtcaaagaaactacttttatgattaaagctcaaaatgatatacgtcatcaaattaatcgatggattgattctgattcaaatgacgataatactcaattagcgattcctaaaaagcaagaatttgcaatcaacaatatacagatgaatatgactaaaaaagatgttgaagcacaattgggacaacataagcgtatgacttcgagtgtgtatggcacaaattggtacacatattattcaaatgattataatcaatttttgatggtgagttatattaacaatcatgttaatgcactgtatacaaatcaaaatcttatttcatcaaaatctcaaattaagtatgatactcctaaagatgttgttagggaaagatatgggcccccgattcaagttataaaaaaagggaaagttggttttgatgtaaaaagtaatgaatatgatgttttccataaagaccatatttataccacagtattttatgataagcacagagataatggtgtgaagtcattattacaagttagtgagaaaatggaaaatcgattaagatatcaatatgggaaaccatctaaattacttgcaaagagttttgagttgcaaaattttgacattgtcaatgctgaaagaaaacagcatggcttaaaaacattagattattctaaggatgtttctcatactgcgcgtaagcatagtgttgacatggttaagcataattattttgaccatgtaaatcaaaagaaactttctccttttgatagattaaaaaaagatggaatagaatttaatgctgctggagaaaacttagcatatggacaattgaatagtatctatgcacatgaaggtttgatgaattcattggggcatagaaagaatattttaaacacccattttgattatttgggcgtaggtgtatatttcaatgatcgaagacaacccttttggaccgaaaattatacaagttaa

SEQ ID NO: 2399 - DNA, 1212 bp, Staphylococcus epidermidis
ttaatgaaaattcaaacagaagtagatgaattgggctttttcggtgaatatggtggccaatatgtacctgaaacattgatgccagctattattgaacttaaaaaagcatatgaggacgcgaaatcagatactcacttcaagaaagaatttaattattatttaagtgaatatgttggtagagaaacgcctttaacatttgctgaatcatacacaaaattgttaggtggtgccaaaatatatcttaaaagagaagacttaaatcacactggtgctcataaaattaataacgcgataggacaggcactattagctaaaaggatggggaaaactaaattagtagccgaaacaggtgctggtcaacatggtgtagcaagtgccaccatcgctgctttattcgatatggatcttattgttttcatgggaagtgaagatatcaaacgtcaacaacttaacgtatttagaatggaattgctaggagctaaagtagtgtctgtgtcagatgggcaaggaacactatcagatgctgtaaataaagctttgcaatattgggtgaatcatgtcgaggatacacattatttattaggctcagcgttgggacctgatccgtttccaactatggtcagagattttcagagtgtgattggtaatgaaattaaaagccaaattttaagtaaagaaggacgatttccagatgcgttagtcgcgtgtgttggtggaagatccaattcaataggtacgttctatccatttatacaagatgatgttaaattatatggggtagaagctgcgggaaaaggaagtcatacgcataatcatgctttagctatagggaaaggtaaaccaggtgtattacatggttccaaaatgtaccttattcaaaatgatgatggacaaattgaattggcacactctatatcagcgggactagattatccaggtattggacctgaacattcgtattataatgatattggtcgtgtatcatatgtaagtgctacagataatgaagctatggaagcacttataacattctcaaaagttgaaggtatcattccagcaattgaaagtgcacatgcattgagttatgttgaaaaattagcgccaaatatggatgaaaaagaaattattgttgtgactatttcaggtcgtggagataaagatatggaaacaattaaacaatacaaagaaaacggtggtgaacaaaatgagtaa

SEQ ID NO: 2400 - DNA, 1152 bp, Staphylococcus epidermidis
atacttgaaatgactcatatacaatattgttattctgaaaattctgaaacaaggaggcgctctatgcgaaatattttatttgtagggttaggccttattggcggtagcttggcgagtaatttaaaatatcattacagtaatttcaatattcttgcatacgattcggactacacacaacttgatgaagccctttctataggtattattgatcaaaaagttaatgattatgctactgctgttgagatagcggatataatcatctttgcaactcctgttgagcaaacaattaaatatctatctgaacttacaaattacaatacaaaaactcatttgattgtaacagacacaggtagtaccaaacttactatacaatcattcgaaaaagaattattaaaacatgatattcatttaattagtggtcatcctatggcaggaagtcataaatctggtgttttaaacgcgaaaaaacatttatttgaaaatgcttattacattcttgtatttaatgaaatcgaaaataatgaagccgcgacatatttaaagaaattacttaaacctacgttagcaaaatttatcgttactcatgcaaatgaacatgatttcgtaaccggtatagtgagtcatgttccacatatcatcgcttcaattttagttcatctaagtgctaatcatgtcaaagaccattctttaatcgaaaaattagcagccggtggctttagagatataactcgtatagcaagtagtaatgctcagatgtggaaggatatcactttaaataatcaaaatcatattttatctttacttaacgagattaaagaacaaattactggtattgaaaatttgatacgagaacaaaatagtaatagtatttacgatttcttcgttaaagctaaagattatcgtgatcaacttcctgttaaacaacacggtgcaatatctactgcgtatgatctttatgttgatatccctgataagccgggtatgataagtcaaattacaaacatcataagttcacataatatttctattataaacttaaagattttagaagtacgggaagatatttatggagctttacaaatcagttttaaaagtcccgaagatcgagagaatgctataaaagccctcgcaaattttgatacttattattaa

SEQ ID NO: 2401 - DNA, 204 bp, Staphylococcus epidermidis
caaaggagaatgttgattatgccaatcattaatgtgaaattattagaaggccgttctgatgaacaacttaaggatttagttacagaagtcactcatgctgtagaaaaaactacaggtgcaaataaagaagcgattcacgtggtcattgaagaaatgagaaaagatcattatgctgtcggtggcgtaagaaaatctgatcagtaa

SEQ ID NO: 2402 - DNA, 615 bp, Staphylococcus epidermidis
gtttttatgatgatcatcgtcatgttaatcttgagttatctgattggtgcattcccaagcgggttaattattggtaaattattttttaaaaaagatataagacaatacggtagtggaaatactggagcaactaacagttttcgtgttcttggaagaccagctggatttatagttacgtttttagatattttcaagggatttattacagtcttttttccactatggttcccagttcatgcggatggtgttataagcaccttctttacaaatggtttaatagtaggattgtttgcaatactcggtcacgtgtatccaatatatctgaaatttaatggcggaaaagcagtagctaccagtgcaggagttgtattaggtgtcaatcctattttacttcttatcttggcaattatcttttttagtgtattaaaaatctttaaatatgtttctttatcaagtatcattgcagcaattagttgtgtgattggttcaatcatcattcatgattatattttacttgctgttagcggaattgtttcaatcatattaataattcgacacaaatctaatatagttagaatttttaaaggagaagaacctaaaattaaatggatgtaa

SEQ ID NO: 2403 - DNA, 240 bp, Staphylococcus epidermidis
tattggatgattttaaaatacaaatataaatttttaacatatatgacaatagtcatagtatgttgtattattttttcaaatttctttttaagcgttaaccaaggtgttcaatcagaacaaacgtacgaaatgactgaccacaagattcatcaacataatcaacaaggaactactcaaaactataaagacaaacaaaatagcgaacagaatgatcagtctgtgttcgcattagttaattaa

SEQ ID NO: 2404 - DNA, 1470 bp, Staphylococcus epidermidis
gagggattcgttttgcaagattttgataacttaattcctggctggtttaaaacatttgttcaagtcgggaatgacttaatttggtctcaatatcttattggattattattaacagcaggttttttctttacaattagttctaaatttattcaactcagaatgttaccagagatgtttagagcattaactgaaaagccagaaactttaagtagtggtgagaagggtatttcaccatttcaagcttttgcgattagtgctgggtcaagagtaggaactggaaatattgccggtgttgcaactgctattgttcttggtggccccggtgcagtcttctggatgtggattattgcttttattggtgcagctagtgcatttatggaagcaacgcttgctcaagtttataaggtacatgacaaagaaggtggattccgtggcggaccagcctattacataacaaaagggctaaaccaaaaatggcttggaattgtatttgctgttttaattacagttacatttgcttttgtatttaatactgttcaagcgaatacaattgctgaatcattaaatacacaatacaatattagcccggtaattactggaatagtacttgcagttattacaggtattatcatctttggtggtgttcgtagcatagctacactatcttcacttattgtgcctattatggctattgtttatataggtatggttttaatcattttattactcaatatagatcaaattgtacctatgattggcactattattaaaagtgcattcggagttcagcaggttactggtggtgctgtaggagctgctattcttcaaggtattaaacgtggtttattctcaaacgaagctggtatgggatctgcacctaatgctgctgctacatctgctgtgccccatcccgttaaacaaggtttaattcaatcattaggtgtattctttgacactatgcttgtttgtacagctacagcaattatgattttattatattctggtttgcaatttggtgatagcgcgcctcaaggtgtagcagttacgcaatcagcgttgaacgaacatttaggttcagcaggaggtattttcttaactgtagcagttaccttatttgcattttcatctgttgtaggtaactattactatggacaatccaatattgaatttttatctaacaataagatgatattatttatttttagatgttttgtagtacttttagtatttgtaggtgctgttgctaaaacagaaacagtttggagtactgccgatttatttatgggtcttatggcaatagtaaatatcatatcaattataggtttgtcgaatattgcgtttgcagtgatgaaagattatcaaagacagcgtaaagaaggtaagagacctgtgtttaaacccgaaaacttagaaataaatttatttggcattgagacttggggacaacatgcaaaaatgccaaaaaaatag

SEQ ID NO: 2405 - DNA, 1155 bp, Staphylococcus epidermidis
cgaacgtacgtttgtaggagggcgaaatcattggcaatgaataaacaaaataattattcagatgattcaattcaggtacttgaaggactagaagcagttaggaagagacctggtatgtacattggatcaactgataaacgaggattacatcatcttgtatatgaagttgtcgataactccgtcgatgaagtattaaatggttatggtgatgcgattacagtaacaattaatcaggatggtagtatttctatagaagataatggtcgaggtatgccaacaggtatacatgcgtctggcaaacctactgcagaagttatatttactgttttacatgctggaggtaaatttggacaaggaggttataaaacatctggaggtctccatggggtgggtgcttctgtagtaaatgcccttagtgaatggcttgaagttgaaattcatagagatggtaatatctacacacaaaatttcaaaaatggtggtattccagcgacaggtttagtaaaaactggaaaaacaaaaaaaactggtactaaagttacatttaaaccagactcagaaatatttaagtcaacgacgacttttaattttgatattttaagtgagcgtttacaagaatctgcatttttacttaaagatttaaaaattacacttactgatttacgtagtggaaaagaacgagaagaaatttaccattacgaagaaggaattaaagaatttgttagttatgtcaatgaaggtaaagaagtattacatgatgttactacatttgcagggcattccaatggaatagaggtagacgtagcattccaatataatgatcagtactctgagagcatattaagttttgtaaataatgttcgtacaaaggacggaggtactcatgaagttggtttcaaaacggcgatgactcgtgtttttaatgaatatgcacgtcgtataaacgaactgaaagataaagataaaaatttagacggtaatgatatacgcgaaggtttaacagcgataatttcagtacgtataccagaagaacttcttcaatttgaagggcaaacgaaatcaaaacttggcacttcagaagcaaggagtgctgtagactctgttgtttcagaaaaattaccatattacttagaagaaaaagggccaattatctaa

SEQ ID NO: 2406 - DNA, 438 bp, Staphylococcus epidermidis
attgaactagttaaacttagagatgatgttggtgaactaccagcagctaaagaaacgatcattgtttcacctattgctcttgatatacctaatacaattgaagcaacaacgccagaagtcgcagctggtaatacaacttttgtagcgacttcaaatttagttgcgcctaatccaaatgcaccttcacgaattttatcaggtacagatgacattgcatcttcactcatacttgtaatcatagggacaatcattatacccacaacaataccgggactgattgaattaaactctcccaagttaggaattagatttctcaatataggtgtaacaaatgtcaaagcaaagaagccaaatacaattgtaggaatcccagccaaaatttctaatattggtttaatgattctacgtgaacgatcagatgcatattcattaaggtag

SEQ ID NO: 2407 - DNA, 1608 bp, Staphylococcus epidermidis
atgttacaagtaactgatgtaagtttacgttttggtgatcgtaaactatttgaagatgtaaatataaaatttacagagggtaattgttatggattaattggtgcaaatggtgctgggaaatctacattcttgaagattttatcaggcgaaattgattcacagactggtcatgtatctctaggtaaagatgagcgtttggctgtgttaaaacaagatcattttgcttatgaagatgaacgtgttttagatgttgtgattaaaggacatgaacgtttgtatcaagtgatgaaagagaaagatgaaatttatatgaaacctgatttcagcgatgaggacggtattcgcgctgcagaacttgaaggagaatttgcagaaatgaacggttggaatgctgaagctgatgctgctaacttattatcaggattaggcatagaacctgacttacatgataaaaatatgtctgaacttgaaaataatcaaaaagttaaggtattgttagctcaaagtttatttggtgatcctgacgttcttttactagatgagcctaccaatggtttagatataccagcaataagttggttagaagactttttaattaattttgaaaatactgtcattgtcgtttcgcatgaccgtcacttcttaaataatgtttgtactcatattgctgatttagactttggcaaaattaaactttatgttggtaactatgatttttggtatcaatcaagtcaattagcacaaaaaatggcacaagaacaaaataagaaaaaagaagaaaaaatgaaagagttacaggatttcatcgcacgcttctcagcaaatgcttctaaatctaaacaggcaacaagtcgtaagaaacaattagaaaaaattgaattagatgatatccagccatcatctcgtagatacccttacgtgaaatttactcctgaacgtgaaattggaaatgatttacttacagtagaaaatctttctaaaacaattgacggcgaaaaagtactagacaatgtttcattcactatgaatcctaatgataaagctattttagttggtgatagcgaaattgctaaaacaacattgttaaaaattttagctggagaaatggaaccagatgaaggtacatttaaatggggtgtaacgacatctttaagttacttccctaaagataactctgagttctttgatggtgtcgatatgaatttagttgaatggttacgtcaatacgctccagaagatgaacaaactgaaacatttttacgtggtttcttaggtcgcatgttatttagtggtgaggaagttaagaaaaaagcaagcgtgctttcaggtggagaaaaagtacgttgcatgttaagtaaaatgatgttatcaagtgctaacgtacttttacttgatgagccaacaaaccatttagatttggaaagtatcactgctgtaaatgacggattaaaatcatttaaaggttctatcatcttcacttcttatgattttgaatttattaatacaatcgcaaatcgagtgattgacttgaatcaagctggtgccctttctaaagaagtaccttatgaggaatacttacaagaaattggtgtattacaaaataattaa

SEQ ID NO: 2408 - DNA, 744 bp, Staphylococcus epidermidis
atcaaaggagttattcaacttatggtacaacatttatcagctcaagaaatcattcaatatattagtgatgctaagaaatcaacaccactcaaagtttatgtaaatggtcattttgaaaatgtcacattcccagaatcttttaaagtttttggctctgaacattcaaaagtaattttctgtgaagcagatgaatggaaacaattttatcaacaaaatcattcattaatcactgaattagaaattgagatggatcgtcgtaattcagctataccgcttaaagatttaacaaacacaaatgctcgtattgagccaggtgcgtttattcgtgagcaagcaatcattgaagatggtgctgtggttatgatgggtgctacgattaatattggagctattgtaggagaaggaacaatgatagacatgaacgcaacacttggtggacgagctacaacaggaaaaaatgttcatgttggtgcaggtgctgttttagctggtgtcattgaacctccaagtgcttccccagttgtcattgaagacaatgttttaattggagcaaatgctgttattcttgaaggtgtacgcgttggtgcaggtgctattgtagcagctggagctattgtaactcaagatgtgccagctggagctgtagttgctggtacgcctgctaaagtaattaaacaaacttcagaagttcaagactcaaaacgtgagattgtgtctgcactgcgtaaattaaataatgaataa

SEQ ID NO: 2409 - DNA, 801 bp, Staphylococcus epidermidis
ctatttcaggtcgtggagataaagatatggaaacaattaaacaatacaaagaaaacggtggtgaacaaaatgagtaaattattcattccgtatattatgggtgatttaaattttattcatcatttaaaaacattaactgagaatggagcagacattgttgaaattggtgtgccattttctgatcctgttgcagatggacctataatcatgaaagcagggcgcaacgctattgacgagggttcaaacattaaattcatttttgatgaattaataaaaaataaaaatactatttcatctaagtatgtattaatgacttattataatattctaagtgcttatggagaagaattatttttggataagtgtgatgaagctggtgtttatggtttaattattccagatttaccttacgaacttacaaaaaagtttaaaaaagatttttatcatcattctgttaaaataatatcgttaattgccatgaccgcaagtgatgctaggattatgcaaattgcaaagaactcagaaggatttatttacacggtaacaatgaatgccacaacaggtaacagtggggagttccatccagatttaaagagaaaaattgaatatataaaaaaagtttcaaaaattcctgtggttgctggatttggtatcaaaaatcctgaacatgttaaagatatagcgtccgttgcagatggtattgtaattggtagtgaaattgtaaaacgtattgaaatagattcaagaaaagaatttatcacttatatcaaatcaataagaaccacgttgaattctttataa

SEQ ID NO: 2410 - DNA, 681 bp, Staphylococcus epidermidis
tttgaagaggtgtatatattcatgagtaaaaaagttttatttgttttaacaagtacaagtcaatttacagacggtacagaaactggattatggttagaagaagctggagcaccatataatatattgactgaagaaggtatcaatgttgatgttatttctattaaaggtggaaaagtaaatcttgatcctaattctgtttctaatgaatcactgaatcagtatgctaaattcgtgtcacacttaaacgatacacctagtatcgaaaatgtaaatgcagatgagtatgacgctatttatctaccaggtggacatggtactgtatacgattttgccaataatgagaaattagctgatattttacttcaatttaaaaatagtaataaaataatctcttcagtatgtcatggacctagtgcgtttgtaggtgtaaaagatgcaaataatcactatctagtagatggtgtcaaaataacttcatttactgatagtgaagaaaaagcaatgggatttgaaaataaagtaccatttttaactcaatctaaattagaagagcaaggtgcaaattttgtagtgaaagatgactttacatctcacgtagaaaaagacggtcaatttatcactggacaaaatccccaatcaagtgaagacattggtaaagcacttgcaaatgaattaaaataa

SEQ ID NO: 2411 - DNA, 246 bp, Staphylococcus epidermidis
ttattggtattcctctatacgctgtacttaaggtattggtttcacacatatttatgttatttaaacgaagatacaatcgctactatggaaatgatgctggtgagtacattatcactgaagaagaaaaaggaattaaacaataatatatataattttagactggaacaacaaaacaacaatgttccagtcttttttatttttaaatcacatacatttgcaatcatgatatgcttagtaatcatatga

SEQ ID NO: 2412 - DNA, 642 bp, Staphylococcus epidermidis
  unsure (12),(13),(14),(15),(16),(27),(36): Identity of nucleotide at the above locations are unknown.
ccaaataaattnnnnnggtgcctgctngaggagaancttgctgggtcggcccacgatggaaaattaactggactttttggtgcgccagtttcggatagagaaaatagtatgacagcaggacaacgtggaccattattaatgcaagacgtttattatttagaacaaatttctcacttcgatagagaagtgattcctgaacgtcgtatgcatgcgaaaggttcaggtgcatttggtacgttcacagttacaaatgacatcacacaatatacaaatgcgaaaatattctcagaagtcggaaaacaaacagagatgtttgcacgtttttctactgtttcaggagaacgtggagcagcagatttagaacgtgatatacgtgggtttgccttgaaattctacactgaagatggaaactgggatttattaggtaacaatacgccagttttcttctttagagatcctaaactatttattagtttgaatcgtgctgtaaaacgagatccacgtacaaatatgagaagtgcacaaaataactgggacttttggacaggtctaccggaagcattgcatcaagtgacaatattaatgtcagatagaggtatgcccaaaaggattccgaaatatgcatggattcggttctcataa

SEQ ID NO: 2413 - DNA, 2049 bp, Staphylococcus epidermidis
ttgatgaaattttcgtgggtacgttggattttatatattgttgcattatttttaccaatttttattttttataccgtcgcacgacctgtagatagaaataatcgtaatatgggtgtgtattgtacagttgtatcatgtgttgagtggatggcagcagctactgtattatattttgctgcattgattgtcgatatacatatctcatttatgacttttgtacgtatatttgttattgcagctttatctggtttagttagttttattccaggtggttttggcgcgtttgatttagtcgtgttactaggactgaaatcacttggtatttctgaagaaaagatacttctagcattagttttatatcgatttgcttattattttgtgccagtgatgattgcacttatactatcttcatttgaatttggaaatactgctaaaaaatatctcgacaattcgaagtactttatacctgtaaaagacttcacttcatttttgaggtcttatcagaaagatattttagctaaagtgccttcattttcgttagcgattttaatatttttaactagtattattttctttattaataatttaactattgtctatgatggattgtatgatggaaatcattttgcctattatattgctttagctgtacaaacgagtgcttgtttgttacttattttaaatgtaagaggtatttataaaggcagtcgtcgtgcaataatttatgcctttatttctattattttaattgctagtgcgactatatatacttatgcgtcatttttattattgtcatggctcattatcatatttgtgttactgattttagcttatcaacgtgctcaagtacttaaacgaccattacgctttaaaaagttggcggttatgctacttcttagtatctttattctttatttaaatcatattttaatatcaggaactttatatgcattagatgtttatcatattgagattgatacgtctttattacgatattacttttggatgaccattgttattattatgctactcgttggcgttattgcttggctttttgactataagtataaatgccctcatcatagcattgatttaacactttgcgatgcaattattcaaaaatacggtggtaattatttaagtcaccttgtttatagtggtgacaaagattgtttctttaatgaaaataaagattcatttattatgtatcgatataagtccaatgcccttgtcgttttgggtgatccaattggcaatactaaatcattcgagtcattattagaagcattttatcagtttgcagagtatcaaggttatgagattattttttatcaaataagtgatcaatatatgcctttatatcataattttgggaatcaattcttcaaattaggtgaagaagctattattgatttaacaacgtttacaacatctggtaaaaagcgacgtggtttcagagcgacgctcaataaatttgatgatttaaatatcaattttgaaattattgaaccaccatttactcaagatttctttgatgaacttaaatttgtgagtgataaatggttggatggaagaagtgaaatgcatttttctgtaggtcaatttactcaaacttatttatcgaaagcacctattggagtaatgagagatcactctggcaagatgattgcattttgtagtttgatgcctacttattctaataatgcaatatctgttgatttaattagatggttgcctgaattggatttacctttaatggatggattatatcttcatatgttgttatggagtaaagaaaaggggtataaagcatttaatatgggaatggcgacactctcgaatgtaggtcaattgcattattcttatttaagagagagaatggcaggacgtgtatttgaacatttcaatggtttataccgttttcaaggattaagacgttataaagaaaaatatagccccaattgggaacctagatttttagtttatcaaaagcattattctctgtgggagagtatgcttaaagtgatgagagtcatacgccataaataa

SEQ ID NO: 2414 - DNA, 204 bp, Staphylococcus epidermidis
tcatatatttcactttgtcgcttagtgagttctctcataaataggcactccttattgttgtttgagattattatatcattaattacattttctaacacacatttgttcgtaatgttgttgacacagaatttatgttctgataaattacttatacaaacaaatgttctaggagtgatattggatgattttaaaatacaaatataa

SEQ ID NO: 2415 - DNA, 471 bp, Staphylococcus epidermidis
gaggatgtttcaatgaaaaagtggcaattagtcggtactactgtattaggagcttcggttttacttggcgcttgtggcggaaatgatggaggttcaggagacggcaaagatcttaaaggttctgctaaaggtgaaggttcgtccacagtagctcctatcgttgaaaaattaaacgaaaaatgggctaaagatcataaagacgccaaaatttcttcaggtcaagccggtacaggtgctggtttccaaaaattcattgctggcgaaactgatttctcagacgcttcaagacctattaaagacgaagaaaagaaaaaattagaagataaagggattaaatatcacgaattcaaaatcgcacaagatggtgtaacaattgcggttaataaagataacgactttgttaaagaattaactaaatcacaattaaaagatatttactctggtaaagctaaaacatggaaagaccgttaa

SEQ ID NO: 2416 - DNA, 207 bp, Staphylococcus epidermidis
attcagacatcctcgtggcttaatataagaaaagtaatagctcaacgagctgaaaatcatcaaaaaaattataaaaaagacaattcctatattatttcaatagaaattgtctttatttacttattttggaactttttgttccaggctttccacatctatatagatattgatttaattataattacaatgtttgtaggaattaaatga

SEQ ID NO: 2417 - DNA, 996 bp, Staphylococcus epidermidis
gaggttaaatcattggtgaaaagtggcaaagcacgagcacatacaaatattgcgttgattaagtattgggggaaagctgatgaaacttacattattcctatgaataatagtttatcagttaccttagatagattttatactgaaacaaaagtgacatttgaccctgattttactgaagattgccttattttaaatggtaatgaagtgaatgccaaagagaaagaaaagattcaaaactatatgaatatagtgagagatttggctggaaatcgtttgcatgcgcgaattgaaagtgaaaattatgtgccaacagcagcaggacttgcttcttcagcgagtgcttacgctgctttagctgccgcttgtaatgaagctttgtcattgaacttatcagatacagacttatcacgattagctcgacgtggttcaggttctgcttctagaagtatttttggtggatttgccgaatgggaaaaagggcatgatgatttaacttcatatgcacatggtattaattccaatggttgggaaaaagatttatcaatgatatttgtagtgattaacaatcagtcaaaaaaagtatctagtaggtcaggaatgtcactaacaagagatacttctagattttatcaatattggttggatcacgttgatgaagatttaaatgaagcaaaagaggcagtcaaaaatcaagattttcaacgcttaggagaagtcattgaagcaaatggtttacgtatgcatgccactaacttaggcgctcaacctcctttcacgtatttagtgcaagaaagctacgatgctatggcgattgtggaacagtgtcgaaaagccaatttaccttgttactttacaatggatgcgggtcccaatgtaaaagttttagtagaaaagaaaaataaacaagctgtgatggaacaatttttaaaagtatttgacgaatcgaagattatagcaagtgatatcatcagctctggcgttgaaattattaagtaa

SEQ ID NO: 2418 - DNA, 273 bp, Staphylococcus epidermidis
acgcataaatctttgaggaggatacaatatatgactaaaaacacattaaatgacttaaacaatcatttatttgcgcaattagaaagattaagcgatgaagaattaaaaggcgaagaattacaagaagaattgaatagatctaaagcagtttctgatgtagctaaaaacattgtgagtaatggaaacctaattttacaagcgcataagtttaaagatgagcaaatgaatgctgacgctaaattacctaaaatgttggaaaacaaagaaaaatga

SEQ ID NO: 2419 - DNA, 327 bp, Staphylococcus epidermidis
aataatccgtcatctaattcaccacgtaacatagagttagtaattgtcgtaacttcatcttctgtcttaaattctgctaactcctctatccacatgatagaaaaagggaaccgactatcttttaacgactttaatcgttcagggttctgcgcccctctgaagataatccgattccctctaggtacatatgttatttccattggcgacactttaactttaaacaggtgtgacaccttttgttcttctatcgcccacttgatttgctcaaatactgatgtagctaatgtattatcagtcttacgtactacaactgcattcataggatag

SEQ ID NO: 2420 - DNA, 426 bp, Staphylococcus epidermidis
ggtggaactttgagtaaatacaattctaaaaaagttgaatataaaggtgtcgtgttcgatagcaaaattgaatgtgacttctaccagcatttagaacgtaacttgggaaatgaatatgatcatatagaattacaacctagatatgagttgatacctaagtttgataaccaacgtaaaacagaatatatagccgactttgcattatggaaaaataacaagctgcttgaagtgatagacgtaaaaggtatgccaacagaagtagcgaagttgaaagcgaagatattcagatatcaaaacagagaagtaccactcacgtggatatgtaaagcacctaaatacacagggcaagagtggataacgtatgaagaattaattaaggtacgcagaaagcgtaaaaaggagaagatgaaggatggtaaagattaa

SEQ ID NO: 2421 - DNA, 996 bp, Staphylococcus epidermidis
tttggagtgttatatatgtgtactgccatttctttatatacaaaacaacgttaccattatttagctagaacaatggactttgcatttgaatttaatggtatcccaaccattgttccacgccattatcactaccaatttgatctagattcagacatgcgtcttgaatatggttttgttggaacaaatttaaaagtaggacgttatagatttggtgatggtataaacgaaaaaggtttagctatttcgaaccattacttcactggtgaagcctcatacagtacccataaacgttatggttattttaacttagcacctgaggagtttattgtttgggttttaggttttaataaaagtattagcgaattaaaacaaaaggttaagaaaatcaatattatgaatgaaaaaaatacgactttgaatatcgttcctcctttacatttcatggtcactgatgaaacaggacataccgtagccatagaacctcacaatggcttattaatagttaaagataattatgttcataccttaacaaatgaacctaaattagattggcatctatctaacttaagaaattacgcttttttaacgccacagaaatcaaccaatcaattaataggtaaagtgctagtaagatcaatgggctgtgaagcaggaacaaatggcttaccgggtggttatacgtcaacagatcgttttatacgcgctacatatttaagacaccaactacgctgttcccataatgaagatgaaaatttaatgaattgttttaaagttctagaatcagtcagtatccctcaaggtgcagttatcgatgccaataaaatacattacacacaatatcaattagtgatggaaagtaaagaaagaagttattatattaagccttactttagcaatcaaattttcaaaataaaattaactgaagaccttttaagtaagaatgagatgacattcttacctattaatcacgaattaaagataacatcaatacaatag

SEQ ID NO: 2422 - DNA, 1218 bp, Staphylococcus epidermidis
gcgggggaacccgcttttttacataaaaagtggtatacttaccacaaggtgattaatatgaaaataataaataataattttacatttcacaaaggtaaaaattggataaatttaagtgggctaccaaggaagaaaacaaaaagaggcgaacaaattatttggaaaaattccataggttataatgtgaattatttttttgaaggtatcagtggagatataaaaatattagactcttacaggaaaaatgatgaaagatatttaaaagtggaagtaaaaaacgaaacatatgaaatacgttcatctaacttcaaaaattgcgaaataaagaaaattgtgactgatggttataaacataatttaggatttattataaatggttgtaaagtaattggtaaaagacttaatccaagaagtaaagaaagagaatataaaatgttgtgtctaaatacaaacttgacattttatagaagagaatcaagaatagatgtcggtgcgccaagtccatacattagcggtaaatatgtttatgaaggaaattggttatacaacgaaaaaaatgttttaccttttttaaaagatgttaatgatgcaaaaaaatatacaaagttctcaaggagagaaataaattgcgtttgccctaattgtaaaactgaaaaaacaacgcctgttaataacttggtccaacaaggtttcttttgccacgtatgttctactaacatatcatatccagaaaaattaatgattgctttattaaatgaaaatagtgtagtttttgaatatcaaaaaatattccaagatcttaaacccaaaagatttgatttttacttaccagaatataatttagttatagaaacccatggaaagcaacattataaagaaaacgaaatttggtatagaaaatctaaggaatctgatgttgtaaaaatgagttattgcaaaaagaaaaacataaaatatgttgaagtggattgcagtttatctgattacaactttataatgaataacattaataaaactgaattgaaacatgtactaaaattatatgacaaagaaaatataataaaaagaataaaagaattagagcaaataaaagatgtggatgaaataattaaactatacaagaatggtagaaaccttacatatatcagtcgaaatgttggattaaccaaatggaaaatagaggggctattgaaacgtctgggatatattgcacgctaa

SEQ ID NO: 2423 - DNA, 681 bp, Staphylococcus epidermidis
aggaggttgccaatcatgactgatgaaagacacgtacttgtgattttcccccatcctgatgatgaaactttttcgtctgctggaactatcgcaagttatattgaaaaaggtattcccgtcacatatgcatgtcttaccctaggacaaatgggacgtaatctaggtaaccctccttttgcaacaagagaatctttaccatttatacgtgaacgtgagttagaagaagcatgcaaagcaattgggattacagatttaaggaaaatggggttaagagataaaactgttgaatttgaaccttacgatcaaatggatcaaatgattcaatcacttattgacgaaacaaatccatcattaattatttcgttctatcctaaatttgcagttcaccctgatcacgaggcaactgcagaagctgtagtacgtacagttggacgcatgcatgaatcagatcgaccccgtcttacacttgtagcgtttagcaatgatgcatcagaaattcttggagaacctgatattcaaaatgacatatctcaatatagtgatataaaacttaaagcttttgaagcacatgcttcacaaacaggaccatttttaaaacaacttgctagtcccgaaatagatggtcaagcacaaagtttcttaaaaatagagccattttggacatatcactttgaatcttaa

SEQ ID NO: 2424 - DNA, 834 bp, Staphylococcus epidermidis
atgatggctttaaaaaaagtattaacgatagctggttcagatacaagtgctggtgccggtatgcaagcagatcttaaaacgttccaagaacttgatgtatatggaatggtcgctttaacatctattgtaacaatggataaagaaacatggtcccatgatgtaacacctattgatatgaatgttttcgaaaaacaacttgaaactgcaatatcaattggacctgatgctattaaaacaggaatgttagggacacaagacattattaaacgtgccggagatgtttttgttgaatctggtgcagactattttgtagttgatccagtaatggtttgtaaaggagaagacgaagtacttaacccaggaaacacagaagcaatgattcaatatttactacctaaagctacagttgttaccccgaatttattcgaagcaggtcaactctctggtttaggaaaattaacatcaattgaggatatgaaaaaagctgctcaagtgatttatgacaaaggcacacctcatgtcattattaaaggtggtaaagcactcgatcaagataaatcttatgacttgtactatgatggccaacaattttatcaattaactactgacatgttccaacaaagttataatcatggtgcaggatgcacatttgctgctgccacaacagcttatcttgcgaacggtaaatctccaaaagaagcaatcattgctgctaaagcatttgtagcttcagcaatcaaaaatggttggaaaatgaatgactttgtaggacctgttgatcatggtgcatataaccgtattgaacagattaacgttgaagtcactgaggtttaa

SEQ ID NO: 2425 - DNA, 276 bp, Staphylococcus epidermidis
tcaaaatatacggaggtagtcaagttgagacacaaattattaaaaacggccaatgatttaaataaattgattttgcatagtgatgaaaaagtgaaagcagaatttcatacttttgataatggagaagttggtattaccttttggcactattctcaaaaatatgaaagtgactgtaatcatctgaatttctacgaatttttcacagataaagaattacaaagaagttttgaattagcaaaagatgtcattgcaggggagtgtttaatcgatgagtaa

SEQ ID NO: 2426 - DNA, 339 bp, Staphylococcus epidermidis
tctgctgatacaatgttaaccaaattacttacaacaagtggtaatgatgtggaatatacgataaacccacaagctataataaaaggaaacactagctttttattgaaacctaaatttcttatcatcgctaaagcgataggcgtcaaaattaaggttgctccatcattagcaaaaaatgctgcaataattgcacctaatatcatgataaacacaaacatttttaatccatgtccttgtgatgctttaaccatatgtatggcagaccactcaaaaaatcctatttcatcaaggattaatgaaataaggataactgcgacaaaggtaagtgtggcattttaa

SEQ ID NO: 2427 - DNA, 522 bp, Staphylococcus epidermidis
ggtattccaacacatatgaaaaaaaatcatgattacatgcgcttagcaattaatgaagcacacaaagccaaagcattaggagaagttccaatcggagcagttattgttaaagaggatcaagtcattgcacgtgcacataatttaagggaaacattgcagcaacctactgcccatgcagagcacatagcgatagaacgggcgtcagaagttgtcggcagttggagattagaagaatgtacgttgtatgttacattagagccctgtgtcatgtgtgcgggcactattattatgagccgtattccaaaggttgtgtatggtgctactgatcccaaaggaggatgttcaggaagtcttatgaatttattagaacaaccgcagtttaatcatagggcaatcgtagaaaaaggaattttagaagaagagtgtgcagaactattgagaagtttttttaaggaaatacgtgaaaagaaaaaagcagaaaaacaggggaagatacaaaaggatataaatttgttaaaatga

SEQ ID NO: 2428 - DNA, 528 bp, Staphylococcus epidermidis
agaatggcaacgtgtgctagattatgcagattatataagaagcaaacgcaaataaagggtgtctttatggggttatatgaaaaaatgttaatagaacatgattatatagaagtcagagagacagatgttatgcctaatgacttacatggtctatggttaggtgatttaattttaattaagcgaaacttatcagaaatacgaaaagccgaagtattatacgaagaactagcacaccataaacttacatatggaaacatcttagatcaatctaaattcaacaaccgcaaatttgaaaactacgcaaggcgttacggatatgaaaccgctctacctttgcgcattattgtggaagcgcataactatggtgttagtaacttatatgaattagctgaatatgttcaattaagcgaagaatatatatcagaaatattgaaacattacaaaaacaaatatggcattggaactaactacggagaatacttaattacatttgatccgttaagagtttttaaatataaagaaatataa

SEQ ID NO: 2429 - DNA, 255 bp, Staphylococcus epidermidis
tattcaaaaactacactattttcatttaataaagcaatcattaatttttctggatatgatatgttagtagaacatacgtggcaaaagaaaccttgttggaccaagttattaacaggcgttgttttttcagttttacaattagggcaaacgcaatttatttctctccttgagaactttgtatatttttttgcatcattaacatcttttaaaaaaggtaaaacatttttttcgttgtataaccaatttccttcataa

SEQ ID NO: 2430 - DNA, 927 bp, Staphylococcus epidermidis
gaaaacatgactagacaaggatacggagaatctactggaaagattattctaatgggtgaacacgcagttacatttggtcaaccggcaatcgcaattccatttaatgctggaaaaattaaagtcctcattgaaagtttagatgaaggtaattattcttctatcacaagtgacgtatatgacggaatgttatacgatgcccccgaacatctaaagtctatcattaatcgctttgttgaaaaaagtggagtgaaagaaccactatcagtaaaaattcaaactaatttgcctccatcaagaggtttaggttcaagtgctgcagtagcagtagcgtttgtacgcgccagttatgattttatggatcaacctttagatgacaaaacattgattaaagaagcaaattgggcggagcaaatcgcacatggtaagccaagcggtattgatacgcagacgattgtgtcaaataaacccgtctggtttaaacaagggcaggccgaaacattaaaatcactaaaattaaatggttatatggttgtcattgatactggagtaaagggttctaccaaacaagcagtagaagatgttcatgtattatgtgaatctgatgaatatatgaaatatatagagcacattggtacacttgttcacagtgctagcgaatcgattgaacagcatgatttccatcatttggctgacatatttaacgcatgtcaagaagacttgagacatttaacagtaagtcacgataaaatagaaaaattacttcaaattgggaaagaacatggtgccattgctggtaaactaactggtggaggaagaggtggcagcatgcttcttcttgcggaaaatttaaaaactgcaaagactattgttgctgctgttgaaaaagctggcgcagcacatacatggattgaacatttaggaggttaa

SEQ ID NO: 2431 - DNA, 210 bp, Staphylococcus epidermidis
ccacaaatgactttaggaaatcgtattaaacagcataggcaagacaaaggtttgaatatgagagagtttggagaattcatcgacaatgcctctgacagcatagtaagtaggtgggaacgaaatatttctgtacctaatgctaaaagacttaaattaatagctgatgacatgaatattactgtaacagagttactgaaaggagtgaaataa

SEQ ID NO: 2432 - DNA, 441 bp, Staphylococcus epidermidis
tatacgatgacgaaactgaaccttaaacaacaagcatttgttgatgagtacattaagacaggtactgcttatcaatcggcaatcagggctggttatagtgagaaatacgcaaaatcaagtagtcataaattgttggaaaatgtgggaataaaagcagaaatagacaaacgaatggaaaaactgaaaaaagattcaattgcagaccaagatgaaatacttcaatatctcacctctgtattacgtggggaggtaacagaccaagagttgatacctattcaagttggcagaggcgaaatggaagtagaagaactagaaaaaaggtcagatactaacgctagaactaaagctgcagaattattaggtaagcgatatatgatgtggacagataaacaacaaatcgaaacgactgcgatggtgcatttcgatgatgatatcaattaa

SEQ ID NO: 2433 - DNA, 204 bp, Staphylococcus epidermidis
ccacctactgcatttgtacctaatgcgataggaaaaacattgacatcagatttacctaatcgtacttgttttaccattaaaagtcatctcctttatttaaaatacttaaatatattatacccaaatcataacttattcattcatgttaattatctattagaagcaagtatcttgaccttaaaatcattatacgctttaatgtaa

SEQ ID NO: 2434 - DNA, 747 bp, Staphylococcus epidermidis
tacacttatgcatatggctgcactgctttctgctacagcggaaaagaaaccactagttgcctgggatttgaatatgggggacttataaatacactcgaagcagcaagaaggtatcaattaaaatattttacgccaagttcaataggagcttttggtatttcgacacctaaagtaaatacacctcaattaacaatacaacaaccaacgactatgtatggtataaacaaagtaactggggaattattatgtcagtattattatgtcaaatttggagtagatacacgtagcgttagatttcctggtttaatttcacatgttaaagaacctggcggtggcataacagattatgcagttgatatgtattttaaggcagttagaaaaggacattatacaagttatattaatcgttacacttatatggatatgatgtacatggaagatgctattgatgcgattatcaaattaatggaagaagacagtgttaaattaaaaacaagaaatggctataacttaagtgcgatgagtattgaacctgaaatgctaaaacaagctatacaagtatactatccagatttcaccttagattatgacattgatttagagcgtcaagatattgcattaagttggccagatagtatagatacgagctgtgctcaggaagagtggggatttgatcctaaatatgatttaccaactatgactaaagtgatgttagaggcaattgagaaaaaacaaaaagaatgctga

SEQ ID NO: 2435 - DNA, 357 bp, Staphylococcus epidermidis
atggaaatcgcaaaaatgagagttaaaaataaatacttctctattacacctaatgtagtagagaaaatgaaagaagcagatatcaatcccgatatcttaagacaaagattagcttctggttggaagtttgaagatgcaatagaagctcctttgggagtaagacgtagtgaatgggatagtttaaaacctaaagaggacggaatcgctagttataaagagagaatggcacaacgtagattacaagagttgaaacgtaagaaaccacatttattcacagtgcctcaaaaacaccctcgtagtgaatggtgtacgtaccttatggaaaatgacatcttccctagaaaggttgcgaaatga

SEQ ID NO: 2436 - DNA, 318 bp, Staphylococcus epidermidis
gtaatgaacgcacaagacgttaaaatattaaataatctttcactcgatgatacttctaacgatgaaacaatagaattacttattgaaaaatatctgaatgtagcagaagaatattgtaaccaaacattcaatagacagtcattacctagtaacgtagagaaatttattgctaattgtattaaacaaggtacgactagcaacatttcttcacgtactatgggaactgtaagctacacattcgttactgacctacctaaggaaacatacggttacctaaaaccatttagacgtttacgttggactggttatcatgtttaa

SEQ ID NO: 2437 - DNA, 246 bp, Staphylococcus epidermidis
tcttcattagctcctgtatccggtaatttatcttttgtattcttatctgagctattgtctaatcctgagtcactgtctgagtcggaatcgctgtctgaatctgaatcactatctgagtctgagtcactgtctgaatctgaatcactatcggaatctgagtcgctgtctgagtcggaatcgctatcggagtctgagtcgtcgctatctgagtctgaatcactatctgaatctgagtcgtcatcatag

SEQ ID NO: 2438 - DNA, 531 bp, Staphylococcus epidermidis
ataatgaaagctatacctaaaattttcgacaaagaaaaagggcaatggattgaactaatggctaaacctatcgccgaagaagtagttaagataatgaaagaggattggttatctaataagaaaacaattgactattggttattacaatatacagagggtgtagttgagcctatacaagttgctatatttactgacggcaatgaagtcgatgaaatcttaaaaagtaacttagaatggatgtttaatggttatgtatctaatctagaaaacaaaaagctctttaatttacaagattttataaactattgttacagcactaaaacagagttgcctaaacagttcaaagtcaacgctattgtaaaattcgatagtttagacgaacctattaaattacaagagatagataatatcacgactaatcctgatgttttaggcatattagatgaaacttctgaaggatctatagaggttaaatatatctataatgatcattctatcgaagataaaaagttaataaaagagaataaataa

SEQ ID NO: 2439 - DNA, 3558 bp, Staphylococcus epidermidis
atctgtttggcaggtcaagttgtccaatatggaagacatcgtaaacgtagaaattacgcgagaatttcagaagtattagaattaccaaacttaatagaaattcaaacaaaatcttatgattggttccttaaagaaggtttattagaaatgttcagagatatttctccaattgaagatttcactggcaacctatctttagaatttgtagattacagattaggtgaacctaaatatgatttagaagaatcaaaaaaccgtgacgctacttatgctgcacctcttcgtgtgaaagtgcgtcttattattaaagaaactggtgaagttaaagaacaagaagtcttcatgggtgattttccactgatgacagatacaggtacgttcgtaattaatggtgctgaacgtgttatcgtatctcaattagttcgctcaccatccgtgtattttaacgagaaaatcgataaaaatggacgtgaaaactatgatgcaacaatcattcctaaccgtggtgcttggttagagtatgagacagatgctaaagatgttgtatatgttcgtatcgatagaacacgtaaattaccattgactgtattactacgtgcgctaggtttctcaactgatcaagaaattgttgacttattaggagacagcgaatatttacgtaatacattagaaaaagatggaacagaaaatacagaacaggctttattagagatttatgaacgtttacgtcctggcgaaccaccaacagtagaaaatgctaaaagtttattatattctcgtttcttcgaccctaaacgctatgatttagccagtgtaggtcgttataaagcgaacaaaaaattacacctaaaacatcgtttgttcaatcaaaaattagcagaaccaattgttaacagtgaaactggtgaaattgttgttgacgaaggaacagtgttagatcgtcgtaaacttgacgaaatcatggacgtattagaaacaaacgctaatagcgaagtatttgaacttgaaggtagtgtaattgacgaacctgtagaaatccaatctattaaagtgtatgtgcctaacgatgaagaaggtcgtacgactactgtcattggtaatgcattacctgattctgaagttaaatgtattactccagcagatattgttgcctcaatgagttatttcttcaacttattgaatggtattggttatacagatgatattgatcatctaggtaatcgtcgtttacgttctgtcggtgagctattacaaaatcaattccgtatcggtttatccagaatggaacgtgttgttcgtgaaagaatgtcaatacaagatacagattctattacgccacaacaactcattaatatcagaccagttattgcatcaatcaaagaattctttggtagttcacaattatctcaatttatggaccaagctaacccgttagcagagttaacgcacaaacgtcgtttatctgctctagggcctggtggattaacacgtgaacgtgctcaaatggaagtgcgtgacgttcactactctcactatgggcgtatgtgtccaattgaaacacctgagggtcctaatattggtttaataaactcattgtcaagttatgctagagtgaatgaatttggttttattgaaacgccatatcgtaaagtggatttagatacaaactcaatcactgatcaaatagattatttgacagctgatgaagaggatagctacgttgttgcacaggctaattctagacttgatgaaaatggtcgtttcttagatgatgaagttgtttgtcgtttccgtggtaataacactgttatggctaaagaaaaaatggattacatggacgtatcaccaaaacaagttgtttcagcagcaacagcatgtattccattcttagaaaatgacgactctaaccgtgcgttaatgggagcaaacatgcaacgtcaagcggtgcctttaatgattcctgaagctccatttgtgggtacaggtatggaacacgtagccgcaagagactctggtgctgcaattactgctaagcatagaggacgcgttgagcatgttgaatctaatgaaattttagttcgtcgtttagtcgaagaaaatggaactgaacatgaaggtgaattagatcgttatcctttagcgaagttcaagcgttcaaactctggtacttgttataaccaacgtccgattgtatcaattggtgatgttgttgaatataatgagattttagcggacggtccttcaatggaattaggagaaatggcattaggacgaaatgtagttgtcggtttcatgacatgggacggttacaactatgaggatgctgtaattatgagtgaacgactagttaaagatgatgtatatacatctattcatattgaagagtatgagtcagaagctcgtgatacgaaattaggacctgaggaaatcacacgtgatattccaaacgtatctgaaagtgcacttaagaacttagatgatcgtggtatcgtttatgttggtgcagaagttaaagatggtgacatcttagtaggtaaagtaacgcctaaaggtgtaactgaattaacagctgaagagagattattacacgctatctttggtgaaaaagcacgtgaagttcgtgatacatcattacgtgtacctcatggtgctggcggtatcgttttagatgttaaagtctttaatcgtgaagaaggagacgacactctatctcctggagttaaccaattagtacgtgtatatattgtccaaaaacgtaaaatacatgttggggacaaaatgtgtggtcgtcacggtaacaaaggtgttatttctaagattgttccagaagaagatatgccttatttaccagatggtcgaccaatcgatattatgttaaacccattaggtgtaccatcacgtatgaacattggacaagtattagaattacatttaggtatggcagctaaaaacttaggaattcacgttgcttccccagtgtttgatggtgccaacgatgatgacgtttggtcaactatcgaagaagctggaatggcgcgtgacggtaaaactgtcctatacgatggacgaactggtgaaccattcgacaatcgtatttcagttggtgttatgtacatgcttaaacttgcacacatggtagatgataagttacatgcacgttctactggaccatactcacttgttacacaacaaccattaggtggtaaagcacaattcggtggtcaacgtttcggtgagatggaggtatgggcacttgaagcttatggtgctgcttatactttacaagaaatcttaacttataaatctgatgatactgtaggtcgtgttaaaacttacgagtctatagttaaaggtgagaacatttctagacctagtgttccagaatcattccgagtattgatgaaagaactacaaagtttaggtttagatgttaaagtgatggatgagcatgataatgaaatcgaaatggctgatgttgatgacgaagatgcagcagaacgcaaagtagatttacaacaaaagagtgctccagaatcacaaaaagaaactactgattaa

SEQ ID NO: 2440 - DNA, 876 bp, Staphylococcus epidermidis
cttatctattattacagctgctcaagctttacaataatggacttagcaactaaatattttaatcaaatcaactggcgttatgtcgatcattcaagtggtttagagcccatgcaatcttttgcgtttgatgacactttttccgaaagcgttggtaaagatttatcttgtaatgtagtacgaacgtggatacatcaacacaccgtgattttgggcattcatgattcgcgtttaccatttttaagtgatggtattcgttttcttacagatgaacaaggatataatgcaattgttaggaattctggtggcttgggtgtcgtattagatcaaggaattttaaacatatctttgatttttaaaggacaaaccgaaacgactattgatgaagcctttacagtgatgtatttattgattaataaaatgtttgaggatgaagatgttagtatcgatactaaagaaattgagcaatcgtattgcccaggaaaatttgatttaagtattaatgataagaaatttgccgggatttcgcagcgacgagtacgtggtggtatcgcagtgcaaatatacttatgtattgaaggttctggctcagaacgggcattaatgatgcaacagttttatcaacgtgcgcttaaaggggagactactaaatttcactatccagacatagatccctcatgtatggcatctttagaaacccttttaaatagagaaattaaagtgcaagatgttatgtttttattattatatgcactaaaagatttaggggcaaacttaaatatggatcctattacagaagacgagtggacacgttacgaagggtattatgataagatgttagaacgcaatgcgaaaatgaatgaaaaattagatttttag

SEQ ID NO: 2441 - DNA, 771 bp, Staphylococcus epidermidis
catgaatattactgtaacagagttactgaaaggagtgaaataatggcggtttttagagtttacaaagaaactggaaacttcgtaactgtacacaaaaattttattcatgacgataacctaagctggaaagctaaaggaatcttgctttacttattaagccgacctgatgactggcaaatatacgaatcagaattagttagacattcaactgacggacttagtggcctcaaaactggcataaaagaattggagaaagtcggttatattcaacgaactagaaagcgtgatgataaaggtaggttgaaagagtatgaatatgctgtctatgaaaaacctaaccacattcgattttccaacgtaggaaaaacctatataggaaaaacctacgtaggagaatcgcacactactaataataatagtactaataatgatttaactaataataaaaacactaataatgtgacagacgagacatcaaaatcatttcaatatattagtaataatttagaaatcatacaaagtccattaaaagcacaacaactagaagaagctataaaggattttaaagataacaaactagagattgttactgtagctactgattattgcaaagaaaataacaaaggcattaactatcttatcaaagtattagaaaactggagtaaagacggtgtcgatactaaagaaaaagcgatatctaaagttaaacctagaaacaataaagaagataattacctagctaagaagaaacaggaactattaggaggttag

SEQ ID NO: 2442 - DNA, 825 bp, Staphylococcus epidermidis
aacctttactataattataataatgatttattcttaattttaaaaaaatttggtgatgaaatgaataaggatacaattgaaacatctcgtgaagcattgataaaagatgttgttatgattgctgctcgtatattacttgaatctggagctgaaggtacacgggtagaggataccatggcacgtattgctacaaaattgggctatcctgaaagtaatagtttcgtgactaatactgtaattgaatttgttttacataatgaagcatatcctcggttgtatagaattaaaactcgagatacgaacttaataaaaatttctcaagctaatgaaatctcacgtcaaattacaaatggcacaatgacgcttgaagaagctaagtatcaattagaggaaatatatgttgctaaaagagatagcagtctaccttttaaaggaattgccgcagcaattatcgctacgagcttcctctatctacagggaggtcgtctggttgatatcatcacagctgtattagctggaacgattggatacttagtagtagaaatattagatcgaaagctacacgcacaatttattccagaattcataggttctttggtaataggtattatttctgtaattggacatgcatttgttcctagcggagatttagctacaattatcattgcagcggtcatgccgattgtacctggagtactgattacaaatgctatccaagatctattcggaggacatatgttaatgtttactacaaaatctttagaagctttagtcaccgcctttggtataggcgctggtgtaagttcaatattaattttagtctag

SEQ ID NO: 2443 - DNA, 1506 bp, Staphylococcus epidermidis
attatgtactattttgtaggtaataacatcggtcataaaactgctggtatagaaaaagcaatgattaatcgattaaacctatttaaagcatatcattatcaagctaaaatcttattactagcatggaatcgctatttaactcaaacagcatcgcaatatattaatagcgaagattatataaacatgtatgattattttcaagaagcaagtaacgtaacatcagtgttcagtaaaaattggattcattactggagaaatgaatgtggctatactataaaacctgtttctgagacaaatgacgttcggatttatgatcaacaacaatttataatgtatgcgcattttgctgatgaagcttatcaaaaaattgattatattaattactttgatacatctagaagaaaaataaaaagagagttatacgatacacgtggatttttaagttgcgttagagttttatcaacggaccaaaaaatacaagcagagtactatctttctcctcaaggaaacgtgaaaattgaaaagtattatgatattaattcaaatcatccctatgtggcaaaaaagattatattaaatcatttaggtaaaacgcactttttaaacaatgaaactgagctaggtgctttttttattgaaacaatatatcaaagtagtgacttattctttagcgatcgtaacctcgttacatcacatatatttaacatagttgcatcttacatccctgttattgcagtgttacatagcactcatgttaaagatgttactgatttaacgcattcaccaatcaaaaatgtttataaaggggtttttgaacatttacaaaggtataaagccatcattgtttcaacacaacaacaaaaagctgacgtaattgagagaatcagaggagtcattccagtatatgctattccagttggttattcatcttttgaaatgaacgatgactctaataaaaataactatgtttcacctaaaaaaattatttctgtcgcaagatactcacctgaaaagcaattgatacaacaaattgaacttattaataggcttaaagatacgtttccaaatatcgaactacatatgtatggttttggtaaagaagaacaacatttaaaagaacgcattcaagaattaggactagaaaaacacgtaatattaagaggttttttaaaagatttaactgatgaatatcaagatgcatatctaaatttaataacaagtaatatggaaggcttttccttagcattattagaatgtgaatcacatggtgtgccttctatcagttatgatattcaatatggtccaggtgaattgatacaggacggtaagaatggatatttaatagaaaagaataatcaacacatgctatttgaaaaagtaaaattattgctcaacaacccccaacttcaacaatctttttctcaccattgtattgaaactgcacaaaagtattctcaaacacaaatcatgttactgtggaaaaatttacttcaacattttaactaa

SEQ ID NO: 2444 - DNA, 219 bp, Staphylococcus epidermidis
gtcatgttatattctttatacataaggcacccggttaatttagtttattggtatttattaaattatacgaaaaggccttattttttaaagtattttaatataaaattacatataagcacaaagtattttggcgagactcttgagggaacaggacaagctgaagactacaggctgaagctgtcccctaagaaagcgagccaacaatacgaagcattgtaa

SEQ ID NO: 2445 - DNA, 996 bp, Staphylococcus epidermidis
ataatcctatataatacattaaacgcgtgggggggattcataataatgaaatatatagatgagcaaacacaagctcaattattagacatgaatgaagtcattttagaagtagaaaaagctttgcaagctttttcagagaataagacgataacgccattaagatatgttttgccatttaatgagcaaaatcgttatttagtgatgccagcattatcagatgaattaaatatcgttggacttaaaacagtctcatttgcacctgaaaattcaaaaaaagggaaagcgactattactggatcagttattttaagtgactatgaaacaggagaaacattgtctatattagatggtggttttcttactaaagtaagaactggtgcaatttcaggtgtagctactaaatatctagcaaaagaaaacgctaaaacacttagtgtaataggggcaggtgtacaagctgaaggtttaattgaagcgatacttgctgttagagatattgaaaaaattcacatcgcaagtagaacgttcgaaaaagcagaaaaatttgctcaaaatatacgaaatcgatttaatattaaagtgagtgtatttagatcggcagatgaagcgatagacagtgcagatattgtagttacagcaacaaatgcaaatcagcccgtttatactcattctttacatccaggcgtgcatttaaatgcagtcggatcctttaaaccagatatgcaagaaataccttcagaaacaatgcttgttgctaataaaattgttgttgaatctatggaagcagctttagaagaaacaggtgatttaaaaattcctcaagcagaaggaatattaactaaaaatatgctacatagtgaattaggcgacattatttctggtgaaaaagttggccgcgaaactgaagaagaagtgacagtctttaaatcggtcggtctagcaattgtagatatcattgtggcacaatatttttataaaaaattaatacaatcttag

SEQ ID NO: 2446 - DNA, 384 bp, Staphylococcus epidermidis
tggaggaaatataaaatggctaatcaagaacaaatcattgaagcaattaaagaaatgtcagtattagaattaaacgatttagtaaaagcaattgaagaagaatttggtgtaactgcagcagctccagtagcagcagcaggtgcagctggtggcggaaatgctgcagctgaaaaaactgaatttgatgttgaattaacttcagctggatcttcaaaaattaaagttgttaaagcagttaaagaagcaactggtttaggattaaaagatgctaaagaattagtagatggagctcctaaagtaattaaagaagctatgcctaaagaagatgctgaaaaacttaaagaacaattagaagaagttggagctagcgtagaattaaaatag

SEQ ID NO: 2447 - DNA, 408 bp, Staphylococcus epidermidis
tatttagtgtattcaaaagcatctatattaaacatgattgatggatataaaatgaattgtaatatcttagaggatgtagtacctgaatgtgatagtaattctatagcacaatatgggatacaagctacgttacctaaaccacaaggagaaaacggcagtaaagttgaagatgtagtaattagattagaaagaacaaataaaagatacgcacaaatgttaaaagaagttgagttcatcaatcaatctcaacaaaaattagggcatgttgatttttgttttctagaacacctcaagaaaggcagacgtagagataagataatagaaaagatgcctaatgctaaattgaatagaaataattttttagcacgcaaagatgagttagcagaaaagatttatttattgcaatga

SEQ ID NO: 2448 - DNA, 378 bp, Staphylococcus epidermidis
ataatacatcttgatcaatattgctatcagttaattctttgtataagtttgttgttttatcaaaatttgaatcatgataatcatggttatcattttgatgatcatgattgttgtgacgataatcatcatttctatcgtaattgtcttgatagtgtcgatcattataattacgttcatcatgatgagtatggtcgccatcttgagtataaagtgattcatagtcgatatcatcacgttgattatcatattgatgttggcgatgatgctggtcatgatgattatttaaatgcacagaacggttataatcttcgtcattataattgcgattgtagttacgtttgtcattttgataaacatagttatctttgtcttgtctag

SEQ ID NO: 2449 - DNA, 516 bp, Staphylococcus epidermidis
tggttttttcaaacaaaaatcacgtcaattctggacgcaaatgaacatagcaccgtctatggcaaaagaggaagagaaagagtctacgaagaacggtatcgagttcatgaagaacaactacaaagaaatcatgggcgagctaccttactagattattcagaaatacggcagataaccagtcaatacataggctatcttccttatgatgaattaatgagtttgacgcctaatgaatggaaagactgggttatcggtcgtagattggcgttacttgatgaacaagaaactttattgtttggtgctcaagctaacggccttgtacaagctggcaagtcgttaaaacgactacaaaaacagttagagcgtgcaagatacgaagttcgcgggcaatctgatgagtacgaacgtatgaaaaaacgtaagctagcacaaaacaaacgtaatagagaagctcaaaaacaaggtacacgtcgttttatgaattcattacgtaatactagtcaaagaggaggttag

SEQ ID NO: 2450 - DNA, 465 bp, Staphylococcus epidermidis
gagtgcactcatatgttttggatatttaattttatatttagctttcttgcttcactctttttctgtgtcatatttgatgcccctaggaagttgtattttgcttgtggctttgtcggcgcttgtggatggatggtttatactgtattatttaacggctttgaactccatacgatttactcaagctttttcggtagtttagcgttaggtttacttagtcattatatggcccgtcgaaaaaaagagcctgtaattatttttatggttacaggtattatacctctggttccaggaggacttgcttatgatgccactaaaaatttagtgttattacactttggaaaggcgattaacacaatgcttgaagtgacattaatagcaggtgctattgctttaggtttattatttgctgatcaaatttctaaaatcgttatttcaggttttgctcgtaccagaaaaagattgtaa

SEQ ID NO: 2451 - DNA, 489 bp, Staphylococcus epidermidis
gggagaagtcacatgtatagtgtcagacaagcaactgaaaaagatgttgtagcgataagagatgttgcgacaaaagcttggtataacacatatttaaatatttatgctgcttcaacagttaatgaactgttggccgcttcatataatgaaacgcatttaaaaaagagactaaatgagcaattatttttagtggcagaagaagatagtgagattgttggttttgcaaatttcatttatggtgaagagctttatttatctgcacactatgttagacctgaatctcaacatagaggttatggaactcgtttgctagaagcggggttgaaaaggtttaaagaccagtatgaaacagtttatttagaagttgataacaataatagtaatggcatcgaatattatcaaaatcatggattcgagattattcgctcatatcaacctgaaatgtatggtgaaatcatggatttagctttaatgaagaaatcattttaa

SEQ ID NO: 2452 - DNA, 393 bp, Staphylococcus epidermidis
tacgtaaaccaaggaaaaagcaaaacgaaacaatcagattcaccagctttaaacagaggtttcaatagtaaaaagaaacaatttactaacttaaactcacctcaaaaacgtggtgtatgtactcgtgtaggtacaatgacacctaaaaaacctaactctgcgttacgtaaatatgcacgtgtgcgtttatcaaataacattgaagttaacgcatacattcctggtatcggacacaacttacaagaacacagtgttgtacttgttcgtggtggacgagtgaaagacttacctggtgtgcgttaccatatcgtacgtggtgcacttgatacttcaggtgttgatggacgtagacaaggacgttcattatacggaactaaaaaaccaaaaaattaa

SEQ ID NO: 2453 - DNA, 939 bp, Staphylococcus epidermidis
ttgatattacatgatgttgaggtatacaaaaataaagaacgtttgcgtattagtaacaatcgctttactggtactgcgttgagagttgtttcttacgatgttaaaggtgcaggctatgaccgaaagtttgatgaaattgatcgtgttaacggtagatttcataatgctactaaagaagaaaagaaaagtatatctatgacggttaggtacgatgtagaaaagatagcttacgcttctcatttaaaagcgaacatacaagctatgctaagaggtcatttttatcttagagaattagcaacgtccgaaagtgaagttaaattcgagaatatattcgaacctaaggaacaatcttttgaactagaatatgttgacggtaggcagatacttgttggcttagttaatgaagtgtcattcgatactactaaaacgtcaggtgaattcacactagatttcgaaacgattgaattaccatactttgagagtattgggtatagtacagatttagaaaaagagagtggtaatttgaataaatggggtattccagacaaaaacccgttcaacacatctcataaagaacgtagatacacattctatgatactaaagtaggcgatgtatattacggtggtacagctgaaattaaccaattcaaccaagatagtgttgtagaaatgacacttggagaaaatgtcagtaaaaatgatagcgatggttttaacttctatatgacacatagtgacattatgaaaataagtggattagaattgagagccggtgatgttatcaaatttgacggcattcatgtatatcgtaataacttacgcattgatgattacaataagacgaaacaacaacctgtgttaatgcctggttggaatactttccatactactaagaaacttcaaaaaatcacgtttaaacacaaaagatattacttgtaa

SEQ ID NO: 2454 - DNA, 834 bp, Staphylococcus epidermidis
catatggcacaaggaacaacaactaaaagtacacaaatcgttccagaagtattaaaacctatgatgcaagcagaattagataagaaattgagatttgcacaatttgcagacattgacagtacattagtaggacaaccaggcgacactttaactttccctgcatttgtttacagtggtgacgctacagtagtacctgaaggacaaaaaattcctgtagacaaaattgaaactaacagacgtgaagctaaaatccataaaatcggtaaaggtactgatattactgacgaagctttattgtctggttatggtgatcctcaaggcgaagcagtacgtcaacatggattagctattgctaacaaagtagataatgacgtattagaagctttacgaggtactaaattaactgtaagtgcagatattggcacattagcaggtttagaagctgctatcgatacattcgatgacgaagatttagaaccaatggtattattcattaaccctaaagacgctggtaagttacgctctagtgcttctgcaaacttcactcgtgcaaccgaattaggcgacaacattatcgttaaaggtgcatttggcgaagctttaggagctgttattgtacgttctaagaaattagatgagggcgaagctattttagctaaacgtggtgcagttaaacttatcactaaacgtgatttcttcctagaaactgaccgtgatccttcaactaaaacaactgctctatacagtgataaacactatgtagcatacttatatgacgaatctaaagcagttaaggtaactaaaggcgcaggaactacagactcaggtgcataa

SEQ ID NO: 2455 - DNA, 741 bp, Staphylococcus epidermidis
atttcaatgcaaatacaacctgaattctttgagaagttaaaaccccgttattctgataacggggtttttcaattaattaatacaagcatactaaatgcttttggattgaatgataaaattagaggtgaagaaatgagtcattattatgatgaacaacctgatgttaaaagtaacccaaaaagaattagttatcaaattaaaaatgtgcaactagaacttactactgatgctggagttttttcaaaagataatgtggattttggatcagacttactaattaaaacttttttgaaagaacatcctccaggcccaagtaaaaccatcgcggatgtaggatgtggatatggtcctatcggtttagcaataggaaaagcatctccacaccatcaaattacaatgttggatattaacaatagagctttggcgttggcagaaatgaataagacaaaaaatcaagtggataatgtaacgattatggaaagcgattgtttgtctgctgtcaatcatcagtgctttgattacattttaactaatccccctattagagctggtaaggacattgttcatcgaatctttgaacaagcgtttgacagactcaaaactacgggtgaactttatgtcgtcattcaaaaaaagcaaggtatgccttcagctaaaaagaaaatagaagaactatttggcaatgtagaaattatagctaagagtaaaggatattatattttgaaaagtataaaaggttga

SEQ ID NO: 2456 - DNA, 1803 bp, Staphylococcus epidermidis
atacaaacgcaatgttgggatttaccaaactacattttcaatagatattggcattttaaaacaacaggaaatgcgattgctatggcatggtatagatatcctaaaggcttcaaattctataggaacactagaaactttgttccgaaacctggtgacatggcagtttggggaaagggctcctttaataacggtgttgggcatactgctgttgtcataggtccatctaccaaaagttactttactagtgtggatcaaaattggattggtgcaaatagttatacaggctcacctggtgcgaaaattaaacatagttataacggtataagtgggttcgtcagacctccctaccacgcagaaactaagaaaccatcgaaaccaagtagtacaccgtccaaaccttctaatgacaacactcctaaaaacacaaaagaacaaacaaaacctataactaaagagattaccaaagtttcctatacatcattcgcatacgatttagacgatgatttggaatatatttatcattacatggttgaagggcaaaagttgatagggaaggtaaaaggtatatatatcaaagagagtacacatatgcgttctgttgaagaattgtatttacaacgtaataaatatgtgaatgaagatgaataccctcatgtatatattgaccgtgagcgtgtatggacacctagacctgattcagaagaagcaccagaacatccaggttggcttgttatggaagtttgcggaggacaaacggatagcaaacgccaattcatgctcaatcaaatcagagcgttaatctacggcgtttggttgttaagttggagtaaggtgaaactttctgaatcgtcaatcaaagcagatcctaacatatggcgttctatgaaagatttaatcaattacgacttaatcaaaaatggtattcctgatgaaagtaaatataaagaagtcgagaagaaaattatcggtttatatttgaaaagagataaattacttacagaaacaattactacaacaactacaaagacaaagataaaaattaaacctaaaacttcggtcgacaatccttcacagaacgataagtcgacaggtaaaacgacaaacagaacttcaaataaacctcgtgtagttgtagagaaaagtaaatatactttccaacaagcgcttaatgcacaaatggctcatggcatgcctcaaaaatcttatagttggggttggggtaatgcttctaggtcacaaacaagtaagtatatgaatcctaacactatatggaatagttcaactcaacgctatcaaatgctagatttaggaaaatatcaaggtatatcagtaagtaagttgaataagatacttaaaggtaaaggcactttatctggacaaggtaaagcttttgcagacggttgtaagaagtacaatgtaaatgaaatttacttaatcgctcacgctttcttagagagtggatatggccgtagtaactttgctagtggacgttatggtatctacaactactttggtattgcagcttacgacaacaaccctaacgcttctataggatacgctagacgtcaagggtggacgagtccacgtaatggtattataggtggcgctaagttcgttaggaaacaatactttaacaaaggtaaaaacacattatacagaatgcgttggaatcctagcaatccaggtcgtatgcaatatgctactgctatcgaatggtgtaatttccaagcatcaaccattagtaaattatacaaaacagttggtacaaaaggtatgtactacattcgagataaatatagataa

SEQ ID NO: 2457 - DNA, 543 bp, Staphylococcus epidermidis
cgaatggcgcagaataaatacattgcagcgttacaaattgctgacaaagatttagcgagcaagctaaaagaagaagatgctattctgttagctagtttagctgagggtggacacacaatcagcaatgacttagctgaaatgattacaggtggcaaaaaagactacggtcgtaactctgtagaagaagaaatcaagttaactgttgaccgtgtacctggcgacaaaggtcaagaagctttaaaagagtcagttaaaaacttcaaacagttacgtttatggatttgggaagttaaaaagcgtgatggtaagcatcatggtacttttgcttatgtaattatagaagaacaagaatggtcatttgatgatgaggatgacaaaatcgaaatcactgcaaaagttaaatttaacagtgctgacggttctgttgactcattaccaccagaatggcttaaccctagtgctgctgctcctacagttgaatttgaaggcatgggtgaatatacaggaacgtatgaagaacgtacacctagcgctggtgcataa

SEQ ID NO: 2458 - DNA, 675 bp, Staphylococcus epidermidis
tataactttaactatgaggtgaacatcatgaattttgatagttatatttttgattttgatggaacgctaattgatacaacaacatgtcacgtcaaagctacgcaaagcgcttttaaaagattaaatttagatgaacctacagaacaagctattttacatacatatcatttaaatttatataacaattttaaagcgctagcttcacatgaactgtctttttatcaaatagaaaaattaatagatgaatacaatcattgttttagcaacgatgaaatacatcaatcaaaagaatataccggaataagtgaagcattaaaatttttacataaccaaaagaaaaaaatatttgtagtgtctaataaagaaatactaacaactcaaaagtatttagattatctcggattaagccgttttataactgattcattaggtgtctgtattaaaaatgaagacaaacttctttgtgaaacgattcaaaatttgatacagaaacatcatttaatgataggtaaaaccgtgtatataggggacacagcacagaatatcaagagtgcgaatcaagctcatgtgcaaacatgcgctgtcacatggggagcacaatctgcacacgaattgttgcatgaaaatcctcattatattgttaatgatccagaagaatttttaacaattttataa

SEQ ID NO: 2459 - DNA, 411 bp, Staphylococcus epidermidis
gaggttattaatgtgatttggataagtttttcatcggtaataattgtgttagtactgtgtatttttgctatatataagtggattaaagcagagaaaagagttaatgagttacaggaagataaacatggattgcaattagataagttacatttagaaagagaggtatcttggttgaaaaataaggataataaaaacaacataggcaaatacgtggttgagttaaaaaaaggagtatatttagtgaaaaaatatataggtagttatggaaacacatgcataatcactgacaatgtatttgaagctttatcttacgacgatttatattcagctaaagaagatgcatgtagttttaacggacgtgtactagaacacaaacctaatttagaggtggtcaaacaatgtggggcgtaa

SEQ ID NO: 2460 - DNA, 1011 bp, Staphylococcus epidermidis
gagagaattaaggaggatattatggctgatttattatctgtattacaagacaaattatccgggaaaaatgtaaaaatagtattacctgaaggtgaagatgaacgagtgctcattgctgcgactcagctacaaaaaactgactatgtttcacctatcgttctaggaaacgaagataatattaaatctcttgcttctaaacacgctttagatttaactcaaattgaaatcatagatccagcaacgagtgaacttaaagatgagcttgtagatgcttttgttgaaagacgtaaaggtaaggcaactaaagaacaagcagttgaattattagataatgtaaattatttcggaacaatgcttgtgtatactggaaaggctgaaggtttagtgagtggtgctgcacattctactggagatacagtcagaccagcattacaaattatcaaaactaaacctggtgtatctagaacatctggtattttctttatgattaaaggcgacgaacaatatatttttggagattgtgcgattaatccagaattagatgctcaaggacttgctgaaattgcagtagagagtgctaaatcagcacaaagctttggaatggaccctaaagtagctatgttaagcttttctacaaaaggttctgctaaatcggatgatgttactaaagtgcaagaagcattgaagttagctcaagaaaaagctgaagcagatcaattagatcatgtagttattgatggagaattccaatttgacgctgctattgttcctagcgtagcagagaagaaagcacctggtgcaaaaattcaaggtgatgcaaatgtatttgttttccctagtctagaagcaggtaatattggttataagattgctcaacgtttaggtggatacgatgcagtaggaccagtcctacaaggattaaactctccagtcaatgatttatctcgtggttgctcaactgaagacgtttataacttatctattattacagctgctcaagctttacaataa

SEQ ID NO: 2461 - DNA, 195 bp, Staphylococcus epidermidis
gtaatggctaacagagaagaaacaattgaagttgaagcaacaatcaaagtgagatgtaaatatccagtatgggtaaacaatcaaattactgcaagtgatgaaaaggaacgcattttagatttaatcagtaagaaccctgaaaaagagttaatgagcgaagattttgaactagttgaattaatagaggtggagtaa

SEQ ID NO: 2462 - DNA, 816 bp, Staphylococcus epidermidis
aatgaatataaattaattagatttagacagagaaacttttttaacgtatgttttttctgtctttttttatttacacaactaagaataaggagagataaaatgatttatgcgggtatattagcaggtggtattggttctagaatgggaaatgttccattacccaaacaatttttatcattacaaggaaaacctattattattcatacagtagaaaaatttttaatgtataaggactttgatgaaatcatcattgccacgcctcaaaagtggatcaattatatgctcgatttgctaaacaattatcaattagacgataagaaaataaaagtaatacaaggcggagacgaccgaaatcactctataatgaatattatagaaagcattgagcaacataaaaaattaaatgatgaagatataatcgttacccatgatgcagttaggccatttctaacaaatcgaattattagagagaatgtggaatatgccagtcaatatggtgcagtagatacggttgttaatgctgttgatactatcatttcttcaaatgatgcacaatttatttctgggattccaataagaagtgagatgtatcaaggacagacgcctcaaacttttaaaataaaagagttaaaggatagctatttatcgttaactcaatctcaaaaggaaatattaactgacgcgtgtaaaatactcgtagaattgggtaagccagtaaaattagtcaaaggagagttatttaacataaaaataacaacaccatatgatttaaaagttgcgaattcaattattactggagctgttgataatgattaa

SEQ ID NO: 2463 - DNA, 294 bp, Staphylococcus epidermidis
cgtatgtataaagtaatcgaatatttcgaagacttacaagatgacaactacgagtataacgtaggaaaaacgttccctcgtaaaggtttaaatgtaagtgatgagcgattaactgaactatccacaaaagaaaaccgtcagaataagcctcttattgaacgtgtagagagcgataaagacttaaaaggtatgaaagtatctgagttaagagaactcgctaaagaacgtgaaatagagggcttttctagtatgaaaaaagatgaactcgttgaagcattaggaagtgttaagtaa

SEQ ID NO: 2464 - DNA, 1404 bp, Staphylococcus epidermidis
tgtaaacataattatataaagtgtttacaaatggtgatgaagatgaaaaaaataatggaatatttacagcattatattaatcaatacccgcatcgattagctttagtgtttgaagatcgacatctaacgtatggagaattaagtaaagaaatttatcaggctagtatgcgctataaagaagtaaaattaaacaaaaaagtaggtctaatggatgaacatcctgtaaataatattattaactattttgcggtacatcaaagaggtggaattccttgcatttttaatcatcaatggagtaatgaaaggatacatcaacttgtaaaaagttatgacatacaatggttaattaaagataatcatcttacctcaaatcatgataactcaatttataatgatgaggttatcccacgtaatgttatacatataggtttcacgtcaggaactacaggtttacccaaagcgttttatagaaatgaacattcttggatagtttcttttaaggaaaatgagaaattactccagcattgtgaagaaaccattgtagcaccgggtcctttatcacattcactttcattgtacgcatgtatttatgcattaagtactggaaaaacatttataggtcaaaaaaattttaatccactatctcttatgcgtcttattaatcaattgaacaaaacgacagcaatatttgtagtgccaacgatggtacaacaacttatttcaactcaacgacattgttcatcgattaaaagtattttgagtagtggtgctaaacttacattgcaacagtttcaacaaatcagaaatttatatccacaagcaaatttaatagaattttttgggacatctgaagcaagttttataagctacaattttaaccaatcatctcctgctaattctgttggtaaacttttccctcatgtcgagacacgattattaaatcaagatgatgatgcagtaggattattagccgttagaagtgaaatggtgtttagtggttatgttggacaaagcaatcaagagggggcatggattaaaacaggcgacttcgcttatattaaaaatcaacatttgtttttagtaggtagagagagtgatcgtattatagttggggggattaatgtatatccaacagctattgaaagcttaattatggatattgaaggcattgatgaggcccttgtcattggtataccacatgctaaatttggagaaatagcgatattgctttattcaggtaaagtacaattgaattaccgacaaattaaatcttttttaatgaaacatctttcaagacaagaagttccatcaaaattaaagaaaattgaccatatgatttatacagaatcaggaaagattgctagaaaagagatgaaaaataaatttattaatggagagttataa

SEQ ID NO: 2465 - DNA, 489 bp, Staphylococcus epidermidis
tcgatgagtaaattatttgaattaaaagatagttaccaacaagtttacgaccttattgcagaacaagaagatgaacaaattttaaaagatacgctagcaagtattaatgatgctatcgaagataaagcagatggatatgtagcagttattaaatctttagaagcagataacaatgctatagatgaagaaataaaacgtttaagacaacgtaaaacttctaatcaaaacggcgtcaaacgtttaaaagaaagcttacaggaagttatggagcagacaggtaaagaaaagtttaaaactgcgcttaattcgtacagtatcgctaacaatccacctagcttagatgtcacagatgaaagtttgatacctaaacaatactacatcgaacagaaaccaaagttagacaaaaaagagttattgaaagctataaaagacggtttagaactcaaaggagtagaactaaaacaaagtagaagtttgagggtgagatag

SEQ ID NO: 2466 - DNA, 204 bp, Staphylococcus epidermidis
tttaaaatcaatcgactcaattcatcattattcattttcttaagttttggcaagcgaatgataaaaaagattaatcctattaccaaccaaattcctaaagcgatgtatgatggtatcgaaagtgctgcaggagaacctggaataagcaataaacataagaacacaaaggatacaatcgatcctataataccaaaaattttataa

SEQ ID NO: 2467 - DNA, 426 bp, Staphylococcus epidermidis
aagagtgtcctattggctaaggttaaatacggtaattgggacttagttaaggaacttgaggagttcgaaaaagaaacgattagatgggctaaaaaaggtatagctaagacaacgacaattattcacaattcaatagttagcaacatgcctgttgacaccggttatcttagagaaagtgtttctatggactttaagaaaggtggattaacaggggttattaatattggtagtgaatacgcagtgtacgtcaactatggcacaggtatatacgtggttggtccaggtggtagtcgtgcaaagaatatcccgtggcgttataaagacgcagacggtcactggcacacaaccaaaggacaacatgcacaacctttttgggagcctgccattgacgaaggtagagcgtttttcaataagtatttttcataa

SEQ ID NO: 2468 - DNA, 222 bp, Staphylococcus epidermidis
gttaaatacaaacgcaatgttgggatttaccaaactacattttcaatagatattggcattttaaaacaacaggaaatgcgattgctatggcatggtatagatatcctaaaggcttcaaattctataggaacactagaaactttgttccgaaacctggtgacatggcagtttggggaaagggctcctttaataacggtgttgggcatactgctgttgtcatag

SEQ ID NO: 2469 - DNA, 954 bp, Staphylococcus epidermidis
atggcgaacaacaaagacaatccaaaaataaccaaccagaatgacatcgacaattacatcgacagacttgttaatcaagctaataaagaaatcgaaactctgtttgctaaacgtttgaaagaaatcaaacagattattgcaaatatgtatgaaaaatacgatagagatgaaccacaagtgacgtggactgaattcaataaatacaacaggctcaacaaagaacttaatcgtataggacaaatgttgtcacaagactatagagaggtcgctaaggctatcaaacagtcgcaacagaacatctatatagaaaagtacatgatgagcctatttttgtatgaagtagcaagtcaaacgtctatgaactttgatataccaaccacacaaacgatacagacagctatagaacaacctatcgagtttattaagctggtacctacattacagaaacatcgtgatgatacattaaagcgtattcgtatgcatatcacacaaggtattatgagtggcgagggctactctaagatagctaaagcgttaagagatgacttagggatggcaaaggcgcaatcagtaagagtagcacgtacagaaacaggacgtgcattgtcacaagcagggttagatagtgcaatggtagctaaagacaatggactcgatatgaagaaacgttggtattctactaaagatacacgcacacgtgatacacacagacacttagacggcacttcagtcgatatcgaagataactttcattctagtggttgtgtaggtcctgcacctaagttgtttgtaggtgtagctagtgcaaaagagaacatcaattgtcgttgtaagcttctttattacatagacgaagatgaattaccaacaacgatgagaactaaagaagatggcgctattccatttactacatatcgtgaatgggagaaagataaacggaaaggtggtgtttga

SEQ ID NO: 2470 - DNA, 243 bp, Staphylococcus epidermidis
aaggagttaaaaatgaattcgagagtaataactaaagaaaacaagaaagaaatagctcatagaatcaaacaaataagattacaaagaaattttgatataaacgaattcgctgaaatcttatatgtttctcctttctctataaaacaatgggaagaaggcaaaagaattcccaatatcaagaaaataaaattaatagcattcgttttcaagacaacacctgaatggctattgtacggggagtga

SEQ ID NO: 2471 - DNA, 336 bp, Staphylococcus epidermidis
aagagaataaataaaatcgagtcaacgcaatgcgttggctttttaatttatctaaaaggagatatgagtatgaaaacagatgtaggttcaattgtaagaacaatcgtatttattttagcttgggttaaccaatttttagctacgaaacatatttcacctattccggtagacgaagtgactatcagttctattattactggtgcaatttctttgtggacttggtggaaaaacaataatttctctcacgcagcacaaaaaggacaacaaaaattgcatgaagttaaagcaggtacagaaaacacaaatggtaaagcaccaattggaggtaatgattaa

SEQ ID NO: 2472 - DNA, 378 bp, Staphylococcus epidermidis
aggatggtaaagattaaaaagaaagttgaaatgacattaccagaattgattgagtgggcttggaagaatggtgttaaagaaaaagcgttttatagcaatattgacagaggttctgtgtattttgacatggtgcaaacagtgtcgatagagtattcaatcgttgtagatgaaactttcacagtagaagttgaagaagaagttacggaagaaacaaagataccagaaatgttggaaatatttgtaaatggtggtggagttaaacgggttgaaaaatctatcaatgaactaaaagatgattttagcaaagaattttggttgaaagatggagatacaatgacactcatctggaaagatggcgaattggtcggtgatgagtaa

SEQ ID NO: 2473 - DNA, 204 bp, Staphylococcus epidermidis
atttttacaaagataaaaatattacagatgttttggcagatattttacaggaggggtaaaaccatgaaaaattatgatttgattattattggttttggaaaagcaggtaaaacattagcggcacatgctgctagtcacggacaaaaggttgcagtggtagaacgatccacaaagatgtatggcggtacatgcattaatatttaa

SEQ ID NO: 2474 - DNA, 1386 bp, Staphylococcus epidermidis
ttaatgacaaataaaactagaagtcaagcgcatgcttatttagacaggttaaaaggttattggtgggatttcgacggtgtttatggcgcacaatgttttgatttagccaatcaatattggtactacgtaacaggtcatactttaagtggtatgtacgctaaagatataccttttgttaatgattttaacggatacgcgaatgttgtaaaaaattataactcttatattcctaaaaaaggtactttagttgtttttccttacgaatatggtaacggatgtggtcatgttgctattatagaaagtgctactcaaaattatttctatagtttggatcaaaattggtatggcggggcaagaaataatccgccagaggttgctcaaacaatataccacgaatatcaccctgatatgtattttgtagaacctctgtattctaaagaaacaaaagtaagtaaaattaaagcaaaaacaactaaacctaaacctgtaaaaaaagttaaaaaaagaaaagtgatgatcgttgctggtcatgggtataatgatcctggtgctattggtaatggttataacgaacgtgattttataagaaaaaacattgttgataatgtatcaaaatatttgaaagatgcaggacatactgttggtatatatggaaaaaagcaagatatgtatcaggatacagcctatggagtaagagtcggtaatcacagagattatggcttatattgggtaaaatctcaaggatatgatactgttattgaatttcatttagatagtgcaggtcctaaagctacaggtggacatacaatcattccagccggttatcctgctaatataacggataaaaacatccaagcagcactaaaacaaagtgttggtactataagagggataactcaacgtaacgacttattaaactgtaatgttgctaatgatattggtatagaatatagacttgttgaattggggttcattacttcatataaagatatgaagtatattaatgaaaatataaaacctttcacaaagtcaatagcaagcgatattaacggcaagccaattggaggtacaagtgcaggtaaagttaaaagtgtaaaaaaaacatgggattggaaaggtagattttatccgaacacaacaattaaagttagaaaaaaacccaacggcgaaattgtagaaaaaggttcttggttgtacggaaaagacgattgggtagatattgttcaattatacaaagacactaagaaaaaattatggtggggtaaattcaaatatccaaccaatcctagttctggttatttttattgtgctttaggtgaaatcaccgacaaacaagaacgaataaaaaaagaaaagaaattatatggaaagataaagtggcagtga

SEQ ID NO: 2475 - DNA, 213 bp, Staphylococcus epidermidis
gttcatcccctaataaacaatgacattttaatagagtctgatatagttgtcacattgtgtagtgatgcagatgcaaactgtccagttttacctaaaaacgtcactaaagaacattggggatttgatgatcctgctggtaaagattggtcagaatttcaacgtgtaagagatgagattaaagcagcgatcgaaacatttgctcatagagtgtaa

SEQ ID NO: 2476 - DNA, 591 bp, Staphylococcus epidermidis
aagcagcaaaacaatgtagagcagctattgaaggtaaataagatgagtgaatttaataattatcgtcttattcttgaagagttagattctactttatctcaagtagataatacagagtatgaacgttttgctaatgatgttataggtgcagatcgcatatttacagctggtaaaggtcgttcaggttttgttgctaatagttttgcaatgcgcttaaatcaattaggtaaaaatgcctacgttgtaggtgagtcaacaacaccttcaattaaagaacatgatttgtttattattatttcaggttcaggttctacagaacatttaagattattagctgaaaaagcacaatctgagggtgcaaaaattgtcttattaactacaaatgcggaatcgccaatcggtaatcttgcagagacggttgttgaattgcctgcaggtactaaacatgatgttgagggttcgaaacaaccacttggtagtttatttgaacaggcttcacttatattcttagatagtgttgtattacctttaatggatgcatttcacattagtgaaaaaacaatgcaagagaatcatgctaatttagaataa

SEQ ID NO: 2477 - DNA, 2793 bp, Staphylococcus epidermidis
ttaaaaaaaaataatttactaactaaaaagaaacctatagcaaataaatccaataaatatgcaattagaaaattcacagtaggtacagcgtctattgtaataggtgcaacattattgtttggtttaggtcataatgaggccaaagctgaggagaatacagtacaagacgttaaagattcgaatatggatgatgaattatcagatagcaatgatcagtccagtaatgaagaaaagaatgatgtaatcaataatagtcagtcaataaacaccgatgatgataaccaaataaaaaaagaagaaacgaatagcaacgatgccatagaaaatcgctctaaagatataacacagtcaacaacaaatgtagatgaaaacgaagcaacatttttacaaaagacccctcaagataatactcagcttaaagaagaagtggtaaaagaaccctcatcagtcgaatcctcaaattcatcaatggatactgcccaacaaccatctcatacaacaataaatagtgaagcatctattcaaacaagtgataatgaagaaaattcccgcgtatcagattttgctaactctaaaataatagagagtaacactgaatccaataaagaagagaatactatagagcaacctaacaaagtaagagaagattcaataacaagtcaaccgtctagctataaaaatatagatgaaaaaatttcaaatcaagatgagttattaaatttaccaataaatgaatatgaaaataaggttagaccgttatctacaacatctgcccaaccatcgagtaagcgtgtaaccgtaaatcaattagcggcagaacaaggttcgaatgttaatcatttaattaaagttactgatcaaagtattactgaaggatatgatgatagtgatggtattattaaagcacatgatgctgaaaacttaatctatgatgtaacttttgaagtagatgataaggtgaaatctggtgatacgatgacagtgaatatagataagaatacagttccatcagatttaaccgatagttttgcaataccaaaaataaaagataattctggagaaatcatcgctacaggtacttatgacaacacaaataaacaaattacctacacttttacagattatgtagataaatatgaaaatattaaagcgcaccttaaattaacatcatacattgataaatcaaaggttccaaataataacactaagttagatgtagaatataagacggccctttcatcagtaaataaaacaattacggttgaatatcaaaaacctaacgaaaatcggactgctaaccttcaaagtatgttcacaaacatagatacgaaaaaccatacagttgagcaaacgatttatattaaccctcttcgttattcagccaaagaaacaaatgtaaatatttcagggaatggcgatgaaggttcaacaattatcgacgatagtacaatcattaaagtttataaggttggagataatcaaaatttaccagatagtaacagaatttatgattacagtgaatatgaagatgtcacaaatgatgattatgcccaattaggaaataataatgacgtgaatattaattttggtaatatagattcaccatatattattaaagttattagtaaatatgaccctaataaggacgattacacgacgatacagcaaactgtgacaatgcaaacgactataaatgagtatactggtgagtttagaacagcatcctatgataatacaattgctttctctacaagttcaggtcaaggacaaggtgacttgcctcctgaaaaaacttataaaatcggagattacgtatgggaagatgtagataaagatggtattcaaaatacaaatgataatgaaaaaccgcttagtaatgtattggtaactttgacgtatcctgatggaacttcaaaatcagtcagaacagatgaagaggggaaatatcaatttgatgggttaaaaaacggattgacttataaaattacattcgaaacaccggaaggatatacgccgacgcttaaacattcaggaacaaatcctgcactagactcagaaggcaattctgtatgggtaactattaacggacaagacgatatgactattgatagcggattttatcaaacacctaaatatagcttagggaactatgtatggtatgacactaataaagatggtattcaaggtgatgatgaaaaaggaatctctggagtaaaagtgacgttaaaagatgaaaacggaaatatcattagtacaacaacaactgatgaaaatggaaagtatcaatttgataatttaaatagtggtaattatattgttcattttgataaaccttcaggtatgactcaaacaacaacagattctggtgatgatgacgaacaggatgctgatggggaagaagtccatgtaacaattactgatcatgatgactttagtatagataacggatactatgatgacgactcagattcagatagtgattcagactcagatagcgacgactcagactccgatagcgattccgactcagacagcgactcagattccgatagtgattcagattcagacagtgactcagactcagatagtgattcagattcagacagcgattccgactcagacagtgactcaggattagacaatagctcagataagaatacaaaagataaattaccggatacaggagctaatgaagatcatgattctaaaggcacattacttggagctttatttgcaggtttaggagcgttattattagggaagcgtcgcaaaaatagaaaaaataaaaattaa

SEQ ID NO: 2478 - DNA, 300 bp, Staphylococcus epidermidis
tttatgaaaaaaataataatcactggagcacttggtcaaattggtactgaattagttattaagtgtagagaaagatatggaactgaaaatgtattagctactgatataagaaagccagaaccacactctccagttaaaaacggtccttttgaaatcttagatgttacagatagaaatcgtttatttgaaacagtgagatatttcaatgctgatacacttatgcatatggctgcactgctttctgctacagcggaaaagaaaccactagttgcctgggatttgaatatgggggacttataa

SEQ ID NO: 2479 - DNA, 222 bp, Staphylococcus epidermidis
ggtaaagaaaagtctattttagttccaagtctacttttaaagaagctaattttcgatgagaacacaaatttaattacggaaaaaataggtgatgataataacataacttgtaacttaataaaggtagtgttttacttatactgtatacataataaaattaatatctattttgaatatttagaaaattcattgaatagtagaatcacgattgatataatttag

SEQ ID NO: 2480 - DNA, 495 bp, Staphylococcus epidermidis
aacgtaagaaaccacatttattcacagtgcctcaaaaacaccctcgtagtgaatggtgtacgtaccttatggaaaatgacatcttccctagaaaggttgcgaaatgatatgaatataaaattaataaaagaaaaaatcgacaatgaaaataaaagaatgggaagcgagttggaatacactttcaaatataaaggccataaatgtaaggtgaaacgcattgaagaatatggtcatttgtgtggatatatatatttaaatgtcaaaagaggaagcgaagaatatgaaattatagatgagttggcgcattgcggtgtatcttatcacaaaggtaacttgataggttttgattgcgcgcatgcaggagacttttcactgcgtatgtataatctatttgaaaataaaacttatctaagcgatttagaaacatataaagatcttgaatatgtagaaaataacataaaagaaatcatagactctttgcaaaagggtggttaa

SEQ ID NO: 2481 - DNA, 564 bp, Staphylococcus epidermidis
aatgttggaaaacaaagaaaaatgacatattttaaatggcaagataaacatgtgaaatttctaaaagaaaatgcgaatggtaacaattcagaagatttaacgcaatctttcaacaatagattcgggacaaatcaatctaagtcgtctcttaagtccaaaatgtatcaaattggaattaaattcaataacaatacaggaagatttaaaaaaggtgatcattcttataatacttatgcaattggaactaaaagtattgataaagacggatatgtaattattaaacattcaaattctaagggagactataacaaaaattggaaactctatcatcattacttatgggagcaaaaacatggaaggattccggaaggttatgtagttatttttcttaacggggacaacagagattttagaataaaaaatctttattgtgttgagcgtggagtatggttaaaagttatcaataacgatatgagattcgataatccagaattagttgagtctgctattcatctatcaaaattgatgatcaaacaaaaaaatatagaaaaaaggagacgatga

SEQ ID NO: 2482 - DNA, 3648 bp, Staphylococcus epidermidis
tctaaattgaaggaggtaggctccttgattgatgtaaataatttccattatatgaaaataggattagcttcacctgaaaaaattcgctcttggtcttatggtgaagttaagaaacctgaaacaataaattaccgtacacttaagcctgaaaaagatggtctattctgtgaaagaattttcggacctactaaagattgggaatgtagttgtggtaagtacaaacgtgtacgctacaaaggtatggtatgtgatagatgtggcgttgaagtaacgaaatcaaaagtgcgtcgtgaaagaatgggtcatattgaattagcagcacccgtatctcacatttggtatttcaaaggaattccaagtcgtatggggctattattagatatgtctcctagagcattagaagaagtaatatacttcgcttcatatgttgtagttgatccaggaccaactggacttgaaaagaaaacattattatctgaagctgaattcagagaatattatgacaagtacccaaatcaatttgttgccaaaatgggtgcagaaggtattaaagacctattagaagaaattgatttagatgaagaattaaaagagttacgtgatgagcttgaatctgcaacaggtcaaagattaacacgtgcgattaaacgtttagaggtagttgagtcatttagaaattctgggaataatccttcttggatgattttagatgtattacctattataccacctgaaattcgtccgatggttcaattagacggtggacgtttcgctacaagtgatttaaatgacttgtatcgtcgtgttatcaaccgtaacaaccgtttgaaacgtttattagaccttggagcaccaggtatcatcgttcaaaatgaaaaacgtatgttacaagaagcagtcgatgctttaattgacaatggtcgtcgtggtcgccctgtaacaggaccaggtaaccgtccattgaaatctctttcacatatgcttaaaggtaagcaaggacgtttccgtcaaaacttactaggtaaacgtgttgactattcaggacgttcagttatcgcagttggaccaagcttgaaaatgtatcaatgtggtttaccaaaagaaatggcgcttgaattatttaaaccattcgttatgaaagagttagttcaacgtgaaattgctacaaacattaaaaatgctaaaagtaaaattgaacgtatggacgatgaagtttgggatgtgcttgaagatgttataactgagcatccagtactattaaaccgtgctccaacattacacagattaggtattcaggcatttgaacctactctagtagaaggtcgtgcaattcgccttcaccctcttgttacaactgcttataatgcagactttgatggtgaccaaatggctgttcacgttccattatcaaaagaagctcaagctgaagcacgtatgcttatgcttgcagcacaaaacatcctaaaccctaaagatggtaagccggttgtaacaccatcacaagatatggttttaggtaactattacctaacattagagcgaaaagatgccgtgaatactggtgcaatctttaacgatactaatgaggttttaaaagcttatgcaaatggttatgtacatctacacactcgtattggtgttcatgctaattcattcaataatccaacgtttactgatgagcaaaatagcaaaattttagctacatcagtaggtaaaattattttcaatgaaattattcctgattcatttgcatacatcaatgaaccaagtcaagctaacctagaaagaacgacacctgataaatactttgttgatcctacgcaattaggtgaaggtggactaaaagaatactttgataatgcagaacttattgaacctttcaacaaaaagttcttaggaaatatcatcgcagaagtattcaatagatttagcattactgatacttcaatgatgcttgatagaatgaaagatttaggattcaaattctcatctaaagctggtattactgttggtgtttctgacattgttgtacttccagataaacaagacattttagatgaacatgaaaaattagttgaacgtgtgactaaacaatataatcgtggtttaatcactgaagacgagcgttacaatgcggttgtagaaatttggactgacgcaaaagaccaaattcaaggcgaattaatgcagtctcttgagaaaactaacccaatattcatgatgagtgattctggtgcccgtggtaatgcatcaaacttcactcaattagctggtatgcgtggtttaatggcagcaccatctggtaagattatagaattaccaatcacatcttcattccgtgaaggtttaacggtattagaatactttatttctacacacggtgcgcgtaaaggtcttgccgatacagcacttaaaacagctgactctggttaccttactcgtcgtcttgttgatgtagcacaagatgttatcgttcgtgaagaagattgtggtacagaccgtggtttattagtttctgatataaaagaaggaactgaaatgattgaaccatttatcgaacgtatcgaaggtcgttattctaaagaaacaattcgccatcctgaaacagacgaagtaattattcgtccagacgaattaataacaccagatattgcaaaacaaatcactgatgcaggtattgagcaaatgtatatacgctcagcatttacatgtaacacacgtcatggtgtatgtgaaaaatgttatggtaaaaaccttgctactggtgaaaaagttgaagtgggtgaagcagttggtacaattgccgctcaatctatcggtgaaccaggtacccaacttacaatgcgtacattccacactggtggggtagcaggaagtgacatcactcaaggtcttcctcgtatccaagaaatctttgaggcacgtaatccaaaaggtcaagctgtgattactgaaatcgaaggtgtagttgatgatattaaattagcaaaagatcgccaacaagaaataattgttaaaggtgctaatgaaactagatcttatctagcatcaggtacttcaagacttaaagttgaaataggtcaatctgttgaacgtggtgaagttctaacagaaggatcaattgaacctaaaaactatttatctgtagcaggcctaaatgcaactgaaagttacctattaaaagaagtacaaaaagtttaccgtatgcaaggtgttgaaattgacgacaaacacgttgaagttatggtaagacaaatgttacgtaaagttcgcatcattgaggctggtgacactaaattattaccaggttcattagttgatattcataactttactgacgctaacagagatgcattcaaacatcgtaaacgtccagctacagctaaaccagtattacttggtattactaaagcttctctggaaactgaaagcttcttatcagcagcttcattccaagaaacaacacgtgtgcttactgatgcagctattaaaggtaaacgtgatgatttacttggtcttaaagagaatgttattattggtaagttaattcctgctggtactggtatgagacgttacagtgatattcaatacgataaagctactgcaccagtaacagaaacaagtgaagaagttgaaacgatagaataa

SEQ ID NO: 2483 - DNA, 657 bp, Staphylococcus epidermidis
aaacgaatgaaatggtcagaggtatttcatgatataacaacgcgccatgattttcaggcgatgcatgactttttagaaaaagaatatacgactcaaaccgtctatccagataaacaaaatatctatcaagcatttgatttaacgccgtttgaagatatcaaggttgttattttagggcaagatccttatcacggtcctaatcaagcacatggtttagcattttcagtgcaacctcatgctaaatttccaccatctttaagaaatatgtatcaagaactagaaaatgatatagggtgtcatagaacttcgcctcatttacaagactgggcaagagaaggtgtcttgttattaaatacggtattgactgttcgacaaggtgaagcacattcacatcgaaatattggatgggaaacattcacggatgaaatcatacaagctgtttctaattatcgtgagcatgttgtttttattctgtggggaagaccggctcaacaaaaggaacgattcattgatacatctaaacacttaatcattaaatcgccacatcctagtccactatcggcttttagaggattttttggttctaaaccttattcaactacaaataactatttaaaatctaaagggaaaacaccagttcagtggtgtgaaagttag

SEQ ID NO: 2484 - DNA, 228 bp, Staphylococcus epidermidis
acgatgatgaaaatgacaactagcacattagaattatcctcaactatcaaccaacgttacaaatacaacacacaaggcaagacacctacccagatacaacaggaattacgacagataggtgttaaaggctttgtggttaaagtagcaggaagcagagtgacgatgaaagttgagaaagaaaatataagaaagaatagggagtgtatgaggaatggcagaagtaactaa

SEQ ID NO: 2485 - DNA, 1383 bp, Staphylococcus epidermidis
ggggtgatgaattatgaacgtagctatttacgttcgtgtcaggtccgtacattagaacaaaaagaagtgggttattctattgaagaacaagaaagaaagctcaaatcattttgcgagataaacgactggagtgtatcagacgtatttatcgacgctggtttctctggcgctaagcgtgacagaccggaattacaacgtatgatgaatgatattaaacggtttgatttagttttagtgtataagttagacaggcttacacgtaatgtgcgtgatctacttgatttattagaggtattcgaacagaataacgtagcattcagaagtgctactgaagtttatgatacatctacagctatgggtagactgtttgttacgttagttggtgctatggcagagtgggaaagagaaaccattagagagcgtgttatgatgggtaaacgcgcagcgattaaacaaggtatgatactcacaccaccacccttttattatgatcgtgtagataacacttacattcctaatgattataaaaaagtagttttatgggcatatgacgaagtgatgaaaggtaatagttcaaaagctatagctagaaaattaaacgattcagatataccacctcctaatggcaaaaggtgggaagatagaacaataacgagagcgctaagaaaccctataacaagaggtcattatacttggggagatgtatttatagaaaactctcacgagcctattattaccgaagaaatgtatcaacaaataaaagaaaggctagaagaacgaatcaatactaaaatagtcagtcacgtatcagtgttcagaggtaaatttatttgcccgagatgtggtggcacattaacaatgaacacagcaacaagaaagagaaagaaagggtatgttacttataaaacatattattgcaacacatgtaagactaaaaaacaaagtttcggtttttcagagaatgaagcattgagagtgtttcgtgattacctatctaaactagacttagataaatatgaagtaaagacaaaacaaaaagacgatgtcgttactattgatatagacaagatcatggaacaacgtaaaaggtatcataaattatatgctaaagggttaatgcaagaagaagaattatttgaattgattaaagaaacagacgaaacaatagcagaatatgaaaagcaaaaagaattagtacccagaaaatcactagatatagataagataaaaaaatttaaaaatgcattattggaatcatggaaaatattctcgttggaagataaagcagattttattaaaatggctattaaatctattgacatagattatgtaaaacttaaaaacaggcattctatcaaaataaatgatatagaattttattaa

SEQ ID NO: 2486 - DNA, 183 bp, Staphylococcus epidermidis
agaaaggtgaaattcatgattactgtattagtcattactatattttttattacagtaactttaataatttggcaaccaaaaggattagatatagggatttctgcagtcatcggcgcgcttttagctatcgttactggagtagtgagtgtctcagatatattagaagtgacaagtatagtttaa

SEQ ID NO: 2487 - DNA, 861 bp, Staphylococcus epidermidis
aagataaagaataataaatggaggatggaaactatgactgaattaaatactaaagaaatgaaattagacgcactattgaaagacatgcagagtgtagtaattgccttctcaggtggagtagatagtagcttgttactgaaaaaagcgattgatattttaggtgttaactatgttaaacctgttgtagtaaaatcagaattatttagaaatgaagagtttgaactagcgcttaaacttggacaaagtctaggtgttgaagtattagaaactgaaatgtctgaacttcaagatgcgaatatcgttaaaaatacgcctgaaagttggtactatagcaagcgcttgatgtatagtcaacttgagaatattaagaataaactaggatttaattatgtgctagatggtatgattatggatgacttagatgattttcgtcccggattaaaagcaagagacgactttggtgttcgtagcgttttacaagaagcaaaactatataaatctgaagttagagaattaagtcatcaacatgacttgcctgtatggaataaaccagccttatgtagtctagcatcaagaataccttatggtgaggaattaagttttacaaaagttaacaaggtcaacgaagcagaaaaattcattttaagcctaggtattaaccacgtacgagtacgctatcatcacaacatagcacgcattgaagtaacagaagatcaattaaataatcttcttaaattgaaagacagtatcatattacatttgaaagaattaggatttgactatgtaacaatggatttagaaggctatcgtacaggtagtatgaatgaaatcattgataccaaatctacaagttttaaataa

SEQ ID NO: 2488 - DNA, 495 bp, Staphylococcus epidermidis
aaaaaggagaaatgtagaatgaaagaaccgccgcataatagacttacatttaaagagagtatgacagaaggcaaatatctgacgacaataactaaagaagataaaattcgttataaaaaattatctgttgaagaaaaaagaaaagtattaaatgatttcaacgcttctacaccgcaaaaggacgacaaagttagcttattcgattatatgaaacgcactatgttaaaacatggtttagacgaagtgacttctattacagaaaatgctgttttaaaaaacgaaccaggcaaacatatcgacagttttatgacgagattgagtagtttttcaacaacaaaagatggaacaactgttttcacatatgagttaatcaatcaaaactttgttgttataaaaatattagatgaacaactgaaacaaaataaaaaaataatagaacaaaataatgaaatcatcagtttactcaaacaaatagctaacagaggagaaatgtag

SEQ ID NO: 2489 - DNA, 903 bp, Staphylococcus epidermidis
aataagtggaaacgaggtcaactaatgataaagctaatagcaactgatatggatggaacattacttaacgctggtcatgaaatcaccactatgaatcaagaagcgataaaatttgcgcaagcgaacggcattacagtagttattgcaactggtagagcattttatgaggcacaaacacctgttgctgaaacagacttaaaagtaccttacatatgtttgaatggtgcagaagttcgtgatgaatcatttaatataatgagtacatcgcatcttaatcatgatttagtacacaaaattactacagcacttaaaaataatcatatttattatcaaatttacacaaaccgtggcatatatacagaagatcctaaacgtgatttagcaatctatatagatattgcagaacgtgcgggtcaaaaagcagatgtagacaagatacgaaataatatacaaaaacgcatagataacggtactttaaaagttgtagataattatgattcaattgaagatattcctggagaacttattatgaaggtgttagcttttgatgcagatttaagtaaaatcgaccaagtaggtcaagcgttagcatcatcaccaaatttagcagtatcttcatcatcaagaggtaatctagaaatcactcattcaaacgctcaaaaaggcattgccttatcagctattgctcatcaattgggtatagatttaacagatgtgatagcaataggagataatttaaatgatatttcaatgctagaacgtgtaggttatccagtagcaatgaataatgctacagacgaagttaaacatattgctaaatatgtcacagacaccaatgaaaatagtggagttggaaaagcaatcatgaaaatattaaaagaagaaaataatttagaggtgtaa

SEQ ID NO: 2490 - DNA, 420 bp, Staphylococcus epidermidis
gcaactgttgaaactacacgtgaaaaccaacttgctacagtattccaaattctagtaactgcacctgaaatcgcagaccaaatttggttccaacttgtgatgttagtaccgagtattctgtttaaaacgttgaatatgaagttagaaatttggttccagattgacaatatggtattccaaatggtattcatcacgttttgcgtcatagtttgtaatgtctgccacgctccaggtatgtcgcctgataaaagttgtatccatgctgtagctaatccaatgaataattgtgacgcagcttgtagaattccacctatcgcagtgaatactactgaaacgatagtccatagatattggaacgccattactacaccgttaataagactgatgaataagaagcctaaaacttggttagctacttga

SEQ ID NO: 2491 - DNA, 498 bp, Staphylococcus epidermidis
agaatgactgaaaatacaatcaatcctattactacattagaattcaacggagaagaagtagaagcaaaagctactttcttatttgataaaactgctaaaaagtttgctaaagatgagcaagataaaaacggtaaaactactaaagtatcaggttttaatgctatttataacggtattttagaacgtgatactaatgcaattgcagatttttgggaatgtgcaacagcttatttaaataagaaagctcctacacgtgagcaaattgaaacttctttaatgcagtttatcgataaaaatggcgacacgcttgaattactacaaggcgctttagacgtaatgaataatagtggttttttcaaacaaaaatcacgtcaattctggacgcaaatgaacatagcaccgtctatggcaaaagaggaagagaaagagtctacgaagaacggtatcgagttcatgaagaacaactacaaagaaatcatgggcgagctaccttactag

SEQ ID NO: 2492 - DNA, 261 bp, Staphylococcus epidermidis
atgtctaatgaaaaagttgcacgctttaacaaacaacaatatgtagttggtcttaaagaaacgcttaaagcgttaaagaaaggtcaagttacatcattgattattgctcaagacgttgaagttcatttgctaactcgcgtgttaagctatatcaatcataaaaatataccagtatcatttttttctagccaacgtgcgttaggaaaatatgtaggtattaatgttaatgcgacaatagttgcattaataagtgagaattag

SEQ ID NO: 2493 - DNA, 1221 bp, Staphylococcus epidermidis
aacaataatgatatactaatatcaataattaagatggaagaagtgatacatgtgtttgattggtttcaattagcaagtaataaagaaaagagaatggtgcaattacgacgatatttgcatcaatacccagaactttcttttgaggaaaaacgtacgcatgattttattgtaaatcaattgagccaattagcatgcaccatagaaacaccagttggacgtaatggtataaaagcaacttttaaaggatctgattcaaatggaccaacgattgcattacgagcagatttcgatgcactacctgttcaagaattaaatgatgtaccctatcgttcaaaaaataaagggtgcatgcatgcttgtggacatgacggacatacagctattttgcttggagtagctgaaattgttcatgagcatcgtcatttattgaaaggtaatgttgtttttatattccaatatggtgaggaaattatgccaggtggttctcaagagatgattgatgatggctgtctacagaatgtcgataaaatatatggcacacacttatggagtggttatccatctgggacaatctattctagacctggagcaataatggcttcaccagatgaatttagtgtgactatatatggaaaaggtggtcacggtgcaaaaccacacgaaacaatagaccctattgtcattatggctgagtttattttaagtgcccaaaaaataatttctcgaacaattgatccagtaaaggaagctgttcttactttcggaatgattcaagcaggatcaacagatagtgttattccagatacagctttttgtaaaggtactgtacgtacttttgacacaaaattacaaagtcatgttcaaaataaaatggataagctcttacaaggtttatctttatcaaacgatattacatatgaattggaatatattaaaggttatttaccagtacacaatcatcaacaatcatatgatgtagtcaaacaagcagctaatgatttacatttaagatttaatgagtcagacttaatgatgattggtgaggacttttcacattaccttaaagtacgacctggtgcattcttcttaactggttgtggtaataaagacaaaggcattactgcacctcatcataatcctcattttgacattgatgaatcttcattaaaatatgcagctagtgaatttttaaaaatattagaaattgaaaatgttttttaa

SEQ ID NO: 2494 - DNA, 498 bp, Staphylococcus epidermidis
aaaaacagtgacttcggaaaatctgtagattgggcaattcaaggcacagacgcacgtaatggcgttatgcaagaaactaaagatgaacttgatagtgacaacttggataaatatagcttgaaagaaagtgctgaccaagaccaattcaagaaaattcaatctgcttttaaacaacaagaacctatcgtcttcacagcaatggaacctagctggttctctaaagaattagacgttaaaatgttgaaagatccagacaacatttatggtaataataatcaacatattgacttagtatttaacaaagactttaaagaagcacatccagctgcatacacagttgcaacacgtatggcagatgattggagtaaatctgacgaagacaaattagctaaaaaaatctttgttgataacaaaaatccagaacaagtagctaaagactatgtggatgataatgataataaagtagatgaatggttagaaggtattgagactatctaa

SEQ ID NO: 2495 - DNA, 363 bp, Staphylococcus epidermidis
aaccatttagacgtttacgttggactggttatcatgtttaatccattagacgagtttcctcatacaatcgaattaggctcaagagaagttgtaggagagtatccacgtgaacaagagcgctttaagagcgaaaaaacaatacaaggttttatggatacgcctacttcatctgaacaactaaagttccatcaaatgaaccaatcatacgacagaaacctatatacgccgtacagcctgccaataactaacacaaatttattcaaatacaacggtaaaacttacgaagtagtaggagaacctgtcgatcaaggtggacaacaagaaatcaatcttactcggttgaaagagtgtcctattggctaa

SEQ ID NO: 2496 - DNA, 882 bp, Staphylococcus epidermidis
aacatgacagaatttgacttatccactagagagggtcgttggaaacatttcggttctgttgaccctgtcaaaggtacgaaaccaactactaaaaatgaaatgaccgatttacaaagtactcataaaaatttcttatttgaaatagaggaagtaggcattaaaaatttaacttatccagttttaattgatcagtaccaaacagctggtttatttagtttttcaacgagtttaaataaaaatgaaaaaggcattaatatgagtcgcatattagaaagcgttgaaaaacattatgataatggcattgaacttgaatttaacacactacatcaattgttgcgtactctacaagataaaatgaatcaaaatgctgcaggtgttgatgtgtcaggtaaatggttctttgatcgttatagtcctgtgactaatattaaagctgtaggccacgcagatgttacttatggtttggctattgaaaatcataccgttacacgcaaagaattaactattcaagccaaagtaacaacactatgtccttgctcaaaagaaattagtgaatattccgcacataatcaacgtggtatcgttacagttaaagcatatttagataaaaataatgatgtcatcgatgattataaagataaaattttagacgctatggaagccaacgctagttctatcttatatccaatcttaaaacgtcctgatgaaaaacgagtaacagaacgcgcttatgaaaatccacgatttgttgaagatttaattcgactaattgcagctgacttagttgaatttgactggattgaagggttcgatattgaatgtcgtaatgaagagtctatccaccagcatgatgctttcgcacgtctgaaatatcgcaaataa

SEQ ID NO: 2497 - DNA, 330 bp, Staphylococcus epidermidis
ggaatggcagaagtaactaaggaacaattattagaattcattagaaacaatgagttagatttagacgaaagctatccacgtagtgattggtggaagtttagaaatgaacgtgacagtttacgtaagcaacgtgatgaactcatcaatgatatggcagaaacgaaaaggaaagcagaggcgtttgatgagatagtaaaagttttagctagtatctcaaaagagatagtggaatatccaggcgataatgataaacaaaaagaggttatctacaaaagatatgatgatttatttgaacctatgaaattattggaggtaaacgatgaaagataa

SEQ ID NO: 2498 - DNA, 252 bp, Staphylococcus epidermidis
tttctacaagaaaacgcagaggttttatggatgaaagtttatgagtatcagcaacttttaggttttatgtatcgagaggattataaagaagatccaatcatagccaaaatattaatcgagtctgggtgggcagttaaaaggctgcttgatactggaaccattaaaccctttgacgattatgaagaagtgaaagagttaatcatgaatgaaacgaagtggaggcaaccagatgggacttatcgacggacttaa

SEQ ID NO: 2499 - DNA, 552 bp, Staphylococcus epidermidis
atgactaaagaactagaaattaaattattaacagaaaatgcgactatgccgaagagagatagattagatgctgggtacgatatctattcggcagaaacagtaatacttgagcctcaagagaaagcaacgattagaacagacattgctgtgaacattccagaggggtatgtagggctattaacgtcaagaagtggtgtaagtagtaaaacacatttagtgattgaaacaggcaagatagacgcaggttttcaaggtaatatgaagattaatattaagaatgatattgaagtagtagatgcagatgaatttatctataaagatataaaaaatgaaataatcgatgacggaagctttaacgaaccaattgaagagcaaagctctaatccgctagatatttttaaaccaagaaacacaagttatgtcattaaaaaaggcgacaaactcgcacaactcgttatcgtacctatttggacaccagagttaaaagaaatagaggagtttagcagtgggtcagaaagaggagagcaaggctttggatcaacaggattctaa

SEQ ID NO: 2500 - DNA, 252 bp, Staphylococcus epidermidis
acgatgaaagataaagattataaaagtttatggataaagttgaaagagaagaaattaaaagaatatgtggaagtacatcgctcagtaaatcaaattataacaccatacaatcaatatcatttatttgagatagctaacgaaatggtaagtgaaaacgaattaaagcgagatttaaaatatatggaccaactagacggaacgcatgagttccaaaatttattaagtgatttggaggcttgcaatggacaatag

SEQ ID NO: 2501 - DNA, 627 bp, Staphylococcus epidermidis
atgactgaagaaacattatttaatcaattaaatcagaaagatgtaaatgatcatgtagaaaagaaaaatggtttaacctacctagcatggtcatacgctcatcaagaattaaagaagatagacagcaactacagtattaaaacacatgaatttgtacaccctgatgtaccactagataactattttgtaccttatttagctactccagagggttacttcgtacaagtgtcagtaactgtaaaaggacaaactgaaacagaatggcttccagtattggattttagaaacaaatctttagcaaagggtagcgcgacaacgttcgatattaataaagctcaaaaacgttgtttcgttaaagctgcagcattacatggtctaggcctttatatatataacggtgaagaagttccaagtgctaacgacaatgacattacagaattagaagaacgtatcaaccagtttgtaactttatctcaagaaaaaggtagagacgcaacgctagacaaaacaatgcgttggttaggtattcaaaacattaacaaagttactaaaaaagatatagcaaatgcacatcaaaaactagatgcaggactaaaacaattagataaggagaattcgaatgactaa

SEQ ID NO: 2502 - DNA, 639 bp, Staphylococcus epidermidis
atttcattggaactacaattagccattgatttattaaataaagaagaagcagcaaaattagctcaaaaagttgaagaatatgtagatattgttgaaattggtacgccaattgtaattaatgaagggttacctgcagttcaacatttaaatgaaaatattaataatgctaaagtattagctgacttgaaaattatggatgcagcagattacgaagtgagccaagcagtaaaatatggtgcagatattgttacaattttaggtgttgctgaagatgcttcaattaaagcagcagttgaagaagcgcataaacatggaaaagcattgcttgttgatatgatagcagtgcaaaacttagaacaacgtgctaaagaactagatgagatgggtgcagactatatcgcagttcatacaggttacgacttacaagctgaaggaaaatctccattagacagcttgcgtacagttaaatctgttatcaaaaactctaaggttgcagtagcaggtggtattaaaccagatactatcaaagatattgttgctgaagatccagatttagttattgttggtggcggtattgcgaatgctgacgatcctgtagaagcagcaaaacaatgtagagcagctattgaaggtaaataa

SEQ ID NO: 2503 - DNA, 351 bp, Staphylococcus epidermidis
tttattcaggagatacttaaaatgagaaataatgatgaaataatcacaataattaaatcagctatgaaagaacaagatatgtcacttagtgaattagctcgtcgtgtaggagttgctaaatctgctgtatcacgttatttaaacttaactagagagtttccgttaaatcgtacagaagattttgcaaaagcacttagtatcagtacagaatacttacttggttttgacaaaagtgaacaacaagatgaacaaccaaaacatcgtgcagcacatcttgaaggggaattgacagatgaagaatggcaacgtgtgctagattatgcagattatataagaagcaaacgcaaataa

SEQ ID NO: 2504 - DNA, 504 bp, Staphylococcus epidermidis
ctaacagaggagaaatgtagaatgaaaaaggttctttttttaatttttgctagtttattagtattaggtgcatgtggacaagatgaggacaaaaacaaagaagatgatgctaaaaaggttgaagttaaaaagacgaaagaaaacaaaaaagataaacaaagtcaatctaaagaacaaaaacaagaaaaaccttataacaatgatgatgaaccaattttaaatgataacagaaatgcaaacgacaacaattcaaatcaacggaacaataaacaaaatcaaaatgtagataaaattgataacaatgcgtacaaccaacagcaaaacggtcaagtaaatcaaaaagaaaatacagaaaatggacttgacccaaacttcgtacgacataatgacaacatggtaaaagaatggcaaaatcaaatgcgagaacacaacgaaaactttaatcctgaatctggtggagatttgtataacgtcgaaaccggtaactacgttgatgatgaataa

SEQ ID NO: 2505 - DNA, 1314 bp, Staphylococcus epidermidis
gataggagggaaagtatgacgctatcatcatatgcaacgagtaaattaacagaagaaaaggtatttaaagatccaattcatcgatttatccacgtacaggatcaattgatttgggacttaattaaaacaaaagaattccaacgcttgagacgtattaaacaactaggtactttgtatttatcatttcatacagccgaacatagtcgttttggacactctttgggtgtttatgaaattgtgcgccgaatgattgatgagacatttataggacaagacgcgtgggataatactgatcggccacttgcgttgtgtgctgcgttgttacatgatttaggtcatggtcctttctctcatagttttgaaaaaatatttaatacagaccatgaagcatttacacaagctattatcacaggagacactgaggttaatggtgtactaagtcgagtctctgataactttcctaaacaagtagctgatgtaattaataaaacgcacgataataagcttgttatttctatgatttcctcacaaattgatgctgatcgaatggactatttacaaagagatgcatattttacaggcgtaacgtatggctcatttgatatggagcgtattttaaggttgatgagaccatctaaagaagaagtgttaattaaagatagtggtatgcatgctgtcgaaaattttattatgagtcgttatcaaatgtattggcaaatatattttcatccagtaagccgtggtggggaagttttattaaacaattgtttaaaacgagctaagcagctttataatgaaggatatgaatttaaaatgtatccaaaagactttataccattctttgaaggaacaatgacgattgaacaatatgtagaacttgatgaagcagttgtattgtattacttgaagaaatggattcatgaaaatgatacaatattaagtgatttatcaagacggtttatcaatcgagatttatttaaatatattcctttcgacggttcaattattaccatttcggaattgcaagaattatttgaagcgggtggtattaatcctgattattactttgtaagtgaagcattttcagatttaccttatgattatgatcgcccaggctcaaatcgcaaaccgattcatttattaaaaagtaatggtggaattacagaaataagtaatcaatcattggtgattaatagtattacagggattaatagagaagaccataaattatattatcctaaagagatgattttaaaaattaaagattatcaaattaaaggttctattattaacttacttaatgaattaaattaa

SEQ ID NO: 2506 - DNA, 1035 bp, Staphylococcus epidermidis
ggagggctttttatgaaagcagctgtagtaaccaaagatcatagagtaagtattgaagaaaaacgtttaagagaattaagacctggagaagcattagtaaagactgaatattgtggtgtatgtcatactgatttacatgttaaaaatgcagatttcggtgacgtaacaggtgtaacattaggacatgaaggaattggacgtgtcattaaaattgctgataacgtagattcattaaaggtaggggatcgtgtatctatagcatggatgtatgcagcatgtggtaattgtgagtattgcacaactggtagagaaacattatgcagggatgtccttaatgccggatatactgttgatggggcaatggctgaagaagtcattgttgatgcgaattatgcagttaaagttcccgaaaatcttgatccagcggctgcttcatctattacctgtgcaggtgtgacaacatataaagcagtaaaagtgagtggtatcgaaccaggacaatggttaggcgtatttggtgtgggaggattaggtaatttagcattgcaatacgccaaaaacgtaatgggcgcgaaagtcgttgcatttgacattaatgatgataaattaaattttgctaaagagcttggtgctgatgcaatcataaattcaactaatgttgatcctattgaggaagttaatcgtctaacgaataataaaggattagatgcaacggtgattactgctgtagctaaaacaccttttaatcaagcagttgatgttgttaaggcgggtgcacgtgtggtagcagtaggacttccagtagataaaatggatttagatattccacgtttagtgcttgatggaattgaagtcgttggttcattagttggtaccagacaagatttaagagaagcatttcaatttgctgccgaaaataaagttattcctaaaatccaattaagacaattatctgaaattaacgatatttttgatgaaatggaaaaaggaacaattacgggtcgaatggtaattgatatgaaaagcacgcactga

SEQ ID NO: 2507 - DNA, 375 bp, Staphylococcus epidermidis
tggaagagtttatatagaaaggtgggtagcaagatgaaaaataaatttttaatctgtgatgagtgtcaggctgtgaatttaaaatctttgaagcgaaaattagaaaaattagatccggaagctgaaattgaaataggctgtcaatcttattgtggaccaggtcggcgtaaaacatttgcatttgttaataatcgaccacttgctgcattaaccgaagaagaacttatggaaaaggttacaaaacaattaaaaaaaccacgtgatccagaagaagaagagcgactaagaaaacgtaacgaagaacgaaaacgtcgtaaagaagaacaagatcgcaaacttaaggaaaagttaaagaagcacaaagcagagaaataa

SEQ ID NO: 2508 - DNA, 576 bp, Staphylococcus epidermidis
aatgccacacttacctttgtcgcagttatccttatttcattaatccttgatgaaataggattttttgagtggtctgccatacatatggttaaagcatcacaaggacatggattaaaaatgtttgtgtttatcatgatattaggtgcaattattgcagcattttttgctaatgatggagcaaccttaattttgacgcctatcgctttagcgatgataagaaatttaggtttcaataaaaagctagtgtttccttttattatagcttgtgggtttatcgtatattccacatcattaccacttgttgtaagtaatttggttaacattgtatcagcagattactttggtattgaatttgttgaatatttaaagcgtatgtttatacctaatttattttctctattagctagtatcttaatattatggttttactttagaaaatccatccctaaaacatttgatatatcaagtatttttgaacctaaaaatgctatacgagacacacgattatttaaaatttcatggattattttagctttattacttataggttacttagtgagtgagttcatcccctaa

SEQ ID NO: 2509 - DNA, 852 bp, Staphylococcus epidermidis
ttatcattctgtctttatatattgatttggatgcacaacttttctcatgaaggttgtgcattttttcttatacaaataaaaattattgggggcataaagatgaaaaaaactgcaattatcacgggaagtagtcgtggattaggcgctaaaattgcaataactttactagaaaaaggctacaatgttgttgttaattacaaacaaaataaggataaagctgaaaaattaattagaaattataatcaaagtagggctatagctattcaagctgatgtgacagacagaaacgatgtgaatcgaatgattcaaactgccacacaacattttggaaaaatagatatagtcattaataatgcacttgttggttttaaatttgatccaaatcagcaaaaatcgtttaaagatttaacttgggaagattatcaacaacaacttaatggtactttaaaaggagcatttaatgtgactcaaagcgtcataccacaatttatagaacaacaaagtggatgcattgttagtattggaaccaatttgtatcaaaatccagtcgtaccttatcatgagtatacaacagcaaaggcaggtctcattggctttactcgtaatattgctgcagaacttggacaatatggtattacagcaaatgttgtttctggaggattactcaaaacgactgatgcaagtgcagtcactacacctgaagtatttgatttaattgctcaaactacacctcttagaaaagtaacatcacctcaagatgtagccaatatggtcgtatatctcgcttcagatgaagcacgtggcgtaacaggtcaaaatattaccgttgacggtggtttaacaatgaactaa

SEQ ID NO: 2510 - DNA, 252 bp, Staphylococcus epidermidis
ttatggcgactattggcgaataatcgacaccccatgccattaaatttaaattgttattctagcgacaaagatttattcagaataaaactggtagaagaattacctttaaataaaactttaacttttaaatttataactacacgaaaaaatatcacttataagattaaagatttcaaattaccgcaatatagaaggtcattccatagaaaacttaaacatcacaaaaaggtttcaaataaaaacaaagattaa

SEQ ID NO: 2511 - DNA, 228 bp, Staphylococcus epidermidis
acggaaaggtggtgtttgattatggaatttaatgtgaaggttaatgttgatgctgatgaagcaattgagaaattagaacgtatcaaaaaactatacgaagaaattaatcaattaaagaatgatagaccagttgtaaaagtaggaataagcaatgaagccgatgtagaacaaattagaagttatatcaatgagaaaaatgttgaaaatgcaaactttaacttattctag

SEQ ID NO: 2512 - DNA, 519 bp, Staphylococcus epidermidis
gaggtatctcgtttgtctgagaaaaaaggtttcaatttcaatattataaaaaatgatccactagatggtcataaaggaaccaatattggttcgattagtttagataatattgccccggtttttatagatgttgaaaatcagaaggcatttgttgatattggtggtatgcacgcacgtgctgaagttgaaaagggtgtcaagtggattactgacaaatcacaagttgaaggtgaggaggctaaagcatactggctatgttgggtgacgaccgaacgtagtgaagaagggccatattatgcgggtgtgactgcatgctatttattagttaacaaaagtattagacgtggttataagagcatgccagaacatgttaatatgatggataagtctatgaaacatcaatttatcatcgaccaaatcggtgatgataacaaacaaattttaaaagaatttctacaaaatcataacgttgaaatgtggaataattctagtgaagaactatatcgagcatttgaatag

SEQ ID NO: 2513 - DNA, 474 bp, Staphylococcus epidermidis
attatgcctcgtaaaggatcagtacctaaaagagatgtattaccagatccaattcataactctaagttagttactaaattaattaacaaaattatgttagacggtaaacgtggaacagctcaaagaattctttattctgcatttgatcttgttgaacaacgtagtggtcgtgatgcattagaagtgttcgaagaagcaattaataatatcatgccagtattagaagttaaagctcgtcgtgtaggtggttctaactaccaagtaccagttgaggtgcgcccagaacgtcgtactactcttggattacgttggttagttaactatgcgcgtcttcgtggtgaaaaaactatggaagaccgtttagctaacgaaatcttagatgctgcaaataatacaggtggtgcagtcaaaaaacgtgaagacactcacaaaatggctgaagcgaacaaagcatttgctcactaccgttggtaa

SEQ ID NO: 2514 - DNA, 2706 bp, Staphylococcus epidermidis
aaacttttacggtttttatggctaaggaggtcaaaaactttgaaattagacaatttaattacgaaacttcactcgtactttagtcaaaagtttgtaagtcaacttgagaataacttcgaacaaataaaatactggactaataaaagtgatgatagctttaacgagcatttaaccactcaaaaaaatgcgcatacaactgatcaaatcaaacacaaaactacaaaaggtaaagatgtcgtattatctaatcatgaaaattatcaagatgaacttattgaacatcttgtgttaggtcataacggtgatggcaataacgaattaaaagctagtcacacatcaatggacgctcaaagtttcgattctttacaccaacgtctatatcacgactttttaagagaaagtaacgctagagaagaactaagagccgacttaactaagaaaatacaacgtattgttaacgttgatgactttggcggagatcctacaggtcaaaaggacagtacgaaagctttccaagacgcattaggtaacggcaatgtacaggtaactatgagtggtggtacttaccttacaacaggtattaaaatgcctaacaactctcgtttggtaggacaaggtaaagacattactacaattaagtttatggacgaaacacctgcagaaaatattggtatcactaacttaaaaatgagtggtggagctgaaaacatttcattagaaagtttttcgttcaacgggaataagtttagacaaaataaaacacttaaagctaccggtggttctcgttcatctaacattagatttgcgggtgtaactaatggatatatctataacgttaaatcatatgacgctttactacactgtatcgatgtaacatatgcaaatgacaattattactacgaaggcgatggaaacagagtgccttacgcattagaaagtaagcatattcatattgataattgtgaggtatatggttgcggagatgatggtatcactacccatcactctcgttacattacaatttctaattgttatgcacatacaccaacaggcggaagtaataacaacggtgtagaaattgacgatggctcacaatatgtgttcttatcaaacaacagaaccaaaggtaacttcggtggtttagaaatcaaagcacacagtaatgcaagtgctgcaagtggtgtgttcgttaacggtcacgtatcaatcgaagatacaagagcttacaacattcgacacatcggtcatcatagagctaaaacggacaataaaagtttgactgcttatgacgtggtgctaaataattgcttagctttaaaccctaaatacaatggtgtgtatccaggctcaacacctagagcattattaatcagtgcttatagaaatgtttctgtaaataactttacagctataggtgatagtgatttcggaaaattagaaggtggaaaactagataaaaaacaaccagcaatagccatccaattcatgtccgaaaacatctcgcttaataatattaatgtgcgtaactttaaaaatgcagaagtagatattagattatttggcggagataatagaccgtctagagtatcactaaataacataaatatttggaattcatctaacaatatcggtatcggtgttggaagtaaaatatacgacactaaaataactaattgtaacttacacggcaatggttcaggtataggattacgtttgacaaataaccacgctatgattagcggcgtcacagctgataattattcaacttctgcatggatagcaggagaaaagtacgacacaccacctacagtaggaaaaggcggcgctagtatagcgtctacaggaagtgctggtgtagcaaacgctagtgcagttattgcatctacaggtggttcgaaagcatacagtaatcgtagctttgtattaggttctggtgctaactccaaatcttatggttcacgtagcggtattatcaattcacttaattctgaaactgataaaaaaggccatacacaactgattatgaatagtaatcgtgttaagtcacctggtaactatcatgttgtcgctggatatggttctagtggtaatgcttctacatctaacattaaatttgatttaagcacttattcaggaaacttaactttagccggtcaacttaaacaagatagtgccgatatcgcagagttatttgagtcacaaaatggattagcaatcgatttaggaactatcgttacattagacggcgataagataagaaaagcgcaacctaatgacacaccaattggcgttatatctggaactgccgcgttggtagcgaacgaaaaaacattccaccataaagatagatttttaaaaaatgagtatggagtaacgattacaaacagaaaacaagttgaatttgtagacgatgaaggaaatgtttctttcgaatggcgtgacataccagtagaaaaccctgaatataacgacaaaatcgattatcaatcacgttcagaacgacctgaatggaatgtagtcggattattaggtcaaatctacacgaacattgaaaaagacgttataccaggcgactatatcaacggtagagcaggtgtaggatataaagataatgtgaatggtaaaggtcgtgtcatgaaaataacttctgaatacactgaagaacgtggatgtgcaatagcattagtattgtggggtgctaaataa

SEQ ID NO: 2515 - DNA, 402 bp, Staphylococcus epidermidis
atccatcagcgtggactgatacagattatatttacggtcaatatgaatggacggagtgatgaaatgaaagtagtttatttatggaaaaatggacaagcaattattgttcacaaaaacgaagaagatgaatatgtttatcctgatgaaaaatggacagagaaccaacctcctcaaggtattatcttaccttgctattatgacggtaaacaatgggttggacaaacccaagatgagctagaaaagatgttgcctgaagtagaaattcctgttgatgacaaagatattgctatagctaaattaactagcttagttgtcgatttacaagaagaagttatgagtttgaagcagaacatcgcactaataactgaagaacaagcaaatcaaaaattgggggaagcgtaa

SEQ ID NO: 2516 - DNA, 366 bp, Staphylococcus epidermidis
gaaatgcagctttatttgaaagatggtatggaaattagagaagttcaatttacaaatgaagaagttcaaaattattgcgaattgcttaatataaagtatgaccattatgttcctactcttatgtgtgccaagttatggccacaatttgagttatttcaatctttttcaaagaagcctatcatattaaaagagacacacattaagacacaacatcaacttcaagtcgattgtacgtatgaagcgacattgcataaggtttcacaaaaattaattaaaaatatcattaaatatacatatggactcgaaatcaataaagataaaaaacattgtatgtatataaaacaaatatttatcgaggtaagataa

SEQ ID NO: 2517 - DNA, 507 bp, Staphylococcus epidermidis
ttatctattagaagcaagtatcttgaccttaaaatcattatacgctttaatgtaactaatgaagttacattaaggtgggtaaaaatgaatttagaattcaatattgcagtacatgtactatgttttcttgctcaacacgatcaagaacaattcaatagtaaagaattagctaaattaacatgtctgaaccctgtacaacttagacgcgttctagcatatttaactgaacacaactatatcaaagttcagcgtggtaaagcaggaggctaccaagccaatcaacatactgctcaagtagatttagccaagttatatcaacactttgttttagataaaaataatagccaaagacgatttactggcgcttctgacagtcattgtcaaatttctaagaaaattgctcatacaatgtcacattattattctcaagaacatcaaataatattagatttttacaaagataaaaatattacagatgttttggcagatattttacaggaggggtaa

SEQ ID NO: 2518 - DNA, 1089 bp, Staphylococcus epidermidis
ggaagagatagaatgattcaggtaaaagcccccggaaaactttatattgcaggcgagtatgcagtaaccgaaccaggatataaatctattcttattgcagtaaatcgctttgtaacggcgacaattgaggcgtcaaataaagttgaaggtagtattcattccaaaacattacattatgaaccagttaaatttgaccgtaatgaagatagaattgaaatctcagatgttcaagctgctaagcaactgaaatatgttgtgacagctatagaagtgtttgaacagtatgtgcgcagttgcaatatgaatttaaagcactttcatttaaccattgatagtaacttagcagataactctggtcagaagtacggattaggttcaagcgccgctgttttagtatctgttgttaaagctttgaatgaattctatggtttggaattatcaaacctttatatttataaattagctgtaattgcaaatatgaaattacaaagtttaagttcatgtggtgatattgcggttagtgtctacagtggttggcttgcatatagtacgttcgaccatgactgggtgaaacagcaaatggaagaaacatcggtgaatgatgttttggaaaaaaattggccaggcttacatatcgaacctttacaagctcccgaaaatatggaagtccttattggatggactgggtccccagcttcttctccacacttagtgagtgaagtcaaacgtttaaaatcagatccaagtttttatggtgattttttagatcaatctcatgcttgtgtagaaagtttaatccaagcttttaaaactaataatatcaaaggtgttcaaaagatgatacgtataaacagacgtattattcaatctatggataacgaagcatcagttgaaattgaaacagataagctaaaaaaattatgtgatgtcggtgaaaagcacggtggcgcttctaaaacttcaggtgctggtggtggcgattgcggcattactattatcaataaggtaattgataaaaatattatttataacgaatggcaaatgaatgatatcaaaccattgaaatttaaaatttaccatggacaataa

SEQ ID NO: 2519 - DNA, 2118 bp, Staphylococcus epidermidis
tacttattcagtaaatactggaaggagaaaaaatacatggcaagagacttttctttgaaaaatactcgtaatatcggtatcatggctcacattgatgctggtaagacaactacgactgaacgtattctttactacacaggtcgtatccataaaattggtgaaacacatgaaggtgcttcacaaatggactggatggaacaagagcaagaccgtggtattactatcacatctgctgctacaactgcacaatggcaaggtcaccgtgtaaacatcattgatactcctggacacgtagacttcacagttgaagttgaacgttcattacgtgtacttgatggtgccgttactgtacttgatgcacaatcaggtgtagaacctcaaactgaaacagtttggcgtcaagcaacaacttatggtgtacctcgtattgtttttgtaaacaaaatggacaaattaggtgcgaactttgaatattcagtaagcactttacatgatcgtttacaagcaaatgcagcacctattcaattacctattggtgcagaagatgaatttgaagcaatcattgacttagtagaaatgaaatgctttaaatatacaaacgacctaggtacagaaatcgatgaaatcgaaattccagaagaccataaagaaagagctgaagaagctcgcgctcaattaattgaagctgttgctgaaaacaacgacgatttaatggagaaatatcttggggatgaagagatttcagttgatgaattaaaagatgctatccgccaagctactactgacgtagaattctacccagtactttgtggtacagcgttcaaaaacaaaggtgttcaattaatgcttaatgcagtaattgattatttaccttcaccattagatgttaaaccaattattggtcatcgtgcgaacaaccctgatgaagaagttgttgctaaaccagatgattcagcagaatttgctgctttggcatttaaagttatgactgacccttatgttggtaaattaacattcttccgtgtatactctggaacattatcttcaggttcatatgtgaagaactcttctaaagataaacgtgaacgtgttggacgtttattacaaatgcacgcgaactcacgtcaagaaattgacactgtttattcaggtgaaattgcagctgcagtaggccttaaagaaacaggtactggtgatactttatgtggagagaaaaatgacattatcttggaatcaatggaattcccagaaccagttatccacttatcagttgaaccaaaatctaaagctgaccaagataaaatgactcaagctttagttaaattacaagaagaagacccaacattccatgcacacacagatgaagaaactggacaagttatcatcggtggtatgggtgaattacacttagatattttagttgaccgtatgaagaaagaattcaacgttgaatgtaacgtaggtgctccaatggtttcttatcgtgaaacatttaaacaacctgcacaagttcaaggtaaattctcacgtcaatctggtggtcgtggtcaatatggtgatgttcatattgaattcactcctaacgaaacaggtggcggtttcgaattcgaaaacgctattgttggtggtgtagttcctcgtgaatacattccatcagttgaacaaggtcttaaagatgctatggaaaatggtgtcttagctggttatccattaattgatgttaaagctaaattatttgatggttcttatcatgatgtcgattcatctgaaatggccttcaaaattgctgcatcattagcgcttaaagaagctgctaaaaaatgtgatccagttatcttagaaccaatgatgaaagttactatcgaaatgcctgaagaatatatgggtgatatcatgggtgacgtgactgctcgtcgtggacgtgtagacggtatggaaccacgtggtaatgctcaagttgttaacgcatatgtaccactttcagaaatgtttggttatgcaacttcattacgttctaacacgcaaggtcgcggtacttacacaatgtactttgaccactatgcagaagttcctaaatcaattgctgaagaaatcatcaagaaaaataaaggtgaataa

SEQ ID NO: 2520 - DNA, 210 bp, Staphylococcus epidermidis
gttatatacagttctcaaaagagaacgaacggaggtgaaaacatggtacttaacttaaaaagattgagagcagaaagaatagcttgcggaataactcaagatgagatggcacaaatgatgggatggaaaaaagaactccatatgctaaaagagaaaacgggattgtggatattggagctaatgagtttattaaaatggctaaaatattag

SEQ ID NO: 2521 - DNA, 246 bp, Staphylococcus epidermidis
ctttgcaacagaacctgttttcttatatatctccttaatacacgctattttcaccaacaatttttccaaagtgttgcattttccaacgacgtaaaacttttaatggtaccgaacgtgggtataacttgttacattatcaaatgtaacattttaaatatgcttaatttgaggtatcgatttaatgtaattgctcacaaaacatcagcacactacccatactttaagcgatataaattaatgaaatag

SEQ ID NO: 2522 - DNA, 183 bp, Staphylococcus epidermidis
ggagtgagcaggttgattaaacgaatattaaagatttggtttactatcgcaatgtatgagttgggcaaatggattggcagagaagtttattataagttaactgcaaatgatgaggtggaagtgcctaaggactttgacgagaatgaccacgctcatttaaatggcatatacggaggttattaa

SEQ ID NO: 2523 - DNA, 642 bp, Staphylococcus epidermidis
cgattgataaggagtggtcaaatggacattgtaggaatgcagtttaattatcttaaagttctagagttttatggcagaaataaacataaaaagaaactatataaatgttactgtacgagatgcggtaataaaaaaataatgattggtaccgaagtgaaaaatggttattctaaaagttgtggttgtttgaataaagttagtcattctaaaaaacatggtatgactggaactttaatttataataaatggaaaggtatgaagcaacgatgttacaactctaactatgatttttacagcgcatatggcggtagaggtataaaggtttgtgatgagtggaaagatgactttatgcaattctacaaagatatgggggatgtaccattcgaaggtgctgaattagacagaattaacaacgatgacgattataaaccatcaaattgcagatgggttagtcatgaagaaaatgcaaacaatcgacgaaaatatcataataagacaggatatacaggagtaacttacaaaccacatctaaacaaatatcaagcgcagctttacaaaaacaagaaatttatatacttaggtgtttatgaaactgcagaagaagcacacttagcttataaaaaagctaaaaatgaatattaa

SEQ ID NO: 2524 - DNA, 270 bp, Staphylococcus epidermidis
atgaaacgaagtggaggcaaccagatgggacttatcgacggacttaaaaagcaatacacgttatatcagattgacggttggaagatgtgcagtgtaacgccgttaggggaagatacattcaaactaggtaactatgcaggcatacactttagaaacacattctcaggaacagtaacgaaagatgaactagaaaaactgaaacgcaaacataagcttttcagaaaagaagaactgcaacaacaaatgacaattaacgaattattattttga

SEQ ID NO: 2525 - DNA, 210 bp, Staphylococcus epidermidis
atgaaacgaagttcatacctacgtcgtcaatcaaatttaattatatctatgattattttcgttatttttttaattgtagatatcaatgtacttattaataaacatcaagttgtgcctgtgctattatcaagtatcagtttaattatttttatcatgctatttgtagttgcattgttcaaatgtataactaattataaacatcaatcttag

SEQ ID NO: 2526 - DNA, 783 bp, Staphylococcus epidermidis
gtacctatgagccatagttataattctatagaagaggtgctcaaagctgtaaaatcaaatcaactatctattaatgatgctaaagcccaactcagtcattatgacgaattgggctttgctaaaattgacttacatagagcacagcgtcaaggatttcccgaagttatctttgggcaaggaaaaacaaaagaacaaatcactaaaatcatctctagtttgatatttcataatgaagttattctagtgacacgtgttgatgaaatgaaagcaaaatacattttacaacattatccaaacttggaatatcatcaaactgcacagttaattagcactccactaaaagatataccacaatctaaatactatgtttctgtactttgtgctggaacttctgatttacctattgcagaagaagctgcattaaccgctgaaatcatgggagtaagtgtaaaacgattttatgatgtcggggtttcaggtattcatcgcttattatccaacattcatgatatacgcagagggaaagtttctatcgttatagctggaatggaaggcgctttagcaagtgttgttggaggattagtcaaccaccctgtatatgcagtaccaacgagtgtaggttatggagcaaacttgaatggggttaccaccctattatcaatgataaatagttgcgcacccggaaccagcgtattaaatatcaataatggatttggtggcggttacaacgctgcacagattattcatatgctagaaaataaagagagtgaggtatctttatga

SEQ ID NO: 2527 - DNA, 198 bp, Staphylococcus epidermidis
gtgatttggaggcttgcaatggacaatagagagtttatccaacgctgcatagtatcatctacagcttttacaggacacgatgggtgtttactaatcaaagagcttaacgaagtatatcgcaaggcagagttgtacgacaaaatagtggaaaataattcaaagagtttagtagaaaatggaggaacaataaatgactaa

SEQ ID NO: 2528 - DNA, 3123 bp, Staphylococcus epidermidis
tcaaagaggaggttagccatgaacaaaaactttatggctcgtatatcggcgattattacagattttcaacggaatatcagaaaagctcaacgtatggcaaaaactgaaatacccgatgaaattgaaacacaagtcgacgccaacataagtaaatttaaacgagccttaaatactgctaaagcaatggctcaacgttggcgagaacataccgttgatatagacggaaacgccaaccctgttaaacgagcaattgcagtagttagagaaaaactacaacagttaagagataaagaagtagacatcaaagggaataacaatcccttaaaacgttctgtactaggtgctaaagctatgcttgcaaccttacatgataaaacagtacacgttaactttgacacaagaggtatgacgagagcacaagtgctgacaagagcgttaggtcaatcgttagatgaatacggcgataaaatggacgccttagcaactaagataagaacattcggtactgtattcggacaacaaatcaaaggtatgttaattgcgagttttcaagggcttattcctatcatagctggattagtacctgcaatcatggcagtagctaacgcattaggtgtagttgctggtggtgcattaggagtagctggtgcatttggtattgctgcgagtggtgcgttcgcatttggtgctatggcagtaagtgcaattaaaatgttgaatgacggaacattacaagctactgcgcaaacaagaagataccaagcgtctttagaacaagttaaatcaacgtgggaaggcattatcaaacaaaatcaagctcaaatattcaatacgttatctaacgctttagatactgttaacgtagctttaggacgtatgaaaccattcttagcaggtatctctaaaggaatggaacaagcgtcacagagcgtcttaaaatgggctcaaaacagtcaaactgcgagtaagttctttaacatgatgaatacaacaggtgttaagacgtttaacacattattaagtgctgcaggacgttttggcgatggacttataaatgtgtttacacagttaggtccattattcttatggactgctaaaggtttagataatttaggtaagaagtttcaaaactgggctaacagtgtagcaggtcaaaatgctattaaatcattcattgaatacacacagactaatttacctaaaataggccaaatattcggcaatgtattcatgggtattggcaacttgatgaaagcatttgctcaaaacagttctaatatttttgattggttagttaaaatgactgccaagtttagagaatggtctgaacaagttggtaaatcagagggctttaaaaagtttgtacagtatgtacaagagaacggaccggttattatggatctaatcggtaatatcgtaagagtgttagttgcgtttggtactgctatggcaccaatagcaagtgtgatattaaaagtagtaacggcgttagctggtttcatcgctaagttgttcgaaacacaccctgctatagcgcgtatggttggtataggtatgatactcggtggtatgttgtgggctttattagctccaatcatcgcagtgagtacagtgttatctaatgtgtttggtgtaggtttaatccaagctatcggtaaaatgttagcttttgctagaaacactcaaatacttagaagtgcattaaacttagtgaaaatagccttcaggctccttatgagccctattagtacaattatgcgtatcttacctatgttaagtggtgctttccaagcattaggagtagctataggtgcgatttcatggcctgtattagctattataggcgttattgtcgctttaataggtattattgtttggttatggaaaacaaacgagaatttcagaaaaacttgcattgaagcttggaacacgattaaagatacgataatgaacgctgtaaaatcagtgattaactggtttaatcagttcagagcgtctatacaacaaacattgcaacctattattcctatcttacaaatgttaggtcaagtagctaaccaagttttaggcttcttattcatcagtcttattaacggtgtagtaatggcgttccaatatctatggactatcgtttcagtagtattcactgcgataggtggaattctacaagctgcgtcacaattattcattggattagctacagcatggatacaacttttatcaggcgacatacctggagcgtggcagacattacaaactatgacgcaaaacgtgatgaataccatttggaataccatattgtcaatctggaaccaaatttctaacttcatattcaacgttttaaacagaatactcggtactaacatcacaagttggaaccaaatttggtctgcgatttcaggtgcagttactagaatttggaatactgtagcaagttggttttcacgtgtagtttcaacagttgctcaaaaaatgatgcaagcgctcagtcgtattatttctggtggtgcacaatgggtttcaagcatcatttctgcaatgagtagatttttacaagcagtagttagtggtttcttcagagtggtcggcgctgttggaaatggcatgagaaacgcattaaatcgagcgcgcagttttattggtcatttctatcaagtaggcgttgatatgatagctggaatgataagaggtatcgttcaaaaagctaaagatttagcagcagctgcatggaacgctgcaaaaggtgcattgaacgctgcgaaaagcgctttagatagtcattctccttctcgtaaattcatacaactaggtaatgatagtatgactggattaggtatgggtatctctgaatatgcaggaaaagctgcaagagaaagtaaattagcggcattaaaagttatggatgccttcaacgcagacttaaaaccggactttttagaagaaggattggctggtttaggaaattctttcgatgcacatatgagtaaagacgtacgccatagcatgcaagagaacaataaacctatcgtcaacgtgactgttcgcaatgagtcagatataccagctattaaatcatacattgaagattccaactcaaaagacgcaagtttcggattattttaa

SEQ ID NO: 2529 - DNA, 387 bp, Staphylococcus epidermidis
gaagaaacaggaactattaggaggttagacattatgtcaatgactgaactagaagcaattgaaatcttagagttaataaataatgtctacgatatgaaattcaatgaaattaaatacaacctttgggtagaacaactcacacaatatggggatttcgatagaacactacacaaaacaaagaaatatgttagagaaagtcgttacaaacctacgatttcacaaattattgatcgcaaaccaccagaaatggaaagcgcagtaataccggaagaacagactgataaatacagaatgcagcacgataaagaatttagagagaaaaggcaacaattaagaaaacaatggcaaaagatgaaagaagattgggggttagatgatgagtattga

SEQ ID NO: 2530 - DNA, 699 bp, Staphylococcus epidermidis
gaagtgggagggttaaatgtgatttacatgtacgaaccatttactcacacggtgactaagacagacttatctcatctgcacaatattacaggtattcccctcaacacactgtggtaccaaaaagaacgtggcacatataacgataagttgaagtgcttctttaccgacacaatgccgagagtgaataagaaacaggtgttcaacgaaagtgttgtagcaaaagatgaaatttggaagtatagcgagaagtatgatctatacgtaagtaacttaggcagaatgaaaagacctgatggaaaatacaagtttgcgaatggatgtaacggtatttccacagtcatttataagaataagaagtatcgtgcagcagatattgtatatgaaacatttatcggcaatttgagaacagggtatcacgcttatcctaaggacagtagatacaacaatcttatggcagataacttattccaatctacattgcaaaaatatagagtgtatcgcagaaataaaggcatatctaagccagtatatcttgtcgataacaacaaccgaattgttgaagaattcgcaagtacagtagaagctcaaaaattattattcatagacagacgcaacatcgcaaggaagtgtaaccgtaaacatgtaagtgacggattgatgtatatgtgggcagacgaatacgaggagttaaacgcataa

SEQ ID NO: 2531 - DNA, 204 bp, Staphylococcus epidermidis
agaggcaagggaggtataaacaacatgattatctacagaagaaatatagaaaatggaacacccatttatgaaatcataactaaaactttcaagacaattactataaagtgtgatgaaacttttaataagtatgaaatctatcaattgctctctctactagagaatgacgttgacaacatgccgacaagttactcatatcgttaa

SEQ ID NO: 2532 - DNA, 1197 bp, Staphylococcus epidermidis
ggtatctttatgacaaaagcattatatttagattgccacgcaggtattgccggagatatgctactttctgctttagttgatttaggagcaaaccctgaagacattgaatcagaactaaaaaaattacctttagatcaatttaagctacattttcaaaaaagagtaaaacaaggtattcatgcaatgacattaaacattgatgttaaagaagcaaatcatcatcgtcacgttaatgatatatttaaaatgatagatgacagtacacttccggaaagggttaaatatcgcagtaagaaaatttttgaaatcattggtcaagcagaagctaaaattcatggcatgtcgtttgaagaagttcactttcatgaagtgggggcaatggactctattatagatattattggtgggtgtattgcactagaacaactagggattaacacattatactgttcagctattccaacaggtcatggtaaaatcaatattgctcatggcatttatccaatccctgcaccagctactgctgaaattcttaaaggtataccaatcgcacattttgatgttcaaagtgaactcacaacccctactggtgctgcatttgctaagggacttgtttcatcgtttgggccatttccttcagcaacaatacaacatataggctatggcgccggcagtaaggattttgatttccctaatatattaagggttattcaatttgaatctgaattcgagcaacaagatagcgtccaagtaatagagtgtcaaatagatgatatgacacctgaagcattaggttattttatgaataatgcgttagagcaaggtgctttagatgcttactatacgcctatatttatgaaaaaaagtcgcccaagcacgcagttaacgttaatatgtaaattacatgataagacatatttcgaacaacttatcttacaagaaacaagttctttaggcgtcagaagtacttctgttaatagaaagaccttgaaccgcgcattcaaaattctttctacacaacacggcactgtttccattaaatttggcctacaaaatggaaaaattatgaaaatgaaacccgagtatgaagatttgaagaaaatagctaaaactacaaaacaaccgtttcaagtaattcataacgaggtattacaacaactctatcaaacatatcatataggaaatatacttcaataa

SEQ ID NO: 2533 - DNA, 1500 bp, Staphylococcus epidermidis
gttttatttatggaaaataaaaataacaatgtagatagaggtaaccttaagcagaatctttccgagaaatttgtatgggctattgcatatggttcgtgtatcggatggggcgcttttatattaccaggagattggattaaacaatcagggcctattgcttcttcaataggtatagtaatcggtgcgttattgatgattcttattgctgtaagttatggcgcactcgttgaaaaatttcctgtttctggtggcgcatttgcttttagttttttaagttttggaagatatgtaagctttttctcttcatggtttttaacatttggctatgtttgtgttgttgcgttaaatgcgacagcattcagtttgttgattaaatttttattaccaaatgttttgaacaacggtaagttatatacagtagctggttgggatgtttacataactgaaattgttatcgcaactgtgctacttatagtgtttatgttgattactattagaggtgccagtgtgtctggttcgttacaatattacttctgtgttgcaatggtccttgtagttgcacttatgtttataggttctttctttagcagtcactttagtttgagtcatttagagccattagcgagtgtagataaaggatggtttcaatcaatcattatgattgtctctattgcaccatgggcgtacgtagggtttgataatataccgcaaactgctgaagaatttaacttttctcctaacaagacgtttaaacttattgtttatagtttactagctgcgtcactcacttatgtagtgatgttactttacacaggctggctaagtacacaagcaacaagtttaaatggtaacttatggcttacaggtgcagtgactcaagatgcattcggttttattggccttgcagtattagcagtggcaattattatggggatttttactggattaaatggatttttaatgagttcgagtcgcttattattttcaatggggcgctctggcattatgccaacagtatttagtaaattacacagtaaacataaaacaccatatgtcgctattatcttcctagtagctgtatctttaattgctccttggttaggtagaacggcattaacatggattgtagatatgtcatctacaggtgtttcaattgcatattttattacttgtttatctgctacgaaattatttagttttaataaacagagtaatacgtatgcaccagtttataaaatttttggtattataggatcgattgtatcctttgtgttcttatgtttattgcttattccaggttctcctgcagcactttcgataccatcatacatcgctttaggaatttggttggtaataggattaatcttttttatcattcgcttgccaaaacttaagaaaatgaataatgatgaattgagtcgattgattttaaatcattctgaagacgaagttttagagatggttcatgaacctggtcaatctaattcaacgaataaatag

SEQ ID NO: 2534 - DNA, 1164 bp, Staphylococcus epidermidis
tggagagttataaaaatgaaacaacctgttattattgcagcaaaacgtatagctttcggtaagtatggtggccgattgaggcatttagaacctgaatcattactagaacctttatttaatcattttacagatcagtatccaaaagtaatgtctcttttggatgacgtcattttaggtaatacggtaggtaatggggggaatttagctagaaaatcattacttgaagcgggattagattttaaaatacctggtataacaattgatcgtcaatgtggctcaggtcttgaagccgttatacaagcctgtaggatggtacaaagtggtgctggaacaatatatattgcaggtggtgttgagagtaccagtagagcaccttggaaaatcaaacgtccgcagtcagtttatgaatctgagtttccacaattttttgaacgggcgccttttgcaagagaaggagaagacccttcaatgattgaagcagccgaaaatgtagcgaagaaatatcatatcagtagaaatgaacaagatgactttgcgtatcgcagtcatcagttggcatcaaaaaatatgaataacggtaatatttcccaagaaattttaccgttcaaagtgaaaggtgaatattttaatcaagatgaaagtattaaacctcaacttactctcagaacacttggcagacttaaaccacttttaaatgaaggaacagtcacagtaggaaatagttgtaagaaaaatgatggtgcagtattactgattgttatggaagaaaatcgggcacgtcaattaggattcacagaagggattaagtttgtgaatagtgcaactgtaggtgttcaaccacagtatttaggagtaggtccagtgccagcagtaaatcaattattagctcaagaacgattaactataaatgatataaatgcagtagaattaaatgaagcatttagctctcaagttattgcgagccaacaacagcttaacattcctttgaataagttgaattgttggggaggagcaattgctacagggcatccatatggtgcaagtggagcagcgttagtcacacgtttattttatatgaaacatcaatttagaactatagcaactatgggaataggtggagggataggaaatgcagctttatttgaaagatggtatggaaattag

SEQ ID NO: 2535 - DNA, 1245 bp, Staphylococcus epidermidis
tatagaattttattaacttatgtacggaagtatagacactcgattaatatcggatgtataccgactaaaacattaattcatgatggtattgaaggtagttcattcaaagaggctattactagaaaaaaagaagtcgtacaggcattgaataacaagaactatcaaggcttaaattcaaaggacaatatagatgttctaaattataaagctaattttatttctaacgaggtaatagaactacaagataataatggaacaattcaagaaacaattacagcagataagatagtaatcaacactggttcacgtgcaaatatcccagatatcaaagggatagatacagctcaaaatatatatgattctactggattactaaatattgactatcaacctcaagaacttgttattattggtggtggttatatcgctctcgaattcgcttcaatgtttgcaaattttggaacacatgtaacaattcttgagcgtggtgatgctatcatgacaaatgaagatcaagacattgcaaatcttattgtcaaagatttacaagataaaggtgtgactataaacactaatactagtactattgcattttcaaacaataaagatcaaactatcatacacacaaatcatggagaaatatcagctgatactgtgctcttagccacaggtcgtaagccaaatacaaatcacttaggtcttgaaaatacagatgtaaaaatcggaaaacaaggtgaagtaattgtaaatacacatttgcaaagtacagtgaaacacatatacgctgcaggtgatgttaaaggtggattgcaatttacgtatatttcactcgatgattatagaatcattaaatcacatctatttggtgatggttctagaacaactgaaaatcgtggtgcaataccttatacggtctttattgatcctcctctatctagagtaggactaattgcaagtgaggcgaaattacaaggatacgatattctagaaaataaagtctttgtcagtaacataccccgtcacaaaatcaataatgattccagaggtttatttaaagcagtaattaataaagatacaaaagaaattttaggagcgtcattatatggcaaagaatcagaagaactgattagcttaatcaaacttgctatagatcaacatattccttacacagtattaagagataatatatacacacatccgacaatgaccgaatcctttaatgacttgtttttagaaccactttga

SEQ ID NO: 2536 - DNA, 501 bp, Staphylococcus epidermidis
atgtctgctatcattgaagcaaaaaaacaacaagtcgatactatcgctgaacaacttaaaaattcagtttcaacagttatcgttgactaccgtggtttaactgtagcagaagttactgaattacgttcacaattacgtgaagcaggtgttgagtataaagtatacaaaaacactatggttcgtcgtgctgctgaacaagcaggtatcgaaggcttggatgaattcttaacaggtcctacagcaatcgcaacttctactgaagatgttgttgcaccagcaaaagttattgcaggatttgcaaaagaacatgaagctttagaagttaaaacaggcgttatggaaggtaacgttatctctgctgaagaagttaaaacagttggttcattaccttcacacgatggtcttgtatctatgcttttatctgtattacaagcacctgtacgcaacttcgcttatgcagttaaagctgttggagaacaaaaagaagaaagcgctgaataa

SEQ ID NO: 2537 - DNA, 882 bp, Staphylococcus epidermidis
ggtgttcatatgacaaataatcactttcttaacataggtgtgttactgtatggatgtggtcatcatcaagcggcatggcgtatgaaagattctaatattgaggatatcggcaacatatcttattatcagcatttagctcaaatagctgaaaaaggtcttttggatatcgtcttttttgcagataatcaagcctttaatgcaagtgataatactactatgcccgctttttggtttgatcctataattaacttatcagctattgcacaagttacatcacatataggattagtgccaacaatatcgagtacattttcaaatccattcaccgcttctcgtcaattattaagtctagactacttatctcatggccgtgtgggttggaatttagtcacatccatgacagatattgaagcccaaaatcacagtcttcaatacttaccagaaagacatgagcgctacaaaaaagcagatgaatttgcatcggtaatgaatcagctattcacttcttggtcaactgcatcttatgtaccagataaaaacaacaacaaaattattgagtctaaagatattaaacctttttatcatgagggagactattttcaagtacgaggaccacatacaacaccacaaagtcctcaaggtaaaccagtatctatgcaagccggtgcgtcaaaagaaggtattgcattagcagcaaaatatgctgatgctgtttactctgtttcatgggatatcaagcaagcacgtagttataaaaagaaattgtctgatgctatttctaaaactcaacatccagatagaaaaattaaaattttccctggtttagtaacttatgtaggtgaaacccatgaaaaaagcattatcaaaaaaagcagaacttga

SEQ ID NO: 2538 - DNA, 447 bp, Staphylococcus epidermidis
atcatgagtattaaagatttgaatagaggcgatagaatcagaatgcaagaagttaatggtgttgaaattacagtgcaaataaaaaatgtttatcgtttagttcagtcaagtcttgatatggataaatgggttgctgatgtagaagcaattgacgggagaacttggactattgatgattgttatgatttttactcattacctaatggaaatgaaggaactaaaaagacattagatgacaaggttaaccacccgtcgcattacacgtatggagatatggaaattatagatttcatagagcaggtcactaaagattacaaaccagagttagcatttgcgattggtaatgcaatcaagtatataagtcgtgctaatcgtaagaacggtaaagaagatttagacaaggcgcgttggtacctgaatagagcatttgagaagtgggagggttaa

SEQ ID NO: 2539 - DNA, 1251 bp, Staphylococcus epidermidis
atgatgagtattgatgtattgagtaccgaagaatctataatatctaacctcatgcgtaatccagaattactaggtaaattcagattaaagcctgaaatgtttactgacgagaaattaagagtgttcattgagtatgtgttagagcaaggcaaagtcgatgtaaatcaaatctactttaaaagtcgtgatgataatgaatttatatctactgaccgattaggtcgtttatacaattcagacggcactgacaaggcgttttttatggacgaccaattgaatctattacaagaatacgtcttgtcacaggctcgtgagaagctcacagagtatcaatcaatgccaagtaaagaaaattttaattatttggtagaggaattagagaaattaaaaggtatgacaataaaaaaatcagacgctaccgatagttttttagctgaagttgtagaaaatattctatctgatgaaccaaaacaatttattaaaactggtattgcttctatagataacaaaatcattggctttgaaccaggtcagttgaatgtattaggtgcaagaccttcgttaggtaaaacttctcttgcattaacaatgatgtggaatatcgcgcagcgtggatatcctacaacgttctttagtttagaaactggaggtaacaatatcgttgagagattagttgcaacaataacaaatattccactatctaaaatcaagcaaggtaacggattaaatgatgatgaagtttcatcggtaatgtctgctatagatcaaattaaaaaatgtaattctttgaagattgaggaccaagcacaaatgacaccacaagacgttcgagaagttgcttcacagaaagcagataagcctcacgttatatttattgattatcttacactcatgcaatcagatgtacctcaacgtgatagacgattagaagttgaaaagatttctcgtgatttaaaaattatagctaaagaaacaggttgtatcattatcgcactatctcaattaagtagaggtgtagaaagtcgtagtgataagcgtccgatgatgtctgatttaagagaagcaggaggaattgagcaagacgcgaatatgattttcttcttataccgtgacgattattacgaccaagaccaacaagacaacattacaggcaagtcggaaattgaattcattatttctaaaaataaagacggagaaacaggggtagcacaccttgatttctacaagaaaacgcagaggttttatggatga

SEQ ID NO: 2540 - DNA, 1245 bp, Staphylococcus epidermidis
gaaactatcatgagagataaatttgaaataacttttattaagaataggagagatttaataatggcaaaagaaaaatttgatcgctcaaaagaacatgccaatattggtactatcggtcacgttgaccatggtaaaacaactttaacagctgctatcgcaactgtattagctaaaaatggtgacactgttgcacaatcatacgatatgattgacaacgctccagaagaaaaagaacgtggtattacaatcaatactgcacatatcgaataccaaactgacaaacgtcactatgctcacgttgactgcccaggacacgctgactatgttaaaaacatgatcactggtgcagctcaaatggacggcggtatcttagttgtatctgctgctgacggtccaatgccacaaactcgtgaacacatcttattatcacgtaacgttggtgtaccagcattagttgtattcttaaacaaagttgacatggtagacgacgaagaattattagaattagttgaaatggaagttcgtgacttattaagcgaatatgacttcccaggtgacgatgtacctgtaatcgctggttctgcattaaaagcattagaaggcgatgctgaatacgaacaaaaaatcttagacttaatgcaagcagttgatgattacattccaactccagaacgtgattctgacaaaccattcatgatgccagttgaggacgtattctcaatcactggtcgtggtactgttgctacaggccgtgttgaacgtggtcaaatcaaagttggtgaagaagttgaaatcatcggtatgcacgaaacttctaaaacaactgttactggtgtagaaatgttccgtaaattattagactacgctgaagctggtgacaacatcggtgctttattacgtggtgttgcacgtgaagacgtacaacgtggtcaagtattagctgctcctggttctattacaccacacacaaaattcaaagctgaagtatacgtattatctaaagatgaaggtggacgtcacactccattcttcactaactatcgcccacaattctatttccgtactactgacgtaactggtgttgtaaacttaccagaaggtacagaaatggttatgcctggcgacaacgttgaaatgacagttgaattaatcgctccaatcgctatcgaagacggaactcgtttctcaattcgtgaaggtggacgtactgttggatcaggcgttgtaactgaaatctttgaataa

SEQ ID NO: 2541 - DNA, 477 bp, Staphylococcus epidermidis
gtgaaacccatgaaaaaagcattatcaaaaaaagcagaacttgatcaaaaattacccattgaagatgctttaaagcaactcagtttttttgttcaacaagattgttcagattgggaattagatgaaccagttcctcccttacctcctgctaaaaatttcaaaggtccgattggtcgatatgaaacagttttagccattataaaagataaacaaccgactgtaagagaattattaggttacttaagtgccggtggtggtcatcttactcttataggtacacctgaggagatagtggatgagatggagcagtggtttaatgaaggcgttgcagacggctttaatctgatgccaccttcattaccccatagccttgaagattttttaaaatacattataccagaactacaacgtcgtgctttatttaaaaattcttataatcaatctacactacgtacattattaaatctcgactcataa

SEQ ID NO: 2542 - DNA, 690 bp, Staphylococcus epidermidis
aaaggagtcttttgtatgaactatttcagatataaacaatttaacaaggatgttatcactgtagccgttggctactatctaagatatgcattgagttatcgtgatatatctgaaatattaagggaacgtggtgtaaacgttcatcattcaacggtctatcgttgggttcaagaatatgccccgattttatatcagatttggaagaaaaagcataaaaaagcttatgacaaatggcgtattgatgagacgtacatcaatataaaaggaaaatggaactatttatatcgtgccattgatgcagagggacatacattagatatttggttgcgtaagcaacgagataatcattcagcatatgtatttatcaaacgtctcattaaacaatttggtaaatctcaaaaggtaattacagatcaggcaccttcaacgaaggtcgcaatggctaaagtcattaaagcttttaaacttaaacctgactgtcattgtacatcgaaatatctgaataatctcattgagcaagatcaccgtcatattaaagtaagaaagacaagatatcaaagtatcaatacggcaaagaatactttaaaaggtattgaatgtatttacgctctatataaaaagaaccgcaggtctcttcagatctacggattttccccatgccacgaaattagcatcatgctagcaagttaa

SEQ ID NO: 2543 - DNA, 537 bp, Staphylococcus epidermidis
cctttaataattgaagggtggtttctaatgttaataaatgtacttaatttaaatgactcacaagacggcaatcgcattaaacaaggtgacttatcgcacatgcgatacatcttgtctgacaataacaacgaagacttaaaattagaaggattgcctgcaaaagtttttctcactgacagtacaggtgtcaaatatatctacgacactacagttaggcaatatgacaatgcctatgtgtgtgatgttgtaatcaatcaaattatccctgcaaacacgtattcattagaaatatgggtggataacaagtatgtattcccgtccgacaataaagcgaaaattcaagtaacagagagtgtgattggtaggcaattgatcaatacacaaaatcatgatttatggcaagaaatgattgaatacggtgtaaaaaacggattaattaagaatcaaactgaaagcgaagaaaattttgttattggagagaacgcccctaatgacacaactaaaatttggattgatactactggaggtaatgaataa

SEQ ID NO: 2544 - DNA, 369 bp, Staphylococcus epidermidis
gtgagaataatgaacaaagaacagattctacaattgattgagcaagaattgatacaagcagatgaagctcagacagatacggaatttgaaaagcatatgtatgctatacacatgctcacatctcttgttagttctcatcaaagtcgttctacaatagagaaattaaatcattctaaaccaatgaatagtaatatcaaagatgattatgagatgaaacaacagtcttcacaaaaacatcatgtaactgcagctgaaatagaagcaatgggtggtaaagtaccacaatcaatgaaaaagcatcatacttctaataatatgatgattacagatgatcaagttggtaatggtgaatctatttttgatttttaa

SEQ ID NO: 2545 - DNA, 711 bp, Staphylococcus epidermidis
gcgcatgtaatcatgattttttttcatatgtgttggaatacctcacttatggtacaatactcattgtctatcttaacatttggagaagtgattatgaataaaccatttattgcaatcgaaggacctataggtgttggtaaatcctctcttgctcaccgattaagcaagacgtttggtttttatgaagagaaagaaattgttgatgaaaatccatttctatctgatttttatgatgatatagaaaagtggagttttcaaactgaaatgttctttttatgtaacagatataaacagattagagatattgagtcgctaaatcaaggtatagttagcgattatcatattcataaaaataaaatttttgctaaaaatactttagatgctaaagaatttgataaattcagtcgtatttttgatattttaactgaagatatcgaaatgccaaatacaattatctttttagatgctgatttagatgtattaaaatctagaattgcacaacgtaatcgtagctttgaatctcaaatagaagatgactatttacttactttaaaaaaagattatcttgcttattatgaatcattaaagaatgacggtgcaaatgtcattcgaattgatacatctcaacaagatttcgttaaaaatgattacgattaccaaaatattttaaatttagtaaaacctatgattggagaaaataaagatgaataa

SEQ ID NO: 2546 - DNA, 609 bp, Staphylococcus epidermidis
ggagtagtaataatgaaaagagaatttttacgtggtttaggtgtcgaagaagatgctattcaaaagattatcgacgaacatcatgaaggtttgcaatcttataaagaaaaagtagagaaagttgactcactaaaagaacagttggaaactgctaacgaagaaattaaaaatcgtgataatcaaatcgaagaactcaaaaacaatgttggcgataacgatgaacttaaacaagagttagagaaatataaagaacaaaacgccaactacgatcaaaaactcaaagatgttcagttgaacaaagctatcgaagtatctttagctaaagagaaagcaattaaacctgaacaagtaatcaaactaatcgataaagataatttagaagttgatgacaatggaaatgtcaaaggattagacgattacatgagtgagttcaaaaaagagaatgagcatttgtttgaacaatctaaaccaagtggacgcacaccagatgacggtaaaaacgtaaatggtgggattacacaagaagaatttaacaatatgagtgtcgcagagagaactaatctattcgttaacgatagaaaaacttacgacactctaataaacaattag

SEQ ID NO: 2547 - DNA, 687 bp, Staphylococcus epidermidis
atggtagtaataaaaaactacattacagaagatgacggtacaacaactgtagtcatcaaaggagtagaactagataacaaaacatcattacttttagacaatggttacgaagttgaagtggatgtaagggtagttgatccattcaaaattacagataagcaacgtagaaaagtgtttgctctttgtaacgatatagaatgtgcaacgggccaaccccgtgactatatgaggtatatgttcatggattacgtagaagtcctctacggctacgaaaaacgcctctctttgagcaattgtactagagaacaagctagtcaaattatagaggtcattattgactgggtgtttcataacaatatcccactcaactataaaacaagcgacttacttaagaatgataaggcgtttctttactggtcgacagtcaatcgtaagtgtgtaatatgcggtaaacctggagaattggcacatcataaagcgattggcagaggtgctaatcgtaagaaaatggatcattacggatatgaagtgttggcgctgtgtcgtgaacatcatcaatcgcagcatgatatgggtgtagaaacctttgataaattacatcaccttgaaaattcgtggctttcagtagatgagcgcttaaacaaaatgttgaaaggagttaaaaatgaattcgagagtaataactaa

SEQ ID NO: 2548 - DNA, 201 bp, Staphylococcus epidermidis
cctcctaaaatcccaaaatataaaaagtgtaaaaatagcaagatagaaagtaaaaacatggtaacggaaaacccaatcgttacatattccttgtatttaattccttcaacaaaaagatatattataaatatctccattaaaacaaagactatagacaatgttataattgtaatcatatatataatttcacccaatatttaa

SEQ ID NO: 2549 - DNA, 579 bp, Staphylococcus epidermidis
aggtgtaaaataatgaaaggtttaattattatagggagtgctcaagtagggtctcatacgaacgctttatcaaaatatttaaaaggtcaactcggcgaacatgatgttgaggtggaaatctttgacctagctgagaaacccattcatcaattggattttgctggtacaacacaagcagttgatgaaattaaaaacaatgtcaaatctttacagagtaaagcaatggaagcagatttcttaattttaggaacgccaaattatcatggatcgttttcaggtattcttaaaaatgcacttgaccaccttaatatggaccatttcaaaatgaaacccgtgggactcatttgcaatagtggaggaatagtaagttctgagccattatcacacttaagagtcatcgtacgtagtttacttggtattgctgtaccaacgcaaattgctacacatgactctgattatgctaaattagaagatggtaccttatacttagaagataatgaatttcaactacgtgcaaaattgtttgttgatcaaattgtatccttcgtaacaaatagtccatatgaacacttaaaataa

SEQ ID NO: 2550 - DNA, 183 bp, Staphylococcus epidermidis
tataaaaaaatcactttaaaagacggactgctttttaaaaaaatgtttattgagacagaggattttatgtttaactatagtacatctaaagctcttttaagtgattttcaaaataataattttaattactttattcaaaataaaaaagagcgtgttatatttgaagatgggcatttcctctaa

SEQ ID NO: 2551 - DNA, 678 bp, Staphylococcus epidermidis
ttggagaaaataaagatgaataattatggtattcctcaaaatgcagtaataaccattgctggcactgtaggggttggtaaatctacgttaacacaagcacttgctgacaagttaaattttaaaacttcctttgagaatgtagaccataatccttatttagataaattttatcataattttgaacgttggagctttcatcttcaaatttactttcttgctgaacgttttaaggaacaaaaacgcatgtttgagtatggtggcggattcgttcaagatcgttcaatttatgaagatgtggatatttttgcaaaaatgcacgaagaacaaggaacaatgagtgctgacgactaccacacgtattacgaattatttaatgcaatggttatgacaccttattttccaaagcctgatgttctgatttatctagaatgtgattatgatgaagtaattgatcgtattcaacagcggggacgtgacatggaaatcaatacagatccagaatattggaaaaaactatttaaacggtatgaaaattggattaacaattttaatgcatgtcctgttgttcgacttaatattaatgaatatgacatacacgaagacgtagactcccttgattcagtcattgataaaattgctcaagttattaaagcataccgacaagtggatacaagataa

SEQ ID NO: 2552 - DNA, 2706 bp, Staphylococcus epidermidis
attaatgaaatagggggaaatgtcttggcaaagctattatacaaactaggaaaatttatagctaagaacaaatggctaagtgttataggatggcttgttatactaggtgttattatcacgccattaatgataaactcaccgaagtttgacagtgacatcactatgaacggccttaagtcattagacacaaacgataaaatcagtaaagaatttcatcaggacagtgagaaagcctcgatgaaaatagtcttccattctaataagaatgatggactcaataataaagatacgaagaaagatattgaagatgctttagacaatatcagacaaaatgatgattatatccaaaatatctctaatccatatgacagtggacaagttaatgatgaaggcgatactgctatcgctaacgtaagttatgtagttccacaaactggattaaaagattcttctaaacatatcatcgacaaagaattaaaagatgtaactgacaaccataatgtgcaaattgaaaaaactcaaggtggcgctatgaattccgaacctggtggtacatcagaaattgtcggtatcatcgtagcattcgtaatcttacttattacctttggttcacttatcgcagctggtatgccaattattagtgcaatcatcggtttaggttcaagtgttggtatcatcgcattattaacatatatctttgatattccaaacttcactcttacactagctgtaatgataggtttagctgttggtattgactactcactctttattctatttagatttaaagaacttaagaaaaaaggtgtcgatactgtagaagctattgcaacagcagtgggtacagcaggcagtgctgtaatattcgctggtcttacagttatgattgctgtttgtggtttatcacttgtaggaatcgacttcttagcggttatgggattcgcttcagcgattagtgtgttatttgcagtattagcagcattaacactattacctgccctaatcagtatcttccataaaagtattaaaattaaagataaaccaactaaaagtaaagaccctaaagatcattcttgggcaaaatttattgttggtaagccagttatcgctgttattgtaagtttaattattttaattttagctgctataccagtcagtggcatgcgtttaggtattccagatgatagtttaaaaccaactgactcatcagaatacaaagcctataaattaatctcagataattttggcgaaggttataacggacaaattgtcatgttagtaaatacaaaagatggtggaagtaaaagcactatcgaacgtgatttaaataatatgcgtagtgatttagaagacattgataatgttgatacagtttcaaaagcacaactaactgacaacaacaattacgcattattcacaatcattcctgaaaaaggaccgaactcacagtcaacagaaaatctagtatatgatttacgtgattatcatagccaagcgcaagaaaaatatgactatggcactgaaatttcaggacaaagtgttattaacatcgatatgtcagaaaaactaaacaacgctattccagtatttgcaggcgttattgttgtattagcattcttcttattaatgattgtgttccgttcgatcttagttccattaaaagcagtactaggctttatcctttcattaatggctacattaggtttcacaacattagtcattcaacatggctttatgggtagcttatttggtattgaaaacacaggaccattacttgcattccttccagtaatcacaattggattgttattcggacttgccatcgactacgagctcttcttaatgacacgtgtacatgaagaatacagtaagactggcgataatgatcattcaatccgtgtaggtatcaaagaaagtggacctgttatcgtagctgctgcacttattatgttcagtgtattcatcgcattcgtcttccaagatgacagtgcaattaagtcaatgggtatcgcattaggtttcggtgtgttattcgacgcattcgtcgtacgtatgacattaattccagcattgacgaaactctttggtaaagcttcatggtaccttcctaaatggttaggtgcagtattgccaaacgttgacgttgaaggtaaagctttagaagaagataatcatcacgacacatcttctgaaaaaggtcatgtcaacgataaaaatagtgaatactctagacaagacaaagataactatgtttatcaaaatgacaaacgtaactacaatcgcaattataatgacgaagattataaccgttctgtgcatttaaataatcatcatgaccagcatcatcgccaacatcaatatgataatcaacgtgatgatatcgactatgaatcactttatactcaagatggcgaccatactcatcatgatgaacgtaattataatgatcgacactatcaagacaattacgatagaaatgatgattatcgtcacaacaatcatgatcatcaaaatgataaccatgattatcatgattcaaattttgataaaacaacaaacttatacaaagaattaactgatagcaatattgatcaagatgtattattcaaagcattaatgttatacgctcgtgaaaacaacaaaggtgtttacgatagatataaccgatcatctcaacatcgtcatgatgacgaacttagagactaa

SEQ ID NO: 2553 - DNA, 510 bp, Staphylococcus epidermidis
gtggaggaaataagaccaataacctatcaagataaagaggcatactattattatattcaagagtggtatgaaaatgaggaaaaagtggtaccagggaatacagatattgccaattatagttcatttaacaatatggttgatcggcttaattgtagtgaagttgatgagggttttgtaccgactacaacactattttattttaaagattcaattattataggtgctgttgatatcagacatcaattaaatgataaactatctaatattggtggtcatgtgggatacggtgtagctaaatcttatagagggaaaggttacgctactatccttctagaaaaggctttagatgaacttaagacattaaatgtagaggtcgtacttatgacttgtaatccacttaattttgcttctcaaacagtgatgaagaaatgtggtggatatcaaattgaatcctatattaaaaaaaatggtaaacctgttcatcgatatcatatacctaatacaaaataa

SEQ ID NO: 2554 - DNA, 1068 bp, Staphylococcus epidermidis
aagttgcgaattcaattattactggagctgttgataatgattaatcaagtatatcaattagtaagtccacgacaatttgaagcaacatttaaaactattgatttacataatcataatagcaaagttattgttcgacccttatatttgtcaatttgtgcagccgacttgagatattattgtggaaatagagatagcaaaattttatctaagaaattacctatgtcattgattcatgaaagtgtaggtgaaattgtatacgactctgaacatcgactgaaaaatggaactaaggttgttatgattcccaatacaccgtctaaatcgcataatattattgcagaaaattatttaacttctagtcattttaagtcaagtggttatgatggttttatgcaagattatatagtaatgaaacctgatagagtagtcactttaccacaagaaattgatttgagtgtagcgtcgtatactgaattagttacagttagtgttcatgcaatagatcgttttcaatcaaaagcaataccacaatttgaatcattggggatatggggagacggtaatttagggtatatcactgcagttttactaaaaaaactatatcctactacaaaaataatagtttttggaaaaacattatataaattaagccgtttttcatttgtagatgaaattattcaaattgacaatattcctcaacatatcaaaattgatcatgcatttgaatgcgtgggtggtaaaggaagtcagcaggctattgaacaaattattaatattattaatcctgaagggagtatcgctttattaggagtgagcgaactgcctatacaagtgaatacaagaatggttttagaaaaaggtttaactataattggtagtagcagaagtggtttaaaggattttgaaaaaactattgaattgtatcgtaaatatcctgaagttcttaatcaattagcattacttaaaggtaaagaatttgaaataaataccatagaagatctcattacagcgttcgaatatgatatttctaacgcatggggaaaaacagttttaaaatggaatatttaa

SEQ ID NO: 2555 - DNA, 444 bp, Staphylococcus epidermidis
ataaggagaattcgaatgactaatttaactattttaacaggacgtatcactaaagatttagaacttaaacaagcaggacaaacacaagtaactaacttctctatggcagtggacaatccattcaaaaaagatgacacatcattctttgacatcgtagcgtttggcaaaactgcacaactattaaacgactattgcggtaagggaagcaaagttttaatcgaaggcaacttgaagcaagaccgtttccaagataaagaaggacacaatcgttcagtagtacgagtaattgctaacagaattgaatttttagatagcaaaggtagtaaccaacaaaacaaccaacctcaaaagcaacaagaacaaactactgaaacaaaaagcaaaaatccgttcgcaaatgcaagtggccctattgacattactgatgatatgttgcctttctga

SEQ ID NO: 2556 - DNA, 744 bp, Staphylococcus epidermidis
aggtgtttgatattgaaaattattaatttagattcaaaaaatcttgcgtcattttatgtagcatgcgagttgtttaaacaaatacagcagcaccctcatgccaaactcggtttagcaactggtggaactatgactgacgtatatcattacttagtaaatttattaatcaaaaataaagttgatgtgtcgcaggttgaaacatttaatttagatgaatatgtaggtttaaaagcaagtcatcaacaaagttaccatacctacatgaataaagtgctatttgagcaatatcctcattttgttaaaaatcacattcatattcctgatggcttatcagaaaatctagaagcagaagcggaacgatataacaatttattagatgaaagagggccaatcgatattcaaattttaggaattggagaaaatggtcacattggttttaatgaaccagggactgacttcaatagtgaaacacatgtggtgaacttaacagaaagcaccataaaagcaaatagtcgattttttgacaatgaaaaggatgttcctagacaagcagtttcaatgggggtaaaaagtattttaaaagcaaaaaggattatcctactcgcatttggtccaaagaaaaaagaggctataagtaaactgttaaatgaacaggttaccgaagatgtacctgcgaccattttacacacacaccctaatgttgaagtttatgtagacgatgaagcagcgccagattgtttataa

SEQ ID NO: 2557 - DNA, 810 bp, Staphylococcus epidermidis
ctgtttgtgatagaatttgatatgaatccaataaaaattttgaaaaaggagcgaataataatgagtgaagcagcagaaactttagatggttggtatagcttacatttattttatgcagtagactggacaacttttcgtttaattgctgaagatgatcgtgaagcaatgattactgaattggaaacatttattaaagataaaacagttgctagagaatcacatcaaggtgatcatgcaatttataacattacaggtcaaaaagcggaccttttactatggtttttacgtccagaaatgaaagagttaaatcaaattgaaaatgagtttaataaattacgtatcgcagactatctcattccaacttattcctatgtgtcagtgatagaattaagtaattatttagcaggcaaatctgatgaggatccttatgaaaatccccacgttaaggcacgattataccctgaattaccacattctgaatatatatgtttctatccaatggataaacgacgcaatgaaacttataactggtatatgttacctatcgaagaccgtaaaactttaatgtataaccatgggatgataggtcgtaaatatgctggtaaaatcaaacagtttattacaggttcagtaggttttgatgactatgagtggggtgttacattattttcaaatgatgtacttcaattcaaaaaaattgtctatgaaatgcgttttgatgaaacgactgctcgttatggcgaatttggtagtttctatattggtcacattctaaacatcgaagacttcaaacaattttttagtatataa

SEQ ID NO: 2558 - DNA, 582 bp, Staphylococcus epidermidis
gagaatcagataatgccgtcagcaaatcaaaagcgtatgattaaacatattcatgaaacagtgtttatacttttacatgattatcattttgatgaaatcacggttcaaaaaatatgtgatattgcagaaatcaaccgcagtacgttctatagatacttccaagataaatatgaattactctacactttacctgactttattacacaacaaattatagctaaaagtgacacatcagcagacattacaacccctgaatcatttgaagactttatctattacattggtaataataaaaagatttttaagcatctattagtttcgtctcgacaggcagatgtatttagaagtttaacgaatgtgagtcgcgaaatgatgttaaataacccaactcgtaagcgtgcccccttagcgcaaaagattagagaaagtaaacatcctgaaattgtagctgatttttacagtagtggcgtaatagaagtactaagacgttgggtagaaaatgactataactatacagttgaagaagtgtttgtaacattaaataatgtgcttgaaacgtcattatattgttatgataaataa

SEQ ID NO: 2559 - DNA, 1314 bp, Staphylococcus epidermidis
tgtggacagataaacaacaaatcgaaacgactgcgatggtgcatttcgatgatgatatcaattaaattatccgaactgttacctaaacactttcatagcttgtggaaagcgactaaagatagagagaagcttaacatagtagcaaaaggtggacgtggtagtggtaagtcgtctgatatatctattatcattacacagttaatcatgcgctatcctatgaatgcagttgtagtacgtaagactgataatacattagctacatcagtatttgagcaaatcaagtgggcgatagaagaacaaaaggtgtcacacctgtttaaagttaaagtgtcgccaatggaaataacatatgtacctagagggaatcggattatcttcagaggggcgcagaaccctgaacgattaaagtcgttaaaagatagtcggttccctttttctatcatgtggatagaggagttagcagaatttaagacagaagatgaagttacgacaattactaactctatgttacgtggtgaattagatgacggattattttataagtttttctttagttataacccacctaagagaaaacaatcgtgggttaataaaaaatatgaaacctcattccaaccagataacacattcgtacatcattcaacgtacttagataacccttttatctctaaacagtttatacaagaggcagagagtgctaaagaacgtaacgaacaacgttatcgttgggagtatatgggggaagcgatagggagtggcgttgtgccgtttaacaatttacaaatagagaagataccagatgagttgtacgataatttcgataatataagaaatggtgccgattttggttatgctgctgacccgttagcatttactaggtggcattacgataaaaagaaacgcattttatacgctatggatgaaatatatggtgtacaaatgagtaacagagaattcgctaaagaattatggaaacgcggttatcaatcagatgaaatatattgtgactccgcagaaccgaagtcaattgatgaattaaaaaaagaacatgggattaagcgtgtcaaaggtgttaagaaaggccctgacagtgttgaatacggggaacaatggttaaatgatttagacgctattgttattgaccctaacagaacacctaacatagcaagagagtttgaaaatatcgactatgaaacggacaaagacggtaacgttaaaccgagattagaagataaagacaatcacagtatcgattcctgcaggtacgcgctctctagagacatgaggcagaataaacttagcatacttacgtaa

SEQ ID NO: 2560 - DNA, 1284 bp, Staphylococcus epidermidis
ttggaggggataaaagtgaagacgcaagttttgtacggaaaatctgaaattgaaatcaatgtgcctgatgatagcacaatcatagagcctcaaaacatcgacgctattcaagattatgaatcaacaattaaaaatgtattaagaaaccccacaaattctaaacctttaaaagaaatggtaaacagtaatgatattgtttctattgttattagtgatattacacgtccaacgcccaaccatattcttgtacctttactaattgaggaattaaatcatgttcctcgtgagaatttcgtaattattaatggtacagggactcatcgagatcaaacgcgagatgaattgattcaaatgttaggtgaagatattgtaaattcagtaaaaatcgttcacaatcattgctcagaaaaagaaagtctagctaaagtgggacacagtcaatatggatgtgatgtttatttaaacaaagcatatgtagaatccgattttaaaattgtaacaggttttattgaaccacactttttcgccggattttcaggtggacctaaagggataatgcctggaattgcaggtttagaaacaattcaaacatttcataatgcaaaaatgattggcgatccgagatcaacgtggggaaatttagaagacaatccagttcaagatatggcacgggaagttaaccgtatgtgtaaacctgactttttacttaatgttgcattgaataaaagtaaagaaattactgcagcatttgctggtgaaatcttagatacacacaaagaaggatgcgcatatgtaaaagatcatgcaatgtttaaatgtgagcaacgctttgatattgttatcgcatcaaattctggctatcctttagatcaaaatttatatcaaacagttaaagggatgagtgcagcgagtaaagttgttaaaaaagacggtcatattattatggtatctgagtgtgcagatggctttcctgatcatggtaagtttgccgaaattttcaaaatggcagacacacctcaaggtattttagaacttattcacaatccaaactttaaggaagttgaccaatggcaagtacaaaaacaagcaagtattcaaacttttgccaatgtgcatgtttattcagaacttactgaccaacaacttaaagactcgatgttaatcccaacctctaacattgaacatacaatacaagaattagaacatcgatatggccgtaaattaaccattggtgttatgccacaaggtcctttaacaataccgtacgtagaagataaagaataa

SEQ ID NO: 2561 - DNA, 336 bp, Staphylococcus epidermidis
cttgtggtttttattttaagtgaagtaggtgtttatatgacagaaagtagccaaagaggggattacgaaagacgtataaaaagattggaagataacgacgaaaaaatcttcaactctttggaacagataaaagacggacaacacaatcaaaatttgattaatcaaaaaatgaatttcactttggactctatcaacagagagagagaattagaatctcaaaacaaaaaagaaaatcaaaaaaacatcaaagacattaaaatgtgggttttaggattggttggcactatagctggttctttaatcgtagcagtattaagaatgtttttcggtgtttaa

SEQ ID NO: 2562 - DNA, 345 bp, Staphylococcus epidermidis
caaatgaacttcaaacaaatgcatcaattcaattataggttacctgagctattgacaaactatttacatttaatacattcgactagtgaaccaagaatgtgtcatgctatgaagaaaggtgaaattcatgattactgtattagtcattactatattttttattacagtaactttaataatttggcaaccaaaaggattagatatagggatttctgcagtcatcggcgcgcttttagctatcgttactggagtagtgagtgtctcagatatattagaagtgacaagtatagtttaaaatgccacacttacctttgtcgcagttatccttatttcattaatccttga

SEQ ID NO: 2563 - DNA, 258 bp, Staphylococcus epidermidis
tttgtgaatgtaaaaaaggaagggctaattatgcgatttaaattaaaagaagatgaaattttagaatttttagatttaaattttccacaacaaacatttgaaaaaggtcgtctccttattgggcaaaataagagacaaccattacacgtttattattttggaaaaaaattcttggctcttttaaatgtaaattttaacacttttgaatatattaaagtagatgaagtcgattataatgatataaaaaaatcactttaa

SEQ ID NO: 2564 - DNA, 210 bp, Staphylococcus epidermidis
aagttttacgtcgttggaaaatgcaacactttggaaaaattgttggtgaaaatagcgtgtattaaggagatatataagaaaacaggttctgttgcaaagttaaaattatatgcacatctatacaaaactataaaagcaaatattgttttaacagtaaagagctttattagtattaattatttttcgtttttcagtataaatattacatga

SEQ ID NO: 2565 - DNA, 1455 bp, Staphylococcus epidermidis
catacttacgtaaacgaggtgattagcattaattggccatgggataaaccatatcacgaacaagtggtagaacagattaaaccgaagtatgaaacgcaagaagaaatgatattgcgcttagttagagagcataaagagaatatagacaatatcacaatgggtgaaagatattataatcatcacccagatatattagacgctcctttcaaaagagatgtgaacggcgactatgacgaaactaaaccagactggcgcatgtatactaactaccatcaaaacttagtagaccagaaagtagcttatgcagttgctaatcctgtgacatttggtgtagataatgacaaagcattaaaacaaatacaacacacacttaatcacaagtgggatgacaaattagtagatatattaactgctgcaagtaataaaggtatcgaatgggttcaaccatatgtagatgaagagggagaatttaaaacgtttcgtgtacctgcagaacaagctgtacctatttggactaataaggaaagagatgaactgcaagcgtttatacgtgtatatgaattagacggagcagaacgtgttgagtattggactaaagatgatgtgacattctatgagttgaaagaaggacaacttatccctgatttctatcgtagtgaagatcatatacaacctcattattatcaaggtaataaattgatgagttggggacgtgttccttttattccgttcaagaacaacccacaagaagtatctgacttattcatgtacaaaacaatcatagacgcgttagataagcgattatcagacacacaaaacacttttgacgaatcagtagagttaatctatatcttaaaaggttatgaaggtgaagatatgaaagacttcatgcataaccttaaatactacaaagcaattagtgttgcaggggaaagtggttccggtgtggatactatcaaagtagaagttcctatagactctgttaaggaatacacgaaaatgttgcgcgattacattatagagtttgggcaaggtgtagacttccaacaagataagtttggtaatagtcctagtggtattgcgcttaaatttatgtacagcaacttagacttaaaagctaataaattgaagaacaaaacacttactgcgttacaagagttgttacagtacattattgatttctatagattagatgtgaaagtgcaagacatcgagattacattcaacttcaatgtaatggtaaatgagttagaaaactctcaaattgctatgaattctacagggttattatctaaagaaactattctttctaatcatgcttgggttgaagatcctgtagctgaaatggaaagaatagaacaagaaaacatagaactcaatcaacaactccctgacattgaggagggattgaatggcgaacaacaaagacaatccaaaaataaccaaccagaatga

SEQ ID NO: 2566 - DNA, 1089 bp, Staphylococcus epidermidis
gaggcaacagtcatgtcagaaaaagtaaaattcgaaaaaagagagtctttaaaagaaaaacctgatacagcaaacttaggatttggacaatatttcacagactatatgttaagtgttgattatgacgctgatcaaggatggcatgatatgaagattgtgccgtacgcaccatttgaaatttcaccagcagcgcaagggttacattatggtcaggcagtttttgaaggccttaaagcctataaacataatggagaagttgtattattccgcccagatcaaaacttcaaacgtattaataattctttagcacgtttagaaatgccagaagttgatgaagaagcattattagaagggttgaagcagcttatcgacgttgaacgagattgggtacctgaaggcgaaggtcaatcgttatatattcgtccttttgtatttgctactgaaggtgttttgggtgtacgttcttcacatcaatataaattactaattattttatctccgtcaggcgcttattatggtggtgacacattaaagtcaactaaaatttatgtcgaagatgaatatgtacgtgcagtacgtggaggtgtaggtttcgctaaagttgcaggtaactatgctgccagcttactcgcacaaacaaacgctaataaattaggttatgaccaagtattgtggcttgatggtgttgaacaaaaatatgttgaagaagttggtagtatgaatattttcttcgtagaaaatggaaaagtagttacgccagcattaaacggtagtatcttgcctggtatcactagaaagtcaattattcaattagctgaagatttaggttatgaagttgaagagagaagagtttctatagaagagctgtttaacgcatatgataaaggtgaacttacagaagtatttggttcaggtacagcagctgttatctctcctgtaggtacacttcgctatgaagatagagaaattgttattaataacaatgaacctggtaaaatcactcaaaaattatatgacacatatactggtattcaaagtggcaaattagaagataaatacggatggagagtagaagttcctaagtattaa

SEQ ID NO: 2567 - DNA, 378 bp, Staphylococcus epidermidis
tttaagggagtgaacgtgttggaaccaattaaagaacaagaagtgctagatttattaacttcttactcaaatcagcctgtttacctacacgttgaaacaacaaatggtgcttatgcaaatcatttcgatcaacgcgtatttaacgctggaacatttttaagaaatattgtcgtgacttttgaacatgcacaacttaaaggcggcgacaaagatccatatcgtgtaggtcttaaattaaaagatggtggctgggtttacgtgcaaggacttacgcactatgaagttaatgagaataacgaatttttaattgcaggttttaattatgaaggacaattggctgctacaatagaaataagtaaacagccatttactatataa

SEQ ID NO: 2568 - DNA, 945 bp, Staphylococcus epidermidis
cttttaatggtaaaacaagtacgattaggtaaatctgatgtcaatgtttttcctatcgcattaggtacaaatgcagtaggtggtcataatttatatcctaatttggatgaagagcaagggaaagaagttgtacgtcaagctattgataatggtataacattattagatacagcatatatctacgggcctgaacgttctgaagaattagttggacaagttgtaaaagaatatccacgcgagaaagtgcaaattgcaacaaaaggttcgcatgttattaaagaaaatgaagaagttgttcaaaataacgatccagaatatttaaaacagcaagttgaaaatagtttggaacgtcttcaagtggattatattgatttgtattatattcattttcctgatgacgatacaccaaaagataaagcggtggcggctcttaaagagcttaaagatgaaggtaaaattaaagcaataggtgtatctaatttctctttagaacaattaaaagaagcgaataaagatggatatgttgatgttgttcaattagaatacaatttattacatcgtgaaaatgaagaagtaatggcatatgctgcagaaaataatattacatttgttccttacttcccacttgcttcaggtatactagctggcaagtacgatgaaaatcaaacatttgaggatcatcgtgcagaacgtcctgattttcaaccagacgtattcaaagataatgtgcgtcgtgtaaaagcattaactgatattgcagaggcacatgatacaacgattgccaatgtcgtattagcattttatcttacacgtccatcactagatgttgtcatccctggtgcaaaacgtgcagagcaagttgttgaaaatattgatgctgcaaatattgaattatcgcaaggtgaaatagacaaaattgatagtttattcccaattaaaaaataa

SEQ ID NO: 2569 - DNA, 441 bp, Staphylococcus epidermidis
gatatgtgggtatcagtagaacgatatctgtttaacaagatatacaacaaattaaaaagcaaccctatcatcaacaaacaacttgatggtagggtttttgattgcgttcaaaaagacgctgtttacccatatatcgttgtgggtgaaacaaacgtcactaataaagaaacaacgacaagtatgtttgaagatgtgggcgttacattgcatgtttatagccaagctagaaatagagatgaggcctcacaaatcatccaatacttaggttttgtacttaactctgaaatagaaataaataactattcatttataaaaagtcgaattgatacacaagaagtgataactgacattgatcagtacacgaagcacggtatcattcggcttgtttttaaatacagacacaatactttacaaaggagtgtaacgaatggcgcagaataa

SEQ ID NO: 2570 - DNA, 477 bp, Staphylococcus epidermidis
agactaatattaaaaagggggaaacacgttatgttaaaacgacgtagttcgaaattcttaggactactagccacactagccttagccatagtgctaagtgcttgtggtaatagtggtaacggtagtggttcatcagacgatagtcaaacatcacttggtaataaagaaatcgaaatatcttatatcgcgagtgataattcaacaccacgttcactagttatagcagaagtattgaaaaaagcaggttatgatgtaacaactacaccagtaacagcaagtggcccgttatatgctgctgtatcagagaactctgattcattccatgcatcaggtatattccctactactgataaaagttactacgataagttcaaaagtaaattaacaatttatgatgataaacatttaattgataacgcaaaagtaggtttagccgtacctaagtacgtgcaagatgtcgactcaattagtgactga

SEQ ID NO: 2571 - DNA, 1857 bp, Staphylococcus epidermidis
ttgccaatattattaaaaacgttacagggcattgggcaatccctacctgtagaaacaaaattaaacgagaaattaaatgaagatggctccttagaaatagaaatggtagaaaacaaagctacattcgacgctataggggctattactaaaatgtggacgattacaggtgttggtggtgcagatgaccttaatgaataccgtatcgttatgttagataaaacgactgtaggacaaaaagaaaagttaacaatcaaagcacgtcctgttgaattagatgacctaaacaatttaagagtgtatgaagtatataacggtagttttacaggaaaaaggtactttgatttagtttttaaagatacgggttataagtatgaattacacgctaaagtttcatcgtctaaatttgaaaatctaggtaaccatgatacaaacttagaactattcaaaaaaggtttagaacgttacgacctagagtacgaatacgaacctaaaacaaagacttttcacttgttcgatgttgttcaacgtaaggctgactattatatcaaagcaggcgttaacgctaacaatgtaaaggtgcaagaggacgcttctaaatgttatacctacatcagaggttatggtggttttgacgatcaacaaacttttaacgaagctagcttgcaatatgagtacacacaccccttagctgaccttataggtaaacgacatgcgccacctgttgtagatggacgtatgacaaagggtgatacactcaaaaaagctatggagctagttatacaagaaagtttaaaaacatctgtaaccctagacttcatatctttacaaaaacattttaaagaagcagtacctagagttggagatattgtgaatgtagttgacgatttaatagggttaaatgaatttgttagaattatcgaaattactactcatagagatatttacaataaaattatcaaacaagacgtagtgcttggggaatttagattacaagatagatacatgaaagcagtaaacactgctgcaaattatgttaaagctattaagtctaacaaatctgatcctgcgaaagatttacggtcaatgcaagcacaaacacaagctaacactaaaacaacacaagatttacaaaagaaaaccgatgacattaaaaagagattagaaagcgcacatgctaaaagtgttacaactgcaaatggtacgattgttcacgactttacacctaagtctaaaattaggaaagttaaaacaataggtactattggagattcagtagctaaaggtactggtgctaaaactaactttacgcaaatgttagctaagaagataaaagctaaatcaacaaacttagctgttagtggtgcgacaataagcacaaacaaagataatagcatttatgaacaagcaactaaaattaaaggagatttaatcattgttcaaggtacagatgatgattggacaaatgatattaagataggcactgataaaacggacattaaaacgttttacggtgccttttatagtgccatttctaaaattaagagtaataaccctaaatcaaaaataatcgtcatgacacctacaaaacagtgttatataaaagacggtaaggttgtccgaaaagacaccactaagaacgatttaggttacacgttagctgactatgtagacgttcaaatagacgcttgtaatgagttagatatacctgtgtatgacgcttatcactcaacacaattcaaacccaatataccttcatacagaaaatcgagcatgcctgacggtgtacaccctaacgaaaaagggcacgaagtcattatgtatgaactagttaaaaacttttacggtttttatggctaa

SEQ ID NO: 2572 - DNA, 1725 bp, Staphylococcus epidermidis
aatggaatatttaaagaaaaggaaacaactatgacaaagcaaaatatatttatagatgacatttattgggaacgtgtccaactcttcgtcaaaggacattttgaaggagtaaaacctacaagaaatttccttcttagaaatctaacagaaacaaaactattaaatgccaatcatgttaatattcaagggtcaacttttgaggcaagatttaatattgctattttagaaaaaggtaattttttaggtacaggcaattatatattaatcaaccgacaagaagatgaatatgtctgccaaattaaccccaaatttttgaatgataaaaaaaatcagatgactttagaggagttaagagattacaactcacttgagacccaatcgttacaaaaaagttatttattaaaaaagtatggtaaaagtttccaaagatataataacaaagagattaaatcttacgtcattgttccggcaatatcccaagaaattaatgagtttatttttaaagttcaatataaatctgaaataaagaaaataagtaaacttaagcaattatcatacatattacataaagctttgaggaaaattagcttcaatgtgagagataaaatatatttgtcggtatttaacatttccaaaacagtatataagaataataaaaatcatgttttgtttacatcagattctagagcaaatatgtcaggaaattttaaatttatatacgaagaaatgcttaaacaacaattggacaaaaaacttgtcattcattctatttttaaacctaatatagcaaataggagatcgtttattgataaattaaaatttccatattttttaggaaaatctaaatatatcttggttgatgattatcatccgatgatatataaacttcaatttagagaaaaccaagaaatagttcaagtatggcatgctgtgggtgcttttaagactgtaggatttagtagaactgggaaaaaaggaggacctttcatagactctattggacataggaattatagtaaagcttatgtttcgtcaaataatgatattctttactatgctgaagcttttggaattgaagaacatagggttattccaacaggtgttccacgtacggatgttttgttcgatgaatcttataaaacacgcattaaacaaagtttagaaacaaaattaccaattataaaaaataaaaaagtcattctttttgcacctacatttagaggaaatggacatcgcacagcacactatcctttctttaaaattaattttgcaagattagctagttattgtgaagaacatcaagctactgttctgtttaaaatgcatccttttgttagaaataaattaaatatcccagcaatttatagtaaatattttttagatatttcaaattaccgcgaagtaaatgatgtattgttcattacggatattttaatctctgattattcttctttaatctatgaattttcagtttttaaaaaaccaatgcttttttatgcttttgatttggaagattatatttacacgagagatttttatgaaccttatgaaacctttgttcctggtaaaatagtgaaaacttttgatgagcttattttagctttagaaaataatgattttgaattagaaaaggtgaagccgtttttaaataaaaattttaaatataaagatggtaaatcaagtgaacgattagttaaagatttatttaacaaattttttcagtaa

SEQ ID NO: 2573 - DNA, 285 bp, Staphylococcus epidermidis
ttttgcgtatttctcactataaccagccctgattgccgattgataagcagtacctgtcttaatgtactcatcaacaaatgcttgttgtttaaggttcagtttcgtcatcgtatattaccacctactctcacggttaagcacctttatttgacgtataaaaaaaagacactgcataaacagtgcctaatgattatgttttgttatttatttgagtttatgtactcatgtcacatctctatgtcacatcaatacataaaaaagttacccgtgtgttctcacggataa

SEQ ID NO: 2574 - DNA, 387 bp, Staphylococcus epidermidis
aggagtacattcaaaatgatgaaagtttttattattttaggtgcattaaatgcaatgatggctgtcggtactggcgcatttggagcacatgggttggaagataaattatcagataaatacatgtcaatatgggaaaaagcaacaacttatcaaatgtatcatggattaggtctgttagttataggtttaataagtggtacaatatcaattaatgtaaattgggctggttggttattattctttggtattgtctttttcagtggttccttgtatttcttagccttaacacaagttcgtattttaggtgcaattacgccaataggtggtgttctatttataattggttggcttgttcttgtgattgctacacttaaattcgctgggtaa

SEQ ID NO: 2575 - DNA, 804 bp, Staphylococcus epidermidis
atatttttttcactcaagtcgttcccaaaaaagaacagtaaacaaattaaggagggattaaaagtgaacgaattacaaacattcaattttgaagatttaccagtaagaacgctatccatagacgacgagccttactttgtaggaaaagatgtggctgacatcttaggttactcaagaggagcaaaagcgatacaagatcatatcgataaagaggatattcgtgtagtcccaattcaggaccgcaccggaagatatcaaaaagcttctttaataaacgaatctggtttatacacattagttatcgacgcagttcgacaaagcaataacagagatattaagaaaaaagcgaaagcttttaaacgttggataactaatgaagtattgccatctattcgtaaaacaggttcttatcaagttcctgataatccaatggacgcattaaaacttatgttcgacgcacaaaaacaaactaaagaagaaatcgcaacagtgaaagcagatgtgatcgatttaagagaaaaccaaaaattagatacaggagattacaacttgttgtctagaacgattaatcaacgagttgctcacattcaaaagatacatgcaattacaaatcaaaaacagcgcagtgaattattccgagatatcaattcggaagttaaaaagatgacaggcgcaacatcaagaacaaacgtaagacaaaaacactttgatgatgttatctcaatggttgctaactggttcccgtcacaagctacgttatacagaatcaaacaattagaaagcaatttagaaaaaggacaataa

SEQ ID NO: 2576 - DNA, 264 bp, Staphylococcus epidermidis
attatgaaatttacaatagaaatggtgaatgaatatttaactatagttaatgatgagaatccgatccatcgttccattgtaccaggacaactcatatgtgaaaaagtattttctgaacttaatgtgaattggatgaattacaaaattaagtacttaaaacctataaatatagatgaagaagtacaatttttaataaaagaaaatgatgaaattgtagtttttaaaacatatgatgataccaaactaacaattactagaagttga

SEQ ID NO: 2577 - DNA, 789 bp, Staphylococcus epidermidis
agttcagtttcctataattgtcatgtaatctataatacaatagtttatgtaactataattaatataaaaatcattttcaggagagaattaaaattggaatggatattatttgataaagatggtacattgattgagtttgacagtagttgggaaaaaattggcgtacgtctcgttgatcaacttttagaaacctttccagtacatgataaggaagcggcacatcgccaattaggcattatcgataaaaaaattaagccagattctgttatgggatcgggttcattaggtgaaattatagagtcttttaatggtgtaacaggtaaagaaacatcagattggacaaaggatacgagtcaggaactcattgattcaagagtgcctgaaaacaattggattgatggtgtacaagaaactattcaagctcttagaaatgaaggatatcacataggtatagtaacaagtgatactaaaaaaggagtcgatcaatttctggaggaaacgcaaactagaaatctctttgatttagtaatttctacagaaacacacgcagaagaaaagccacatcctaaagttttagatccactatttaatgcttttgatgttaaaccagaaaaggtagcaatagtaggagatacggccaacgatatgaaaaccgcgattaatgctcatttaggattagctatcggtgtgctaacaggcgtggctaaaaaagaggaactctacgacgcagatgtcatcattaatagtgcaaaagatgttaaacaagttatagagcaatacggaaaataa

SEQ ID NO: 2578 - DNA, 309 bp, Staphylococcus epidermidis
gtctgctattcatctatcaaaattgatgatcaaacaaaaaaatatagaaaaaaggagacgatgataatggattttgtagaacaagcagttaaagaaattaaagaaaaaataggaaaagaattagatttagaaaaagaaacatatttactacaaactccatctgcttatatgcaaattggattagaagaagatgatgacgatgaaagaaaattaaatgtacaagtaactggtggtaatattacttgtttaaaaacagacaaagatatattcaaagacttatatgtaaacgatgatgaaaatgacaactag

SEQ ID NO: 2579 - DNA, 1536 bp, Staphylococcus epidermidis
ataatggaattagaaaaagtaggtaaacttgatttaaacgaagaaccatatttacaaccgatatctaatagaggtatcggtttttataatctcgataaaaacactgctaaatttcaatttgtagtacaaaaagacaacaaacctttgttaatcagcgataagaatgttaaaggttatgctttctttaaagctgcgaacggaacagaagaaaaacgacctagtacatcaggtgtattagacgtagaattcattgatccaatgaaaggattaataggtgttacggtacctcaatggtttctgaaaaacgttgtcgattctgaagtgttgggtgaaatttacttatcactcaacgatgtaaacaacgtaggaaaagacgacactgttgtgttaggcacttttaaattcacggtacgcgacagtcttatcaatcaaatcgaaagtgatatcaaagtatcttatattcgaatgtttgatgaattgcgttcggaattagaaaagaaagtgcaacaacttaagcaagatataggcgatacacaaacgttgattgaatctattaagcaaacagctgaagaatacctcattaaaataaacaaggctcaagcagacgctattgtttcaattacagacgcgttaatatcgtctaaccaaagcattgacctagagagagaagaagctttaagacaaattgatgctaaacgtgacgctatcaaaacggattatgatttagcttcagatacattccaaaaaacttatgatagcaatgtggacgcttttaattcaaatgttaatcaagctaacacaacaattgatgaaaagctacaaatatttaatgaaacccttgaaagagatggctttactactcctgaatatgtagaaagtaagtttacagaaaaggattggcaaaaatttaaattaacaaatgatgatggtactaatttttatgatgccaacctacaaatagatttcgacaataacgaacaattaatgtctttaccgataggaactagatatgttgttcttactttgaacaatccagctggaacaaataataatgggtggttaacaaagtacaaaagaaatggagatgctgttctaatacaataccaaccttacaattcaactgtaatctaccaaaaaagattttataagagttggagcaaatgggaacgtgttggttcagatgttgtagatactggttggattgatttacaactagtgaacagtgcgtcgcctcataacgacttagtttccaaaggtggatttactagtgcgtacagaacaatcacacagaatggagttactaagaaaatgttacgcattaatgctacaactatcaaacatggacagactattgcacttttacctaaagaattcgtcaaaaacttaatgtttttctcaataagtgcacctagaaacaaaaacagcggacgtatttcgttgaacacatcaggaacagtgaattttgacgctactgtagatccatcagcgtggactgatacagattatatttacggtcaatatgaatggacggagtga

SEQ ID NO: 2580 - DNA, 501 bp, Staphylococcus epidermidis
tggttatgttcacgtattctgattaaactattcttaaataaaaatagaaaagaggaatacattatgaatacaaaatatttattagcagtcggagcaattgttacatcacttacattaggcgcatgtggaaattctaactcggaaagcgatcacgctaatcacaaagataaacaacaagaagacagtaatgtaaaaacagacacaacgaaaaaattatctggtaattttgaatctaaaaacggagaaaaagtagaaggtaaagctaaaattgaaaatggcaaacttatgttagagaattacaaatcttctaaaggtccagacctatatgtttacctaactaaaaacggagatattaaatccggtaaaaagatttcaacagtagactacaataaatccaaacaaacttttgatttaaaaaatgtagatttagaaaaatacaatgaagtaacaatttattgcgaaaaagcacatgtaatttttggtggcgctaaattaaaataa

SEQ ID NO: 2581 - DNA, 789 bp, Staphylococcus epidermidis
cgtcatacctcatactttaattcaggaggtgaaatgatgaaagaacgcttcagtcccaaaacgctttctgacattaccggagttagtatacgcacgcttcattattatcatgaaaaggggttactcgtgccacaacaaatgagtgctaatggataccgatattataatgttcaagatatttcaaagttacaatatattctctttttaaaggaattagatttaacattaaagcaaatacagacgtattttgaaggtgatagtgattttagaactaaaatattacatgataatttttatcacattgttaaaaaaagagatcgcttaaacgatattatccgtacgttagaacatcattttcacaaagataacgatgagattgaggtaactacaatgcaaaatttcaatttaaatgaacagtatgaaaaagaagcagcaagtaagtatggagatactcattattatcaagcatataaagataaacaaaaatgtaaggatgaatcagaacagcaaaatcattttgaggaaattaataagcaattaaatatgttttttgacgaaatgaatcaactatacttaaacaaagtttctatacttgaagcaagtggaaaaactaagaaattacaatgtattttgaaagaacaagttcctaattgtgacaatcaatttttagaatatatagctcagatttatattgaggacgagcgatttgtaaagtttattaacaagcaacgtgaacgtggtttgaatttatacatttctgacgcgataaaaacatttattaaattataa

SEQ ID NO: 2582 - DNA, 234 bp, Staphylococcus epidermidis
ggattcacctccatatatgttgtgtcacgcttaggtaacacgtatttaaatcatcatgactcaataagtgacaactacatgctaagaccttcccatcgtgacactccccgtaaaaaatgtgattggcttcattctatcataaatcttttgttatatgttaaacatatgccaatactatattgtagacaaaataatttttttattcaaccaatgacaaatcatttgaaagcatga

SEQ ID NO: 2583 - DNA, 684 bp, Staphylococcus epidermidis
ggagtcatatcaatgtcacaaaatgacttaaataaagaaaaagcacttgtcgtatttagtggtggtcaagatagtacgacatgcttattttacgctaaaaaacattttaaagaagtagaactcgttacatttaattacggacaaagacatgataaagaaattgaagttgcaaaaaaaattgcaaaagaacaaaatttgaaacatcatattttagatatgtcattactatctcaacttactcccaatgcacttacacaacatgagttaagtattgaagataatgatgatggtattcctaatactttcgtaccagctagaaatctattgtttttatcttttgctggcgcgttagcctatcaaattcatgctaaacatattattactggtgtttgtgaaacagatttttcaggttatccagattgtagagatagctttatcaaatctatgaatgtaactttaagtctttcaatggataaagactttgtcattcatacaccattaatgtggttagacaaagcacagacatgggcactcagcgataagctaggtgtgttagattatattcgccacaacacattaacatgttataacggtatcattggtgatggttgtggtgaatgtccagcatgtcacttaagagctcgaggtttaaaacattatcttgaacataaaggagaagaataa

SEQ ID NO: 2584 - DNA, 201 bp, Staphylococcus epidermidis
ggagggatatcaatgagcttacatttccaaattttgctgtggctttctatcttatttatcatcgcaggaacgatattattggtaacaatgcttaaaactaaaaaagaagaacgaaaagaatcttatctaggctttactgtaattttcttaatctttggttttgccatcttaatttatacttttatattcggaattttataa

SEQ ID NO: 2585 - DNA, 201 bp, Staphylococcus epidermidis
attcagacatcatcgtggcttaatataagaaaagtaacagctcaacgagctgaaaatcatcaaaaaaattataaaaaagacaatttctatattatttcaatagaaattgtctttatttacttatcctggaactttatgtcccaacctcttatttttatattaatgtctttagtaatcattttgaaattagaatatctttaa

SEQ ID NO: 2586 - DNA, 471 bp, Staphylococcus epidermidis
ggaatcaaatcattcttaaccatgaagactaacgtaattatagatggagatgcttgtcctgttgttaattctgtcattgaattgacgaaagggacaggcatttttgttacaattttaagaagttttagccatttttcacaacaaatacaacccgaacatgtaaaaattgtatacgttgatgacggtcccgatgcggtagactataaaatagtcgaacttgctagcaataatgatatcgtcatcacacaagattatggacttgctagtctactgatagacaaagtacatactgtcatgcatcataaaggaaatatttatcactcaaacaacatccaaagcttattaaatcaaagatatctaaatgctcaaataagaagacgaggtggtcgtcacaaaggccctcctcccttcacaacagaggatagacttaaattcgagcatgcttttagaaaaatcattaatcaaatatag

SEQ ID NO: 2587 - DNA, 291 bp, Staphylococcus epidermidis
actgtcttgtctagttttttttctttcatcagtttttggttcttttgctctcttttctcctgtttgtggattttgtctcaccggagtttgagttgtaggtctttgtggcgtttgaacagtttgttgcgtttgttgcgtttgttgagtttgaggaacttgttgcgtttgttgtgtattattctttttttcttccaccgattttttatcttttttttcctttttgtctttatcgtcttttttcttttcttgctgtgttgttttatcactgagtcgttcgttacctttttttga

SEQ ID NO: 2588 - DNA, 210 bp, Staphylococcus epidermidis
aatcaaatgtctttttatgattttattttaggatttatcaatgacgatacgccactaggtcatttagcacaatacatttttaatgatgcttgtttcccaaaggaagagaaaaataataattctataagaacctatgtgcttcttaattataatgatcgtcagttaatcgaaagtacaaatcgtgcaattagtctatatcaattaatttga

SEQ ID NO: 2589 - DNA, 273 bp, Staphylococcus epidermidis
atcaaatcgtcctgcaacttctctctgctaattgggtcaagagcactaaaaggctcatccatgataataacgggaggatctgcagctaatgctcgcactacaccaaccctttgtcgttgtccacccgatagttcatcaggttttctatttttaaattgctcaggatttaaacctaccattgtcaataattcatccacacgtaaatcaatatcgttatctttccactttttcatttggggtacttgtgcaatgttttctttgatagtcatatga

SEQ ID NO: 2590 - DNA, 276 bp, Staphylococcus epidermidis
ttcactactttgtcatgttattactccgcacttgtaactgttgcgagcatacaaacagttggaattatccttgtagttgctttactaatcactccagcttctacagcttttttaatcagtaaacaactttatgccatgatggtaattgcaagcataatcagcgtgataagttcgattatcggtctaaattttagttatatatataatattccaagtgggagcaactattgttatctgtacctttatgatttatattgtaacgctatcagttactag

SEQ ID NO: 2591 - DNA, 1029 bp, Staphylococcus epidermidis
ctaagggagtctttatttatgtcatatattttaattgtcacgatagctatagttatattttcattaatatttgactttatcaatggtttccatgatacagctaatgctgtagctactgcggtttctactcgagcattaacaccaagaagagctattttattagcagcagtcatgaactttattggggcattgaccttcacaggtgttgctggaactattacaaaagatatcgttgatccattcaaattacaacatggtttagttgttgtgttagcagctattattgctgccattatttggaatttaatcacttggttgtatggaataccaagttcatcttctcacgcactaatcggatctatagcgggtgcagccattgcatcgcaaggttcgtttgcagtattacactatcaaggttttacaaaaattattatcgtattaatcatttcaccaattatagctttttgtgtaggttatatgatgtatacgattgttaaaatcgtttttaaaaattcaaatttaacacgtactaatcgtaattttaggtttttccaaatctttactgcagcattacaatcattctcacatggtacaaacgatgctcaaaaatctatgggtattatcacattagctttaattgtaggtaatttacaagatggtagtaatgttgaacctcaagtatgggttaaagttgcgtgtgcaacagctatgggattaggtacagcagtaggtggttggaaaatcatcaaaactgttggcggaaatattatgaaaattagacctgctaacggtgcagccgctgatatttcttcagcattaacgattttcgtagcgtcatcattacatttcccattatctactacacacgttgtgtcttcatctattctaggtgtaggtgcttcaaatcgtgcgaaaggtgttaaatggagtactgctcaacgtatggttgtaacatgggtgattactttacctatctcagctgttttagcagcaattatttattttattattcatctgttcttaaaataa

SEQ ID NO: 2592 - DNA, 195 bp, Staphylococcus epidermidis
acaggatatcctttggctaacatcgctgaaacacttaaaacaagtaacagtgtgattaaactgaaaataatggaaaatatagggaaccataaaaaactaagtcccaaaaataaagcaattccagatcctaatgatgcaccactagctaatcccaatgtaaaactatctgcaagtggattatttaacacaatttga

SEQ ID NO: 2593 - DNA, 327 bp, Staphylococcus epidermidis
ataaacaatcctacgcctataacggtagttatgacaagacctagagccatcatcataacaggtttgatatacttccttaaatgtactcttgaaacattaacaccctcaacgaatagtagtggtgcaatcaatgtaaccataaataattcagaatcaaaattgaattcaactggaatgggagtgaggtataaaatcatcccaaggaaaatttggataaatgcaagaggtactttaggtatgaaagtatgtacaaaggagctcacaataactagtgcgacaaatatgagtagagtttcaaatatctccacactttcacctctttattaa

SEQ ID NO: 2594 - DNA, 510 bp, Staphylococcus epidermidis
gaaaggctgttagttatgtttatttatctgtttcactttatcattagtttcattgccacagtccttttttcaattatatttaatgcacctaaaaaattgctattagcttgtggatttgttggagctgttgcttggacaatatatcagatgacagtaggtatggatttaggtaaagttggcgcttcatttttaggaagtctaatattaggattaatgagtcatacaatgagtagacggtacaagcaacctgttattatatttatcgtccccggcattatacctctcgttccaggtggcgcagcatatgaagctacaagatttttagtatcaaatgattatacgaatgcagttaatacttttttagaggtaacattaatttctggtgcaattgcattcggtatacttgtatctgaaatagtctattacatttattcacgcatcaagcaatcttatggtaaaatcaagggtaaaacttataaaaaatcctataatatgaataatagagtataa

SEQ ID NO: 2595 - DNA, 939 bp, Staphylococcus epidermidis
gaaaggatgttcaaaacattgaataaaaatgacatcttacgcggattagagtcaattcttcctaaagatattattaaagtggatgaacctctcaagcgttatacatatacagaaacaggaggagaggcagatttttatttatcccctaccaaaaatgaagaagtccaagccatcgtaaagtttgcccatgagaacagtataccggtaacttatttaggaaatgggtctaacattatcattcgagaaggtggaattcgaggaatcgtcctcagcttattatctctcaatcatattgaaacctctgatgatgcaattatagcaggtagtggtgcagcaattattgacgtttcaaatgttgcacgtgaccatgtattaaccggtttagaatttgcatgcggtatccctgggtcaattggtggcgccgtattcatgaatgctggtgcttatggcggagaagttaaagactgtattgactatgcattatgtgtcaatgaaaaaggtgatttattaaagctcactacagctgaactggaattagactatagaaatagtgtggtacaacaaaaacatttagttgtattagaggctgctttcaccttagaaccaggtaaattagatgaaattcaggccaaaatggatgatcttactgaaagacgtgaatctaaacaaccgcttgaattcccttcttgcggaagtgttttccaaagaccaccgggtcattttgcaggtaaactcattcaagattctaatttacagggctatcgaatcggtggcgttgaagtttcaactaagcatgcgggattcatggttaatgtagacaacggtacagcaactgattatgaagcacttatacatcacgtacaaaaaatagttaaagaaaaattcgatgttgaattgaatactgaggtacgtattataggtgatcatcccacagattaa

SEQ ID NO: 2596 - DNA, 258 bp, Staphylococcus epidermidis
ctaaatccaccttcaagtgccttagcaacaggtaaaacacctttagctacacctttaattcctttaattgcttctccacgtgcacgaagtttcgataaattaatggccacaccaccaccaattttactaagttgttttgcagttgaatcaatgaaattgatagaatttaagctatcgtctacttctaataagaaacatgaaacaagttctccacgtcttgctctacctgcattcaagaatgttggtgtcgccggttga

SEQ ID NO: 2597 - DNA, 270 bp, Staphylococcus epidermidis
ggtgtaacacctatgaaattaaacaaagcaaatatattcaatttgatattcaccattttatttttttcatttaacattctcataacctataacgcaaatatagattataagttatggttaatacctggtttagcaatttgtggttttgctcttttttcaagcttgaccttagtaattatctatagtgatttattcagtgaaatattattttttatcaacattatcttagcactgtattacatttatccgattttttatgaatttgtctaa

SEQ ID NO: 2598 - DNA, 762 bp, Staphylococcus epidermidis
atgagaacaccaattatagccggaaactggaaaatgaataaaacagttcaagaagctaaagactttgtaaacgaattaccaacattacctgatcctaaagaagtagaatcagttatttgtgcaccaacaatccaattagacgctttagtaacagctgttaaagatggtaaagcaaaagggttaaaaattggagcacaaaacgcttactttgaagaaagcggtgcttatactggagaaacttcaccagtagcattatctgaattaggtgttaaatatgtagtgattggtcactcagagcgtcgtgactatttccacgaaactgacgaagaagtaaacaaaaaagcgcatgctatcttcaatcacggtatgacacctattatttgtgtaggtgaatctgatgaagaacgtgaagctggtaaagcaaataaaatcgtaggtaatcaagtgaaaaaagctgtcgaaggtttatcagatgatcaacttaaagaagttgttattgcatatgaaccaatttgggctatcggtactggtaagtcatctacatctgaagatgcaaatgaaatgtgtgctcacgtacgtcaaacattagctgacttatctagtcaagaggttgctgacgctacacgtattcaatatggtggtagtgttaaacctaataacattaaagaatatatggctcaatcagatatcgatggcgctcttgtaggtggcgcatcattaaaagttgaagatttcgtacaattgttagaaggtgcaaaataa

SEQ ID NO: 2599 - DNA, 1107 bp, Staphylococcus epidermidis
atgaaaggaccgtcaattgtagtaaaaggtgcacgagcacataatttaaaaggagtagatattgaattacctaaaaacaagttgattgtcatgactggactttcaggctcaggtaaatcttcgttagcgttcgatactatttatgctgaaggtcaacgacgttatgtggaatcgttaagtgcatatgcgcgacaatttttaggacaaatggacaaacctgatgtagataccattgaaggtttgtcaccagcaatatctattgatcagaagacgacaagtaaaaacccacgttctaccgttgccactgtgactgaaatctatgattatattcgattattatatgcgcgtgtcggtaaaccgtactgtccttatcacggtatagaaattgaatcacaaactgttcaacaaatggttgatcgtattttagaattggaagaacgtacaaaaattcaattacttgctccagttatatcacatagaaaaggaagtcatgaaaaattaattgaagatataggtaagaaaggatatgtgcgtttacgtgttgatgatgaaatcgtcgatgtaaatgaagtgcctcaattggataaaaataaaaatcacacaattgaagttgttgttgatagacttgtagttaaagatggcattgagacgcgtttagcggactctattgagacagcacttgaacttgctgaaggtaatttaacagttgacgttattaatggagaagaacttaaattctctgagaaccacgcatgtcctatatgtggtttctctattggtgaattagaacctagaatgtttagtttcaacagtccgtttggtgcgtgtccaacttgtgatggtttaggtcaaaaactaaaagtagacctagatttagtcattcctgataaaaataaaactttaaatgaaggtgcaattgaaccatgggaaccaacaagttcggatttttatccaactttattaaaacgtgtatgtgaagtctacaaaattaatatggataagccatataaaaaattgactgatagacaaaaaaatatacttatgaatggttctggagaaacagaaattgactttactttacacgcaacgaaatggtgttactcgtag

SEQ ID NO: 2600 - DNA, 273 bp, Staphylococcus epidermidis
cagcaggtgccaaaaggtaaacgatttgcgctacctaatgctgaagttatgattcaccaaccattaggtggtgcacaaggacaagcaactgaaattgaaattgcagcaaatcatattttaaaaacacgtgaaaaattaaatcgtattttatcagaacgtacaggtcaatcaattgaaaaaattcaacaagatactgatcgcgacaacttcttaacagctgcagaagctaaagaatatggattaattgatgaagtaatggaaccagaaaaataa

SEQ ID NO: 2601 - DNA, 2571 bp, Staphylococcus epidermidis
gccaaacagtttttagttaaaggagcgacgcgtgcaatgggatttttatcgaaaattgttgacggcaataaaaaagaaattaaaagattaggtaagttagcagataaagtacttgctttagaggaagatactgcgatattaaccgatgaagaaatacgtgaaaaaacaaaatcttttcaaaaagagttagcagaaattgaagatgtaaaaaaacaaaatgattatttagataaaattttacctgaagcttatgcacttgtacgtgaggggtcaaagagagtatttaatatgattccttataaagtacaagtaatgggtggtattgctatacataaaggtgatattgcagaaatgagaacaggtgaagggaaaacattgactgcaaccatgccgacgtatttgaatgctttagctggtagaggtgtacatgttattacagtcaatgaatatctatcaagttcacaaagtgaagaaatggctgaactatataactatcttggcttaactgtaggtttgaacttaaatagtaagtcaactgaagaaaaacgtgaggcttacgcacaagatatcacttatagtacgaataatgaacttgggtttgattatcttagagataatatggtgaactatgctgaagagagagtaatgcgtcctctacattttgcaattattgatgaggtcgattccatattgatcgacgaagcaagaacacctttaattatttctggtgaagcggaaaaatctacttctttatatactcaagcaaatgtttttgcaaaaatgcttaaagcggaagatgattataattatgatgaaaaaaccaaagctgtacatcttacagaacaaggtgcagataaagctgaacgtatgttcaaagtagataatctttatgatgttcaaaatgtggaagtgattagtcatattaatacagctttaagagctcatgttactttgcaacgcgatgttgattacatggtcgttgacggtgaagtattaattgttgaccaatttactggacgtacaatgcctggacgtcgtttttctgaaggtttacaccaagcaattgaggctaaagaaggtgtagcaattcaaaatgagtctaaaacgatggcatccattactttccaaaactatttcagaatgtataataagttagcggggatgactggtacagcgaaaaccgaagaggaagaatttcgtaatatctataatatgacagttacccaaattccaacaaacaaacctgttcaacgtaaagataattcagacttaatttatattagtcaaaaaggaaagtttgatgcggtagttgaagatgttgtagaaaaacataaaaaaggacaacccgtcttactaggtactgttgctgttgagacttctgaatatatttcaaatttactaaaaaaacgtggtgtcagacatgacgtattaaacgctaaaaatcatgaacgcgaagctgaaatcgtttcaaacgcggggcaaaaaggtgcagttacaattgccacaaatatggctggacgtggaacagatattaaacttggtgatggtgttgaagagttaggtggacttgctgttattggtactgagcgtcatgaatcaagacgtattgatgatcaattacgtggacgttcaggacgccaaggtgatagaggagatagtcgtttttacctatctttacaagatgaattaatggtacgttttggttcagaacgcttacagaaaatgatgaaccgtttaggaatggatgattcaacgccaatcgagtcgaaaatggtatctcgagctgtagaatcagctcaaaaacgagtagaaggtaataactttgacgcgcgtaaacgtattctagaatacgatgaagttttacgtaagcaacgtgaaattatttataatgagcgtaatgaaatcattgatagtgaagaaagttctcaagtcgttaacgcgatgttacgttctacattgcaacgtgcgattaatcattttattaatgaagaagacgataatcctgactacatgccatttatcaattacgttaatgatgtgttcttgcaagaaggagatcttcaagatacagaaattaaaggtaaagattcagaagatatttttgaaattgtatggtctaaaattgaaaaagcatatgcacagcaacaagaaacattaggagaccaaatgagtgaatttgagcggatgattttattacgttcaattgatacacattggactgatcatattgatacgatggatcaattgcgtcaaggtattcatttacgttcatatgcacaacaaaatccacttcgtgattatcaaaatgaaggtcatgaattatttgatatcatgatgcaaaatatcgaggaagatacatgtaagtatatcttgaaatcagtggttcagtttgaagatgatgtagtacgtgaaaaatctaaaagctttggtgaagcaaaacatgtaactgctgaagatggcaaagaaaaagcaaagccccaaccgattgtaaaaggtgatcaggtaggtagaaatgatccatgcccatgtggtagtggtaaaaaatataaaaattgtcatgggaaagcgtaa

SEQ ID NO: 2602 - DNA, 753 bp, Staphylococcus epidermidis
aataaaattactatagtgtacgaaatgagggatagaatgacccatgtagatattgcagcgacaattgcaccagaagacaagctttctaaaactttactcaaagatataaaagtaaacgaagaatcaatagatatcattgaattgcgcattgaccaatggccatcatttaataaggcattattaaatgaagtgattaagcaattaaaaatattccatttgaaaatattagtaacatatagaacttcagttcaaggaggaaaaggagctgtaaatgagcaagagtatttaaatatactaggtgaattaattgagtgtccacaatttgatatgattgatattgagtggagcagtgccgtcaaaattgaaaaatatacgcatcttgttcaacgtgcacaacaaaaagggctcgaagttgttctttcgcatcataattttcaagaaacacctgctttagatgaacttaaatttatttactttaaaatgcaaaaactcaatcctgagtatttaaagcttgcggttatgcccaaatgtcaagaggacgtgttacatttattagaagccatgtcactcacagcgaagcacacaacatgccgaattgtcggtatatcgatgtctagtttgggtaaagtcagccgaattgctcaaggcgtatttggtggaacgctgtcttatggttgcatagaagaaccacaagcacccggacagatacatgtctctaagttaaaatccatggtttctttttatgaggattaa

SEQ ID NO: 2603 - DNA, 582 bp, Staphylococcus epidermidis
ggagagattactatgattagatttgaaattcatggagataacctcactatcacagatgcaattcgcaactatattgaggagaaagtaggtaaattagaaagatactttaacaatgtgccaaatgctgtagcacatgttagagttaaaacttattctaattctacaactaaaattgaagttacaattcctttaaaagatgtcactcttagagctgaagaaagacatgatgatttatatgcaggcattgatttaattactaacaaattggaaagacaagtacgtaaatacaaaactcgtgtaaatcgtaaacatagagatcgtggagatcaagatatctttgttgctgaagtacaagagtctacaacaaacaatcatgcagatgatatagaaagtgaaaatgatattgaaattattcgttctaaacaattcagcttaaaaccaatggattctgaagaagcagtattgcaaatgaatttattgggacatgatttctttatttttaccgatagagaaactgatggcacaagcattgtttatagacgaaaagatggcaaatacggtctgattgaaacaactgaataa

SEQ ID NO: 2604 - DNA, 813 bp, Staphylococcus epidermidis
ggaggagttactttgaaaaagttagcctttgcaattacagccgcttcaggcgcagcagcagttctatcacatcatgatgctgaagcttctacacaacataaggttcaatctggagaatccttatggactattgcacaacaatacaatacttcagtagaaagcattaagcagaataataatcttagcaacaatatggtattcccaggacaagttattaatgtaggtggaagtgcttcacaaaatactagttcaaacacttcttcaagttcagcatcttcacatactgtagtagcaggtgaatcattaaacatcatagctaataaatatggtgtttcagttgatgcattaatgcaagcaaatcatctaaatggttatttaattatgcctaaccaaatattaactatccctaatggtggttctggttcaggatcaggtggtacagcaactcaaactagcggtaattatacttcaccttcattcaaccatcaaaacttatacactgaaggtcaatgcacatggtatgtgttcgacaaacgttcacaagctggtaaacctatcagtacttactggtctgatgcaaaatactgggcgtcaaatgcagcgaatgatggttatcaagttgataatactccatctgttggtgcaattatgcaaagtacacctggaccatatggtcatgtagcatacgttgaacgtattaatggtgatggtagtattttaatttcagaaatgaattatgcaaatggtccatacaatatgaactatcgtactatcccagcttcagaagtatcttcatatgcatttatccactaa

SEQ ID NO: 2605 - DNA, 675 bp, Staphylococcus epidermidis
atgaatgagttaggtcaaacaattattgagaattacaatacctttgcgccaaaaaatatgttctcagagtggcttaagaatctgctacaaccacttgccactttatcgttgggattttttgtatataaatacactgataatcgtcataaaaaaagattattaaacgagttagattcgaagtcagaatggagaaaaacgttatttataataggtgggaactctaccgtcacattagatgatgtatatcaattcagaactgcactaagatttaattttaaaaacaatgggaactatatcgataaagagaaaagcaaaaaagaaggctttagttatttctttgacaatatgaatataataattattaaatactgtattaatctaatagaaaagaagcaagcagtatctaactcaatagatttagatataaaagatcaaaacagtataagactattttgtagatatatgttagcagaccactgggagaaaaatcaaaataaaaatttaaaatttgatgatcctaacaaagaagaagagttatgtattttcacattaaaagagtttttgaagctacacaaatattatcaaaattctaaagatgaagattcaaaaaataaatttaagtctttatttgacgaatcgaaagagttagtagaaaaaaaagacaccccttcataa

SEQ ID NO: 2606 - DNA, 552 bp, Staphylococcus epidermidis
agcttagctacacaacagcaaaaattattctttaagctactgttttttactctggtgcacgtaagggcgaaattagagccctcacatggcgcgatattaactacgatgatgattttcatacatataaataaaacggactatcacggtgaagtgacagcccctaaaacaaaagcagcaatacgtgatatatacctaccttttcatatgatgaatgacatagaaaaatatttaaaatggtacaaagaaaacaatgtatataaagatgattatgtattattcggtacattcttcaaggcatacagtgaatcaactatagatcgttggtttaccactgcattaaaagtgttagatgaacaactgccagacgttcagacattccctagaatcgttatacatgaattaagacatagccatgcgtctatgctagtcaatcatggtgcaagtatcatggtaatagcacagcgtttaggtcatgctgatagtaatgaagtatataaccgatacggtcatttgtaccctagtacgcagaaagaaatagttaaatacttgtaa

SEQ ID NO: 2607 - DNA, 1554 bp, Staphylococcus epidermidis
agatttcgtacaattgttagaaggtgcaaaataattatggcaaaacaaccaactgccttaatcatcttagatggtttcgcaaatcgtgaaagtgaacatggcaatgcagttaagcaagcacataaacctaattttgatcgatattatgaaaaatatcctacaacacaaatagaagctagtggcttagatgtaggtcttcctgaaggtcaaatgggtaactctgaagtaggacatatgaatattggtgcaggacgcatcgtatatcaaagtttaactcgtattaataaatcgattgaagacggagaattctttgataacactgtattaaataacactgttaaacatgttaaagacaatggctctgcgcttcatgtattcggattgctttctgatggtggtgtacacagtcattataagcatctatttgctattttagaattagctaaaaagcaaggaatagataaagtatatgtccacgcatttttagatggtcgtgatgttgatcaaaaatctgctttgaaatatatagaggaaactgaagataaatttaaagaattaggtgtaggccaattcgcttctgtttcaggacgttattatgctatggaccgtgacaagcgttgggatcgtgaggaacgtgcctataatgctattcgtaactttgaaggtcctacatttacttcagctaaagcaggcgttgaagctaattataaaaatgatgtgactgatgaattcgtcgaaccgtttatagttgaaggccaaaacgatggtgtgaacgatggagacgcagtaatcttttataatttccgtccagatagagcagctcaactttcagaaatctttactaataaagcgtttgatggatttaaagttgaacaagtggacaacttattctacgctacattcacgaaatataatgacaatgtagatgctgaaattgtatttgaaaaagttgacttaaataatacaatcggtgaagttgctcaagataatggcttgaaacaattacgtatcgctgaaactgaaaagtatccacatgtaacatactttatgagtggtggacgaaatgaagagtttgaaggagaacgtcgtagactcatcgattctccaaaagtagcgacttatgatttaaaacctgagatgagtgcatatgaagttaaagatgcattattagaagagttagacaaaggtgacttagatttaattctactgaactttgctaacccagatatggttggacatagtggtatgcttgaaccaacaattaaagcaatcgaagcagtagatgagtgtcttggtgaagtcgttgacaaaattattgatatgggtggtcatgccatcatcactgcagaccacggtaactcagatcaagtattaactgatgacgaccaacctatgacgacacacacaactaatcctgttccagttattgtcactaaagaaggtgttacattaagagaaactggacgtttaggcgatttagcgccgacattattagatttattaaatgttaaacaaccatctgaaatgacaggtgaatcactgattaaacattag

SEQ ID NO: 2608 - DNA, 723 bp, Staphylococcus epidermidis
atcatgcgtacgaatgataaagtattactcgaaaatattaatgattattttagtcacaaaggaatgtcaccacacttaattgatgatataaaagaaaaatatcgacaagatattaaaaagtctgaagaaaaagatcaagattacattgaatatagaggtaaatcacctgcgcaattaatattaacaattcagcgtaatttgtttgcattacaactcaatccaatgattttctttatcattaactttattcttatttcatatttgtacgataaacaatatgtaccttttcaagcaattaccggtataagcttgttttattgcttagttatatttccaataacactcattttatatgtgcgtattgccaaaaaaaattatctatacagtaataagtatgaaatgagaactggaataatcattggtattattgctttaattctagtaattatgcaagggtttcactttaactgggctattattcctatttctatctatggtcatcagtttgtatttttcgctggaattattttaagtcttgttggtatattctttaaacgtatagaatttgtaggagttggcttactattttgtcaaaaaacaatagatgcaatggtaactgacccggaaattgcacagtttttctctttagcaatttggattatacttgttgtgctaatcattttttatacgatacgtttatctgaacgcactaaatcatcataa

SEQ ID NO: 2609 - DNA, 948 bp, Staphylococcus epidermidis
gaaagttggtttttatcattgttttttctatatcttttaggaatttttgttggcatgttacttcctattcaaacttcaatcaactcaaggctaagccaatttacccgttcatctttttatgcttcaaccatatcttttgctgtcggaacaatatgcttacttgtgcttaatatcattattcatccacaagtattaacaccagaattcttttctaagcaaacacttaactatacttgggtcctaggaggactattaggtgttatctatttaactggaaacttattattattaccaagattaggcgcagcacttactgttgttattacggttacagggcaaattattatgggtgtaatcattgatacatttggattattgggcgcccatcaacaatcttttacattatttaaaggtgttggaattatatttttaattactggaattatatttatgaattatgttcgtagacatcctgttaatagacataagaatacaccaatagtattctggttgcttattggattcgtatttggtttcgctccgccaatccaaacaacaatcaacagcacactggctcaacacacacactcatccatatttgcttcactcatatcatttagcgttggtacaatagcgttatttatattaacattagtatttaatcgtagtctgaaaatatcatctactcataaaacactaggtaagattaaatctatttattttattggagggatactaggaatggcattcgtaacatctaatattattttaatgcctttcttaggagcagctttaactactataattgctatgatgggccaaatgattatgggtattattatcgatcatttcggtttgttgggttcacctaaaaacaaaataacatcacgtaagttaggtggattattatgtatagctataggtattattttattacgattattttaa

SEQ ID NO: 2610 - DNA, 513 bp, Staphylococcus epidermidis
tgggaggtcaccatgaacaatatccgtttattgaatcaaaacgatttggattcctatattgaattaatgaaatttggtcaccataattatgaatgggatcgttactatttagaaaatgttagcattgatagactcaaaactatcttgtctaatcatactgattattggaatatatttggtgcttttgaagatgatgaacttgttgcaacatgcactttaaaacaaatgaattatgtaggtaaatgccataaagctattcttgaaaataattttgttaaaaataatgatgaaattgttaaccgagaattaattaatcatattattcaatacgctaaagaacaaaatattgaaacattgatgattgctattgcatcaaacaatataagtgctaaagtgttctttagttctataggttttgaaaatcttgcttttgaaaaaaacgctagcaaaattggcaatgaatattttgacgaaaattggctcatttattcaacaactgagtcatcagattaa

SEQ ID NO: 2611 - DNA, 183 bp, Staphylococcus epidermidis
actaaattaacggggtgtcttatgtataaaaattatcatatgactaaacatactctaccaatggaaacttcagtaattatctccacacatgatatgtcacaatatgtgaatgatattgtaaaaaaattccaggtactgaattcagacagcatcgttgcgcaacattatagcatcccaaaatga

SEQ ID NO: 2612 - DNA, 1149 bp, Staphylococcus epidermidis
attatgctaactgaaaaagagcaagatattatcaaacaaactgtaccattattacaagataaaggaactgagattacttcaattttttatcctaagatgtttgaggctaacccagaattattaaacatgtttaaccaaacaaaccaaaagaaaggtatgcaatctgctgcattagcacaagcagtactagctgcagcaatgaatattaataatttaggtgcaattaagccagcaattatgcctgtggcacataagcactgtgctttacaagtttatcccgaacattatccaattgtaggtgaaaatttacttgctgcaattcaagatgtgacagggttagaaagtgacgacccagtaattcaaacatgggcaaaagcgtatggagaaattgcagatgtatttatcaaattagagcaagaaatttacaaccatatgttatggaaaggttttaaaccatttaaaatcacaaacattacacaagaaacaagtgacatcaaatctttcacagttgaatctgaagaatatgatttaagtcaattcgaaccaggtcaatacattaccgtagatgtttctagtgaaaagttaccatatagagctaaacgtcattattcaatcatagatggagatgaaaatcacttagtatttggtgtcaaacgtgatgtgactactgaacatgaaggtgaagtttcaacaattttacatgatgaaatatcagaaggtgacatgattaatttatctgctcctgtaggtggcttttcaatagaaaatactgaaagaccgcaattgtttattggttctggcgtaggtatgacaccattagtttcaatgtttaaaaaagctgcatcattaaacgttccaactcaaatgattcaagcggttgtgacagaagatgaacgaccatttgctcaaaaacttgatagcattacagataattatgagcaagcacagctacatttacacgtgaaagataaagaaggttatttagaagctaaagaattagaacaatatttaagtgaacagcctgaaatttatatttgtggtggtacgaaattcttacattcaattataaattctcttaaagaattaaattatgatatgaatcatgttcattttgaaacatttattcctcgtttaagtgttcaagtatag

SEQ ID NO: 2613 - DNA, 204 bp, Staphylococcus epidermidis
atatttgtaacaaatccattaattaaaagagaatattctataaaaataattccacaatcaacttcacgtactttattacttaaccactactatacgcttatttttggaaaagtaaaggattttctatattttataaattgtagagctcttaataatgtcaaaagctatttaaataaggcattgtatagattaatagtttattaa

SEQ ID NO: 2614 - DNA, 249 bp, Staphylococcus epidermidis
tctaatacaacggcatttttaggattctttggtacttcgacagtattagagatttttttcttatcactgccattattttctttaccacttgcttcaaaactatttttgatggttacagtttctttagaatcactatttttctttttcgaagttgaattattattcgaactattactacaagccgttaaaactaaaactagagacaataataaaaataagactgtttttttcatatgtgcaactccctaa

SEQ ID NO: 2615 - DNA, 834 bp, Staphylococcus epidermidis
gtgaataaaactatcagagatatcattttagttatgataggttcatttattttctctgcaggtatcaatgcatttgttatttcagggaatttgggtgagggtggtgtcactggtatagccatcgtattatattatgcttttcatatttcaccgggaataaccaatttcgttttaaatgctattttaattattgtgggttataaatatttgagtaaacgtagtacatatttaacaatttttgctacagtactcatttcaatctttctaggtttaactgaaacatggcatgtagaaactgggaatgttgtgattaatgctgtgttcggtgggacttgtgttggtttaggaattggtattatcgttttagcagggggaacaaccgctggaacggttattcttgcgagaattgttaataaatatttagatattagtacgccttacgctttgttattctttgaccttatcgttgtgcttatttcattgacagaaattcctttagtgaagtgcttagttacagttatgtctttatatataggtacaaaagtgatggaatttgttatagaaggattaaatactaaaaaggcaatgactattatatctagtcgccctaatgaggtagcaaaagctattgatcagcaagttggaagaggattaacaatattaaatggacacggttattacactagagaagaaaaagatgtactttacgtagtcatctctaaaacacaagtatctcgtgctaaacgaatcatcaaaaatattgacgaaaatgcctttttagttattcatgacgttcgtgatgtatatggtaatggttttttgttagatgagtaa

SEQ ID NO: 2616 - DNA, 801 bp, Staphylococcus epidermidis
atgaaaaaaacgctaactgtaacgttaagttcgattgcagcttttattgcaatcaacactgcagctaacgcacaagaatctgagacgtcgcaactagacacatatgcaacgggtgatgtaattacaaatcaatcaaacttaggtatttacattgtaaaacctggagatagtttatataaaattgctttagaacataatctttctttagaagagctttatgcattaaatcctggtgtagaacctcttatttttccgggagatgaaattgtagtatctgaaactgcatttgaacaatttaataacacaaacacattcgtaaattatgaaactaactacattccagtaggatataataatgtatcaactgatacatccaacactacttatgataattatgatagtgaatcaactgatacatactctgtgtcaaacgcctatgatggtctaagaagtgtatctaactcagctaatttatacactactggtcaatgtacttattatgcattcgatcgtcgagctgagctagggaaaccaattggaagtctatggggcaacgctagtaactgggcatattcagctaatcaggctggctttaatgtagatcacacacctgaggttggtgctgtattccaaagtggtccgggtcaaaatggggctggtgcttatggacatgttggcgttgttgaatcaatcaattctaatggttctgtaactgtttcggaaatgaactggaatggtggcgttaacgtaaaatcttacagaactattagcaaccctaattcatataattacattcactaa

SEQ ID NO: 2617 - DNA, 846 bp, Staphylococcus epidermidis
tgtactatgacaaatgatgtccaaattttaaataacggttatccaatgcctgcagttggattaggagtttataagatagcggatgagcagatggaagaggttgtccgtacagctttagatgcaggatatcgtgcatttgatacggcatacttttatggaaatgaaaaagccttaggtagtgcattaaaacattcaaatgttgagagggacgagttattcataacatctaaactttggaatgattatcaaggttatgaccaaacaatagagtactttaataaatcattggacaatttagggttagactatttagatttatttttaattcattggccttgtgaaaatgatcaattgtatattgaatcatataaagccttagaacatttatatgaagaaggtaaaataaaagccattggtgtatgtaactttaagatacatcatttagaaaagttaatgaaagaaactaaaattacaccacaggtgaatcaaattgagttacatccgtactttaaccaacaagatgtacaagacttttgtgatgaacatgatattaaagtaacagcttggatgcctttaatgcgcaataaagggttgcttgatgaccctgtaattacagatattgctcatcgttatgataaaacacctgcacaaattgtcttacgttggcatcttgcacataatcgtattatcattcctaaatcacaaacacctaaacgtattaaagaaaattttgatatttttgattttaatcttgagttaacagatgttgcagaaatagatagtttaaataaaaatgctagacaaggaaaagatcctgatgatgtcagtattggagatttgaaataa

SEQ ID NO: 2618 - DNA, 960 bp, Staphylococcus epidermidis
acatccatgaccaagcaacgcatcgttatttcttcattactattcattttcattctcacaacttgtagttttagttacattactttctctaaattaacttctagaacagaagatattaaaaatattaaaactataaaagcaaagcccaaattactcctttcaacaactggtatacaagcccctcttaacagctatattttctactacactcccactttaggacaactccaaaaacttttagtaaaaaatcatagcaaagtatctaaaaacactccagtgttagaatattacaattatgaaaaagatcatttatatgaggaactccaaaatacacttagtaatgaacgtaacaacaaaactttaaattctaaaaatgatttacattattattcattccttaatcagctaaaattacaaatgattcaaactaaatcctcaattaaatccactttattttcaccaattaatggaagtatttcatatattaattctatcccttcaaaaccaaacgaaaagatagtgcaaattaatagcaacgaacgtattattcgtgctaatatatcagaatctgagttgaatttattaaaaataaatcaaaatatttctgtaacatctagtgacaacactcaatttactagtaaaattaaagaaatttcgaatataccatcaaaaataaaaaatggcgtctcatattacgacattttactttctacacaacccaatcatcaaattggaacacactttaaaatcaaattagcctcaaatgacataaagttacctacgtcagctattgttcaaaaacgctatgttttaattctaaaaaacgggaaaattacaaaaagagaagtaacatacaaaaagagtttaaaaagtgggtatattaatataactaaaggcttattgatagatgaaaaagttgttaaaaatcctacttctaaattaataaacatttatatataa

SEQ ID NO: 2619 - DNA, 495 bp, Staphylococcus epidermidis
atagagatgacagcgatattatggattttaattattatagcctttgcgttagcatttattggtttaattaaaccggtgataccatcacttttaatgttatggattggttttttaatttatcaatttggttttcatgagggaagattatcgtggattttttatgttgcaatgattatctttaccattatgatattagtagccgattttgtgatgaataaatatttcgtcaatcgctttggaggaagtaaaataggtgaatacacagcgctcataggtgtgattgtaggttgtttcgtttttcctccctttggtattatcattattccttttgttgctgtgttcattgttgaattggttcaagggtttaactttcaacaagctataaaggtgagttttggctcagtgattgcatttttagcgagtacaattgctcaaggtctaataatgattgtaatggttatttggttctttttagatgtctttctaataaattaa

SEQ ID NO: 2620 - DNA, 1575 bp, Staphylococcus epidermidis
aataaggagacgattaaaatggctaaaggggaccaatatcaagctcatactgaaaaatatcatgataaaaagtctaaaaaaagttataaacctgtgtggattatcattagttttattattttaattacaatcttgttattacccacaccagcaggattacctgtaatggctaaagcagcactagctattttagctttcgctgtagttatgtgggttacagaagcagttacttatccagtttctgcaacattaattttaggattaatgatacttttactaggtttaagtccagttcaagatttatccgaaaaacttggaaaccctaaaagtggcgacataatactaaaaggtagcgatattttaggaacgaataacgcgcttagtcacgcttttagtggtttttcaacctcagccgtagcacttgtagctgcagcattatttttagcagtagctatgcaggaaaccaatttacataaacgacttgcattacttgtgctatcaattgttggaaataaaactagaaatatagtcattggtgctattttagtatctattgttctagcattctttgtaccatcagctacagcacgtgctggtgcagttgtcccaatattactgggaatgattgctgcatttaatgtgagtaaggatagtagacttgcttcattattaattattactgctgtacaagcagtttcgatatggaatataggtattaaaacggctgcagcacaaaatattgtagccatcaattttattaaccaaaatttaggacatgatgtatcatggggagagtggtttttatatgctgcgccgtggtcaatcattatgtctatagctctttattttataatgattaagtttatgccacctgaacatgatgcaattgaaggtggaaaagagttaattaaaaaggaacttaataaattaggaccagtcagtcatagagaatggcgactaattgtgatttcagtgcttttattattcttctggtcgactgagaaagtattgcatccgattgattcagcttcgattacactagttgctctaggtattatactaatgccaaagattggtgttattacttggaaaggtgttgaaaagaagattccttgggggacgattatagtatttggtgtaggaatctcacttggtaatgtattacttaaaacaggagccgctcaatggttaagtgatcaaacatttggtttgatgggtcttaaacatttaccgatcatagcaactattgcgttaattaccttatttaatatattaatacatttaggttttgcaagtgcaacgagcttagcctctgcgttaatacctgtgtttatttctttgacttcaacgctaaatttaggtgatcatgctattggttttgtattaatacaacaatttgtgattagttttggtttcctactacctgtcagtgcaccacaaaatatgcttgcatatggtactgggacttttaccgtaaaggattttttaaagacaggtatacctttaacgatagtaggttatattttagttatcgtatttagtttgacgtattggaaatggcttggtttagtgtaa

SEQ ID NO: 2621 - DNA, 1944 bp, Staphylococcus epidermidis
caaaatttttttgaaaattcgatagttgacaatttccagtatttgaaaaggaagataagcatggaagcatacaaaattgaacatttaaataaatcctatgcagataaagaaatttttaatgatcttaacctatctatatctgagcatgaaagaattggattagtaggtatcaatggaacaggtaaaagtacactattaaaagtcattggtggtctagatgaagattttactgcagatattacccaccctaatcaatatcgcattcgttattcctctcaaaaacaagacctcaatggccatatgactgtgttcgaagctgttttaagttcggatactcctacattaagaattataaaaaaatatgaagaagcagttaatcgctatgcgttagatcaaagtgactctaattttaataaaatgatggaagcacaagaagaaatggatcaaaaggatgcatgggactataatgcagaaattaaaacgattttatctaaactagggattcacgatacaactaagaaaatagttgaactttcgggtggtcaacaaaaaagagttgtattggctaaaactctaatagaacaaccggatttacttttgctagatgaaccgacgaaccatcttgactttgaatccatccgttggctcattaattatgtcaagcaatatccacatacagttttatttgtaacacatgatcgctactttttaaatgaagtatcgacgcgaattattgaactggatagagggaagttaaaaacatatccaggtaattatgaagattacatagtaatgcgtgcagaaaatgaattagtagaacaaaaacaacaagaaaaacaaaaagcattgtataaacaagagttagcatggatgcgagcaggagcaaaggcaagaactactaaacaacaggcacgtatcaatagatttaatcaactagaatcagacgttaagacgcaacatacacaagataagggtgaacttaatcttgcatattcaaggttaggtaaacaagtatatgaattaaagaatttatcaaaatcaattaataataaagttttatttgaagatgtcactgaaattattcaaagtggtagacgtataggtattgtaggacctaatggagcgggaaaaacaacattacttaatattttaagtaatgaagatcaggactatgagggtgagcttaaaatcggtcagactgttaaggtagcttattttaagcaaacagaaaagacacttgaccgtgatattagagtgattgactacctaagagaagaaagtgaaatggctaaagaaaaagatggtacctcaatttcagttacacaattgttagaaagatttttatttccgagcgctacacacggtaaaaaagtttataaactctcaggtggagaacaaaaacgtctgtatttattgcgtttacttgttcataaacctaatgtactccttttagatgaaccgactaatgatttagatactgaaacacttacgattttagaagattacattgatgatttcggtggttctgtcattacggtcagtcatgatcgttatttcttaaataaagtggtacaagaatattggtttattcatgatggtaaaatcgaaaaaattattggatcatttgaagattatgaatcttttaaaaaggaacatgaacgccaagccatgctatctaaacaaactgaacaacaaaataaacataagcatcaaccaaaaaagaaaacaggactatcttataaagagaagttagaatacgaaacaattatgacgcgtatagaaatgactgaaacgcgtttagaagaccttgaacaagaaatgattaatgcaagtgataattatgcaagaatcaaagaacttaatgaggataaagagcaacttgaagcaacctatgaagcagacatcacgagatggagtgagcttgaggaaattaaagaacaataa

SEQ ID NO: 2622 - DNA, 513 bp, Staphylococcus epidermidis
gaggacattgccatgcaacatcttataaaaaaacatgtattgaatggcgagtttgaactagttagacagttaatgtccgaaacagattttatggaatttgaagaagcatacatctctagtgctcatgaagtagagagtatgatgttttatacatgtattctagatatgattaaggtagaagaatcatcagaattacatgatttagcattccttttacttgtttatcctttaagtgaatatgagggcgcactagattcagcttattatcatgcagattcttccataaaacttactgacggaaatgaagtgaagagtttattacaaatgttattgcttcatgctattcctgagccagttatttcggataaaaaagcgtttgatgtcgctaaacgaattctaaaactcgatccaagtaataatgttgcacgaaatgtacttaaagatacagcaaaacgtatggataatgtagttgtagacattaatgaattgaacaatcaaagagatgcacgctaa

SEQ ID NO: 2623 - DNA, 2136 bp, Staphylococcus epidermidis
aaatatgctgctaaagtcattttagaagctgcaacaaaagcaggtgctcctaaagattgtattcaatggatagaagtgccatcaattgaggcaactaaacaattaatgaatcataaagatattgctttagttctagcgactggaggctctggaatggtaaagtccgcatattcgacaggtaaacctgcattaggagtcggtccaggtaatgttcctacttatattgaaaaaactgctcatatcaaacgtgctgttaatgatatcattggttctaaaacttttgataatggtatgatttgtgcttctgaacaagtcatggttgttgataaagaagtatacactgacgtcgttaaagaattcaaattacaccaaacatattttgttaataaaaatgaactacaacaattagaagatgccatcatgaatgaagataaaactgcagttaaacctgatatagttggtaaatctgctgtagatatagcgaaattgtcaggaattagtgttccagaaaaaacaaaattattagtcgcagaaattgatggaattggaaaagattatcctttatcacgtgaaaaattatcacctgtactcgcaatggtaactgcaaaatcaacaggacatgcactacaaatttgtgaagacatattaaaatttggtggtttaggtcacactgctgtaattcacaccgaggatagtcaattacaacaaaaattcggtctaaaaatgaaagcttgccgtgtattggtaaatacaccttctgctgtcggaggaattggaaatatgtataatgaactcattccttcactcacgttaggttgtggttcatatggtagaaattctatttctcataatgtaagcgcagtagacttattaaatattaaaacaatagcaaaacgtcgtaataatatgcaatggtttaaactcccacctaaagtttattttgaagaaaattcagttatgtatttgacagagatggataatgttgaacgtgtaatgatagtttgtgatccaggaatggttaatattggttatactgatatagttgaacaagtgctgagacgccgagaaaaccaaccacaaatcaaagtgtttaacgaagttgaacctaatccatcaactcatacagtctataaggggttagaaatgtttataaatttccaacctaatactattattgcactcggtggcggttcggcaatggatgcagccaaagcaatatggatgttctttgagcatccagaaacttcattttttggggcaaaacaaaagttcttagatattcgtaaacgtacttataaaattaccaaacctaaaaacgcaaaatttatatgtataccaacgacatcaggaactggttctgaagtgacaccttttgcagtaattactgatagcgagacacacgttaagtatccactagcagattatgcgttaactcccgatattgctatcgtcgatccacaattcgtattaagtgtacctaaagatgttgccgcagatacaggaatggatgttttgacacatgccattgaatcttacgtctctgtcatggcttcagattatacaagaggcttaagcttacaagcaataaagttaacttttgattatctaaaatcatcagttcaagaaaatgacaaacactcacgagaaaaaatgcataatgcttcaacaatggccggtatggcatttgccaatgcttttttaggaatttctcattctatcgcacataaaattggtggtgaatatggtattccccacggcagaacaaatgctattttattaccacatgtcattcgctataatgccaaagatccacaaaaacatgcactgtttcctaaatatgatttctttagagcagatactgactatgctgacattgcaaaatttttaggactcaaaggtaatacaactgaagaattagtggatgctctagctaatgcggtgtatgatttaggatgttcagttggtattgatatgaatttaaaatcacaaggcgtaactgaagagcttcttcactctactatagacagaatggctgaattagcatttgaagatcaatgtacaactgctaatccaaaagaaccgctaattagtgaacttaaaggcattatcgaaacagcatatgattatgaaagataa

SEQ ID NO: 2624 - DNA, 1077 bp, Staphylococcus epidermidis
agtaattatttgaaagggttagccatgatgaaagaaaagctaaaatggatatggataacaacactaatcatacttgttgtctcacttatattggcttttaatttgaagagtcattataaccatgttcatgataaacagaagagcaagacaaatgttcaaattaataacaaaaatgtaaaattatatagagatatctcatatggtaaaggtatacccaacagcaaattagacattattaccccagctgatatgagcaatgatacgaaattaccggtaattttttggatgcatggtggaggatttatcgctggagacaaacaatataaaaatcaattattgtcaaaagttgcagaacaaggatacatcattgtcaatgtaaattatgcgttagctccgcaatataaatatccaacgccgctagtacaactcaatcaagctgtaaagtttataaaagagaataagcatgagttacctattgattttgatcaagttgttattgggggagactctgctggcgctcagttaactagtcaatatgtagctatgcaaaccaatgaagacttgagagatgaaatgcattttgaacagcagttcaagccttcacaaataaaggctgctgtattttttggtggtttttataatatgaaaaccgttaaagcaactgagtttccgagaatacaattatttatgaaaagttatactggaacaagtcattgggaaacagattttaaaaacttatctcaaatgtcaacgctcaatcaagtgactcacgaatacccaccgacatttctttcggttggtgacgctgatcctttttatagtcaaaataaagaatttgcgcaaggtttgaaaacagaaaatattccagtagatacattattctatgatggttcgcatcacttacatcatcaatatcaatttcatctagataaaccggaatcaaaagagaatatcaaaaaagtactgctatttttaagtcgaaacacatcatcttctggagtggagagtaacgagtcatcacaaaatcagccaactcaaaatactaatgaagtatccttatacccttttgattcttaa

SEQ ID NO: 2625 - DNA, 471 bp, Staphylococcus epidermidis
cagttttatgctataatgacatttattattgtaagggttaaggtgagtagtaaattgaataaaaatattaacattcaaacccgtcaagttttgaaacagaatggtgaaaagcagagatttgagtttactacaaaaggttcttggcaacaaaaatttgcagattttatacgttacgaagaacaaattgaagatgctaaagttaatgttacgattaaaattgaagatagcggtgtaaagttaattcgtaaaggcgacattaatatgaacttacatttcgtcgaaggacatgagacgacaacactctatgatgtacctaccggaaaaatacctttaactgttaaaacactaagccttatgcatttcgttactcataatggcggtaaacttaaaatacattatgagttatatcaagatgaacaaaagatgggttcttatcaatatgaaataaattataaggagataagcgaatga

SEQ ID NO: 2626 - DNA, 213 bp, Staphylococcus epidermidis
ataagtaaagcaattgaaatcattgtattaacaatcatagttgtaatggataggattttcgaaatacgatttttatttttagtgaagactaaaattaaagcacatacaaaaggcaacaacataggcaatattattaaattactcatcatcttcatcacctttcaatgcacttatttcatcctctttagttactctgtaagttctatatattaa

SEQ ID NO: 2627 - DNA, 378 bp, Staphylococcus epidermidis
acgttgaaagcaaaaatgactttctattgttttattcccacatcaaagtatttaaaaacttatttatcattaatagcttttataccaggtaattctttaccttctaagtattctaatgatgctcctccaccagtagagatgtgtgtaaagtcatcttcgaaacctaatgaaattgctgctgcggcagagtcaccaccaccaataatagtagtagcgtcttccaatttagcaatagactcacatacaccgattgtacctttagcaaaattactaaattcgaatacacccataggtccattccatactacagtatgtgcaccttgtaattctttattaaataattctactgttttaggtccaatatccattgcttcttga

SEQ ID NO: 2628 - DNA, 2001 bp, Staphylococcus epidermidis
gaggcgtattttggaatggtagaacatgttccatttaagttaaagtctgaatttgagccacaaggtgatcagccacaagcgatacaaaaaattgtggatggcgtaaatgaagggaaacgtcatcaaaccttattaggtgcaactgggacaggtaaaacttttactatgagtaacgtaattaaagaggttggtaaacctacacttattattgcacataacaagacattagcaggtcaactatatagtgaatttaaagaatttttcccagaaaatagagttgaatatttcgttagttattacgactactatcaacctgaagcatacgtgccttcaacagatacctttattgaaaaagacgcctccattaacgatgaaattgaccaactacgacattctgctacaagttctttatttgaacgtgatgatgtcattattatcgcaagtgttagttgtatctatggtttaggtaatccggaagaatataaaaatttggttgttagtgtacgtgttggtatggagatggaacgaagcgaattgttgagaaagttagttgatgtacaatactcacgtaatgacatagattttcaacgtggtacatttagagtgcgtggagatgttgttgaaatattcccagcttctagagaagaaatgtgtattcgcgtagaattttttggagatgaaattgatcgtatcagagaggttaactatttaactggtgaagtaattcgagaacgtgaacattttacaattttcccagcttcgcacttcgttactcgtgaagagaaaatgaaagtagctattgaacgtatagaaaaagaattagaagagagactaaaagaattacgtgatgagaataaattattagaagctcaaaggttagaacaacgtactaactatgatttagaaatgatgagagaaatgggcttttgttcaggtattgaaaattattctgttcacttaactttaagaccattaggttcaacaccatatacattgcttgattattttggagatgattggcttgtcatgattgatgagtctcacgttacgttacctcaaattcgtggtatgtacaatggggatagagctcgtaaacaagtattaatagaccatggatttcgtttgccaagtgcgttggataaccgaccattaaaatttgaagaatttgaagaaaaaacaaaacaacttgtttatgtttcagctacaccaggcccatatgagttagaacatacagatgaaatggttgaacaaattatacgacctactggtttacttgatcctaaaattgatgtgcgtccaactgagaatcaaatcgatgatcttttaagtgaaatccaagatcgcgttgacaaagatgaacgtgtacttgtgacaacacttactaaaaaaatgagtgaagatttaactacatatatgaaagaagcggggattaaagttaattatttacactcagaaattaaaacattagaacgaatagaaattattcgagacttacgtatgggtacttacgacgcaatagttgggatcaatctgctgagagagggtatagatatacctgaagtatctttagttgtaattttagatgcagataaggaaggcttcttacgttctgatagatctcttattcaaactattgggcgagcagcacgtaatgacaaaggagaagtcattatgtatgcggataaaattacagattctatgcaatatgcaatagatgaaacacaaagacgtagagaaatacaaattgctcataacaaagaacatggcatcacgccgaaaacaattaacaaaaagattcacgacgtcattagtgctactgtggagagcgatgagacaaatcaacaacaacaaactgaattacctaagaaaatgacaaagaaagaacgtcaaaaaacaatagaaaatatagaaaaagaaatgaaaaaagcagccaaagatttagatttcgaaaaagcaacagagttaagagatatgttatttgaattaaaagcagaagggtga

SEQ ID NO: 2629 - DNA, 1380 bp, Staphylococcus epidermidis
aatctaatggctataggtgtcatattaaatagagtttttaggctaaataataatccattatttgattatatatatagtaataaagaatctataaatcattgttattttattattccaactgaagagtttgaagaagaagcaaaaaagaaagcacaatactattatgggtccatacagaagtttatgtatgaactacaacgatatgatatagaaccctttttgatgtcttatgataaattaatagacttttgtaaaaaacaagctatagacaaagttgttgttgcaggtgatattatgagttatcatcacgaagaatatgacattttacatcaaaggaaacgatttaaacaagctaatattcaagtaatatcattaagagcaaatcattattttaacccccgcaaaacacataataaacaaggggaaccatataaagtatttaccagtttttatagaaaatggcgtccttacttaatgattagagatgaatatgactatcatttagaagatatttcaaaggttgtagtgaaatctcaacataaaattaaagaagattatcattcatatggtataagtgaacgtgatgttcaaaatcgttggtctgaatttttatctcaagatatcgaaaattataaagaaaacagggaatacttgcctgaagtattaacaagccaactaagtatttacttagcttatggaatgatagatattatacaagttttcaacgatttacttcaaaattatgataaaaatgaacaaaattacgaaacttttatacgtgaattgatttttagagagttttattatgtattaatgaccaattatcccgaaacagctcatgttgcttttaaagaaaaataccaacaattgaaatggtcttataatgaagagaattttaaactgtggaaagatgggaatactggttttccaattattgatgcagcaatggaggaacttaaaacaactggatttatgcataatcgcatgagaatggtagtttctcaatttttaactaaagatttgtttattgactggatttggggtgagtcatttttcaaacaaaaattaatagattatgatgcagcttcaaatgttcacggatggcagtggtcagcttctactggaacagatgctgtaccatactttagaatgtttaatcctataagacaaagcgagcgttttgataataatgcacgatatataaaaacttacattccaagattaaatcaggtagatgctaagtatttacacgatactcataaattcgagcaacaaataaaggggcaaggtgttgaaataggtaaagactatcctaaacaaatgattgatcacaaagaaagtagacaacgtgtaatgtcagaattcaaagcattagattaa

SEQ ID NO: 2630 - DNA, 477 bp, Staphylococcus epidermidis
gtaatagtggctaagaaaaaatcaaaatcaccaggtacgttagctgaaaatcgtaaagcaagacatgactacaatattgaagatacaattgaagcgggtattgctttaagaggtactgaaattaaatctatacgtcgtggtagtgccaatttaaaagatagctttgcgcaagtgagacgaggcgaaatgtacctgaataatatgcatattgcaccatatgaagaagggaaccgttttaatcatgaccctttacgtacacgtaaattactcttgcacaaaaaagaaattcaaaaattaggtgagcgtacacgagaaataggttattctattattccgttgaagttatatttaaaacatggtcaatgtaaagttttattaggcgttgctagaggtaaaaagaaatacgacaaacgtcaagcacttaaagaaaaagcggtaaaacgagatattgatcgtgcagttaaagcccgttattaa

SEQ ID NO: 2631 - DNA, 798 bp, Staphylococcus epidermidis
tttatgcattttaaacgtgttgtaaagtggggattgaatatgtatcaaaaccaaagaataaaagataaaattaacatattaggtgtaagttttgataatactacaatgctggaaatggtagaaaatattaaacaattcatatctagcaatacagatgataatttatttatagtgactgctaatcctgaaatcgtggattatgcaactgaacatgagctatatagaaatttaattaatcaagctgattatgtagttccagatggtacaggaatagtaaaagcttcaaagcgattaaaacagcccttaaaacggcgtgtgccaggaatagaacttcttgaagaatgtctgaaaatagcacatgtcagccatcagcgcgtatatctgcttggatctaaaaatgaaattgttgagtcagcagagaaaaaacttcaatctcaataccctaatatccactttgcacatcatcatggctatattcatctagaagatgaaacagtcataaaacgtataacaagttttaatcccgattacatttttgtaggaatgggatttccaaagcaagaacaatggattcaaaagcataaggacaagtttaagcacactgtgatgatgggcgtaggtgggtcgtttgaagtattcagtggctcaaagaaaagagcacctcaaatatttagaaagttaaatattgagtgggtatatcgtgtgcttattgattggaaacgcattgggagaatgataagtattcctaaatttatgttaaaggtagcaatacaaaaatataaaatgaaatcaaaataa

SEQ ID NO: 2632 - DNA, 327 bp, Staphylococcus epidermidis
ggatttaattttggaggtgacacgatgattgaaatgttcactcaaatatttattataagtgcattagtgatttttggtatggcactacttgtttgtctagtcagattaattaaaggtcccactactgctgatagagttgtatcatttgatgcctcgagtgctgttgttatgtctattgttggtgtgatgagcgttatttttaactcagtgtcttatttagattcaatcatgttaattgcaattatttcgtttgtcagttcggtctcaatttcaagattcatcggggaaggacgtgtcttcaatggaaatcataaaagacatcgttag

SEQ ID NO: 2633 - DNA, 612 bp, Staphylococcus epidermidis
cgcgttaattttatattaaaatataggcaaaataagcattttcgattaaatggagtgtttaagatggttatttatattgaaactgaacgtttaaacttaagagattgggaaaccaaagatttattaccttttcaaaaaatgaatgctaatgcgcaagtacgtagatacttccctagtttacttagttatcgtcgttctgagatagacatggaaaatatggatagcataatacaagagagtggcctaggtttatttgctgtagagttgaaagagacgggagaatggttagggtttataggtgtgaattacgtttcaaaagatagccattacccttttaaagagttaccgttttatgaaataggttggaggctaattccagaagtatggggaaatggtctagctacagaaggggcagaagccgtaatgaaatatgctagagataaaggaattaaagaattatatagttttacttctgaaaataatttgccttctagaaaagtcatggaaaaattaggaatgacttttttagacaattttgaatatccgaatcttagtaaataccatccccttaaacgtcatgtaagatattataaagagctacttccttcttga

SEQ ID NO: 2634 - DNA, 771 bp, Staphylococcus epidermidis
gccactctttattggctaaggtatcacttaaagaaatcatcgcttattttagagaccgtaataaccgaggtgaagataagcatgacccacttactaatcgtggatgatgaaaaagatattgtagacatttgtcaaacgtatttcgaatatgaaggatatcaggttacgacaacaacatgtggtaaagaagcactaaaattattatcttcagatatagatattatgattttagacattatgatgccggaagttagcggatacgatattgtcaaaaaaatgaaagatatgcaacttgatatacctttcatatatctaacagcaaaaactcaagaacatgacacgatatacgcactgacgttaggtgctgatgactatattaaaaaaccctttagcccaagagaactagtattacgtactaataaccttctcgctagaatgagtaaatcaaatcattctaataaaattgagcaattagaatttgatggtttagttttaaaaaatttaagcaagacacttaccattaacaatatagagatacctatgcgcattaaagaatttgaattgctatggtatcttgcttctagagaaggtgaagttatttctaaatccgaacttctagaaaaagtatggggatatgactattacgaagatgctaacactgtcaatgtccacatacatagaattcgcgagaaattagaaaaacatgattttttaccctacactattacaactgtgtggggccttggttataagtttgaaaggagccgataa

SEQ ID NO: 2635 - DNA, 207 bp, Staphylococcus epidermidis
aaagaggtttatatgttatacgtaattataggcttttttataataggaatcggactatatatttttagtttctttttagcacaaaatcaaggattatcttataaaagtcattgcagaaatttttctgcagtttttatatcactcggtgtattatgcttaatgggatatctcgttcattatgtatctaaacactatttaggcatatag

SEQ ID NO: 2636 - DNA, 183 bp, Staphylococcus epidermidis
ctgttgtattactccaagaaggttaaaagtaatggactttcaggtgctattagtggtggcgctgaacaattgtttggtaaacaaaaacaacgtggcgtcgatttattcttgcatagattaacaataattttagctattttattctttgtacttatgttttgtattagttacttaggtatgtag

SEQ ID NO: 2637 - DNA, 183 bp, Staphylococcus epidermidis
aaaactcattacattgaactttactttattacaatttatctaataaatattaagaaaagtaacgaaatatgtcttataaatagcgatatatcaactttctttaataaatgttcagaacaatacattattttaacaatgttacaagataataacaaagcccacaaagtcaaatatttttgttag

SEQ ID NO: 2638 - DNA, 348 bp, Staphylococcus epidermidis
atcatgaatttaatattactccttgtgataggatttttagtgtttattggaacttatatgattttatctattaatttaattcgtattgttattggtatttctatttatacacacgccggtaatttaattattatgagtatggggaaatatggacctcatatgtctgaaccgctaattcaaggtcatgctcaaaactttgttgatcctttattacaagctatcgttttaacagctattgtgattggatttggtatgactgcgtttttattggtgttaatatatagaacttacagagtaactaaagaggatgaaataagtgcattgaaaggtgatgaagatgatgagtaa

SEQ ID NO: 2639 - DNA, 249 bp, Staphylococcus epidermidis
tggatttgttacaaatatttagtgcaaaagcacgtggaggtattctatatgaataacggtacagttaaatggtttaatgcagaaaaaggatttggtttcatcgaaagagaaaatggcggagatgtattcgtgcatttctcagcaatcgttgaagatggatataaatctttagaagaaggccaaagcgttgaattcgatatcgtcgaaggtgaacgtggtgagcaagctgcaaacgttgttaagatgtaa

SEQ ID NO: 2640 - DNA, 435 bp, Staphylococcus epidermidis
cattattgttacaaaaggtcctgttttaaatggttttttggtcactgtagtttggcaattgatcatgacactgtacttcaaattgaaggtccaggggataaaccaatgacggaagattttgaatcttatcgtgacagatatggaaaaggtaaaaatgaatggataaaagtctatcgatgttcacaccctaacgctggaacaaaagcagctcaatgggcaaagaaacattatgagaatagcgatagcgaatatcttgttacattcaacttaaaaagtgaaacatttacatattgcactaaaattatatatcaagcatataaatacggcgtagataaaaattccgtaagtgatcacggtttatatattatttcaccctatgcgctaacagataattttacagatgaatataaattaaaattagtaaaaacatattaa

SEQ ID NO: 2641 - DNA, 219 bp, Staphylococcus epidermidis
gtcatgttatattctttacacataaagcacctcgttaaattagtttattggtatttattaaattatacgaaagggccatattttttaaagtattttaatataaaattacatataagcacaaagtattttggcgagactcttgagagaacaggacaagctgaagactacaggctgaagctgtccgataagaaagcgagccaacaatacgaagtattgtaa

SEQ ID NO: 2642 - DNA, 210 bp, Staphylococcus epidermidis
gactatcaatatgtcattctatgtattttgttaatgatgaacaatgatgaacaacaaaaaaatgaaagcgtttgttttacgtactatatttctgtgcaaaccccaaaagttcttttaatcttacaaaagttattataccacgtgaaaaatagggttaaaatgacatttttacaaaacttatataaaaaaccacgcccttccactcattaa

SEQ ID NO: 2643 - DNA, 558 bp, Staphylococcus epidermidis
acggagggatataaaatgaaattgaaactattaggaacattagcactctcgtcaataatattaacagcatgtggacaagaaaatgtaaaaaaaacagaaagcaatccaaaagaagaacaaaataaaacggataatatgcaaactaatgggagcgtaacaaattctaatagtaatcaaaaacaaaaaacagctcaaaaacaaatttccgctcaagaagcagaacaaattgtctcgaactattacattaataaagggattaataagcaacaagttcttgaatttaaaacaaatatagatagaagcaatgctaatgaatattatgttgaacaccttgtaagagatgcagccggaactcctataaaattttgtgctgtagtaaacaaaagtacaggtgaagtgatcaatcgatttaatgacatgaatgaggaagaaatgaaggaatttgaggaatttaaaaaaagaagtcctaagtaccataattctggtgaagaaaaaaataaaatgcaagaaaattcttcatcttccgaacaacaagaagtccacaattctgttatataa

SEQ ID NO: 2644 - DNA, 219 bp, Staphylococcus epidermidis
gtgttcaagtatagttttaaagaaggtaatataatgaaaatgaatccaagatatgttaaagtgttttttctatatttagtaagcacatttatttctaatcgcttaacaacgaataaatctttatgcaaaacattaatgcaaggcattttaggttatggtttatttgcattaggattaaagtatttaactattaagaaaaaacaacatcaagcgcaatag

SEQ ID NO: 2645 - DNA, 2169 bp, Staphylococcus epidermidis
agtttgaagtacaagggacaaataaagacattattgaatttaaggataaggtgggcaatttcaatgaaaaccatggaagaaaagaaatacaatcatattgaattaaataatgaagtgaccaagagaaaagacaatggtttctttgatttagagaaagatcaagaagcattgaaagtgtatcttgaagaaatccatgataaaatgatttcttttgatgatgaaatcgaaagacttcattatcttgttgataataatttttattttaatgttttcgaaaaatatagcgaagcagaattaattgaaattactgaatacgcaaaatcaattcacttccaatttgctagttatatgtcggcaagtaagttttataaggattacgctttaaaaacgaatgataaaactaagtttcttgaggattataatcagcacgtcgcaatcgttgcactttatttagcgaatggtaatgttaaacaagcaaaacaatttatttctgcaatggtggaacaacgttatcaaccggcgacaccaacattcttgaatgcaggtagagcaagacgtggagaacttgtttcatgtttcttattagaagtagacgatagcttaaattctatcaatttcattgattcaactgcaaaacaacttagtaaaattggtggtggtgtggccattaatttatcgaaacttcgtgcacgtggagaagcaattaaaggaattaaaggtgtagctaaaggtgttttacctgttgctaaggcacttgaaggtggatttagttatgcagatcaattaggacaacgtcctggcgctggggcagtgtacttaaatattttccattacgatgttgaagagtttttagatactaagaaagtgaatgcagatgaagatttacgtttatctactatttcgactggtcttattgtaccttctaaattctttgatttggctaaagagggtaaagatttctatatgtttgcacctcatacagttaaacaagaatacggtgtgactttagatgatattgatttagaaaagtattacgacgatatggttgcaaaccctaatatcgataaaaagaaaaaagacgcacgtgaaatgttaaatatgattgcacaaacacaattacagtctggttatccatatcttatgtttaaagataatgcaaacaaagtacatgcgaattcaaatattgggcaaattaaagtgagtaatttatgtactgaaattttccaattacaagagacatcagtaattaacgactatggaattgaagatgaaattaaaagagatatttcatgtaacttaggctcattgaatatagtgaatgttatggaatcaggtaaattcagagattctgtgttcacaggtatggatgctcttacagttgtaagtgatgaagcaaatattcaaaatgcaccaggtgtaaaaaaagcgaatagtgaactacattctgttggactaggagtaatgaacttacatggttatctagctaaaaataaaattggctatgaatctgaagaagcaaaagactttgctaatatattctttatgattatgaactattattccatcgaacgttcaatggaaattgcaaaagagcgtggagaaaagtatcaagactttgagcaatcagactatgcaaatggtaaatattttgaattctatacatctcaagaatttgaaccaaaatttgaaaaggttcgccaactttttgatggtatcgatatacctacttcaaatgattggaaagaattgcaaaataaagtagaacaatatggactttatcacgcttatagattagctattgctccgactcaaagtatttcttatgttcaaaatgcgacaagttctgttatgcctattgttgaccaaattgaacgtcgtacgtatggaaatgcggaaacattttatccaatgccatttttatcaccagaaacaatgtggtactacaaatcagcatttaatactgaccaaatgaaacttattgacttagtagctacaattcaaactcacgtagaccaaggtatttcaacgatactttatgttaattcagaaatttcaacacgtgaactttcaagattatatgtatatgcacaccataaaggccttaaatctttatactatacacgtaataaattattaagtgtggaagaatgtacaagttgtgcgatttaa

SEQ ID NO: 2646 - DNA, 648 bp, Staphylococcus epidermidis
atgttagatttcattaaccatttgcttagttatcaatttttaaatcgtgcattaatcacatctattttagttgggattgtatgtggaacgatgggtagcattattgttttacgtggtctttctttaatgggtgatgccatgagtcatgctgttttaccaggtgttgctttatctttcttatttaatattccaatgtttatcggggcacttgtaacgggaatgcttgcaagtttgtttattggttttattacttcaaacagtaaaacaaaaccagatgctgcaataggaataagtttcactgcattcctagcatctggcgtcataattattagtttaatcaatagtacaacagatttatatcacattttatttggcaatttattagcaattacacatcaatcattttggacaacaattgtcattactgtactggttattttacttattattatcttttatagacctttaatgatttcaacatttgatgcaacttttagtcgtatgagcgggctgaacacaacattaattcactactttgtcatgttattactccgcacttgtaactgttgcgagcatacaaacagttggaattatccttgtagttgctttactaatcactccagcttctacagcttttttaatcagtaa

SEQ ID NO: 2647 - DNA, 1032 bp, Staphylococcus epidermidis
attatagatttacattggttcaaaactctttattttatacataaatatgacaggaggattttaatgaaggcggtaaattggaacacccaagaagatatgactaatatgttctggcgtcaaaatatctcacaaatgtgggtggaaacagaatttaaagtatcaaaagatatagcaagttggaaaacattaacagattctgagaaaaatacttttaaaaaagcgcttgcaggtttaacaggtttagatacacatcaagctgatgatggtatgccattaatcatgcttcatactactgatttaagaaagaaagctgtttattcatttatggctatgatggaacaaatccatgcgaaaagttattctcatatcttcactacattattaccatctagtgaaaccaactatttattggatacttgggttattgaagagccacatttaaaatataaatcagataaaattgtagaaaattaccacaaactttggggtaaagaagcatcgatttacgatcaatatattgctcgtgtttctagtgtattcttagaaacatttctattctattctggcttctattatccattatatctcgcaggacaaggaaaaatgactacgtcaggtgaaattatacgtaagatacttttagatgaatctatacatggagtgttcacaggtttagatgcacaaagtctacgtaatgagttatctgaaagtgagaaacaaaaagctgatcaagaaatgtacaaattattaaatgaactttatgataatgaagtttcatatacacatttattatatgatgatattggtcttgctgaagatgtattaaattatgttcgatataatggaaataaagcattatcgaatttaggttttgaaccatatttcgaagagagagagtttaaccctattattgaaaatgcactagatacatctacaaagaaccacgatttcttctctgttaaaggtgatggctatacattggctttaaatgttgagcctctacgtgatgaagactttgtttttgataattaa

SEQ ID NO: 2648 - DNA, 186 bp, Staphylococcus epidermidis
  unsure (22): Identity of nucleotide at the above locations are unknown.
aaatggaatctttttgggaatngggaaaatttcaaaggaactgatatagataaatttttagaaattaatggagctgctattttgtattcatacagccgtgcacatataagtcatattactaatacaagcaaatacccttcatttgatttacctttttataatttcacagacaatgattatcaatag

SEQ ID NO: 2649 - DNA, 681 bp, Staphylococcus epidermidis
caattgattcagtacccgaaaatgaagttcaggaatttcacgataaaactaaaattttggagcggttataatatgcatttatttgaaacaatgaaattggataagggattcattcctcgtcttgactaccattatcaacgtatttcaacttctagtgagcatctaggatttcaatttgatcatctattttggaagcagtttattcataatataaaaaccttgcattcaaaaggcgtatttcgtttgaaggtgacgttaaacaaagaaggtgaattaaactatgagttatttccgatacccgataaacctttttttaccgctcgactagttcaacaaaaaaagaatattgataaagtaatcataactaataaaacaacagaacgtgattatttaacacataatcatttcacagacttaatactgatctatgatgaagatggtaaaattttagagtttgacattggcaacgtgatgatacaagaaagagataaattgtatacaccaacatataaaggagacatgctccccggctgtatgagacaatctcttatagatcaaggcaaagttatagaaaaagatttttatatcgaagaatttaaagaaaaaatcaaatcgagtcaaatcaacgtctatttaatcaatagcttaagagaggttgtcggtgttaaagtatatgtataa

SEQ ID NO: 2650 - DNA, 1137 bp, Staphylococcus epidermidis
caaatagttcagagaaaaggatgtcatttaatgaaaatcagagtcatcgtcccttgctataatgaaggcgaagtcgttttgaaaacttatgacaaattaactgaaataatgaagaaagatagtttaatcaaaaattatgaatacgatttactctttattaacgatggtagtacagatacgacaatacatcatatcaagaatattgttgcgtatgataaccatgttaaatatctttcattcagtcgaaactttggcaaagaagctgcaatgattgctggctatcagcatagcacaatgcacgacgcggtgattatgattgatggagatttacaacatccgcctgaatatattccacaaatgatagagggttacattgaaggttatgatcaagtggttgctaagagaaatcgtcagggagagaattttgtacgtaaaactttgtctcgttgttattataaattaattaatgcatttgtagaggatatccaatttgaagacggcgttggtgattttagattactcagtcgacgtgcagttcaagctttaacaacacttgatgaatataatcgtttctctaagggtctatttgaatggataggttatgaaacaaaagtatttaaatatgaaaatgtgacgcgtgaagatggagaatctaagtggacttttagaaagttactcaactatggtattgatggactcatctcttttaacaataagcctttacgcatgatgatatacttaggtatgttcacgttttctatcagtattttatatataatttatttattaataaatattttgattaatggtataaatatacctggttattttactacgattgctgctatattattgttgggtggtattcaattaatgtctattggcgtagtaggagaatatattggtcgtatttattatgaagttaaacatagaccgaagtatattgttgaaaactctaatattcagactgagaatctcgacatgagatataatgctttaaacctgaataaaaatagaaacaacaagcgtagtaatgatttatataaattaagttctttttataaagttaaaacatatagtgatacgtatgcatcaaattattctcaagatgaaggttttaaagagcgtgtacattaa

SEQ ID NO: 2651 - DNA, 261 bp, Staphylococcus epidermidis
gcagtactccatttaacacctttcgcacgatttgaagcacctacacctagaatagatgaagacacaacgtgtgtagtagataatgggaaatgtaatgatgacgctacgaaaatcgttaatgctgaagaaatatcagcggctgcaccgttagcaggtctaattttcataatatttccgccaacagttttgatgattttccaaccacctactgctgtacctaatcccatagctgttgcacacgcaactttaacccatacttga

SEQ ID NO: 2652 - DNA, 1128 bp, Staphylococcus epidermidis
caaattttacatagcgtgaggtacaacttattcaatgaaggtgaactgatgtatacactattacttatagcttttactatgatagtcagtttaataattacacccattattattgtaatatcaaaaaaattagatttagtagatcgtcctaatttcagaaaagtacatacgaaacctatctcagtgatgggaggaacggtcattttattttctttcttaatagggatttggctcggacaccctattgaacgtgaggttaaaccgcttatattaggtgcaattacaatgtatatggttggattgattgatgatatttacgatctaagaccttatttaaagttagcaggtcaaattgttgcagctttaattgttacgttttatggaattacaatagactttatttcattgccaattggtccaacgattcattttggcatattcagcattcctattacagtaatatggattgtagcaattaccaatgctattaatcttatcgacggacttgatggacttgcctcaggcgtctcagcattggcattaatgactattggattcatcgctattttacaagcgaacatatttattatcatgatttgctgtgtacttttagggtctttacttggtttcttattctataactttcacccagcgaaaattttcctaggtgatagtggtgcattaatgataggatttattatcggtttcttatccttactcggctttaagaatatcacatttattgcattattctttcctatagttatattagcggtgccatttattgatacattatttgcaatgattcgtcgaatgaaaaaagggcaacatataatgcaagcggacaagtcacatttacatcataaattacttgctttaggatatacgcatagacaaaccgttttacttatttattcaatagcgattatgtttagtttatctagtgttatcctctatttatcccaaccgttgggtgcacttatgatgttcattctcattgtctttacgattgagttgatcgttgaatttactggattaatagatgataattatcgaccaatattaaatttaattacaaaaaaaggaaatggtaagcaacatcattatgatgagcatcaccgttcataa

SEQ ID NO: 2653 - DNA, 207 bp, Staphylococcus epidermidis
tggataacacataagattccggttcttaaaatagaggttcgattcctctcgagggggttgctgaatgatgaggagattttaatgtctgagcttatttgtaatctcagtcttaaaatctcattttttataattcaatttgttcaccatttcttattttatccgctaattcattcaactttcttaaacggtgattcatacctgatttag

SEQ ID NO: 2654 - DNA, 852 bp, Staphylococcus epidermidis
ggagtaacacacatgaatataacattaggatatatcgatcctgttgcctttagcttgggaccaatccaagttcgatggtatggaattattattgcttgtggtatcttacttggatacttcattgcacaagcagcattgaaacaggttggattacataaagacaccttaatcgatattatattttatagcgcgattgttggattcatagttgcgagaatatactttgttacatttcaatggccatattacatgaatcacttgagtgagataccaaaaatttggcatggtggtattgccatacatggtggcttaattggtggacttatctctgggattattgtttgtaaaatcaaaaatctacatccgtttcaaataggagatattgtggcaccaagtattattttagctcaagggataggacgctggggaaactttatgaatcatgaagcgcatggaggtccagtatctagagcttttctagaacatttacatttgccagactttattattagaaatatgtatattgaaggccaatattaccacccgacgtttctatatgagtctatttgggatgtaataggttttgtcattttaattactttaaggaaacgtctaaaacttggagagacattctttggttatcttatttggtattctgtagggcgctttttcgttgaggcgatgagaaccgatagtttgatgcttacgagtcatatacgtgtcgcgcaacttgtttctgtcgtgcttattatgattagtgtgatattcgtaatttatagaagagttaaataccaaccaataaaatatgaaaattcaggaccattaacatggccgattaaaaaggctaagtga

SEQ ID NO: 2655 - DNA, 1056 bp, Staphylococcus epidermidis
ggagttgcacatatgaaaaaaacagtcttatttttattattgtctctagttttagttttaacggcttgtagtaatagttcgaataataattcaacttcgaaaaagaaaaatagtgattctaaagaaactgtaaccatcaaaaatagttttgaagcaagtggtaaagaaaataatggcagtgataagaaaaaaatctctaatactgtcgaagtaccaaagaatcctaaaaatgccgttgtattagattatggagcgcttgatgtgttgaaagaattaggtgtggctgataaagtaaaaggtttacctaaaggtgaaaataaccaatctttacctaaatttttagatgaatttaaagatgataagtatattaatactggaaatttaaaagaagtgaactttgataaagttgcatcagctaaaccagatgtgatttttatttcaggaagaacagctaatcagaaaaatttagatgaatttaaaaaagctgcaccaaaagctaaagttgtatatgtaggtacaagtgatgacaacttaattaaagatatgaaaaaaaatacagaaaatttagggaaaatctacgataaagaagataaagctaaaaaaattaataaagatttagatagaaaaatatctgatatgaaagataaaactaaagactttaataagaaagtaatgtatttattggttaacgaaggtgaactatcaacgtttggaccaggaggaagatttggtggtttagtgtttgatacattaggatttaaacctgcagacaaaaaggttagcaaaagcccgcatggtcaaaatataaataatgaatatattaacaagcagaatccagatgttattttagctatggatcgtggttcagttgtaggtggtaaagcaacaacaaatcaagttttaaaaaacaaagttataaaaaatgtaaaagcagtaaaaagtaatcatatttacgaattagatccaaaactatggtatttctcttcaggatcttcaacgacaactatcaaacaaattgatgaattaaatgaagtagtagagaaagttgaaaaataa

SEQ ID NO: 2656 - DNA, 726 bp, Staphylococcus epidermidis
gtaggacaacacctcagacttcttgggaaaattggacaatgtagcatgcgagatataacaatcatgcgaagatttgtagggggagaaatcatgttatcaatagaaaaattatatcaaattctatatcaaaatatgggccctcaatattggtggccagcagaaacgccaatagaaatgatgcttggggcaattctagtccaaaatactaattggaacaatgcagatatagcgttatcaagattaaaagaagaaacttcttttaatgcacagacgatattgaaaatgcctttagaatcgttgcagcaagtgatacgttcgagtggtttctataaaaataaagctaaggctatacaggcattgttactatggttaaatcaacatcattttgattatagtagtatagctaagttatacggtgatagcttaagaaaagaattactcaccatccgtggtataggtgaagagaccgccgatgtcttaatagtatatatttttaaaggtaaagaattcatacctgatagttatactagacgtatttttagaaaattgggatatcaacatacagaaagttatcataaattgaaacaggaattaacacttcctgaatcattttcaaatcaagatgcaaatgagtttcacgctttattagataattttgggaaaaattattttaatggtaaggggaaacaacgctatacctttttagatacctattttaaaaaataa

SEQ ID NO: 2657 - DNA, 681 bp, Staphylococcus epidermidis
ttcgttatgcaaatattattagtcgaagacgataatacgctttttcaagaattaaaaaaggaattagaacaatgggattttaatgtcgttggtgtcgaagattttagtcatgtgatggagacatttgaaacatttaatccagaaatagttattttggatgttcaattaccgaaatacgatgggttttattggtgtcgaaaaatgagacaacagtcgaacgttcctattttatttttatcatcaagagataatccaatggatcaagtgatgagtatggaacttggtgcagatgattatatgcaaaaaccattttatacaaacgtcttaattgctaagctacaagctatttatagacgcgtttatgaatttggagttgaagaaaagagaacgttaagttggcaagacgctactgtggatttatcaaaagatagtattcaaaaagatgataaaactatctttttgtctaaaacagagatgattattttagagatgttaatcaataaacgtaatcaaatcgtgacacgagacactctcattactgctttgtgggatgatgaagcttttgttagtgataatactttaacagttaatgttaatagattaagaaaaaaattatcagaaattgacatggatagtgcaattgaaaccaaagttggtaaaggatacttagctcatgaataa

SEQ ID NO: 2658 - DNA, 687 bp, Staphylococcus epidermidis; identical to SEQ ID NO: 1857

SEQ ID NO: 2659 - DNA, 531 bp, Staphylococcus epidermidis
caaaattttaaaatttatgttgaaaaaaattttaactcgggttactttctcagtggaggcgataatatgaaatataagattgaaaaattggatgacagtagcgtcgtttatatgagaatgataggtacttatcaaagtgataaaaactttgaaatgatgaagacttttaagcattggattcagactaatcattattggaaatatgttgagaaatacggtgtgttaggtatagcattagataatcctctccacgttcaaagtaatcaatgtagatatgacgttgttttgagaatagatgaaacagtaaatgatcagacaatatctaaaagagattttacaggtggcatatatgctgtgtttaaagttagtcatacaaaaataaatatagagaagttctttagcaatttagaaaatattttaaatgaaagtcatttgcgtatgagaaatgaaccaattatagagagatacattgaagaagagggaacagataaagtgtgtgaaatgttagtgcctatctatgaagtaaattaa

SEQ ID NO: 2660 - DNA, 264 bp, Staphylococcus epidermidis
gaggcatttaaaatgactgaagtagatgttgatgtagcaataatcggtgcaggtcctgccggtatgacagcagcagtatatgcatctcgtgccaatttaaaaactgtcatgattgaacgcggtatgccaggcggtcaaatggcaaacactgaagaagtagagaattttccaggatttgagatgatcacaggtcctgacttatctactaaaatgtttgaacatgctaaaaaatttggtggcggaataccaatatggcgatattaa

SEQ ID NO: 2661 - DNA, 492 bp, Staphylococcus epidermidis
tgtagatttaaaataatgatgactgctaatgattggatagaccggttggaattaatttcgcatcctgaaggcggatattttaaagaaacaatgagaggcgacggtaaaggaagagcgtcttttagcagtatttattttctattaacacagcgcgatatatcacattttcatagaatagatgcagatgaagtatggtattatcatgctggtcagacgttgaagattcatatgataacccctaaaggtgaatatcatactgttaaattaggtagagatatagattgtggtgagtgtttacaatattgtgtgccaaaagggacaatttttgcttctactttagatagtgcagagggatatagtctagttggatgtatgtgtcaacctggatttgaatacgagcattttgaacttttaacacaagaatatttgattcgtcaatatccacaatatgaaagcataataaaaagattagctatatctcaagaagattaa

SEQ ID NO: 2662 - DNA, 189 bp, Staphylococcus epidermidis
ttgaaacttttgtttgattcaatttcaaaattatcaattaatgagacagttggtgatggtgctgaaataaatgacgttgtaaataaacgtgatgaatataaagagagtatacggtattataataatcatttagttttagtgaagtataatgaaaaatctatatgtaagttaaaatatcttcgaaattag

SEQ ID NO: 2663 - DNA, 1296 bp, Staphylococcus epidermidis
agtaaaattaaatattacggtagactgatttctccaacgcatcaacttgaagatgaatcagtatctcaagtttcaaaaggtgttataaaagacagtgagcgttggtattgtattcaatgtggaaacacttccttgcaatattttgtgacttacaattcaacgatattggataaaacaatcacatactgtagacgatgcattcaattaggcagaatggatagtattacagatatatgtctcgtaaaaagttttcaaaaagcaacaaaagcgaattatcagttaccctttgaattatcaaagcaacagcaatacgcttcagaaactatcgttcaagctataaaaaataataatgacctcttgttatatgccgtcacaggagcagggaaaactgaaatgatgtttgagggaattaggatagctcgtcagatgggacataatattgctattgtatcacctcgtgtagacgttattattgagataagtcatcgaattaaagatgcttttatcgatgaacatatagatgtgctacatcaatctagtagacagcaatataatggtcattttgttattgctactatccatcaattattgaggtttaaacagcattttgatactgtatttctcgatgaggtagatgcttttccgttgtctatggatccacaattatcaaatgcaatacaacttgcttcaaaatcgaatcattcacatattttcatgacggccacaccaccgcgtcattttttaaaacaattccccccagaaaaaataattaagttaccagcccgttttcaccgatccccccttcctattcctaagttcaaatatttcaaattaaaatcaacacgaaaacaaaatttattacttaatatatttagatatcaaattaaccaacaacgttttactttggtctttattaataatatagaaattatgaataaaatgtatcaacagtataaaatggacatccctgatttgatttgcgttcacagtgaagatgatttacgatttgaaaaaattgaagctttaagacgaggacaacacaaaattgtattcactacaactattttagaaagaggatttacaatgacacacttagatgtcgttgtagttgatgctggaagttttcaacaagaggctttaattcaaattgctggtcgcgtaggacgtaaacagcagtctccaagtggcttagttttatttcttcatgaaggtgttacattatcgatgattttagctaaaagaaacattatttcaatgaatcgtttagcaattaaaaggggatggattgatgcgtaa

SEQ ID NO: 2664 - DNA, 453 bp, Staphylococcus epidermidis
attaaagttaatcttaccaataaaggaggattaactatggaattatatagtatgcctatgtttaataaatttttagttaacgacatagagaaatcatcggaatggtatcaagagaatttaggttttaaaagtatttttaaatttaaaaatgaacaaaatcaaattttaatggagcatttacgattagcaaaatatcaagatttgatgttaatttctggcaaacagtttgaagtcggtaatgcagtttatacaaatatacttgtaccaaatattcgaattttaaaacaacgaatatcttctcaatatatcgtggaagatcttgaaggaaaaccatggaattctattgaaatgacaattaaagatttagataatcatttaattacgcttacacaaagtaacataaaaaatgaagaatttaatgctttgatgcaacatacttcaaaaactttttaa

SEQ ID NO: 2665 - DNA, 1101 bp, Staphylococcus epidermidis
ctaatggttaataaaggagtcggtatggaaatgtttgaagctatcatatataacatatctgtcatggtggcaggtatatatttatttcataggttacaatattctgaaaataaaagaatgattttttctaaagaatatgtaacagtactaatgacattcgtttctttacttttagcggcataccctatcccatttcaaaacgaatacctcgtccatttaacatttgtacctcttttgtttttaggacgttataccaacatgatatatacactcacggctgcttttatcgtatctttagtcgatgtatttatctttggaaactcaattatttatggtattacattaatcgttattgcaggtattgtcagtgcagtgggaccattcttaaagcaaaacgatatcatttctttacttattttaaatttgattagcattatcattttgttatttttagcattattaagccctatttatgaactcgtagagattttagtgcttatccctatttcatttattattacaattgcttcagcaataacattcgttgatatatggcactttttctctttagtcaatcgttatgaaaatgaagataaatacgattatcttacaggtctaggtaatgtgaaagaatttgatagacacttaaatgaggtctcaagtaaagctgaagaaaagaaacaaagtttagccttacttctcattgatattgatggctttaaagatgtaaacgatcattattcacaccaatcaggagatgctgttctcaaacaaatgtctcaactattaaaaaactatgtcccaaaccagttcaaaatatttagaaacggtggcgaagaattttctgttgtaataagagattacacactagatcaaagcgtgaaattagcagaaaatattcgaagtggtgttgaaaaatcttctttccacctaccaaacaaagaagtaatcaagctatcagtttcaattggtgtaggatacttaactcaagaagatcgtaaatctcaacgtaaagtatttaaagatgctgatgacatggtacatgtggctaaaagtgaaggaagaaataaagtcatgtttaatcctattgtcaaattataa

SEQ ID NO: 2666 - DNA, 1242 bp, Staphylococcus epidermidis
ctgcaatctaaaaataggatagaggtcgagaagatgtttacagcattattgcaaataaagaattataaattgtttgtggtcaatatgttgttactaggtatgggaatagcagtgactgtaccttatttaattttatttgctacaaaagatttggggatgacgacaacacaatatggactgctacttgcacttgctgcgataagtcagtttatagtcaattccattattgcaagattttctgatacacatcatcttaatagaaagattctaatcatcactgctttgtttatgggggcagtgagcttctcaatttatttctacgttcatcaaatatggttattcatcgtgttatatgcgttgtttcaaggattatttgcaccagcaatgccacaattgtatgcctctgccagagaatcaatcaatgcttcaagttcacgtgatcgtgctaagtttgctaatactgttttacgttcaatgttttcacttggttttttatttgggccatttataggtgcacaacttattgagttaaaaggttattctggattatttggtggcacaatagctattattttatttactttaattttacaagtgtttttttataaaaatttaccggtaaaaaatcaaatttctgaacaacagcatattgagaaaatcgcaccaaatatgtttaaagataaatcattatttattccatttatagcgtttatattacttcatattgggcaatggatgtatacgatgaatatgccactttttgtgacagattatttaaatgaaaaggaaagatatgtaggctatttagcaagtttatgtgcaggtttagaagtgccgtttatggttatattaggtatattatcagctaaattgccaactcgaactttattgataattggttctgtatttggtggcgcattttactttagtattggtgtatttaaaaattttcatatgatgcttgttggacaaatatgtttagccatctttctagcaatattactaggtcttgggattagttattttcaagatattcttcctgattttccaggttatgcatcaacactttttgccaatgccatggtaataggacaacttggtggtaatttgctaggtggtgtgatgagtcattgggttggtttggaaaatgtattctttgtctcagcaagttctatcttcgtagggatgatactcatcttgtttacgaaagatcaaaaaattacaatagaagatgtggagtag

SEQ ID NO: 2667 - DNA, 1194 bp, Staphylococcus epidermidis
ataatggctaaaaaaatcgtttcagacttagatttaaaaggtaaagttgttcttgagcgcgctgattttaacgttccaattaaagatggtgaaatcactaatgacaacagaattgttcaagcattaccaacaatcgaatatattattgaacaaggtggtaaattagttttattctctcacttaggtaaagttaaagaagagagtgataaagaaggactttcacttaagcctgttgctgaaaacttatctaagaaattaggtaaagaagttatattcgttcctgaaacacgtggcgaaaaactcgaaacagcaattgaaaacttaaatgaaggcgatgttttattagttgaaaatacacgtttcgaagatttagatggtaaaaaagaatctaaaaatgatcctgaattaggtaaatattgggcgtcattaggtgatgtatttgttaatgatgcatttggtacagcgcaccgtgaacatgcgtcaaacgtaggtatttctactcatctagaaacagcagctggttacttaatggaaaaagaaattaaatttattggtggcgtagtgaatgatccacaaaaaccagtagttgctattttaggtggcgctaaagtttcagataaaattaatgttatcaaaaatttagttaatatcgcagataaaatcttaatcggtggcggtatggcttatacatttattaaagcgcaaggtaaggaaataggtctttcattattggaagaagacaaaattgattttgctaaagacttgttagagaataatggcgatcaaatagtattacctgtagattgtaaaatcgctaaagaattttctaatgatgcaaaaatcactgaagtatctatcaatgaaatcccttcagatcaagaagcaatggatattggacctaaaacagtagaattatttaataaagaattacaaggtgcacatactgtagtatggaatggacctatgggtgtattcgaatttagtaattttgctaaaggtacaatcggtgtatgtgagtctattgctaaattggaagacgctactactattattggtggtggtgactctgccgcagcagcaatttcattaggtttcgaagatgactttacacacatctctactggtggaggagcatcattagaatacttagaaggtaaagaattacctggtataaaagctattaatgataaataa

SEQ ID NO: 2668 - DNA, 528 bp, Staphylococcus epidermidis
gaggaacataaggagacatgcagaatgaagcatcaaaaaaatcagagcaggtttaaactactaatagctggcataatagcaggacttttatctggtgtagtcaaactaggttgggaggtaatgttcccaccccgaacacctagtagagatgccactaacccacctcaacaactcttacaattactaggaataccgtcaaatattacccatctcacatacaatttttctgagcatgcattaccttggataagttttatcgtacactatagtttttctatcgctattgcaataatctatatttatatcgcaaagaaatatacaaaaatcacactaggttatggtgctttatttggtatagttatttggattgtttttcatttaatcttaatgccaattatgcatgtcgtaccgaatgcttttgatcaaccattttcagaacacctatcagaattttttggacacattgtttggatgatggttatagaaatggtcagaaggtatttctataatattcaattaaataaataa

SEQ ID NO: 2669 - DNA, 843 bp, Staphylococcus epidermidis
tatgggcataaaagactgagggaaagaggtaaagatatggcaaattcttgtttgcatatactttcaaaaaaagaatatacggcaacacgatgtcaagacggcattttattattttggcctatcgaagggagtatgcactttcaacaatttatgaaagaaaggatactctcagatgagttatatattgtgaataatatggatgtgtttagtatcagtgacaatggcatcacactagaagtatatatttctagtgattggtttacagagttaggctattctttttttaattaccattatatttcggatttaatacaatctaagaaagaaattaaagaactagttgctcaacttacgttgaattttttagataatgatgtggataaagagcaagatattatcaataaaattgttcatattcttgctaatgaggctattattgacaaaaaaattgctgaagaccaatatatgtatgattattatggtgagttaaaggatgaattgaattatatatataatcacatcgaagaaagacttactctaaaagatatttccaataaattatatgtttctaagtccaacctttctacgcagtttcatttgttattaggtatgggatttaaaaaatatatagatacacttaaaattagtaaatctatagagatgctacttacgacaactaaaacgataagccaaattagtgaaacgttaggatttagtaatgtatctacatattctagacaattcaaaaattatttaagtgtaacgcccaatgcatatcgtgcaatgaaaaaatatgataagtacaatggatgttctgatgatgatgtttcagaacacttttaa

SEQ ID NO: 2670 - DNA, 228 bp, Staphylococcus epidermidis
gtatcaaataaacataatcatttattatttaataactttgtagtttatattattgacttattattttcaagttttttattatatggattatcatttccaattatacaaaaactacaaatccccatccgtgaaggtgcttttatgaatcacaatttcatttgtacaagaactactaactttcctttcaagaaggaagtagctctttataatatcttacatgacgtttaa

SEQ ID NO: 2671 - DNA, 1044 bp, Staphylococcus epidermidis
ctcatgaataattttcgatggttttggttttttataaaatctcgtattaattggatattgtggatattatttctcaacattattttattaggtgttgcctacatagattatgagatttcagttgaaagtgtattttatatagtgatattaaacgtaggattgagtatacttttcttattatttacgtttgttaaagaagtccgtctatctaaacatttttatgaagataaagaaattgaagaaattaagcataaagatttggcagaaaccccatttcaacaacaagtcatagattatctgtatcgtcatatagccgctcaaaaagagaaagtagtcgaacaacaattacaaattaaaaatcatgaacaaacaattacagagtttgttcatgatataaaaacacctgttacggctatgaaattattgatagatcaagagaatgatgatcagcgtaagcgagcgttattatttgaatggtctcgtattaatgagatgttagataagcaattatatttaacaaggcttgaaacacatcatcgtgatatgtattttgattatatttcattaaagagaatggttatagatgaaatacaagttactcgacatatcagtcaggcaaaagggataggttttgaattagattttaaagacgaacaaaaggtttatacagatgttaaatggtgccgtatgatgattaggcaagttctatctaactctttgaaatatagtgataattctacaataaatttaagtggttataacatagaaggacacgttgttttaaaaattaaagactacggtcgtggaattagtaaaagagatttaccacgtatatttgatagaggatttacttctacaacagaccgcaacgatactgcgtcttctggtatgggattataccttgtacaaagcgtgaaagaacaacttgggattgaagttaaagttgattcaatagtggggaaaggaacaacgttttatttcattttcccacaacaaaatgaaatcattgagcgcatgtctaaagtgacaagattgtcattttaa

SEQ ID NO: 2672 - DNA, 957 bp, Staphylococcus epidermidis
aatatttgtaatagtaaaggatatattaaaatgaaaaataataaaaatgaaaagttgaaaatcacaatcgttagcggtttcttaggcagtggtaaaactacgttcctgacacattatattaatgaattattaaaaattgatgagaaaataacagtaattatgaacgaatttggatcatttgatgtagatggtaaccatttgagtgaattagtcaaagtgtatccattgttgaacggttgtgtttgttgtgatatgaaatcagatttagttcaacaaattgagatgctcagtcacaaccatgaaacggaccatattataatagaagcaactggtatcgcgcatcctattgaattgattatggcgtgtcaagatcctcgcatagttcagtttgttgaacgtccccacgttgttagtattgttgatgcacttcgctttttacaaagacaacagtatactgactccacaaagcgtctcatggaagaacaactcgaggtaagcgatgtgctcgtcgttaataaattagatttaatatctgttgaagacagagatgctttaaagaaccaacttaacgaagtaaacaaatatagttcaaaaatatatactacttatggacaagttaatatcgaggagttgtcacaatttcgtgatcaattagtaatgacacacacacattctcatcaccatggtataaatagtatgcaatacacatttacaacagctattgaccgacaattattttaccaatttattttgcgtatgcctgataatgttttaagattaaagggatatgtacaatttaaagatgaacccaatgtgacatatgagtttcaatattcatttggtatgccggattatgaagttattaatggggattatccgttaacaatagtattgattggtgaacaacttgatgttaacagactaaaaaataaactcgatgttttgcaattctcataa

SEQ ID NO: 2673 - DNA, 639 bp, Staphylococcus epidermidis
ttttctagtaaaaagaagaaaaccgtgcctatcaaaattaataatccagtggtagttaacacgagtttagagtgtaaggataattttctaaaacttttggcgttccacaaatcaaccacgactaaatgtcccaaacctcccaaaatgataagtattggaatagtgataatgattaccggatcatttgaaaaatcgattaagttgtttttaaaaagggcgaatcctgcgttgttaaatgcggaaactgaagtgaataaacttaaaaatagacctttacctatgccaaattttggaataaacgataaacatagacaaagtgtaccaaataattcagtggcgatgctgtatatggctagatgtttaataagtttaattacaccaccgggttcgtcaatattccaagtaatcataaataaaattctattgttaattgatattttcttatttaaaaagatgagagttagcattgctacagtgacaatacctaatccaccaatttgtataagtaataagataatgatttctccaaaaatattaaattgtgttccaacatcaactggtgatagacctgttactgtgaatgcgctagaagctacaaacaatgcgtcaataaagttaatgggtttcttccctgtatag

SEQ ID NO: 2674 - DNA, 1062 bp, Staphylococcus epidermidis
ttgcctctcaagtacctttgttacaaagatataaggaggaaggtagtagtgaaagacttaattaaagttcaacaaaagcttatacctgatcttatagataagatgtatagacgcttttatattttatctactatctctcaaaatcaacctgtaggaagaagaagtctaagtgaacatatggatatgactgagagagttttacggtcggaaacagatatgttaaagaagcaagaattaattcgtgtcaaacctacgggaatggaaattactaatgaaggtactgaagtattagcacaactaggtgaatactttaatgtttatagcgatgaccataaattggccagtgctatcaaagataaatttcatattaaagatgtacatgtcattccaggagattccgattctaatcgaactgtaaaacgtgaaatgggtcaacaagctgggcaacttttagaaggtatactttatgaagatgctattgtctctgtaactggtggttcaacaatggcgtgcgtgagtgagtcgatacatttattaccgtttaacgtattctttgttccagctagaggtggacttggagaaaatgttgtttatcaagcgaatacaatcgcttcgagtatggcccaacaagctggtggctattatacaacactctatgttccagacaacgtgagtgagtccacatacgatacgttaatgttggaaccttctgtcatgcatacactagataaaatcaagcaagctaatataacaatacacggcattggtgatgcgctgaagatggcgcatcgacgtcaatcatctcaaaatgtgattgataaccttcaacatcatcaagccgttggagaagcttttggatattattttgatgctcagggtcaaatagttcataaggtcaaaacgattggccttcagctagaggatcttgagaacaaagactttatctttgcggttgctggtggacaatcaaaaggagaagctattaaagcttatctttcaattgcaccggaaaacactgtattgattacagatgaagccgcagcaaaagtcattttacaatag

SEQ ID NO: 2675 - DNA, 762 bp, Staphylococcus epidermidis
tcacaggtcctgacttatctactaaaatgtttgaacatgctaaaaaatttggtggcggaataccaatatggcgatattaaatctgttgaagataaaggcgactataaagttatcaatttagggaataaagagataacagcacatgcagttattatctcaactggagcagagtataaaaagattggcgttcctggtgaacaagaattaggaggacgtggagtaagttattgtgcggtttgtgatggagcattctttaaaaataaacgtcttttcgtaattggcggcggagattcagcggtagaagaaggtactttcttaactaaatttgcagataaagtaacgattgttcaccgtagagatgaattacgtgcacaaaacatcttgcaagaacgtgccttcaaaaatgataaagttgactttatttggagtcatacacttaaaacaattaatgaaaaagatggtaaagttggttcagttacacttgaatcaactaaagatggtgctgaacagacttatgatgccgacggtgtattcatttatattggaatgaaaccactcacagcaccatttaaaaatcttggtattacaaatgacgcgggatacattgtcacacaagatgacatgagtactaaagtacgaggtatttttgctgcaggtgacgttcgtgataaagggttacgtcaaattgttactgctacaggagacggtagtattgcggctcaaagtgcagctgattatattacagaattaaaagataattaa

SEQ ID NO: 2676 - DNA, 1047 bp, Staphylococcus epidermidis
tactttttaaatatcattttaaaggaggccattataatggcaattaaagtagcaattaatggttttggtagaattggtcgtttagcattcagaagaattcaagatgtagaaggtcttgaagtagttgcagttaacgacttaacagatgacgatatgttagctcatttattaaaatacgatactatgcaaggtcgtttcactggagaagttgaagttatcgaaggtggattccgtgtgaacggtaaagaaattaaatcattcgatgaaccagatgctggtaaattaccatggggcgatttagatatcgacgtagtattagaatgtactggtttctatactgataaagaaaaagcacaagctcacatcgatgcaggtgctaaaaaagtattaatctcagctccagctaaaggtgatgtaaaaacaatcgtattcaacactaaccatgatacattagatggttcagaaacagttgtttcaggtgcttcttgtactactaactcattagcaccagttgcaaaagttttaagtgacgaattcggtttagttgaaggtttcatgactacaattcacgcttacactggtgaccaaaatacacaagacgcacctcacagaaaaggtgacaaacgtcgtgcacgtgcagcagctgaaaatattatccctaactcaacaggtgctgctaaagctatcggtaaagttattccagaaatcgatggtaaattagacggtggagcacaacgtgttccagttgctactggttctttaactgaattaactgtagtattagacaaacaagatgtaactgttgaccaagttaacagtgctatgaaacaagcttctgacgaatcattcggttacactgaagacgaaatcgtatcttctgatattgttggtatgacttacggttcattatttgatgcgactcaaactcgtgttatgactgttggagatcgtcaattagttaaagttgcagcttggtacgacaatgaaatgtcttacactgctcaattagtacgtacattagctcacttagctgaactttctaaataa

SEQ ID NO: 2677 - DNA, 258 bp, Staphylococcus epidermidis
ctttggttaaaaagtacaagtaaggtgatgaatatgaaagactggacaattaacaatcattccaaacgacaattgattattcaaagtaatcatgatgatatttcgattatagaaccattgcgaaatggttcttttaaaatacttgctgaatttaatgcgttaaatacagattacattcaagtttatgaccacacacttgttgtttctatacatgagaaagagattagtgtgttagatcgatcttcacagtcaatttaa

SEQ ID NO: 2678 - DNA, 507 bp, Staphylococcus epidermidis
gatagaataaatcttaagagaaatgtgggtaaggagatgaaattgaaaaacttatttttaagttctgttgcagttattttatcaatttgtttagtacttttattatttttagctacaaaccaaaatgcattagcgaaagtccataaaacaatttgtacttttactaaagtgaaaacagtatctcataacgatatattccctaacttaaatatgaatcatgttgctgaagcttcagaaaaaaactctgatcaccaaaagaatgttaataaaacaaatcaacaaagtgtaagaacgcaagcatcttatgatttcaacccacaggaatgtaaagtaattgctttgaattacgctgagaatcatttaagcaaaaaatataatatagagcgtactttcaacgagtcgcttcattcagtatatgtattttctagtgaaaataaacttcatcaaactaaggttaaagtcaataaaagtgggactgtacatgcatcaaacatcaataatcattaa

SEQ ID NO: 2679 - DNA, 261 bp, Staphylococcus epidermidis
tttatagtaaagggatgtgatgttgtgatgaataaaaatctattaaaaaaatacttgaatgatgatagtttcaaatcagttgtcgttgttatagggaataagagaatcgtattagagaatgatattcatgttgattatgaaaacgaagttattatttatccatgtaaaaattgtacacgtattataccgtttagttcaatttcctatttagaacttattgataagcaagaccaatttattaactattttaaagaaggatga

SEQ ID NO: 2680 - DNA, 225 bp, Staphylococcus epidermidis
tttctttcaaaacttcttggaaagcttgcttatcaccatagacttttgacaactgtcttacctctaatatcgacaaataatcactcctgtcatacttcaaccaaattatctttttacgaagacaaacttaatgtagactatcatatcttctttaatttacatcttttattatatcgattatttattacaattgtgataatagtaagtaacaaaacgcacgtttaa

SEQ ID NO: 2681 - DNA, 444 bp, Staphylococcus epidermidis
gtaactacaaaggagtctatcatgagaaaatggttaaccttactattaattacaacattggtgttaactgcatgtggtaaaagtaacgaaaaagcttctttagaaaaaagcattgatcagttgaaaaaagaaaataaggatttaaaaaaacagaagaaaaagttacaagagcaaaaggataagcttaaacacaaacaggatagtctccaagaagatgtaaatgacttgcctgctaaaagcacatcccgagataagaaaaataaagataatcatgatgcaaaagaaaagtcttcagataatcaatcgacatctgctaatcatgatgatcaaactaacaaaataaaaagcaatcaagatgaacatgacagtcaatcctctaaaccacatacacagcagaagccctcacagaatgatagaaaaaataatcatcgacaagaacgatag

SEQ ID NO: 2682 - DNA, 759 bp, Staphylococcus epidermidis
aaatatcaaaaatatcttaaaatacttaataaagtagtaccattaaatgacgacgaaacctttaaattaggaatcgtattgagttatttaaaacagtatcgtgcttctcaaaatttactttatccactttataaaaaaggtaaatttgtctctattcaaatgtataatgcattgagtttcaatttttattacctaggaaataaagacgaaagtattgagatgtggaacaagctcactcaaatttctgaagttgatgttggttatgcaccttgggtaattgaggaaagtaaaacggtatttgaatcacgagtgttaccattattactagatgataataatcattatcgactttacggtatttttttacttcatcaattaaatggaaaagaaatactaatgactgaagatatttggtcaattcttgaatcaatgaatgactatgagaaactttatctcacatatttggtacaaggactcacactcaataaattagattttatacacagaggtatgcaaaggttgtataattttaagaaattcaaatataacacgtctttatttacagattggattaatcaagcagaaatgattatagctgaaaatgtagatttagtagatgtcgatagatatgtagctgcatttgtttacctatcgtatcgtcgttctagccaaccacttaccaagaggcaattgatggacgattttaatgtttctagatacaaactgaataaagcaattgaatttatattgagcatataa

SEQ ID NO: 2683 - DNA, 681 bp, Staphylococcus epidermidis
atggcacaaaaagaaaataacatcattccaatgatttttgatgaggctttttatcgtaaaatggctacccaaaagtggcgacaacaggactacaagaaggcggcagaatattatgaaaaagtgcttgagttgtcacctaaggattttgatattcaacaacactatgctcaatgtttagttaaattaaatatcggcaaaaaagcagaacgtctattttatgagaatattgttaaagactttcatgtagcagaaagtttctatgaactaagtcaattaaatatagaattaaacgagccaaacaaggcattcttgtttggtattaattatgtaatattgtcagaggataaagattttagagaaatgcttgaaaaaacattcgaagtcacgtatacaaatgaacaaaaaattgaattagaagcacaattgttttcaacacaacttttatttcaatttctcttttcgcaaggtaggttagaagaagcccgaacatatattttgaatcaatcttacgagatacaacagcatagggtgattaggaatttacttgcaatgtgttatttgtatctaggtgagtatgatagcgccaaagcaatgtttgaagaacttttaaaggaagataattcagacgtgcatgcactttgtcactacacattattactttataataaaaaagaagcataa

SEQ ID NO: 2684 - DNA, 390 bp, Staphylococcus epidermidis
atgattaaaaagacataccaaaagggcgttaaaatcatcgttgatatgagagataggataataataattgtacctgttgtcattggtcttttaattttacgaaatagtgaaagacgttcaacttcgtctattttgaaagtacctacaaaaagtaaaatcgcccctattataaatatcgtgggtgataaatatgggatggacatgtacaccgattgtgtgctcgatttatctgtaataaattgcaataagcttataacaatggctagtattatagcaataaacttttggtcagaaattacaaaaggatatagcttgaaatttaaatatatttgtaaaagtgtccatatcataaatagcgtgacggtaaacatcgtaataaaattgaattga

SEQ ID NO: 2685 - DNA, 243 bp, Staphylococcus epidermidis
aatcataaaaagacatttgatttcagccccttttttaaagtgttaaaaacacttgagtcacctacttatatactttcacctattaatcataccagattgctcgagtttttatgtgcaaaaaattcttttttgcactatatacataaactttttttgctaataatgataattttcatttatttttgttcttgtgatgaaattacagttgttagaggtttaaaaataactataacattaaattga

SEQ ID NO: 2686 - DNA, 1197 bp, Staphylococcus epidermidis
ttcaaagaaaagaagggttcaatcatgtcagaatatgttttaacgaatggcatcgtatatacagaaaatgaaatgattaacaatggatatgttcatattaaagatgggaaaattttagacgttggtaagtgtccttttcatccgtcatcgtcgcataatacaattgacattattgatgtaaaaaaacgacatatactgccaggatttatagatattcacatccatggggggtatggtgaagatgccatggatgcatctgaacaaggcttacaacatttagcagaatcactcctttctgaggggacaacatcttttttagcaacaacaatgacacagtcaacagtcaatattgagcgagcacttcaaactattgctaaatatactcaacaacaagatgttacaaatgctgccgaaattgtgggagtacatcttgaaggtccatttatttcagaacataaagtaggcgcacaacatcctcaattcgtacaacgtcctacggttgataaaataaagtcgtttcaggaagtagcgaatggactaattaagattattacgtacgctcctgaagttgatggagcaacagaaacgttaaagacaatgaaaaatgatatcattttttcaatcggacatacggtggcaacgtttgatcaagcgaatacagctgtgagtcatggtgccaaacacatcactcatttgtataatgcagcgaccggctttcaacatagagaaccgggtgtatttggtgcagcctggttaaatcaagggttgcatactgaaatgattgtggatggtgttcattcacatcctgcatccatcgcacttgcatatagacttaaggggaatcaaagctgttatttaattacagatgcgatgagagctaaaggaatgccagaaggacattatgatttaggtggtcaggatgtgattgtaaagggaagtgaagcacgcctgtcttctggggctttagctggaagtatactcaaaatgaacgaaggacttaaaaatttaatacaatttacaggtgacacgattgagcatttatggagagtaacaagtttaaatcaagcgataacattaggcatagacgacataaaaggtagtattaaaatcgggaaagatgcagatattgttatcatagatgatgcatgtaatgttgaaacgacgattaaaaatggaaaatatcatgctttcaaatga

SEQ ID NO: 2687 - DNA, 558 bp, Staphylococcus epidermidis
agggagcgaaatacattggaattacaagaagctatatctaatcgtagaagcgtcaaaaaatttaaacacgatatggtggttgatgatcaaacggtttacgatgcaatatataaagctactgacgctccaaatcatggtatgagagaaccatggagattggttcatatttcaaaagataaactcggtgattttagtagggatatcacaagatttgcttttccagatagtccggataagcgagaggatcactttcatgcagtaacaaatttaggtggcatgttgttgttgattttaaaagatgatccaagacaacgtcaaagtcgtgaaaattattttgcatttggagcttttgctcaaaatttaatgttacttttatacgaagcgggtattggtacttgttggaagtcgccacaatatatctttgatcctaaaatacgaaaagctttgggtgtaaaggataatgaaatattagcaggatttttgtatcttactgatttagaagaagtaccaacgaaggctaaacgtaaaaataaaaatcttattaccgaatttgaataa

SEQ ID NO: 2688 - DNA, 975 bp, Staphylococcus epidermidis
aaggtaggaaaaattatgcaaatgagcgctaataaaaaaataagtatactggtcgttatggcaatttgtatggcaattttttatttattggtaggtttagattttgatatatttgaatatcaattccaaagccgtttcaaaaaatttattcttatattattagtaggagcatcgataggaacgtccgtagttattttccaatctattactacaaatagattattaactccttctattatgggacttgattctgtgtatttatttgtcaaagtcttacctatttttattttaggtgaacaagcaactgttgttacaaatatctaccttaattttttaatcactttgatcgcaatggtgtttttttcattgctattatttcaagttatatttaaactaggtcacttttcagtctatttcatattactagttggtgtaatattaggaactttcttccgtagtattacaagttttctccaacttataatgaatcctgaatcttttttagcagttcaaaatgttatgtttgctagctttgaagcatcaaattctaaattagtaactgtttcaggcatattattagttatattaataattgttacaataatacttcgaccatatttagatgttcttttgttaggtagagcacaagcaattaatctaggtgtttcttatgagaatatgacgcgtatgtttcttattttggttgctttactcgtctctatatctactgcattaataggtcctgtaacatttcttggcttattaactgtcaacttagcacacgaatttatgaagacctatgaacacaaatttattttaccggcaacaatattattcagctggattagtttatttatagcgcaatgggtagttgaaaatctattcgaagcaacaactgaattcagtttgatagtagatttagttggtggaagttacttcatatatttgcttgtcaaaaggagaaatgcaaattga

SEQ ID NO: 2689 - DNA, 600 bp, Staphylococcus epidermidis
acagaaggaaaaaattttgctatactaaacacgtatatcacgaacagggagtgtaagagcatgacgcgacagagaatcgccattgatatggatgaagtgcttgctgatacattgggtgctgttgttaaagcggtcaatgaacgagcggatttaaatatcaaaatggaatcattaaacggtaaaaaattaaaacatatgatacccgagcatgaggggttagtcatggatattttaaaagaacctggattctttagaaatttagatgtaatgccgcatgctcaagaagttgtaaaacaactcaatgagcattacgacatatacatagccacagcagcgatggatgttccaacctcttttcatgacaaatatgaatggttattagaatactttccttttttagatccgcaacattttgtattttgtggtagaaagaatattattcttgcagattatcttattgatgataatccaaagcaattggaaatttttgaagggaaatcaattatgtttactgcttctcataatgttaatgaacatagatttgaacgcgtaagtggttggagagatgtaaagaattattttaattcaattgaaaaatag

SEQ ID NO: 2690 - DNA, 516 bp, Staphylococcus epidermidis
gtgcttatgaagaaactaataacatcattacttgttttaggattagttttaactggagtaagcgttggaaacaacgttgaagcggcaactggtaattcaatgaaaacagtacaacaattaaacaaaggtgataaatcattagaaaacgttaagataggcgaatcaatgaagagtgtattaaaaaagtatagtcatcctatctattcttataacccaaatagtaatgaaaagtattacgaatttagaactgataaaggtgttttgctagtaacagctaatggtaaaaaagaaagaggaaatgttacacgcgtatcaatgacatataatgatgcaaacggcccttcatacaaagccgtaaaacaacaacttggtcataaagctataagtcgtgtacattataataatgttacaggtaactttggctatattcaaaaagatcaagcaagttatcaattcagttcaaattcaccaaaggataaaaatgtgaagttatatcgtatagatttaaataaataa

SEQ ID NO: 2691 - DNA, 1245 bp, Staphylococcus epidermidis
actcgtatgaagaaacaaattatcgaaagattaacgagatatgtaaaaattgatacacaatctaatcctgattccaagacgacaccatctacgaataaacagtgggatttattaaatctattagaagaagagcttcaatcattaggtcttaaaacagacatggatgaacatggttacttatttgctacactcgaaagcaatattaattataatgtacctactgtcggttttttagcacatgtagacacttcaccagatttcaatgcttctcatgtaaatccgcaaatcattgaagcctataatgggcaacctatcaaacttggtgaatctcagcgtatcttagatcctgatgtttttcctgaattaaataaagttgtgggtcatacactaatggtgacagatggtacatctctactaggcgccgatgataaagcaggtgttgtagaaataatggaagggataaagtatttaattgatcatcctgacattaaacacggtacaattcgagttggctttacacccgatgaagaaattggacgaggcccgcatcaatttgatgttagtcgatttaatgcagattttgcatatacaatggatggcagtcaattaggagaactacaattcgaaagtttcaatgcggcagaggtaactgtcacttgccatggtgttaacgttcatccaggttcagctaaaaatgccatggttaatgcaattagtttaggtcaacagtttaatagtttacttcccttacatgaagttcctgaaagaactgaaggatacgaagggttctatcatttaatgaattttacaggtaatgttgaaaaagcaactctacaatatattattcgcgaccatgacaaagaacagtttgagctacgtaaaaaacgcatgatggaaattcgtgatgatattaatgttcattataatcattttccaattaaagtagatgtgcatgaccaatattttaacatggcagaaaaaattgaacctttgaaacacatcattgatatacctaaacgtgtctttgaggctttagacatcgtacctaacactgaacctattcgaggtggtacagatggatcacaattatcttttatggggttacctacacctaatatttttactggttgtggcaatttccacggtccttttgaatacgcttctatcgatgtaatggaaaaggctgttcatgttgtcgttggtattgctcaagaagtagcaaacagccatcaatcttataaataa

SEQ ID NO: 2692 - DNA, 330 bp, Staphylococcus epidermidis
atagtgatgaaaaatattcatcaaaccgaagaatttaattctactattggtagtactgatccagtaattatcaagtttgaagccgactggtgtccagattgtaaagcgatggatatgtggatagatccaattgttgaaaaatataataattatcaatggtatgtggtcgatcgtgacgaattagaagatgtgacaactgaaaatgatgttatgggtatcccaagtattttaatattccaaaatggtaaaaaattagcacacttgcattcagcaaatgctaaatcacctgaacaagttgaatcattcttgactgaacatttagatcaataa

SEQ ID NO: 2693 - DNA, 1515 bp, Staphylococcus epidermidis
aaggtgatgaagatgatgagtaatttaataatattgcctatgttgttgccttttgtatgtgctttaattttagtcttcactaaaaataaaaatcgtatttcgaaaatcctatccattacaactatgattgttaatacaatgatttcaattgctttacttatttatgtcgttaatcataaaccgataacacttgattttgggggatggaaagcacctttcggcattcaatttctaggtgattcactgagtctgcttatggtgtcagtatcatcttttgttgttacgctaataatggcatacggctttggtagaggggagaagcgagtcaatcgatttcaccttcctacatttattcttttattaacagtaggtgttattggttcgtttttaacttctgatttatttaacctatacgtgatgtttgaaattatgcttcttgcttcgtttgtacttgttacattaggacaatctgttgaacaattacgtgcagcgatagtatatgttgttctgaatattttaggttcgtggttgcttttattaggaattggcatgttatataagacagtcggaacacttaatttctcacatttagcgatgcgattgaatcatatggaaaataaccaaacaataacgatgatatctttagtatttctagttgcttttagttcaaaggcagcactagtgattttcatgtggttacctaaagcatatgcagtgcttaatacggaacttgccgcgttatttgcagcattgatgacaaaagttggagcttatgcgcttattcgtttttttactttactattcgaccatcatccaagcgtcacgcatacattgctcgtgtttatggcttgtatcacaatgattatcggtgcatttggtgtcatcgcttacaaagatattaagaaaattgcggcttatcaagttattttgtctattggattcattattttaggtttaggttctcatactatatcaggtgtaaatggtgctatcttctatttagcgaatgatattatcgttaagacattattgttttttgtaattggtagtcttgtttatatgtcaggctatcgaaattatcagtatttaagtggactggcaaaaagagaaccattctttggtgttgcatttgtcgtggtaatttttgctataggtggcgtacctccttttagtggctttccgggtaaagtcttaatattccaaggggctattacaaatggtaattatattggtttagcacttatgattgtgacaagtttaattgctatgtatagtctttttagagtgatgtttataatgtattttggtgatgctgacggagaacaagtacaatttagaccactacctatttatcgtaaaggtttacttagtgttttagttgtagtggtattagcgatgggtattgcagcccctgttgttctgaaagtaacagaggatgcaacaaatcttaatatgaaagaagatgtctttcaaaagaatgtaaatacacatttgaaggaggttaatcataagtga

SEQ ID NO: 2694 - DNA, 1968 bp, Staphylococcus epidermidis
tggggagtgaaaaagatgagaattactgaactgttaactaaagaaacaatagcgatggatttagatgcttctgataaaagtggggtgattactgagcttgttaatcaattggataaagcaggtaagttaagtgaccctgtatcgtttaaagaggcaattcataatcgtgaatctcagagcacaacaggaattggtggaggtattgctataccacatgctaaagttgcagcagttaaaacacctgcaattgcattcggtaaatctaaagaaggtgtggattatcaaagtttagacatgcaacctgcacacttattctttatgattgcagcgcctgaaggtggagcacaaacgcatttagatgcgcttgcgaaactttctggaatattaatggatgagaaaatacgtgaaaaattaattcatgctgaatctcctgaagaagtgttaaacattatcgatgaagcggatgatgaggcaacaaaagaagaagaagcagaagcgaacgaaaatgcaactgtttcaactgacaactcaaatcaagataataatgagccatatgttttagctgttacagcatgcccaactgggattgcccacacatatatggcacgtgatgctttgaaaaagcaagctgagaagatgaacatcaaaattaaagttgaaacaaatggttctagtggtattaaaaaccatttaactgaacaagatatagaacgtgcaactggaataattgttgcagcagatgtccatgtagaaactgatcgttttgatgggaaaaatgtggttgaggttcctgttgctgatggtattaagcgtcccgaggaactaattaatacagctttagatacaaatcgtaaaccatttgtagcgcaaggtggatctaaaaaacatgacgataatgaagaaaagttaagcccaggaaaagcattctataaacacttaatgaatggtgtttctaatatgttaccacttgttatttcgggtggtatcttaatggcaattgtattcttattcggcgcaaactcatttaagcctgatagttcagaatataatgcatttgctgaacaattatggaatattggtaaaaatagtgcctttgctttaattattccaattttagctggtttcattgcacgtagtattgcagataaaccaggttttgcagctggtttagttggtggtatgttagctatttctggaggttctggctttattggtggaattattgctggtttcttagcaggttatttaactcaaggaattaaatatattacacgtaaattgccacaagcaattgaaggcttgaaacctactttaatctatccattactttcagtttcaattactggattgttaatggtgtatgtctttaatccgccagcagcttggttaaatcatttgctactaaatggtttaaatagtctgtcaggctctaatattatgttacttggtcttgtgattggagctatgatggcaattgacatgggcggtccatttaataaagcagcttatgtatttgctactgctgcattaacggaaggaaatgcagctcctattactgcagcgatgattggtggtatgattcctccattagctatcgctacagcaatgttaatctttagaagaaaattcactaaagagcaaagaggctcaattgtaccaaactatgtcatgggattatcatttattactgaaggtgccatcccattcgcagctgccgatccattacgtgtgattccttcaatgatggttggctcaggtgtggctggagcaattgctttaggtttaggatcaagtatcaaagcacctcatggtggaattttcgtcattattggtactgattttaaccatatacttcaaactcttattgctttagttgtgggtacgttagtttcagctttaatttatggtttcttgaaaccaaaagtaacagaaaatgaaattcaagcatctcaagctatggatgaatag

SEQ ID NO: 2695 - DNA, 789 bp, Staphylococcus epidermidis
atatttaagaacatttattgtttatataaaaaaggagttactatgagagacaaagacaatcaacattcgagattatattatattattttgacaatcgttattatcgcaatttgcgttgttgttgtaatactttttaatactttaaagacaaaccgttctcattctaccgatagatacgcagattttactgaattaaaaaaagatacgataaaaaataaagattggcgtattaaaacaaaacaccgtaaaaataaggatattttagtcactgcaattcacggtggaggtatcgaaccaggtacgactgaaattgcacgacgtatttccaatgttggaaaatataatttttatacctttgaaggtcttcgaaagtctaataacgatcaactacatgtaacatccactcattttaacgaacctatattagataagttacttaaaaacactaaagaaacattatctatacatggattctctggagatgaccctattgtttatatcggaggtaaagataaagagatgtctcactctatcacgaaagaattacgtaaaaaagactttactgtaaaagaaagtcctaacaaaatcgatgcaaagtcatcagataacatagctaataaaaatgaatctaactcaggtgtccaattagaactcacgactgcattgcgaaaacagtttttcaaacattataaattagatcgacatacacgtagtgattcagataaatatactaaagatttttacaaatttgcgaacgcagtgcaaaaaggtatcgaaaaggtaaattaa

SEQ ID NO: 2696 - DNA, 978 bp, Staphylococcus epidermidis
tttttaaagaaaaaattaaacaagggggcattgcttatggtcaatagaagaaagatatcaattattggcgcgggacatacaggtgggactctagcattcattcttgcacaaaaggaattaggagatattgtgttgattgaacgccagcaatcagagggtatggctaaaggaaaggcgttagatattttagaaagcggacccatttgggggtttgacacatctgtacatggttcagtaaatatagaagatattaaagattcagacatagtggtgatgactgcaggtatacctaggaaatcaggaatgacaagagaagaattagttcaaactaatgaacaaatagtacgagaaactgcattacaaattgcaacgtatgcacctcattcaataattattgtattgactaatccggttgatgttatgacatatactgcatttaaagcatcaggttttcctaaagaacgtattattggtcaatctggaattttagacgctgcaagatatcgaacttttattgctcaagaacttaacgtgtctgtcaaagatgtaaatgggtttgttttaggtggacatggtgatacgatgttacctttgattaataacacacacattaatgggattccagttaagcatcttatttctgaagaaaagattgatcaaattgttgaacgtacacgtaagggtggtgcagaaattgttgcattactaggtcaaggctcagcatattatgcaccagcaactgctatatatgaaactatagatgcaatttttaatgatcggaaacggttattaccaagtattgcttatctagagggagaatacggttgttcagatatttgtttcggagttcctactataataggatatcaaggaatagaaaagattatagaggtagatatgaataatgatgagtatcaacaactacaacactctgcgcaagctgtgagtgaagtcaaaaactcactaaaattcaaataa

SEQ ID NO: 2697 - DNA, 852 bp, Staphylococcus epidermidis
attcagtttgatagtagatttagttggtggaagttacttcatatatttgcttgtcaaaaggagaaatgcaaattgattcaaattcgaaatttagataaaacgatagacaataaacctattttaaaagatattagcgtagatattaaaaagggaaaattgacttcactcataggtcctaacggtgctggtaagagtacattattatctgctatcagtcgcttatttagttatgagaacggttcaattttgattgaagacaaagaaatttcagaatataaaactgacgatttagctaaaaaattaagtattttaaaacaatctaatcacactgatatgaacataactatcgagcaactagttaaatttggtcgttttccatattcaaaaggtcgaatgaagcaagaagactatgacaaagtggaatatgctcttgacttattacagcttaatgaaattaaacatcgtaatattaaaacactatctggaggtcagcgacaacgtgcatatattgctatgactatagcacaagatactgattatatattattagacgagcctttaaataatttagatatgaaacattcagtacagattatgcaaacgttacgagatttatgtcgtcagttaaataaaacaatcattatcgtattacatgatatcaactttgcttcttgttattcagacgacatcattgcgcttaaacaaggtgagctagttaaagctgatgataaagataatgttattcagtctgacattttaaaaagtttatatgaaatggaagtacgtatagaggagataaggggacaacgtatttgtctatattatgatgaaactacttttgactcagtttaa

SEQ ID NO: 2698 - DNA, 186 bp, Staphylococcus epidermidis
acctgctctgatttttttgatgcttcattctgcatgtctccttatgttcctcctatatatttaaacaccattagcgttgttaaaaagagaaactttaatataattcaacctaattatattacttttatgttctttaaatgtttaaataatatgagctttaatttacaggatatgttagttttatga

SEQ ID NO: 2699 - DNA, 1272 bp, Staphylococcus epidermidis
tcaatgcatgaaagtataaaaatacatataggtaggtgccaaatgtttttattagttaatatcattggattatttattttcctaggtataggagttattttctctagaaataggaagaatatacaatggaaatctatttttattttggttattttgaatttgtttttagcttggttctttatatattttccatggggaagagcaggggttaaaggagcagctaacggtatagcatgggttatagaatccgcacatgagggtaccggatttgcatttaaaagcttcacgtctaataaaatgatggacatggcggtaagcgcgctcttccctattttattagttgtaccattatttgacattcttatgtactttaatatacttccaaaaatcattggcggtattggttgggtacttgctaaagttacacgccaacctaagtttgaatcattttttggtgttgaaatgatgttcttaggtaatactgaagctcttgcagtttctagtgaacaacttaaacgaatgaatgaaatgcgggtactaactattgcgatgatgtctatgagttcagtttcaggagcaattgtgggcgcttatgtgcaaatgatacctggagaacttgtattgacggcaattccacttaatattattaacgcaattatagtttcttgtattttgaatcctgtatcagttgaagaacaagaagatgtcgtgtatagcattaaagatcaccaaactgaaagacaaccatttttctcatttcttggagattcagttttagcagctggaaagcttgtattaattatcattgcatttgtcattagctttgtagctttggctgacttaattgatagattgattcatttaatcacacatcttattgcaaatggtattggtgtcaaaggtagctttggtcttgatcaaatcttaggcgttttcatgtatccatttgctttactattaggtttaccgtttaatgaagcgtgggaagtagcacaacaaatggcgaagaaaattgtaacaaacgaatttgttgtgatgggggaaatttctaatcaagtcaatgcgatgacgcctcatcatagagcagttatatcaacatttttagtttcttttgcaaacttttcaactattggaatgattataggtacattgaaaggtattgttgataagaaaacgtcggatttcgtttccaaatatgtaccgatgatgttgttagcaggaattttagtatccttacttactgctgcatttgttggattatttgcttggtaa

SEQ ID NO: 2700 - DNA, 1980 bp, Staphylococcus epidermidis
cgtaaaaatgattcattactaaaaacggaggaaacaaacatgagtttacccaagaagaaaataggaatttttgcgttcttcttattaacggtattcaccattactttgaagacatatttttcatattatgttgacttttctttaggtgtcaagggtttagtacaaaacttaatattgcttatgaatccctatagtttgattgcacttgtactaagtgttttcctattttttaaaggtaagaaggcattttggttcatctttattggaggatttttacttacgtttctactatacgcaaacgttgtgtacttcagatttttctcagatttcttaacttttagtacactaaaccaggcaggcaacgttgaatcaatgggtggtgcagtaagtgcttctttcaaatggtatgactttgtctacttcattgacactattatctatcttgctattttaatatttaaacgcaaatggttagataatagagcattcagtaaaaaattcgtacccgttgtgatggctacatcagtagcattatttttcttaaatttagcgtttgcagaaacagatcgtcccgaattattaacaagaacttttgaccataaatatcttgtgaaatacttaggaccatataacttcactgtttatgatggtgtaaaaacaatcgaaaataatcagcaaaaagcactagcttctgaagacgacttaactaaagtgctgaattacactaagcagaaacgtactgaacctaatcctgaatattatggtgcagcgaaaaagaaaaatataattaaaattcaccttgaaagtttccagactttcttaatcaataaaaaggtaaatggtaaagaggttacaccgtttttaaataaattatctagtggtaaccaagattttacgtatttcccaaactttttccatcaaacagggcaaggtaaaacatctgactcagagtttacaatggacaacagtttatatggcttgccgcaaggctcagcctattcactgaagggagataatacgtatcaatcattaccagctatactagaccaaaagcaaggttatacatctaatgtaatgcatggtgactacaaaacattttggaatcgagatcaagtttataaacatttcggtattgacaatttctatgatgctacttactatgacatgtctgacgacaatattgttaatcttggtttaaaagataaaccattctttaaagcatcagcagattatcaatctaaaatgaaaaagccgttttattcacacttaattactttaactaaccactatcctttcacattagatgaagaggatgcttctattgataaacctaataccggtgactcaacagtagacggttatatacaaacggcacactatctcgaccaagctttagaggaatatattactgaccttaagaaaaaaggtctatatgataactcagtcattatgatttacggtgaccattatggtatttctgaaaatcataataatgctatggaaaaattattaggtgagaagattacaccagctaaatttacagatttaaaccgcactggcttctggttaaaagttccaggtaaatcagggggcgtaaataaagagtatgctgggcaaatggatgttatgcctacattactacatcttgttggtattgatagcaagaattacctaatgtttggttctgacatgttctctaaacaacacaataacgtagtaccgtttagaaatggtgattttatcactgaagattataagtatgtgaatggtaaaatttactcaaataaagataatgaattgcttactgaaaaacctaaagacttcgataaaaataaaaaacaagtagagaaagatcttgaaatgagtgacagcgtgttaaatggtgacttgttcagattctacaaaaatcctgactttaaaaaagtaaatcctggtaaatatgaatataaatcaggtccaaaagggaacgaaaaaaaatag

SEQ ID NO: 2701 - DNA, 750 bp, Staphylococcus epidermidis
ttattgctcgaagtgaatcatttgaatttatttttgggaaaaaagcacattcttaaagatattacattctcattacctataaatggtgaaatcattggtattgtaggacctaatggtgccggtaaatcatctcttctcaaagcatttatcggagaatttaaagcgaccggtaaacatacattatatgatcaccctatacatacacaacttagatatattacatatatcccacaaaaagctcatattgatttagattttcctataaaagtggatcaagtgatactatcaggatgttatgaagacattggatggtttaaaaaagcaagtgtagttgaaaaaacgaaacttaaccaattacttaatgatttagaactcgaccatatacgccatcgacaaattgcagaattaagtggtggacaattgcaacgtgttcttgttgcaagagcacttatgagtaatagtgatatttattgtttagacgaaccttttgttggcatcgacatttatagcgaacaacttattatgaagaaaattaaacatttaagacatatgggtaaattgattttaattgttcatcatgacttatcaaaagcagatcaatattttgaccgcattttattattaaatcaatcgttgcagtttttagggccaacaaaagaagcattatcatctgaacgattaaatgcaactttcattaattacaaagatgattcgcttttaacactatcctcacaagggagtacgaattag

SEQ ID NO: 2702 - DNA, 342 bp, Staphylococcus epidermidis
atatttttagaggtgaatagaatggctattaagctgagttcaattgaccagtttgaacaagtattagaagaaaataaatatgtttttgtattaaaacacagtgaaacttgtccaatttctgcaaatgcgtatgatcaatttaataagtttttatatgaaagagacatagatggttattatctaatcgttcaacaagagcgtaaactatctgattatatcgcagagaaaacaaacgtaaaacacgaatcaccacaagctttttattttgtagatggtgaaatgaagtggaatgcagaccacgatgatattaacgtttctcaacttgctcaagctgaggaataa

SEQ ID NO: 2703 - DNA, 828 bp, Staphylococcus epidermidis
ggagacttagatatgtcagatttattccaaaacgcaccaccctatattcaggcgcttatagccggaataatcacgtggttacttactgctttgggtgcggcagcagtttttatatttaagaaagtgaatgataaagtcttaaattcgatgcaaggttttgcagctggaatcatgatagcagcaagtttttggtcattgttacaacccgcaattgaatcgagtgaaaatagtgctatgccatggcttcctgcagcaataggttttattctcggtggcgtttttatcagggttctagattatattattccccatattcaccaaaatgcccaagataaaaaccaacaacaagagggtgtgcctacctctcttggaaaaaatgcattacttgtgttagctatcacacttcacaacatacctgaaggactatctatcggagttgcattcggtggtgttgtatctggcaacagtcacgctacatttttaggtgcgattggtctagcgataggtatcggcatacagaatattcctgaaggtgcagcactatcgatgccaatccgtgctgcaggtgcaacacgttggaaagcatttaattatggacaagcttcagcaattgttgagcctattttcgctactatcggtgctgcagcaattttagtggtaaatcctatattgccttatgcattggcgtttgctgcaggtgcaatgattttcgttgttgttgaagaactgatacctgattctcaatcaagtaacaacactgatttggcaactttaagtctaatgattggttttacaattatgatgattcttgacgttgcacttggataa

SEQ ID NO: 2704 - DNA, 288 bp, Staphylococcus epidermidis
atgttgagcctctacgtgatgaagactttgtttttgataattaatatagtacttttaaagagatttctattaaaattagtaggaatctctttttttatgaaagttggtattataaaatattttgatgtattattactgctggataaaacatttataaaattcccaaaaaatatgaaaaaactattgaaaaaagaaaatagagtctataatattgatgttaatgataatcattatcattatcattatcattactttcgtatattgaccttatacatctttaatatttag

SEQ ID NO: 2705 - DNA, 984 bp, Staphylococcus epidermidis
ataagaatagaaaaaagggttaggaagggtgagtgttcaatgagctttgcatcagatatgaaaaatgaactaacacgcatagaagttgacgaatcgaatgctaaagcagagctcagtgcattaattcgcatgaatggcgcacttagtctatcaaatcaacagtttgtaattaatgtacagacagaaaatgcgacaacagctcgtcgaatttactctcttatcaaacgtatatttaatgttgaagttgaaattttagttagaaaaaagatgaaattgaaaaaaaacaatatttatatatgtcgaacaaagatgttagcgaaagaaatactaaatgatttaggaattttaaaaaagggagtttttactcacgatattgatccggatatgattaaagatgatgaaatgaaaagaagttatttaagaggggctttcttagcaggtggttctgtaaataatcctgaaacatcttcatatcatcttgaaattttttcacaatatgaagatcattccgaaggtcttactaaattgatgaatagttatgaactcaatgcgaaacatttggaacgtaaaaaagggagtattgcgtatcttaaagaagctgaaaaaatttccgactttcttagtttgataggtggctatcaagcattgttaaagtttgaagatgtaagaattgtccgtgatatgcgtaattcggttaatcgtcttgttaattgtgaaacagcaaattttaataaaactgttagcgcagcaatgaaacaggttgaaagtatacaattaattgatgaagaaattgggcttgaaaatttacctgatcgtttaagagaagtagcgaagctcagagtagaacatcaagaaatatcgttaaaagaattgggtgagatggtttctacagggcctatatctaaatcaggtatgaatcaccgtttaagaaagttgaatgaattagcggataaaataagaaatggtgaacaaattgaattataa

SEQ ID NO: 2706 - DNA, 765 bp, Staphylococcus epidermidis
gatatgtcagattcaatcactatcattgatgaaaataaagtgattgatgtagtcttaattgctgggcgaatcttacttgaagcaggcgctgaaacatatcgaattgaggatacaatgaatcgtattgcccatagttatggtttacatgatacatacagttttgtgacatcaactgcaattattttctcattaaatgatcgtactagtacgaagttgattcgtattcgcgaacgtacaaccgatcttgagaaaattgctttaaccaatagcctatctcgtaaaatttcgagtaagcaacttacaattgacgaagcaaaaagtgagttactgcaacttaaacgtgcgtctcttcagtattctttcttaacaaatctcattgctgcctttgtagcttgtggttttttcttattcatgtttggtggcgtagcttccgacgcttggattgcatgcctagcgggtggcatagcttttttaacgtttagtttcgtgcaaaaatatatacaaattaaattcttttcagagtttgtagcatctgctgttgttattagtattgcagcaatattcactaaactaggtatagctaaaaatcaagacattattactattgcaagtgtcatgcctctcgttcccggtattttgattactaacgctattcgtgacttacttgccggagagttacttgctggtatgtcacgtggtgttgaagctgctttaactgcatttgctattggtgcaggagtagctattgtattactattattataa

SEQ ID NO: 2707 - DNA, 1791 bp, Staphylococcus epidermidis
atggttctggagaaacagaaattgactttactttacacgcaacgaaatggtgttactcgtagacgtaaaatggtttttgaaggtgtgatacctaacattgaccgtcgttaccatgaatctccctctgaatatacacgcgaaatgatgagtaaatatatgacagagttaccgtgtgaaacttgtcatggcaaacgcttaagcaaagaagcgttatctgtatacgtaggcgactataatataggtgaagtcgttgaatattcaattaaaaacgcgctttattatttcgaaaatttaaaattaagcgaccaagataaatcgattgcagatcaaattttaaaagagattatttcaagattatcatttttaaataatgttggtttggaatatttgactttagatcgctcatcagggactttatctggaggggaagcacaacgtattcgtttagcaacacaaattggttcacgattaaccggagtactatatgttttagatgaaccttctattggattacatcaaagagataatgatagattaattaatactttaaaagaaatgcgtgatttaggtaatacacttattgtcgttgaacatgacgatgatactatgagagcagctgattatttagttgatgtgggtccgggagctggtaaccacggtggagaggttgtctcaagtggtacccctaataaagtaatgaaagataaaaaatccttaactggtcaatatttaagtggaaaaaaacgaattgaagtccctgaatacagacgagaaatcaccgatagaaagattcaaattaaaggtgctaaaagtaataatttgaaaaatgtaaatgtagacttcccactatctgtcttaactgttgttacaggtgtgtcaggttctggtaaaagttcactcgtcaatgaaattttatataaagcattagctcaaaaaattaataaatctaaagtgaaacctgggaattttgatgaaattaaaggaattgatcaattagataaaatcattgatattgatcaatcgccaataggtagaacaccacgttctaacccagccacatacactggtgtctttgatgacataagagatgtctttgcacaaacgaatgaagctaaaatacgaggttatcaaaaaggtagatttagttttaatgtcaaaggtggacgatgtgaagcttgtaaaggtgatggaattataaaaattgaaatgcattttttaccagatgtctatgtaccttgtgaagtatgtgatggtaaacgctataatcgtgagactttagaggtaacatacaaaggtaaaaatattgcggatgtattagaaatgactgttgaagaagctacgcatttctttgaaaatattcctaagattaaacgtaaattacaaacacttgtagatgttgggttggggtacattactttaggtcaacaagctactacattatctggtggcgaagcgcaacgtgtaaaactcgcatcagaattgcacaaacgttcaacggggcgttctatttatattcttgatgaaccaactacaggattacatgtcgacgatataagtcgtttattaaaggtattgaatcgtatagtggaaaatggtgatacggtcgttattatcgaacacaatcttgatgttattaaaacggctgatcatattattgatttaggtccagaaggcggtgaaggtggaggaacaatcatcgcaactggtacacctgaagagattgctcaaaataaagggtcttacactggtcaatacttaaaaccagtattagagagagacagcgttgaatag

SEQ ID NO: 2708 - DNA, 402 bp, Staphylococcus epidermidis
attaatcaggaggggattctcgtggcagtaccgagcgaatttaaatattctaaagagcatgagtgggttaaaattgaaaataatgtagcaacaattggtattacagaatacgcacaaaacgaattaggtgatattgtatttgttgagctacctgaaactgacgatgaattaaatgaaggtgacacattcggtagtgtggaatcagtaaaaacagtatcagagttgtatgcgccaatttctgggaaaattgttgaagttaatgaagaattggaagatagcccagaatttgtaaatgaatcgccatacgaaaaagcatggatggttaaaattgaaattagtgacgatagtcaattagaagaattattatcagcagatcaatactcagaaatgattggtgaataa

SEQ ID NO: 2709 - DNA, 336 bp, Staphylococcus epidermidis
ttcttcaaggaggacacatcattggcaaaggtttatggatcactcatagataatgaaacacgatgtacacattattattcatctttagatgttattgccattaaatttaaatgttgcaacaaatattatccgtgttataaatgtcataatgaacacgtatctcatacaattgaaagatgggctgaaaatgagtttgatgaaaaagctattatgtgtggtgtttgtaaacatgagatgcgtattcgtgactatatgatggtagaaatgtgtcctcgttgtaaagcgcattttaacagtcgttgtaaatttcattatcatttatattttgaagtataa

SEQ ID NO: 2710 - DNA, 951 bp, Staphylococcus epidermidis
acaaaaaaggagcgctttaacgtgaaaaaaattctcgctttagcaatagcatttttaattatccttgccgcatgtgggaatcacagtaaccatgaacatcactcacatgaaggaaaattaaaagttgtaactacaaactctattctctatgacatggttaaacgtgtcggtggaaataaggtcgatgttcatagcatcgttccagtaggacaagatccacatgaatatgaggttaaacctaaagatattaaagcattaacagatgctgacgttgtattttataatggtttaaacctagaaactggaaatggttggtttgaaaaagcacttgaccaagcaggaaaatcaacaaaagataaaaatgtgatagcagcatcaaataatgttaaaccaatatacttaaatggtgaggaaggtaacaaaaacaaacaagatccacatgcatggttaagtttagagaatggaattaaatacgtaaaaacaatacaaaaatcactagaacatcatgataaaaaagataagtctacatatgaaaaacaagggaatgcatatatatcaaaattagaagaacttaataaagatagtaaaaataaatttgatgacatacccaaaaatcaacgtgccatgatgacaagtgaaggtgcatttaaatattttgctcaacaattcgatgttaaaccaggttatatttgggagataaacacagaaaaacaaggtacacctggtcaaatgaaacaagccattaaatttgttaaagataatcatttaaaacatttattagtcgaaacaagcgtagataaaaaagctatgcaaagtttatcagaagaaactaagaaagatatttatggtgaagtatttaccgactctataggtaaggaaggtactaaaggtgactcatactataaaatgatgaaatctaatattgatacaatacatggtagtatgaaataa

SEQ ID NO: 2711 - DNA, 711 bp, Staphylococcus epidermidis
aatttaagggagtattttattatgaaatccactgcgcaattaacaaaggagaataatgtcaaagctttgcgactgaacaataccgatcgtgaaatatttgaaaattacatgacatatgtgcgtgctgacttacgagttaaccctcacgattcagaattaatgttaaaccgtactttgaaacacttaattcgtgcaggtgatactggaatgcttgcgatggagtttttcaaccatgatcctaaagcacatgctaaaaaagagataagggaactcccaaatgaaacatttaaaaacatttttaaatatataagtcataacttcattcttttaataggtattttttgttttctcaaaggattgattggcttttttatagggggcgatagtaatttactatatttatatacgtttcccctaactgtcattattggtttagtaattatatttttatttatttggatgaactttaaaacggtacaattacagtgctttaacaactcttattggacctggtggctcacctatggtgtcatcgcattattattaatcactcttttttatgttttttttataccgcaatcatttttagcgtttggaccatatattaaagttagtaattggactttcatcattattgcgataataatcatccctatttcattttatgtgaatcatcacttttataataaagaagcaaatacacgcatataa

SEQ ID NO: 2712 - DNA, 1011 bp, Staphylococcus epidermidis
aagtggagggagataatgaaacaaatgaatgtagtacttattggtggtggcactggactttctgtccttgctagaggccttagagaatttccaatagacattactgccattgttactgtagcggacaatggtgggagcacggggaaaattagagatgtcatggatattccagcgcctggtgatattcgtaatgtcattgctgctttaagtgactcagaatcgatattaactcaattgttccagtaccgttttggtgaaaatcaagtagatgggcattcattaggtaatttagttattgctggaatgactaacattactaatgattttggacacgctattaaagagttaagcaaagttttaaatattaaaggccaagtcatcccttcaacaaacgcaagtgtgcaactcaacgcggtgatggaagacggtgaaattgtacatggagaaactaatatacctaaaacacataaaaaaatagatcgtgtgtttttagaaccaagtgatgttgaaccaatgaatgaagcgatagaagctttagaacaagcagatttaattgtcttaggaccaggttcattatatacaagtgttatatcaaatttatgtgtcaaaggtatttcagaagcattattacgtacatctgctccaaaactttatgtatctaatgttatgacacaaccaggcgagactgataattatgatgtcaaagagcatattgatgcacttactcgacaagttggtgaaccatttattgattttgtcatatgtagctcagaatcctatagtaaagatgttttacaacgatatgaagaaaagaattcgaaaccagtagcagtacataaagaacaattaaaagatagtggaattagagttttaacggcatctaatttagttgaaatatctaatgaacactatgtcagacataacacaaaagtattatcaaaaatgatttatgaacttgccttagaattaacaagtacaattcgctttactcctagtgataaaaagaaataa

SEQ ID NO: 2713 - DNA, 1014 bp, Staphylococcus epidermidis
aatggtctactattttgtagagggaatgaaggtgaaaaagtgattaaatttaaaaatgtcacaaagcgatatgctaataatattgctgtagataatgtaagttttaatattaaagaaggagaattttttgtgttaattggtccttcaggttgtggtaagacaacaacacttaaaatgatcaatcgtttaattcctttaagcgaaggttacatatattttaaagataaaccaattagtgattatccagtttacgaaatgcgttgggatattggatatgtactacaacaaattgcattatttcctcatatgactatcaaagaaaacattgcacaagtaccccaaatgaaaaagtggaaagataacgatattgatttacgtgtggatgaattattgacaatggtaggtttaaatcctgagcaatttaaaaatagaaaacctgatgaactatcgggtggacaacgacaaagggttggtgtagtgcgagcattagctgcagatcctcccgttattatcatggatgagccttttagtgctcttgacccaattagcagagagaagttgcaggacgatttgattcatttgcaaactcaaattaagaaaacaatagtttttgtaacgcatgatattcaagaagcgatgaaactaggtgacagaatttgtttactcaatgaagggcgtgttgaacaaattgatacacctgatagttttagaacgcgacctaaaagtgactttgtaaagcaattcatgggtagtcatttggatacaacgcataatattgtgaatcaagtgaagattaaagatttaggaattaatcggtctgtagatgacaatgcaagcgttattcattatcctgaagtagatgctgagttgtacttaaataatatttatgaagatttgtctcattatgatgcagttgtggtcaacgataaagaacaacatcgtcgatatttgttaaatagagaagatgtgtttacttatttatctcttaataaggaggaagcgacacatgaatga

SEQ ID NO: 2714 - DNA, 1125 bp, Staphylococcus epidermidis
ggtatgagtttgtttataataggtactaagttttttaaaatttcagtcaatttaaggtgtgatttatgtatgaagaaacaattagaccaattaacagcatatacgccagggctttctccagaatctttaaaaaaacagtatggcattaaaggtgaattacataaacttgcttcaaatgaaaatgtatatggtccaagtccaaaagttaaaacggctattcaatctcatttagatgaattatattattatccggaatctggatcgccaaaattaagggaagcaataagtcaacaacttaatgttgatgcatctcgtattttatttggtgcgggtttagatgaggttattctaatgatatcaagagccgtattatcaccaggagataagattatcactagtgaatctactttcggacaatattatcataatgcaattgtggaatcagctgatgttatccaagtgcctctcaaagatggtggatttgatttagatggtatgttacaacaaattgataataaaacgtctttaatttggttatgcaatcctaacaatccaactgggacttacttttcgcacgatgaattatttaatttcttaaaacgtgtcccaagtgatattcctgtattaattgacgaagcatatgtagaattcgttactgctgatgattttccagatacgctaaaattacaggaggattttgacaatgcctttttattacgtactttttctaaggcatatggattagctggattaagagtaggatatgttatagcctctgaagacgccattgaaaagtggaatatcattcgtccaccatttaatgttactagaatttcagaatatgcagcaatcgctgccttagaagatcaagagtatttgaaagaagtgacacaaaaaaatagttttgaacgagataaattttatcaaattcctcaaagtcagcattttttaccaagtcaagcgaattttgtctttgttaaaacttcaagaagtcaagcactttatgatgcattgttaaacgtaggatgtattacacgtttattccctaacggtgttagaattactattggtttaccagaacaaaataataagatgattgaagttttaaaacattttgagtattaa

SEQ ID NO: 2715 - DNA, 192 bp, Staphylococcus epidermidis
ttgaagcaacttattataagccaactttcaactcagtcatcgtctgccattatattgaaaaattttgagcagaggattactcctttatactcatcatactatataactagtagtcccatatcgtgtggttttatattaccctcctataatataaacaacatcttttacacacgatatggtggtattagttag

SEQ ID NO: 2716 - DNA, 960 bp, Staphylococcus epidermidis
ttacacaaactatttatcgaaagtaggtatatatttatgaaacaaccgtataaccatggtgttcttttctatcatgaacatagcggtttgaaagatatacataatggcataggagaagttgcaaaatctcttagttcaatgtgtaaacacctctctcttcaactcagtgaaaataaaggcgatattattaaatattgtaaatctattaaaaatgaaaattatagctctgatgtagacgttttatttattttaggtggagatggtacacttaatgaactagtaaatggcgttatgcagtatcagttaaatttaccaatcggtgtaataccaggtggtacctttaacgattttacaaaaacacttcaactgcaccctaattttaaaacagctagtgagcaattattaacatcacatgctgaatcatatgatgtgttaaaagtgaacgacttatatgtacttaatttcgttggacttggcttaatagtacaaaatgcagagaatgttcaagatggttctaaagatatattcggtaaattcagctatattggatcaaccgttaaaacgttattaaatcctgttaaatttgatttctcattgactgttgatggtgaaacaaaagaaggcaatacttcgatgatgttaatagcaaacggtcccaatataggtggtggacaaattccgctaaccgatttatcgccacaagatggaagagcaaacacatttgtatttaatgatcaaacactaaatatattgaatgatatattaaaaaaacgtgatagtatgaattggaacgaaatcacacaaggtattgatcacatatcaggtaagcacatcacactctcaacaaaccctagtatgaaagtggatattgatggcgaaattaatttagaaacaccaattgagattcaagtattacccaaagcgatacaacttcttactgcaactgaacaaaataattaa

SEQ ID NO: 2717 - DNA, 246 bp, Staphylococcus epidermidis
gttaattcttgtaaaattaaattctgtcgtttttctgatatcactgctatacctcccctaattcacttatattgtaatggctacgcttacatatttcaatcaaaatcttccattttcaatcaaaaacaatcattttatgacaaaaataaaaacacctttcagattaggtgtttgaaatggattgtatcatcacactttaagacgtacattttaattttcagaaatcattttctaagtattaaataa

SEQ ID NO: 2718 - DNA, 1125 bp, Staphylococcus epidermidis
tataatgattggaaatttaaagatggtgaaaaaatgagattgataattaaaaagatttatatcatagctattgtgcttttaaatatggtttttaaaccgtttaatataaattcgaagcacattgtgataatgatgacctttaagcaagatatactgcctattatagaggccttatgtagtgaaggataccatgtgacggttataggtaaaaaaatatatcagaaagatattaataacattaatcatgcatattttatacctgccggaaataaatatattatgagacatatgaaagtattaagtaaagcaaaggttattattttagatacgtattatttaatgatgggtggctatcagaagaaaaaagggcaaactgttattcaaacatggcatgctgctggtgcgcttaaaaattttggcttaactgatcatcaagttgatttaaaaaataaggctatggtaagacaatacaaaaaagtttatgatgctaccgattattatttggtaggtggggagaaaatggctcaatgttttatacaatcgtttgatgcatctccatcgcaaatgttaaagtttggacttccaagactgacccaatactttagaagcaatcttaagttagaacaacaacgattaaaaaagaaatatcatattacaaataaactcgcagtatatgttccgacttatagagaaggtcaagtagcacaacgtactattgataaagaaaactttgaacggcacttgccgaattatacgttattgagtcatttgcatccttcgactgttgattgtcaaacttctcattcaatcgatgttacttcattgttaattatggcggatattattataagtgattatagctcattacctattgaagcaagcgcacttaataaaccgacacttatttataattatgatgaacagcaatatgaaaaagtaagaggattgaatgaattttattatgctattccagaacgatacaaaatgagtaatgaagagtcaattatacaagcgatacaggataacgatgagcaatttcaatctttatttaatgattggcatcaatataactcaaaagatagtcttaaccagttagttcattttattaataagttggtgaaataa

SEQ ID NO: 2719 - DNA, 681 bp, Staphylococcus epidermidis
gaatatagactaattttaatattaaggaggtgtcttattatgggaatgcatcaatattttaaaagactatcagatttagaaaaattaataagattaccaggtaaatttaaatattttgaacacaatgtcgcagctcattcttttaaagtaactaaaattgcgcaatatatggctactgtcgaagaatatcatggaaataaaatcgattggaagagtctttatgaaaagtcactcaaccacgactttgctgaagtgtttacaggtgatatcaaaacaccggtaaaatacgcaagtaaggaattaaaacatttattctcccaagttgaagaagaaatggtcgatacgtttatcaaagaggagataccaacacaatatcagcacgtgtatcgtgaacgtttacaagaaggtaaagatgattctctagaaggtcaaattctatctgttgctgataaaattgatttattgtatgaaacatttggagaaatacaaaaacgtaatcctgagccactattttttgaaatatatgaaatgagtttagaaactattatacaatttgatcacttagaatctgtaaaagattttattgaaaatgttatacctgaaatgctcacagaaaactttattcctcgaactgaattacgtgaaacaacaatgtcaattctaaacagaagaaatgggtga

SEQ ID NO: 2720 - DNA, 1104 bp, Staphylococcus epidermidis
ttctcactgtgcaactctaaggaggtaaatattcacatggggctgaataaagaagctataaaaattggttttgcctatgtcggcattgttgtcggcgcaggattttcaacaggacaagaagtgatgcaatttttcacaccatttggtttatggtcatatattggagtgattatctcaggatttatacttggattcataggaagacaagtagctaagataggtactgcatttgaagcgaaaaatcacgagtccacattgcaatatgtgtttggaaaaaaatttagtaaagtttttgattatattcttgtctttttcttatttggtatagctgtcactatgatagccggatcaggttctacttttgagcaaagttttggaattcctacttggttaggcgcattaatcatgacagttttgatttacttaacattattattagattttaataaaattgtaagagctttaggactagttacaccatttttaatcataatggttattcttattgctgtgttttacctatttacaggtagtatttcattaggggaagtaaacagtgctatgcctgaaacgagtgcttggaaaggtatcttttggggattagtatacggcggattagcctttgctgtaggatttagtacgatagtagctatcggcggtgatgcgtctaagcgaagagtttcaggtgcaggagcaatgtttggtggtgtgctatacgctatcctacttgcgttaattaacttctcgcttcaaacagaatattcaaaaattaaagatgtggcaatacctacgcttaacctagcgaaaggtatacatccatggttaggtcttgtactcacagtcattatgttagctgtgatgtacaacacgattttaggtctttgttattcttttgcagcgcgtttcacagaaccttatagtaaaaaataccatatattcattattatcatgatggtgatggcatttattttaagtttcgtaggattcgctgatttaatcaatgtcttatacaaatttatgggtattgtcggattatttattgtagtagcagtattgattaaatattataaacgtaaaaaagatgatgaagagcatatcgcgtaa

SEQ ID NO: 2721 - DNA, 834 bp, Staphylococcus epidermidis
gagaaagcgtggttaagtttaatgttcgcagttggaacggttttaaaagaacatattaaaaacttctatttaattcaaagactagcacaattccaaattaaaattaccaatcataataactatctaggtattgcatgggaagtgttgaatcctgctttacaaatcatggtgtattggcttgtttttggtttaggaattagaagcaatgcacctatacacggcattccgtttgtattttggttgttagttggtataagtatgtggttctttattaatcaaggtgtcctagaaggaactaaatcaatctcacagaaattcaatcaagtggcaaagatgaatttcccactctcaatcattcctacttatattgtaacaagtaggttctatggtcatttaggattattagcaattattataatagcttgtatgttcaatggaattatcccttcaattcacattgtacaattacttatatatgtaccttttgcatatttgctaacatcgtcggtggcacttttaacatccactttggggattttaattagagatacgcagatgattatgcaagcattaatgagaatattgttttatatgtctccaattttatgggtgccaaaaaatcacggcgtaagtggtttgattcatcaaattatgttatttaatccagtatattttatcgcagaatcataccgagcagcgatattgttccatcaatggtatttcatagatcattggaagttaatgctatataacgttattatcattctcttattctttatagtaggttctattttacatagacgctatagagatcactttgcggacttcttgtaa

SEQ ID NO: 2722 - DNA, 606 bp, Staphylococcus epidermidis
gtgaagaggtgtttacaattggttaaaacattatatttaatgagacatggtcaaacagtatttaacttaaaaggtaaaatacaaggggctagtgattctcctttgactgcattaggtgtacaacaagcgaatgcagcacaacaatattttaaaacgaaaaatattcattttgactatctttattcatcaccacaacaaagagcatgtgacacgttagagaacgctgtaccaaaccaacaatattggtgtgtaaaagatcttaaagagtgggggtttggattatttgaaggggaaagtatcgagttattaagagctattaaacaacctagatatttgtatggtgacgctgttgtaccatttggtggagaatcaagatctgaagttgaacacagggtttatcgagcactctatgaaatgatggatacaacagatggagagacaattctagcagtgagtcatggtagcactattggtttgtttgtaagaaatatattagggtatgacaagggaagtaaatttgaaataggaaattgtaacattgtaaaatttgaatacgatggagaagaatttatctttaaagatttaattaatcccattaaaaaatag

SEQ ID NO: 2723 - DNA, 414 bp, Staphylococcus epidermidis
ggagaatttcgtatcatgaaaagagtcattacttatggtacatatgacttgcttcattatggtcatattgaattacttagaagagctcgtgagatgggggattatcttatcgttgcgctttctactgatgaattcaaccaaatcaaaaacaaaaaatcatattatgattatgaacaacgtaagatgatgttagagtctattagatacgtagacttagttatccctgaagaaggatggggacagaaagaaaaagatgttgatcgttttgatgttgatgtatttgtgatgggtcatgattgggaaggggagtttgacttccttaaagataagtgtgaagtcatttatcttaaccgcacagaaggtatctcaactaccaaaatcaagcaagaattatacggaaaagatacaaaataa

SEQ ID NO: 2724 - DNA, 813 bp, Staphylococcus epidermidis
gtttgtcttcgtaaaaagataatttggttgaagtatgacaggagtgattatttgtcgatattagaggtaagacagttgtcaaaagtctatggtgataagcaagctttccaagaagttttgaaagaaattaatttagatgttgatgaaggtgagtttatatcaattatgggaccttctggttcaggaaagacaactttattaaatgtacttagttcgattgattatatgactaaaggatctattacaatcaacgggaaacaacttgagaagttatctaataagcaattatctgatattagaaaaaaagatattggatttatttttcaagattataatattttaaataccttaaccgttaaagaaaatatcatgcttccactatcagttcaaaagttagataaacaaataatgcatgaacgttatcaacgtatagtagaagctttgaacattagtgatattagtgataaatatccatcagagttgtcaggtggacaacgtcaacgtacctcagcagcaagggcatttattaatttaccttcaattatatttgctgatgagcctacaggtgctttagattctaaaagtacactagatttacttaagcgtcttaaatatatgaatgaggaatttaacacaaccatacttatggtgacacatgatccagtagcggctagtttttcaaaccgtgttgtgatgttaaaggatggacaaatctttactgagttgtatcaaggtgatgatgataaacaaacgttttataaagaaattataagaacgcaaagtgtacttggtggcatcaattatgagctttaa

SEQ ID NO: 2725 - DNA, 681 bp, Staphylococcus epidermidis
  unsure (40): Identity of nucleotide at the above locations are unknown.
aaaagaattcgtgcacttcaacaggatattaataactatntgataccggagtttaaaaaatataaaaattccactcaacatttaacagcagatactaatgaggttaagcacttgaaagaggattatctaaaaactgttgaaaataaagagaaatctatatatgatttaaaagaatttgtagatttatgtaatcgctcaattaaagataatgaagatattttggattatactaaattattcgagaaaaatagaactgaagtggagtctgacattaataaagcacaaaataaagaagatgcaagtcaacttaaatcaaaattagaagaaaataatcaacaattaaaagatactgctaaaaaatatttaaattcttcaaataatgattctgattcagcgaaagaagcaatcaaaaatcatatttcaccacttattgacaaacaaattacggatattaataaaacaaatatttctgataatcatgttgataatgctagaaaaaatgcaattgagatgtattatagtttgcaaaattattatgatacgagagtagatacgattaaaactagcgaaaaattagctcaaattgatgttgatcgattgccaaaagaaggaaaagatatatcagagatggataaatcgttcaaaagagaatttaaaaaaataagagaaagtgtgaattaa

SEQ ID NO: 2726 - DNA, 222 bp, Staphylococcus epidermidis
gaattacatcgtaagaagaagggatataaaatgaaagatactcagttaacatatatattattaatcattgcaagtattttattaattgctaatggtatatttgcatttgaacgtacgttatcaatgatattaatgtcgatattatttatattagttggaatcattttattatcaacaacattgaataccatgtatcaatcatcaaaacactcaaaacgttaa

SEQ ID NO: 2727 - DNA, 537 bp, Staphylococcus epidermidis
gtgattattttgagaagattaagtaaagagaagcatcatcaagtgaatcctttatggcatatatatagaaaaattaaattcgtaaaagtgctaaagcaaacgttgattatagaaattgcaagatttgttcctagtatgaaacttaaaaataaaatatataaaaagcttttaaaaatggatgtcgggaatcatacttcatttgcatataaagtgttgcctgatttgttttatccagaatacatttcggttggcaagaatacagtcattggttataatacaacaatattaactcacgaagtacttgttgatgagtggagagtaggaaaagtcattataggcgattacactttaataggtgcaaatacgacaatattaccaggaataaccataggaaatcatgttaaaattggtgcgggtacggttgtgtctaaagatgttcccgattacagttttgcatttggtaatcctatgcaaatacaattagattcaggaggtgacaatgaatggcacaaaaagaaaataacatcattccaatga

SEQ ID NO: 2728 - DNA, 612 bp, Staphylococcus epidermidis
attatataccgggtacttattcacgaatttggccacgtcttatttaacaaactcgctggtggaaaggccaaagatcttgtcattgtgacaagccctagagaaagaaaagtcacttcacaacaaggctatgcgattacacaatctaaaggatacttaggtcagtttattacaactataggtgggtatcttatgccaccattgatgtttttaactggattggtatctattcactatcaatatccaagtatatttattactatatatttatttatttttatatattatttctttattacttcccgtaaactatcacctttgattgtcattatactcatctcaagtttactctatttagtatttaaacaagaccatcaatggttcatttacgacattgtcacattaagttaccattttattttaggcgtacttttaggtgaaatattacaatcctcatggacgatttttcgtcttacctttcaacgacctaaaccttcttgggatggcagtgctttaacgaaagttactcgagtacccacctttatctttagtttagtgtggatattattcaatctctatactgtgtatttattaatcaaatacacaatactataa

SEQ ID NO: 2729 - DNA, 468 bp, Staphylococcus epidermidis
gtatttatacgttacttaattacaaagataggagggggcaagatgaaagagaatgatgtagtacttaaatcagttacaaaaattgtagtgtttattttgttaacatttggattttatgtattttttgctggccataataatccaggtggtggctttattggtggcttgatttttagctcggcatttatcttaatgtttcttgcctttgatgtaaatgaagtgttgaaaagcttgcctattgattttaaaaaattaatgattataggttcactcatatctgttgcaactgcatcagtgcctatgttttttgggaagccatttttatatcaaactgaagcaaatgtaacatttccattactaggacatgttcatgttactactgtgactttatttgagcttggcatcttattaacagtagtaggtgtgattgttacagttatgctatctataagtgggggtagatcatga

SEQ ID NO: 2730 - DNA, 1035 bp, Staphylococcus epidermidis
atcgtgcaacgaatggaagccagtcgttttacactttttaagtattgttttgttaatatagtgattaagaaagtattgaaagagagagttatgaataaatatagaagtgtcattatatggttatttattttaatattaagcatgagcttaagtttaagctgggatgtaggaaaacttgatgatgtttttaatcaaaccatactattccaggttcgtttacctagattacttgaagccatgctcactggtgcagtacttacattagctggccaagtgtatcaaattgtgttaaataatccacttgcagatagttttacattgggattagctagtggtgcatcattaggatctggaattgctttatttttgggacttagttttttatggttccctatattttccattattttcagtttaatcacactgttacttgttttaagtgtttcagcgatgttagccaaaggatatcctgttcaaatgcttatattaacgggattactatttggtgcactattaaatgcattattgtatttgcttgttttgattaatcctaagaagatgaatccaattgctagttatctgttcggtggttttgcatcagctgaatatcaggatgttatgattattagtttgatagcatctgtcgcaatcatagtattatttttaatgcaaaaaggaattaaattactgcaagttggtgaattgaaaagtcagtctctaggattaaatgtacaacaagtaacgtatattgttcttatagtagcctccatcatgacagcagttgtggtcgcatacgttggagttattggttttataggcatgattattccacaactgattagaaaattttattggcgttatcaaataggtttacaaatgttattgaatataatcataggtgctgtagtcatgataattgcagattttataggaagtacaatgatacaacctatacaaattcctgtaggcatcgtgatggcattgctcggtgtaccagtcctattttatattttaattaaacagactaacatatga

SEQ ID NO: 2731 - DNA, 498 bp, Staphylococcus epidermidis
aatttaaaacgaatgattaagtacatctactggtgggtatcaataaaatacatacaatttgaggaggtaataatgatggcagttcaatatgaaactaaagcgactaacgtaggtggacgtaaaggtcatgtccatactgacgataatgcaataaatgtagatgtattaccaccacaacaagctgacggtaaagcgactaatccagaacaattatttgctgcaggttacgcttcatgctttaatggtgcatttgatttaattttaaaacaaaataaagtgcgcgatgctgaacctgaagtaacgttaacggtacgcttggaagacgatccagatgccgaaagcccaaaacttagcgttgatattcatgcaaaagttaaaaatgttttatcacaagaagatgctgaaaaatatttacaagatgcgcacgacttttgtccgtattcaaaagctacacgtggcaatatcgatgtaaacttaaatgttgaagtagtagaataa

SEQ ID NO: 2732 - DNA, 1674 bp, Staphylococcus epidermidis
ggagataagcgaatgaatataatcgatcaggttaaacagacgctaatagaagaaatagaagctagtattagaaaagctaacctcgcagaagatattccagaaattaaaattgaaatacctaaagatactaaaaatggagattattcttctaatattgctatggttttaacaaaaattgctaagcgtaatccacgtgaaattgcgcaagctattgtcgatcatttagatacaagcaaagcacacgttaaacaggttgatattgctgggccaggtttcatcaacttttatctggataatcaatatttaacagacattattccagaagctatcacaaaaggtgatcgatttggatatgcaacacaatctaagaatactaacattttattagaatatgtatcagctaatccaacaggagacttacatattggtcatgctaggaatgcagctgtaggcgattctttagctaatattctcattgcggctggttacaatgttacacgtgaatattatattaatgacgcaggtaatcaaatcactaatttagcacgatcaattgaagcacgatacttcgaagctttaggtgatacgagttatgagatgccggcagacggttataatggtaaagacattattgaaatcggtaaagatctcgctgttaaacatccagaaataaaagactactctgatgaagaacgcttaaaaacgtttagacaacttggtgtcgattatgaaatggaaaaattaaaaaaggatttatctgattttaacgtgcactttgataattggtttagcgaaacatctttatatgaaaatggcgcgattaaaaatacattatctaaaatgaaagagctaggctatacgtatgaagcagatggcgcgacttggttacgtacaagtgactttaaagacgataaagatcgtgtattaataaaaaaagacggtaattacacttatttcacaccagatacggcctatcactacaataagattaatagaggaaatgatattttaattgatttaatgggtgctgatcaccacggttatattaaccgtctcaaagctagcttagaaacatttggtgtagacagcgatcgtcttgaaattcaaattatgcaaatggttcgccttatgcaaaacggagaagaagtgaagatgagtaagcgtacaggcaatgcgattactttacgtgaaattatggatgaagtcggtatcgatgctgcacgttatttcttaacaatgcgtagtcctgattctcattttgactttgatttagagttagctaaagagcaatctcaagacaatccaatttattacgcacaatatgcacatgcacgaatttgttctattctaaagcaagctaaagaacaaggtattgaagtgtctactgatgcagacttttctaaaataaataatgataaagcaatagacttattaaaaaaagtagcagaattcgaatcgacgatagagagtgcagccgaacatcgtgcacctcatcgtctaactaattatattcaggatctagctgcagcattccataaattttataatgctgaaaaagtgcttacagatgatacggaaaaaactaaagcacatgtagctatgattgaagcggtgcgtattaccttgcacaatgcattagcattagtaggtgttacagcaccagaatctatgtaa

SEQ ID NO: 2733 - DNA, 234 bp, Staphylococcus epidermidis
atgaaatttagagaatggacaataacgattaacggaaaagggcctataaatgttgtagccaatgaagatactttactcatattacagaaatatcaacatgtcgaagtagcattaaaaatagataatgagacggttcaagttaaatctctcggttataacgaagatataattattaaccataatactaaagaaattacgattaatgtaaccaacttgttagaagatgatgaataa

SEQ ID NO: 2734 - DNA, 276 bp, Staphylococcus epidermidis
cttaacattagatttacatggaataaaggaggattaatgatgtctactcatagtcaatgtaactatgtcaatcctaattcaatttctttagattgggaatgtttaattataagcaaaacagatatgctactcgatggtgtacctaaagaattaattaatacttggttagatcaaaatgttatcgagccgttttgtgttcgtaataatgaaataaactttaaaactaaagatgtttggaatgctcttaagacccataactggtattattcaaattaa

SEQ ID NO: 2735 - DNA, 1710 bp, Staphylococcus epidermidis
ggtgaagatagatcaatgaaatcacatattcattttagtatagatagagatttaatatgcgctatcatggtaggtgttttaagcggaattgtaacattagcaatgttctttttaagtggttatatgattactcaaagtgcgctaggtgcgccactttatgcattaatgattttagttgtatctgttaaattgtttggttttttaagagcaattacacgctatatagaaagattactttcacacaagacgacatttacaatgttacgtaatgtacgagttcaatttttaaaaatgctatatccagtcgttccagatatctatagaagatttaattcaagtgatcttattacaaaaatgataagccgtgtagaagctttacaaaacatatatctgagagtatattacccaccgattgtaatcggattaactgcaattgtttcagtaataactatgttgtttttatctccactacatgcattagtgattactttaagtatgttattaactttatggattgttccttggttaagtgctatgaaagcacgtaaattaaagcaacaagtgacccaaacgcaaaaaacatttcttaaaagatattatgattataaagaaggtcatgaagaattaaaacgtttcaatcgcagcgatgacttcgaaaatacagtttcccagtctttacgacaatttgatgatatgcaacttaaggaacgccgatttctttctatttatgactacttgttaaacttaatagcgatgttctcaatatttatgtgtttagtgttaggtgcgcaacagattcatgatggtcagctcaatgctatttatattacaagtattatattgatgatattaactttatttgaacaagcagtacctatgagcaatgtggcatattataaagcagatacagacctggcacttgaagagatacaagaggttattgtacctaagtataaaattccttcagaacatacaaacttaaagcgttcgcaaaatcttttattagaaattaaaaatgtcacatttaaatatgaacatcaacatcattctactttaaaacagattaatctaaccattgaatatggtgataaggtggcaatcattggtccttcaggatcaggtaaaagtactttgcttcatgtattacttgggctatatcaaatagaagagggagaagtgagattaaatggtaaggatatgaacagtatcaatgacaatgataaatatcaaacatttaatgcaatgcttcaatctcaatatatttttgatggttcaattcgtgataatttattttctgagcaatcagatgataacctcaaaaaggttctcgaagatgttggattagaatatttaaatttagatagtatagttacgttagacggtcataatttatcaggtggggaagctcaacgtctaagtttagcgagattgctattaagaccttcggccggtttttggatattagatgaacctactacagcactagatattaataatacccaaaaaattataaatttgattgaatccttatcccaaacactcatcatagctacacatgatttagaaatacttccaagatttaataaaattatagtcatgaatgacggagaaataatagaaaatgattcatatcaagaattaatgcagcatgacggttatttaaaaaaagtaatagaaatgaatggaaacgaaatgaaattttttaattaa

SEQ ID NO: 2736 - DNA, 438 bp, Staphylococcus epidermidis
ttttaccaaagaaaatggacgctcaatcaacttgtagactattttagtaggtggttagatgagacaaaaggaacttttgtacatactcaaaaacaagatcatcactacatcatttacaataggaacattaaaagacctttagctattttcaaaatggttaatacaacagaagatataattacattacatcttgttgatggtaaattgatgaaacctaaatcaaagaagcaagcaaaattagaatttagacttcttaaaggaacacgtttaattatggttcatttatacgattatatccctagattattttggccaatttactatttcatacaagcaccgattcaaggacttcttatgagaggttttgaaattgattgtagaattaagcattatcaaggtcgcattcaatcaggtgagaagattaaatatactaaataa

SEQ ID NO: 2737 - DNA, 621 bp, Staphylococcus epidermidis
tataataaaagcaaggagttggtgactgtgaaagtaaaatatatagacaaacgtcactggcgtcgcctggtagagagagaatatacagaggttaaagttaataataatagatttaaaggtattataggcttggtcacgatgaaaaaggttcgtgagcctttagaggtgacggtagttggacaaaacataatagttgcagatgacaattataaatggttacagatactaccggataagaagcggtatagtatgactgtcatgtttgataataaagggaatccattagaatactactttgacattaatataaagaacattactcaaaaaggaaatgcacgtaccatcgatttatgtttagacgttctcgttctacctaatggtgagtatgaacttgtagatgaagatgatttaatgtacgcactacaaaataaacaaatttcaaagaagcaatatcatgaggcatatattatcgcccatcaattaatgattgaaatagaagataatttttcagaaatacaagataaggttatgcgttgttatcataaaatcaatcataaagcacagaaaatgaaacataaacgtccctataaagctaaaaagaaatcacaccgacgacattaa

SEQ ID NO: 2738 - DNA, 480 bp, Staphylococcus epidermidis
ttttgtaaaaggagtacaattatgacagactcaaatgctaaagaaataagaactggacgtttaattgcgataagttcattagtgttttgtattttacttatcatacaccactttattgtattagatgaatcaacagctaaatcaattttatctttagctggtcaaaaaacatcagatacagcagtgaaaaacattttaaatagtgaccgatacactggaattatgtatattttagcttacttagcaggtactgttgctttctggaatcgccatccatatttatggtggtttatgtttgccgtatatatttctaatgcactatttacactcgtaaatctttacttatttattcaaggtattttagatgtaaaaaatgtacttgcagttttaccaattttaattgtagtgattggatctataattctagcaatttatatgctagttgtttctattacacgtaaaagtactttcaatagatag

SEQ ID NO: 2739 - DNA, 2052 bp, Staphylococcus epidermidis
agaggtgaaagtgtggagatatttgaaactctactcatatttgtcgcactagttattgtgagctcctttgtacatactttcatacctaaagtacctcttgcatttatccaaattttccttgggatgattttatacctcactcccattccagttgaattcaattttgattctgaattatttatggttacattgattgcaccactactattcgttgagggtgttaatgtttcaagagtacatttaaggaagtatatcaaacctgttatgatgatggctctaggtcttgtcataactaccgttataggcgtaggattgtttattcattggatttggcctgaattacctataggtgctgctttcgcaattgcggctatactttgtcctacagacgctgttgcggtacaagcaatcacgaaaggtaaggttttaccaaaaggttcaatgaccattcttgaaggtgaatctttacttaatgatgctgcaggtatcatttcatttaaaattgccgtaggtgtattgattactggaactttttccatttttgatgcgattcaacaatttttgattgcctctattggaggtgctattgttggtctaattataggcatggctttagtgagatttcgtttaacattaatgagacgtggcattgagaacattaacatgtttacatttatacaattgctgacgccgtttgtcacttatttgattgctgaattattccatgcatcagggattattgcagcagtagttgcgggactcgtgcatggatttgaacgtgaccgtatagctcaaacgagaacacaattacagatgagctataatcacacatggagtattttaggctacgttttaaatggttttgtgttttcaatcttaggttttttagtacctgaggtaatagtgaaaattattaaaactgaaccgcataatttattattcttaatcgtcatcacattgctagtcgctcttgcggtgtatctctttagatttgtgtgggtatatgtactttatccttatttctatttatctgtcagtccattccaaaaaatgatttctaaaaatgatgaagataaagttactgagagtaaacctaagcgtagcttatatgcactaatcatgactctatgtggtgtacatggaaccatttcactcgcaatcgccttaaccttgccatatttattagcaaatcatgaaacatttgcttatcgaaatgatttattatttattgcttccggaatggtaatattaagtttaattattgcacaagtcattctgcctttagtaacgcctgatagccctgaagtgaagataggtaatatgtcatttaaagaggcgagaatctacattttagaacatgttatcgattacctaaatcaaaaatcgacgtttgaaacgagttaccgttatggaaacgtcattaaagattaccacgataaactcacatttttaaaaacggttgaaaaggaagatgaaaactccaaagaactagaacgacttcaaaagattgcatttaacgtagaaacaaaaacgctagagaaattggttgatgatggcgaaattactgagagtgttcttgaaaactatatgcgttacgctgaacgaacagaagtgtataaacaagcttcgttattaagacgaattattgttggtttaagaggaatgctattgaaacgtcgtgtaaaaacaaaaattaattcggcatcatctcttagtgttactgataacttattagaattgggtaaaatcaataagcttgttcattataacgtcgtaagtcgtttagccaaagaagctactactgataataaactagaagtaggtatgatttgcgatggatatctgatgagaatagataacttaacaccaaacaatttctttaattccagacatgaagatacacttaccaaaattaaattaaatgctttaagagaacaacgtcgtattctaagagaactaattgaaaatgatgagataacagaaggtactgcattaaaattaagagaatccattaattatgatgaaatggtaattgtagatagtatgacataa

SEQ ID NO: 2740 - DNA, 312 bp, Staphylococcus epidermidis
gaggagagaagaacgatgcatgaacaagattttaatattctagaaggtaaaaagatgacattagtagaattaggtcgtgagttagagaatctaactggtcgtactattaaagatacaacaagtgatattaaacgagtcattgcacatttgcctaactttgaatcagatacagatacatttgtagcaacataccaccttaatcatcaaaatgattttattgatgcaacatttgttgcacctaaaaatcaaagtgatcgtttgaaagaaataccggtacacattaagttgattagttatatttctaaaaactaa

SEQ ID NO: 2741 - DNA, 750 bp, Staphylococcus epidermidis
aatattaagaggtcattgaaaatgaatttaaactgcattaaggctatcgtctttgatttagaaggtactctattagatagagtaaaatcgcgtgaaaagtttatagaagagcaatatgaacggtttcatgattattttattcatgtgcaattagcagattataagaataaatttattgaattagacgatgatgaagacaacgataaacctgatctatataaggaaatcattaaacaatttcatatcgaccgtcttaaatggaaagatttatttaatgactttgaaatgcatttctatcgttacgttttcccttactatgatactttgtatacattagaaaagttatcgaaacatcattacatgattggtgtgattgcaaatgggaaatccaaaattaaacaatttagattgcattcattgggtattatgcacgttattaattatttaactacttctgaaactgtaggctatcgtaagccacatcctaaaatctttgaagatatgattgatcaattgggggttaaaccatctgaaataatgtatgtcggagatgatgcattaaacgatgttgctcctgcacgtgcaatggggatggtaagtgtgtggtataaacaagaagatgcagaattggagccattaacagaagaagtagattatacgattactaccatagaggaattgcttaaaattttaccagataattttgaaacagaaggagaagaacaacatggcaatggatttaattactaa

SEQ ID NO: 2742 - DNA, 537 bp, Staphylococcus epidermidis
tttggaaagagctgtactataatgtttgtgaattatttcacaatatctaaggagtggttgtatatgttatctgtaactaaaaaaaatacatatgaatcaaacaaagatgaagtcacacaaatgattgattcattagcagaaaaaggacaagaagctctaaaagaactatctaaaaaatcacaacatgagattaatgacattgtacatcagatgagcatggctgctgttgatcagcatatgcatttagctaaactagcttacgacgaaacaggtagaggtatttatgaagacaaagctatcaaaaatttatatgcctcagagtacatatggaattcaatcaaagacaataaaacagtaggtatcataggtgaagataaacaaaaaggattaacgtatgtagctgaacctataggcgtgatttgtggagtgacaccaacgaccaaccctacatctacaactattttcaaagcaatgattgctattaaaacaggtaatccaattattttcgcatttcatccaagtgcacaacaatcataa

SEQ ID NO: 2743 - DNA, 315 bp, Staphylococcus epidermidis
atcaaggagagtatgataaaaatgaatgaagataaccgtaacaaacaaattaaatttgaaagaaacctaatcacttttccatatttaggttttgcctttattgttttattatttaatattttttatactgatgtaaaaattacaatggtcttatttggtctattctttgcttacaatttaggaatgctttttatagccttcataagacattttaaacgtacacttatattaaccttaatactaacaatattaagtggtatagcattttttgtactactttatgtttttggattaaatcacgatatttttggatag

SEQ ID NO: 2744 - DNA, 465 bp, Staphylococcus epidermidis
aatgtctggaggagaactttaatgtctgaacaacataatttaaaagagcagctatgctttagtttgtacaatgctcaaagacaagttaatcgctactattctaacaaagtctttaaaaagtacaatctaacatacccacaatttcttgttttaacaatattatgggatgaatcacctgttaacgtcaaaaaggtcgttacagaattagcacttgatactggaactgtatcgccattactcaagagaatggaacaagttgatttaatcaaacgtgaacgttctgaagtagatcaacgtgaagtatttattcacttaacagacaaaagtgaaatgattaggcccgaattaagcaacgcatctgagaaagttgcaaccgcttcttctttatctaaagaagaggtcaaagaacttaatcgcttattaggtaaagtcatcgatgcatttatcgaaacaaaagaaaagtaa

SEQ ID NO: 2745 - DNA, 306 bp, Staphylococcus epidermidis
catagtcggaggcagattttgatggaaaaccttacaaaagaacaaaaatatacaatagctaaattttataaattatatatggaaagatctaatgcggggcaaccagaagaagaagctaatcattttaaagattctgtaacggcacaagatgattatttttgtgatagaaaatatgaagatttcattcataactgtaaagtcttaataaatgaaggttacttagatggcgaggttgaagataacaaaatatataatattcaggttacaacaaaagcttttacagaaattgagcgtagctttggttaa

SEQ ID NO: 2746 - DNA, 939 bp, Staphylococcus epidermidis
ttttataggagggaaatcatgatatatacagttaccttcaatccttcaatcgattacatcatttttactgatggatttgaaatatcaggattaaaccgggcaaaagcaacgtataaatttgcaggaggtaagggaatcaatgtatcaagagtacttaaaactttagatgttgattctacagccttaggattttcaggaggtttccctggagattttattgctcaaacacttgaggacagtaatatccaatcagattttgttcaagtagatgaggatacgcgtattaatgtaaaactaaaatcaggtcaagaaacagaaatcaatgcacccggacctaaagtgacacacgcgcaatttgaacaacttttatctcaaatacgtcgtactacaaacgacgatattgttattgtagctggaagtgtaccgaacagtattccaagtgatgcttatgcacaaatagcacaaatcactgaaaaaactggtgcgcaactagttgttgatgcagaaaaagatcttgttgaaacagtattaccatatcgaccattatttattaaaccaaacaaagatgaattagaagtaatgtttaacactacagtcaagagtgatgaagatgttataaaatatggtaaagaaattttgaaaaaaggggcacaatcagtcatcatttcacttggtggcgatggtgcaatatatgttgatcaacatcaaagcattaaagctgtgaatccacaaggacatgtagttaatacagtaggatctggtgatagtacagtggcaggtatggtagcagggttgtccatgggtcttaatatagatgaagcttttcaacaggccgtagcttcaggaacagcgactgctttttcagaagatttagcgacaagagatgctatagaaaatattaaatctcaagtgacaatttctgtacttgatggggagtga

SEQ ID NO: 2747 - DNA, 2406 bp, Staphylococcus epidermidis
agatgtaggagagaaaggaggggcataatgaatttaaagcaatccatcgaagaaatgataaaacaacctgactatgaacccatgtcagtatctgactttcaagatgcgttaggtttaaacagtgccgactcatttagagatttaattaaaatactcgttgaattagaacagtctggtttaattgaacgtacaagaacagacagatatcaacgtaaacaatccaacaaaacaaattcaaaactaatcaaaggaacgttaagtcaaaataaaaaaggctttgctttcttaagacctgaagatgacgagatggatgatatttttattccaccaactaaaatcaatagagcattagatggagatactgtcatcgtggaaattcaaaaatctcgtggagaacataaaggtaaaattgaaggtgaagtaaaatctattgaaaagcattcagttacacaagttgttggaacgtatagcgaagcaaagcattttggtttcgtattaccggatgacaaacgtattatgcaagatatctttatacctaaaggacaaaatttaggtgctgtagatggtcataaagtattagtacaaattacgaagtatgccgatagtactgacaatccagaaggccacgtctcagcaatattaggtcataaaaatgatccaggtgtagatatactttccatcatttaccagcatggaatagaaatcgagtttccagatgatgtattacaagaagctgaagaagtaccggatgtaatagaaccatctgaaatcgaagggcgtcgtgatttaagagatgaattaacaatcactatagatggcgcagatgctaaagatttagatgatgccattgctgtaaaaaaattaaaaaatggcaacaccgagcttacagttagtattgcagatgtaagttactatgtaaaagaaggatcagctttagataaagaagcttatgatcgtgcgacaagtgtgtatcttgtcgatcgagtaatcccgatgattccacaccgtctaagtaatggaatatgctcattaaatccagaagaagatcgtttaacattaagttgtcgaatggaaataaatgaacgaggcgaagttgtaaaacatgaaatctttgatagtgtaatacattcaaactacagaatgacatatgatgcagttaacaaaattatcactgatcaagattctgaaatacgttcacaatataaagatttaacacctatgttagatttagcgcaagatttatcaaatagattaattcatatgcgcaaacgtcgtggagaaattgattttgatattaatgaagcgaaagtacttgtgaatgacgaaggtattccaacagaagtgctaatgagagaacgtggcgaaggagaacgtttaattgaatcattcatgttagcagccaatgaaacagtagctgaacacttcaataaattggaagtaccatttatttatcgtgttcatgaacaaccaaaatctgaccgattaagacagttcttcgactttattaccaatttcggtattatgataaaaggtacaggtgaagatattcatccaacaacattacaaagcattcaagaagaagttgaaggtagaccagaacaaatggttatttcaacgatgatgttacgttctatgcaacaagcacattatgatgatgttaatttaggacattttggtttgtctgctgagtactatactcactttacgtctccaatacgccgttatcctgatttaacagtgcatagattaattcgtaaatatttaatagagaattctatggataaaaaagaaatacgtcattgggaagagacgttgccagaattagctgagcacacatcacaacgtgaacgccgtgccattgaagccgaacgtgatactgatgaattgaaaaaagctgagtatatgattcaacatattggtgatgaatttgaaggtatcattagctcggttgctaattttggtatgtttatagaattacctaatactattgagggtatggttcatatcgctaatatgacagacgattattatcattttgatgaacgacaaatggcactaatcggtgaacgtcaagcaaaggtctttcgcattggtgatacggtcaaagttaaagtgacacatgttgatgtggaagaacgcatgatagatttccaaattgttggcatgccattacctaaaaagacatcatcacaacgacctgctcgtgagaaaaccattcaagctaaaacacgtggcaagtcgttagaccacactaaaagtgatcgtaatggtaaaggtaaaaagaaaaaacgtaagcaacgtaaaggtaaaaatgcacgtaaaaaagataaacaaggtaatacgcatcacaaacctttttataaagataaaagtgtgaagaagaaatcgcgtcgaaagaaaaaatag

SEQ ID NO: 2748 - DNA, 525 bp, Staphylococcus epidermidis
caaaacaggagtgttgatatgacacatctcattcgtgaaattagtattaaagacgttgaaaactttatcagcctattaagccaaatatatgatgaatcagaatttacattctacaatccaggtgaatatttaccaacgatatcttccgcaagtcaacacttagaaaaatacatcacctcacctaccaaagcaatatatgtcgctgaaagtgatgagcaacttgttggatacgtatttgttaatactgaaacttatgaacgtacacagcacgaagctgtggtgtaccttggtgttagagaatattaccaacatcaaggtattggacaagcacttatcaatagaattgaagcatgggctttaaatcatcatattcgacgtattgaagctacggttgttactgaaaacattaacgcaatagaattgtttaaaggcatgggctttcaaatcgaaggtgaacttaaagataagctttttataaaccaaaaatattataacgaatatgtaatggctaaaatattaaattaa

SEQ ID NO: 2749 - DNA, 210 bp, Staphylococcus epidermidis
  unsure (174): Identity of nucleotide at the above locations are unknown.
aatgtgtttggaactaataatagaaatatgagtccgaaaacaataaataagggccattcaaaagctttgactggtttgaacaattttaaaagtagacaaagttcaaatggcacgtatgctaaaaataaatttaacgtcataaagttaaaaatatgtgattcagtcatagatatnacaaataagataataaagtatattcttgcaaagtaa

SEQ ID NO: 2750 - DNA, 663 bp, Staphylococcus epidermidis
attgtaggtggcaaaaataagatggataaatccataattactattaaacaagcacattcaattgaaaatgtgataagtaaatcacgctttatagcatatattaagcctgtttcgactgaaaatgaagcaaaagcttttatagatgaaattaaaacaaaacataaagatgcaactcataattgttcagcctatactgtcggaccagagatgaatattcaaaaggcaaacgacgatggcgaaccaagtggaacagctggcatcccaatgcttgaaatactgaaaaaacaagagatacacaatgtttgtgtcgtcgtgacacgctacttcggtggtatcaagttaggtgcaggcggtcttattagagcatatagcggcgccgtgcgtgatgtgatatatgatataggtagagtcgaactaagagaagctattccagtaaccgttacgttagattatgatcagacaggtaaatttgaatatgaacttgcctctactacattcttattaagagaacaattttataccgataaagtaagttatcaaattgacgtagtaaaaaatgaatatgatgcttttatagactttttaaatcgaattacttctggaaattatgatttgaaacaagaagaccttaaactattaccttttgatattgaaaccaattaa

SEQ ID NO: 2751 - DNA, 1065 bp, Staphylococcus epidermidis
atcaaattagggggtctctttgacttagaaaataaagagacgaacatacaagagtatgaagaaatgatgactgatcctgatttttggaatgatcaaactaaagcacaagatatcattgataagaacaatgcactaaaatctatagtaaatgggtattatcaactgacaaatgctgtcgatgatatgagtgcgacgagagagttattacaagaagaatatgatgaggatatgaagatagaattagaagaggaagttcagcaatttgaagaacaaattgatcaatatgagttacaattactcctcgacggaccacatgatgcaaataatgctatattagagcttcatcccggtgctggcggtacagaatcacaagattgggtaagtatgcttcttaggatgtatcaacgttactgtgaacaaaatggctttaaagttgaaacggttgattatcttccaggagatgaagcaggcgttaaaagtgtcacattacttattaaaggacataatgcttatggttatttaaaggcagaaaaaggtgttcatcgtttagttagaatttcacctttcgattcatctggtagacgccatacttcttttgcatcatgtgatgttattcctgattttaataatgatgaaattgaaatcgagattaacccagatgatatcacagtggatacttttagagcttcaggcgctggtggacaacatattaacaaaactgagtctgcaattagaattacacatcaccctacaggtattgtagtcaacaaccaaaatgaacgatctcaaataaaaaatagagaagctgcaatgaaaatgttgaagtccaaactttatcaattaaagttagaagagcaagagcaagaaatggctgaaattcgaggcgaacaaaaagacattggatggggaagtcagattcgttcttacgtctttcatccatattcaatgattaaagatcatcgtacgaatgaagaaactggtaaagtagacgctgttatggatggagaaataggcccattcatagaagcttatttaagaaaagaaatggatagtcgagacgtataa

SEQ ID NO: 2752 - DNA, 696 bp, Staphylococcus epidermidis
caattaaaaggggatggattgatgcgtaaatgtatccagtgcaatcaacctattcatgagaccattcatatttataacttatttaaaccacctcagatattttgtgaacgatgtgaaacattatggcttaactccaaaattcataaagatggtaggtgtcctaagtgccttaacaacaaaatttctactgatggcgaatgtcatgactgtcaattcttaagtaaaacattttatttaatggaacaattgttttgtgattatagttatgatggtatgatgaaagaaatcatacaccagtataagattaagcgagacttctatttggcagaagtattggcgagaaaattagttttacctcaaacgcaatatgattatatagttcccattccttctccaattgaacgcgacattgaacgtacatttaatcctgtgaccactgtcttagataaaatgggcatctcatatcaagatgtattaggtacacatatacgtcctaagcagtcaaagttaggaaagattgaacgttcaaaagcccctaatccattttatataaaagatgaagagataaatatcgaagggaaagtaatactactcatagatgatatttatacaacagggttaactattcatcacgcagggtgtaaattgtacgataaaaaagtcagaaaattcaaagtgtttgcgtttgcacgataa

SEQ ID NO: 2753 - DNA, 681 bp, Staphylococcus epidermidis
tatagaaaaggagttattataatgtcacaatcgacacaccaatcaactgatcataaaagacaatctcaagataagaaccaaacacatgcctatgcaaaagtttggttatattttatgtattattggatgatttttgggattggttgttattttggacaatatcttcctatgtcatggagaaaaccattgtctctaggattgttaattctgatattagcaacgttgtttattaaacgtgcgcgaaaatatggattagtgatctctcatatatacgctattattgtaggtttgctttcgtatgctctttttacgacttacttacaaaatttaggagcagaagtattctataaaaatattattcttgctattggtgcatttatagcttttggtattataggttactttttaataaaagacgcttcgagtatgggaaaatatttgtttgtgacattaattgcgctaattatagctgggattatagggatatttattaataatccaatttttcatactgtcattacaatagtgagcttattattgtttctcctttatactttatacgattttaatagaatgaaaagaggtcaattctcaccaagagaaatgggatttaatttgtttatcaacttattaaatatcatcgaagatatacttagtttagcaaatcgctttaaaaactaa

SEQ ID NO: 2754 - DNA, 204 bp, Staphylococcus epidermidis
cgcttgagaggttcatccactttaataatatctttaggaagaattgactctaatccgcgtaagatgtcatttttattcaatgttttgaacatcctttctcatcttcttaatatcaacattattatatcaattataaaagttatttgcgaaatttggatatatgaattgattataaatataaaatggttatgtcgtactttatga

SEQ ID NO: 2755 - DNA, 795 bp, Staphylococcus epidermidis
ctaaagggaggtgccaagatgaataaaattcaaatttgtaatcagattgaacttaactatattgatgaaggcgaaggcatccccatcattttaattcatggattagatggaaacttggcaggatttaaagatttaaaaaatgaactcaagaagcagtatagagtaattacttatgatgtcagaggtcatggaaaatcttcacgaacagaatcatatgaattaaaagatcatgttgaagatttaaatgatttaatgggagcattaaatatcgattctgcacatattttaggacatgatatggggggcatcattgcgagtgaatttactgaaaaatatcaatataaagtgattacattgacaattgtttcggccaaaagtgaagacattgcaaatggtttcaacaaattaatggttgattaccaagaagaattagcaggctttaataaatctgaggcaatgattattttattctctaaattatttaaagagaaagataaagcaatgaaatggtatcaaagccaaaaattatacaatagaccaactccggaagaaagtgcaattgcagtacgtgcattgcttaatattaaagatttaactcgtgttcatcataatgtgtccatacctactttaattgtgaatggtaagtatgacccactcatacaaaataaaagtcattatgatatggatcaatattatgatcaagttacaaaaattgtatttgataattcaggacatgcaccacatatcgaggaaccagaaaaattcctgaaactctacttagattttgttagttaa

SEQ ID NO: 2756 - DNA, 777 bp, Staphylococcus epidermidis
attaggggaggtatagcagtgatatcagaaaaacgacagaatttaattttacaagaattaactcaaaaggactttttaacacttcaagatttagttgatagaacaggatgtagtgcatcaactatacgaagagatttatctaagttgcagaatatgggtaaattacaacgagtacatggtggtgctacaattcatcaaaatcgagttaaggaacctaagttatctgaaaaaagaactcagaatttacgtgaaaaacaagaaatcgctaaacgtgctgcatgtgatatccaagatcatgaatgtatatttctagatgcgggttcctcaacttttgagttaattcaatatattgaggcaaaagatattactgttgtaacaaacggaatgacacatgttgaagaactattaaagcacggtattaaaactttaatggttggtggccaagttaaacctacgacaatggctacagttggtgctaacgcgttagaaacattaagacgttattgttttgatcgtgcttttataggaatgaacggtattgatgtgaaatatggattaacaacccctgatgaacaagaagctttgattaaagaaacagctatgaaactatcaaatcacaaatatgtgcttgtcgatcaatcaaagtttaatcaaatttattttgcaagagttccaattttagatggacttagcatcataacttcgcaaaaagcaatgcaaagcaagatgactgaagcttacatgaatgaatttaattttataggagggaaatcatga

SEQ ID NO: 2757 - DNA, 1182 bp, Staphylococcus epidermidis
aaaaaaaggggggttcctatgaaaaaacaattattcattctttattttaatatatttcttatatttttagggattggattagttattcctgtacttcctgtatatttgaaggatttaggattaaaaggtagtgacttaggaatgctagttgctgcttttgcattatcacaaatgattatttcaccatttggtgggacactagctgataaattgggtaaaaaattaattatatgtatcggtttagtattctttgctgtctctgaatttatgttcgcagccggtcaaagttttaccattttaatcatttcacgtgttttaggtggctttagtgcaggcatggtcatgcctggtgtaacaggtatgattgcagatatttctccaggagctgataaagctaaaaactttggttacatgtcggcaattattaattcaggttttatattaggacctggatttggaggctttttagctgaaatttcacatagattacctttctatgttgctggaacattaggtgttgttgcattcattatgtcagttttattaattcataatcctcaaaaagcaactacagatggattccaccaatatcaacctgaattattcactaaaattaattggaaagtatttattactccagtcatattaacacttgtattagcatttggtttatctgcttttgaaacattattttctttatatacagctgacaaagtaaattatactcctaaagatatttcgatagctattatcggtggaggcgtgtttggcgcattattccaagtattcttctttgataaatttatgaaatatatgagtgaacttaattttattgcatggtcattactatattcagccattgttctcgttatgttagtgcttgcaaacggttattggacgattatgattattagctttgttgtttttataggttttgatatgattagaccagctttaaccaattacttctcgaatatagcaggcaaacggcaaggttttgcaggtggattgaattcaacttttaccagtatgggtaactttataggtcctcttgtagctggtgcattattcgatgttaatttagagtttcctttatatatggctattgcggtttcattaagtggaattatcattatttttattgaaaaaggacttaagtcacgccgtaaagaagcaaattaa

SEQ ID NO: 2758 - DNA, 456 bp, Staphylococcus epidermidis
agaattttcttgcattttatttttttcttcaccagaattatggtacttaggacttctttttttaaattcctcaaattccttcatttcttcctcattcatgtcattaaatcgattgatcacttcacctgtacttttgtttactacagcacaaaattttataggagttccggctgcatctcttacaaggtgttcaacataatattcattagcattgcttctatctatatttgttttaaattcaagaacttgttgcttattaatccctttattaatgtaatagttcgagacaatttgttctgcttcttgagcggaaatttgtttttgagctgttttttgtttttgattactattagaatttgttacgctcccattagtttgcatattatccgttttattttgttcttcttttggattgctttctgttttttttacattttcttgtccacatgctgttaa

SEQ ID NO: 2759 - DNA, 930 bp, Staphylococcus epidermidis
atcactttcttaactcactgtgttatatttattttcaacaaaatcttctattcactttacactaggttaataaatttaacaactgatgtgttgtatattataatctatataaatgtttataaggaaggtacaaaaatgagcgtttcggtaaatattgaaaatttaacaaaagaataccgtatctatagaaataataaagatagaattaaagatgcattaatacctaaaaacaaaaataaaacattttacgctctggataacgtaagtttaacagcgcatgagggagatgtgataggtttagtcggcatcaacggttcaggtaagtctactttaagtaatatgattggtggctctatttcaccaagttccggtgaaataacgagacatggtgatgtgagtgtcatcgctattaatgcaggactaaatggacaattgacaggtgtagaaaatattgaatttaaaatgctctgcatgggctttaaaaggaaagaaattaaaaaattaatgccggaaattatagaatttagtgaactcggcgaatttatttatcaacctgttaaaaaatattcaagtggtatgcgtgcaaaacttggattttcaattaatattactgttaatcctgacatattagttattgacgaagcattatcagtaggcgatcaaacatttactcaaaaatgtttagataaaatttatgaatttaaagcggctaaaaaaacaatattttttgttagtcataatattagacaagtgcgtgaattttgtacaaaaatcgcttggattgagggcggtaaactaaaagaattcggcgaacttgaagaagtattacctgattatgaggcgtttcttaaaacttttaagaaaaaatctaaagcagaacaaaaggaatttagaaataaattagatgagtcacgttttgtcgtaaaataa

SEQ ID NO: 2760 - DNA, 1368 bp, Staphylococcus epidermidis
aattcacttatgatattatcatctttgttatataactcatataaagaatggtggaaatttatgagcaaagtaaataaacctttatatttctatcttatgttatttctgttgacaactttaattggtgcttttctactctatttgccctatacagggaagaaacccattaactttattgacgcattgtttgtagcttctagcgcattcacagtaacaggtctatcaccagttgatgttggaacacaatttaatatttttggagaaatcattatcttattacttatacaaattggtggattaggtattgtcactgtagcaatgctaactctcatctttttaaataagaaaatatcaattaacaatagaattttatttatgattacttggaatattgacgaacccggtggtgtaattaaacttattaaacatctagccatatacagcatcgccactgaattatttggtacactttgtctatgtttatcgtttattccaaaatttggcataggtaaaggtctatttttaagtttattcacttcagtttccgcatttaacaacgcaggattcgccctttttaaaaacaacttaatcgatttttcaaatgatccggtaatcattatcactattccaatacttatcattttgggaggtttgggacatttagtcgtggttgatttgtggaacgccaaaagttttagaaaattatccttacactctaaactcgtgttaactaccactggattattaattttgataggcacggttttcttctttttactagaaaatcaaaactctatgttacacatgggattaattgaaaaaataggaaatgcatttttccaatcagtgacaacaaggactgcaggatttaacacaattgacgttggaaacattaaaacaccgacagctttattacttatggctctcatgtttattggaggtgcaccattgagtgctgcaggtggtataaaggttacaacttttgttattgcaacaatcgctatttttaatacgatacgcaaagaaaaaaacaactctatatttaatagagaaatatcagaaagatacatacagttgtctttcgtaactattctcatttctattgcatttatcggtatggttacgtttatacttaccataatcaattccaatatacctttaatcaaaatactcttcgaagtcgtatcagcattcggtacagtcggtctcactatggatttaacttccgaatactataattggactgagtttattattatcatcgtaatgttatgtggtaaaattggattactgaatattagtagagcgcttgttccacctaaagaccctaaaaattatagatataccaaaggacacattcacttataa

SEQ ID NO: 2761 - DNA, 726 bp, Staphylococcus epidermidis
gatgacattatgggacgtaaatggaacaacattaaagagaaaaaagcccaaaaagataaaaatactagtagaatatatgccaaatttggtaaagaaatatatgtagctgcaaagtctggtgagcctaatccagagtcaaatcaaactttaagattagtattagaacgtgcaaaaacatattcagtacctaatcatattatagatagagctattgataaggctaaaggcgctggtgacgaaaactacgatcacttaagatatgaaggttttggtccgaatggttcaatgcttatagttgacgcattaacaaacaatgtaaatcgtacagcatcagatgtacgtgctgcgttcggtaagaatggaggaaatatgggagtatctggttcagtagcttatatgtttgaccatactgcaacctttggtgtagaaggtaaatctgtagatgaagtcttagaaacactaatggagcaagatattgatgtaagagatgtaattgatgacaatggcttgactattgtttacgcagaaccagatcaatttgcacaagttcaggatgcattacgtgaagctggcgttgaggaatttaaagtagcagagtttgaaatgttacctcaaactgatattgagttgtctgaagaggatcaagctatttttgaaaaattaatcgatgcacttgaagacttggaagatgttcaaaatgttttccataatgtagatttaaaataa

SEQ ID NO: 2762 - DNA, 507 bp, Staphylococcus epidermidis
atgattgttataaagggtgagaatatgtctaaaactaaaaaaacaaatgcaatgcggattttagatagagctaaaattaattatcaaatgaatacttacgaagttactgacaagcatcaacatggagaagagattgcacaactcgtaggtgctaaaatagaagaagtctttaaaacacttgtactagagaattccaatcatgaacactatgtttttgtcattccagttaatgaaaccttagatatgaagaaggcggctcatgttgttaatgaaaagaaattgaatttaatgcctctcgatcaattaaaacaagtaacagggtatgttagaggaggatgttcacctatcggtatgaaacattcctttaaaacgacgattgatgcttccgctaaaaatttagaaaaagtttatattagcggaggtcaaagaggaatgcaaattatcattcatgtgaatgatttaattgacatgacaaaggctcaggtagaatctattacacagaattaa

SEQ ID NO: 2763 - DNA, 627 bp, Staphylococcus epidermidis
  unsure (57): Identity of nucleotide at the above locations are unknown.
tgcgtggttatgcaatctcgttactttgcaagaatatactttattatcttatttgtnatatctatgactgaatcacatatttttaactttatgacgttaaatttatttttagcatacgtgccatttgaactttgtctacttttaaaattgttcaaaccagtcaaagcttttgaatggcccttatttattgttttcggactcatatttctattattagttccaaacacattttatatgattaccgatctcatacacttaaaccaatttcaatttaactttttagctggattaaacatcacagaatggatttatttcacctatttaatacttggcgtactcttagcaatatacctcacaattcttatatttttagaaattgcacattttacgtcttatgtatggttaaatcgactattgatagttatattaatgttcttaaatggattaggtatttacatcggtcgattcttaagattacatactgtctatttattaaatgcacctttaaaaattgtgaaagaggtttttttaatcatagatgttaaagcgttactatttgtcgttttaatggtgctcatacaagcaacagtcatattgtttattaaaggggtgagattataccaatga

SEQ ID NO: 2764 - DNA, 240 bp, Staphylococcus epidermidis
ggaggaatttttatgattacaaaagaagatattgttgcagatgttgtaacagattatcctaaaagtgcagatatatttagaaatgctggaatagatttttgttgtggcggacaagagagtatcgcttcagctgtcaatcataaaccaaatattgacttaaattccttattaaataagttgaatcatattgataatacagaaggtaacagtaccattaatcctggaacttttaaatggtga

SEQ ID NO: 2765 - DNA, 909 bp, Staphylococcus epidermidis
ggtgaaactatgaaacgctatttaattactggtggaactggcatggtcggttcccacttggtcaacgaaattaaacaaaccgatgcacatattacaattttaaccagacaggataaaacttctaatcatcccaaaatcacgtatatcaactggtcaaaagagggttggcaacatcaagtaccagatatagatattgttattaatctagctggtgcaacgttgaataaacgttggacatcttcccacaaacaagcgatgatgcttagtcgtattcaatcaacgcaaacactatttgaactttttgaaacacgtgaacacaaaccagaagttttatttaacgcaagtgcaatgggctactaccctccagatttatttacaagttatacggaattatatcgaacacttccatttgatttcttatcagaaattgtatatcaatgggaacggtttgcgaataaatttaagcaattcggtacacgtgtcgttttaggtcgattcggtcttattctatcagacgatggtggtgctcttgaaatgatggaacttccgtatcgtttatatgttgggggaaaactcggctctggaagacaatggtactcttggattcatatcgatgacttaattagaggtattttatttactatcaatcatgataacgctgaaggtccatttaatttaactgcacctattcctgaaagacaaaacttatttggttatactttagcacgtgcgatgcataaaccacatgaaacgtgggcacctaaattgatactacgtgcagtgctaggtcagatgtctactgtcatattagatacacaaaaagtacttccaaataaattacatgcactaggttttgagtttaagtataataatttaagaaatgctttagatgatttaattaaagcttaa

SEQ ID NO: 2766 - DNA, 864 bp, Staphylococcus epidermidis
ggggacgctatgaaaatagatgattatcgtttgctcattactttagatgagacaaaaactttacgcaaagcagcagaaattctatatatttctcaacctgcagttactcaacgtttaaaggcaattgaggctgcatttggagttgagatttttattcgtacaaaaaaacagctcattactacgactgaaggttcaatgattattgaacatgcgcgtgatatgctcaaacgtgaacgtttattttttgataaaatacaagcacatattggtgaagtgaacggtacaatttcaatcggttgctcttcgcttattggacaaacattgcttcctgaagtattaagtctttataattcgcaatttcccaatgtggagatacaggttcaagtaggatctactgaacaaataaaagcgcatcatcgagactaccatgtgatgattacacgtggaaataaagtaatgaatttatcgaatacacatttatttaatgatgaacattattttatatatcctaaggatcgtaaggaagatgtaactaaactgccttttattgaatttcaagcggatccaatttatattaaccaaattaaacaatggtataacgatcatttgggacatgattatcacgcgacaatcacagttgatcaagttgccacatgtaaagaaatgttgcttagtggtgtaggggtaactatactaccaaaaattatgatgaaaaatatcgataagaacatgtttgaatttgaaaaagtcactattgataaaaagccacttattcggtcaacatacatgagttatgacgcaagtatgctacaacttcctcaagtagacgcattcgtaaatttaatgttgaactttattagataa

SEQ ID NO: 2767 - DNA, 201 bp, Staphylococcus epidermidis
cctctgtatattctctctctaccaggcgacgccagtgacgtttgtctatatattttactttcacagtcaccaactccttgcttttattatattaaactaggatgtcaatgtcatcttaagtctcagataaatactgtttacataaatgttcttattaaatcattaagactattttactataaattgatttattttacttaa

SEQ ID NO: 2768 - DNA, 894 bp, Staphylococcus epidermidis
tcatataatattgaggcgatgatattgaattcaaaagttaaaggtattattgctatattgatttcagctgtgggttttagttttatgtcagtcttttttagattggccggtgatttaccagtctttcaaaaatctctagctagaaattttgtagccatgtttataccattattttttatttataaatataggcaacctatgtttggaaaattaagtagtcaacccctactcatctcacgttcaacacttgggttaattggtgtcttacttaatatctacgcaattgatcacatggtattaagtgatgctgatacattaatgaaattaaatcctttttggacaattgttcttagtttaatttttttacatgaaaaggtacgaaaatatcaaatcacggcgatgattattgctataatagggatgctattaattgttaaaccagaattttcatcatcagttattccttcaatagcaggattactatccggtatttttgcagcttctgcctacacatgtgttagagcactcagcactcgtgaaaaaccttatacgatagtgttttatttttcattattctcagttgtagttcttatacctttttcaatatttacttatacacctatgacaacaattcaaattcttttcttactcggcgctggattatcagcagctgtaggacaaattggtataacattggcttatagttttgctccagcaaaagatatctccatcttcacatatgcgtctataatatttactgcattatttggatttattctgtttggagaatcacctgatatgtttgcaacagtaggatatattgtcattatcggagcaagttactatatgtttgataaagcaagacgtgaaacaactataaatcaaaataattaa

SEQ ID NO: 2769 - DNA, 354 bp, Staphylococcus epidermidis
gggggtaatatgcgtagtgtaattaagttggaaaatacatttatattcataatcacaatcgccgtttatgttaaattagaattttctatatggctgtttttacttttactattagttccagatatatttatgttaggatatgtgattaatagaaaaacagggagttatgtctacaatattggacacacgtatatcacacctataattatcgcgctattatatttatacattgatgaaaggttactattacagatttctttaatatggttagctcatattagtatagatagaactttaggtttcggactcaaatattcatcagatactgataaaacgataatacaaaagatgtaa

SEQ ID NO: 2770 - DNA, 1161 bp, Staphylococcus epidermidis
gggttaaatatgcacattgaatttaagtatcgctattatgaaaatgaaaaggactatgaagactatcaattagaaatggataactttcaagattctaaaattgcatatcgtcttgatgaagtaggggatgtcattcactttgcagaacaagaacaacgtaacggaagctatgttgcactttatgttacttatgaagcagcacctttttttaataaggaaatggtggtcaataatgtgaaacaatcccatatttttgctgcagcttattcatttaaatcggtcaattcgataaaaaatataaaaaaagtaatgcccaataaaaatcatataaaaactgaaggattttatttttgtgaaagtgataaagcgatgattaacaagatcaaatcgattcataaagccattattgaaggggcaacgtatcaggtgaattacacaacccgcttaaaagcagaagttttctgtcctataagtcacttatattatcaacttactatgtcacaaaatggtaattataccgttttaatggacacacctgatataaaagtagcatcaatatcgcctgaacttttctttcaaaaaggtgactataaaggtaaatcaaatatgattgttagtaagccgatgaaagggactatgcctagagggaaaaatgttaaagaagatgagctatattataataatttaaaaacctcctctaaagatatggcggagaatgtgatgattgtagacttattacgtaacgatattacaagaattgctcaaagtggaactatagatgtacctgaattgttttcgattgagaaatatgacacagttttccaaatgaccagtacagtgtgtggccgattacaagatgacattcaattgatagatatgatgcgagcgctctttccttgtggttctattacaggtgcaccaaaaataaatacaatgcaatatatagctcagttggaggacatgccaagatccatttactgtggaacaattggcttattacttccaaaccaaaggatgatatttaatatccctatacggacaattgagtataatcatgaagaagcggtttatggggtgggtgctggtataacaattgattcagtacccgaaaatgaagttcaggaatttcacgataaaactaaaattttggagcggttataa

SEQ ID NO: 2771 - DNA, 597 bp, Staphylococcus epidermidis
ggtatgaatatgattttaatgatagataatcaagattcctttacatgtaacttaatagattatattaaagtacaaactactgaagaagtgaaaatcatttctgtaaatgatttgatgacacagcatctcgatgcattgaatccgagagcgattgtcatttcacctggacctgggaaacctagtgattatccaatactatcatccgtattagaaatatttcaccgtcacgttcccattttgggcgtctgtttaggttttcaattaatcattgaatactttggaggaaacattattcataatgataaacctattcatggacatattaccaagataaggcatagcaatgagggtatttttaaaggtctaccatcgtattttaacgtgatgcgataccattcacttatggctgacccctctacaatacctagcgcattaaaagtcacagctctgaacaacgagaatgttattatggctgttgcacatcataagtatcctatttatggtttacagtatcatcctgaatctatactaagtgaatatggtcacgaacaattaaatttattcttaaccgaggtaggggttaaatatgcacattga

SEQ ID NO: 2772 - DNA, 405 bp, Staphylococcus epidermidis
gataatgatatatgcgttgtctacttatatttggaggtgcagattttgaatgagcagaaattaattaaattactagaattttacaaacaatataaagcattatctggatatatagataaaaaatataagttgacgttaaacgatcttgctgtactatatttagctaaaatatattgcttagatgagcgaattcttatgcaaacttttctaaaactggctacaggagagttagatattagtagaactaagattttgatgtctattagaagattgatagacaaagaaaagttaaataaagtaagatcgaatagagatgaaagaaaaatttttctatatatggatgaaaataatatgagtgaatttgatgctttatttgaagatgttgaaaaattcttaagttattaa

SEQ ID NO: 2773 - DNA, 744 bp, Staphylococcus epidermidis
cgaggtgatattatgaaaatatatagtcaaggcgaccaagccattgttgtttcaatagagaaaaatgtatctcaaagactgacagaagatttactttcattgagagcatatttaattgataaatcatatccatttattactgaaattgtagctacagagtctgacctaatgatttgttatgacgcaagagatatgattaaacatcaccatattcagtcaccatttttatatatgaaagctttaattgattctataaaattagaaattagacatcatcgacaacaacttcaagcaaaatatattcaaaaacaacaatctgttaatattccagttatatatgggggagaatttgggcctgatttacaacatttgttaaagcatcttaaactcaaattagaggattttgtaaaattacatactcaagaaaaatattttgtatcaatgatggggtattcaccaggatttccgtatcttactggaatgaataaaaaattgcatgtgaaccacacaagtgaaaagaaaaaattcatcccttgtggatcagttattatggaaggaaaaaaatgtggaatagttactactgatacatataatgattggttagttatcggatatacaccagttcaacttttctttcctgagcaacaaaactttacattattaaagctaggagacaatgtcacgtttgagtctaaagatatcaatgaaatagaactaggagattataaaacatgtcaatcataa

SEQ ID NO: 2774 - DNA, 1743 bp, Staphylococcus epidermidis
agacgaggtataactatgaaagaacaaaaccctttgtttttcttatttaaaagactctcatggccatatgggttaatcattgcagcggttatcattacttcgttgggaagtttaagtggtttattagtaccattattcaccgggcgtttagttgataaattttccgtcagtagtattaattggggaatgatagctatatttggctcgattttcttagttaatgcattgcttagcggtataggcctatatttgttaagtaaaattggtgaaaagattatttatgcgattcgttcattattgtgggaacatattattcaattaaaaatgccgttctttgataaaaatgaaagtggccaattaatgagtcgtctaacagatgatacaaaagtgattaatgaatttatttcacaaaagctacctaatttattgccttctgttttaactttaataggttcattagtcatgctatttatcatggattggaaattaactttattaacatttattactattcctgtatttattttaatcatcgttcctttgggacgtgtgatgcaaaaaatatctaccaatacgcaatctgaaattgcgaacttcagtggattattaggtagagtgcttaccgaaatgcgtttagttaaagtatctaatactgagcgtttagagttagataatgcgcatacaaatcttaaaaaaatatatagattaggattaaaacaggctaaaatatcagcagtcgtacagcccatttctggtgttgttatgctattaactattgcgattattttaggttttggtgcattagaaataggtactggagcaattactcctggaacacttatagctatgatattttatgtaatccagttatctatgccactgattaacttatcgacactagttacggattataaaaaagctgtgggtgcgagcagtcgtatatatgaaattatgcaagagcctattgaacctactgaagctttatcagaatctaaagacgttacgatcatcgacggcgaattagtatttgagcacgtggattttaaatatgacgttaaaaagattttggaagatgtgtcatttagtattccacaaggtgaagtgagcgcgtttgtaggaccttctggttcaggtaaaagtacgatttttaatttaattgagcgcatgtatgatattgaacgtggagatattaaatacggtaatcaaagtatttttgatattccactttcaaagtggcgcacaaaaattggttatgttatgcaatctaattcgatgatgagtggaacgataagagataatattttatatggtattaatagaaaagttgatgatgaagagttaatagagtatgctaaactagctaattgtcatgattttattatgcagtttgacgaaggttacgacacgatggttggtgagcgtggactcaaattatcaggtggtcaacgacaaaggatagatatcgctagaagttttgttaaaaatcctgatattttgttattagacgaggcgacagcgaacctagatagcgaaagtgaattgaaaattcaagaagcacttgaaacacttatggaaggcagaactactgtagtcattgctcatcgactttcaactataaaaaaagctggtcaaattgtatttattgataaaggtgaagttaccggtaagggaacgcatcatgaattgatggcaagtcatgataaatacagacattttgttacatctcaaaaattatcagattaa

SEQ ID NO: 2775 - DNA, 834 bp, Staphylococcus epidermidis
agcaagattttagagaatgaaagtaggggaattattatgagtcgtttaagtggtgaacaagtgaaaattggctacggtgattctacgattattaataatttggatgtcgcaattcctgatggaaaggttacttctattattggacctaacgggtgtgggaaatcaactttattgaaagcgttatctagactattgtcaattaaagaaggtaaaattaatttggatggtaagagtattcatgccacatccacgaaagaaatagctaaaaaaatagcaattttaccacaatcaccagaggtcccagatggacttactgtaggagaacttgtttcttatgggcgttttccacatcaaaaaggatttggtcgtttaactgcagaagataaaaaagaaattgattgggcattgtcagttacaggtacaagtgaatttcgtcatcgtactataaatgatttaagtggtggacaaagacaacgcgtgtggattgcaatggcactagcccaacgtactgatattattttcttagatgaacctacaacttatttagatatttgtcatcaattagaaatattaaatttagtcaaaaagctcaacgaagaagaaggttgcactattgtgatggttttacatgacattaatcaagcaattcgcttctcagatcatctcattacgatgaaagctggagatattgttgctactggtcaaactgatgaagtgttaactaaggacattttagaaaaggtatttaatattgatggtgttttagatatagatccgagaacagggaaaccaattttagttacttacgatttattctgtcagacgtattcgtga

SEQ ID NO: 2776 - DNA, 456 bp, Staphylococcus epidermidis
aacattatcttgaacataaaggagaagaataaggaaatgcaacaaatatatccaagtgtcactcacccatatcaattcgaacttaacaaagattttaacttttcagctgcacattacattccctttgaagaagcgggaaaatgtattcgtacacacggtcatacgtattacgtcaacttaacaatcgctggtaatacactagataaatgtggatttttagttaattttagagatttaaaaaagctagttcatgaacaatttgaccattatttgcttaatgacttacctgcttttaaggataaaagtccctcaacagaaattgtcgcacaaacgatttaccacattattcaaaaagagttaaatcaaagagagaatcaaccgaaatgtgttcaagtttatcttagagaaacaccttcaagttacgtagtttatagaccaaaggaagatcaagtgtaa

SEQ ID NO: 2777 - DNA, 447 bp, Staphylococcus epidermidis
ttaactatctttaaatttaaaaagatgggttttaagatttatggatatgatataaatagggaggtttcattaatggctatttcaaaaatcaatgactgctttgaattattagctatggtcacttatgctgacagattaaaaggaataattaaaaaagaattctcaatcagctttgaagaatttgcagtattaacttatattagtgagaataaagaagaggaatattatcttaaagatattatcaatcacttaaattataaacaacctcaagttgttaaagctgttaaaaatttatctcaagaaaattactttaataaaaaacgtaatgaacacgatgaaagaactgttttaatcttagtagattctaagcagcgtaaaaaaatcgatgatttacttaaacgagtaaacaaccgtatcacagaagcaaataatgaaaatgaagtataa

SEQ ID NO: 2778 - DNA, 216 bp, Staphylococcus epidermidis
ttaaaaatcttaaaagtaaattaccaagcaaataatccaacaaatgcagcagtaagtaaggatactaaaattcctgctaacaacatcatcggtacatatttggaaacgaaatccgacgttttcttatcaacaatacctttcaatgtacctataatcattccaatagttgaaaagtttgcaaaagaaactaaaaatgttgatataactgctctatga

SEQ ID NO: 2779 - DNA, 240 bp, Staphylococcus epidermidis
ggaggatacatcagtatgtcaaaaactttggaactcgtatttaaatcaaatcttaataaacccgtcaaattactattacccgattttaacgctattactacagaacaattaattaaagaaagtatgaaccaacttttagaattagacattttaagatttagtttgggaaagcctgtcaaaatttatgctgcacaacttattgataaaagtacaactgttatatttgaagataaaaattaa

SEQ ID NO: 2780 - DNA, 609 bp, Staphylococcus epidermidis
gagttcaacatgattatatatatattaattaacatcgccatcgtcttgctaattcttggcttcgatttataccgacatcgtttcagacagcttaagtttagctccatattattatctgttttaatcaatagcatgattgatatttttgcgattaatcaattcaattttattacgatgtttaccgtcacgctatttatgatatggacacttttacaaatatatttaaatttcaagctatatccttttgtaatttctgaccaaaagtttattgctataatactagccattgttataagcttattgcaatttattacagataaatcgagcacacaatcggtgtacatgtccatcccatatttatcacccacgatatttataataggggcgattttactttttgtaggtactttcaaaatagacgaagttgaacgtctttcactatttcgtaaaattaaaagaccaatgacaacaggtacaattattattatcctatctctcatatcaacgatgattttaacgcccttttggtatgtctttttaatcatttatagcttactcattggttttatattatggcaaggtgttttcttcataaaagataaaaaataa

SEQ ID NO: 2781 - DNA, 1080 bp, Staphylococcus epidermidis
ttttatgacatattaaaaaaattgagttataaaaagttagagaagttacaaacgaatactcatttaagttatttaaatgggattaagggtataataactttaaaattaaacagacgtatccacgcctggaggagagacatggaaaataaacctgattattttcaccacattgaacatagaaagtttcaaagtagctcaaaaattacattatggttatctttagttattactatgatattcactgtagttgagttcgtaggaggtattgtgtcgaattcactcgcgttactctctgactcatttcacatgctaagtgatgttctagcattaggtttatcaatggtagcgatttatttctcgagcaagccacctacaaagaactatacatatggttttttacgcttggaaattatcgtagcttttctcaatggcttagcacttattgttatttcactaggaattatgtatgagggtatcatgagaattatacaccctagacctgttgaaagtggcattatgattctaattgcgtttattggtttaattgccaatatcgtattgaccatcattttaatgatttctctaaaaaaagagaataatattaatattcaaagtgcattatggcattttattggtgatttattaaattctttaggtattattgtggcgtttgtgttgattcattttactggatggaacattgttgacccaattattagtattctcatttcattgattattttaagaggaggatacaaaattattaaaaatgcttcaaaagttctgatggagcgtgtgccggatcgatatgatacagatgaaattatgggagcaatgaaagatgttgaaggcgtgatagatattcatgaattccatttatggagtgttacaactaatcaaagttctttaagtgcacatgttgtactaagtgatgactacattaaatcgccttatgctacaataaataaagtttcggatttgttaaaaacacaatacggtttagaacatgtaacacttcaaattgaaaatataaacctcaatcatttagatgaggagtatttcaaacaacttcaagaatag

SEQ ID NO: 2782 - DNA, 1278 bp, Staphylococcus epidermidis
ttaagggacataatgaagaacacgcagaagatatgttatttctttagtgtcaaatcattgttacttagatttatagattattctcatacatcctttagtatgtttaaaataatttttggaaaagagaaaaataaggtggttaagacaatgaaagttttagtagccatggatgaatttaatggaattatttctagttaccaagctaatagatatgttgaagaagcggtagcaagtcaaattgaagatgcagatatcgttcaagttccactatttaacggtcgtcacgaattattagattcagtctttctttggcaatcaggaaataaatatcgtgtgagtgcgcatgatgctgacatgaaagaaaccgaagcaatatatggacaaacggatagtggtatgactattatcgaaggtcacttatttttaaatggcaaaaaacctattcaacatcgatcaagttacggtttgggagaggttataaaagcagcattggacaatcatacagaacatcttgttatttctttaggtggaataggaagttttgatggcggtgcaggcatgttgcaagcattgggtgcaacattttatgatgatgaagcacaaattgtcgatatgaggaaaggtgcatatttaataaaatatattagacgtattgatttatcaggtgttcatccacaattaacaaaggtaaacattcaattaatgtcagatttctcaagtcgattgtatgggaaaaaaagtgaaatcatgcaaacatacgaatcattagatttgtctcaaaatgaagcagccgagatagataatttaatttggtattttagtgaattatttaagaatgaattgaaaatagcaatgggaccaatcgagcgcggtggtgctggaggtggtatagcagctgtattaaatagtctctatcaagctgagattttaacaagccatgaattagtgaatcaaatcacacatttagaaaacttaattcaacaggcagatcttattattttcggagaaggtttgaaagaagaagatcaaattctagagactacaacaatacgtatagcagaacttacccaacaatacagcaagccagctattgcaatttgtgctacaaatgataaatttgatttgtttgaatcattgaatgttacagcaatgtttaatacatttattgatatgcctgattcatatacagattttaagatgggtattcaaatcagacattacacagtacaagcactaaaattattgaaaacgcaaataaacttaccgctttcatcctaa

SEQ ID NO: 2783 - DNA, 225 bp, Staphylococcus epidermidis
atctactgcatcatcacttcgtatatctttgaattattcttaaattactttaattttaaaatcaaatttatactgtttaattataaaaacgcaccccaaaagctaaaatttagtctagcttttggggtgcacaatattgtcttgagcattttaatatgctttcagtcgatgactggattaaaaatgtatttatgtcaagcttactatatcaataattcagagtag

SEQ ID NO: 2784 - DNA, 942 bp, Staphylococcus epidermidis
ggtgaatgcatgttaacaacagatagattagttaatacgttaaatttagaattacttactggtgaagaaggtttagatagaccaattaaaaacacagatatttcacgtccaggtttagaaatggctggatatttttcacattatgcttcagaccgtattcaattattagggacaacggagttatcattttataatttacttccagatgaagagaagaaaggaagaatgagaaaattatgccgacctgaaactccagcgattattgttacacgtgggttagaaccacccgaagaacttatacaagcatctcaagaaacgcatacaccaattattgttgcgaaagatgccacaacgagtttaatgagtaggttaacgacatttctcgaacatgaactcgcgaaaactacttctttgcacggtgtacttgttgatgtttacggtgtaggtgtactaattacaggagattctggcattgggaaaagtgaaactgcattagaattagtcaaacgaggccatagattagtggctgatgataatgtagaaatcaaagaaattactaaggatgaacttgtagggaaaccgcctaaacttatcgaacatttgctagagattcgtggtctcggaatcattaatgttatgactttgtttggagcaggatcaatattaactgaaaaacaaattcgattaaatattaatttagaaaattggaataagaataaattatacgatcgtgtaggtcttaatgaagaaacattgaaaattcttgatacggaaatcactaaaaaaacgataccagttagaccagggcgtaatgtagcagtaattattgaagtagctgctatgaattatcgtcttaatatcatgggtattaatacagcagttgaatttaatgagagacttaatgaagaaatcgttcgaaatagtcataaaagtgaggagtaa

SEQ ID NO: 2785 - DNA, 297 bp, Staphylococcus epidermidis
ccgcctggcataccgcgttcaatcatgacagtttttaaattggcacgagatgcatatactgctgctgtcataccggcaggacctgcaccgattattgctacatcaacatctacttcagtcattttaaatgcctcctacttattaatcattatgcgcattatatatcatacttttcatttcataaatttatatgctcaatataaattcaattgctttattcagtttgtatctagaaacattaaaatcgtccatcaattgcctcttggtaagtggttggctagaacgacgatacgatag

SEQ ID NO: 2786 - DNA, 333 bp, Staphylococcus epidermidis
atgaatttaattcctacagttattgaaacaactaaccgcggtgaacgtgcgtatgatatatattcacgtttgttgaaagaccgtattatcatgctaggttctcaaattgatgataacgtagctaactctattgtgtcacaattattattcttgcaagcgcaagattctgaaaaggatatttatttatatattaattcaccaggtggcagtgtaactgctggatttgctatttatgatactatccaacatatcaaaccagacgttcaaacaatctgtattggtatggcagcgtctatgggttcattcttgttagcagcaggtgccaaaaggtaa

SEQ ID NO: 2787 - DNA, 306 bp, Staphylococcus epidermidis; identical to SEQ ID NO: 1918

SEQ ID NO: 2788 - DNA, 453 bp, Staphylococcus epidermidis
tcatttctaatctacttttggctgaatcaatggttgacgaaagaaggtgattcaatgaaagtagtatattattcattttctggtaatgttagacgatttattagtcgtgctggtattaaagatacatttgaaattactcaagataattgtaacgaatcagttaatgaaccctacattttagttactggcactattggatttggagaggtgccgcagccggttcaatcttttttaaatgtaaatcatactcagttacaagctgttgctgcgagtggaaatcgaaattggggacaaaatttcgctaaagctggccatacaatttctgaggaatataaagttccattaatgatgaagtttgaagtacaagggacaaataaagacattattgaatttaaggataaggtgggcaatttcaatgaaaaccatggaagaaaagaaatacaatcatattga

SEQ ID NO: 2789 - DNA, 528 bp, Staphylococcus epidermidis
atcaaaataattaaaggagctagaaaattgacacaaggacgtcaaaaagatgaattaaaagatattactttattaggcaatcaaaataacacttatgaatttgattatagaccggaagttttagaaacttttgataataagcatcaaggtcgtgattattttgttaagtttaattgtcctgaattcacatcactatgccctattacgggtcaaccagattttgcgacaatttatatctcgtatatccctaatatcaagatggtggaatctaaatcattaaagttatatttatttagttttagaaaccacggagattttcacgaagattgtatgaatattattatgaatgatttaattaatttaatggacccacattatattgaagtttggggtaaatttactccgagaggtggcatttccatagatccttacacgaattatggtcgtcctgatacaaaatatgaaaaaatggctgaacatcgattaatgaatcatgacatgtatccagaaaaaatagataatcgttaa

SEQ ID NO: 2790 - DNA, 288 bp, Staphylococcus epidermidis
agtaaatcaattatttttgcaactagctttatgaattattcaaggagcttctttaaatatatgaaattaatatctaaaagcatatacttatcatttatattttttatttttagtctcatgttatttaccaatcaaagtttcgctaatgataataaacgttttcagctaaaaccaggtgacattattgttacaaaaggtcctgttttaaatggttttttggtcactgtagtttggcaattgatcatgacactgtacttcaaattgaaggtccaggggataaaccaatga

SEQ ID NO: 2791 - DNA, 1008 bp, Staphylococcus epidermidis
aacatgtcaatcataattgaaaatagtggcctatttagtagctttcaagattttggaagaaagggatatgaacatgaaggtgtcatcccgagtggcgcactagatgaattagcacatgaaatagccaaccgtctggttgcaaatgacaaaaatgaagcaacacttgaaatgactcaaaaaatggcaacaattcgtttcactgagccggcacttatagctttaacaggtggtaattttaaagctgaaactgaacatatgaaaatttatcctaataaattatatctcatcaatgaaggtgagacattgaaatttaatgaaaccagtcgtacatcacgtgtttatctagcagttggtggaggttttaaactagaaaaatggcttcattcagcatctacagattttaatgtggaaattggtggttttgagggaagaaagcttaagaaaggtgatgaaatagaattaaaacaccactattctcaacgacatcttaagctatttgataacttatctgacaaacgtacaactgattggggaattgatggttacgcattgtctttcaattatgtttcggatgtttttcatgttataaaaaataagggaacggaagattttaaaaaagaggcgacgcgtcgttttacaacggctgaatatagtgtgtctagtaaaacaaatagagtaggtatggtgcttgatggcccccaaatcaaagcatactatgatgatatgccggctcatcaatcagtaaaaagaggaaccattcaagttaagagagatggcacaccgattgtattattaaacgatcattatacattaggaagttatcctcaaataggtacaatcgcaagctatcatctaacaaaattagcccaaaaaccacaaggctcaaaattgaaatttcaatttatagatatcgaaactgcagaaaaaaacttaataaagtatagcaattggttaaatcaattgttccatggtattgaacaccgtatgcaattagaaatgttaaagtga

SEQ ID NO: 2792 - DNA, 246 bp, Staphylococcus epidermidis
ggtaaaacaatgtcgaatcataattattctgacgaaaaaatcgaagttatagatccgagtgatgatagatataaaggagatgattattttaataaaaattcatctcaaaacaatcaaaatttaaaaacttttaatcaaacttattcttatggttgcacacattcaggatgcggctgtatattaggctgtttaactatttcacttatttcattcttactttcattactaattttttggattatataa

SEQ ID NO: 2793 - DNA, 651 bp, Staphylococcus epidermidis
ttgatgacaatcgctcaaaatggaggatttttaatgtttagtaagaaaaaggataagttcatggttcaattagaagaaatggtattcaatctagaccgtgcagctattgaattcggcaaaatggacttcaatacacacttagatttgaaagcttattctgataatattaaaacgtatgagtcacatggtgacgaacttatgcatcaagttatttctgatctcaaccaaacattcattacaccaattgaacgtgaagatatcttatctttatgcaatgcaatagatgatgttctagatgctatggaagagacatcagcaatgtttgaaatgtattcaattgaatatacagatgagtacatggctgaatttgtagaaaacatacaaaaagcagttgccgaaatgaagctagctgtaggattacttgtagacaaaaagttatctcacatgcgcattcattctattaatattaaagaatttgagacaaattgcgacggtatcttaagacagtcgatgaaacacatcttcaacagtgaaacagatccaatcacattaattaaaataaaagatatttatcaaagcatggaagaaatagcagataagtgtcaagctgttgctaataattttgaaactataatcatgaaaaatagctaa

SEQ ID NO: 2794 - DNA, 714 bp, Staphylococcus epidermidis
atggctaaaatacccgttttagaaatatttggaccaacgattcaaggtgaaggtcgtgtaataggaagaaaaacaatgtttgtgcgtacagctggttgtgattatcgatgtagctggtgtgattctgcatttacttgggacggtagtgctaaagaagatatcaaattaatgactgctgaagaaatttatgatgcgttacttgaaataggtggtcatcgatttaatcacgtaactatatccggaggtaaccctgcgttaatcaaaggtatacaggaattagtagatttatttgaagacaaacatatttatacagctttagaaacacaaggtagtcgtttccaatcatggatgacacaaattgacgatttaacgattagtccaaaaccccctagttcgggaatgaaaactaatctagaaatattagattctgttataaatcaatgtacatttcattcacttaatttgaaagtggtgatttttgacgatgcagactatgattttgcaaaattaattcatcatcgctaccctaacatcccattctatctacaagtaggtaatccttatcttgatgataacgttgaccaacatacagataaattacttgaaaggtatgagcaattagtggatcgtgtaatgcaaagtagtgatatgaatcatgtctatgtactaccgcaattacacacattattatggagtaataaaaaaggtgtctaa

SEQ ID NO: 2795 - DNA, 918 bp, Staphylococcus epidermidis
cttaagaaaatgacaagcaacgaaaaagaaatgggtaaaagtgaattgttagttgttacaggtatgtctggagcgggtaaatcattggtgattcaaagtctcgaagatatgggatttttctgtgtagataatttaccacctgtactattacctaaatttgtagaattgatggctcaaggaaatccttcattgcaaaaagtagcaattgcaatagatttaagaggtaaggaattatttaaatctctagttaaagaaattgatattattaaaagtcgtaatgacgtgattttagatgttatgtttttagaagctaaaactgaaaaaattatttcacgttataaagaatcaagaagagcgcacccactaaatgaacaaggacaaagatcattaatagatgcaataaatgaggaacgtgaacatctatcagaaatccgaagtatcgctaattacgtgattgatacaacaaaattaaaacctaaagaattaaagcaacgcatttcaaagttttatttagatgaaaactttgaaacatttacaatcaacgtgacaagtttcggtttcaagcatggtatacaaatggatgctgatttagtttttgatgtcagatttctacctaatccctactatgtagaggaattgcgtccatttactggtttagatgagccagtgtacaattacgttatgaagtggaaagaaacccaaatattttttgataaattaacagatttattaaaatttatgattcctggctacaaaaaagaaggtaaatcgcaattggttattgctataggttgtacgggtggacaacatcgatcagtcgcattagctaaacgtttagctgaatatcttaacgagatttttgaatataatgtttatgtgcatcatagagatgcgcatattgaaagtggagggagataa

SEQ ID NO: 2796 - DNA, 1077 bp, Staphylococcus epidermidis
gttggtgaaataatgaaattagcaataattattccagtgtataacgctgaagaaacgattaaacgtgctatactctcagttgatactagtgtgccttatgagattatttgtatcaatgatggttcaactgatcaaacacaacatgtacttacagaattacaacaaaaacatccacacattaaagtcattcatcagagtaatcaaggagcagctcgaagtagaaatgttggcttagaagctatgtctgaagatgttgatgcatttttatttttagacgcagatgatgagtttttacctagtaggattgatttaatggtgaatgcttttaataaaaacaaagaaaccgatgttgttatcggtcaaatggcaagagatgttaacggcgaatggcaagtcatttcgacccatcaatctatggtaaaagatgcgattgtcacacttgatcgtaaaccggatattttacaatcgataggacctggagcaaaattatttagctcgaagtatgctggattacgttttgatgaagatgtcgttttctgtgaagagcatacctttattgtcaaagcgttctctaaagcgcgagatattcaacttatacctaacattgtatatggctataatgagagagaaggatcagtaacagcgcaacgtgctgatacattcttaccttatatgagtgatgcgttaaaagttcgtcaacgcgtgatggaattactattattattagacgaaaaaatctactatagttatcgaatggataacctcatagtaagttacttaatacaggcacatttaaagaaaaataacaaaataacgcaatctttgcttgaaagtgttatagcgtatatgaaagctatgcagcatacacattactcgggagaggctatgtttcgaattgttagagctgttgaacagagtgcaacacattggacaaagcctttatacttacaatggaaaaaggcacttagtgaggttggaattggcagaccaggattaattcgttttaaacttcaagttatacctaaaaagatatccttttctggtaaagaatcactaaaaagaatttttaaaaaataa

SEQ ID NO: 2797 - DNA, 207 bp, Staphylococcus epidermidis
cttaaagaaatacgaggttcactcatgatttatttacaaaattttattactacaactatccaattaaatatctatcttattttagttattggactgctttacgtaatcatccactattatagaaataaaggtgtgaacgctttcttagatatttatttaaattatataccgggtacttattcacgaatttggccacgtcttatttaa

SEQ ID NO: 2798 - DNA, 507 bp, Staphylococcus epidermidis
atcatattgataatacagaaggtaacagtaccattaatcctggaacttttaaatggtgaatctcttagacaatatatacaatcagcttatcacgaaacgttaaaagaagaatttaagaatcttacaccttacatgactaaattggcaaaagtacatggtcgtagtcacccatacttattaaaattacaagacttatatcgcgagtttggtgatagtatgttggatcatatacgtaaagaagatgaggaagattttcctaaactcattcaatatagtcaaggacaagatgtacaaaacattaaaatcatattagaagatttaattaatgaccacgaagatactgggcaattattaaatgttatgaatcaactaacctctgattatcaaaccccagaagaagcatgtggaacatggaagcttgtttaccaaagattacaaaatatcgaacgtcaaacacaccaacatgtacatcttgaaaaccatgtgttatttaaaaaggtaagttaa

SEQ ID NO: 2799 - DNA, 276 bp, Staphylococcus epidermidis
  unsure (273): Identity of nucleotide at the above locations are unknown.
tgtttagtgataaggagtgcaaatatgaaaaaactactatttatcataacagttatcattttaaccatagttgtatccgcttgtggaaatgaatcaaaaagagatattaaacaatttgaacgtcaatatgaagaaattcatcaaaaacaacacagtgtagaaaaagttatggataaaataccattaaaagagttagataatttaagtaaaactgataccactgataaaaataaaaaagaattcgtgcacttcaacaggatattaataactatntga

SEQ ID NO: 2800 - DNA, 1068 bp, Staphylococcus epidermidis
aaggagccgataactattttttcaataagaagtcaaatcattatcggtgtcatttcaagcgttattttaacaacaattatactggttattgcatataagctcatgtggtttaatggtcacatgacactcactttagccatcactactatgataacaagctgtttaacactttcgatttgtagtatttttattaatcctttaattcagaagattaagcaattcaatattaagactaagcaatttataaatcacgaaaaattcattgatgatgaaacatttcagtctcctagagaaattaaagagttgaatgattcttttaataaaatggcatatgaaatcaataatcaaatgaatatgataaaaaacgagcaacaagaaaaaactgaaatcatacaaaaccttgcacatgatttaaaaacacctttagctggtattcgatcatattctgaaggtttacgggatggcgtcattagtgatcctcaagaagttcatgaagcatatgaaatattaattaaacaagcaaatcgtttatcaattttatttgatgacattacacatgtgattaatttaaatactggacgttcttatcctttggaattaatacagctcgatcaattacttgttaatatattacaaccatacgagcaacacataaaacaagaaaatcgtacacttgaagttaatttctgcacagatattgatgcattctaccagtatcgacctccaatcgaacgtattttgaccaatttactagataatgcattaaaattttctaattctggtagccgtattgatattattatttctgagtgtaaagaaaacgacgtcattagtatttcaataaaagatgagggcataggtatcgttccagaacttcaatcacgtatctttgaaagaacgtttagagttgaagattctcgaaatactaagactggtggttcggggttaggattatacattgcaaatgagttagcacaacaaattgacgcctctattacagtccaaagtgatttagacattggaaccacgatgacacttaccttaaaaaaatttcaatttaaaaagtaa

SEQ ID NO: 2801 - DNA, 654 bp, Staphylococcus epidermidis
ggtgaaacgatgttaactgaagaaaaagaggattatttgaaagcaattttgactaatgatggcgacgtgtcctttgtatcaaataaaaaactatcgcaatttttaaatatcaaaccaccatcagtaagtgaaatggtagggcgtttagaaaaggaaggctatgttgaaacaaaacattataaaggtgcccgtttaactgaagaagggttaaagcaaacgttagacatcataaaacgacatcgattactagaattatttttaatagaaattttacaatataattgggaagaggttcatcaagaagctgaaatacttgaacatcggatatcagatttatttgtagagcgtttagataagattttaaattttccgaaaacatgccctcatggaggcgtcattcctagaggtgatcaatataaagaaatttttactacgtcaattcttaattttgaacctggagaacgtgttactgtacgacgagttcgtgataagacagagttgttagtttacttatcaagtaaggatatttatattggaaatacagttgaaattgtatccaaagatgataccaataaggttattattcttaagaggaatgatattgtaacaattttaagctatgaaaatgcgatgaatatttttgcagaaaaataa

SEQ ID NO: 2802 - DNA, 1566 bp, Staphylococcus epidermidis
atagagaagatgtgtttacttatttatctcttaataaggaggaagcgacacatgaatgagttctttgcgacattaagtgatagaaaagggcagctattttctactataattgaacacattcaactttcttttatagcgcttttcattgcaactcttatagcagtaccaattgcaattttgctcactaaaacaaaaaaactttcagaaatcgtcatgaatattgcagctgttctacaaacaattccatcactggcactacttggtttgatgataccaattttcggaattgggagacttccggcaattatcgccttagttgtatatgcgttacttcctattctacgtaatacatacacaggtattaaggaggtcgatccctctcttattgaagcggctaaaggcattggaatgaaaccacttagaagattgaccaaagtcgaactccctattgcaatgcctgttatcatggcaggaatacgcacagctatggtattaatcattggtactgctacactcgcagctttaataggcgctggtggtctaggagatttaatattattaggcattgatcgtaacaatagtgcactcattttaataggtgctattccagctgcacttctagctattatttttgattttattttaagatacatggaacgtttatcatataaaaaattgctcatttctttagggacaattgtaattgtgattatcatagctattgccatacctatggcagcgcaaaaaggtgataaaatcacattcgcaggcaagctaggttcagaaccgtcaattattacgaatatgtataaaatacttattgaagaagacacagatgatactgtagaagtcaaagatggcatgggtaaaacctcattcttatttaatgcgcttaagtcagatgaaattgatggttatttagaatttacaggtactgtattaggtgaattaacgaaagaagatttaaagtctaaaaaagaaaacgatgtatatcaacaagcaaagtctagtttagaaaaaaaatatgatatgacaatgcttaaaccgatgaaatataataatacgtatgcattagctgtaaaacgtgactttgcaaaaaaatatcaaattaagacaataggtgatttacgcaaggtagaagataaacttaaaccaggttttacattggaatttaatgatagaccagatggatacaaagctgttaaaaaaacgtatcatcttaatctttctaatgttaaaactatggaacctaaattacgttatactgcagttaaaaagggagatattaatctcatagacgcatactctactgatgcagaattaaaacaatataacatggtagtattaaaagatgatcaacatgtatttcctccataccaaggagcaccgctatttaaagaaaaatatttaaaagaccatcctgaagttaaaaaaccgctcaataaattggcgaatagaatcacagatgaagaaatgcaagaaatgaactataaggtaacagtgaagaaagaggatccttataaagtagcaagagaatacttagaaaaagaaaaattaataaaataa

SEQ ID NO: 2803 - DNA, 288 bp, Staphylococcus epidermidis
aggggtgagattataccaatgataattgaagtaattttaatggtatgtctcatcattattcaacttatgataggtcatttatggcatcaaataggatggagttatactaaagctattttattaatgtgtttaccgttagggataggattatatttgatgcaattattttattatgagccccgttatacaaattgggaagtacctttgaaaactaaattaaatcttaaatatatgtatattttaactttgttagaatatattttaatctatgtttgcttttttatgtaa

SEQ ID NO: 2804 - DNA, 1323 bp, Staphylococcus epidermidis
ttaaaggagatattaaacatgccaattattacagatgtttacgctcgcgaagtcttagactcacgtggtaacccaacagttgaagttgaagtattaactgaaagtggtgctttcggacgtgcattagtaccttctggtgcttctactggtgaacatgaagcagttgaattacgtgatggagataaatcacgttatttaggtaaaggtgtgactaaagcggtagaaaatgttaacgaaatgatcgcaccagaaatcgttgaaggtgaattttcagttttagatcaagtatctattgataaaatgatgattcaattagacggtacacacaacaaaggtaaattaggtgcaaatgccattttaggtgtttctattgccgtagctcgtgcagctgctgacttattaggtcaaccattatataaatatttaggtggatttaatggtaaacaattgccagtacctatgatgaatattgttaatggtggttctcactcagatgcaccaattgctttccaagagttcatgattttacctgtaggtgctgagtcattcaaagaatcattacgttggggtgcagaaatcttccataaccttaaatcaatcttaagtgaacgcggtttagaaactgcagtaggtgatgaaggtggtttcgcacctagatttgaaggcactgaagacgctgtagaaactattattaaagctatcgaaaaagcaggatacaaaccaggtgaagatgtattcttaggatttgactgtgcttcttctgaattctatgaaaatggtgtttatgattacactaaattcgaaggtgaacacggtgctaaacgtagtgcagcagagcaagttgactacttagaagaattaattggtaaatatccaatcatcactattgaagatggtatggatgaaaacgattgggaaggttggaaacaattaactgatcgtatcggtgataaagttcaattagttggtgatgatttattcgtaactaacactgaaattttatctaaaggtatcgaacaaggtattggtaactcaatcttaatcaaagtaaaccaaatcggtacattaactgaaacattcgatgctattgaaatggctcaaaaagctggatatactgcggttgtatctcaccgttctggtgaaactgaagatactacaattgctgatatcgcagttgctacaaatgcaggccaaattaaaacaggttcattatctagaactgaccgtattgctaaatacaatcaattattacgtattgaagatgaattatacgaaacagctaaatttgaaggaattaaatctttctacaatttagataaataa

SEQ ID NO: 2805 - DNA, 660 bp, Staphylococcus epidermidis
atagtagttttttcatatttgcactccttatcactaaacattatacataaacgtatttattatgaaaatgaattgtgttatagtatgtcagactttattgtatatattatttttataaatgaggagtatttcatgtacgctaatgtccaaccttttattaaaaatgaatctgtgaaacaatttacatatgaatataacaaagtgaaagacgtattgtttactattttagattctcctattaaatacactcagcatatcggtggtacctgtcattttaattatcaaactgagcccattttagatatacttgttggtgtaaataacttgcacgatattacttcactagatgaaaagcgcctaaattatgctggtttttatcgtttgcaccattcttacaagaaaaaagttgtcatggcacgttttaataatttaagtgaattaaaacaagaagtaagattacatattattcaaatggaaacttctcttttcaaacaatatcaaacagtcaatcatttactacacaacgataaagcaatagcagaatggtttgcaagtaagaaaaatgaaattgtgcaacatgctaaaaagatacgtgaatatgagtctcaaaaacaaaatttgtttgagaaattatataaggaatctaatttgttatcgtaa

SEQ ID NO: 2806 - DNA, 888 bp, Staphylococcus epidermidis
ttgaggaggataagtattaagatgaagattgcagttatgaccgattctacaagttatttaccacaacatataatagaacaatataacataccagtcgcttcactaagtgtaactttcgatgatggagtgaatttcactgagagtgatgatttttctgtagatgatttttataaaaaaatggcttcatctaaaactataccaacaacaagccaacctgctattggcgattggattgaaaattttgagagattaagagaacaaggatacactgatgtcatcgtgattaacttatcaagtggtataagcggaagctatccttcagcaacacaagctggtgaaatggttgaagatattcaagtacatacgtttgatagccgtcttgctgcgatgattgaaggtagctttgcaatttacgctgctcaattggtacaaaagggatataaacctgatgatattattaatgaactaactgaaataagacaacatattggtgcatacttaattgttgatgatttaaaaaatttacaaaaaagtggtcgtatcactggagctcaagcttgggtaggtacattattgaaaatgaaacctgtcttgcgttttgaagaagatggtaaaatacatccacacgaaaaagtacgtactaaaaaacgtgcgctaaaatctttagaaacaaacatttttaaagaaatagaaggcatggaagatgtgacagtatttgtaataaacggtgataaaactgaagatggaaagtcatttcttcagcaattaaaggaagatcatcctaatgttcatattcagtattgtgaatttggaccagtgatagcatcacatttaggatcaggcggtttaggattgggttacttcccaagaagaatcgacattaattaa

SEQ ID NO: 2807 - DNA, 759 bp, Staphylococcus epidermidis
gggagagggattttaatcatgcaaattaaactaccaaaaccattcttttttgaagaagggaaacgtgcagtgttacttcttcacggctttacaggtaactctgctgatgtaagacaacttgggcgttatcttcaaaaaaagggctatacatcttatgctccacaatatgaaggacatgcagcgcccccagaagaaatattaaaatctagcccttttgtttggtttaaagatgttttagatggttatgattatttagtagatcaaggttacgaagaaatagcagtagctggtttatcattaggtggcgccttcgcattaaaactaagtttaaatcgtgatgtgaaggggattataactatgtgtgcacctatggagaataaaacagaaggttcgatttatgaaggctttcttgaatatgcacgtaactttaaaaaatatgaaggcaaagatcaacaaacgattgatcaagaaatggaacaatttcatccaactgaaaccctgagagaactgagtgacactctaaatggagttaaagaacatgtcgatgaagtaattgatccaatacttgtcgtacaagcagaacaagatacaatgattgatcctcaatcagcaaattatatatataatcatgtcgattctgatgaaaaagaaatcaaatggtatcaacattcaggtcatgtgattaccattgataaagaaaaagagaaagtctttgaagatgtatatcaatttttagaatcattggaatggacagagtaa

SEQ ID NO: 2808 - DNA, 309 bp, Staphylococcus epidermidis
atgacgtttgtatcacatcaaaggcatttgcctatatttttcaaaaaatgtgtccttttttttcaatctatttcgatatatatagtgaaaggaggttttattatgaatgaagtcaatcaagtgacgattatctttactcaaatcaaacataattctgaaggtaaagtagtcgaacataagcgtcgtttttctaacattaatccgcttgtttctaatgatcaaatcaaatcttttcgttccatcattgaacgtatcagtggcgaagagtatgacaaagtcgagatcgttaaaacagaatctttaatttaa

SEQ ID NO: 2809 - DNA, 1704 bp, Staphylococcus epidermidis
aattattctgtgagcgaattgattttaattttttgtaaacactctataatatatgtaggtgatattattgtgaaaaaactaacaaaaatggttttaagttataaattataccccacactcatgttaatcatgagcgtttttttatcttttacggtcgttgcgcaaaacatttcaatttcacactttttaaatcacttactgtattatcaacaacaatctttattattattgttatcagttatttttatctctcttattttaagagcaacatttaatatgctgattcaatttttaggagatcatttggcatttaaagtaaaacatatgcttagagaacaagtgattttgaaaaaaagtgtccgttcaattggtgaagaaataaatattttaactgaaagtattgatggtatcggtccgttctttcagagttatttacctcaagtctttaaatcaatgttgattcccatcgttattattattaccatgtgttttgttcatttacctactgctattattatgatagttaccgcaccttttattccattgttttatgttatttttggacttaaaacaagagatgagtcaaaggatcaaatgacatatttaaaccagtttagtcaacgttttttaaatacagctaaaggtcttattacatttaaacttttaaatcaaacgaaacaatctgagcaacaactttataaagacagtacacgttttagagatttaacaatgcgtattttgaaaagtgcctttttatcaggacttatgcttgagttcataagtatgttagggattggattggtcgcattggaagcggctttaagcttagttgtatttaaccatatcaactttgtgactgcagcgatagcgattattttagctcctgaattttataatgcgattaaagatttaggtcaagcatttcatacaggtaagcaaagtgaaggtgctagcgatgtggtgttttcatttttagaatctgaagataaagctgattctcctacattaaaagtggatgagcaacagtttgaacaagttttaattaagcatgttgattttcaatacgctaatagtaatcatatggctttgaaaaacatttctttttcggtaaataaaggagaaaaggtcgctattgtgggaccgagtggtgcagggaaatccactttagctaagttgcttagtcaatcagtaacacccacacatggaacactttcatttaaccaagcatcattaaatatcggatttctaagtcagcgcccacatatatttgcagattctatcaaaaataatattgcaatgtatgatgatgagatatgtgatgagcaagtgattcaagtgcttgatgaagtggggttaaaagagaaagtactttcattaaaatatggtatctatacttctattggtgaaggtggggaaatgttatcaggtggacaaatgagacgtattgagttaagtcgtttattattattgaaaccagatattgtaatttttgatgaaccagcgataggattagatattgaaactgaaaaggtcatacaacaagtattagagcatcatttttctacaacgacagtgtttattattgcacaccgtgattcaaccattcgaagttcagcacggcgtatatatatcgaaagtggtcatcttataaaagatgattcgataatttctgttacgcgtagtgaggtgaagatagatcaatga

SEQ ID NO: 2810 - DNA, 189 bp, Staphylococcus epidermidis
tttaacaatgtttgtaacatgttaacagattttacaaagacggtagctaaatatataatatggtacatagatgatgaaagtgagatgacattatgggacgtaaatggaacaacattaaagagaaaaaagcccaaaaagataaaaatactagtagaatatatgccaaatttggtaaagaaatatatgtag

SEQ ID NO: 2811 - DNA, 276 bp, Staphylococcus epidermidis
aacaacaatgtcaattctaaacagaagaaatgggtgacgataatgatttggtatgtttgtgcggccttctttccttgtatattagttgtgctgtttagtgtggtgactagaagtaaatggattggtacattagtcacactggtaataataggggcatcagtttataaaggattctttcacaacgaatggattatttttatagatgtgacaagtttattagctggttatttaataattgatcaacttgaatttcataagaaccaaaatgattcttaa

SEQ ID NO: 2812 - DNA, 519 bp, Staphylococcus epidermidis
ctattaaatgtaggcgtttttaactatagaaagagagtgttaatcatgaagaaaataagtttatttataatatttttaattcgtgtaatttcaggtattgttattttcagacaaggatgggagaaatttacaggtgattttacattaaacgggctagttccggtaattagagataacacagactctcctcaatggtataaatggttttttgaacatattgttgcacacacaacaggattatttaatataatcgtacctttaggggaaatggcaattggtttaggtttaattttaggtatatttgcatacgctgcaagtttctttggagccttcgttatgataaattatattttagcagatatgatttttacgtaccctctacaattagctttctttattattttactcatgagccactctttattggctaaggtatcacttaaagaaatcatcgcttattttagagaccgtaataaccgaggtgaagataagcatgacccacttactaatcgtggatga

SEQ ID NO: 2813 - DNA, 198 bp, Staphylococcus epidermidis
tgcgtaaatgtatccagtgcaatcaacctattcatgagaccattcatatttataacttatttaaaccacctcagatattttgtgaacgatgtgaaacattatggcttaactccaaaattcataaagatggtaggtgtcctaagtgccttaacaacaaaatttctactgatggcgaatgtcatgactgtcaattcttaa

SEQ ID NO: 2814 - DNA, 660 bp, Staphylococcus epidermidis
gataaattcgtgtttaagaatgaaagagaggtaaacaatatgagcggtatctccaaatttattagtgcgattgtagttttgctattattaataggtttagcatttggtatttactcatttgtcgatagttcaaaaaaaggtaacgaacgactcagtgataaaacaacacagcaagaaaagaaaaaagacgataaagacaaaaaggaaaaaaaagataaaaaatcggtggaagaaaaaaagaataatacacaacaaacgcaacaagttcctcaaactcaacaaacgcaacaaacgcaacaaactgttcaaacgccacaaagacctacaactcaaactccggtgagacaaaatccacaaacaggagaaaagagagcaaaagaaccaaaaactgatgaaagaaaaaaaactagacaagacagttcaaattttaaagaaagcccaaatgaaaaagatcaatcgtcaacacaacaaaagccacaacaaaataaatctaaccagtcatcagagaatcgtcaaagtacccaaaataaatcaaatcaaacacagtcaaccagaccacaaaacaatggaaatagtggcaatcaaaatgctagttcggggcagaacacacaaaaacaaaataataacaatcaaaattctcaaagctcaaaaaaggattaa

SEQ ID NO: 2815 - DNA, 852 bp, Staphylococcus epidermidis
aggaattgcttaaaattttaccagataattttgaaacagaaggagaagaacaacatggcaatggatttaattactaaacaagacggtacaacattacactatagtactatgggacaaggatatcctgtcgtactcgtgcataccgcttttgataattatgctgtttttaatgatttagctaaggtattagcaaagtcttttcaggttgtgcttatcgatttgagaggacatggttactctgataagcctagaaatatagagttttatgactttgctgacgatataaaatttttattagatgctatatatatagatgaagcagcatttattgggcacgagatgggggcacttattgctgctgatatgtctgttagaaatcctggctatatatcctcaatcacattagttaatcctacttcaatagaaggtgaattgcctgaagaacgcttgttcagaaaatatgcgcataaaatacgtaactgggaagatgataagcaagaaaaatttttagataaacgtagatattataaagcgcgtaagatgaataaatttttaaagcatgtcgttgatacaaatagtatttctactaaagaagaaattcaagctgttaaagatgtcttcaaatctgaaggtattgcagatgttttcaagcatgttcaagttcctacgcttattgttgctggagaacacggagaacgtacaactacactagaagctaaagaagtcgcagatttgattcaacactgtgaatttaacgtctatcaacattcaagtgcatatccttttgttgaagaacaggctcaatttactcaagagacaacaaacttcattcaacaacatgcacctaaataa

SEQ ID NO: 2816 - DNA, 294 bp, Staphylococcus epidermidis
ttctttaacgtaacatcatgtggtgaactcagtaacacttcatttgttaacgtactacgacttaacgccgcaaaacataatacagaaactgttattgctgacacaacagtcattacagttagagaaaatgcattcttcttaacacgatatataataggtgatgtgaacataacatctgtgacacttaccgttccatttctcaaccgctgtatcgctttaaatatcaatgaaactgtacttctaaagaaaaaatatgatcctataacagttaaaaataaaatagcaaaaggttga

SEQ ID NO: 2817 - DNA, 1278 bp, Staphylococcus epidermidis
tgtttcaacgttttatcctgttcgttcaaattaattccaattgatgaaattaaaatgttgtttttgcaaggtattcataaaaaaatagggtatgaaggttcaaatattattttttgtattatgcctaacttatgccaatataagaatttgttctctcaagaagagatgaatgatatcattaaaattattattgaatatcgcttgcacgtcgcatttagcatcgataaaatcgagcaaatatatgaacttaatcaactttttacatatcaatatgaaaacttaaaaattatgaataaatgttctgtttcagattacaatgtgcaatttatatttaatttgaacgaaaaaagtattcgagaaatttatcgtaatatcttgaagatacaaaacatcgaattggaatataaaataggtttagatattagttgcatgtttaatgacactgcacaatttaaatcattagcttcgcaaataaagcgtttaaaatttgactatctttatattgataatgctagattaaagtcatcctatttacttgataatgaggaaggtttattactcaaaaatattctacaatttaagcatttaatagatgatttaaagcagtttgattttagtagtgaaaatttaatttttctaaatttatataatcatcaattactgaataataatgaaattgatttaagtaatagcgctccattactatttaaaacgatttcaaaactaaaaaaacattttaaaggctacggattaaatgtattttcaaatcctaaagtctttaacgctgtacatttatttgatgagaatgggtttaaaacaacgtttggactgatttttaatcatttgagttggatgactaatcaaaaccaaattgaacaacgattctataatattattgaaaatgctgatcaatattatctctacttatatgattggcgtgtgattgaaagtgaatctaatgagagcgactttaaagacgttgatatatggattaactttgaagatgaagcgttaatagatgaatatatttgtgtgattgctaaagttgatgatgaaggtggcaatattaatcatatgatttctcaaaacttacgtcacaaatatgtttggtctacaccgttcttgatgagagttgaggagaactttagaccatacatgcacattatggaacatgactttaaaaagggcccattgaaaatcagaatgaaatataatgcagtatatttagttgaaatatataaaaaagataaaataaataaaaggcgtagcacaacttaa

SEQ ID NO: 2818 - DNA, 2403 bp, Staphylococcus epidermidis
atgagtttagtatatcttatggcgactaatttattagtcatgctcatagttttattcactctgagtcatcgtcaactaagaaaggttgcgggctatgttgcattaatagctcctattgtgacatctacatattttattatgaaaataccagatgtgattcgaaataagtttattgctgttcgattaccatggatgccttcaattgatattaatttagatttaagattagatggtttaagtttaatgttcggcttaattatttcgctaataggtgtgggtgtatttttttatgctacgcaatatttatcccacagtacggacaatcttcctagatttttcatctatttactattatttatgttcagtatgattggcattgtaatagctaataataccatcttaatgtatgtattttgggaactcacaagtatttcctcattcttgcttatatcctattggtacaataatggtgaaagtcaattaggcgccattcaatctttcatgattacagtgtttggtgggctagcgttattaacaggatttatcattttatatatcattacaggaacaaacacaattactgatatccttaatcaacgcaatgcaatttcacgacatcctttatttataccaatgattttgatgctattattaggtgcttttaccaaatctgcacaatttccgtttcatatttggttaccaaaggccatggcagcacctacaccagtaagtgcttatcttcattcggcaacaatggtaaaggctggaatctttttactatttagatttacacctttattgggacttagtaatgtttatatttatacagtgacatttgttggtctaataactatgttatttggatctttaactgctttacgacaatacgacttaaaaggtatactcgcttattctacaataagtcaattaggtatgattatgacaatggtaggtctaggtggcggttatgctcagcacacatcagatgaattgtctaagttttatattttagttttatttgctggcttattccatttaatgaatcatgcggtttttaaatgtgcattatttatgggcgttggtatcattgatcacgagtccggaacacgtgatattcgtttgctaaatggtatgcgtaaagtcttccctaaaatgcatattgtcatgttgctcgctgcattatctatggcaggtgttccttttttaaatggctttttaagtaaggaaatgtttttagattcgttaactaaagcaaacgaacttgatcaatatggcttcgtattaacgtttgtgattatttcaataggtgtcatcgcgagtatattgacttttacttatgcactttacatgataaaagaaacattctggggaaattacaatatagaaaaatttaaacgtaaacaaatacatgaaccatggctatttagtttaccagctgtgattttaatgttactcattccagttatcttctttgttccaaacgtttttggcaactttgttattttgcccgcaaccagatctgtatctgggataggtgcggaggttgatgcatttgtgccacatatttctcagtggcatggtgtgaatcttccattaattttaagtatagttgttattattattggacttattttagctctagttgtgaattggaaagaggttacgcatcaaataatcaaaagtgcttcgattacagatggctatcggaaaatttatagagaatttgaattatactcagcccgtggtatacgtgcattgatgaataataaattgaattattacatcatgattacattatttatttttgtagctattgtagtttatggatatttgactgtgggttttcctcatgtacatcagcttcatattagttctttcggaccgttggaagttatcttatcagttgtaacattgattatcggcatttcattaatctttattcgtcaacgactaacgatggtggtattgaatggaatgattggattcgcagttacattatattttattgcaatgaaagctccagatttagctttaacacagttagttgttgaaactattacgacaatcttatttattgttagtttttcgagactacctaacatccctcgagttaaggcaaatttaaaaaaagagaccttcaaaatcattgtgtcacttgttatggcattgacggtggtatcacttatttttgttgctcaacaagcagatggtatgccttcaattgctaaattttatgaagatgcatatgaacttacaggtggaaaaaatattgtcaatgctatactaggtgacttcagagctttagatactatgtttgaaggactagtgttaatcatagctggattaggtatttatacgttacttaattacaaagataggagggggcaagatgaaagagaatga

SEQ ID NO: 2819 - DNA, 714 bp, Staphylococcus epidermidis
aaaagaatagtaaaagttatggaggcaacgtgtatggacaaaaagaaactcattaaaacacttatcaatgtattaccaatcgttatcgtaccattagtaactgaacgtaagcgtattaaagaacatccagatgtacagaaagtaactaatgctacatctaaagctacttcaaaaacaacttctgcaatttcaaataaagcttcagatgtcaaagagtacgtaggagataaaaagcaagaatttgataataagcgtgaattgaagaaaattgcgaaggaaaatgatccagcctacattgagaaaaaaggcgaaaaattagctaaacaaaatcgtaaagaagcagacaaaatggacaaaaagcttcaaaagaatattgagaaacgtcataaagaagaacaaaaacaacgtgaagctaatcagaaacaacgtattaaagacatgaaaaaaactcaaaaatacgaagagcaagttggcttaactcctggtaaaatagatcacgaaattgagaaaaaaggcgaaaaactagaaaaagataatcgtaaagatattaaaaaattagataaaaagcttcaaaagaatattgaaaaacgtcataaagaagaacaaaaacagcgtgaagaagcagagaaagctagaaaaaaagaatttaaaaaatatgaaaattacgtggctgacagtgtcgtaaaacaacataaggaatcaaatcattcttaa

SEQ ID NO: 2820 - DNA, 432 bp, Staphylococcus epidermidis
atgatgatagtgatagttactttgacgcttagaaggtggattgacatggctattgtaaataaggttattattgttgaaggtaaatcggataagaaaagagtacaacaagtaatcgctgaacctgcaaatatcatttgtacacatggcactatgagtatagataagatagacaacatgatagaaacactttatgacaaacaagtttatgttcttgctgattctgatgatgagggtgaaaaaattagaaaatggtttaaacgttatttaagcgaaagtgaacatatttatgttgataaaacgttttgtgaggttgctaagtgtcctaaaaattatttagcacatgtattaagtagatatggttttaatgtaaaaaaagaaaagaaacttatgaataatttaaaaactgaaaggctagttttagtaaatgaataa

SEQ ID NO: 2821 - DNA, 1914 bp, Staphylococcus epidermidis
ttaatgcaagtgataattatgcaagaatcaaagaacttaatgaggataaagagcaacttgaagcaacctatgaagcagacatcacgagatggagtgagcttgaggaaattaaagaacaataaggggaatgtaatcatgcaagagactttatcgcattattttggttataagtcatttcgaccaggacaagaagaaattataactaaaatattaaatcatcagcatacactgggggtactacctaccggtggcggtaaatcgatatgctatcaagtaccaggtttaatgcagggtggcacaactattgttataagtccacttatttctttgatgaaagaccaagttgatcaactacaagcaatgggaattcaagctgcatatttgaatagtagtttgactcataaacaacaaaaagagattgaagagcaaataaagcgtggtgccattcagtttttatatgtagctccagagcgctttgaaaatactttttttctaaatttattacgtaaaatagaaataccccttatcgcttttgatgaagcacactgtatatcgaagtggggacatgattttagacctagttaccaaagtgtcatacaaaaagtttttaccttacctcaaaacttcacaatagttgcacttacagctacggcaactgctgaagttcaacaagatatcatgtctaagttatcaattggacaaaatgatgttgtcaaaacaagtactaaaagacgcaatttaatcttcaaagtcaatccgacttatcagcgacaaaaatttgttgtggattatgttgcaaatcatgaaggacaggcaggaatcatttattgttccactcgtaagcaggtagaagaattacacgaagctctaaatagtgaaaaaattaagagcacaatttatcatgctggtttaacgaataaagagagaattgaggcgcaaaatgatttcttgtatgatcgtgtagaggttgtcattgcgacaaatgcatttggtatgggtattgataaatcaaatgtacgttatgtcattcactataacatgcctggagatttggaatcttactatcaggaagctggacgcgcgggacgtgatggtttaaaaagtgagtgtatccttttgtttagtgaacgagataagggattacatgagtattttattactgtatcccaagctgatgatgactataaagataaaatgggcgaaaaattaacgaaaatgattcaatataccaaaacgaaaaagtgtttagaagcgacaattgttcattattttgaacccaatgaaaatttagaggaatgcaatcaatgtagtaattgtatacaggaaaataaaacgtatgatatgactcgtgaagcgaaaatgattattagctgtattgctcgaatgaagcaacaggaaaattatagtgttattatacaagttttacgtggagaagtgacagattatataaaacaccatcattataatgaattaacgacacatgggttgatgaaaaattatacaacatctgagttatcacacttaattgatgagctacgtttcaaaggatatttaaatgaaaatgatgaaattcttatgtgtgatacatcagtgaaacaattactaaataatcataccaaggtttataccactccgttcaaacaaaaaactaaagagaaggtatttatcaacactgttgaaggtgtggatagagcgttatatcgtgagcttgttgatgtacgtaaacagctaagtgataaacttggaatagcacctgtaagtatattttctgattacacgctcgaagaatttgctaagcgtaaacctgaatcgaaacaagaaatgattgctattgatggtgtaggtagttataaattaaagcattattgtcctaagtttatcgaaaccatacaaagctataaaactagaatataa

SEQ ID NO: 2822 - DNA, 483 bp, Staphylococcus epidermidis
gtgaagcaagttgtattaaatattgttatcgcgttcctttgggtactctttcaagatgaagatgaatttaaatttacaaccttctttgctggatttttaattggtttaattgtgatttatattctgcatcgcttttttggtgaagaattttatttgaaaaagatatgggtggctattaaatttttagctgtatacctataccagcttattacttctagtataagtaccataaattacatcttatttaagacgaatgaagttaatccaggtttactcacatatgaaacttcattaaaaagtaattgggctattacttttttaacgattttaattattattactccaggatcgacagttattcgaatttctaaaaatactaataaattttttattcacagtattgatgtgtcagaaaaagataaagaaaatcttctaaaaagtattaagcagtatgaggatttaattttggaggtgacacgatga

SEQ ID NO: 2823 - DNA, 186 bp, Staphylococcus epidermidis
  unsure (106): Identity of nucleotide at the above locations are unknown.
gataataaagtatattcttgcaaagtaacgagattgcataaccacgcactactttctatagagtgtgataatcgagagttaatgataacttttacagtgagggatntcaaacaatttgaggtgtgttctggttatacagatgtgaaagcgaagaaaaattataccggtattttcattagactttaa

SEQ ID NO: 2824 - DNA, 1920 bp, Staphylococcus epidermidis
gaacgcaaagtgtacttggtggcatcaattatgagctttaatgaaattatcttcaaaaactttaaacaaaatgtgacgcactatgctatttatttattatctcttgttatcagcgttgtattatattttagttttgtaactttaaaatatgcgcaccatttacacggtaatcaatcgtttcctgccatcaaagaaggttcacaagtaggaagttattttttatttatcattattgtggtctttttgctttatgctaattttttatttttgaaaagacgaggtcgtgaactatcgttattacaaattattggtctaacaaagaaagatatcatgaaaatgattatgttggagcaattgatgacatttatgatgacaactattgtaggtatcatattgggaatctttggttcgaaaattttactcatgattgtattgcgattattaggaatcaacgtgagtgtttctattatatttaattatcatgccattttagaaacgttattattaatagctgtgtcatatgtacttatagtctttcaaagctatgtatatttacttaaacgttctattaaagagttagcgtctgatgtaaataaaaaagagttcagtcatacacgcacaacacttggtgaagttgtattaggtttgctagggattattatgatagttagtggttatataatgtcgactaaattagtagataacgtagaaacaattattcaaccttttgctattttatttttaactgttataggatcatattttttctttagaagtacagtttcattgatatttaaagcgatacagcggttgagaaatggaacggtaagtgtcacagatgttatgttcacatcacctattatatatcgtgttaagaagaatgcattttctctaactgtaatgactgttgtgtcagcaataacagtttctgtattatgttttgcggcgttaagtcgtagtacgttaacaaatgaagtgttactgagttcaccacatgatgttacgttaaagaatcagaaacaagcaaatgaacttgcttttaaattaaataaccgtaatattgaacattactataattataaagaggtcgtgtatgcaaaagtttataaagatcatctttttagcgaaggtgtatatagaccgaaagaaatcacagtaacgagtgataaatatattccaaatgtaagtacgaaaaaagggcagacagatattattatacctagaggatctctcaaagatgttgttaaaacagacaaaaaaaggacggcttatgtaggaagtaagaagtttcgtttaaaagtaagtttgagaaaagggataaataaagtctattttatgtctgatgttgatcgtggtagaccgacacttattttaaatgatgaagattatcaaaaaattagagaacatataaaagaaaagaatattgtttcccaatatggttttgatcttaaaaataaaaatgatttaccagaattagaaaaattagttagtagtatcaatgaagatatagaaacaagaagtgaagcggcaagtgaaatttctagtttaactggtattttattatttgtgacatcgtttttaggaattacatttttaatcgcagcaggatgtataatttacattaaacagattgatgaaacggaagacgaacttgagaactacacgattcttcgtaagctaggatttacgcatcaagatatgtctaaaggtttgaaacttaaggtaatatttaattttggtttacctttaattattgcattactgcatgcatattttgcttcacttgcttatatgcatttaatgaatgtgacaaatcaaatacctatttttatagttatggcagtttatacagcaacttatgcagtatttgctattatagcttataatcattctaaaagaacaattaaacattcgatataa

SEQ ID NO: 2825 - DNA, 675 bp, Staphylococcus epidermidis
gaagacgaggtggtcgtcacaaaggccctcctcccttcacaacagaggatagacttaaattcgagcatgcttttagaaaaatcattaatcaaatataggaggcatattatgaaaagaattgctgtttattgtggtgcaagtaaagggaaaaacccatcttatgttaaagaggcatacgaattaggaaaatatatggctgaacaaggatacgagcttgtattcggagcaggatcagtcggcattatgggagctattcaagatggcatacttgagcatggcggtaaagctatcggtgtcatgcctaaaatgttagatgaacgagaaataacaagccaaaaagtaagtgagcttatattagtagattctatgcatgaacgaaaaaataaaatgactgaacttgccgatgcttttattatggctccaggcggtgctggttcattagaagaattttttgaaatgtatagttgggctcaaattggtatacaccaaaagcctataggtgtatttaatttaaatggattctttgagccactacaacacttaatcgaccatatgattaaagaaggatttattgatgagaaatatcaaaagcttgcacctttatatgatactaaagaatcactcatcgaaggacttaaacattacaaaccacttggtgtacgtacatacgattaa

SEQ ID NO: 2826 - DNA, 198 bp, Staphylococcus epidermidis
ttaaaatttttaagaaggagaatttatttgagtttaaaggaaatatggaaagttctcataaataaaaaatggcaaactgaagaaatatgttatttaatattgtatatatttttagcgagtatttttaccacgccattgtttggtattcctttgggagttttagcatacttatatcttaatgaagaaatattgaagtag

SEQ ID NO: 2827 - DNA, 531 bp, Staphylococcus epidermidis
ttgcaattatttcgtttgtcagttcggtctcaatttcaagattcatcggggaaggacgtgtcttcaatggaaatcataaaagacatcgttagtcttattgcttcgatacttattttcttaggaagtattattgcattaattagtgcaatagggattgtaaaatttcaagatgtctttctaagaagtcacgcctcaacgaaaagttctacattgtcagtattactaactgtagttggtgtactgatctattttattgtgaattcaggttttttcagtgtcagattattattatcactagtttttatcaatcttacatctccggttggaatgcatttgataagtagagcggcctaccgtaatggtgcatatatgtacaggaaagacgatgcatctagacaatctactatcttattaagccaaaaagagtttaatacgccagaagaattaaaaaaacgtgcaaaactacgagaagaaagacgagaaaaattatactataaagaaaaagaatatattaataaaatggacgattga

SEQ ID NO: 2828 - DNA, 546 bp, Staphylococcus epidermidis
gagttgatatttatgaagcctaaagtattgttagcaggtggcaccggctatattggtagatatttaagtcgagtcattgaacatgatgctcaattatttgctttatctaaatatcccaaacctgacaaaggatctacgaacaaaatcacatggttaaaacgcgatatatataatcataaagatgtagttgaagctatgaaaggtatagacattgcggtatattatttagatccaactaaacattctgctaaattaacacatgcaacagcacgagatttaaactttatagcggcagataactttggtagagctgcatcaataaataagctgaaaaagattgtgtatattccggggagccgtcatgataatgaagctattgaacgtttaggcgcttatggcgtaccagttgattgtacggatgttgaagtgaaacgtcctcatattaacgtagaattacaaacagctaaatatgatgatgttcgaacagcgatgaagatgattttaccaaagaaaatggacgctcaatcaacttgtagactattttag

SEQ ID NO: 2829 - DNA, 225 bp, Staphylococcus epidermidis
tatgaatcattttctattatttctccgtcattcatgactataattttattaaatcttggaagtatttctaaatcatgtgtagctatgatgagtgtttgggataaggattcaatcaaatttataattttttgggtattattaatatctagtgctgtagtaggttcatctaatatccaaaaaccggccgaaggtcttaatagcaatctcgctaaacttagacgttga

SEQ ID NO: 2830 - DNA, 930 bp, Staphylococcus epidermidis
ataggaacattaaaaataatttgtgaaagggtgatgctccaaatgaaaagtaaactatggatagttatatgtgcattgattgtagtactggctgcatgtggtcaagatgccaatcattcatctaataataaagacactgaaaaaagcgataaaaaatatcatagaattatttcgctcattcctagtaacacagaaattttatatcgcttaggaatcggagaagatatagttggtgtatccactgtggatgattatcctaaagatgtaaaaaaaggtaaaaaacaattcgatgcgatgaatttaaataaagaagaattaataaaagctaaaccggatttgattttagcgcatgagtcacagaaaaattctgcaggtaaagtgctaaagtcacttaaagataagggagtaaaagtcgtttatgtgaaagatgcacaatcgattgatgaaacttatgatacttttaaatcaattggacaattaacggatcgtgaaaaacaagctaaagaacttgttgatgaaacaaaacacaatgtagaaaaaatcattaactccgttcctaaacatcataagaaacaagaagtgtttatggaagtatcgtctaaaccagacatttacactgccggaaaagataccttctttaacgatatgttagagaaactagatgctaaaaatagttttgatgatgttaaaggttggaaatcagtaagtaaagaaagcattattaaacgtaatcctgatattctgatttccacagaaggtaaatcaaaatcagactacatagaaatgataaaaaaacgtggcggttttgataaaattaatgctgttaaaaatacacgtattgaaacagtagatggggatgaagtttctcgaccaggtcctcgtattgatgaaggtctaaaggatttaagagacgatatatataaaaaatag

SEQ ID NO: 2831 - DNA, 210 bp, Staphylococcus epidermidis
cctatgacattattatggttagctatattaatacttcttactgtattaggtaaaaagatgtcaaaccaagccattaaaaacaatcaagtgcttattgctaagttaatagctactataactacattttgtgcgtttgtgttggtttatttgcttatgcaatctataatgccacatattattaaattgatgaatgtcttttatcatcattaa

SEQ ID NO: 2832 - DNA, 876 bp, Staphylococcus epidermidis
agtatgtttttacttgaattaataaaaggcatcatcttaggtatcgtagaaggacttaccgaattcgcccctgtttcatctactgggcacatgatacttgtcgatgatatgtggttaaagtcaactaattttctcggttctcaatcagcattcacatttaaagttgttatacagttaggttcagtatttgcggccgcctgggtatttagagaacgcttcttagaaattttacatattggccaacataaacctgaaccttccacttcgggagacagacgttcaaaaccacgacgtctgaatttaatacatgtattagtaggtatggtcccagcagggattttaggatttttatttgatgatttaattgaaaaatacttatttagtgtaccaacagtcttaattggtttatttataggtgccatttatatgattatagctgataagtattctaaaactgttcagcatcctcaaacagtagatcaaattaattatttccaagcatttgtcattggtatctctcaagcaatagctatgtggcctggatttagtagatccggttcaacgatttcaacaggtgttcttatgaaattgaatcataaagctgcatctgatttcacttttattatgtcggtaccaattatgttagctgcaagtggattatctttactaaaacattatgagtatattcatttagcacacataccattctacattttaggatttttagcggcatttattgttggattaattgcaattaaaacattcttacacttaattaataaagttaagttagtaccttttgctatttatagaattgtcttagttatttttatagcaatcctatacttcggattcggtattggcaaaggaatttaa

SEQ ID NO: 2833 - DNA, 354 bp, Staphylococcus epidermidis
ttgattaaattttatcagtatccgaaatgcacaacgtgcaaaaaggctgcaaagtttttagatgagcacgatgtgaattatgaatccattgatattgttcaacatacaccgactaaaaaagaattcaaaaatatcgtagataaaacgggtgtgaatattaataagttgtttaatacacatggtatcaaatatcgcgaattaaatttaaaagagaaacttaaaaatatgtctgatgatgaaaaactagaactacttgcttcagatggaatgttggttaaacgtccattagctatttctggtaaccatttgactttaggatttaaagaaaatgagtatcaacaccaatggttatag

SEQ ID NO: 2834 - DNA, 297 bp, Staphylococcus epidermidis
atgaataaattgaaggatattgaagacataactgttaattttaataaagaaaaacatctcatatttggttatacaccaatgtgtggaacatgtaagatttctgaaaggatgttggatattgctaatgaaatcttacaattgccaataaaaaaaatagatcttaatttttatcctgaatggagtaaagagaaacaaattatgtctgttcctgttttgttgcttatgcgtagagaggaagagataaaaagaatctacgcatttcagtcagttacttatttgttagaaaatttaaaataa

SEQ ID NO: 2835 - DNA, 978 bp, Staphylococcus epidermidis
ctaatgaaatttatttttaaaggttataccttatttattttattagtgattttaactattgtctctttatttataggggtgagtcagctctctctaatagatattttccatttaagtgatgaacaaataaacattttgttttcgagtcgaattcccagaacagttagtattctactttcgggtagttcactagctttatcaggattaattatgcaacagatgatgcaaaataaatttgtaagcccaacgactgctggtactatggagtgggcaaaattaggtattttaatgtcattgttgttctttcctaatggtcccattttaatcaaattattatttgctgttgttctaagtattgttggaacgtttttatttgtccaattaattaatcttatccgtgtaaaagatgtaatctttgttccacttttaggcattatgattggtggtattttatccagttttactacatttgtagcgttgagaaccaatgctttacaaagcattggaaactggttaactggtaactttgcagttataacgagtggtcgttttgaggtgttgtatctcacaataccattacttattttggcatttgtatttgcaaatcattttactattgcaggtatgggaaaagactttagtcataatttaggtgtaagttatgaaaaaatcattaaaatagcattattcataacagcaacgctaacagcattagttgttgttactgttggaacattaccatttttaggtttaatcgtaccgaatatcatatctatctatagaggcgatcatttgaaaaatgctttaccacacacgcttatgctcggtgcaatttttgttttaattgctgatattattggtagaataattgtttacccttacgaaattaatattggattgacgataggtgtatttggcacaattattttcctaatcttgctaatgaaaggtaggaaaaattatgcaaatgagcgctaa

SEQ ID NO: 2836 - DNA, 1350 bp, Staphylococcus epidermidis
ttggaaacttcgaccataattagtttagttatattttttcttttgattgcattaacaacagtattcgttgggtcagaatttgcactagtaaaagtgagatcaacgcgtattgaacaattagtagatgagggtaataagagcgcaaaaattgtcaaaaaaatgatagacaatcttgattattacttatctgcctgtcaattaggtattacagtaacatctttaggcttaggttggttaggtgaaccgacatttgaaaagatgatgcacccactattcgagttattacatttaccgagtcctttaacaacgacgatttcatttgttgtttcattcattgttgtgacatatttacatgttgtattaggcgaattggcacctaaatcatttgctattcaacatacagaacaacttgcacttttatattcaagaccattattttattttggtaattttatgaaaccacttatatggttaatgaatggttcttctcgtgtgattgtcagaatgtttggatttgatccagatgctcaaactgatgcaatgtcagaagaagaaataaaaattattataaacaatagttataacggtggagagattaaccaaaccgagcttgcgtatatgcaaaatattttttcatttgatgaacgtcatgcaaaagatattatggtgccacgtacacaaatggttacgctcaacgaaccatttaatgtagatgaattattagatactatcaaagaacatcagtttacaagatatccaatcactgaagatggtgataaagaccatgtaaaaggttttataaatgtcaaagagtttttaacagaatatgcgtcaggtaaaccgattaaaatcgccaattatattcatgaattacccatgatttcagagacaactagaataagtgatgctcttgtaagaatgcaaagagagcatgtacatattagtttgattatagatgagtatggtgggacagctggtattttaacaatggaagatattttagaagaaattgttggtgaaatcagagacgaatttgatgatgacgaagttaacgatatagttaaacttgatgatcatacttatcaaattaatggtcgtgttttacttgatgatttaaatgaaaaatttggcatagagtttgaagattctgaagatattgatactattggtggttggttacaatcacaaaatactaatttgcaaaaagatgacttcgttgatactgaatatgatcgttggacgattacagaaatcgacaatcatcaaattatttgggtcaacttaaattatgaatttaatagtggacgtccttctgttaatgaagaacaagaagatgacgaacgtgattaa

SEQ ID NO: 2837 - DNA, 1509 bp, Staphylococcus epidermidis
tttatgacttcaaataagtcccatgaaaaagcagttcaagaaataccacaacatggattcttcgggcatccaaaaggattaggcgttctctttttcgtagaattttgggagagattcagctattacggaatgagagcaatgcttattttttatatgtattttgcactccaggaaaacggacttggaatggacaaaacaacagccatgtctatcatgtctgtatatggatcattaatttatatgtcttcaattccaggtggctggatagctgatagaattacaggtacccgaggtgccacattaatcggagctatattaattattataggtcacatatgtttaagccttccttttgcaatggtaggtttattcacttctatgttctttattattgtaggatcaggtttaatgaaaccaaacatttcaaatattgttggtagactctatccagaaaacgacgtacgcatggatgctggatttgttatcttctatatgtcagtgaacatgggtgcactcgtttcaccaattattttacaacactatattgatattagaaatttccatggcggcttcttgattgcagcaatagggatggctcttggattagtttggtacttactatttaaccgaaaaactttgggtagtatcggtatgaaaccgacaaacccattatcttcttctgaaaagaaaaagtacggaacaatcatcggaatcgttgttatagcaatagtattaatccttatgattgcttactttacgcatacgctatcatttaatttaatcagtaatactgttttaattttaggtattgctttaccaatcatttactttacaacaatgattagaagtaaagaagttactgatactgaaagatcaagagtaaaagcatttattccgttattcattttaggcatgttattttggtcaattcaagaacaaggatctaatgtattaaatatctatggtattgaaaactctgatatgaaattaaatttatttggttggaaaacacattttggtgaagctattttccaaaccattaacccattatttattttattatttgcacccgtggttactcttttatggcaaaagctaggaaagaaacaacctagcctacctattaagtttgcaattggtactattttagcaggcgcatcctacatacttatgggagcaatcggtcatatttatggggatacacaattctcagttaactgggttattctttcatacgttatctgtgttattggtgagctttgtctctctccaactggtagtagtgcagcagttaaattagcacctaaggcatttaacgcacaaatgatgagcctttggttattaactaacgcttcagctcaggccattaacggtacattagttaaattaattaaaccacttggtcaaaccaattactttatcttcttaggtgttgttgcaaccgtgattacgttaattatattagcgtttattcctaagatttctaaagcaatgaaaggtattcgttaa

SEQ ID NO: 2838 - protein, 67 aa, Staphylococcus epidermidis
LLQTHIYVKVRFELTKLHSYNNKHNFHHNKLLACVYTPFSLLNYLYSHLGIINKPIFLNFNSFRITH

SEQ ID NO: 2839 - protein, 113 aa, Staphylococcus epidermidis
FLLNIKEVKSMLEFRNVYKSFKKKEILCDVNYKLSAGEKVGLIGSNGSGKSTLMKLIAKTQLPSKGNVYLNNIDIHKSHNMIKDFSFMIGQIYYPELNARTNIENYLKINNKN

SEQ ID NO: 2840 - protein, 126 aa, Staphylococcus epidermidis
INLFFSILTLLELRIDVYLANLLIILVPSITSAILIIFTSKMKLYLWLNVISNLIFYIIYSKYIMHLDGYLSYIERAQINNSDIEIKISPNMLELSQIIFLFFVYLIPQMIVVFIKHKRGEINARI

SEQ ID NO: 2841 - protein, 65 aa, Staphylococcus epidermidis
  UNSURE (13),(16),(22),(49),(54): Identity of amino acid at the above locations are unknown.
AHQRGGARRGVAXVVXAATGIXQVAAAAKANGCTHGYHQYFSKFSGLAXKRAFXQSGTCLYSSRS

SEQ ID NO: 2842 - protein, 182 aa, Staphylococcus epidermidis
IQTSAGLDECPFMGQPGKFREVLVVTMSTSICLCGSGNLMDACCGQYHNGHPAPCATALMRSRYSAYVLGLVDYLVANTLPAQQNGLDRDAIGAWSAQSTWLGLEVESSEVFGGQPEHAFVTFTARWHDSTGEHSHREQLSFVQNDGRWYFIDPTVEVKAGRNDACLCGSGQKFKKCCSSYL

SEQ ID NO: 2843 - protein, 80 aa, Staphylococcus epidermidis
MPVYGPTRKISRSIGGNHEYIHLPLRQRQLDGCLLRPIPQWPPRAVRHRVDALTIQRLCAGAGGLSGGQYATGTTERPRP

SEQ ID NO: 2844 - protein, 79 aa, Staphylococcus epidermidis
SIQALSGDGVALHYLLEAYKHLKAIALAGEAKQLLQVLKLDADAGLIVGGDAKALKAFIAAIAQHRVWEREPMAKAVPA

SEQ ID NO: 2845 - protein, 82 aa, Staphylococcus epidermidis
DGHRRGPTRRVAGPIARRPGTRAVSAPTGRGLFAAQPDRPAKRRCQRRRYGLEPRPGVDAQGSRADRWGQQRHRPRAQGRAG

SEQ ID NO: 2846 - protein, 244 aa, Staphylococcus epidermidis
  UNSURE (114),(162),(167),(171),(237): Identity of amino acid at the above locations are unknown.
INPLHPFSQQRVQPRVILGARHLDAHITLVIHHIGGDGIQLMAQFLDIREVQRHRGAFGGGVDDLGWRLGFGSFQGGFGFIQLGLARVGDGVVDPTGQRGSLGHQRPGAAQGRXGGVDIAFLQDDLAALQIGLGQLALIRLECRVVGRLGLQRGELVLGGGXLTAGXVLFXLCNGHSARIPHLRGQRAGCFCRRPPPGKMPAGTNKRRLTASFLPLSNCAKSEQVYPPPTGAGTNSXINNCGGR

SEQ ID NO: 2847 - protein, 88 aa, Staphylococcus epidermidis
GEAVAAGAQAGRGCGVDCRRGCQGVEGVYCGDCPASGLGTGAYGQGGSGLSHWLFDRAPSRASRIVALPAIGFSRLYAESTQPAPEYA

SEQ ID NO: 2848 - protein, 78 aa, Staphylococcus epidermidis
RRICKSQVWKKPGVGDEKPYISVAISERTVGTKSTSGSDEQPAQSSSSPSSESHSSQQAHQPQPQQDQHPSGVAGFNF

SEQ ID NO: 2849 - protein, 107 aa, Staphylococcus epidermidis
KMNLENLTTERKNENTMGLNEMSVKEALQKMNQEDQKVAMAVGQELAAIEPVVEAIIKSFNQGGRLIYMGAGTSGRLGVLNAAECVPTFGVKPKMVQGPIRWWAKNH

SEQ ID NO: 2850 - protein, 295 aa, Staphylococcus epidermidis
  UNSURE (169): Identity of amino acid at the above locations are unknown.
PRFRFGSSRPLIELGVTGLRMDYGITIEQMAHASHKIDIGLNASTITLEEVAELKAHQADFSRLEAWHNYYPRPETGIGTTFFNEKNRWLKELGLQVFTFVPGDGQTRGPIFAGLPTLEKHRGQNPFAAAVGLMADPYVDAVYIGDPTISERTMAQFGYYHQTNQFLLXVAPSESRYLKRILGTHTNRLDAARDVLRSELSKTSEMFRKDEIATIESEQTEARPVGTVTIDNEKYGRYMGEIQVTLVDLPKDEKVNTITRIIEKDQTILPLIKAGNQFTLVTEGTIENEFRKLNN

SEQ ID NO: 2851 - protein, 75 aa, Staphylococcus epidermidis
LATTAAMARRDTVLPVGRRTVPCLLGCSGRDLHAAARPGPVAAFAASAAVARQSRPVPAGPDRHRAAGRSPAVAG

SEQ ID NO: 2852 - protein, 61 aa, Staphylococcus epidermidis
PGIAQPAQELRQGVQAPANPGHRRDQQPGTGPVAQEPAVLYRQSHPADAAHAKPQGTLRPG

SEQ ID NO: 2853 - protein, 456 aa, Staphylococcus epidermidis
EEKARETKREKERERNQPEREPEKRTRKKRGNREEQMTKTERRTGQSDQERDKGTREEERREKTRRKKAGKRKRAKKAKEEKRTKGQKREEGREQAGGEAPKMGFSLFNPFRRGVVLVDGHENVALEWVKGEIADTVKQARAAMDAFADDASEQALAQCVEGIHQVHGALQMVEFYGAALLAEEMEHLAQAMQAGHVSQREEGIRLLQQALGQLPLYLDRVHSARRDLPLVVLPLLNDLRSVHGKSLLSETSLFSPQLLVIAPLPDDDLAQRAPADFAEQLQHWRQMLQQGLAGLLREDHGPSNLEDMARFFAQLEALCHGAPLLPLWQVTSALAEGMLTGVIANSPALRSLLKSCDKVFKRLQTQGIEGINSPAPDQLLKSLLFYIAKVTRPTPRMQSLKERYGLDEALPDSTVVDAERARLAGPDRNAMGSVLGALCEELVRVKERLDLFVRDS

SEQ ID NO: 2854 - protein, 147 aa, Staphylococcus epidermidis
RARKRRPRMGQGRDRGHREAGPCGNGRLCGRRQRASPRAVRGGHSSGPRRPADGRVLRRGTARRRNGAPGPGHASRARQPARRRHPPAATGPRATAVVPGPCAQRPARPAPGSVAAAQRPAQRARQKPALGNQPVQPATAGDRPAAR

SEQ ID NO: 2855 - protein, 88 aa, Staphylococcus epidermidis
RKRKEEPGRATKSETREPEKRREEKKQEGKKRGRERGRRKQKRKKERKAKKEKRGESRQGGRPPKWDSHFSTHSEGESYWLTGTKTSP

SEQ ID NO: 2856 - protein, 118 aa, Staphylococcus epidermidis
RRKSKRDEERKGKGEEPARKRTRKKDKKEERKPRRTDDENGKKNRAERPRARQGNQRRGEKRKNKKEKSGEEKEGEESKRGKKNERPKKRRGERAGRGGGPQNGILTFQPIQKGSRIG

SEQ ID NO: 2857 - protein, 65 aa, Staphylococcus epidermidis
GIFLRLSPLGRSHFEEHQFGHRTVFSRYIKLLPGVFWGGAQKREGQNAAQKRGLRGKHGKMAENS

SEQ ID NO: 2858 - protein, 68 aa, Staphylococcus epidermidis
RQILHPLNPHAPTAKRKLFAAFPTLIRFAHIYIEKKRMRKRHNRFTKNRYTKNKLRDAVYASLNLLIK

SEQ ID NO: 2859 - protein, 131 aa, Staphylococcus epidermidis
AKFIITKLKRVIMNEKNIKHSHNFITSKHNIDKIMTNIRLNEHDNIFEIGSGKGHFTLELVQRCNFVTAIEIDHKLCKTTENKLVDHDNFQVLNKDILQFKFPKNQSYKIFGNIPYNISTRYNTQNLFLIV

SEQ ID NO: 2860 - protein, 134 aa, Staphylococcus epidermidis
YAKFVFDSIADEIYLMVEYGFAKRLLNTKRSWALLLMAEVDISILSMVPREYFHPKPKVNSSLIRLNRKKSRISHKDKQKYNYFVMKWVNKEYKKIFTKNQFNNSLKHAGIDDLNNISFEQFLSLFNSYKLFNK

SEQ ID NO: 2861 - protein, 107 aa, Staphylococcus epidermidis
  UNSURE (104): Identity of amino acid at the above locations are unknown.
RGFLYHRRDLADRRWRPRLIHRYLQTLTHNNNKESTAMRTHDVHSIIDNAPFNRFHWLVVSLCALLLIFDGYDLFIYGVVLPSIMRESGLTPLQTGALSIYDCXAPP

SEQ ID NO: 2862 - protein, 244 aa, Staphylococcus epidermidis
NRARLLVDAAVAFHRAAVEGLVDDLLVPHALLLALRLAVARDAPRWGLGAARCGGIDTDAAAGGLQGQARGQGIDPALGRAIGHPIDPACGDRRHIDDGPTALLQHVGQHAMATPQRGEQRAAHFGFDLRYRVELKGLGPDSPADVVDQNVDAPKPHLGGGHDLGTRGMLLKVGDQGQQPRMLQLMHQLRAIDRDHPGALRQQPLGHAPADALGGAGNQRYLGVKTWIHADLLTRRQNLRRHWR

SEQ ID NO: 2863 - protein, 103 aa, Staphylococcus epidermidis
GGGETIIYAQGAGLQGRQPRLAHDRWQDHAIDKQVIAIKDQQQGTQADNQPMEAIERGIVDNRMNVMGTHGSALFIVVVSQCLQVTVNQPRSPPPIGKVTPVI

SEQ ID NO: 2864 - protein, 272 aa, Staphylococcus epidermidis
RRNSPPMPSQVLTPREEISMNPRFDTKVALVTGAAQGIGRRVAERLLAEGAWVVAVDRSELVHELQHARLLTLIADLEQHAACAEVMAAAKVRFGRIHILINNVGGTIWAKPFEFYAVAQIEAEVRRSLFPTLWCCHCVLPYMLEQGSGAIVNVSSVATRGVNRVPYGAAKGGVNALTACLALETAGSGIRVNATAPGGTEAPPRRIPRNSQPQSEQERVWYQQIVDQTLDSSPMKRYGSIDEQAGAILFLASDEASYITGVTLPIGGGDLG

SEQ ID NO: 2865 - protein, 62 aa, Staphylococcus epidermidis
SRMSVACWKRGVADAMNYRGQTPNAANVKPCANVAEGLTPVLDNASCHPHAVPPSWRFQAAM

SEQ ID NO: 2866 - protein, 187 aa, Staphylococcus epidermidis
  UNSURE (2),(96),(122),(133): Identity of amino acid at the above locations are unknown.
FXASATPRFQHATDILDHIQRLQQLRRRTDLGRKRHAGLALGALGIDADHVDLFTRKDFGDVAQQALAVAGQNENIDRIHGVVATRAAPFREDHAXGRLGAHFLEILARGAVDKTPLPRVTXPTMLSGGAGLXHLGSTVIKPSVPTTKKPDLGPCSTLEARLLPNTTGLPAPQLPQCRATPAPPGAG

SEQ ID NO: 2867 - protein, 167 aa, Staphylococcus epidermidis
  UNSURE (157): Identity of amino acid at the above locations are unknown.
QGLSTRAALVHVMGDLLGSVAGIIAGAVIYCTGWMQIDPLLSVLVSLLILKSTFGVLRESYHFLMEGVPLHIDYIVVGTDVDQVDGVIAVHDLHVWDMSPGQPALIGHVEIEHLDHWPNVLRAIKKMLLDKHGIDHITLQPETATMAGLHAGDKTHXPALGSDPRPR

SEQ ID NO: 2868 - protein, 242 aa, Staphylococcus epidermidis
ALGIMRGNPCPQGPGSWWKEFLARGGGKAAVQFGNRWPKRLGFSQVGRVFPFPSARVNSACPRWSRRCTTLGKLWCRKTRCVGQEPRFQCRAGPQVRLFGGGDGGFDDGAAQVMQAGAAGQHRRIRHARQGCFIHRATCKNFEEMRAKSPERVIFTEWGSTGGHDTVYPVDIFILAGDRQGLLRDISEIFSREKINVIGVNTQSAKGQARMTFTAEISSTAQLLKALNVIKDVGGVLEARRS

SEQ ID NO: 2869 - protein, 250 aa, Staphylococcus epidermidis
RGFPPRAGGAAGPGIPRRSAAGICRRLLQWRPDGFPPGRRSTGVAGGDRNGGGEPADHGERCLSAGRAADRCVADQRHARSDQSLSRRQGQPVRLRRPGRGTLDTGLGTLVGRPERHRSAAGRGAADPSRPGVDRAPALAGRRPSAGGAAQRAWRRPRAGAAGLSLPADSRQERPGTGRASGNLALLQPVAALRLRPRRRIPDGTRLSRGDSRPDWPAPVPGRCGSRGHRGRDRAASSRPAPPVRRGWKR

SEQ ID NO: 2870 - protein, 118 aa, Staphylococcus epidermidis
SATQRSAARPADRHRSPWSAGSPPPLRSPPATPVLRRPGGKPSGRHWSSRRHIPAADRRGIPGPAAPPARGGKPRHRRHAAAPNSWRPCGNRSSGPRSRPGRPPGNLLAPPAGRSRSR

SEQ ID NO: 2871 - protein, 283 aa, Staphylococcus epidermidis
HSEDSSLKVAGLRRHYLLYVPPGVTEGAPLLVVLHGSRGDGAHMRRISGYGFDRLAAQEGFLVAYPDGFEGHWNDCRKAASYSARLRDVDDVAFLRALVARLAQEYRVDPQRVYVAGYSNGGQMAFRLAAEAPGLPAAIATVAASLPTTENDACRPVERPTAALLINGTRDPINPYLGGKVSLFGFGDRGAVRSTLDSARWWAGLNGIAAPPDVAPLTRPGPVWTERQRWQEDGHPPVELLSVHGAGHVLAQPDYRFPRILGKSDPELDAPVEIWRFFSQLPR

SEQ ID NO: 2872 - protein, 232 aa, Staphylococcus epidermidis
VKIPAVLSNDYRMGYDFIQSIQELSGIPTYFVPGNHDLWSDQADKTSTEILSFFRSKEECLIGNPIIINDQYAIVGHVGWYDYSYADHRFSQQKIASGKHYGATWQDKVRTDWSLSDPKLSLLAAQEVEKDINNVSPRQIILVTHVVTHPQFVVPTPHRIFDFFNAFIGTHDFDTIYRNYPIRFSIMGHVHFRKKLVENNILYICPCLGYQRQWMTDDIAYEINHALVDFDI

SEQ ID NO: 2873 - protein, 208 aa, Staphylococcus epidermidis
NTCAKGPEKKLLHPQTAASTPRAIYYFDMVRRCHSIREAARRLNVASSAVNRQILKLEDEMGATLFDRLPGGLRVTAAGEILTRHITLLLQDVERVRGELDGLHGVQTGHVEIATVEGAAVEILPAALKRMRERYPKVTIGVTVQGSQSIPSAVVNGQADLGLAFALPRGGEITQLCVGHFRLGALMTPSHVLAGESHVSYAQCCEHG

SEQ ID NO: 2874 - protein, 348 aa, Staphylococcus epidermidis
LHNKNRDLPTMTIPKASPQRPEDENLGVAANMAYGLQHVLTMYGGIVAVPLIVGQAAGLSPADIGLLIAASLFAGGLATLLQTLGLPFFGCQLPLVQGVSFAGVATMVAIVGSDGAGGVPAILGAVMAASFIGLLITPVFSRITKFFPPLVTGIVITTIGLTLMPVAARWAMGGNTRAADFGSMSNIGLAALTLMLVLLLSKIGSATISRLSILLAMVIGTVIAVFLGMADFSGVTQGPMFGFPTPFHFGMPTFHVAAIISMCIVVMVTLVETSADILAVGEIIDTKVDSKRLGNGLRADMLSSMFAPISGSFTQSAFAQNVGLVAVTGVKSRSVVATGGYPPDLFTM

SEQ ID NO: 2875 - protein, 207 aa, Staphylococcus epidermidis
HGEEIRRIPAGRHDRTALHPGNRHQADVLGKGTLGERTRDRREHARQHVGAQAVTQALGIDLGVDDLAHREDIRRGFHQRYHHHDAHGDDRGHMEGWHAEMEWCGETEHRPLGHPGEVSHAQEHGNHGADHHRQQDRQTGDGCAADLAQQQHQHQGQRGQADVGHAAKIRRAGVAAHRPACRNGHQCQADGGDDDTGHQGREEFGYS

SEQ ID NO: 2876 - protein, 63 aa, Staphylococcus epidermidis
LLRGDPGADVRFPHTIPFRHANLPCGRDHLHVHRGDGNAGGNLGGYPRGGRDHRHQGRFQALG

SEQ ID NO: 2877 - protein, 247 aa, Staphylococcus epidermidis
DFVTKVHCTKGSTCLTLPIPAQPSQVGGRATRKPQRRESFAGRGAFLIAAIGSAVGLGNIWRFPYVAYSNGGGAFIVPYLVALLTAGIPLLFLDYAVGHKFRGSPPMALRRLHRRMEAIGWWQTLICWVIVIYYAVIIAWAIRYVGFSVTKTWGHDPEGFLTGSFLHVASNVDVEFHFVSGVFWPLLLLWLFVLAIMATGVEKGITRASWIFMPLLAVMFITLVIVALTLDGASPGLKRRSPDNHHG

SEQ ID NO: 2878 - protein, 60 aa, Staphylococcus epidermidis
DVGEIYFAHEPGEAYPGGVNGAVTEGVVFEILLVLGLRQVKLDAVGHGDRGRDGSIARVE

SEQ ID NO: 2879 - protein, 92 aa, Staphylococcus epidermidis
LESWPARRQHMNKTEMVSSDNALPGGHTPVLAMPYFHRVTGDRLDRPFPSSETIYLAMGCFWGAEKLFWNTDGVLQTAVGYMGGLTPNPTYR

SEQ ID NO: 2880 - protein, 79 aa, Staphylococcus epidermidis
QQQWPEHSRHEVELDVNVASHVQEAARKEPLRVVSPRFRHREPDIANGPGNDDRIVDDDHPTDEGLPPPDGLHAPVETA

SEQ ID NO: 2881 - protein, 128 aa, Staphylococcus epidermidis
PYSGNAPGQRRGHTVPFGDLVHHHRTVHDGHHCQGLLPSQPTQRGLWSHHDRDLHGQRRRVLPGGGRAPAVSRRQPLRLLPRSRHRGMPRRARERSRSLPRPTINALGRDSGHDVVATPPEHHGYDHY

SEQ ID NO: 2882 - protein, 149 aa, Staphylococcus epidermidis
VYTGCTGHAETVRVTYDPTQVSTEAILTIFLENHDPTQGMRQGNDVGTQYRSEIWCTTTEQFMTATTVKGSYQANLLNAGYGAITTAISMANGVEFYLAEAEHQQYLEDNPFGYCPVHATGVCLAGLVSEVDLSHVLRSMHLVATQGTM

SEQ ID NO: 2883 - protein, 112 aa, Staphylococcus epidermidis
VGLVRALDSGGRHELFGGGAPDLRTVLCAHVVALAHSLSRVMVFQEDSEDRLGRDLSGVVGYSNGFGVSGASRVHLAVGGVRGETAHVPDGGLQYSVSVPKQLFGSPKTAHG

SEQ ID NO: 2884 - protein, 61 aa, Staphylococcus epidermidis
QQPANNEHLIHTDCRLHSGRMHSGLSKPCANIPIIQANPTNRKRCFDQLDWAITAQRLSSL

SEQ ID NO: 2885 - protein, 428 aa, Staphylococcus epidermidis
LLGEPFCIWVVGGVFLAVIGLSAIYLFTAHKIIRWRRKHIDRINEQEDELGAILFNTLKSGKSIKLEGAEHTATHPLNEAFTQYANAAVTVTSSGGFLNGIKILFISLATGGLLGWGVLDQLSGQPVISLGQLVATFSIAGSFLINITALTEGYRVLDQFLADQRRLLHLLSLPNFGDDNGQLEIPLKPKSTLILNPCIVTDTSSIRLTIKTAIEFTQIQSVAITGPSGAGKSTLLEVLAGLNPSLTSRLLIDDKPICELSAQAHLRYLRYCPQSPQFLEGYFDHSVLFGIPPSPHLNHAIEQLNLEEIVLNRSLSENASNISGGEAKRLSLLRFVNRPGEFNLFDEPSASIEQKLATPVWDLLFDIFGKRGLICVTHDVRHLHRFDQVIVMSNGAIIDQGPWSELANKTSILTLLSDFDLENQTGNR

SEQ ID NO: 2886 - protein, 63 aa, Staphylococcus epidermidis
GCGLKRFLPGSVAQLRGSSVGRGGFQTVRSDQSSLPGTGATGGNTSGTSNALGHSVRKWACRR

SEQ ID NO: 2887 - protein, 107 aa, Staphylococcus epidermidis
NNTYIIQALRQGGINLLKNNLNNLKFRKSNKDSLKLKWISLEKRKLRGCILAYDRRLNGKFLEPLHLCTEIAIFGDGLDTVLSETKKGLNEFLMFLQSYDSICSERR

SEQ ID NO: 2888 - protein, 64 aa, Staphylococcus epidermidis
ACLELLASSIPPASVSQNAGIMGMGHHAQPNSVFLVSYRIKAMINYNSNFNIKSIQHEKNKKDE

SEQ ID NO: 2889 - protein, 329 aa, Staphylococcus epidermidis
KVLSSFLMLSIISSLLTICVIFLVRMLYIKYTQNIMSHKIWLLVLVSTLIPLIPFYKISNFTFSKDMMNRNVSDTTSSVSHMLDGQQSSVTKDLAINVNQFETSNITYMILLIWVFGSLLCLFYMIKAFRQIDVIKSSSLESSYLNERLKVCQSKMQFYKKHITISYSSNIDNPMVFGLVKSQIVLPTVVVETMNDKEIEYIILHELSHVKSHDLIFNQLYVVFKMIFWFNPALYISKTMMDNDCEKVCDRNVLKILNRHEHIRYGESILKCSILKSQHINNVAAQYLLGFNSNIKERVKYIALYDSMPKPNRNKRIVAYIVCSISSFT

SEQ ID NO: 2890 - protein, 321 aa, Staphylococcus epidermidis
LVSSIDTKRRIIMKKSVRLYNMIEYCNENRNFKLNDLMSEFNISRSTALRDIKEIEALGVPLYSNPGKNGGYTIIGNRDQTKIAITDEELKALVFTLSSISNVSNLPFQTEYQEILKKLYNNSNKKELINQYNDLFQYFNEDKYQFKSYKLFNEIIRLIIENKSFETCYSQNYIKEQYKGIGIMYKNHQWYFVVANIESKLVNLLNISKIKELYEMGETQECNDITMQNFQQFMVKNETAIDILIRSNVMGLNILKGYLWSDYMIENIDEETYLFKSKVNAKDIDFIAKLIVTGGVNVKVETPNSLKNAVKVELTKIINMY

SEQ ID NO: 2891 - protein, 413 aa, Staphylococcus epidermidis
VKFLASQLFKGGFFIDYLGVDISKRSSVVAHYKNGKFQKEFFIQNNKNGYNYLLKYLNDLDHPQLIFESTGIYSRGMERFCCVNQINYIQMNPLEAKFKTSALRSWKTDQADAHKLACLGPTLKQTGSLPIHELIFFELRERARFHLEIENEQNRLKFQILELLHQTFPGLERLFSSRYSIIALNIAEIFTHPDVVLDIDKDVLITHIFNSTDKGMSMDKATKYALQLRVIAQESYPNVDRHSFLVEKLRLLIQQLKQSIHHLKQLDDAMIQLAQQLDYFENIHSIPGIGKLSTAMIIGEIGDIKRFKSNKQLNAFVGIDIKRYQSGHTHCRDTINKRGNKKARKLLFWVIMNIIRGQHHYDNHVVDYYYKLRKQPNEKPHKTAIIACINRLLKTIHYLVMNHKLYDYQMSPH

SEQ ID NO: 2892 - protein, 181 aa, Staphylococcus epidermidis
FSTFNFFLLSACTINIERDEENSEKNKQKENTHTDSNNTSSNESNTSKQSSQENTINQTEQNQPTENNSSSQQDLQLITENEAIQKVKDEFPPIRTGNDYRIDTTRTDNNVYAIKFTSQDAEGYPMKAAVTIDKRTGEFIDYIDDRSDEDKERHVQHAKESTLYKGPYDAFRKDFSHKINE

SEQ ID NO: 2893 - protein, 187 aa, Staphylococcus epidermidis
TAELPKKTTRIGKPYYKTDNLLQRQFKASCPMEVLTTDITYLPFGHSMLYLSSIMDIYNGEIVAYKIDDKQDQSLVNDTLNQIDIPEGCILHSDQGSVYTSYAYYQLYEEKGIIRSMSRKGTPADNAPIESFHSSLKSETFYINNELNRSNHIVIDIVEKYIKNYNNNRIQQKLGYLSPVKYRELIA

SEQ ID NO: 2894 - protein, 147 aa, Staphylococcus epidermidis
LVYTLHLLYFKKEVSMMTKKIIYFICTGNSCRSQMAEGWGKKILGDEWQVYSGGIEAHGVNPKAIEAMKEVGIDISNHTSNLIDKNILNQSDLVVTLCSDADNNCPILPPNVKKEHWGFDDPAGKPWSEFQRVRDEIKTAIESFKTR

SEQ ID NO: 2895 - protein, 425 aa, Staphylococcus epidermidis
VMEFNGILEDYATYIYRGKQPKYSTNGIPVINQKAIQWSGLNKEFLKFHNNEIKVDSRHFVKKNDLLINSTGTGTVGRVYHFKFQPEKMFVDSHITIIRTDENKLRSRFLYYQMRTNKFQNMILNEFLAGSTGQVEFNKSMVKKLPISIPEVNYQDVVIKVLDELEDKIEINKKIIANLEELSQTLFKRWFVDFEFPNEEGNPYKSSGGEMIDSELGKIPSNWKIYKLKDIASHKKETFNPKKSEEVTVKHFSLPAYDNEEQAIEEEVNKIKSNKWIINNNCVLFSKMNPDTKRIWLPVIDNKKLNVASSEFVVMESPNNKINSFIYNICLNSQFIDYLKANTTGSTNSRQRVKPTIAVNYKLAIEDSIVKKYSEIITPYMEEMKILRSEIGKLTQLRDTLLPKLMSGELEISDDIEVNSDELSI

SEQ ID NO: 2896 - protein, 127 aa, Staphylococcus epidermidis
SSNTRTQTKIEITIYKRGDYSMEFIKSSSNGTEEEQLEFYEQIFNALADKIRLKILHSIRQSNTKSLCVCDLEELLELKQSKLSYHLKKLVDANILIAEKHGTWNYYKINEQQIQVVLNEDTCCKIL

SEQ ID NO: 2897 - protein, 564 aa, Staphylococcus epidermidis
LLCTRCSIVRCVWRRIIMNHILQMLSKLLSVAKEAIDRQGLIAILTIPVNNDDEIEETAQGETVYNELIDQLRLNIPKDTDYRPNIYSYFGIKKNPNDTVLMEMMIKVFHIKRFNSELFVFKANGWQKINGDELQGLISKMIQVLLVDYKPSLSTLKNVVDGLQKSTDVEELVENEHYIGCGENMFDLNTFQVVKNSIDIFPKTRLNLSLSTNDVITDKIPPYFKQYMLQLANYDDDLQYFLFQHTAVLLTADTKYRRGLILYGGAKNGKSVYIELVKSFFYSKDIVSKPLNELEGRFDKESLIDKSLMASHEIGQSKIQEKIVNDFKKLLSVESMHVDRKGKTQVEVILDLKLIFSTNAILNFPPEHAKALERRINIIPCEYYVEKADTSLIDKLQSEKKEIFLYLMYVYQQIVKADIEYLENSRVTEITHDWLNFGYEFVSSRSVSIANQKACINLLRKLIEIKSGSRIKVSELNKVINEEIKVSSQVINQLIQANFDTQTKLYNGYDYWIDLGWKEANKKEIHDISEKDNIISLDKNENITDDEALDEENLDFDWEDCDDE

SEQ ID NO: 2898 - protein, 74 aa, Staphylococcus epidermidis
KGVTGNGKSYIAFTLVNHAIDNRYSVLFYRLTDLLSKLQQADYNSIDKLLKVISRTDILVNDDFLLPYTTEQEQ

SEQ ID NO: 2899 - protein, 144 aa, Staphylococcus epidermidis
TKLTRCLMYKDYNMTQLTLPMETSVLIPTNDISRHVNDIVETIPETEFDEFRHHRGATSYHPKMMLKVVLYAYTQSVFSGRKIEKLLNDSIRMMWLSQNQKPSYKTINRFRVNPKVDALLESLFIQFHSQCLKQNLIDDQAIFH

SEQ ID NO: 2900 - protein, 90 aa, Staphylococcus epidermidis
APSTKVAMAKVIKAFKLKPDCHCTSKYLNNLIEQDHRHIKVRKTRYQSINTAKNTLKGIECIYGLYKKNRKSLQICGFSPCHEISIMLTS

SEQ ID NO: 2901 - protein, 63 aa, Staphylococcus epidermidis
TIATFQPNKTHSINTINGFINGEAIKKLTAGPKGTLEFNRPASIGIVEQEQKGVIAPNIIPKK

SEQ ID NO: 2902 - protein, 109 aa, Staphylococcus epidermidis
MARTYNVIKYVIKKNKDDLKIHGLRLYEFNIKDEKAINISQPIFVNRATLIEKIQNDEAFTHAFRVNHNTYYAGQLISLSLNKNGYINNNFEASRDIIRNVEVSILDYE

SEQ ID NO: 2903 - protein, 162 aa, Staphylococcus epidermidis
MEFAYYEAKSLNDFENELKTLALNKKYTFSKETEVLKEEEILEKSNSHERELLKVFKDNAQITTYHFKSHKSNYLIIIGETKTPNIIGLTVIFDKKPFKQIGKVALGWLIALTSGGSILAIGAVFGILTSVARRTLVIKGPLGKEISQIIENELGEPIEIKK

SEQ ID NO: 2904 - protein, 65 aa, Staphylococcus epidermidis
LPYANTTATPNIATNKITPKLAKIFFTLLTPFYIYFNFILIYFATLFYIYSKIIEKEHILKSMCL

SEQ ID NO: 2905 - protein, 169 aa, Staphylococcus epidermidis
NKKALTTIAIIIIFGILAPVVFLLQQISRSRIRKNKLQAKQKENNGSNSQIISETSNNMNPENESSSNNQEKTQTTTHEATMNQQKVTRDNIFDYAIAAINKVGNADLLKFQQPEHNGSEWTINANNKSGTGANTIVVKDDETVQIWMDLKHLWIMKLNNQIGERLLVV

SEQ ID NO: 2906 - protein, 71 aa, Staphylococcus epidermidis
EALFIEKKHLRMIHFNMNSTKVFLYNSHYWGQSKIKIDNFFNKIDTLILKQGKKIELLKQRKQGLLQKMFV

SEQ ID NO: 2907 - protein, 230 aa, Staphylococcus epidermidis
QKGAFCMNYFRYKQFNKDVITVAVGYYLRYALSYRDISEILRERGVNVHHSTVYRWVQEYAPILYRIWKKKHKKAYYKWRIDETYIKIKGKWSYLYRAIDAEGHTLDIWLRKQRDNHSAYAFIKRLIKQFGKPQKVITDQAPSTKVAMAKVIKAFKLKPGCHCTSKYLNNLIEQDHRHIKVRKTRYQSINTAKNTLKGIECIYALYKKNRRSLQIYGFSPCHEISIMLAS

SEQ ID NO: 2908 - protein, 230 aa, Staphylococcus epidermidis
QKGAFCMNYFRYKQFNKDVITVAVGYYLRYALSYRDISEILRERGVNVHHSTVYRWVQEYAPILYRIWKKKHKKAYYKWRIDETYIKIKGKWSYLYRAIDAEGHTLDIWLRKQRDNHSAYAFIKRLIKQFGKPQKVITDQAPSTKVAMAKVIKAFKLKPDCHCTSKYLNNLIEQDHRHIKVRKTRYQSINTAKNTLKGIECIYALYKKNRRSLQIYGFSPCHEISIMLAS

SEQ ID NO: 2909 - protein, 101 aa, Staphylococcus epidermidis
TLQAIKEDMHLILFDGTITLEGEHAVRIDEHKIRGDRMVVPFDTFKQIGKPRNQNDIHFKNDPFQRVTNDLWITNPSLSEVDQEQIWQTGDYFSKHLQNIE

SEQ ID NO: 2910 - protein, 113 aa, Staphylococcus epidermidis
EITYIMISKQIKDLRKQHNYTQEELAEKLNTSRQTISKWEQGISEPDLIMLMQLSQLFSVSTDYLITGSDNIIKKDNKSYYEMNFWAFMSEKWWVIIIIVIIICGTIGQIFSN

SEQ ID NO: 2911 - protein, 157 aa, Staphylococcus epidermidis
KANYKWRIDETYIKIKGKWSYLYRAIDAEGYTLDIWLRKQRDNHSAYAFIKRLIKQFGKPQKVITDQAPSTKVAMAKVIKAFKLKPDCYCTSKYLNNLIEQDHCHIKIRKTRYQNINTAKNTLKGIECIYALYKKNRRSLQIYGFSPCHEISIMLAS

SEQ ID NO: 2912 - protein, 400 aa, Staphylococcus epidermidis
KDNYMKKHAYKQLLLGMIAMLIVMSISRFAYTPILPFMQQDTSMDNQEAGFLATWNYLGYLVGAVIPIFYIYKTKVIDLKIYLALNIISTILMGFTEQYLIWSIFRLISGITSGTVFVLTSNIVLDSLKKIQREGISGVLYSAVGLGIFLSSIYLYFFASVDSWKMVWFVLGIVSLVLGLIVLVFMKENTNTIINFKEEKMKINNRLNKKFVIFFSIAYFFEGAGYIITGTFLVAIVKSIPSVAEYATLSWMFVGLGAIPSTLIWSLIAEKISYKKAIYGAFILQIISVCLPVFTHEIFSLVISSVLFGGTFLGLTTLFISKGQSLMYKTDDPLNLVSLLTVIYSLGQMLAPMFAGILIGKSNNYNIALIFATVLLILGLISTIFSYKQNESIGEKYELK

SEQ ID NO: 2913 - protein, 83 aa, Staphylococcus epidermidis
VQEYAPILYQIWKKKHKKAYYKWRIDETYIKIKGKWNYLYRAIDAEGHTLDIWLRKQRDNHSAYVFIKRLIKQFGKPQKVITD

SEQ ID NO: 2914 - protein, 115 aa, Staphylococcus epidermidis
EKRYRIGYFKKVQGIGEEVVPTVVVDLVDQLKVKYSIKLILEVLNIPKSTYYRWKNKTHKNDTVTQKVIELCKANHYTYGYRKITALINQCYTSPINHKRVQRMMQKHHLNCRVT

SEQ ID NO: 2915 - protein, 301 aa, Staphylococcus epidermidis
EKRYRIGYFKKVQGIGKEVVPTVVIDLVDQLKVKYSIKLLLKVLNIPKSTYYRWKNKTHKNDTVTQKVIELCKANHYTYGYRKITALINQCYTSPINHKRVQRMMQKHHLNCRVRPKKMTKIGKPYYKTDNLLQRQFKASCPMEVLTTDITYLPFGHSMLYLSSIMDIYNGEIVAYKIDDKQDQSLVNDTLNQIDIPEGCILHSDQGSVYTSYAYYQLCEEKGIIRSMSRKGTPADNAPIESFHSSLKSETFYINNELNHSNHIVIDIVEKYIKNNNNNNNNRIQQKLGYLSPVKYRELIA

SEQ ID NO: 2916 - protein, 563 aa, Staphylococcus epidermidis
KERYDMKGKIALYSRVSTSEQSEHGYSVKEQEQVLIKEVVKNFPGYDYETYTDSGISGKNIEDRPAMKRLLQDVKDNKIEMVLSWKLNRISRSMRDVFNIIHEFKEHDVGYKSISENIDTSNASGEVLVTMFGLIGSIERQTLISNVKLSMNAKARSGEAITGRVLGYKLSLNPLTQKNDLVIDENEAHIVREIFDLYLNHNKGLKAITTVLNQKGYRTINQKPFSVYGVKYILNNPVYKGYVRFNNHQNWAVQRRSGKSDKNDVILVKGKHEAIISEDVFDQVHEKLASKSFKPGRPIGGDFYLRGLIKCPECGNNMVCRRTYYKTKKSKERTIKRYYICSLFNRSGSSACHSNSINAEVVERVINVHLNRILSQPDIIKQIASNVIEELKQKHSNQTEIKYDIDSLEKQKAKLKRQQERLLELFLDDQMDSGMLKAKQSEMNQQLEVLDQQIKEAKQANQSQDEIPNFDKLKGRLILMITRFSVYLRKATPEAKNQLMKMLIDSIEITTDKQVKLVRYKIDESLIPQSLKKDWGSFFMPKFQFEIYGQNDYFIDQITTFTT

SEQ ID NO: 2917 - protein, 289 aa, Staphylococcus epidermidis
CKYLSNILGGFIMKIKKLLKTLLIILLCFVLSVIVQNISMLWHIVSIWSVEYILHALTYIVLSYFSVKWFIEIVLKSNMKDYRIIPVKFFKSCFLIGLILILVIDLIYLLFIPGKLIIPHYSTSVGFMEMFFSAFLITGIAAPIFEEMVFRGILMRYFEKQYGILFGIIIPSILFSLVHLFNGELKGENLLLLLIGGSIAGIMYAVTAWTFNSIWASAILHMLWNINGLLNITTQDDHWGVYQYILETKNVLITGGDYGMDTSLLSICSYIAVIIVMIVTKRHFNFLLK

SEQ ID NO: 2918 - protein, 117 aa, Staphylococcus epidermidis
VLIQILKNVLSILHFMIQCLNLIETSVLLRILYVVYRASHETAKEALGDKELRAIAHELTKTVKDNMSVDWSKRDSAKAKMRVQVRRLLKKYGYPPDLQKMAVEQVVEQAELMASPQ

SEQ ID NO: 2919 - protein, 84 aa, Staphylococcus epidermidis
IEYQLYVHHNITYFLHSIQIVHINACILKMVAFFMVLITTTIKIYQEKFLLKFFKSLPFNRIKDNRFISSYSLLACSSSSSKAL

SEQ ID NO: 2920 - protein, 489 aa, Staphylococcus epidermidis
LIRLSFIKNIIEGESMEMEFNENNIDLETIIRDEVNKYLSRDIGDLPATQQAPLELREKYEKMEVPNKGRDIYEVLKDLNNEVLNYLYRPNHPRSFSFIPGPASRLSWLGDILTTANNIHASNFANATLPINIERNLINYLVGKIGYEIKPAGGVFVSGGSMANLTAIVAARDAQVEMEDIKKATVYLTSQTHHSVGKALHVAGFLKNNIRRIEYNDDFTMNTDSLKAAIDKDIEEGYKPAMVIATAGTTNTGSVDDFTTLGDICDHYNLWLHVDGAYGLSHILSDKAQHLFKGIERSDSASWDAHKLLFQTYSCAMVIVKEKNHLLQSFGEDAEYLDDIASDDDVIDPEMLGIELTRPARALKLWITLQVIGEDEIIERIKYGEGLAEYAEEYVSSLDNWRIISHANLSIVNFRYENSDLTEAQNNQLNSMAAQKIADSGYAIAYTTVLNNQRVIRLCTTNPLTTHDDIRETINRLDQYIGDYDMKDA

SEQ ID NO: 2921 - protein, 76 aa, Staphylococcus epidermidis
ELRHILYMNELILLLGDSITTNSDEATFNFLLSITGNQILLVSGFIFENNTQLLLIIHLLLFILLTSSSIACSSLS

SEQ ID NO: 2922 - protein, 237 aa, Staphylococcus epidermidis
VIFKGFIVMYEENIYIKNSEYEFDNNLKQLASYLNIPVSIVRPYKEDLTLYQYKKGQVIYHSTDQIKFVYFLVNGCILHESSNITGDNYLRLSKDENIFPMNFIFNETPAPYEICTALTDCKILTLPKDLLEYLCRKHNEIFESLFKKLNETIQFQVEYIMALRANSAKERIERILQILCLSIGDDNGEFYELKQIMTVQLISNLSGLNRKTTGEIIRELKIENIIYQDKRNWIIKK

SEQ ID NO: 2923 - protein, 85 aa, Staphylococcus epidermidis
LHFKGINAINLSSNCSILELYCCNLIVIIYILVYKAIVQHYRKLTTFYWRYYILNQFQNKLYTTYFLVLFVIRFCVSVKSAVFYN

SEQ ID NO: 2924 - protein, 164 aa, Staphylococcus epidermidis
GDFNMVKKDKDTNDQKSESHMKHNDESKVPEDMTSTNEGEFKVGDKVTITAGHMPGMKGAEATVKGAYKTYAYVVSYKPTNGNEKVNNHKWVVNEEIKDAPKDGFSKGDTVKLEANHMSGMKGATAIIDNVKKTTVYVVDYKSKDNGKIIKNHKWMTGNELKAR

SEQ ID NO: 2925 - protein, 107 aa, Staphylococcus epidermidis
MMTNVQRMIQMNKKSLHFLLLKRKVLGIAFNLPEGEEFTFHDLNSRANVTCSKEVQQNVGRWFAYFVKHAPRVPFIIIGKDTHGHLVYLKTGPNPHHNSNPSKGGVR

SEQ ID NO: 2926 - protein, 71 aa, Staphylococcus epidermidis
VYCLPTCCENLYASFGKTEEGRWIAKNAHNYGFIIRYPKNKESITGYQYEPWHLRYLGKRRRQKCTNLVKH

SEQ ID NO: 2927 - protein, 284 aa, Staphylococcus epidermidis
MNHNFIKLIGEVKMHYIKFIESKDNTKLYMKVNDIQDAKANIIIAHGVAEHLDRYDEITAYLNEAGFSVIRYDQRGHGRSEGKRAFYSNSNEIVEDLDAIINYVKSNFEGKVYLIGHSMGGYTVTLYGTKHPNTVNGIITSGALTRYNNKLFGNPDRNISPDTYIENNLSEGVCSDLEVMEKYKLDDLNAKQISMGLVFSIMDGVRYLKDNAQQFTDNILILHGKEDGLVSYVDSLQLYQEIGSAHKSLHIYDRLEHEIFNESSYNRTIFNEVIEWLETELTYN

SEQ ID NO: 2928 - protein, 60 aa, Staphylococcus epidermidis
AENNTKIYKKKDNFYIISIEIVFFHLFRNVISTEFFSKITGREKVDVSHQQNLLKMLSYT

SEQ ID NO: 2929 - protein, 124 aa, Staphylococcus epidermidis
TMNNDRGKSLQIPQSTSLKEGSIYVATLHSVTETDYSGDIKHQFTYEIEIDQQIFYVNRSVVVNVTHQQLSINDWLERHSNYSASHENYEPYIDQKHLILLGQYNGNYYVQDVASLDAFGGVLS

SEQ ID NO: 2930 - protein, 124 aa, Staphylococcus epidermidis
PKNKIFLERVVRMMDENRSKGNRWGVWAFFGILLVPLLVPLLCCAGPILLVALGSTGIGALFAGATGNWWLTGIFAALAIVMIALILSKLLKNKYNSPEGNGKTKNKTDCCTPPESVDRKHETR

SEQ ID NO: 2931 - protein, 422 aa, Staphylococcus epidermidis
CECNKAKEEFEMVQGPIQVNSEIGKLKTVLLKRPGKELENLVPDHLSGLLFDDIPYLKVAQEEHDKFAQTLRDEGIEVVYLEKLAAESITEPEVRENFINDILTESKKTILGHETEIKEFFSKLSDQELVNKIMAGVRKEEIQLETTHLVEYMDDRYPFYLDPMPNLYFTRDPQASIGRGMTINRMYWRARRRESIFMTYILKHHPRFKDKDVPVWLDRNSPFNIEGGDELVLSKDVLAIGISERTSAQAIEKLARNIFKDANTSFKKIVAIEIPNTRTFMHLDTVLTMIDYDKFTVHAAIFKEENNMNIFTIEQNDGKDDIKITRSSKLRETLAEVLEVEKVDFIPTGNGDVIDGAREQWNDGSNTLCIRPGVVVTYDRNYVSNQLLRDKGIKVIEITGSELVRGRGGPRCMSQPLFREDI

SEQ ID NO: 2932 - protein, 69 aa, Staphylococcus epidermidis
IVANGYSDNILVKLFISEIVHTKDSFLLKLYYKFNFATEPLKDMFVIHICKNQKIMVIYIIIFDNNYLK

SEQ ID NO: 2933 - protein, 112 aa, Staphylococcus epidermidis
KKSKMEENSMKINRYITRGISEQLSLDLQILLWNMVKDRDNQLNTDYLHIFKLQEDDNMLSITHEQEQPAYKLEYHYTNYIKNQNALPKKVYVIREDDVDAFYYVMLLPEEY

SEQ ID NO: 2934 - protein, 74 aa, Staphylococcus epidermidis
YFIKEFDFMKINHAGTLSVDYFVSYLNLIMISREVSLKEAVSYMKNEFFKGKTDLYGKVTETHFNQAIQELKQK

SEQ ID NO: 2935 - protein, 85 aa, Staphylococcus epidermidis
LIIKKRLNDIETLKVYLVLNDSMAVLISSLTRWNSDQGLPAGSSNPQCSFFTFGGNIGQLLSASLHKVTTKSDWFSIFLSIKLEV

SEQ ID NO: 2936 - protein, 127 aa, Staphylococcus epidermidis
RKVKKVKKVENTNSNMHKNDNSYVLSALSYLSIFFAPVILPLFVWILADEPTSGHGKKALGNHIMTWISFCVGRGIFIFSKGVFDKPFDHQLLIFVIALIIAIVFFLIALILYILNIIRGIKILLKK

SEQ ID NO: 2937 - protein, 127 aa, Staphylococcus epidermidis
RKVKKVKKVENTNSNMHKNDNSYVLSALSYLSIFFAPVILPLFVWILADEPTSEHGKKAFINHIMTWVSFFIGRLAFIFSKEVFDKPLDHQLLIFSILLIITIIFFLIALILYILNINRGIKILLKK

SEQ ID NO: 2938 - protein, 84 aa, Staphylococcus epidermidis
NSSNMDGPKTSMDHETKQSDWRTVASCLASQNYISLVKGLVHYFTAIEDEEILDKIYDDFMNDDSITTVLNNDLQTIINHYLSK

SEQ ID NO: 2939 - protein, 374 aa, Staphylococcus epidermidis
KEQNTMYQTNTRDLITKLPQSNKTEHFLMNKFSNQDKVQQLQRQISQQLDQQYNELLSNEKAKLDQYVEVHHNLEPLKKEIESESINLDTDKLPDIKATMLEKAKNDEHSDKIEHLFDRLDQSLNGTNRLYTQLSLIGTRTHRITTKRFNVQGLPKLVQQTILPSQFKKVYTIDFKSFEPSVAAYMTQDEQLIDYLNLEEGLYDALLRDLSLSKEKRVSVKRAFIGSFLFGGRYSSSKFKINQEVSEINWLQVMSKFKKIIEFKEQVEKYKTMPTPYGIEHDMSAFQGSSIMAIYVQTVASYIFKHILLEVYKAQCEQKTFKIIVPIHDAIMIECNDKEIAQSVAQLMKDTANRLFNGEFAHVTVEALGGIDNE

SEQ ID NO: 2940 - protein, 670 aa, Staphylococcus epidermidis
VNKNITALKSTENTTYMQYTVHIDDQIINNIKECTKKFKILPMEDKIPLSPLLQPEYAGEVQDFISTYEQFMINFGKVILDSQGIKIQFESESLSSIQRGIQEHCYLNKRTNDIDVTKEWYLCKFSNRTLEEDKNQLYNALKQLMNDSKNKKQAFQEVFKVHIDIYLYNKEKSEYKYQASSYFYLVKENPKIIYKKRHLQEKQGIKGTTFTNKLKLLNKMYGVDVAKYQPFYNSNNPEYERGQFGERYISQRSNYEFNRLQYQIIYILSKILDKHPLPKSDNNYKHIPTIEKAILRDDSHNFYEYFEDIMKEIMNMDNSPLQEKLLTDFTYQSQCRWYSENKKLKLQLERFMHKVLESNYYEGNKLLRMMSNAIEETINEAKEDKVHFNYFKDYFLTDGGVKNWEQISEKITEFNGKVINDIQHEYNKIQSKNTNQNQKLNFVYLYHCFEFSNNIVKAKDNESKNYILFFIDKYKIKTPFLDQLLINCLNQEIDQESINYNMQTMFEKERYDRSSIIEKLVATRKFKYEKDDSDLFKQLFNDVENSIDRLGIYLLNNGINSNDENARYYRSFLKELSRIKSKLTPFSLEISKSSGREQHYPDDAVDDKDERRKNKEETYHAFDDKSDIDYKLKNKISDYIDNLLSVKIRNNLYDISPNTKSNNYNEPTQK

SEQ ID NO: 2941 - protein, 143 aa, Staphylococcus epidermidis
MFKNILLPYDFENDFSAIPDYLEKVTDEDSVVVIYHVVTENDLAISVKYYNKHKEDIIREKEKKLTPFLRELEKRDIQYKIDVDFGHIKDTILEKITSGDINNGEFDLVIMSNHRVDLNIKHVLGDVTHKIAKRSSVPVLIVK

SEQ ID NO: 2942 - protein, 428 aa, Staphylococcus epidermidis
SRKKLTHFKNKCLKSLKRGFYVMLSKKQIKKTLNSDKMPSLIVNELDRELRNKWKQQYPSKEELIKELKYDAVNENSAVLKNELTSKLKFKLKDYQDSNEFLFYLKNSQKMIEIHDYKMEQFFEDIPLEDSDVYKSIANNEDTETYIIMKAPEFNEEDKLNISIKVDGKFKELDFHRIAYDSKKEMKYLYQNRYIKIFMLIEKNLEYISWGFHHLFNESIGEVNTINIIDTYKMLIALASGEMYTANKIKFNNDSASKNKEILESLNRDLKLFEIIHEFQNSLDKEFKISTPFNSKEIIEGVKTYFLLYKQKLILEEKRLESLLIKTSSFDLEDIKGKKFTLIQEEKVTKTIFTQKISYTQYQCYYQVKSSDYEKLQDDEFKLKFNPEDVITIILKASFNTTEPIGLENIAFEEAETLDTFISNYKSN

SEQ ID NO: 2943 - protein, 146 aa, Staphylococcus epidermidis
GGKNMKFQVSPYFLITQNAEGLKKLYEELFGAKTLYIQRIKDRPIDKQLNIDENDLNKIDQCVLQFGDIKIMIADDTEGLPITQGNNISLCLTFDQVEETKHVYDQLIEKGSEVLKTFSPEFYTEGYGYVRDPYGISLHLFTKRKN

SEQ ID NO: 2944 - protein, 173 aa, Staphylococcus epidermidis
RSENFMKTIKSTLETEAIFSDDQQHRYLLKKTWNSEKQKITIITMYPNYTGLLRIDLTTQLIMNKVSEMDTFGSINFVNLYSNITTPINLKHLENAYDNHTDIQIMKAVKESDEVILAWGAYAKKPVVESRVNEVLEMLKPHKKKVKRLMNPATNEIMHPLNPKARQKWTLKA

SEQ ID NO: 2945 - protein, 226 aa, Staphylococcus epidermidis
SGENIRRNKLMKNISEFSAQLNQTFDQGEAVSMEWLFRPLLKMLAEGDPVPVEDIAAETGKPVEEVKQVLQTLPSVELDEQGRVVGYGLTLVPTPHRFEVDGKQLYAWCALDTLMFPALIGRTVHIASPCHGTGKSVRLTVEPDRVVSVEPSTAVVSIVTPDEMASVRSAFCNNVHFFSSPSAAQDWLNQHPESSVLPVEDAFELGRHLGARYEESGPTNGSCCNI

SEQ ID NO: 2946 - protein, 322 aa, Staphylococcus epidermidis
NQEKKKTIKFEVNQDSATLWYHPHPSPNTARQVYNGLSGLLYIEDSKKNNYPSNYGKNDLPIIIQDKTFVSKKLNYSKTKDEDGTQGDTVLVNGIVNPKLTAKEEKIRLRLLNGSNARDLNLKLSNNQSFEYIASDGGQLKNAKKLKEINLAPSERKEIVIDLSKMKGEKISLVDNDKTVILPISNKEKSSNKGNTPKVSKKIKLEGMNDHVTINGNKFDPNRIDFTQKLNQKEVWEIENVKDKMGGMKHPFHIHGTQFKVLSVDGEKPPKDMRGKKDVISLEPGQKAKIEVVFKNTGTYMFHCHILEHEDNGMMGQIKVTN

SEQ ID NO: 2947 - protein, 325 aa, Staphylococcus epidermidis
ADRKMSISEYKNRYLESLYNTFKTELENERTRYFILDTNYTNSDDTEKEFTWDVKQNNKIREGDLFIFRRPTNLSQIAQQFYFFGAGKIEKIERKNNVATAYISKPLLFVDRVLKDNIENLKWEFKERIKEEWEQFFFKNKISNITKNDFLKLLSLSRNVVEIESNYINNDISLTFKQMADMATRIKKNIYYVGNHEAFVQAKGSAHFEFSKRIKQNYSYRCAITGIKTKDFLVVTHIIPWHENEFIRLDPSNGICLSLFLAKAFKKGFITFSNSYRVVLSKEAEKDAALYEELKIYENQKIELPDCQKPNLKYLDWHREHIFKN

SEQ ID NO: 2948 - protein, 169 aa, Staphylococcus epidermidis
RYMNTIKSTIHTEAIFSDDEQHRYLLKKIWDDKKPACTVITMYLHLDGVLSLDLTTVLILNQLANSEQYGAVYLVNLFSNIKTPENLKHIKEPYDEHTDIHLMKAISESDTVILAYGAYAKRPVVIDRVEQVMEMLKPHKKKVKKLINPVTNEVMHPLNPKARQKWTLK

SEQ ID NO: 2949 - protein, 1041 aa, Staphylococcus epidermidis
IVMNFQFNEDDLEQVALEWLQSLGYDYKKGNEISMTGLTPERKSDKDVVLHERLEKALRKINSDIHPRFIEKAIHELTLEKSPNLLENNLTFHENLINGIEIEDYDDEGQSVVEIVKIVDFEYPQNNDFLAVNQFTVVNGDYTKRPDIVLFINGLPIVVIELKNSTIETVGVEDGYRQLETYKMRIPQLFTFNEVLVTSDGINTKAGSLTANYDRFMTWRSKDGETESSSSLASLDVLIHGMLNPETLLDLIRYFVLFQDDGKGHISKILAAYHQYYAVNKAVDRALLASSGQGDGKGGVIWHTQGSGKSLTMVFFSGKLIQMLNNPTLVVVTDRNDLDNQLYSTFVKSKGRSGKGLLRQTPKQAETRKELKSLLSVESGGIVFTTMQKFEPEQNETTMSALTERKNVIVMADEAHRTQYGFNAKYDDKGEGIKYGYAKYLRDALPNATFVGFTGTPVASTDKNTQMVFGNYIDVYDMTQAVADGSTVKIYYESRIIPLNLPQNLDLDEAYNDITEDQEEDVKQRLKSKWSRIEALAGAKPRVEALAKDIIQHFETRQQAMKGKGMIVTMSRRIAVDLYDEIIRLKPEWHSDDDDKGVIKVVMTGSSMHPISFQRHIGPKKRRNLLEKRMKDMNDELQLVIVRDMWLTGFDVPSMHTMYIDKPMKGHNLMQAIARVNRVFKDKPGGLIVDYVGIAESLKEALKEYTESDQAQTAIDTDKAVELMLLKYDVIQDMLYNLDYSKFNSEKKSERYYAISDTMDYVIGLGEDERQRFIKTVTELGKAFALCATEPTAQELNDEIAFFKAVKAGLVKLLQPPKEGKTRKTPAEVEAEINQLVSQSVVTEDVIDVYQTLGLEQPDLSILSDDFLKDVEGLKQKNVAVELLNRLLKGQVKSLMKTNATVSKRFSEMLGNSINKYNSRSIETSKVIEELIQLAKDIKQEQQRGNELGLNSDEIAFYDALASHETAKEAMGDKELRAIAHELTKTVKENMGVDWSKRDSAKAKMRVAVRRLLKKYGYPPDLQKMAVEQVVEQAELMASNQ

SEQ ID NO: 2950 - protein, 112 aa, Staphylococcus epidermidis
KSQNERKSLMNRYITQGIANNLPIILQQQLWKIVAQRENEQSKELEAIDYFHIFQFNMHNDQLYIKHKQERPEYIKTHKANYSKAININKVYIIREDDVDLSYYVMLLPEEY

SEQ ID NO: 2951 - protein, 82 aa, Staphylococcus epidermidis
LIKKMDEDKGTGKILSSLYIKDDELKKQYSTCREFLDDYLYTAWIIPVLLNEHATSQLEEYLGRYLINQNVPILNLLSHTFK

SEQ ID NO: 2952 - protein, 60 aa, Staphylococcus epidermidis
IVEKLKTLLNLSHFIFLYTVSRTQHTTNEFQKVRVKLTCFFYGFKILESGQSTPLYNYKK

SEQ ID NO: 2953 - protein, 61 aa, Staphylococcus epidermidis
IHRLVKMMDFFKLWMRYRVSLDKNRENLLKSDFCEEDNDDKEIRSYCDWYRFCGVNHSSKM

SEQ ID NO: 2954 - protein, 120 aa, Staphylococcus epidermidis
GGNDMKTTTQELKQYMTRLFQLSNNETWECETLEEAAENILPKRFINDSPLAHLILETYTYYNNELHELSIYPFLMYSNNQLISIGYLDHFDMDFLYLTDTKNTIIDERHLLKEGGNNHE

SEQ ID NO: 2955 - protein, 258 aa, Staphylococcus epidermidis
IMNDLLKIYEKLKKDIENRWLIPFHYVVFGLALVVYFLEIPIYKLVNNLDKELVDKVLYAFSLVYDHIVLIFILIIIIILIVYLFFDVFNMNRFVPSPTTYVDGSESSINYVSAIKRLINFMILIITKYWITYFIVNLIFHNDKLLYLNNDSKHLYKCLLFLNICIFIVHILKSIFIIKIMADDSLRLINENDLTDFYITLNKNDEYRMVKPKYRKIDNFIIIKKSEDFTNSNEYKVINKSKNFEEIIYHFDNLTSNH

SEQ ID NO: 2956 - protein, 61 aa, Staphylococcus epidermidis
YLMEVFEIRSREKSLILCSQMTSVEWHKKLSGKVIAYAILIRAVSKSFKIFLEVESLRKIK

SEQ ID NO: 2957 - protein, 149 aa, Staphylococcus epidermidis
TMKEINIVSLQMIKTDTLSYLKNHISNPEDAAEILRSFIGNSDREHLILICMNSKNEPTHIQTLSIGSINQTVIHPREIFKTAILSNANSIMLGHNHPSGDITPSPEDINVTKRLMLISEMMGILFYDHIIFSDSNTYSIRQHDLEVEV

SEQ ID NO: 2958 - protein, 128 aa, Staphylococcus epidermidis
TTSLLHYLGGNNMKTITQELKQYITHLFQLSNNEAWECEALEEAAENILPERFINDSPLVHLTLETYTYYNDELHELSIYPFLMYANNQLISVGYLDHFDMDFLYLTDTQNIIIDERHLLKQGGQDHE

SEQ ID NO: 2959 - protein, 70 aa, Staphylococcus epidermidis
KRALETDNLYYLAYVTTLDNCFKYYQLITQNEHFCYSQQEERESYQQKFQSMINGLKIKIGIQSSNDDAQ

SEQ ID NO: 2960 - protein, 144 aa, Staphylococcus epidermidis
RGELMHWKENRIKSAKNDTNPMVIKELKGSYVVFGDVQFLPGYCVLLPKREVRLLNDLTLEERQDYLLDMSFVGDAMMKALKPTRVNYEILGNKNHFLHAHLFQRYEWEDESVRYMPVWCMMLLIGLMKKRLTILINMMKLEIR

SEQ ID NO: 2961 - protein, 243 aa, Staphylococcus epidermidis
TGLWRGLAPCFKDRSGIMSFSFLFILTAGMVAAFNPCGIALLPSYISYLIGGETKDHSFRYAIFKGLGLGGAMTTGFLTIFVLAGLLIGGLGSALTGIFPILSLVMGILIALLGLGMLFGKHLPIKIGSFQVKPGKWSIYFYGIAYAVTSLGCTLPAFMLVVSASLNDNSVTAVIIKFIIYSLGMGIVVTAITMVSLISRQLVQKFLHNYMGSIQKIAAVVIFLSGLYMAYYWYFGSGGICTF

SEQ ID NO: 2962 - protein, 707 aa, Staphylococcus epidermidis
GGICYIISSFTITFSLGGVNLNNNSEEHNHQNHMNHSNHMHHDNHESHNHHSGHAHHHGNFKVKFFVSLIFGIPIILLSPLMGVNLPFQFTFPGSEWVVLILSTILFFYGGKPFLSGGKDEIAEKKPGMMTLVALGISVAYIYSLYAFYMNNFSNATGHTMDFFWELATLILIMLLGHWIEMNAVGNAGDALKKMAELLPNSAIKVMDNGQREEVKISDIMTDDIVEVKAGESIPTDGIIVQGQTSIDESLVTGESKKVQKNQNDNVIGGSINGSGTIQVKVTAVGEDGYLSQVMGLVNQAQNDKSSAELLSDKVAGYLFYFAVIVGVISFIVWMLIQNDVDFALERLVTVLVIACPHALGLAIPLVTARSTSIGAHNGLIIKNRESVEIAQHIDYVMMDKTGTLTEGNFSVNHYESFKNDLSNDTILSLFASLESQSNHPLAISIVDFAKSKNISFTNPQDVNNIPGVGLEGLVDNKTYKITNVSYLDKHKLNYDDDLFTKLAQQGNSISYLIEDQQVIGMIAQGDQIKESSKQMVADLLSRNITPVMLTGDNNEVAHAVAKELGISDVHAQLMPEDKESIIKDYQSDGNKVMMVGDGINDAPSLIRADIGIAIGAGTDVAVDSGDIILVKSNPSDIIHFLTLSNNTMRKMVQNLWWGAGYNIVAVPLAAGALAFIGLILSPAVGAILMSLSTVIVAINAFTLKLK

SEQ ID NO: 2963 - protein, 65 aa, Staphylococcus epidermidis
PKTRPVIASPLLALAFIESFTFEIKVWRSIDPINPNIVTSTSPEALDVSIFSEIDLYPTSCSLNS

SEQ ID NO: 2964 - protein, 117 aa, Staphylococcus epidermidis
MKKRISFTAIMTVLLIGLTACGAESDTANESKVQDIQGNPVSLPNEKPTLIYFMATWCPSCIYNEEIFKEIHQLNPNDVQLITVSLDPNTDTKESFAKFKQDYGGDWPHVLKIGVEL

SEQ ID NO: 2965 - protein, 229 aa, Staphylococcus epidermidis
ERVSMASYLFFHPKPACDTYGDMNIYHDKFGNNEDPYVWSERFLHSFCKITDYAYSKSTQKDIIFWISINKEGNNLKYLCDLVFKIEKWDFWYKTFSEQKDAIATNKELTINDAVVEGDEEAYEYHYSWINRGEHKWEPTYRRRRLTLKADPVLSFQPQNRQGNLLDVTELLKTIVNFNVEKSPAKSGTSYKAFELEEEQASKLYEEIKRLSFIRLKGRDLKNLRRNFS

SEQ ID NO: 2966 - protein, 180 aa, Staphylococcus epidermidis
NGVSNVKKIFASLGVILLVAILGVAVVFAYGSYKDLELKKEEAKLKDKKNKKIDKNKTTENENQDQINNQTITAPNEKAQYGNNLGVQEKSTDKNDPNGVLRFDTNGDGLISTSEVTPEAQKLVDEGKLQPSSDRMVEEWTKNKNNVDNTYDYDESYKKQQEMYKKAARGEVPEPGETIK

SEQ ID NO: 2967 - protein, 75 aa, Staphylococcus epidermidis
LNELKIIKKFIKKDNVYIISIEIVFFSLIPRTLCPGLIMIYFFIGDLPLILLAPQLVPQPFFEDLVDSHISLIGV

SEQ ID NO: 2968 - protein, 112 aa, Staphylococcus epidermidis
KKSRREGNSMKINRYITRGINESIPLDLQILLWHMVEKKDNQPHTDYLHIFKLQEDENILSITHEQEQPTYKLEYHYTNYEKNQNALPKKVYVIREDDVDAFYYVMLLPEEY

SEQ ID NO: 2969 - protein, 91 aa, Staphylococcus epidermidis
SYIRSILMKKIKIVPLILIVVVVGFGIYFYASKDKEINNTIDAIEDKNFKQVYKDSSYISKSDNGEVEMTERPIKIYNSLGVKDINIQDRK

SEQ ID NO: 2970 - protein, 277 aa, Staphylococcus epidermidis
IIRRCFFSMKRASYSVETKYKAVEMKAAGFPTKEIMKELNIRNRTQVKNWWRWYRNGESYRFSQHVGKQYTYGYRKITALINQCYTSPINHKRVQRVMQKHHLNCRVRPKKTTRIGKPYYKTDNLLQRQFKASCPMEVLTTDITYLPFGHSMLYLSSIMDIYNGEIVAYKIDDKQDQRLVNDTLNQIDIPEGCILHSDQGSVYTSYAYYQLCEEKGIIRSMSRKGTPADNAPIESFHSSLKSETFYINNQLNNSNHIVIDIVENTLKTIIIIEFNKN

SEQ ID NO: 2971 - protein, 172 aa, Staphylococcus epidermidis
ENFGSGIMKLRALEYSDLLFVHELNNEYSIMSYWFEEPYESLTELQHLFDKHLLDESERRFIVEDENQVVGIVELVEINYIHRNCEIQIIIKPEFSGKGYAKFAFEKAIIYAFNILNMHKIYLYVDADNKKAIHIYESQGFKTEGLLKEQFYTKGKYKDAYFMSLLKSEYIL

SEQ ID NO: 2972 - protein, 570 aa, Staphylococcus epidermidis
QIHGGQYGNKTNQHRFTVNDIVETIPDNEFDEFRHHRGATSYHPKMMLKVILYAYTQSVFSGRKIEKMLNDSIRMMWLSQNQKPSYKTINQFRVNPKVDALLESLFIQFYSQCVKQNLIDDKAIFIDGTKIEANANRYTFVWKKSIQNHESKMNEDSKALYHELVTNKIIPEIKEDHDNELTKEEIDLIGSHLDKEIEDLNQHINNEKCTKTRKQIRLKRTKIKKYKKQINDYFERKYRYEFQKSILKDRNSYSKTDYDATFMRMKEDHMKNGQLKPGYNLQIATNSQFVLSYNVYQNPTDTRTMIPFLNSIQETYGHLPEYIVADAGYGSESNYKAIIDDFNRTPLITYGMFIKDKTKKYKSDIFNTQNWNYDEINDEFICPNNKRLGFKRYAYRHDKYGYKRDFKLYECDDCSECPLKNQCMNFNSKTNKKIMKNYNWEYFKSQINKKLSEPETKNIYSQRKIDVEPVFGFMKAILGFTRMSVRRLNKVKRELGFVLMALNIRKVVAQRAENNQKIYKKRQCLYYLNRNCFFFTYSKNFMSRTHYDLFFYWGLAINSACSTTCSTAIF

SEQ ID NO: 2973 - protein, 549 aa, Staphylococcus epidermidis
MKKGCNIMQQLKTKRVGIYVRVSTEMQSTEGYSIDGQINQIKEYCDFHHFEVKDIYADRGISGKSMNRPELQRMLKDAKEGNIDCVMVYKTNRLARNTSDLLKIVEDLHKQNVEFFSLSERMEVNTSSGKLMLQILASFSEFERNNIVENVFMGQTRRAQEGYYQGNLPLGYDKIPDSKHELMINQHEANIVKYIFECYAKGHGYRKIANALNHKGYVTKKGKPFSISSITYILANPFYIGKIQFAKYKDWSEKRRKGLNDKPVIAEGKHSPIINQDLWDKVQMRKKQVSQKPQVHGKGTNLLTGIIHCPQCGAPMAASNTTNTLKDGTKKRIRYYSCSNFRNKGSKVCSANSVRADVIEDYVMKQILEIVKSDKVIQRVVTHVNQENQVDGAALHHDIAYKQQQYDEVQIKINNLIKTIEDNPDLTSVIRPSIQKYEKQLNDITNQINQLKNQQNEDKTLFDAKEISKLLQHIFHDIKHIEKSRLKALYLSVIDRIDIKKDGNHKKQFYVTLKLNNEIIKQLFNNKQLDEVHLSTSSLFLPQTLYLTI

SEQ ID NO: 2974 - protein, 553 aa, Staphylococcus epidermidis
IERGIQMTQNSYKIPIQGMTCTGCEEHVTEALEQAGAKDVSADFRRGEAIFELSDDQIEKAKQNISAAGYQPGEEESQPSENSVDFNRDGDYDLLIIGSGGAAFSAAIKANENGAKVAMVERGTVGGTCVNIGCVPSKTMLRAGEINGLAQNNPFTGLQTSTGAADLAQLTEQKDGLVSQMRQEKYIDLIEEYGFDLIRGEASFIDDKTIQVNGQNITSKSFLIATGASPAVPEIPGMNEVDYLTSTSALELKEVPQRLAVIGSGYIAAELGQMFHNLGTEVTLMQRSERLFKTYDPEISEAIDESLTEQGLNLITGVTYQKVEQNGKSTSIYIEVNGQEQVIEADQVLVATGRKPNTETLNLESAGVKTGKKGEVLTNEYLQTSNNRIYAAGDVTLGPQFVYVAAYEGGIVANNALGLAKRKIDLRFVPGVTFTNPSIATVGLTEQQAKEKGYDVKTSVLPLDAVPRALVNHETTGVYKLVVNAQTQKLIGAHIVSENAGDVIYAATLAVQFGLTIEDLTDSFAPYLTMAEGLKLAALTFDKDVSKLSCCAG

SEQ ID NO: 2975 - protein, 204 aa, Staphylococcus epidermidis
IVGGIINVFNTTYKEIYSMFPNKPYPVHDIYEDCRTILADLQIEMFNRINKQLYKTCHYNKPRKHHEMIKKLLIEFIIDNKDSKIVSAEPFELNLEAFYAIKQNCNISNNNKPLDEYIITYFEDLLSNISNTLTNNNRANGNNPIINYIYVTQRKDGMVCVVGKSHFKYEFKGNEYKLVKNQEGDLLRRWMKIKVPEKYYLHCI

SEQ ID NO: 2976 - protein, 296 aa, Staphylococcus epidermidis
LKGGDILDRAFRILTIYNRLLQNKSVNKQSLTLELDTSPRTIQRDIDDIRNFLYESKSWISAPKEITYDYKSESYKLEQNKSENMYFMYDILTALYLTTPKLSHYFYQYLKLLIVKHHSNYRTTLLKYLERFEIDKNQTGISTSSLVVQAMNENQYLQYNQNLLLPLSMYYQMHAFHLVYRMNDEIHIDDINQMNLSLSEKSVDTHEKSKVQTYITFEISKDVWSKMHRYYQIHVIEKYDAHYLIVTFKMTRIEAIQLCFMYRSNIRIISPPDLKEQVIDELLLLQTTYLKQQVQK

SEQ ID NO: 2977 - protein, 112 aa, Staphylococcus epidermidis
IIRGVFFSMKRVSYSVETKYKAVEMKAAGFSTKEIMKELNIRNRTQVKTWWRWYRNGESYRFSQHVGKQYTYGKGLEELLEVEQLKLENKRKDIELDILKKYKALERKWYQQ

SEQ ID NO: 2978 - protein, 189 aa, Staphylococcus epidermidis
NSFIGHTMLLGKCLGGMAMDSHLNHILSYWQGPPLEGAKTIISKYGYPQEATMRRLIWYNSGPWKRTIVYKDPVPHNFPTPHLDFLKQTIDYKVPVHLYDAIAAFDGSVYLDRTTGEASAKCHEEAMNFLSLNLLNDIVTGKRDVQGAKAFYAQTAEQFTKYHITSPYTEGFLFPMQYNTADLGVTYFK

SEQ ID NO: 2979 - protein, 460 aa, Staphylococcus epidermidis
IYIITVKGGADMKQVIGYLRQSTMKQQSLAAQKQAIEAIAEKHHIQHINFYSDKQSGRKDNRSGYRQITQLIQQGQCDILCCYRLNRLHRNLKNALKLIKLCQTYHVHILSVHDGYFDMDQAFDRLKLNIFISLAELESDNIGEQVRNGLQEKAKQGRLITTHAPFGYEYHNGTFIINQNESPTVKAVFNYYIKGHGYKKIAQLLEEDNTYINRQPYQVRNIIINPNYCGRVNNQYGQFDNMFPSIVSTSIYEQAQRLRLQKQTKQTPSDNQLKQKIKCPCCNATLTNMTIRKKNHTLRYYVCPKNMNASRFVCDFKGINAQTLEDKVLEVCRDFYQNQRIYTKIKSAIDKRIKRQRNIEKHHTLTQEQLIEKLAQGIIDAETFREQTQSLRQQPQRTTSINGHQIQHIIQNIIQKRFTLNILYPYIETIHITKDKNLIGIYFKNEPLNIVNQTMQSSIA

SEQ ID NO: 2980 - protein, 504 aa, Staphylococcus epidermidis
MATIGFEEKLWQAADKLRGSMDAAEYKNVALGLIFLKYVSDSFEEKYEELKQDPYADEEDQDEYLAENIFWVPKEARWQYINDNAKKPEIGQIIDKAMIAIENENESLKGVLPKEYARPALDKEKLGDIIDLFTFKVGDTESRKQDVLGRVYEYFIAKFASAEGKNAGEFYTPSSIVKLLVEMIEPYKGRIYDPCCGSGGMFVQSERFVEKHQGRLDDIAIYGQESNPTTWKLAKMNLAIRGIDNDLGERNSDTFHNDLHKGLKADYILANPPFNASDWGQERLLDDYRWQFGIPPKGNANYAWIEHMISKLAPNGTAGFVLANGSMSTSGKDELEIRKNLIEQDLVECIVTLPGQLFYSTQIPVCLWFISNNKGQNGKKERKNEILFIDAREIGHMVSRTLKEFSDEDIQKVAQTYHAWRGTNDKPYEDIAGFCKVANLEEVKNNEYILTPGRYVGLADVEEEEEPFEQKMERITSELSEQFAKSKELEDQIRKSLEGLGYGV

SEQ ID NO: 2981 - protein, 430 aa, Staphylococcus epidermidis
IMTILAIIIFLLTLMFVIWQPKGLDIGITALIGAIIAIITGVVSLSDVIEVTGIVWNATLTFVAVILISLILDEIGFFEWAAIHMVRASNGHGFKMFVYIMLLGAIVAAFFANDGAALILTPIVLAMVRNLGFNQKVIFPFIIASGFIADTTSLPLIVSNLVNIVSADYFNIGFIEYVSRMIIPNIFSLIASIVVLWLYFRKVIPNNFEIKNLKTPNQAIKDPKLFKFSWIVLSILLIGYIVSEFIQIPVSLIACLIALIFTVLAYKSRVVNTKQVIKGAPWNIVLFSIGMYLVVFGLKNVGITALLANILSSISNYGLFSSVIGMGFISAFLSAIMNNMPTVLIDAIAIGQSATTGLIKEGMIYANIIGADLGPKITPIGSLATLLWLHVLTQKGVKISWGTYFKTGIVITIPVLFITLVGLYVTLIVF

SEQ ID NO: 2982 - protein, 138 aa, Staphylococcus epidermidis
GDNMEMKISELAKACDVNKETVRYYERKGLIAGPPRNESGYRIYSEETADRVRFIKRMKELDFSLKEIHLLFGVVDQDGERCKDMYAFTVQKTKEIERKVQDLLRIQRLLEELKEKCPDEKAIYTCPIIETLMGGPDK

SEQ ID NO: 2983 - protein, 314 aa, Staphylococcus epidermidis
KEDINMSKIVVALGGNALGQSPKEQLDLLKSTSKSLVSLIDKGYEIVISHGNGPQVGSINLGLNYAAEHKQGPPFPFPECGAMSQAYIGYQMQESLQNELHSMGIDKQVVTLVTQVQVASDDSAFNNPTKPIGLFYTKEQADKFTKEKGYTFVEDSGRGYRRVVPSPQPISIVELDSIETLITHGTLVIAAGGGGIPVIKENEVYTGVDAVIDKDKTSALLAAHLQSDQLIILTAVDHVYINYGKENQRGLDEVSVDEMKKHISDGQFAKGSMLPKVEAALQFLEKNTKGSVLITSLAGLGDALDGKIGTLIKN

SEQ ID NO: 2984 - protein, 110 aa, Staphylococcus epidermidis
LGGIFMSYKELSAILKVLSDPSRLEILDLLSCGELCACDLLAYFQFSQPTLSHHMKILVDNELVSTRKDGTKRMYRLNHTFLDSINKELTYISSPTQQCMCKKIKTGECK

SEQ ID NO: 2985 - protein, 178 aa, Staphylococcus epidermidis
CFYIKIKIKEVNLMYNKVFAILIIIFSIIIIASNDTFAESKNDMMNMKEDKKSTMDMTNMKHHDERKKLNSSQGKNEIIFPEVAESKKDNNGYKNYTLKAQKGKTEFYKNNFSNTLGYNGNLLGPTLKLKKGDKVKIKLINNLDENTTFHWHGLEVNGKVDGGPSHVIKPGKEKNYKI

SEQ ID NO: 2986 - protein, 347 aa, Staphylococcus epidermidis
KNNMNKILIEKEIFKMKNLRNRNFLTLLDFTQKEMEFLLNLSEDLKRAKYAGIEQQKMKGKNIALLFEKDSTRTRCAFETAAYDQGAHVTYLGPTGSQMGKKESTKDTARVLGGMYDGIEYRGFSQRVVEDLAKYSGVPVWNGLTDEDHPTQVLADFLTAKEVLKKPYNEINFTYVGDGRNNVANALMQGAAIMGMTFHLVCPKELNPTDELLNRCNDIADKNGGEILITDDIDEGVKGSDVIYTDVWVSMGEPDEVWEKRIKLLEPYRVTKELMKKTGNPHTIFEHCLPSFHDTETIIGKQIQEKYGLTEMEVTNEVFESEQSVVFQEAENRAHTIKAVMVATLGE

SEQ ID NO: 2987 - protein, 308 aa, Staphylococcus epidermidis
YWVLFLQYLAINKTKVLVKNMNLNDLEAFYKVCENRSFTKAAQELNYVQSNVTAKIQRLESYYQVKLLYRDKKGIKPTPEGIELLKYIKRIFTILHEAEHNVSNNKKLNINIGTIETIAAVHLPKLLNEYKRKNPKIQINLKTDNSIKLIEHVKNREMDCAFISGNINDKDLICTNIFNEKLVILSQKSNFKQNINENKSIIMFGEGCFYRKIFEDWLNYHDINIENKMTLNTLDGILGCVEAGLGIAFLPMSVLNKGNSDGIEITKVEESFQTISLNIIYRQDNKNNNVINQLKQVAFEKMKSNIIK

SEQ ID NO: 2988 - protein, 107 aa, Staphylococcus epidermidis
ITLIIMKGMGIMSNIIKTIGKGIGKGVGAAAYYSVATVGAAIGAIWETTGDRGLMRDALSDSSNQDLIEIYEIQKKDDGDYDTYIAAKSLLQERGFTYNHETNKWEK

SEQ ID NO: 2989 - protein, 182 aa, Staphylococcus epidermidis
KVLIMNLTTQITKMLGIKYPIIQAGMAGSTTPELVSTVSKQGGLGMIGAGYFDSHQLSKEILEVQKLTQAPFAVNLFTPNDIKYDKKQIEQMNTKLKPYREALGLSTPKNSTVKEKEKFEDAIEVIESLKVPIIAFTFGIPNQNIIKRLHNAGKILIGTATSVEEAVENGKCWYGYSCSPGL

SEQ ID NO: 2990 - protein, 77 aa, Staphylococcus epidermidis
EVIMMTLEQQLKHYITNLFNLPKDEKWECESIEEAADDILPEQHVRLGPLSNKILQTNTYYSYTLHKSNIYPFILYY

SEQ ID NO: 2991 - protein, 157 aa, Staphylococcus epidermidis
SKIIKGVIKMKKEKRLNLILTVIQQNQFNKKQQIVDYMARHFGVYYSLTTISRDLQELEIYKIPVENKKYIYKKINQTNQLSAKKQLEIFSDEIIEFITLNNYVLIKTSPGFAQSISYYIDQLQMKEILGIIGGNDTLMILTSSNEIAEFVCYQLFP

SEQ ID NO: 2992 - protein, 154 aa, Staphylococcus epidermidis
LPQIVDDVSIPVIAAGGIMDGRGLVASLALGAGAAQLGTAYLTTNESGADDKIKNEIIESSETDTILTNVFSGKLARGIMNEFVHNMNLYSKQVPPYPLQNQLTTQIRKSALEKGYTEWTHIWSGQSTRLADTVDAAQLTKNIINDAVKIINNK

SEQ ID NO: 2993 - protein, 912 aa, Staphylococcus epidermidis
GEQMKNIDIAIYDIDKVICKSIENNSSDLGYLSQSILSHLRNYVEHIGMKYYFESVNEDMTNSSSNIYNEIQMGIGYFRKHYKLNWLKNFHELLQQSVSHYTFDEDRSERLFIKYYDLMLELKEKLKKDFEMDLLQNLYKVPLNIDSDLKGYYHTISQLIGNKYTDNEYEVDNSRYYIEKTKPFVIENKVYYEITFRNANDKTSKYERLIGYSKHRINTNYAVKFALEMQTISYLGIKANVIIINDYEISIRPCEFNNFAKILDYDLKLQSNHNEYKKLMKLLKEFNLHLLDIVLLDDDEFNELECSVNSESAVINIFNVLRLARRYILTNKSGANVLRYLLFVFNNRIIRLQLPYNRNKCYKLSNLILDYKCVPFDQMPFTASLKGHNPNIYTLLQCIEYKGREYELLVRKIQKNTLKNKKVYTSKEEIEQYGVVNELIDKYNNNLYYKHRPNREIHSFGDKYYLYENEQSIMSIIKSIKLLSNESVEGYSNSVEFWLNNEYTSLDCKEKKEILLRMFSNSKISMVYGAAGTGKSTLINHICNFFYDKDVIVIANTNTAVDNIKRKIKLSNIKTSTISKFLYNDKEKYDLLIIDEAGTVSNKDMNRILENKQFELLLIVGDNYQIESIDFGNWFEIAKDVLSKNIINELTDMYRTKNDDLLYFWKSVREKKSNLNEIINMNKYSTRLDESIFNEFNKDEIILCLNYDGIYGINNINRLLQANNKNDSVIWGVKEYKVGDPILFNETNKYSPILFNNLKGSIIEIHVFEEYILFDLEINKVINELDIISLEIDLISSSENSSVIRIRVEKSDGLNDDDNDSSDSIVPFQVSYAISIHKAQGLEFNSVKIVISDDLDEQITNNIFYTAITRARENLKIYWSPRTEKKIIDNIISKRNLKDLSILKSRIKKQNT

SEQ ID NO: 2994 - protein, 607 aa, Staphylococcus epidermidis
QQPFERRCSLMTQTNPSFNPSPRYKSKKGWYKDKPPKEKGGMPTEVEIAGPIVIENKFIDPKTNTEKVIITDEDQKVIVESSDILTTQKLPSLMKYGFSINEKYTKDLGYALQQMRNQLPISYLYEGVGILETPFGPIVSLNEIYTTTEFDNKSPSDAICENTYDLAPRGTFDNWFNMYIDEVKDHLLLELTVIFGISALVTSFLKHKHEIEFAGILFSFTGQSSTGKSTAAALAVSVAGNPTKGNETLFRSWNATRNALEGYLSNNYGVPIVFDELSSTTLKDTTGLLYSIAEGQGRQRSNVHGEVKAPKNWGTSVISTSEYSIFNDSAQNDGLRVRTIEINEQFTTNATNADNIKKAVALNYGHVLPLVAKYLINREDEVIQWFYKEVDWFEAKLKDETNNTGIRMFKRYAVITTSAKILGRVLSTDIDIANIRDYFIDYHTHTVSERSLADKAIDVIIQFVAQNRGKFSDEGALKNMFENYGLISLKDDHIEVKIIANVFKQMLNNHQFQDVNNVVNALRDKGFILADRGRQTTKRSVKDNSGKKQSLVFYHLKLDVEFASILGLTKDKSLLQNWTPSNDNKAAKELFKSANEGIGPSGVHEDF

SEQ ID NO: 2995 - protein, 274 aa, Staphylococcus epidermidis
LGGIMKNFKVQEAKETPLSAQNANVFIKCVKKYNWLKDIIINGYFQYRYVTEEVEYLNIETTDLSGKRIPIEDITFPMLCFCDIPLNQLKDHNKWYGDYAICMKKSWGVNKNLQPLHYVSNTSEYIKMYQEVFNNIVNKPDTDEKVYEFIFASLFFLKHFKGSQYCEKTDKIEEKIFMDEQEWRSIKLVDEDLDPFYINENSDSKRNYYNEALTKLSSNKLEFNCEDIRYIIVEKEEDVIQLINDINCSNYDDQEKSLLISKISVLNHLREDFM

SEQ ID NO: 2996 - protein, 509 aa, Staphylococcus epidermidis
KRVIIMIKNKWKIELWFQFFSYFIHKIDSEFILKEYAQHILPEEMRTNYVVGEAQPNETIYISYFVNTSNQNIEQHTVKCSEEGIFIDKIPSGFTKDNLTYSIDSQSMVDIDELSNEIIDQGVDALDVLESTTLDTYFTEFLTTINKTTDFAKKIANNTIKQIRENIELKKANYRIDYEKAIDDVSSLESFINLKDTILETHQDLSKENFDDVLISDFLTKYLIYKEKQDSYVKKNISNLNKSNYFKQLVTEGLIKERTSNSQYFEIANSIKPSIHNKYSLNQSDELDQFRQAVIGISLNLYDQNDTYFKFIRSILTEKSRKVNLTIDGLIESQNTINEFMKKQDLISDNELYYLTTIEDTFHFALFTAISDLMDELVLVTSKIIQSATQYDVLVALYSISNLKNDLNKLAHKHERSLTRFKSLIDGYVRNTRLKDLIHNIIMNDIKMTEKVERSLLTDLKKYNISNFYKRDNFNNNPNDFLDKLMIQIISKFYKTRLEDINDGPNLYY

SEQ ID NO: 2997 - protein, 113 aa, Staphylococcus epidermidis
LEEIDSFNELFYLIELYLKAFKGQKKTGYEFEERLNTFIQSYVIILLIDIRLPTVRLYIIRHIVDTCEKEVDNQKRIILIEKSIKKYRYVKEQIKRFGNALKEELSNATLSIE

SEQ ID NO: 2998 - protein, 188 aa, Staphylococcus epidermidis
RGRFLLCDAFTRRILKEVTMMNTIKSTIHTEAIFSDDEQHRYLLKKTWDEKKAACTVITMYPHLDGVLSLDLTTVLILNQLANSERYGAVYLVNLFSNIRTPENLKHIKNPYDEHTDIHLMKAISESDTVILAYGAYAKRPVVIDRVEQVMEMLKPHKKKVKKLINPVTNEIMHPLNPKARQKWILKS

SEQ ID NO: 2999 - protein, 64 aa, Staphylococcus epidermidis
TLSVSISLRRFFIINYFILFDLSPGLVIFLIFLIYTLKNILLNNNKLFKLLIKEDIFISIYFSI

SEQ ID NO: 3000 - protein, 89 aa, Staphylococcus epidermidis
LFLVMIGYVDQIGREIGGVVFMVSCCSIDPYTEFEVIIIGAGVPEVSLAFHLTSYGIRTALADEQNVDNRLKDFLRTFQELIERDSGMP

SEQ ID NO: 3001 - protein, 496 aa, Staphylococcus epidermidis
KSQVIHSLNQITRFLPPLLGEINMDENKLGKTSLIGLVIGSMIGGGAFNIISDMGGQAGGLAIIIGWIITAIGMISLAFVFQNLTNERPDLDGGIYSYAQTGFGDFIGFSSAWGYWFAAFLGNVAYATLLMSAVGNFFPIFKGGNTLPSIIIASILLWGVHFLILRGVETAAFINSIVTVAKLIPIFLVIICMIVVFNFSTFKSGFYGMTSGSVGVFSWGDTMAQVKSTMLVTVWVFTGIEGAVVFSGRAKSKKDVGTATVIGLISVLVIYFLMTVLAQGVIHQNQISKLANPSMAQVLEHIVGHWGSVLVNIGLIISVLGAWLGWTLLAGELPFIVAKDGLFPKWFAKENKNKAPVNALIITNILVQLFLISMLFTDSAYQFAFSLASSAILIPYTLSAFYQVKYTIQNKSKANLKQWIIGIIASIYTIWLVYAAGLDYLLLTMLLYIPGLLVYSYVQRDNNKHLTKLDYTLFIFIIVLAIIGIVRLITGNISVF

SEQ ID NO: 3002 - protein, 76 aa, Staphylococcus epidermidis
LLKVLNRVDLLVEISTYVALLNAQNAEIIWYVDGRIIKRKSPKNGQSSGITFVPYSIVQGVLHVTVIPSMLKSSSV

SEQ ID NO: 3003 - protein, 381 aa, Staphylococcus epidermidis
IKGVLEVKTRAAVLHEMGAKKPYKESKPLKIEYLELDNPSEHEVLIKIHAAGLCHSDLSVINGNRPRPLPMALGHEASGEVIKVGKAVTRVSEGDHVVCTFIPSCGKCIPCKEGRPALCENGAISNEKGEMLEGGMRLSNDEGKVYHHLGISGFAEYSVVSENSIVKIDKKIPFERAAAFGCAIITGIGAVVNTAQIRSGSNVAVVGLGGIGLNAIIGAKLAGANEIIALDINEDKFELAKQFGATATFNSSDKDIDEQIKEYIPGGVEYAFETAGVVPAMKVAYQITKRGGTTVTTGLPNPKDNFSFPQVTLAAEERTIKGSYVGSCVPDRDIPRFVNLYNQGRLNIDSLISEVITLDEINEGFDRLSNGEVGRIIMKMH

SEQ ID NO: 3004 - protein, 80 aa, Staphylococcus epidermidis
SKGVLSMNHDNTIQSNWRTVASCLASQNYISIVKGLVHHFTAIDDEEILDKIYEEFINDDSITTVLNNDLQTIINHYLSK

SEQ ID NO: 3005 - protein, 87 aa, Staphylococcus epidermidis
QKGVFCMNYFRYKQFNKDVITVAVGYYLRYALSYRDISEILRERGVNVHHSTVYRWVQEYAPILYQIWKKKHKKLITNGVLMRRTSK

SEQ ID NO: 3006 - protein, 64 aa, Staphylococcus epidermidis
IVSLSFLKRLSNISLCFLHKYSSKSFGKVNILQSVKAVHISYGAGVSLNMKFIGNIFSSLLNLK

SEQ ID NO: 3007 - protein, 65 aa, Staphylococcus epidermidis
SNTLHRSDKMPSRWVKVKTFKSLSTSKLEKKLQNFKSYNSFDIIEIKRHSYLFLNIVEVYYKDKT

SEQ ID NO: 3008 - protein, 71 aa, Staphylococcus epidermidis
LWAFLAIQRPSSVLPKLAYRFSQQVGKQYTYGKGLEELSEVEQLKLENKRKDIELDILKKYKVLERKWYQQ

SEQ ID NO: 3009 - protein, 303 aa, Staphylococcus epidermidis
FNKFGGVILMIDSIIEFIKTFLMLFFELLILFIIVSFIVSLIQQVVSEDKIKSMLSKPNQGINYFFGMIFGAITPFCSCSTIPILAGLLNSKVPFGPAVSFLIASPLMNPLMVFMLWVLLGWKVAIVYFIVLAIFSIFTGLVFSKMNLAESYKGVNVKGDGFFANKEGSRFKQALNDAWAFLYPMLPYLFIGVFIGAFIYGFVPETFITKYASGDGVISVFIGSVIGIPMYIRPETMLPIAEALVSKGMSLGTVVALIIGGAGASIPEVVLLTKLFKKKFVVSFVIAILVVAIATGLIVNIVI

SEQ ID NO: 3010 - protein, 110 aa, Staphylococcus epidermidis
HDKLVVSYIFLLCNRTLFFGATWGPIMWVMLPEMFPTRARGAATGIAIVVLQIGTLIISQVFPILVNMLEVQYVFLIFAVIGALALIFVVKFLPETRGKSLEEIELQLQN

SEQ ID NO: 3011 - protein, 80 aa, Staphylococcus epidermidis
VAKFIGKGTYIEDIVNGSFLKSQDDLKLKASDFTVEDNYNYGVLIFPENLSLTDNNKKLESLIKTILFTGKRYQYTYFKI

SEQ ID NO: 3012 - protein, 149 aa, Staphylococcus epidermidis
TLISQELLIQKIQDADALITLLSTQVSRQVIESAPKLKIIANYGAGFNNIDIQAAREHHINVTNTPIASTNATAELTMGILLAVARRIPEDDQLCHNEGFNLKITDDNLQVDYPRQFLKGAHAPSVKAQHVIHWGDTFWVSSLWLAWFY

SEQ ID NO: 3013 - protein, 457 aa, Staphylococcus epidermidis
RVISVRRIMMTKKYDLIVIGTGSAGSITAAKCNKAGWNVAMVDDRPFGGTCALRGCDPKKVLHGAAELIDWNKRMVKNGVPSEVSINWKDLMNFKRTFTDDVPEKKEEALNKQGIDTYHGNASFVSEDKLEVNKEVLEGSHFLIASGAKPTPLPIKGEEHLTYSDEFLELDELPQRIVFVGGGYISFEFAHIAARAGSEVHIIHRGQRPLENFDIDLVDILLEKSKEIGIQVHLQHSVESIEKEQGKFHVYARKKEDITRFEADIVIHGAGRVPALDMNLEKGNIERKKHGVHVNEYLQSVSNPNVYAAGDAAATDGLPLTPVASADSHVVASNLLKGNSKKIEYPVIPSAVFTVPKMASVGMSEEEAKNSGRNIKVKQKNISDWFTYKRTNEDFAAFKVLIDEDSDQVVGAHLISNEADELINHFATAIRFGISTKELKQMIFAYPTAASDIAHML

SEQ ID NO: 3014 - protein, 122 aa, Staphylococcus epidermidis
IKEFSIMKNKKGLGIGLITIMIIVCIVLVIMMFVGGKKESYYGIMKDSTTIDKMINTKNEKIEKNVELPKDANVSVKKEDFVMLFKDEKTGKITKVKKVNHDDVPHGLMSKIHDMGNMKHGM

SEQ ID NO: 3015 - protein, 703 aa, Staphylococcus epidermidis
YTMTCFLNIYKEYHSPPERNINRIILMFSLTNDLKITINGETKDLGNHIAIINQSDIYFINSASNLVLLSIPVIYFYSKDNKFFKCYFDRHLLQSSSFVKTIILQAIQHLIKGENQDEQSISKIIQTLLKEAVIRYKKKYIPQIAVNHSVFTEGLTFIHSKVSQSLSLREVAQHCNISESYCSNLFARYLNMNFKDYFTSLKVIDSIKRLLSSEDSINAISEQSGFSSHTNFTNQFKNYLGCSPKQYRTIISKLDSLPSISFSDTDFSQYIDLINQFEFSDHLATETTERDINEFYPQDQTKNSKAFIRFQNFNELFQFVFNEYYNIDFTSLPQAVIFINDITDISTREVNFNLLNRCFEKLFEKNIGLAMRLTSTNEFESIKEIILLFLNSHQDYKMNKKMVKFMLVFETKNMSVNDIHLCHLKIKNKNKAIRYSITVEGLLHQNSSIDRTYDMMKRLNFDYYFIDIENLETKNSLITKRKSYLHSSTHFENYKQFILDSGIPSTKFVYNNLSLKCFKYTNNGTYPLQLSDLVCHLVALMRYGGGVSYQLIEDESPFIALFNRYGSPLPLMHLYKLIEPFLNEPLEIANNFLMSRKDGNYHFLLFNKINDRYLSDSQQRYVFKNTLSTNSLIIIKTLNHEHGAIQNLLPQTKQQFYIERSILDELDKSNQPKTELAIQHDHHLPFQVTLKHDEVKYICFKPS

SEQ ID NO: 3016 - protein, 273 aa, Staphylococcus epidermidis
IYGKGELLPIIFFAVFFGLGLAAIGEKAEPVKGFLNGTLEAVFWMINKILKLAPIGVFAFICTTVMTFGASALIPLFKLLVVVVFAMVFFVIVVLGIVARMVGISIFSIMKILKSELLLAFSTSSSEAVLPIMMKKMERFGSPKDVTSFVIPIGYSFNLDGSALYQSIAALFVAQMYDIHLSLTEQLVLMATLMIASKGMAGVPGVSIVVLLTTLTSMNITAQGLALIIGIDRLLDMVRTCVNVIGNALSTVVIAKWENVYDKEKGQNYLNSI

SEQ ID NO: 3017 - protein, 155 aa, Staphylococcus epidermidis
IMCDKDIYNNKEMIILNKQQVTKAIEKVLNSSKIGVLSTAHHNKPNSRYMVFYNDDLNLYTKTNINSLKVEEIENNPDAHILLGYNETTNNSFVEIDATIEVVKNQKVIDWLWETQDKTFFNSKEDPELCVLKVIPRSIKLMNDDELDTPATIEL

SEQ ID NO: 3018 - protein, 176 aa, Staphylococcus epidermidis
RGVCIMALFKKKISVPTQVIIALVLGVIAGLLLYGQDDVANYIKPFGDVFLNLIKMIIIPIVFCSLALSISNLGDSKKVGSYGWKAILYFEIITTIAIGLGLIIGNLFKPGSGLDPDKLPKGDITKYQSSAHSAEQATTYGNHLIDTLVHIVPTNLFESMAKVSYYRLSFSQYFLD

SEQ ID NO: 3019 - protein, 125 aa, Staphylococcus epidermidis
LKERGKIEKLWREEKYRVLFHDQNAYHSIRTLLKSPTTLGEVKEHITHALTITPTKGSVINAFEHMWGYFKKQCTQYEKQHSRELKALYIENQIDYFELLSFLKNLADKYAVEYLQQSTILNITK

SEQ ID NO: 3020 - protein, 467 aa, Staphylococcus epidermidis
KKYQIAASLRLVDLWGTREAGFELPSLGLAGGLHTITRKESIMVNRQPPQGVIFGLPISLIWGFVAIAVFMTGDGIELAFLSRYVVDLGFSPTQATLLFTVYGFLAAISSWGSGVLAETFGPRRIMLIGVAAWIVFHVLFLIFGLEQQKYTLMVVFYGIRGLAYPLFIYAFMVWIAQVTPGARMASAMGWFWSMYCIGIGLLGNWIPSLSISRIGFINTLWVGVFWVAVAGLMIMYLVKERGAGKPDDAVTLVERLKTLSSGVTIIAERRGMFLIVLVRIICNLSLFGLPVILPLYLTSVEVGFSMEQWLHLWGVMFVVSIFTNVIWGQIGDRLGWLIQMRWFGCIGCALSSLAFYYLPQFYGAHFEIALIAAIGFGISVTAFVPMGAVFLALAPEQKGAAISAHNLAAGLSNFMGPGIATLFIATLGIKGVVWIYAGLYVAGAVLTFFIPVPQPRLCQLRHCPRYA

SEQ ID NO: 3021 - protein, 63 aa, Staphylococcus epidermidis
ATGHVPDCIGANYLQPEPVRSAGDPAAVPNLGRGRFQHGAMVAFVGCDVCGEHLHQRDLGANW

SEQ ID NO: 3022 - protein, 173 aa, Staphylococcus epidermidis
TGCRIPWSKVLSSAGVTGGMDLALALVEEDYGRELALSVAREMVMFFKRPGGQSQFSAQLAAQTAERSVIRDVQEYVVEHLKADLSVPALAARAGMSERNFARTFKAEAGSTPAEFVELARIDAARRLIEDADVSLKRLADTVGYANADGFRRAFMRRLGVGPSDYRKRFSLM

SEQ ID NO: 3023 - protein, 150 aa, Staphylococcus epidermidis
RYRVHPVARRIFGVPEPLGDLDMYTAKAGVLTFLPVGQSPGLDIQQVWCFDPVAQAWRVDMMIESGSPEVWVYKRDGSIRFPRTEMLYLSSEGIPYLRPAAILLFKALHVRPKDEEDFHKTLPTLPDEEVAWLKRHLLKLHPGHHWITPS

SEQ ID NO: 3024 - protein, 147 aa, Staphylococcus epidermidis
RSMKGLLQRVRGARVEVAGQVVGAIDQGLLVLVAVEPSDTAASADKLLHKLLNYRVFSDDEGKMNLSLKDIGGGLLLVSQFTLAADTKSGLRPSFSTAAPPALGEALFEHLLSQAQQLHGTVASGRFGADMQVHLVNDGPVTFLLQT

SEQ ID NO: 3025 - protein, 75 aa, Staphylococcus epidermidis
PAPNRQNRAEPVTSAFRNRLADNFGALQGLTITSNPRRKQIKKPTASYLYARLASIVPTPMGLNDSPRATGQVST

SEQ ID NO: 3026 - protein, 236 aa, Staphylococcus epidermidis
FGEDLERIREHLGIEKWVLFGGSWGSTLALAYAQTHPDRVLGLIVRGIFLARPQDIQWFYQAGASRLFPDYWQDYIAPIPVEERHDMISAYHKRLTGNDQIAQMHAAKAWSTWEGRMLGLCPSPQLIERFSEPQRALSIARIECHYFTNNSFLEPNQLIRDMHKIAHLPGIIVHGRYDMICPLDNAWELHQAWPNSELQVIREAGHAASEPGITDALVRAAGEMARRLLDLPPEEA

SEQ ID NO: 3027 - protein, 60 aa, Staphylococcus epidermidis
SRAWPDCARHLPGPPPGYPVVLPGRREPPVPGLLAGLHRANPGGRAPRHDQRLPQAPDWQ

SEQ ID NO: 3028 - protein, 74 aa, Staphylococcus epidermidis
QQVLKKRLAQRRWRRGGEAGTQAAFGIGCQGELGHQQQTTANVLQRQVHLALVVTEHPVVKQLMQQLVGTGGGI

SEQ ID NO: 3029 - protein, 68 aa, Staphylococcus epidermidis
SARRATRRPSRASPMRWCVRRARWHDACLICPLKKHEGPFATGAWRPGRGGGASGGRDRPGFAGTGGR

SEQ ID NO: 3030 - protein, 397 aa, Staphylococcus epidermidis
LAVGFLICFRRGLLVIVSPCNAPKLSAKRLRNALVTGSALFCLFGAGQLWAFSLDDVSAKAKELAGQKYEAPRSNLPNEFREMKFADYQKIRFRNEKAEWAEQKTPFKLSFYHQGMHFDTPVKINEITATDVQEIKYDPTRFDFGDVKFDPKATDQLGYAGFRVLYPINKDDKQDEIMTMLGASYFRVVGKDQVYGLSARGMAIDTALPSGEEFPRFTEFWIERPKPGDKHLVIFALLDSPRATGAYRLILRPGTDTIVDVKSQMFLRDKVSKLGVAPLTSMFLFGANQPSKVLNYRRELHDSSGLSIHAGNGEWIWRPLNNPKHLSVSNFSVENPRGFGLLQRGRNFSQYEDLDDKYDKRPSAWIEPEGDWGKGSVDLVEIPTADETKCSPAGRAE

SEQ ID NO: 3031 - protein, 87 aa, Staphylococcus epidermidis
SCRGALPPGLARCSPASSPGTGGSRRPGRTTGYPGGGPGRCRAQSGQARDQGGFVHRPGPGSSPRNHRTAPIFQSPGARECAQGLHQ

SEQ ID NO: 3032 - protein, 888 aa, Staphylococcus epidermidis
DGCSFYFLGGRHMEMKPKYDPREVEKGRYEEWVSNGYFKPSEDKSKEAYTIVIPPPNVTGKLHLGHAWDTTLQDIITRMKRMQGYDTLYLPGMDHAGIATQAKVEAKLNEQGISRHDLGREKFLQQAWDWKEEYATFIRQQWAKLGLGLDYSRERFTLDDGLSKAVRKVFVDLYNKGIIYRGERIINWDPIARTALSDIEVIHEDVQGAFYHFKYPYGDGNGYIEIATTRPETMLGDTAIVVNPNDERYKDVIGKTVILPIVGRELPILADEYVDIEFGSGAMKVTPAHDPNDFEIGQRHQLENIIVMDEYGKMNDKADKYKGMDRFDCRNQLVKDLKEQDLVIKIEEHTHSVGHSERSGAIVEPYLSTQWFVKMKPLAQRALDNQNTKDRIDFFPGRFENTFNRWMEEIRDWTISRQLWWGHQIPAWYHKDTGEVFVGEEAPEDIENWIQDEDVLDTWFSSALWPFSTLGWPDTNADDFKRYYPTNALVTGYDIIFFWVARMIFQGLEFTDRRPFNDVLLHGLVRAEDGRKMSKSLGNGVDPMDVIDEYGADSLRYFLATGSSPGHDLRYSTEKVESVWNFINKIWNAARFSLMNIGEDFKVEDIDLSGNLSLADQWILTRLNETISTVTELSDKYEFGEVGRALYNFIWDEFCDWYIEMSKIPMNGEDESQKQTTRSVLSYVLDKIMKMLHPFMPFVTETIWQSLPHHGETIVKANWPTVDQALIFNESKQTMEQLVEIIKSVRQSRVEVNTPLSKAIPILIQTKDEKIKHTLMDNISYLHKFCNPSQLTIDTEIEIPEKAMTTVVVAGKVVLPLEGLIDMDKEIARLEKELDKLQSELDRVDKKLSNENFVNKAPEKIINEEKEKQQHYQEKYNGVKSRIEQLKA

SEQ ID NO: 3033 - protein, 442 aa, Staphylococcus epidermidis
ISQSWRYLYMTATWEKKEGNEGVLTVTVPAEKVNKALDQAFKKVVKQINVPGFRKGKVPRPIFEQRFGVEALYQDAVDILLPEAYGEAIEDTEINPVAQPEVNVTQIEKGKDFIFEATVTVEPEVKLGDYKGLEIEKQETDLSDEELQESIDHSLSHLAEMVVKEDGAVENGDTVNIDFSGSVDGEEFDGGQAEGYDLEIGSGSFIPGFEEQIEGMKTGDEKDVVVTFPEEYHAEELAGKEATFKTKVNEIKFKDVPELNDEIANELDSDAENVDEYKENLRKRLSEQKATEAENTEKEEAINKATENASIDIPEAMINTELDRMIQEFGQRIQQQGLDLQTYYQISGQNEEQLRDQMKDDAEQRVKTNLTLTAIADEENIEVSDEDIDKELEKMSEQFNISVEDIKSTLGNTDIVKNDVRIQKVIDLLRDNAKYVEATKED

SEQ ID NO: 3034 - protein, 422 aa, Staphylococcus epidermidis
KRMFKFNEDEENLKCSFCGKDQDQVKKLVAGSGVYICNECIELCSEIVEEELAQNTSEGFTELPTPKEIMDHLNEYVIGQEKAKKSLAVAVYNHYKRIQQLGPNEDDVELQKSNIALIGPTGSGKTLLAQTLAKTLNVPFAIADATSLTEAGYVGDDVENILLRLIQAADFDIDKAEKGIIYVDEIDKIARKSENTSITRDVSGEGVQQALLKILEGTTASVPPQGGRKHPNQELIQIDTTNILFILGGAFDGIDEVIKRRLGEKVIGFASNEADKYDEEALLEQIRPEDLQSYGLIPEFIGRVPIVANLETLDVAALKNILTQPKNALVKQYTKMLELDNVELEFSEEALSAISEKAIERKTGARGLRSIIEEALIDIMYDVPSSENVSKVVITEQTINEEIEPELYDDEGNLINKNKTSA

SEQ ID NO: 3035 - protein, 110 aa, Staphylococcus epidermidis
DTNFSHIEVFWVLKFFRNNKLIVVLCAMIIFIALIGLSIRSQTQSPAEQYVGDSVSFGQRVISYPIQFVTGSIGDLFEKGSSKKDKNKIKQLEAKNEELESANKKYNNRT

SEQ ID NO: 3036 - protein, 107 aa, Staphylococcus epidermidis
SNHYLPIPHNDPFQLLLDHILVSFPYVYLLKNKKNIHPIKNRTDVLFRGTTYIQEEIIHSFLQALKSLINAHTRLLPTCRLCFNRSYKIGLPSDLIIYIFTATICSL

SEQ ID NO: 3037 - protein, 73 aa, Staphylococcus epidermidis
YYIYNISDLRRFNIMSILTIILIVLLVILLFKVGLSILRFLISVGIVLLCIYLGYQGVLWLFEHFQNFSGFIR

SEQ ID NO: 3038 - protein, 126 aa, Staphylococcus epidermidis
RSSKEEFIMPRVKGGTVTRARRKKTIKLAKGYFGSKHTLYKVAKQQVMKSGQYAFRDRRQRKRDFRKLWITRINAAARQHDISYSRLMNGLKKAEIDINRKMLSEIAISDDKAFAELVSKAKEALK

SEQ ID NO: 3039 - protein, 309 aa, Staphylococcus epidermidis
RMRKLIVGSRRSKLALTQSQQFIDKLKFIDPSLDIEIKEIVTKGDKIVDKQLSKVGGKGLFVKEIQNELFNKEIDMAIHSLKDVPSMIPDGLTLGCIPDREIPFDAYIAKNHIPLQELSEGSIVGTSSLRRGAQILSKYPHLKIKWIRGNIDTRLKKLETEDYDAIILAAAGLKRMGWSDNIVTTYLDRDILLPAIGQGALGIECRSDDKELLDLLSKVHNHDVAQCVTAERTFLSEMDGSCQVPIGGYATIAQDNQIEFTGLIMSPDGKERYEHTALGTDPVKLGIEVSQVLKKQGAYDIIKKLNEAE

SEQ ID NO: 3040 - protein, 173 aa, Staphylococcus epidermidis
IILNLICKRRAYMRYIFSVIKNIIAVLAIILIIYIALQHAPFLKNQEWNPLNDMNNHHQNITQKVSQKNNTLYSQPSNDKSYILKENDIINNVPAGQIKTVFNMIDKAEFMSVSGLERMGFNDEYLAGQQGDEFIIYKFGDDYIRVYNTEFEMNEDLNQLKQPINLKPIEAYQ

SEQ ID NO: 3041 - protein, 77 aa, Staphylococcus epidermidis
ILVKRPIGNESCLGMKTHRGAAKRVKRTGSGQLKRSRAFTSHLFANKNTKQKRQLRKAKLVSKSDMKRVKQLLAYKK

SEQ ID NO: 3042 - protein, 61 aa, Staphylococcus epidermidis
KVGNKMKFDRHRRLRSSKTMRDLVRETHVRKEDLIYPIFVVEQDDIKSEIKSLPGIYQISF

SEQ ID NO: 3043 - protein, 161 aa, Staphylococcus epidermidis
SKYEVKRRGDMEDDPSFKQLISYCLLENEKGEILIYERLSGGGEERLHGQSSIGVGGHMNDVVGADSINEVLRVNAQRELEEEVGLSNNKSQNMEYLGFINDDDNDVGKVHMGVVFKITVHSNDVEAKETDTLKIKWIEQGDIQSYEDFETWSALILQDIS

SEQ ID NO: 3044 - protein, 274 aa, Staphylococcus epidermidis
FGDDMQETLLIRFHEIILMIYLFSIICYFVDFINKNYKTRTVGFYSLGIVWVLQTISLSIFFIHTKQVPLGSIFDVFFSLTWIIISISLILNLIKVMNFSVFFLNLIGFILMSLNTFQPEHYQTQIQQIAVINELLLVHIALAVLSYAFFAIAFVNSLLYIIQYRNLKEKNFDQNYFRIGSVATLETIVFYSTLVAWIILILSTILGAQWGIFAVGKQIFIDPKVIFSTIITLLYGVYIFIRIKKWISQRNLIYFNIILFCLCMINLFFLTHFR

SEQ ID NO: 3045 - protein, 87 aa, Staphylococcus epidermidis
SSALVELITMSVVSNKDGNAESESYETLCFSAKILALDNVRLTIVTFEIPEPKRFKSDNSPISPAPITTACLLFNFPNTFLANSTAA

SEQ ID NO: 3046 - protein, 208 aa, Staphylococcus epidermidis
YIILLIYIIMDIKISQCIGDEIMNECAFNTTDPIYIEYHDYYWGQPIYDSKELFKLMALESQHAGLSWLTILKKKESYEQAFYNFEPQFIAHMTEQDIDYLMKFPNIIHNRKKLEAIVSQAKGYLKIEKDYGSFSKFLWSYVNHQPINMGYKKPRDRKKVDQRATQLSKDLKAYGFKFLGPVTVFSFLEAAGLYDSHLEGCPFKPNHE

SEQ ID NO: 3047 - protein, 205 aa, Staphylococcus epidermidis
LYNSIRKRKSMNINFNNINLIISAVKKAQYPDTGLTEVALSGRSNVGKSTFINSMIGRKNMARTSQQPGKTQTLNFYNIDEQLIFVDVPGYGYAKVSKVQREKFGKMIEEYITQRENLKLVIQLVDLRHQPTEDDVLMYNYLKHFDIPTLVICTKEDKIAKGKVQKHIKRIKDKLELESGDNIISYSSIKNSKQQEIWNFIETYI

SEQ ID NO: 3048 - protein, 358 aa, Staphylococcus epidermidis
SGILKRNFINNLIILLIAIMLSLLLKMLHVILPFMFGPILAALLCVKVLKLKIRWPFWLSQIGLILLGVQIGSTFTQQVIKDISKNWLTIVFVTILLILLALIIAFFFKKIAQVNLETAILSVIPGALSQMLVMAEENKKANILVVSLTQTSRVIFVVILVPLISYFFQDNHHEMNHTTMEVPTLSQTLNIWQIIILFSMVGIIYIGMSKINFPTKQLLAPIIVLIIWNMTTHLTFSLDHWLLATAQLIYMIRIGLQIANLMSDLKGRIAIAIAFQNIMLIVTTFIMIIGIHLITNESINELFLGAAPGGMSQIVLVAMATGADVAMISSYHIFRIFFILFVIAPLIGYFINVKLNNK

SEQ ID NO: 3049 - protein, 427 aa, Staphylococcus epidermidis
RHRSMIMNYLDSLYWIHERSKFGIKPGVKRMEWMLEQLNNPQHKIRGIHVGGTNGKGSTVAYLRTALIENDYSVGTFTSPFIESFNERISLNGVPIMNDEIVQLVERVKPVSEALEIETDLGGATEFEIITTMMFLYFGEINPVDFVIIEAGLGIKNDSTNVFKPVLSILTSIGLDHTDILGTTYLDIAKDKAAIIKPHIPIVYAVKNDDALKYVRDYALEQNAKPIELDREITVVSQDDEFTYRYKDYELETIILNMLGEHQKENAALAITALIELNERQIIELDFNKMIDGIESVNWTGRIEQVKEQPLMVIDGAHNNRSIDALVDTIRHYYGRDKIDILFSAIKGKPIHSMINKLNDIASKFYIADFEFPKALAKEEIAEELKLDNLHLIDDYVDFIENYEGDGLIITGSLYFISEVKAKINFN

SEQ ID NO: 3050 - protein, 229 aa, Staphylococcus epidermidis
NKFMKPVIVMTQTNEVHSHLVDIIHKPFIQLKQLHFNEKLLDHSYDWLIFSSKNAVKYFYPYLKNVKVKKVAVIGDKTAQYCNELGISVDFVPRDFSQEGFLDEFKISEQHLLLPSSEKARSKLVQQLSKYNEVVKIDLYRPVPNFKNISQVKSLVRKHQIDAVTFSSSSAVEFYFKEDNVPEFDHYFAIGKQTARTILKFNTSVKVANKQTLDSLIDKIIESREQNEI

SEQ ID NO: 3051 - protein, 431 aa, Staphylococcus epidermidis
GGHMMSFEKSIKAMEQAEKLMPGGVNSPVRAFKSVDTPAIFMDHGEGSKIYDIDGNEYIDYVLSWGPLILGHKNQQVISKLHEAVDKGTSFGASTLQENKLAELVIDRVPSIEKVRMVSSGTEATLDTLRLARGYTGRNKIIKFEGCYHGHSDSLLIKAGSGVATLGLPDSPGVPEGIAKNTITVPYNDLDSLKLAFEKYGDDIAGVIVEPVAGNMGVVPPVNGFLQGLRDITNEYGALLIFDEVMTGFRVGYNCAQGYFGVTPDLTCLGKVIGGGLPVGAFGGKKEIMDYIAPVGTIYQAGTLSGNPLAMTSGYETLSQLTPESYEYFNSLGDILEKGLKEVFAKHNVPITVNRAGSMIGYFLNEGPVTNFEEANKSDLKLFSNMYREMAKEGVFLPPSQFEGTFLSTAHTKDDIEKTIQAFDNALSRIV

SEQ ID NO: 3052 - protein, 98 aa, Staphylococcus epidermidis
ADVLFLLIRFPSSSYNSGSISSLIVCSVMTTLLTFSEEGTSYMMSINASSIIERNPRAPVLRSIAFSLIADRASSENSNSTLSNSSILVYCLTSAFLG

SEQ ID NO: 3053 - protein, 222 aa, Staphylococcus epidermidis
IFTFNTIYILIIRSNFISLSPTFISFKGRILLRINEMALHEKPRERLITYGAKSLSNVELLAILLNTGRKGFSSIDIANELLKQQSTIRDLKKLSINDLLKIKGIGLYKAVILQAAFELGERINSTSTFDKVQITHPSDVASLMMSTMKDLEQEHFVVLLLNSKNIVTKQAWVYKGTLNSSIIHPREVFNIAIRESSNSIIVVHNHPSGDVTPSERGYEYNV

SEQ ID NO: 3054 - protein, 319 aa, Staphylococcus epidermidis
FFKIYHDWSAKLMADIIPFPQFKSKMIKQINDAERNADFEKMYQLFNVYEQHFDPNEEIALKKCQMLLQLNAYLELREEAIILLKRGFNCYDELMIYYIKSLNGLGQFNEAVEVINQIIDEVKNHKTRMELFPLKEYAISRLDEDRKALSSSLSDFGSLNTREQTSLILQLIDNGHYNFKESVANILISMDLPKNLVSLMLEYLRFAEYSHTITIHKYGETINVNPNHLSGIEHTTIKDKVIPVVMNRLEDGALHILKEAQHIMNNHSILMYPIDIESLYTIDNWIDAYDVYFKQLIGIDINGCNNDTLQFIKSLDNEM

SEQ ID NO: 3055 - protein, 448 aa, Staphylococcus epidermidis
MHFVAISINHRTADVTLREQVAFRDDALRLAHEDLYETKAILENVILSTCNRTEVYAIVDQVHTGRYYIQRFLARSFGFEVDDIKDMSEVKVGDDAVEHLLRVTSGLDSIVLGETQILGQMRDAFFLAQNTGTTGTIFNHLFKQAITFAKKAHSETDIADNAVSVSYAAVELAKKVFGKLKSKHAVVIGAGEMGELSLLNLLGSGISNVTIVNRTLSKAKILAEKHNVSYDSLSALPSLLETTDIVISSTSAEDYIITNSMVKTISETRKLDSLVLIDIAVPRDIEPGIDAITNIFNYDVDDLKDLVDANLRERQLAAETIAGQIPEEIDSHNEWVNMLGVVPVIRALREKAMNIQAETMESIDRKLPDLSERERKVISKHTKSIINQMLKDPIKQAKELSTDKKSNEKLELFQNIFDIEAEDPREKAKLEKESRAKEILAHRIFSFE

SEQ ID NO: 3056 - protein, 72 aa, Staphylococcus epidermidis
TDEVTTNDKNINGIKGKYLISLKEKIFKIMAKIPPMINVNTTIKKKKFNGNISPNILKSNMSPYPINLDANR

SEQ ID NO: 3057 - protein, 237 aa, Staphylococcus epidermidis
YMLLLAYTCSIIFSFLYQFCNQNILKLQYLYSRSHCDFCHTIIKPLDLLPIISFLKLRGQSRCCNQPLQRLYLIGELVSFGAIFLYYPTHFNIHFTLFLITFLFLLTMCLYDIHSMHIDMRLLFVYTVVSVFTTQTYFGNFIMIFLISHVIYLFASKFIGYGDILLFNILGLIFPLNFFFFIVVFTFIIGGIFAIILKIFSFKDIKYLPLIPFIFLSFVVTSSVYHQLLFLLRGEFY

SEQ ID NO: 3058 - protein, 98 aa, Staphylococcus epidermidis
VKIFLSAATSKVSRLATIGTRPINSGIKPYDWRSSGRICSSKASSSYLSASLLANPITFSPKRLLMTSSIPSKAPPKINKMFVVSIWINSWFGCFRPP

SEQ ID NO: 3059 - protein, 286 aa, Staphylococcus epidermidis
KVKLNHYQAYTKLVFKKKILLHEEIKEAYDLGIRAIMFFGVPNDKDDIGSGAYDHNGVVQEATRISKNLYKDLLIVADTCLCEYTDHGHCGVIDDHTHDVDNDKSLPLLVKTAISQVEAGADIIAPSNMMDGFVAEIREGLDQAGYQNIPIMSYGIKYASSFFGPFRDAADSAPSFGDRKTYQMDPANRLEALRELESDLKEGCDMMIVKPSLSYLDIIRDVKNNTNVPVVANNVSGEYSMTKAAALNGWIDEEKIVMEQMISMKRAGADLIITYFAKDICRYLDK

SEQ ID NO: 3060 - protein, 116 aa, Staphylococcus epidermidis
LPVTNRRKVGMTSNHHAPYDLGYTRATMDNTKGSETARSSKSHKVVLSSDCSLQLDYMKLESLVIVDQHATVNTFPGLVHTARHTTRVCNTRSRWSNHLELAVEGGTNDWGEVVTR

SEQ ID NO: 3061 - protein, 614 aa, Staphylococcus epidermidis
RERLMKWLKQLQSLHTKLVIVYVLLIIIGMQIIGLYFTNSLEKELLDNFKKNITQYAKQLDVNIEKVYKDKDKGSVNAQKDIQDLLNEYANRQEIGEIRFIDKDQIIMATTKQSNRGLINQKVNDGSVQKALSLGQTNDHMVLKDYGSGKERVWVYNIPVKVDKQTIGDIYIESKINDVYNQLNNINQIFIVGTAISLFITVILGFFIARTITKPITDMRNQTVEMSKGNYTQRVKIYGNDEIGELALAFNNLSKRVQEAQANTESEKRRLDSVITHMSDGILATDRRGRVRIANDMALKMLGLAKEDVIGYYMLGVLNLENEFSLEEIQENSDSFLLDINEEEGIIARVNFSTIVQETGFVTGYIAVLHDVTEQQQVERERREFVANVSHELRTPLTSMNSYIEALEEGAWQDKELAPSFLSVTREETERMIRLVNDLLQLSKMDNESDQITKEIIDFNMFINKIINRHEMAAKDTTFVREIPQQTIFAEIDPDKMTQVFDNVITNAMKYSRGEKRVEFHVKQNALYNRMTIRIKDNGIGIPINKVDKIFDRFYRVDKARTRKMGGTGLGLAISKEIVEAHNGRIWANSVEGQGTSIFITLPCEIIEDGDWDE

SEQ ID NO: 3062 - protein, 263 aa, Staphylococcus epidermidis
MNWKLTKTLFIFVFILVNIFLVIVYIDKVNKSQVNDSEKVNEVNFQQEEIDVPKDVLNQSVKDTELEQITARSKNFSSYAKDHSSLQTSDSDKTLEGDIDKGVQVSDKNLQDIKEYIAKKIFNGKEYQLSDLTKDKVTYEQTYKDYPIMNNSKARLTFNLSDGKATSYKQTAMDDIQVAKGSNSTKKQVITPRKAIEALYYNRYLKQNDQVLDARLGYYSVVKETNVQLLQPNWEIKVKHKGKDEVQTYYVEATNHNPKVIDY

SEQ ID NO: 3063 - protein, 234 aa, Staphylococcus epidermidis
YMARKVVVVDDEKPIADILEFNLKKEGYDVYCAYDGNDAVDLIYEEEPDIVLLDIMLPGRDGMEVCREVRKKYEMPIIMLTAKDSEIDKVLGLELGADDYVTKPFSTRELIARVKANLRRHYSQPAQEVSGATNEITIKDIVIYPDAYSIKKRGEDIELTHREFELFHYLSKHMGQVMTREHLLQTVWGYDYFGDVRTVDVTIRRLREKIEDDPSHPEYIVTRRGVGYFLQQHD

SEQ ID NO: 3064 - protein, 268 aa, Staphylococcus epidermidis
ERMSRLIRMSVLASGSTGNATYVESEKGSLLVDVGLTGKKMEELFSQIDRNIKDLNGILVTHEHIDHIKGLGVLARKYKLPIYANENTWKAIEKKDSRIPMDQKFIFNPYETKSLAGFDIESFNVSHDAIDPQFYIFHNNYKKFTMITDTGYVSDRMKGMIQGSDVFMFESNHDVDMLRMCRYPWKTKQRILSDMGHVSNEDAGLAMSDVITGNTKRIYLSHLSQDNNMKDLARMSVGQVLNEHDIDTEKEVLLCDTDKAQATPIYTL

SEQ ID NO: 3065 - protein, 63 aa, Staphylococcus epidermidis
KLNIPIHAYISIIKNTVITALLTYTKTIKYDDKPKQKRQAYCKSLTYFAELYFNGKIINNIIL

SEQ ID NO: 3066 - protein, 466 aa, Staphylococcus epidermidis
KDKVRQSLLRFLAKSLKTVIGMNNKEHTKSIILVLLVLMSIVLTYMVWNFSPDLSNIDNTDNSKSDKPKPLTKPMTAEMEGTITPFQIVHSRDDKSQGTVASGAVLDKMIQPLKNQEVKSVSHLKREHNLVIPELSNDFIVLDFTYDLPLSTYLSQVLDIDAKVPNNFNFDRLLIDQDHNNHVVLFAISKDRHEVVKLKTTMKGNNVDKAFKSIEPDMQPYTEIITNKDTIDKATHVFAPSKPKDLKTYRMVFNTISVERMNSILFDDSTIVRSSQSGTTTYNNNTGVANYNDKDEMYHYKNLSEDAKSSSNMQETIPGTYEFINSHGGFLNEDYRLFKTDNRTGKLTYQRFLNGYPTFNKQNFNEIQVTWGDKGVYDYQRSLLKTDVTLNSEESKSVPTVESVRSALANHPDIDFEKVTNIAIGYDMDDKANNEDIEVQRNCELIPRWFVEYDGNWYAYKDGRLE

SEQ ID NO: 3067 - protein, 846 aa, Staphylococcus epidermidis
FIPWGTSNGRNPCEKKREFDPNLAPGTEKVVQKGEPGTKTITTPTTKNPLTGEKVGEGEPTEKITKQPVDEIVHYGGEQIPQGHKDEFDPNAPKGSQEDVPGKPGVKNPDTGEVVTPPVDDVTKYGPVDGDSITSTEEIPFDKKREFDPNLAPGTEKVVQKGEPGTKTITTPTTKNPLTGEKVGEGEPTEKITKQPVDEIVHYGGEEIKPGHKDEFDPNAPKGSQEDVPGKPGVKNPDTGEVVTPPVDDVTKYGPVDGDSITSTEEIPFDKKREFDPNLAPGTEKVVQKGEPGTKTITTPTTKNPLTGEKVGEGEPTEKITKQPVDEIVHYGGEQIPQGHKDEFDPNAPKGSQEDVPGKPGVKNPDTGEVVTPPVDDVTKYGPVDGDSITSTEEIPFDKKREFDPNLAPGTEKVVQKGEPGTKTITTPTTKNPLTGEKVGEGEPTEKVTKQPVDEIVHYGGEEIKPGHKDEFDPNAPKGSQEDVPGKPGVKNPDTGEVVTPPVDDVTKYGPVDGDPITSTEEIPFDKKREFDPNLAPGTEKVVQKGEPGTKTITTPTTKNPLTGEKVGEGEPTEKITKQPVDEIVHYGGEEIKPGHKDEFDPNAPKGSQTTQPGKPGVKNPDTGEVVTPPVDDVTKYGPVDGDPITSTEEIPFDKKREFNPDLKPGEERVKQKGEPGTKTITTPTTKNPLTGEKVGEGEPTEKITKQPVDEITEYGGEEIKPGHKDEFDPNAPKGSQTTQPGKPGVKNPDTGEVVTPPVDDVTKYGPVDGDPITSTEEIPFDKKREFDPNLAPGTEKVVQKGEPGTKTITTPTTKNPLTGEKVGEGEPTEKITKQPVDEIVHYGGE

SEQ ID NO: 3068 - protein, 383 aa, Staphylococcus epidermidis
IKPGHKDEFDPNAPKGSQEDVPGKPGVKNPDTGEVVTPPVDDVTKYGPVDGDPITSTEEIPFDKKREFNPDLKPGEERVKQKGEPGTKTITTPTTKNPLTGEKVGEGEPTEKVTKQPVDEITEYGGEEIKPGHKDEFDPNAPKGSQEDVPGKPGVKNPDTGEVVTPPVDDVTKYGPVDGDPITSTEEIPFDKKREFDPNLAPGTEKVVQKGEPGTKTITTPTTKNPLTGEKVGEGEPTEKVTKQPVDEIVHYGGEEIKPGHKDEFDPNAPKGSQEDVPGKPGVKNPDTGEVVTPPVDDVTKYGPVDGDPITSTEEIPFDKKREFDPNLAPGTEKVVQKGEPGTKTITTPTTKNPLTGEKVGEGEPTEKITKQPVDEITEYGGE

SEQ ID NO: 3069 - protein, 135 aa, Staphylococcus epidermidis
IKPGHKDEFDPNAPKGSQEDVPGKPGVKNPDTGEVVTPPVDDVTKYGPVDGDPITSTEEIPFDKKREFNPDLKPGEERVKQKGEPGTKTITTPTTKNPLTGEKVGEGEPTEKVTKQPVDEITEYGGEKIQHGPKV

SEQ ID NO: 3070 - protein, 99 aa, Staphylococcus epidermidis
GSIPPTPPRKLALTFQRLLPILYKLCRISISGYSKAPRGLSVLSRVTCIFTGTMISPSLSLRQCPNRYAFRAGRNLPDKEFRYLRTVIVTAAVYWGFDS

SEQ ID NO: 3071 - protein, 100 aa, Staphylococcus epidermidis
RLPPTYYRGCWHVVSRGFLIRYRQDVHSYLHICSSLITEFYDPKTFITHAALLRQAFAHCGRFPTAASRRSLDRVSVPVWPITLSGRLRIVALVSRYLTN

SEQ ID NO: 3072 - protein, 97 aa, Staphylococcus epidermidis
GSLTARPTSRAGSKDGLSDPVVPHGRAIAQRIKATPGITGLSPPRVHIDGEVWHLDVGSSHPGAVVGPKGWAVRPLKRYASWVQNVVRQFGPYPSWA

SEQ ID NO: 3073 - protein, 116 aa, Staphylococcus epidermidis; identical to SEQ ID NO: 3060

SEQ ID NO: 3074 - protein, 74 aa, Staphylococcus epidermidis
ANILVVWATPHPFPLNIYFGTLAGGLGCFPFEHGPYHPCSDSQVKLIGIRSLSEFGNPRGAPRPNSALPPIIIT

SEQ ID NO: 3075 - protein, 74 aa, Staphylococcus epidermidis
AHGFKFSFTPLPGYFSPFPHGTGSLSVTREYLALGDGPPRFRRNFTCSVVLRIHSRENMFPTTGLLPSLIHLSR

SEQ ID NO: 3076 - protein, 68 aa, Staphylococcus epidermidis
LCWLSNPHHLSWWETVSGGQFDWGGRLLKGNGGAQRFPQNGWKSFIECKGIRELDCETYKSSRVERRT

SEQ ID NO: 3077 - protein, 121 aa, Staphylococcus epidermidis
IISTEKYSKEKHTLFLISSHQLKELEDLCDRFLLLENHQIREIDLHNRIFTQKLIFKNTLNNAPELKANFNFIKKIDSNSITIINKDEEVDLTNLLNLVGKNPLIKIESNDNLLSSYFYKE

SEQ ID NO: 3078 - protein, 137 aa, Staphylococcus epidermidis
RVGNIMFKFNFFYISKIRATWMLYLIGIYPLLIFLAELLNSNFLSLSATHKNSVSFLELFIAIYDTQQKVMLSLIIIGYLSSLLFYSEISTGRLLFYKDQSRYKIFNSKLTSIISSYFIFFFILLLSTWLLTAECPH

SEQ ID NO: 3079 - protein, 84 aa, Staphylococcus epidermidis
MVNFKIEKLKLNNLFISLSIVIITTIVLNISIGIISYLKLSEYCEFLSMILSLIISFIIIPTFLSSIFNYKTNPFKLLTIKNLL

SEQ ID NO: 3080 - protein, 209 aa, Staphylococcus epidermidis
HLRYNISRIFGVLVGIPVAFIVWLITVFALDLSFIIDMLISFGSFIASYFPTQRLTSRKYLNEIGLSRRDYRYVQSQLHHAHTKIRNILKSFINIRSIKDFRQVNDIYRISRSIHTSIKQRPAMFFKVESFFYSHLDNALNLVDSYTRLARMPRKSQDEKLKLEQTRITLDEIKRTLIADLKRLNEEDYERLDVEIELNKLEQQRRHNN

SEQ ID NO: 3081 - protein, 79 aa, Staphylococcus epidermidis
CILKEFSLGGFRIMKQGTVKWFNAEKGFGFIEVEGENDVFVHFSAINQEGYKSLEEGQSVEFEVVEGDRGPQAANVVKL

SEQ ID NO: 3082 - protein, 69 aa, Staphylococcus epidermidis
LNIEERKVGIIIKLIIRERIIDKNSQYSDNLRYDIIPMLIFSTIVVIITILSDMNKLFSFNFSILKFTI

SEQ ID NO: 3083 - protein, 75 aa, Staphylococcus epidermidis
VIIEKLSLNLYLITYKIILEGNLINRLDSNDSLRCKIKANSKEPIEIEVNKLKLFSKMLNTTSLNKISSPKAIKK

SEQ ID NO: 3084 - protein, 111 aa, Staphylococcus epidermidis
LYSREGEINMWTVVKIRADYEGWWLFEDWPQKIVEQSEFTTYDQMLDYYINVLNHSKKCYDNYVVGKYNIHAFYNNCDLNFCEDCEEDLQIFYSFIILKNNEVYFNLPKID

SEQ ID NO: 3085 - protein, 433 aa, Staphylococcus epidermidis
MFFGAGNLIFPTQLGLESGHFFWPAILAFALTGIGLPLLGVVVGALDKHGYIGSFNKISPRFSLIFLIIIYLTIGPLFAIPRTASTSFEMTVTPIAHNSGNLALFIFTVIYFLIVLYLCLNPNKMIDRIGSLLTPLLLITIVAMIIKGFVDFSGHSSNYGMTNAYHSNLSGFSQGFTQGYLTMDAIASIAFSMIVVNAIKTTGIQHADKIFKQTIIAGLIAAIALVFIYISLGYIGNHINIPSDTLKELKAKDQNIGTYLLTTMATKGFGTFGKYLLGIIVSLACLTTACGLIVSVSEYFHRILPKIPYKVFVIFFILVSFILANQGLNSVIKMSVPVLSVIYPVAITVILLILIARFIPTKRIAQQIPLIIVAIESILSLITTQGWIRISFIDGLPLKEYSLEWFPIAVVATLVGYMISYFVKQSNIVYQKE

SEQ ID NO: 3086 - protein, 108 aa, Staphylococcus epidermidis
YFIILLILIVYVDDYKLIIFYFFIALGEEILFREVVFNILLNNFSLLTSISIGSLLFALILHLNESLESNLLIRFPSSIILYVIRYKFKLSFSIITHWIYNIFIVVMR

SEQ ID NO: 3087 - protein, 104 aa, Staphylococcus epidermidis
FFTIKIRIIKTRGDFMQRKHIQVFGTVQGVGFRFYTQRIAHQFNIKGTVQNVEDYVDIYAQGDDTELEQFIDSVIQGASPASQVSNYNIEELDLDESLSEFKTI

SEQ ID NO: 3088 - protein, 392 aa, Staphylococcus epidermidis
NSNVDIIINRNGEMSEMVSERSSNQSHPLDYYMNNQSTDHHTIAEDLEIQLTENDKQRIKSISEQIEPLNHEGLLKYGANLQQKMSHFSHQILDDVQSKDMGPVGETLSQLMGKLKSVNPNDINPEKQSRLKRLFKRTKASINEVFSRMQSVSSQIDRITIQLEKHKDQLTKDVEFLDQLYQQNKTYFDNVTLYILAAQKKKKEILTETIPQLREKAHQTGNQMDIQATADMEQFVDRLDKRIYDLQLSRQIAIQTAPQIRMIQNVNQALAEKIQSSILTSIPLWKNQMAIALTLMRQRNTVSAQRSVTDTTNELLTPNASMLKENAIETAAENERGIVDIETLKTTQNDIIETIEQTLQIQEDGRQKRQVAEKELNELEQDLKQHLLAMRK

SEQ ID NO: 3089 - protein, 114 aa, Staphylococcus epidermidis
RSLSKPIERYEYKMTNMVIIILVMMSRALKISTTNTMLYGAFQEPSSTLIGPSRSTFFKLINAMTNVSNVPTSATYLFIIGRFPINMSKIAVRIGMTKVKTSKLLSIIFWRSFH

SEQ ID NO: 3090 - protein, 128 aa, Staphylococcus epidermidis
YRMLYRFSHKTGVYGVSVKEETGNQILVQIEQVIKHPKQGDLHHPNETEGVFFHERKALSHFEKRYATPSQLRDFNVEAMPYEDSLQHAITHLENQLKKEKTEYSRLSLNNLNRLKEDYAIQYKRHFD

SEQ ID NO: 3091 - protein, 97 aa, Staphylococcus epidermidis
TKLTRCLMYKDYNMTQLTLPMETSVLIPTNDISRHVNDIIETIPETEFDEFRHHRGATSYHPKMMLKVVLYAYTQSVFSGRKIEKLLNDNIRMMWLS

SEQ ID NO: 3092 - protein, 451 aa, Staphylococcus epidermidis
VLITGGNKMTHIQLDYGKTLEFFDKHELDQQKDIVKTIHQTIHKGTGAGNDFLGWLDLPVDYDKEEFSRIVEASKRIKSNSDVLVVIGIGGSYLGARAAIEMLTSSFRTNTEYPEIVFVGNHLSSSYTKELLDYLQGKDFSVNVISKSGTTTEPAVAFRLFKQLVEEKYGKDEAKKRIYATTDKSKGALKQLADNEGYETFVVPDDVGGRYSVLTAVGLLPIATAGINIESIMIGAAKAREELSSDDLDQNIAYQYATIRNILYSKGYTTEMLINYEPSMQYFNEWWKQLYGESEGKDFKGIYPSSANYTTDLHSLGQYVQEGRRFLFETVVKVNHPKHDIKIEEDADDLDGLNYLAGKSIDEVNTKAFEGTLLAHTDGGVPNIVVNIPQLDEETFGYVVYFFELACAMSGYQLGVNPFNQPGVEAYKQNMFALLGKPGFEDKKKELENRL

SEQ ID NO: 3093 - protein, 92 aa, Staphylococcus epidermidis
VVKTFANIPIIASLFIPFGASIGLDTMALIALIGTASALGDSGSPASDSTLGPTAGLNIDGQHDHIRDTCIPNFLFYNVPLMIFGTIAAMVL

SEQ ID NO: 3094 - protein, 70 aa, Staphylococcus epidermidis
KLSQASPKLWFNWSRISKTSTKSRKSIIKRQRIKIVIKNNSHLKLQKFNFVLSYQSLYKKNVKFPFILSN

SEQ ID NO: 3095 - protein, 66 aa, Staphylococcus epidermidis
CGYHKIKSLLIKRLIDSKTNKKIMKNYSWEYFNVQINQKLSERKAKTIYSQRKIDVESVFGIMKLF

SEQ ID NO: 3096 - protein, 503 aa, Staphylococcus epidermidis
KERQKMIESNLLVLTLVIPILTAILLIFIGKRPIIKRYVALVGTLLTLVIALINLKNVLRDGPIKVELGSWKAPYSIVFVVDIFSALLIITSIIITILVILYSYRSIGLDRERHYYYFSIMFMLIGIIGSFTTGDIFNLFVFFEVFLMSSYCLLVIGTTKIQLQETIKYILVNVVSSSFFVMGVAVLYSVVGTLNLAHISERLSQLSVHDSGLVNIVFILFIFVFATKAGVFPMYVWLPGAYYAPPVAIITFFGALLTKVGVYAIARTLSLFFNNTVSFSHYVILFLALLTIIFGCIGAIAYYDTKKIILYNIMIAVGVILVGIAMMNESGMTGAIYYTLHDMLVKASLFLLIGVMYKITKTTDLRHFGGLIKGYPILGWTFFIAALSLAGIPPFSGFYGKFYIVRATFEKGFYLSGIIVLLSSLIVLYSVIRIFLKGFFGEVEGYTLSKKVNVKYLTTIAVASTVITVIFGLSADTLFPIIKDGAETFVDPSQYIHSVLGGK

SEQ ID NO: 3097 - protein, 87 aa, Staphylococcus epidermidis
NMKHLIKYLISFTFAIIIVIFIQSFIIVGAVISNNSMTPTLQTGDRVIVNKIKVTFDLIQRGDIIMYRHNNKTYFSRIVGNSHNHGM

SEQ ID NO: 3098 - protein, 80 aa, Staphylococcus epidermidis
ARFKVPTTEYKTATPMTKKDDETTLTKIYLIVSCNCILVVPITSKQYEDIKKTSKNTNKLKISPVVNEPIIPININMIEK

SEQ ID NO: 3099 - protein, 200 aa, Staphylococcus epidermidis
YNPKKGFDVLSLSQLEEWFDAFRQFGYIPGFIMLYLRAIVPVLPLTLYVVLLIHAYGLFPGIIISWLGIVSGTFTVFLICKKFVNTIRMKKLKSRKSVQRLISFIDRQGLIPLFVLLCFPFTPNTLINIIASLSHIKIKYYFFVLVISKLISITILGVMGKEIFTIFTNPLRALIMIVLLVVLWFISKKVEKHFMGSTKE

SEQ ID NO: 3100 - protein, 130 aa, Staphylococcus epidermidis
GVIKLNHHYKVGQHIKVRVTGIQPYGAFVETPDHTEGLIHISEIMDDYVHNLKKFLSEGQVVKAKILSIDDEGKLNLSLKDNDYFKNYERKKEKQSVLDEIRETEKYGFQTLKERLPVWIKQSKRAIHND

SEQ ID NO: 3101 - protein, 125 aa, Staphylococcus epidermidis
TMTNLLETFEMKIEQKEDGKVVVSMPVTDKVKQPFGYLHGGASLALGETACSIGAAHLIDTQQFIPLGLEMNANHIRSTRQGHVRAFASLIHQGKTTQVWNIDIKDDHDQLISVMRGTIAIKPIQ

SEQ ID NO: 3102 - protein, 144 aa, Staphylococcus epidermidis
MTMNRQQNNLIFQYAAVIIFFMVIVFGFSLFLAGHYTPGGGFVGGLLFASALLVITIAYDVKTMRKIFPLDFKILIGIGLLFCVGTPLTSWFMSKNFFTHVTFDIPLPLLEPMHMTTAMFFDFGVLCAVVRTIMTIIISIGENE

SEQ ID NO: 3103 - protein, 420 aa, Staphylococcus epidermidis
KEANRIMTENNNLVTSTQGIIKEALHKLGFDDGMYDLIKEPIRFLQVRIPVRMDDGTVKTFTGYRAQHNDAVGPTKGGVRFHPEVDEEEVKALSMWMTLKCGIVNLPYGGGKGGIVCDPRQMSIHEVERLSRGYVRAISQFVGPNKDIPAPDVFTNSQIMAWMMDEYSALDKFNSPGFITGKPIVLGGSQGRDRSTALGVVIAIEQAAKRRGMDIKDAKIVIQGFGNAGSFLAKFLYDLGAKVVGISDAYGALHDPNGLDIDYLLDRRDSFGTVTNLFEDTISNKELFELDCDILVPAAISNQITEDNAHDIKASIVVEAANGPTTPEATRILTERDILLVPDVLASAGGVTVSYFEWVQNNQGYYWTEEEVNDKLREKLVTAFDTIYELSQNRKIDMRLAAYIVGIKRTAEAARYRGWA

SEQ ID NO: 3104 - protein, 61 aa, Staphylococcus epidermidis
FILDGIFVCCCIDFSDWFGAGEWFEVSAIEGELKLAKPSVTVDKVEMIIFLDLNIKTSFQK

SEQ ID NO: 3105 - protein, 808 aa, Staphylococcus epidermidis
ILKEENIVSLLHIAVLLPLIFALIIPFLYRFVKRIHLGWFVLPVPIVLFIYFISLISMTMSGNNVMKNLNWMPHIGMNFNLYVDGLGLLFSLLITGIGSLVVLYSIGYLSKSEQLGNFYCYLLLFMGAMLGVVLSDNFIILYLFWELTSFSSFLLISFWREKKASIYGAQKSLIITVLGGLSMLGGIILLSLATDTFSIQAMISKASDIQNSPFFILVMILFMIGAFTKSAQVPFYIWLPDAMEAPTPVSAYLHSATMVKAGLYLIARITPIFAISEGWVWTITLVGLITLFWASLNATKQHDLKGILAFSTVSQLGMIMSMLGIGAVSYHYQGANSQLYVAGFVAAIFHLINHATFKGALFMITGGIDHSTGTRDVKKLGGLLTIMPISFTLTVITTLSMAGVPPFNGFLSKEKFLESMINVTHLNLMSLNTLGILLPIIAIIGSIFTFVYSIKFILHIFFGSYKPEALPKQAHESSILMLISPIILTSLVIVFGLFPSILTQSIIEPASVAVSQTSNITAEFHLFHGITPAFLSTIGIYIIGILLLISFSYWVRLLQAHPYQLTLNHWYDTSGQRIPGYSENITNSYVTGFSRNNLVIILGILIALTFVTVISVPFSIDFKNVSHLRVFEGATVLFLLIASTFIIFAKSRLFSIIMLSAVGYAISVLFIFFKAPDLALTQFVVESISTALFLLCFYHLPNLNRYNEKPTFKLTNAVISIGVGLSVIILGLIGYGNRHFDSITKFYQEHVFDLAHGKNMVNVILVNFRGMDTLFESSVLSIAGLGVYTMIKLRLKQKNQSSEVNDHE

SEQ ID NO: 3106 - protein, 62 aa, Staphylococcus epidermidis
CGVCFWNYEAILSFTRKSVRGINKDKRELGLVLMTLNIRKVPAQRAENYKKIIKKTIFILFQ

SEQ ID NO: 3107 - protein, 406 aa, Staphylococcus epidermidis
VFIRKRRGDFMTQSEKIINLTNHYGAHNYVPLPIVISEAEGVWVKDPEGNTYMDMLSAYSAVNQGHRHPRIIQALKDQADKVTLVSRAFHSDNLGQWYEKICKLAGKDKALPMNTGAEAVETALKAARRWAYDVKGIEPNKAEIIAFNGNFHGRTMAPVSLSSEAEYQRGYGPLLDGFRKVEFGDVNQLKAAINKNTAAILVEPIQGEAGINVPPEGYLKTIRELCDEHQILFIADEIQAGLGRSGKLFATDWDHVKPDVYILGKALGGGVFPISVVLADNEVLDVFTPGSHGSTFGGNPLASAVSIAAIDVIIDEDLPGRSLELGEYFKSELKKIEHPSIKEVRGRGLFIGIELHESARPYCEALKEQGLLCKETHDTVIRFAPPLVITKEELDMALEKIKSVFA

SEQ ID NO: 3108 - protein, 103 aa, Staphylococcus epidermidis
KGRREIMPFKIFIITALIIVVLSMLAMLIRVILGPSLADRVVALDAIGLQLMAVIALFSILLNIKYMLVVILMVGILAFLGTAVFSKFMDEGKVIKHDSNDRH

SEQ ID NO: 3109 - protein, 163 aa, Staphylococcus epidermidis
EVNSLAIQFVINLLVSVIWLLVTNSYTLNNFVLGFILGLFLVYLLHRVLPGQFYLVRIYRIIMLIITFLTELIKANFGVLKIILKPRIENKPGFFVYETELERDWQLVLLSNLITLTPGTVVLGISDDRKKIYIHSIDFSTKEEEIQNIKSSLEKVVRKVGEK

SEQ ID NO: 3110 - protein, 110 aa, Staphylococcus epidermidis
SLLSGILTSISVYLVSSKSLIRIIMGTTLLTHAANLFLITMGGLKHGTVPIFEKGTSRYVDPIPQALILTAIVIAFATTAFFLVLAFRTYKELGTDNVELMKGAPEDDRE

SEQ ID NO: 3111 - protein, 203 aa, Staphylococcus epidermidis
HEWRIEMTNYPQLNKEIQDNEIKVVMHTNKGDMTFKLFPDIAPKTVENFVTHSKNGYYDGVTFHRVINDFMVQGGDPTATGMGGESIYGSAFEDEFSLEAFNLYGALSMANAGPNTNGSQFFIVQMKEVPENMLSQLADGGWPQPIVEAYGEKGGTPWLDQKHTVFGQLIEGESTLEDIANTKVGAQDKPVYDVVIESIDVEE

SEQ ID NO: 3112 - protein, 390 aa, Staphylococcus epidermidis
KQRGDSMHWTIIGGGLQGTTIALKLKNEGLKNEALTIIDPYSSLCERFNIYTQRISMPYLRSPFVHHIHPKPFHLKQYARYHQYTSAYYGPYKRPQRDMFMHHVHDLIHQFKLNDCHIQGKVEAINKSRGKWCIKLSTGDKMITDCVVIANGYTQTPFIPEIFRNKANVKHIFADNYHASLDKDTQHVVGSGISAAHLTLKLLNEHNHQLVHLWMNKDIEIHNFDADPGWLGPKKLNYLASISSSDARMKLIEDERHSGSMPMELFLRLKKYVQSGRLVIHTSQIDDVTESYIISAGKYFEYKHILLATGFYNQLLTQPLIKNLIQNEQAPLNQSGYPSLSNELEWLNQLFVAGGLADLELGPFARNIMGGKESAERISKAYKRLNKKIS

SEQ ID NO: 3113 - protein, 61 aa, Staphylococcus epidermidis
GNSISEIVPSSFDEVCVRGAKTKRFLTSTPLGSVKDLNKGSYLLFIFLILSLFNDVMTIAC

SEQ ID NO: 3114 - protein, 404 aa, Staphylococcus epidermidis
GVNMKDKIVLAYSGGLDTSVAVQWLIDKGYDVVACCLDVGEGKDLDVVYQKALDMGAVECHIIDATKEFSDDYVSYAIKGNLMYENAYPLVSALSRPLIAKKLVEIAEKTNSIGIAHGCTGKGNDQVRFEVAIKALNPKLKAFAPVREWAWSREEEIDYAIKHNIPVSINYDSPYSIDQNLWGRANECGILEDPYAAPPEDAFDLTTPLEETPDNADEIILTFKQGIPVQVDGKDYQLDDLILYLNQLAGKHGIGRIDHVENRMVGIKSREIYETPGAEVILKAHKALETITLTKDVAHFKPVIEKQFSEQIYNGLWFSPLTDSLKLFIDSTQQYVEGDVRIKLFKGNAIVNGRQSPYTLYDEKLATYTKEDAFNQESAVGFIDIYGLPTQVNALLHGGYSNEQ

SEQ ID NO: 3115 - protein, 353 aa, Staphylococcus epidermidis
KDVFMFKSKKIIISTLSTVTLGLASLSSPSIAETSNHSPAPNQSEKSIQQQTNIPSNMNQSSAKTFKRQAESDSVSGKTNDTHNHWTKNLTGEKFTTIAHRGASGYAPEHTFEAYDKSHNELGASYIEIDLQRTKDGHLVAMHDEKVNRTTNGHGRVDQLTLKELKQLDAGSWFNRKHPEYAKNKYKNAKVPTLDEILNRYGKNANYYIETKSPDVYPGMEKQLLDTLDKHDLLTQKSLKHGHVMIQSFSGSSLEKVHHMNANIPLIRLMNKFELKKATNQDLKNIKSYAIGVGPEYTDLNIKNTRHLKNLGFLVHPYTVDDENQMRNLNQYGVDGVFTNFADRYKKVSETQQ

SEQ ID NO: 3116 - protein, 484 aa, Staphylococcus epidermidis
VSLIFMVYLHKLMHYFTGGIVMSNKAWGGRFETQPEEWVDDFNASIDFDKNLIKQDVQGSIAHATMLAKQHIITDDEAQSIINELKNIQSDFEEGKLKFKASLEDIHLNIEHELIQRIGEAGGKLHTGRTRNDQVATDMHLYTKEQVQYIIELIASFQETIVQLADQHVDTIMPGYTHLQRAQPISFAHHIMTYFWMLERDKGRFMDSLKRIDISPLGAAALSGTTHPIDRHLTQELLGFANLYENSLDAVSDRDYIVETLHHISLTMVHLSRFAEEIIFWSTDEAKFITLSDAFSTGSSIMPQKKNPDMAELIRGKVGRTTGHLMSMLVTLKGLPLAYNKDMQEDKEGLFDAVHTLKGSLRIFEGMVASMKVNSNRLSQTVKNDFSNATELADYLVSKSVPFRTAHEIVGKIVLNCIHKGIYLLDVPLSEYQEHHENIEEDIYDYLTPENCLKRRQSYGSTGQESVKHQLKVAKALLKDNESK

SEQ ID NO: 3117 - protein, 120 aa, Staphylococcus epidermidis
SSMIATIVTSVSIIFVVLGALISAFAATGLIRLRDVYSRAHAAGKAATLGAMFLLFGAFLYFIGTEGYVNMQLIIGIIFVFITGPLSSHLIMKAAYNIKTPYTKDTKIDEIKEDMKHTKL

SEQ ID NO: 3118 - protein, 390 aa, Staphylococcus epidermidis
  UNSURE (207): Identity of amino acid at the above locations are unknown.
HAIVITSLNKESIKNMNNKYEPLFKSLTLPNGVEVRNRFVLAPLTHTSSNDDGTISDIELPYIEKRSKDVGIAINAASNVNDVGKAFPGQPSVAHDSDIEGLKELAQVMKKNGAKAIVQIHHGGAQALPELTPDGDVVAPSAISLKSFGQQKEHDTREMTAEEIEQTIRDFGEATRRAIEAGFDGVDIHGANQCLIPQFVSPYYNIXNDVWADNYKFPVAVIDEVVKAKKAHANDDFIIGYRLSPEEAESPGISMEITEELIHQIANKPLDYIHVSLMDVNSVTREGKYKGENRLELIHQWINGRMPLIGIGSVFTAEDALNAVENIGVEFVALGREILLDYDFVAKIKEGREDEIINAFDPNREDQHYLTPNLWEQFNQGFYPLPRKDK

SEQ ID NO: 3119 - protein, 60 aa, Staphylococcus epidermidis
FCLLVFIKLYERPYFFKYFIVKLHINTKYFGETLEGAGQVEDYRLKLSLRKRANNTRYCK

SEQ ID NO: 3120 - protein, 329 aa, Staphylococcus epidermidis
KVSSMLKLNPYKIGFRTVKTAVGMTLGVIICKLLGLDNYASSAILVVLCIKHTKMHSVQAILSRLVSCLLILFLGSAIFSLLGQHAFVLGLIVLLFIPLTVVLNVQEGVITSCVILLHVFNAKAINGHLILNEIMLLIVGLGIAFLMNLMMPSLDKKLNHFKQDIENQITEIFNIFSQACSMHNDHLNIKFDSLLLNIKKAKSLAFRDVKNHFVRNENSFYHYFDMREEQVELLKRMTSLLERINTDDPILEKISQLMYEIGSNVNSNDYTALRLHSLYEIRLSLDDLPLPTTHKTLNSRAHIIQILNELEEYLNIKSQFGSLKLHSEI

SEQ ID NO: 3121 - protein, 411 aa, Staphylococcus epidermidis
QFYSFIRCYNYVVYKEAYKMTEEFNESMINDIKEGDKVTGEVQQVEDKQVVVHINGGKFNGIIPISQLSTHHIENPSEVVKVGDEVEAYVTKIEFDEENDTGAYILSKRQLETEKSYEYLQEKLDNDEVIEAEVTEVVKGGLVVDVGQRGFVPASLISTDFIEDFSVFDGQTIRIKVEELDPENNRVILSRKAVEQLENDAKKASILDSLNEGDVIDGKVARLTNFGAFIDIGGVDGLVHVSELSHEHVQTPEEVVSVGEAVKVKVKSVEKDSERISLSIKDTLPTPFENIKGKFHEDDVIEGTVVRLANFGAFVEIAPSVQGLVHISEIDHKHIGSPNEVLEPGQQVNVKILGIDEDNERISLSIKATLPKENVIESDASTTQSYLEDDNDEDKPTLGDVFGDKFKDLKF

SEQ ID NO: 3122 - protein, 63 aa, Staphylococcus epidermidis
IVHSVYQLDILDKLPFINQMISVNISIPFSNCFLVMVNGGNNLITFLPAVKMINPIRLASRTT

SEQ ID NO: 3123 - protein, 61 aa, Staphylococcus epidermidis
SNPSTSIIINKDSSHYSKMLTRIAISCHTNERTSSSQRFSYYRIDELNLIDGDSNYTGARL

SEQ ID NO: 3124 - protein, 297 aa, Staphylococcus epidermidis
KEGLKMPQRVLLVDGMALLFRHFYATSLHNQFMYNSKGIPTNGIQGFVRHIFSAIKEIEPTHVAVCWDMGQETFRNEMYDGYKQNRPAPPDELIPQFDYVKEISHQFGFVNVGKRNYEADDIIGSLAETYSQEHEVYIITGDRDLLQCINHNVEVWLIKKGFTIYQRYTLDRFIDEYGLNPQQLIDVKAFMGDTADGYSGVKGIGEKTAIKLIQNHGTVENVVNNLSSLTPAQQKKITNNLNHLHLSKSLAEIYTKVPIETDKLFKEMTYAHTLNEILSICNEHELYVSSKYIATHL

SEQ ID NO: 3125 - protein, 155 aa, Staphylococcus epidermidis
FEVLIVPKKSVRHIKIREIISNEQIETQDELVKRLNEYDLNVTQATVSRDIKELQLIKVPAPTGQYVYSLPNDRRYHPLEKLGRYLMDSFVNIEGTGNLLVLKTLPGNAQSIGAILDQIDWDEVLGTICGDDTCLLICRDEEASEEIKTRIFNLL

SEQ ID NO: 3126 - protein, 314 aa, Staphylococcus epidermidis
IRQLKCIERRLDMQKNILKSGIEISELGLGCMSLGTDYKKAQPIIESAIDNGITYFDTADIYDQGVNEEIVGKALKKYQNRDDIVIGTKVGNRLTDDGHMTWDPSKKHIKESVKGSLKRLGLNHLDLYQLHGGTIDDPLDETISAFDELKQEGYIRAYGISSIRPNVIDYYLKNSQIETLMSQFNLIDNRPESLINDVHDKQVKILARGPVFKGLLTSKSVDVIDEKFKNGVLDYTQDELGSTIASIKELESNLTALSFKYLTSHDAMGSIIVGASSVEQLEENVRNYYKEISLDQIKSARNRVKDIEYTQHLK

SEQ ID NO: 3127 - protein, 81 aa, Staphylococcus epidermidis
FVHTCSYVGFSTCPPLYPETTDFIPGYEVKGLTMHQKQPPASVAYAMLYSLLKLSVCLNLRYIVGNLKYLTQNHSCDFVTT

SEQ ID NO: 3128 - protein, 495 aa, Staphylococcus epidermidis
GCDTMNDHQKNHATSQDDNTKSTPSKNSKHIKIKLWHFILVILGIILLTSIITVVSTILISHQKSGLNKEQRANLKKIEYVYQTLNKDYYKKQSSDKLTQSAIDGMVKELKDPYSEYMTAEETKQFNEGVSGDFVGIGAEMQKKNEQISVTSPMKDSPAEKAGIQPKDIVTQVNHHSVVGKPLDQVVKMVRGKKGTYVTLTIKRGSQEKDIKIKRDTIHVKSVEYEKKGNVGVLTINKFQSNTSGELKSAIIKAHKQGIRHIILDLRNNPGGLLDEAVKMANIFIDKGNTVVQLEKGKDKEELKTSNQALKQAKDMKVSILVNEGSASASEVFTGAMKDYHKAKVYGSKTFGKGIVQTTREFSDGSLIKYTEMKWLTPDGHYIHGKGIRPDVSISTPKYQSLNVIPDNKTYHQGEKDKNVKTMKIGLKALGYPIDNETNIFDEQLESAIKTFQQDNNLKVNGNFDKKTNDKFTEKLVEKANKKDTVLNDLLNKLK

SEQ ID NO: 3129 - protein, 203 aa, Staphylococcus epidermidis
HLITNITTGLKDVVEVTFNQITVDGDTSTNDMVLVMSNGCTNNNEIKKDSEDYYKFKQMLLYIMTDLAKSIARDGEGASKLIEVTVKGAKESSAARMIAKSVVGSSLVKTAIFGEDPNWGRIIAAAGYAKTYFDINQVDIFIGRIPVLIRSSPVKYDKEEIQEIMSAEEISIQLDLHQGNCEGQAWGCDLSYDYVKINALYTT

SEQ ID NO: 3130 - protein, 130 aa, Staphylococcus epidermidis
ESEADSIVWMGENGGFLLFKFPPFLSKMNGRRKLYMQQNKRLITISMLSAVAFVLTFIKFPLPFIPPYLTLDFSDVPTLLATFLLSPIAGIIVALIKNILNFLFNIGDPVGPVANFLARRQLFAIIILCL

SEQ ID NO: 3131 - protein, 112 aa, Staphylococcus epidermidis
ANAAHYGASKAGFSAVLNALRLEQPELKVLNVQPGPIDTPFQKNADPTLKYFKNYRHMMIQPQQLAKQIVEGIILNKIEINQPSWMQIMLKFYQLCPRTLEKLCPNLFKNKV

SEQ ID NO: 3132 - protein, 154 aa, Staphylococcus epidermidis
RSEASVEERLNRVKQQLQQSSYKLTPQREATVRVLIENEKDHLSAEDVYLKVKDKAPEIGLATVYRTLELLAEIKVLDKINFGDGVARFDLRKEGAKHFHHHLVCMECGKVEEIEEDLLPEVENRVENEFNFKILDHRLTFHGVCFECQAKNKQ

SEQ ID NO: 3133 - protein, 323 aa, Staphylococcus epidermidis
GFNLYNILSYAMSHAFNYKTNKSIYNILTGKKSHQTFFDASSQQLLSLYHSLPNLKYSTFEQFILQKDDFKKSIQVKIHPQYTYDSLTQTFSCIQLLIQTLSHTRKESNTFIPIVQNTYIQQRVKQLYHQVIESNQVSNTIDEIYLLFENLNNKYNHTFLHYYLQGYEESMYTRQQISLIEGIPQSELFEREMNELIDILNQLKDSTKYPILSQAIILSPLLTNTYLSYQKLKSGLNLKEIAQLQNVKLNTIEDHILEMYIKGYLIDYTLFINKKDILEFINYYQKHRGERLKFYKEHFTDWTYFQIKLVIVGIERGDLIAER

SEQ ID NO: 3134 - protein, 170 aa, Staphylococcus epidermidis
ECIYMFKKLFGKAKEVDKNIKIYAPLTGEYVKIEDIPDPVFAQKMMGEGFGINPTEGEVVSPIEGKVDNVFPTKHAVGLKAENGLELLVHIGLDTVQLDGKGFEVLVESGDDIKIGDPLIRFDLEYINNNAKSIISPIIITNSDQTESIHIEDVQAVVKGETQVIDVTVS

SEQ ID NO: 3135 - protein, 154 aa, Staphylococcus epidermidis
KSIYRITLGRLKMIKKNKEELNDMEYLVTQENGTEPPFQNEYWNHFEKGIYVDKLSGKPLFTSEDKFESNCGWPSFSKALNDDEIVELVDKSFGMIRTEVRSEKANSHLGHVFNDGPKEKGGLRYCINSAAIQFIPYDKLEELGYGDLIKHFKK

SEQ ID NO: 3136 - protein, 238 aa, Staphylococcus epidermidis
EESYMYNEIFGIASFIVTFALMVLMYRCFGKQGLIAWVAIGTIIANIQVIKAVHIFGITATLGNVMFASIYLATDILNDIYGRKVAKRAVWLGFSSTLVMIIVMQMSLHFIPAPVDNAQNSLKMIFDLVPRIAIGSIIAYIIGQHIDVFIFSMIKKIFSSDKTFFIRAYGSTILSSIIDTGLFVSIAFIGTMPGTAVFEIFITTYLLKLVSTIFNVPFGYIAKSLYRKGKIEQLDNGY

SEQ ID NO: 3137 - protein, 352 aa, Staphylococcus epidermidis
RNTYSYYSKKKKLKTKGNSIMRKITVFGMGSFGTALANVLAQNGHDVLMWGKNVENVDELNTHHMNKNYLKDAKLDSSIKATVDLNKAVQFSDIYLMALPTKAIREVSKDIDQLLTSKKTFIHVAKGIENDTFKRVSEMIEDSISSEHNGGIGVLSGPSHAEEVVIKQPTTVAASSKDNNVSKLIQDLFMNDYLRVYTNNDLVGVELGGALKNIIAIASGIVAGMGYGDNAKAALMTRGLAEISRLGEKLGADPMTFLGLGGIGDLIVTCTSTHSRNYTLGFKLGQGKTAEEALKEMKMVVEGMYTTKSVYHLAQQEGVEMPITNALYEVLFEDVPVSKSVRTLMERDKKAE

SEQ ID NO: 3138 - protein, 190 aa, Staphylococcus epidermidis
KYQYDLNLLLPLVKILKKRCFSKMIRLATKNDLLSITQLVKDAKQIMEEFNNNQWDDEYPAKEHVEEDIEYKTLYVLDVDHTIYGLIVIDQNQSEWYDDIDWPVNPNGAYVIHRLPGSKQYKGAATELFQFAIDLANEHDIHVILTDTFALNKPAQGLFEKFGFTKVDEIEIDYHPFDRGAPFYAYYKNI

SEQ ID NO: 3139 - protein, 438 aa, Staphylococcus epidermidis
KEKYRSLVMKTTIKQAKKHLNQEVTIGAWLTNKRSSGKIAFLQLRDGTGFMQGVVVKSEVDEETFQLAKDITQESSLYITGTITEDNRSDLGYEMQVKSIEIVHEAHDYPITPKNHGTEFLMDHRHLWLRSKKQHAVMKIRNEIIRATYEFFNENGFTKIDPPILTASAPEGTSELFHTKYFDEDAFLSQSGQLYMEAAAMAHGRVFSFGPTFRAEKSKTRRHLIEFWMIEPEMAFTNHAESLEIQEQYVSHIVQSVLNHCQLELKALDRDTTKLEKVATPFPRISYDDAIEFLKKEGFDDIEWGEDFGAPHETAIANHYDLPVFITNYPTKIKPFYMQPNPDNEDTVLCADLIAPEGYGEIIGGSERINDLELLEQRINEHELDEESYSYYLDLRRYGSVPHSGFGLGLERTVAWISGVEHVRETSPFPRLLNRLYP

SEQ ID NO: 3140 - protein, 104 aa, Staphylococcus epidermidis
YNEYHYKTSGGEFIMNKTDLINAVAEQADLTKKEAGSAVDAVFESIQNSLAKGEKVQLIGFGNFEVRERAARKGRNPQTGKEIDIPASKVPAFKAGKALKDAVK

SEQ ID NO: 3141 - protein, 574 aa, Staphylococcus epidermidis
ETGYITILRRMYMFRKSMLILMIAVILFVTACSKDKTQDEAKRKADAKGKPDTWIADRKLKGLVFQSDNDASPKMNKEVAQELKKKTGITLELQTVSNEDSTEALTSGLASGDLPDFIVYYLDDSGRPEMKVLNKAAKQGRLTDLTKMLKNTKIYSKYFKKGYLPKDTKDNIMFNKEQDGTYLVHMGINRHPGQEERRTVGGPYVRKDIMDKLHIDPTSIKTSKDVEKLAEKMKEHHFKDDNGKEITPIGPTAWGGDDRTKFYNDLVWTGQSDEKFLNKGKKIIHESQTEYPLKRVHYVKDLMKKGLMTKEFYTMEENKAKEGLVNGSWGIVSDLHNYVTENQSMKYVPLGPLNTVKGKFRVEKPYKSGANGWAVPSTTEHPEDVVKLADFLASRRGKLLGQYGIKGRDYTLDKKGNPHVKPEVLKEVENNPDEAKKRGFRGAGSYWADHLGYTDIDNKADFGETEYGDNTKTKKTTPEKIADMWHYDQRQKHAKIVNGLTVKSFLSKYEYGEDLEVALDDYSDAIKRAYYSQSDKETKQIIDSAKQRLEEAGLNQFERYVENQRDKKGTQIIY

SEQ ID NO: 3142 - protein, 257 aa, Staphylococcus epidermidis
IIMYKRNERLNLIRKRVDQYGQVAVKDLAIFLQVTPETVRKDLETLENDKLITRTHGGAIQYNHINKEKSYANKWQKQSQVKERIAKKAALQIKSGEIIVIDGGTTTGRIPQYLNDITQTTIVTNSLKIADELNRAIEEQRIQAEVIMLAGKTNTEQDVVRGHMTNELLQRFKFDKAFISCGSFDTSDCYEFDLEEAHASHIMIQKSQLSYLLADSSKRDAHASYRIDGFSEIDYMISDYAKPQNIEYFNQKHWLQI

SEQ ID NO: 3143 - protein, 425 aa, Staphylococcus epidermidis
NKNLLVCLTDLCCVIEYDNILNILQFNVLKNRKGRAIMRYLTSGESHGPQLTVIIEGVPANLEIKAEDINKEMFKRQGGYGRGRRMKIEKDTIEIVSGVRNGFTLGSPITLVVTNDDFTHWRKIMGVAPISDEERENMKRTITKPRPGHADLIGGMKYNHRDLRNVLERSSARETAARVAVGAVSKILLEQLDIHLYSRVVEIGGIKDKGLYDVDMFKNNVDKNDVRVIDENIAQQMRDKIDEAKKDGDSIGGVVQVMAENMPIGVGSYVHYDRKLDGRIAQGVVSINAFKGVSFGEGFKAAEKPGSEIQDEIHYNQDSGYFRATNHLGGFEGGMSNGMPIIVNGVMKPIPTLYKPLNSVDINTKEDFKATIERSDSCAVPAASVVCEHVVAFELAKAVLEEFQSNHMDQLVAQIKERRQLNIEF

SEQ ID NO: 3144 - protein, 371 aa, Staphylococcus epidermidis
LNLQRSKDMIQIKDLNKVYDNGSYAVKDFNLDIEDNEFVVFVGPSGCGKSTTLRMIAGLEDVSKGTISINDKVINDLQPKDRKIAMVFQNYALYPHMTVYKNLAFGLKMRGIKKKIYDEKIQHAAQILEIENLLDRKPKALSGGQRQRVALGRAIVREAQIFLMDEPLSNLDAKLRSNMRSEIIKIHKQMKATTIYVTHDQTEAMTMASRIVILKQGEIQQIGTPEEIYRHPVNEFVATFIGSPSMNMVPMTYNMDAWYFDGQKVADATLLQLASHAQYRLGIRPEDLHLVNDNEISNYPIQLSQFTVDLVELTGSYKLLHCHHNEHKIIAAVDSNLDFELGQTVSFGIKTEDAHFFDSDSGERVQEEVLS

SEQ ID NO: 3145 - protein, 203 aa, Staphylococcus epidermidis
KVVHTKMYQWLWETSLYQKWLISFILICNIFGTIYGYHWYSSQLANTPNYFKLFVPDSPTATLFLCLSLLFILFNKRYALIDALAFITLFKYGSWAVIMNILMFIKMNDIAINGLMLLISHAIMILEAIYFYPRFKISKLAGLMSFIWVTINDVIDYIYGQYPYYDFIAKHLIEVGVLAYSLTIISYILFLKLQKWLKVKTFD

SEQ ID NO: 3146 - protein, 65 aa, Staphylococcus epidermidis
RSNQGGMSMSNLWIIFAVTVLIAVYSAIEVFTNLNHKQQPRFKYFTIAFVVFIILAIIEVIFLAQ

SEQ ID NO: 3147 - protein, 79 aa, Staphylococcus epidermidis
KLNQKQTEPKITYILQVLLTNRALMSKFSPFIKIYLTLVVGPIIENFARKFYGQTKLNFEASSAHGTLIRFCITIFLIQ

SEQ ID NO: 3148 - protein, 443 aa, Staphylococcus epidermidis
GGCQLDIKMPKLGESVHEGTIEQWLVSVGDHVDEYEPLCEVITDKVTAEVPSTISGTITELVVEEGQTVNINTVICKIDSENGQNQTESANEFKEEQNQHSQSNINVSQFENNPKTHESEVHTASSRANNNGRFSPVVFKLASEHDIDLTQVKGTGFEGRVTKKDIQNIINNPNDQEKEKEFKQTDKKDHSTNHGDFLHQSSTKNEHSPSSNERVVPVKGIRKAIAQNMVTSVSEIPHGWMMVEADATNLVQTRNYHKAQFKQNEGYNLTFFAFFVKAVAEALKVNPLLNSTWQGDEIVIHKDINISIAVADDDKLYVPVIKNADEKSIKGIAREINDLATKARLGKLAQSDMQNGTFTVNNTGSFGSVSSMGIINHPQAAILQVESVVKKPVVIDDMIAIRNMVNLCISIDHRILDGVQTGKFMNLVKKKIEQYSIENTSIY

SEQ ID NO: 3149 - protein, 231 aa, Staphylococcus epidermidis
KISHILKMYHILIRKGLLNMKTVLIVGANGRVSIEATKIFLENSRFNVDLFLRNAHRIPDYASNRIKVYEGDAKNIEDLESALNNVDVVFASLSGSLDKQAETIVKAMDNKNVKRLIFVAAPGIYDELPEPFNQWNKEQFGEKLNRYRKASDIIENSDLDYTIIRPGWLTDKNENVYEITAKNETFKGTEVSRKSVASLAVQIAKNPELHSKENIGVNKPNTEGNKPAWFN

SEQ ID NO: 3150 - protein, 471 aa, Staphylococcus epidermidis
RKIHRNSTWRRVCDSMIKRQKLKYKWMLITTLITFTTILLFCLIIIFFLKDTLRSSEIDEAERSSNDIANLFHSKSLSDISALDLNASLENFQEILIYDDKGRKLIQTSNDNTLAYDNKIDFKHPERIHIQRSHGINYLVITEPIRSKDFSGYSVLVHSLQNYDNLVKSLYIVALAFGLIATIITAGVSYIFSSQITKPIVTMSNKMNQIRRDGFQNKLELTTNYEETDNLIDTFNEMMYQIEESFNQQRQFVEDASHELRTPLQIIQGHLNLIQRWGKKDPAVLEESLNISIEEVNRITKLVEELLLLTKDRVNHNVLECENVDVNSEIQSRVKSLQHLHPDYTFETHLATKPIQLKINRHQFEQLLLIFIDNAMKYDTEHKHIKIVTQLKNKMIMIDITDHGMGIPKADLEFIFDRFYRVDKSRARSQGGNGLGLSIAEKIVQLNGGMIQVESELQKYTTFKISFPVLN

SEQ ID NO: 3151 - protein, 243 aa, Staphylococcus epidermidis
NMSQMMFDNFLSSSRAKWGERSGLTLFLPHVFEGQGPEHSSARLERFLQLAAENNSTVVNLSSASNYFHLLRAQAASLDTLEMRPLIVMSPKSLLRNKTVAKPIDEFTSGGFKPIITEDIDEQKVKKVILASGKMYIDLKEYLAKNPNDSILLIAVERLYPFPEEEIKEVLKSLPHLENVSWVQEEPKNQGAWLFVYPYLKALVANKYDLTYHGRIQRAAPAEGDGEIHKLVQTKIIESSINN

SEQ ID NO: 3152 - protein, 188 aa, Staphylococcus epidermidis
RKFKQTDNLRREYNMAYATLAGGCFWCMVKPFTSYPGIKSVVSGYSGGHVENPTYEQVCTNQTGHVEAVQIEYDPNITTFENILDVYFKTFDPTDDGGQFFDRGESYQPVIFYHDENQLKAAELKKQQIDEEGIFKKPVITPIKPYKNFYPAEEYHQDYYKKNPTHYEQYQRGSGRKAFIESHWGGSK

SEQ ID NO: 3153 - protein, 560 aa, Staphylococcus epidermidis
FFNNIGGDIMKRNWWKEAVAYQVYPRSFNDSNGDGIGDLPGLIEKLDYLENLGIDVIWLSPMYPSPNDDNGYDISDYKGIMSEFGTMNDFDQLLSSIHQRGMKLILDLVVNHTSDEHPWFIESKSSKTNAKRDWYIWADPKPDGSEPNNWESIFNGSTWEFDESTKQYYFHLFSKKQPDLNWENPDVRQAVFEMMNWWFEKGIDGFRVDAITHIKKNFEAGDLPVPDGKKFAPAFDVDMNQPGIQEWLQEMKDKSLSRYDIMTVGEANGVTPNDAEEWVGEENGKFNMIFQFEHLGLWSTGDTKFDVKSYKQVLNRWQKQLENVGWNALFIENHDQPRRVSTWGDDKNYWYESATSHATAYFLQQGTPFIYQGQEIGMTNYPFESIESFNDVAVKTEYQIVKKEGGDVNQLLDKYKMENRDNARTPMQWNNSINAGFTTGKPWFHVNPNYTEINVKQQLNDKFSILSYYKALIQLKKSDLIYTYGKFNMVDAENKQVFAYTRTFKNNTVLIVANLTNEVSELNLPFELDISSVDIKLHNYHLNDINLDHIKPYESFVVEI

SEQ ID NO: 3154 - protein, 79 aa, Staphylococcus epidermidis
CDSKLMVKNYSFYQFIMTVRGRKDDKGVFAEQIFEDLAFPKHEDDFNTLSEYIETHSEFTLPMSVFDDLYDDYTEWLKF

SEQ ID NO: 3155 - protein, 282 aa, Staphylococcus epidermidis
IEFKIEGVELNMKLVFYGAGNMAQAIFTGIINSNNLNANDIYLTNKSNEQALKSFAEKLGVNYSYDDEALLKDADYVFLGTKPHDFENLANRIREHITNDNRFISIMAGLSIDYIRQQLNTNNPLARIMPNTNAQVGHSVTGISFSNNFDPKSKNEVDELINAFGSVIEVSEEHLHQVTAITGSGSAFLYHVFEQYVKAGTELGLERNQVEESIRNLIIGTSKMIERSDLSMSQLRKNITSKGGTTQAGLDALSQYDIVSMFEDCLGAAVNRSMELSHKEDE

SEQ ID NO: 3156 - protein, 121 aa, Staphylococcus epidermidis
RMVNVADYSQSNLGKIEIAPEVLSVIASIATSEVEGITGHFAELKKTNLEKISRKNLNRDLKIEAKEDGIYIDVFCSLKHGVNISKTANQIQSAIFNSITTMTAIEPQQINIHIRSIVAEK

SEQ ID NO: 3157 - protein, 64 aa, Staphylococcus epidermidis
HKAKICAEVYRSLCKFFLVLSHLTPSTKMMKRLHGYHSIISYIVKVHLPIIIQNRSKTEFTPNS

SEQ ID NO: 3158 - protein, 344 aa, Staphylococcus epidermidis
WSSNSCIVGGKKMIDYKSAGLTEEDLKKIYKWMDLGRKTDERLWLLNRAGKIPFVVSGQGQEATQIGMAYAMQKGDISSPYYRDLAFVTYMGISPLDTMLSAFGKRDDINSGGKQMPSHFSHKEKGILSQSSPVATQIPHSVGAALALKMDNKPNIATATVGEGSSNQGDFHEGMNFAAVHKLPFVCVIINNKYAISVPDSLQYAAEKLSDRALGYGMHGIQVDGNDPIAVYKAMKEARERALAGEGPTLIEAVTSRMTPHSSDDDDTYRTKEERDLLKQEDCNIKFKTALLDQGIINENWLSQLEKEHKELINEATKSAEAAPYPSEEEALTYVYEEGGQRND

SEQ ID NO: 3159 - protein, 10182 aa, Staphylococcus epidermidis
MKSKPKLNGRNICSFLLSKCMSYSLSKLSTLKTYNFQITSNNKEKTSRIGVAIALNNRDKLQKFSIRKYAIGTFSTVIATLVFMGINTNHASADELNQNQKLIKQLNQTDDDDSNTHSQEIENNKQNSSGKTESLRSSTSQNQANARLSDQFKDTNETSQQLPTNVSDDSINQSHSEANMNNEPLKVDNSTMQAHSKIVSDSDGNASENKHHKLTENVLAESRASKNDKEKENLQEKDKSQQVHPPLDKNALQAFFDASYHNYRMIDRDRADATEYQKVKSTFDYVNDLLGNNQNIPSEQLVSAYQQLEKALELARTLPQQSTTEKRGRRSTRSVVENRSSRSDYLDARTEYYVSKDDDDSGFPPGTFFHASNRRWPYNLPRSRNILRASDVQGNAYITTKRLKDGYQWDILFNSNHKGHEYMYYWFGLPSDQTPTGPVTFTIINRDGSSTSTGGVGFGSGAPLPQFWRSAGAINSSVANDFKHGSATNYAFYDGVNNFSDFARGGELYFDREGATQTNKYYGDENFALLNSEKPDQIRGLDTIYSFKGSGDVSYRISFKTQGAPTARLYYAAGARSGEYKQATNYNQLYVEPYKNYRNRVQSNVQVKNRTLHLKRTIRQFDPTLQRTTDVPILDSDGSGSIDSVYDPLSYVKNVTGTVLGIYPSYLPYNQERWQGANAMNAYQIEELFSQENLQNAARSGRPIQFLVGFDVEDSHHNPETLLPVNLYVKPELKHTIELYHDNEKQDRKEFSVSKRAGHGVFQVMSGTLHNTVGSGILPYQQEIRIKLTSNEPIKDSEWSITGYPNTLTLQNAVGRTNNATEKNLALVGHIDPGNYFITVKFGDKVEQFEIRSKPTPPRIITTANELRGNPNHKPEIRVTDIPNDTTAKIKLVMGGTDGDHDPEINPYTVPENYTVVAEAYHDNDPSKNGVLTFRSSDYLKDLPLSGELKAIVYYNQYVQSNFSNSVPFSSDTTPPTINEPAGLVHKYYRGDHVEITLPVTDNTGGSGLRDVNVNLPQGWTKTFTINPNNNTEGTLKLIGNIPSNEAYNTTYHFNITATDNSGNTTNPAKTFILNVGKLADDLNPVGLSRDQLQLVTDPSSLSNSEREEVKRKISEANANIRSYLLQNNPILAGVNGDVTFYYRDGSVDVIDAENVITYEPERKSIFSENGNTNKKEAVITIARGQNYTIGPNLRKYFSLSNGSDLPNRDFTSISAIGSLPSSSEISRLNVGNYNYRVNAKNAYHKTQQELNLKLKIVEVNAPTGNNRVYRVSTYNLTNDEINKIKQAFKAANSGLNLNDNDITVSNNFDHRNVSSVTVTIRKGDLIKEFSSNLNNMNFLRWVNIRDDYTISWTSSKIQGRNTDGGLEWSPDHKSLIYKYDATLGRQINTNDVLTLLQATAKNSNLRSNINSNEKQLAERGSNGYSKSIIRDDGEKSYLLNSNPIQVLDLVEPDNGYGGRQVSHSNVIYNEKNSSIVNGQVPEANGASAFNIDKVVKANAANNGIMGVIYKAQLYLAPYSPKGYIEKLGQNLSNTNNVINVYFVPSDKVNPSITVGNYDHHTVYSGETFKNTINVNDNYGLNTVASTSDSAITMTRNNNELVGQAPNVTNSINKIVKVKATDKSGNESIVSFTVNIKPLNEKYRITTSSSNQTPVRISNIQNNANLSIEDQNRVKSSLSMTKILGTRNYVNESNNDVRSQVVSKVNRSGNNATVNVTTTFSDGTTNTITVPVKHVLLEVVPTTRTTVRGQQFPTGKGTSPNDFFSLRTGGPVDARIVWVNNQGPDINSNQIGRDLTLHAEIFFDGETTPIRKDTTYKLSQSIPKQIYETTINGRFNSSGDAYPGNFVQAVNQYWPEHMDFRWAQGSGTPSSRNAGSFTKTVTVVYQNGQTENVNVLFKVKPNKPVIDSNSVISKGQLNGQQILVRNVPQNAQVTLYQSNGTVIPNTNTTIDSNGIATVTIQGTLPTGNITAKTSMTNNVTYTKQNSSGIASNTTEDISVFSENSDQVNVTAGMQAKNDGIKIIKGTNYNFNDFNSFISNIPAHSTLTWNEEPNSWKNNIGTTTKTVTVTLPNHQGTRTVDIPITIYPTVTAKNPVRDQKGRNLTNGTDVYNYIIFENNNRLGGTASWKDNRQPDKNIAGVQNLIALVNYPGISTPLEVPVKVWVYNFDFTQPIYKIQVGDTFPKGTWAGYYKHLENGEGLPIDGWKFYWNQQSTGTTSDQWQSLAYTRTPFVKTGTYDVVNPSNWGVWQTSQSAKFIVTNAKPNQPTITQSKTGDVTVTPGAVRNILISGTNDYIQASADKIVINKNGNKLTTFVKNNDGRWTVETGSPDINGIGPTNNGTAISLSRLAVRPGDSIEAIATEGSGETISTSATSEIYIVKAPQPEQVATHTYDNGTFDILPDNSRNSLNPTERVEINYTEKLNGNETQKSFTITKNNNGKWTINNKPNYVEFNQDNGKVVFSANTIKPNSQITITPKAGQGNTENTNPTVIQAPAQHTLTINEIVKEQGQNVTNDDINNAVQVPNKNRVAIKQGNALPTNLAGGSTSHIPVVIYYSDGSSEEATETVRTKVNKTELINARRRLDEEISKENKTPSSIRNFDQAMNRAQSQINTAKSDADQVIGTEFATPQQVNSALSKVQAAQNKINEAKALLQNKADNSQLVRAKEQLQQSIQPAASTDGMTQDSTRNYKNKRQAAEQAIQHANSVINNGDATSQQINDAKNTVEQAQRDYVEAKSNLRADKSQLQSAYDTLNRDVLTNDKKPASVRRYNEAISNIRKELDTAKADASSTLRNTNPSVEQVRDALNKINTVQPKVNQAIALLQPKENNSELVQAKKRLQDAVNDIPQTQGMTQQTINNYNDKQREAERALTSAQRVIDNGDATTQEITSEKSKVEQAMQALTNAKSNLRADKNELQTAYNKLIENVSTNGKKPASIRQYETAKARIQNQINDAKNEAERILGNDNPQVSQVTQALNKIKAIQPKLTEAINMLQNKENNTELVNAKNRLENAVNDTDPTHGMTQETINNYNAKKREAQNEIQKANMIINNGDATAQDISSEKSKVEQVLQALQNAKNDLRADKRELQTAYNKLIQNVNTNGKKPSSIQNYKSARRNIENQYNTAKNEAHNVLENTNPTVNAVEDALRKINAIQPEVTKAINILQDKEDNSELVRAKEKLDQAINSQPSLNGMTQESINNYTTKRREAQNIASSADTIINNGDASIEQITENKIRVEEATNALNEAKQHLTADTTSLKTEVRKLSRRGDTNNKKPSSVSAYNNTIHSLQSEITQTENRANTIINKPIRSVEEVNNALHEVNQLNQRLTDTINLLQPLANKESLKEARNRLESKINETVQTDGMTQQSVENYKQAKIKAQNESSIAQTLINNGDASDQEVSTEIEKLNQKLSELTNSINHLTVNKEPLETAKNQLQANIDQKPSTDGMTQQSVQSYERKLQEAKDKINSINNVLANNPDVNAIRTNKVETEQINNELTQAKQGLTVDKQPLINAKTALQQSLDNQPSTTGMTEATIQNYNAKRQKAEQVIQNANKIIENAQPSVQQVSDEKSKVEQALSELNNAKSALRADKQELQQAYNQLIQPTDLNNKKPASITAYNQRYQQFSNELNSTKTNTDRILKEQNPSVADVNNALNKVREVQQKLNEARALLQNKEDNSALVRAKEQLQQAVDQVPSTEGMTQQTKDDYNSKQQAAQQEISKAQQVIDNGDATTQQISNAKTNVERALEALNNAKTGLRADKEELQNAYNQLTQNIDTSGKTPASIRKYNEAKSRIQTQIDSAKNEANSILTNDNPQVSQVTAALNKIKAVQPELDKAIAMLKNKENNNALVQAKQQLQQIVNEVDPTQGMTTDTANNYKSKKREAEDEIQKAQQIINNGDATEQQITNETNRVNQAINAINKAKNDLRADKSQLENAYNQLIQNVDTNGKKPASIQQYQAARQAIETQYNNAKSEAHQILENSNPSVNEVAQALQKVEAVQLKVNDAIHILQNKENNSALVTAKNQLQQSVNDQPLTTGMTQDSINNYEAKRNEAQSAIRNAEAVINNGDATAKQISDEKSKVEQALAHLNDAKQQLTADTTELQTAVQQLNRRGDTNNKKPRSINAYNKAIQSLETQITSAKDNANAVIQKPIRTVQEVNNALQQVNQLNQQLTEAINQLQPLSNNDALKAARLNLENKINQTVQTDGMTQQSIEAYQNAKRVAQNESNTALALINNGDADEQQITTETDRVNQQTTNLTQAINGLTVNKEPLETAKTALQNNIDQVPSTDGMTQQSVANYNQKLQIAKNEINTINNVLANNPDVNAIKTNKAEAERISNDLTQAKNNLQVDTQPLEKIKRQLQDEIDQGTNTDGMTQDSVDNYNDSLSAAIIEKGKVNKLLKRNPTVEQVKESVANAQQVIQDLQNARTSLVPDKTQLQEAKNRLENSINQQTDTDGMTQDSLNNYNDKLAKARQNLEKISKVLGGQPTVAEIRQNTDEANAHKQALDTARSQLTLNREPYINHINNESHLNNAQKDNFKAQVNSAPNHNTLETIKNKADTLNQSMTALSESIADYENQKQQENYLDASNNKRQDYDNAVNAAKGILNQTQSPTMSADVIDQKAEDVKRTKTALDGNQRLEVAKQQALNHLNTLNDLNDAQRQTLTDTINHSPNINSVNQAKEKANTVNTAMTQLKQTIANYDDELHDGNYINADKDKKDAYNNAVNNAKQLINQSDANQAQLDPAEINKVTQRVNTTKNDLNGNDKLAEAKRDANTTIDGLTYLNEAQRNKAKENVGKASTKTNITSQLQDYNQLNIAMQALRNSVNDVNNVKANSNYINEDNGPKEAYNQAVTHAQTLINAQSNPEMSRDVVNQKTQAVNTAHQNLHGQQKLEQAQSSANTEIGNLPNLTNTQKAKEKELVNSKQTRTEVQEQLNQAKSLDSSMGTLKSLVAKQPTVQKTSVYINEDQPEQSAYNDSITMGQTIINKTADPVLDKTLVDNAISNISTKENALHGEQKLTTAKTEAINALNTLADLNTPQKEAIKTAINTAHTRTDVTAEQSKANQINSAMHTLRQNISDNESVTNESNYINAEPEKQHAFTEALNNAKEIVNEQQATLDANSINQKAQAILTTKNALDGEEQLRRAKENADQEINTLNQLTDAQRNSEKGLINSSQTRTEVASQLAKAKELNKVMEQLNHLINGKNQMINSSKFINEDANQQQAYSNAIASAEALKNKSQNPELDKVTIEQAINNINSAINNLNGEAKLTKAKEDAVASINNLSGLTNEQKTKENQAVNGAQTRDQVANKLRDAEALDQSMQTLRDLVNNQNAIHSTSNYFNEDSTQKNTYDNAIDNGSTYITGQHNPELNKSTIDQTISRINTAKNDLHGVEKLQRDKGTANQEIGQLGYLNDPQKSGEESLVNGSNTRSEVEEHLNEAKSLNNAMKQLRDKVAEKTNVKQSSDYINDSTEHQRGYDQALQEAENIINEIGNPTLNKSEIEQKLQQLTDAQNALQGSHLLEEAKNNAITGINKLTALNDAQRQKAIENVQAQQTIPAVNQQLTLDREINTAMQALRDKVGQQNNVHQQSNYFNEDEQPKHNYDNSVQAGQTIIDKLQDPIMNKNEIEQAINQINTTQTALSGENKLHTDQESTNRQIEGLSSLNTAQINAEKDLVNQAKTRTDVAQKLAAAKEINSAMSNLRDGIQNKEDIKRSSAYINADPTKVTAYDQALQNAENIINATPNVELNKATIEQALSRVQQAQQDLDGVQQLANAKQQATQTVNGLNSLNDGQKRELNLLINSANTRTKVQEELNKATELNHAMEALRNSVQNVDQVKQSSNYVNEDQPEQHNYDNAVNEAQATINNNAQPVLDKLAIERLTQTVNTTKDALHGAQKLTQDQQAAETGIRGLTSLNEPQKNAEVAKVTAATTRDEVRNIRQEATTLDTAMLGLRKSIKDKNDTKNSSKYINEDHDQQQAYDNAVNNAQQVIDETQATLSSDTINQLANAVTQAKSNLHGDTKLQHDKDSAKQTIAQLQNLNSAQKHMEDSLIDNESTRTQVQHDLTEAQALDGLMGALKESIKDYTNIVSNGNYINAEPSKKQAYDAAVQNAQNIINGTNQPTINKGNVTTATQTVKNTKDALDGDHRLEEAKNNANQTIRNLSNLNNAQKDAEKNLVNSASTLEQVQQNLQTAQQLDNAMGELRQSIAKKDQVKADSKYLNEDPQIKQNYDDAVQRVETIINETQNPELLKANIDQATQSVQNAEQALHGAEKLNQDKQTSSTELDGLTDLTDAQREKLREQINTSNSRDDIKQKIEQAKALNDAMKKLKEQVAQKDGVHANSDYTNEDSAQKDAYNNALKQAEDIINNSSNPNLNAQDITNALNNIKQAQDNLHGAQKLQQDKNTTNQAIGNLNHLNQPQKDALIQAINGATSRDQVAEKLKEAEALDEAMKQLEDQVNQDDQISNSSPFINEDSDKQKTYNDKIQAAKEIINQTSNPTLDKQKIADTLQNIKDAVNNLHGDQKLAQSKQDANNQLNHLDDLTEEQKNHFKPLINNADTRDEVNKQLEIAKQLNGDMSTLHKVINDKDQIQHLSNYINADNDKKQNYDNAIKEAEDLIHNHPDTLDHKALQDLLNKIDQAHNELNGESRFKQALDNALNDIDSLNSLNVPQRQTVKDNINHVTTLESLAQELQKAKELNDAMKAMRDSIMNQEQIRKNSNYTNEDLAQQNAYNHAVDKINHIIGEDNATMDPQIIKQATQDINTAINGLNGDQKLQDAKTDAKQQITNFTGLTEPQKQALENIINQQTSRANVAKQLSHAKFLNGKMEELKVAVAKASLVRQNSNYINEDVSEKEAYEQAIAKGQEIINSENNPTISSTDINRTIQEINDAEQNLHGDNKLRQAQEIAKNEIQNLDGLNSAQITKLIQDIGRTTTKPAVTQKLEEAKAINQAMQQLKQSIADKDATLNSSNYLNEDSEKKLAYDNAVSQAEQLINQLNDPTMDISNIQAITQKVIQAKDSLHGANKLAQNQADSNLIINQSTNLNDKQKQALNDLINHAQTKQQVAEIIAQANKLNNEMGTLKTLVEEQSNVHQQSKYINEDPQVQNIYNDSIQKGREILNGTTDDVLNNNKIADAIQNIHLTKNDLHGDQKLQKAQQDATNELNYLTNLNNSQRQSEHDEINSAPSRTEVSNDLNHAKALNEAMRQLENEVALENSVKKLSDFINEDEAAQNEYSNALQKAKDIINGVPSSTLDKATIEDALLELQNARESLHGEQKLQEAKNQAVAEIDNLQALNPGQVLAEKTLVNQASTKPEVQEALQKAKELNEAMKALKTEINKKEQIKADSRYVNADSGLQANYNSALNYGSQIIATTQPPELNKDVINRATQTIKTAENNLNGQSKLAEAKSDGNQSIEHLQGLTQSQKDKQHDLINQAQTKQQVDDIVNNSKQLDNSMNQLQQIVNNDNTVKQNSDFINEDSSQQDAYNHAIQAAKDLITAHPTIMDKNQIDQAIENIKQALNDLHGSNKLSEDKKEASEQLQNLNSLTNGQKDTILNHIFSAPTRSQVGEKIASAKQLNNTMKALRDSIADNNEILQSSKYFNEDSEQQNAYNQAVNKAKNIINDQPTPVMANDEIQSVLNEVKQTKDNLHGDQKLANDKTDAQATLNALNYLNQAQRGNLETKVQNSNSRPEVQKVVQLANQLNDAMKKLDDALTGNDAIKQTSNYINEDTSQQVNFDEYTDRGKNIVAEQTNPNMSPTNINTIADKITEAKNDLHGVQKLKQAQQQSINTINQMTGLNQAQKEQLNQEIQQTQTRSEVHQVINKAQALNDSMNTLRQSITDEHEVKQTSNYINETVGNQTAYNNAVDRVKQIINQTSNPTMNPLEVERATSNVKISKDALHGERELNDNKNSKTFAVNHLDNLNQAQKEALTHEIEQATIVSQVNNIYNKAKALNNDMKKLKDIVAQQDNVRQSNNYINEDSTPQNMYNDTINHAQSIIDQVANPTMSHDEIENAINNIKHAINALDGEHKLQQAKENANLLINSLNDLNAPQRDAINRLVNEAQTREKVAEQLQSAQALNDAMKHLRNSIQNQSSVRQESKYINASDAKKEQYNHAVREVENIINEQHPTLDKEIIKQLTDGVNQANNDLNGVELLDADKQNAHQSIPTLMHLNQAQQNALNEKINNAVTRTEVAAIIGQAKLLDHAMENLEESIKDKEQVKQSSNYINEDSDVQETYDNAVDHVTEILNQTVNPTLSIEDIEHAINEVNQAKKQLRGKQKLYQTIDLADKELSKLDDLTSQQSSSISNQIYTAKTRTEVAQAIEKAKSLNHAMKALNKVYKNADKVLDSSRFINEDQPEKKAYQQAINHVDSIIHRQTNPEMDPTVINSITHELETAQNNLHGDQKLAHAQQDAANVINGLIHLNVAQREVMINTNTNATTREKVAKNLDNAQALDKAMETLQQVVAHKNNILNDSKYLNEDSKYQQQYDRVIADAEQLLNQTTNPTLEPYKVDIVKDNVLANEKILFGAEKLSYDKSNANDEIKHMNYLNNAQKQSIKDMISHAALRTEVKQLLQQAKILDEAMKSLEDKTQVVITDTTLPNYTEASEDKKEKVDQTVSHAQAIIDKINGSNVSLDQVRQALEQLTQASENLDGDQRVEEAKVHANQTIDQLTHLNSLQQQTAKESVKNATKLEEIATVSNNAQALNKVMGKLEQFINHADSVENSDNYRQADDDKIIAYDEALEHGQDIQKTNATQNETKQALQQLIYAETSLNGFERLNHARPRALEYIKSLEKINNAQKSALEDKVTQSHDLLELEHIVNEGTNLNDIMGELANAIVNNYAPTKASINYINADNLRKDNFTQAINNARDALNKTQGQNLDFNAIDTFKDDIFKTKDALNGIERLTAAKSKAEKLIDSLKFINKAQFTHANDEIMNTNSIAQLSRIVNQAFDLNDAMKSLRDELNNQAFPVQASSNYINSDEDLKQQFDHALSNARKVLAKENGKNLDEKQIQGLKQVIEDTKDALNGIQRLSKAKAKAIQYVQSLSYINDAQRHIAENNIHNSDDLSSLANTLSKASDLDNAMKDLRDTIESNSTSVPNSVNYINADKNLQIEFDEALQQASATSSKTSENPATIEEVLGLSQAIYDTKNALNGEQRLATEKSKDLKLIKGLKDLNKAQLEDVTNKVNSANTLTELSQLTQSTLELNDKMKLLRDKLKTLVNPVKASLNYRNADYNLKRQFNKALKEAKGVLNKNSGTNVNINDIQHLLTQIDNAKDQLNGERRLKEHQQKSEVFIIKELDILNNAQKAAIINQIRASKDIKIINQIVDNAIELNDAMQGLKEHVAQLTATTKDNIEYLNADEDHKLQYDYAINLANNVLDKENGTNKDANIIIGMIQNMDDARALLNGIERLKDAQTKAHNDIKDTLKRQLDEIEHANATSNSKAQAKQMVNEEARKALSNINDATSNDLVNQAKDEGQSAIEHIHADELPKAKLDANQMIDQKVEDINHLISQNPNLSNEEKNKLISQINKLVNGIKNEIQQAINKQQIENATTKLDEVIETTKKLIIAKAEAKQMIKELSQKKRDAINNNTDLTPSQKAHALADIDKTEKDALQHIENSNSIDDINNNKEHAFNTLAHIIIWDTDQQPLVFEVPELSLQNALVTSEVVVHRDETISLESIKKKMTLTDELKVNIVSLPNTDKVADHLTAKVKVILADGSYVTVNVPVKVVEKELQIAKKDAIKTIDVLVKQKIKDIDSNNELTSTQREDAKAEIERLKKQAIDKVNHSKSIKDIETVKRTDFEEIDQFDPKRFTLNKAKKDIITDVNTQIQNGFKEIETIKGLTSNEKTQFDKQLTALQKEFLEKVEHAHNLVELNQLQQEFNNRYKHILNQAHLLGEKHIAEHKLGYVVVNKTQQILNNQSASYFIKQWALDRIKQIQLETMNSIRGAHTVQDVHKALLQGIEQILKVNVSIINQSFNDSLHNFNYLHSKFDARLREKDVANHIVQTETFKEVLKGTGVEPGKINKETQQPKLHKNDNDSLFKHLVDNFGKTVGVITLTGLLSSFWLVLAKRRKKEEEEKQSIKNHHKDIRLSDTDKIDPIVITKRKIDKEEQIQNDDKHSIPVAKHKKSKEKQLSEEDIHSIPVVKRKQNSDNQRYKTEESYF

SEQ ID NO: 3160 - protein, 189 aa, Staphylococcus epidermidis
NQLKGTCLNMRLNEKTIDRTVIYNGSIIDLEVHDVELPDGSTSKRELVFHHGAVAVCAITPENEVLLVKQFRKPADQPLLEIPAGKLEKGEDRKEAAIRELQEETGYIASDLQFVTNMYGSPGFSSEKLSIYFTDQLTVGETNLDDDEFVELHKVPLSQIDSLLKDNKIEDAKTIIALQHLLLNYNHSK

SEQ ID NO: 3161 - protein, 389 aa, Staphylococcus epidermidis
CQLKYIYTSKKGVPYMINQKRLLDCFLELVQIDSETGHEETIQPYLKDTFEKMGLHVIEDEASKNNRLGANNLICTLKSNISHQNVPKIYFTSHMDTVVPGKNIQPVVKEDGYVYSDGTTILGADDKAGLAAIIEAIKQIKESNLPHGQIQIIITVGEESGLVGAKAIDTRLLDADFGYAVDASKDVGTTVIGAPTQVKIYTTIKGKTAHASTPKKGISAINIASKAISRMKLGQVDALTTANIGKFHGGSATNIIADEVTLEAEARSHDDQSINKQVKHMKETFETTANELGGQAEVLVEKSYPGFEVSEADKVTQYAISSALALGLKGDTCIAGGGSDGNIMNQYGIPSVILGVGYENIHTTSERIAIKDMYMLTRQIIKIIELVAE

SEQ ID NO: 3162 - protein, 633 aa, Staphylococcus epidermidis
RGIKMSDRFIKFNDEQLDAKQVMMLQDLARLLLKNEQTQVKIQKFPYYNPYSNTLIASWFWSHRPKHIEQAGLKTDVLLATYGYLNMDLSIINQVLHNNDFEHPKFFHQLFKLLEDVRIFEHIRQQRPSTTKMIDLRIETRLSFTESQINFYKTKTVYTDLLFLYLEHAFLSQNFFNIPSIHPAFDDILVHMYQYLPNIFQNQTSEDNMYLAERIMYQVDDLLKEDMLNEYYYLPQKLYEDIYADSFEDLKRTDASNTDGKDNQQTDEDVETAEAETKAADSESKGGAYLEMELHEGENSEVMADNDTAREGDSTDDMTDMMTKKGKGSENTLDHDEGGFIGQNQAFALKGINKDVSIEWNIPDITPQNVIDYQYSKNDVQFEIKDLIQIIKKTIDREHEDERHNLTKGRLQKDLINWFIDDQFKLFYKKQDLSKTFDATFTLLIDASASMHDKMDETIKGVVLFHETLKSLNIKHEILAFNEDAFEADQRQQPNIIDEIINYNYSIFEKEGPRIMTLEPQDDNRDGVAIRIASERLLQRSHEQRFLIVFSDGEPSAFNYSQDGILDTYEAVERARKFGIEVFNVFLSQEPITEDIEQTIHNIYGQFALFVEGVEHLPSHLSPLLKKLLLKSL

SEQ ID NO: 3163 - protein, 138 aa, Staphylococcus epidermidis
RGVKVMAKIYFDAATKGNPGRSACAIIIKENSQRYTFTHDLGKMDNHSAEWAAMLHALEHARELKVSNALLYTDSKLIEDSMMQGKVKNAKFKVYFENIEILEQSFDLMFVRWIPRKQFFFCLSTCSTNTIPTYITII

SEQ ID NO: 3164 - protein, 252 aa, Staphylococcus epidermidis
LTKKESQMSKEQERLQKRIANSGYTSRRKAEVLITEGRVKVNGQTVTELGSKVMPSDLVEVDGIKIEQEDKIYILFYKPTQVITSVSDDRGRRVVTDYFDDLESRIYPVGRLDYDTSGVLLLTNDGEFTNLMTHPRYHIKKKYVAKLKGYLMREEIKQLEKGIELEDGYTQPAQVKIKKQDKEKNTTLVEITISEGRNRQVRRMFEYFGHQVNKLTRIQFGPIDLKGLNAGEGRVLTPHEVKILRHLAENGK

SEQ ID NO: 3165 - protein, 329 aa, Staphylococcus epidermidis
FRRKSTRGGFIMSKNKKQSLQSAHQKPLLKRMWEHKVLYLMILPCLLFFLIFNYIPMTSLVLAFKDFRFDTGIIGGDWKGLYYFKRFFSDPRCIQIIMNTLIISGMKLILALPFPIILAIMFNEIKDSKLGKIRGLFQGVLYIPHFLSWVVVISIFKKLLAPDDGLMNQLIHQFGGDGSTYFMMNPEYFHTIMFSSYIWKNVGWDSIIYFAAIMSINPEIYESAAIDGANRFKQIIHITLPMLTPTIVILFIISLGDILKAGFDQIYLLKTPGNANVSEILDTFVIRTGIEQGDFSYAIAISLLQGVIGLIAVVIINKFADKKLDTSLY

SEQ ID NO: 3166 - protein, 81 aa, Staphylococcus epidermidis
LGGKISMAEVKVPELAESITEGTIAEWLKNVGDNVDKGEAILELETDKVNVEVVSEEAGVLSEQLAEEGDTVEVCQAVAVV

SEQ ID NO: 3167 - protein, 138 aa, Staphylococcus epidermidis
RLMNSLTSSTTCSGLKIKVSNEVEKKMSDVSLKLSAKDIYEKDFEKTMARGYRREEVDAFLDDIITDYQKMADMNNEVVKLSEENHKLKKELEELRLRVATSRPQDNKNFSSNNSSSASNNVDILKRISNLEKAVFGK

SEQ ID NO: 3168 - protein, 210 aa, Staphylococcus epidermidis
IMMNYPNGKPYSKNKPLDGRKSSPFSSNIEYGGRGMTLEKDIEQSNTFYLKSGIAVIHKKPTPVQIVNVHYPKRSKAVINEAYFRTPSTTDYNGVYNGYYIDFEAKETKNKTSFPLNNIHAHQVEHMKNTYHQKGIVFLMIRFKSLDEVYLLPYSKFEKYWQRYINNIKKSITVEEIRKNGYHIPYQYQPRLNYLKAVDKLILDESEDRV

SEQ ID NO: 3169 - protein, 618 aa, Staphylococcus epidermidis
MTKNKKEFTEAPVNFGANLGLMLDLYDDYLQDPSSVPEDLQVLFSTIKTGEAHIEAKPTTDGGGSQAGDSTIKRVMRLIDNIRQYGHLKADIYPVNPPERQNVPKLEIEDFDLDKETLEKISSGIVSEHFKDIYDNAYDAIVRMERRYKGPIAFEYTHINNNKERVWLKRRIETPYKASLNDNQKKELFKKLAHVEGFEKYLHKNFVGAKRFSIEGVDTLVPMLQHTITLAGNEGIKNIQIGMAHRGRLNVLTHVLEKPYEMMISEFMHTDPMKFLPEDGSLELTSGWTSDVKYHLGGVKTTNSYGIEQRISLANNPSHLEIVAPVVAGKTRAAQDNTHQVGAPSTDFHKAMPIIIHGDAAYPGQGINFETMNLGSLKGYSTGGSLHIITNNRIGFTTEPIDGRSTTYSSDVAKGYDVPILHVNADDVEATIEAIEIAMEFRKEFHKDVVIDLVGYRRYGHNEMDEPSITNPVPYQNIRKHDSVEILYGKKLVDEGIISEDEMNEVIDGVQKEMRTAHDKIDKNDKMNNPDMEKPESLQLPLQSDTKDFSFDHLKEINDAMLDYPKDFHVLKKLNKVLEKRREPFEKEEGLVDWAQAEQLAFATILQDGTSIRLTGQE

SEQ ID NO: 3170 - protein, 76 aa, Staphylococcus epidermidis
QVKNSERGTFSHRHAVLHDEDNGNTFTPLHHVPQQQATFDIHNSPLSEAAVVGFEYVYNVENKGNFNIWEAQYGDF

SEQ ID NO: 3171 - protein, 302 aa, Staphylococcus epidermidis
CKKKLVIKEMKKLQMNKLINIINTSLNKSIQSSPLKTNLEESMKYSLNAGGKRIRPVILLLTLKMLNKDYQQGLNSALALEMIHTYSLIHDDLPAMDNDDYRRGKLTNHKVYGEWKAILAGDALLTKAFELVSNDTTIEDSVKVSIIKRLSKASGHLGMVGGQALDMESEGKSIRLETLESIHETKTGALLNFSVMAAVDIAQVEQNIAKNLDEFSHHLGMMFQIKDDLLDVYGDESKLGKKVGSDIVNHKSTYVSLLGKEGAEEKLNNHQYLAMNCLNQISDQYDTSELSDIVDLFYNRDH

SEQ ID NO: 3172 - protein, 563 aa, Staphylococcus epidermidis
GCDEFMLQTLSIKQFAIIDELDINFSDGLTVMSGETGSGKSIIIDAIGQLIGMRASSDYVRHGEKKAIIEGIFDIDESKDAINILESLAIDVDEDFLLVKREIFSSGKSICRINNQIVTLQDLRKVMQELLDIHGQHETQSLLKQKYHLQLLDDYADNQYSDLLNQYQLSYNQYKNKRKELEELESADQALLQRLDLMKFQLEELTEASLKEGEVDQLESDIKRIQNSEKLNLALNNAHQVLTDESAIPDRLYELSNYLQTINDIVPEKFVRLKEDINQFYYLLEDAKHEIYDEMANTEFDEQVLNEYESRMNLLNNLKRKYGKDITELIAYQSKLANEIDKIENYEQSTSQLREEIKTLYNEVIDIGKKLSQERRRVARELRDHIVSEIQNLQMKDANLEISFKPLDEPTIEGIEFVEFLISPNRGEPLKSLNKIASGGELSRIMLALKSIFVKSRGQTAILFDEVDSGVSGQAAQKMAEKMRDIAQYIQVICISHLPQVASMSDHHLLISKASNADRTTTQVKELKDENKIDEIARMISGASVTELTRENAKEMIKQNHNI

SEQ ID NO: 3173 - protein, 115 aa, Staphylococcus epidermidis
RRRDDMIEKQDFNHIEDQLDQLASNKQLKTPEARELLDSYFDLIINYFKQINNIDEIHFNQLDTYPVVPMNFDERYHYMVARKHHFMGYRQMKTLKSELIKMNASYLIRKQRQQK

SEQ ID NO: 3174 - protein, 70 aa, Staphylococcus epidermidis
RRSDVIGKHFIITGATSGLGFAITNELLQRGAHVTILARNIDKFNRIKENYFKPEHINVIKCDLMQRKEY

SEQ ID NO: 3175 - protein, 246 aa, Staphylococcus epidermidis
EVVESMTNEILIVDDEDRIRRLLKLYLERESFEIHEARDGKEAYELALENNYACILLDLMLPEMDGIEVASKLREHKDTPIIMLTAKGEETNRVEGFESGADDYIVKPFSPREVVLRVKALLRRTQTANTEQSEPHARDIIEFSHLVIDNDAHRVLADDQQVNLTPKEYELLIYLAKTPNKVFDREQLLKEVWHYEFYGDLRTVDTHVKRLREKLNRVSSDAAQMIQTVWGVGYKFEVKPSDEPTK

SEQ ID NO: 3176 - protein, 474 aa, Staphylococcus epidermidis
TMSEKQYDLVVLGGGTAGYVAAIRASQLGKKVAIVEKSLLGGTCLHKGCIPTKALLKSAEVNHTIKNAHTFGIDVNHFKINFPKILERKDAIVKQLHEGVNQLMKHHHIDIYNGIGRIMGTSIFSPQSGTISVEYEDGESDILPNKNVLIATGSSPQSLPFIKFDHKQILSSDDILRLNTLPQRLAIIGGGVIGLEFASLMNDLGADVVVIEANDRVLPTESTQVASLLKEELTNRGVTFYENIQLTKDHFNQTDKGVTINISDEPVQFDKVLVAIGRKPNTNDIGLNNTQIKTSDAGHIITNAYQQTEDKHIYAAGDCIGQLQLAHVGSKEAIVAVEHMFDCSPIPINYDLIPKCVYTNPEIASIGKNLEQAKKAGIKAKSIKVPFKAIGKAIIEDVTQSKGFCEMVVNKDDDEIIGLNMIGPHVTELINEMSLLQFMNGSSLELGLTTHAHPSLSEVVMELGLKANGQAIHV

SEQ ID NO: 3177 - protein, 303 aa, Staphylococcus epidermidis
EVAETMKVSQDKSALVIRIISLIIIIGLVITIILPMINIFALAFNSGVDAQKGGITFYPRKFSLDNFKEIFKQGTLLNALFISIAKTVIGTILSVILTAMAAYVLTIKSLPFRRIISFFLVFTMLFSVGVVPLYILLNQLHLTDTFWVYILPSLYSVYNILIMRTFFNQLPSSVIEAARVDGCNDFQIFWKIVLPMSKPVVASITLFNAVSQWNDWFTGAFFVRNPNLKPLATVLQDMLTKQAAIADALKQKSGSYAMLDKLTITGDSMQMAMIVLLTIPVLFLFPFVQKHFVKGITIGSTKE

SEQ ID NO: 3178 - protein, 459 aa, Staphylococcus epidermidis
LLKDNLKRWFGFDEFKEGQEEIIDSVLHGRHTLGILPTGSGKSLCYQLPTYILEKPTLIISPLISLMDDQVMQMKLKGETHVACVHSGMDEVEKRDNIKRLSKSRFIYLSPEYILQPHNFKYIAHINFGLIVLDEAHCLSEWGYDFRPHYALVGKIIHHFNSATVLALTATAPPQLETDLSHILSLKLNVVQKSMNRENISLQHYNFNDDEGKIEWLLPFLSNSGPTIIYVSSKKRCLELAQMIYDSGYLTGIYHGDLSYQERQTVQQQFFNNDIPVIVATSAFGMGINKKDIRTVIHFHLSSSPSNYLQEIGRAGRDGKQSQAISLFQPDDSFILETLLFTDIITDDDITMFETGNHLPDEKEKILSTLNIQFTFSQLKDIFHQSYQRKRLGYMRMMGYTNLDQCRRKYLLEFFGEHPQSPKQCCDQDSRLEPIQILNRKKVKRKLSFNEKLYNLFET

SEQ ID NO: 3179 - protein, 415 aa, Staphylococcus epidermidis
TMEDIYKLIDDINLQKIENLDSRVNEALSSNNDDALFILGETLYNFGLTPQGLEVFRTLYHKYPDESELLIYFIEGLMSENQTDEALEYLAQVEPSTEKLMLEADLYQQINMLEVAIDKLQEALDLEPNDPIIHFALAELLYYDGQYLRATREYETVLETGEYEVNGVNIFSRMADCSLQSGNYSDAISLFDEINEEEMNSEDYFKKSIAYEKNDLTQEAIKIMQTLLSKDPDFIQGYFYLQSLFENEKNYPDAIETGKEGLRLSQFYKELMVSTGSLEIEHGDANEGVELLKQALEVDNAYHEPLLILSDLYRNEEDYESIIQLLTYVDEEDLDPIFMWHLAYAYGQEERDKEAQHFFELAYPTLQTQVEFLSDYYFYLLEIGQKEKAILILNQLLEIDPSNENWHDESMRLQI

SEQ ID NO: 3180 - protein, 147 aa, Staphylococcus epidermidis
QIMDLNFDLYMNDVVEQARNEIEHAGYQQLTSAEDVDQVLQQKGTSLVMVNSVCGCAGGIARPAATHALHYDKLPQRLVTVFAGQDKEATQQAREYFEGYAPSSPSFALIKDGKITEMIERHQIEGHDVMDVINQLQALFDKYCEER

SEQ ID NO: 3181 - protein, 176 aa, Staphylococcus epidermidis
NLMDQSLMDYYYQFHKHQHYFLCHDILEDAWKSQNTFSKHDAVVSLILFATANYHYRRGNLKGALKSFEKALLTINHAKDDTQLHLNINEFKQLIVKMIEAVKLQKQFTPLQLPIEPEFQTLIKRKYPDYLFTSQIIKEPYIVDHHIKRDRTEVIKNRERALFHRQYRNKSNKKDQ

SEQ ID NO: 3182 - protein, 223 aa, Staphylococcus epidermidis
NNKEGYQIMSSINIALDGPAAAGKSTIAKRVASRLSMIYVDTGAMYRAITYKYLQNGKPENFDYLINNTKLELTYDEVKGQRILLDNQDVTDYLRENDVTHHVSYVASKEPVRSFAVKIQKELAAKKGIVMDGRDIGTVVLPDAELKVYMIASVAERAERRQKENEQRGIESNLEQLKDEIEARDHYDMNREISPLQKAEDAITLDTTGKSIEEVTNEILSLL

SEQ ID NO: 3183 - protein, 443 aa, Staphylococcus epidermidis
KREEVYPMTKPIVAIVGKPNVGKSTIFNRVVGERVSIVEDTPGVTRDRIYSSGEWLTHEFNIIDTGGIEIGDAPFQTQIRAQAEIAIEEADVIIFMVNVREGLTQSDEMVAQMLYKSKKPVVLAVNKVDNLEMRNDIYDFYSLGFGDPYPISGSHGLGLGDLLDAVVENFNKESEDPYDEDTIRLSIIGRPNVGKSSLVNAILGEERVIVSNVAGTTRDAIDTEYSYDGQDYVLIDTAGMRKKGKVYESTEKYSVLRALKAIERSEVVLVVIDAEQGIIEQDKRVAGYAHEEGKAIVIVVNKWDTIEKDSKTMKKFTDDVRNEFQFLDYAQIAFVSAKEGLRLKTLFPYINQASENHKKRVQSSTLNEVVTDAISMNPTPTDKGRRLNVFYTTQVAIEPPTFVVFVNDVELMHFSYRRYLENQIRNAFGFEGTPIHIIPRKRN

SEQ ID NO: 3184 - protein, 60 aa, Staphylococcus epidermidis
DLLLHHVLKKYFVISKHLLKYHDIGSNVDAYEIDNNNPLMIDPLDFTHNLKVVCIHAIII

SEQ ID NO: 3185 - protein, 181 aa, Staphylococcus epidermidis
STYCGIKRCINISHTERRYTMTLSIIVAHDKQRVIGYQNQLPWHLPNDLKHVKQLTTGNTLVMGRKTFNSIGKPLPNRRNVVLTNQASFHHEGVDVINSLDEIKELSGHVFIFGGQTLFEAMIDQVDDMYITVIDGKFQGDTFFPPYTFENWEVESSVEGQLDEKNTIPHTFLHLVRRKGK

SEQ ID NO: 3186 - protein, 64 aa, Staphylococcus epidermidis
IACCSVLVSIAFTSLSYRLFIFIPISHVCIIAFISWEFEIINFSFEKTDNLDVGLSYYLFTLLF

SEQ ID NO: 3187 - protein, 270 aa, Staphylococcus epidermidis
FKSCMYSCYNNLVKYALTMQFDIEVDVMYEVKLDAFNGPLDLLLHLIQKYEIDIYDIPMKALTEQYMQYVHAMNQLEINVASEYLVMASELLMIKSKLLLPQTSIEEDIEEDPREDLVGRLIEYQNYKEYTEILNTMKEERDLYFTKHPTDLTHLETNESWDPNQTIDLTELIVAYQRVKNRVELNTPKSVEIKKETFTIQQATAQVTERLKQHESFNFFSLFTFHEPVEQVVTHFLAILEMSKSGIVNIKQTKQFDDIDIIRGVNYSIG

SEQ ID NO: 3188 - protein, 517 aa, Staphylococcus epidermidis
LKLCLIIKNIIFYYIYLRIEVLILSTKQKHIPCLITIFGATGDLSHRKLFPSIFHLYQQDNLDEHIAIIGIGRRDYNNEQFRDQVKASIQTYVKDTDRIDEFMTHVFYHKTDVSDKESYQSLLQFSERLDSEFALGGNRLFYLAMAPQFFGVISDYLKSSGLTQTTGFKRLVIEKPFGSDLKSAESLNNQIRRSFKEEEIYRIDHYLGKDMVQNIEVLRFANAMFEPLWNNKYISNIQVTSSEVLGVEDRGGYYESSGALKDMVQNHMLQMVALLAMEAPISLNSEDIRAEKVKVLKSLRQLKPEEVKKNFVRGQYDQGNIDGKQVKSYREEDRVAKDSVTPTFVSGKLTIDNFRWAGVPFYIRTGKRMKSKTIQVVVEFKEVPMNLYYETDNLLDSNLLVINIQPNEGISLHLNAKKNIQGIDTEPVQLSYAMSAQDKMNTVDAYENLLFDCLKGDATNFTHWEELKSTWKFVDAIQDQWTMVEPCFPNYEAGTNGPLESDLLLSRDGNHWWDDIH

SEQ ID NO: 3189 - protein, 275 aa, Staphylococcus epidermidis
IEECQLMSGLRSVTLGTNDLSKTKELFNHIIGLQHSTKNEHAIRFGDANLSPGTRVHFVEVPEEDYKNLHIDSVGLRTPSDSGLVEYQNIFDKFNISYSSITELNGLKHFTFEDHNQQKFDIYSNELNTGIGLGMPAFDSPVNPLHQVQGLGPVIIKVNELSVTTSILTQVFQLDLFAEYLPHEDAQQPIQVFRIGEGGLGGEIHLFESDEDIQMNTHGPIEQVEFSTNDTQLYLQAKNRLDEIGVPYQTLEQDTSESLRITENSGISFIYTLEK

SEQ ID NO: 3190 - protein, 296 aa, Staphylococcus epidermidis
LSVRQKSKGDETMTTILQLSDLHIGPPNDEKDLKTDDLIHHMMTHYQPDITVLTGDQIWSEGVIDSGRVYKKLMEYLNRYDTQIATTFGNHDTEGHLKRSDLRAIEDQYSTNYVQKNHSLIVDDKEAYTIEVVNNDTVTHVLYVIDGGDYNPFGIGDYDFIRPEHVNWLRETHQAYQTQFQHNFQHNLLFTHIPLQEYREVENIGEYHGIFNEPIACSKINSGLFSQMLLNGDIEGMFCGHDHDNDFTINLYGIRLSFGRIGGYNTYGDLQRGARLIELQPDAIYKSKVLEFDDRF

SEQ ID NO: 3191 - protein, 130 aa, Staphylococcus epidermidis
NMSRKDARVQAFQTLFQLEIKETDLTIQEAIEFIKDDHSDLDFDFIYWLVTGVKDHQIVLDETIKPHLKDWSIDRLLKSDRIILRMATFEILHSDTPKKVVVNEAVELTKQFSDDDHYKFVNGVLSNIND

SEQ ID NO: 3192 - protein, 305 aa, Staphylococcus epidermidis
TSYRFNRGANMNTIIEEYLNFIQIEKGLSNNTIGAYRRDLKKYKDYLEDNKISHIDFIDRQIIQECLGHLIDMGQSSKSLARFISTIRSFHQFALREKYAAKDPTVLIETPKYEKKLPDVLEIDEVIALLETPDLTKNNGYRDRTMLELLYATGMRVTEIIQLNVEDVNLMMGFVRVFGKGNKERIVPLGDTVIEYLTTYIETVRPQLLKQTTTQALFLNMHGKSLSRQGIWKIIKQYGLKANINKTLTPHTLRHSFATHLLKNGADLRAVQEMLGHSDISTTQLYTHVSKSQIRKMYTQFHPRA

SEQ ID NO: 3193 - protein, 69 aa, Staphylococcus epidermidis
HAVLAVQLLQIYMITMMKGIAYVILDDNQGTTEVPEELYEDMEDPLGGCPTDSIKIEDEPFDGDALKFE

SEQ ID NO: 3194 - protein, 322 aa, Staphylococcus epidermidis
GVVRMYNPFDEAYHGLCEEILEIGNRRDDRTHTGTISKFGHQLRFDLTKGFPLLTTKKVSFKLVATELLWFIKGDTNIQYLLKYNNNIWNEWAFENYVQSDDYHGPDMTDFGHRSQQDPEFNEQYKEEMKKFKERILNDDAFAKKYGNLGNVYGKQWRDWEDKNGNHYDQLKSVIQQIKTNPNSRRHIVSAWNPTEIDSMALPPCHTMFQFYVQEGKLNCQLYQRSADIFLGVPFNIASYALLTHLVAKECGLEVGEFIHTFGDAHIYSNHMDAIHTQLSRDSYLPPQLKINTDKSIFDINYEDLELINYESHPAIKAPIAV

SEQ ID NO: 3195 - protein, 234 aa, Staphylococcus epidermidis
IGGSNIMDLIQLKTRPVVIRRELFDHYSELGLDEQDLVILIKLLYASETSNKQPSIEFLQKGSTMEPRQITSVIQNLIQRELLELNVSKDEEGKFTEYMNLDPFYHKLNQLLKHQYLKHEEQDKKEQFKQLFQIVEQSFGRPLSPYEIETLNQWIDVDHHDLSVIQAALDEALSQNKLSFKYIDRILLNWKKNNVKTVDDSKKIREQFNKPKMKHVVKKVPKFDWLNGENPNDK

SEQ ID NO: 3196 - protein, 81 aa, Staphylococcus epidermidis
GGIFWLNDEYPIINGNQAAILGMHSIITRPIAVDKDTIENRPMMYIALSYDHRIIDGKEAVGFLKTIKELIENPEDLLLES

SEQ ID NO: 3197 - protein, 97 aa, Staphylococcus epidermidis
PGVSFLLSSYYVYRKRKNNRSLIYGLITGTIVMTIVLSILNYFVLLPLYGMIFNLGDVLNNVKIVIVSGVIPFNLIKGIIISIIFVLLFRRLRHIIK

SEQ ID NO: 3198 - protein, 366 aa, Staphylococcus epidermidis
KHIRIEVVIMTKIAYTGGGTVGHVSVNLSLIPTSIEKGHEAFYIGSKHGIEREMIESQLPDIQYYPISSGKLRRYLSFENAKDVFKVLKGILDARKILKKQKPDLLFSKGGFVSVPVVIAARSLKIPTIIHESDLTPGLANKISLKFAKKIYTTFEDTLTYLPKDKADFVGATVREDLKQGNKERGYQLTDFDKNKKVLLVMGGSLGSKKLNNIIRQNIEALLHDYQIIHLTGKGLVDDSINKKGYVQFEFVKDDLTDLLAITDTVVSRAGSNAIYEFLSLRIPMLLIPLGLDQSRGDQIDNAKNFESKGYGRHIPEDQLTEVNLLQELNDIELHRESIIKQMETYQESYTKEDLFDKIIHDALNK

SEQ ID NO: 3199 - protein, 332 aa, Staphylococcus epidermidis
RRISMQTIESIIIGGGPCGLSAAIEQKKKGIETLVIEKGNVVESIYNYPTHQTFFSSSDKLSIGDIPFIVEDSKPRRNQALVYYREVVKHHQLNIHPFEEVLTVKKINNKFAITTTKGVYECKYLTVATGYYGQHNTLEAEGAELPKVFHYFKEAHPYFNQNVVIIGGKNSAVDAALELEKAGANVTVLYRGEQYPKAIKPWILPNFESLVNHEKITMEFNATVTKITDHSVTYEKDGQLIEIDNDYVFAMIGYHPDYDFLKTIGIDIHTNEYGTAPVYNRETFETNVENCYIAGVIAAGNDANTIFIENGKYHGGVITQSILTKKQTPLET

SEQ ID NO: 3200 - protein, 377 aa, Staphylococcus epidermidis
LMMSYLFNNYKRDNIEFVDANQNELIDKDNNVYLDFSSGIGVTNLGFNMEIYQAVYNQLNLIWHSPNLYLSSIQEEVAQKLIGQRDYLAFFCNSGTEANEAAIKLARKATGKSEIIAFKKSFHGRTYGAMSATGQKKITDQFGPVVPGFKFAIFNDFNSFKSLTSNNTAAVIIEIIQGESGVLPADPLFMKQLNEYCKQKDILIIVDEVQTGIGRTGKLYAHEHYQLSPDIITLAKGLGNGLPIGTMLGKKNLGHAFGYGSHGTTFGGNRLSLVAANQTLSIINDADLLNDVQSKGQFLIENLRKSLVNKRNVIEVRGVGLMVGIEVTNDPSQVVREAKRMGLIILTAGKNVIRLLPPLTITKKQLEKGIEILTEII

SEQ ID NO: 3201 - protein, 236 aa, Staphylococcus epidermidis
RRVSLMSLISMIIYFVILMVIPMWAQHKVKSNYEKYSQVRSTSGKTGREVAEEILHANGIYDVDVVKGEGFLTDHYDPNKKVVCLSPANYDRPSVAGTAIAAHEVGHAIQHQQGYAPLRFRTALVPLANIGSSLSYIIIMVGIVLTALGSVFGSTVLWVGAGLMSLAVLFSIVTLPVEFNASSRAMKQITALNIVNEKEYKHAKKVLSAAAMTYVASTAVALAELARIILIARSSD

SEQ ID NO: 3202 - protein, 406 aa, Staphylococcus epidermidis
NKVRTTMSHEIFEQAKPILKKIQNKGFKAYFVGGSVRDYIMQRPIHDVDITTSATPDEIESIFDKTIPVGKEHGTINVVFQNDNYEITTFRSEDEYIDHRRPSEVYFVRDLYQDVQRRDFTMNAIAMDLNYRLYDYFNGQQDINNRVIRTVGVPSERFSEDALRIIRGLRFQSQLNFQIDSDTLHAMSSQISDIQYLSVERVVVELKKLIMGNNVKQSFEVMQNMKAFNYIPFFKSFEMSHLHIDEPITFELWIAILIVQQPKDIQLSTLKISNQEKATIKKWVTLIQTLPKIQSKQSLITLVYDYNLNDIEILLSLHHLLKQNGLTTANHLIINEISIREANEKLPIHCRKELAINGKDILNHTNKNSGPWLKDTLREIEIAVISNQIVNTKEEILEWVDAHVKI

SEQ ID NO: 3203 - protein, 69 aa, Staphylococcus epidermidis
LSILPKSWVNVYLCEFSLIIIAQALRPGFPLVAASKYILAITFTPLQNCLLTKMYLFYCIKLKRQSTKN

SEQ ID NO: 3204 - protein, 73 aa, Staphylococcus epidermidis
FKDGYYMLHETWKERTPIKKVEVTNTDAKKFTVADMLTIGKQYDVINETEEYYQIIDNSGLVGGYYKDYFKEI

SEQ ID NO: 3205 - protein, 93 aa, Staphylococcus epidermidis
VTIGGCHMEIIAISETPNHNTMKVSLSEPRQDNSSTTYTAAQEGQPEFINRLFEIEGVKSIFYVLDFISIDKEDNANWNELLPQIENTFAKSN

SEQ ID NO: 3206 - protein, 387 aa, Staphylococcus epidermidis
FKKGWAQMKIGITCYPSMGGSGIIATELGIKMAERGHEVHFITSNIPFRIRKPLPNMTFHQVEVNQYAVFQYPPYDITLSTKISDVIQEYDLDILHMHYAVPHAVCGILAKQMSGKNVKIMTTLHGTDITVLGYDHTLQNAIKFGIEQSDIVTSVSHSLAQQTYEIINTKKEIIPIYNFVRENEFPTRHNEELKDCYGISPEEKVLIHVSNFRKVKRIDTVIETFAKVHESIPSKLILLGDGPELIDMRHKARELDVETHVLFLGKQNDVSAFYQLSDLVLLLSEKESFGLTLLEAMKTGVLPIGSHAGGIKEVIRHEETGFIVDIGDSTQAAKYAIKLLSNPELYQKMQSQMLKDIEARFSSDLITDQYENYYRKMLEQGENNNES

SEQ ID NO: 3207 - protein, 337 aa, Staphylococcus epidermidis
HMFMKREVNEMTKLSYLEAIQNAQDLALNHFSNAFILGEDVGKKGGVFGTTKGLQSKYGDERVIDTPLAESNIIGTAIGAAMLGKRPIAEIQFADFILPATNQIISEAAKMRYRSNNDWNCPLTIRAPFGGGVHGGLYHSQSVESIFASTPGLTIVIPSSPYDAKGLLLSSIESNDPVLYFEHKKAYRFLKEEVPETYYTVPLGKADVKRPGEDITVFCYGLMVNYCLQAADILANDGIDVEVVDLRTVYPLDKATIIERSQRTGKVLLVTEDNLEGSIMSEVSAIIAENCLFDLDAPIMRLAAPDVPSMPFSPTLENEIMMNPEKIQDKMRELAQF

SEQ ID NO: 3208 - protein, 285 aa, Staphylococcus epidermidis
EAIMAKQIIVTDSTSDLSHEYLKQHNIHVIPLSLTIDGKSYTDQVDISSSEYIDHIENDADVKTSQPPIGRFIETYEQLAQDDVEIISIHLSSGLSGTYNTAVQASHMVDGNITVIDSKSISFGLGYQIKQIVELISQGTSTEEIVKEMTQLRDNLQLFVVIGQLNQLIKGGRISKTKGLIGNIMKIKPIGTLRDGKLELVHNSRTQNSSVQYLKKEITDFVKDHKIKSIGIAHANVKDFVDKIIKSFTESFDFSQFDINVTTPVISTHTGQGAIGLVVLRDTLN

SEQ ID NO: 3209 - protein, 208 aa, Staphylococcus epidermidis
GAPIMNRWKRISLLIVFTLIFGIIAFFHESRLGKWIDNEVYEFIYSSESFITTSIMLGVTKIGEVWAMVALSLLLVAYLMLKRFKIETLFFVIVMSLSSTLNPLLKNIFDRERPTLLRLIDISGFSFPSGHAMGSTSFFGSAIYVINRHDSGISKGVLIGLCALFILLISTSRVYLGVHYPTDIIAGIIGGVFCIVLSTLILKKQLAV

SEQ ID NO: 3210 - protein, 448 aa, Staphylococcus epidermidis
VITMTEYLSVSALTKYIKYKFDQDPHLQSVLIKGELSNFKKHSSGHLYFNVKDKESVISAMMFKGNASKLGFEPKEGDEVLIEARVSVYERRGNYQIYVNKMQLDGIGNLYQKLELLKKKLKKEGYFDQSNKKLIPKYPKKIAVLTASTGAAIRDIHSTINNRYPLVEQIQISTLVQGTQARQDIIEKIQYADSLDVDTIIVGRGGGSIEDLWNFNEEDVVKTIFNCQTPIISAVGHETDFTLSDFVADVRAATPTQAAVIATPDQYELLQQIKQYEYTLSRYIKQYIEHQKKQLNHISSYYKFKQPSLLYDQQIQKRDELERQLNHLLNTKVEKSKHHLKLLQQSFNFKNLNQQITQEKQSIYQLHSRLSKIMSNNITNLKTVLKNKLESLNNLSPTNTMLRGYAIVNKDNEVVTSTHKLNENDQISLTMKDGSVDATVKKVRCNDE

SEQ ID NO: 3211 - protein, 248 aa, Staphylococcus epidermidis
EEHMKNIIVIKLGGIAIENLNDAFIQQINAWHLENKKIIIVHGGGQVISNLLTKNNHSTIKIDGMRVTAKNDLPIIYDALINIVGHQLLERLKESNLEFFQFKEKIKELVSAEFLNKNIYGYVGKVKEINTMLLEKMLSRDIIPIITSLGVNEQGEYLNVNADHLATAIAKKLKVEKLVYMTDVPGVIEKDKTLATLTINEAKTKIENKIITGGMIPKIESAIQTLESGVESILIANNLQKGTIIRGD

SEQ ID NO: 3212 - protein, 222 aa, Staphylococcus epidermidis
GANMTNILIVEDEQNLARFIELELTHENYTVDIENDGKVGLDKALSKPYDLYILDLMLPNINGLEICRQIRQKTTTPIIIITAKSETYDKVAGLDYGADDYIVKPFDIEELLARIRAVLRRQPDKDVLDINGIIIDKDAFKVTVNGHQLELTKTEYDLLYVLAENRNHVMQREQILDHVWGYNSEVETNVVDVYIRYLRNKLKPFNKEKSIETVRGVGYVIR

SEQ ID NO: 3213 - protein, 204 aa, Staphylococcus epidermidis
IMNIIKGNIASPLGFSADGLHAGFKKKKLDFGWIVSEVPANVAGVFTTNKVIAAPLKLTKNSIEKSGKMQAIVVNSGIANSCTGKQGEKDAFKMQQLAANKLQIQPEYVGVASTGVIGKVMPMSILKNGFSKLVKNGNADDFAKAILTTDTHTKTCVVNEEFGSDTVTMAGVAKGSGMIHPNLATMLAFITCDANISSQTLQQV

SEQ ID NO: 3214 - protein, 746 aa, Staphylococcus epidermidis
GPRMTENKGSSQPKKNNNGKSNGKKNRNVKRTIIKIIGFMIIAFFVLLLLGILLFAYYAWKAPAFSESKLDDPIPAKIYDKNGELVKTLDNGQRHEHVNIKDVPKDMKNAVLATEDNRFYQHGALDYKRLFGAIGKNLTGGFGSQGASTLTQQVVKDSFLTQQKSIGRKAQEAYLSYRLEQEYSKDEIFQVYMNKIYYSDGVTGIKAAAKYYFNKDMKDLNLAEEAYLAGLPQVPNLYNIYNNPKEANNRKDTVLYLMHKHNRINDKQYADAKKIDLKANLVERTKKERQVTGNEKNPEYDSYVNFVQSELMNNKYFKDKNLGSVLQSGIKIYTNMDKDVQQTLQDRINNGSFYKNEDQQVGATILDSKTGGLVAISGGRNYKNVVERNQATDPHPTGSSLKPFLAYGPAIENMKWSTNHAIQDESSYWVDGSQFKNYDTKGHGTVSIYDALRQSFNIPALKTWQQVKSQAGNDAPQKFASKLGLDYSGKIGPSEVLGGSSSEFSPTQLASAFAAIANGGTYNNAHSIQKVVTHEGDTIEYEHTSHKAMKDYTSYMLAEILKGTFKAYGSAYGHGVSGVNMGAKTGTGTYGQEIYEKYNLPDNAAKDVWINGFSPEYTMSVWMGFNKVKQYGTNSFIGHSEQDYPQYLYEDVMSSISSKDGEDFKKPNDVQGSSPDSLSVSGHSDNNTTNRSVHGSSDTSSSSNGGSNSASSGNNSNSSNGTSQGNSGNAFTRLFNLNSIFDYKVS

SEQ ID NO: 3215 - protein, 225 aa, Staphylococcus epidermidis
KGIINMLEFKQVSKSFRDGNQMIQAVKPTDLKIIQGELIAIVGPSGSGKSTFLTMAGALQRPTSGNIYINNKNISILSEKQLSQIRINEIGFILQSTNLVPFLTIEQQFKLLGKYKKDTLSEDEYQKLVKQLNLSDITNQLPNQISGGQKQRVAIAKAIYTNPSIILADEPTASLDTNNAMAVMKILQKQTKERNKTCVIVTHDERLTHFCDKTYFMEDGVLSLQ

SEQ ID NO: 3216 - protein, 159 aa, Staphylococcus epidermidis
MKHMHRGTHEVERTFLMIKPDAVQRNLIGEIISRIEKKGLKLVGGKFMQVPMELAEKHYSEHEGKPFYDKLISFITSAPVFAMVVEGENAVAVSRKIIGSTNPSEAAPGTIRGDYGLNLGRNIIHGSDSTESAQREVKLWFTSSEIADYKEPREDWLYE

SEQ ID NO: 3217 - protein, 195 aa, Staphylococcus epidermidis
GVNMETTISKLNKHVEQLLKGINEYEPIEINSSLSHLLDMYSIPDEAKIACLTIDTSMRHLDAIGDNHLSKKAILIGDLLSAHFYTLLANIQDSAFQLAMSKAIVKINEDKSSINQNDLTDKELKDAILDIETLFPYLTINHFGSSVDKIKLFAELTSKYKDYHPEYLGKFNRYEIDKYIQEISKSYKKRGNENG

SEQ ID NO: 3218 - protein, 906 aa, Staphylococcus epidermidis
GADIMGIATFAVVDLETTGNQLDYDEIIQIGITFVRQNQVIDTYHSMIRTDLEIPPFIQALTSIEEEMLVQAPYFNEVADDIYQLIKDCVFVAHNISFDLNFIKKAFEKCNIQFKPKRVMDTLELFKIAFPTDKSYQLSALAESHHIPLNNAHRADEDATTTAKLMIKAFEKFEQLHLDTQKQLYYLSKNLKYDLYHILFEMVRNYQTKPPNNQFEQFEQIIYRKQIDLKKPAVNFDGTLKDLYKNVTQSLNLTYRPQQLYLAEIILDQLMHSDKAMIEAPLGSGKSLAYLLAATMYNIETGRHVMISTNTKLLQSQLLEKDIPLLNDVLDFKINASLIKSKNDYISLGLISQILKDDTNNYEVSILKMQLLIWITETNTGDIQELNLKGGQKMYVDQKIETYVPVRHDIHYYNYIKRNAQNIQIGITNHAHLIHSDSENTIYQLFDDCIIDEAHRLPDYALNQVTNDLNYSDVKYQLGLIGKNENEKLLKAVDKLEQRRILEKLDIAPIDVFGLKININELHDLNEQLFTTIYNIIQTSDVYDDDIHKYHYVYDFETGEILKDLRAIIDKLNKTIEIFNGMNHKTIKSVRKQLLYLHDKFKLIEQSIKDHHTSFISIKNLAQKSTIRLLVKDYDVKDILTKQVLEKFKSLTFISGTLTFNHSFKAFQNWFNEDIDFNTFEISTPLTSSNHTNVFVPNDVETYNYKNLDDYVASIVDYIVEYITVTQSKCLVLFTSYKMMHMVQDLLNELPELEDYVILTQQQNQNYKIVQQFNNFDKSILLGTSTFFEGFDFQANGLKCVMIAKLPFMNKHNIKYWLMDSEFTSTFKDYVLPDAVTRFRQGLGRLIRHEDDKGLIVSFDDRLVNSTYKSFFAQSLEHFKQRKGNIKQFNKLLNQIQRSIDNESKS

SEQ ID NO: 3219 - protein, 357 aa, Staphylococcus epidermidis
GESMELKTSYASDNYPIIVKHHAINSLERYIKNEEQRFFIIDKQVYNLFVDKLEALAQKFDAKCIVIPSGETSKSFEHYHRTIEYLLSHQLTRQTCIVAIGGGATGDFAGFIAATLLRGVSFVQVPTTILAHDSSVGGKVGINSEHGKNLIGAFYRPKAVIYDLDFLETLPYSEILSGYAEVYKHALLNGEKSTKNIESNFTSNKVLQALKNLDYYLFEGIKTKLNIVVEDEKEKGKRKFLNLGHTFGHAIEYEHKIPHGHAVMIGILYQFIVANHLFETNYNIQHYINYMKKLKYPLSIIKQLHFEDTYHFMLLDKKNDYNGIQMVLLKNLGKPVVTHVDKDTLLSAFEELQSYFK

SEQ ID NO: 3220 - protein, 301 aa, Staphylococcus epidermidis
LNLIGVKVLDVIKQIQQAIVYIEDRLLEPFNLQELSDYVGLSPYHLDQSFKMIVGQSPEEYARARKMTIAANDVVNGASRLMDVAKKYRYANSNDFANDFSDFHGISPIQATTKKDELKIQQRLYIKLSTTENAPYTYRLQETDDISLVGYSRFIPTEQLSNPFNIPDFLEDLLVDGYIKELKRYNDTSPYELFVVSCPLEQGLEIFVGVPSERYPSHLESRFLPGRHYALFNLQGEIDYATNEAWYYIESSLQLTLPYERNSLYVEIYPLDISFNDPFTKIQLWLPIKQEIYDLDEGYQN

SEQ ID NO: 3221 - protein, 411 aa, Staphylococcus epidermidis
GEIMKKILIANRGEIAVRIIRAAHDLGIQTVAIYSEGDKDALHTQIADEAYCVGPTLSKDSYLNIPNILSIATSTGCDGVHPGYGFLAENGDFAELCEACQLKFIGPSYQSIQKMGIKDIAKAEMIKANVPVVPGSEGLIQSIDDAKKIAKKIGYPVIIKATAGGGGKGIRVARDEKELETGYRMTQQEAETAFGNGGLYLEKFIENFRHIEIQIIGDTYGNVIHLGERDCTIQRRMQKLVEEAPSPVLSEDKRQEMGNAAIRAAKAVNYENAGTIEFIYDLDDNQFYFMEMNTRIQVEHPVTEMVTGVDLVKLQLKVAMGEALPFKQEDISINGHAIEFRINAENPYKNFMPSPGKITQYLAPGGFGVRIESACYTNYTIPPYYDSMVAKLIVHEPTREESIMTGIACFK

SEQ ID NO: 3222 - protein, 110 aa, Staphylococcus epidermidis
MYQIIKQLLEDIDEMNYRYQHVKINGGSFDFYKDVEPYVKNIDNHLEALNCYSKSITETQYMSQQKLDILILNIQKLSVDCHFPRTSRKLFVEKLKSAQYDLKNILSNYV

SEQ ID NO: 3223 - protein, 436 aa, Staphylococcus epidermidis
VNQMNNSEIININGPFKGEIEVPGDKSMTHRAIMLASLAKGISTIYEPLMGEDCRRTMDIFKLLGVTIEEQDNSIIINSPGYQNFITPHQVLYTGNSGTTTRLLAGLLSGLGIESVLSGDVSIGKRPMDRVMKPLLKMNANISGIDNNYTPLIIKPSTIKGINYQMEVASAQVKSAILLASLFSKEATTLTEFDVSRNHTETLFAHFNIPISIQGKTIQTIPYAIEHIQPRDFHVPGDISSAAFFIVAALITPGSDITIHNVGINPTRSGIIDIVKQMGGNIELSNVSKGAEPTASIHVKYTPNLNAVTIKGDLVPRAIDELPVIALLCTQASNSCIIKNAEELKVKETNRIDTTADMLNLLGFNLQPTHDGLIIHPSEFRSNATVDSQTDHRIGMMLAVASLLSSEPLKIEQFDAVNVSFPGFLPKLKLLENEGK

SEQ ID NO: 3224 - protein, 267 aa, Staphylococcus epidermidis
RMEIMVQTVYKNSDQTVFEDAKALFQLNKNILLKGPTGSGKTKLAETLSHVMKLPMHQVNCSVDLDTESLLGFKTIQTNEEGHQEIVFIDGPVIKAMKEGHILYIDEINMAKPETLPILNGVLDYRRQLTNPYTGEVIKAAPGFNVIAAINEGYVGTLPMNEALKNRFIVIEIDYIDGDILKTVIKEQSKLQDEQLIQDIVKFNEDLRTMTKQGQISEEAASIRALIDLSDLATVMPIERAVQRTIIDKLEDEREQQAILNAIELNF

SEQ ID NO: 3225 - protein, 224 aa, Staphylococcus epidermidis
MERILMISKKKALQMIDVIADMFPNAECELNHRNAFDLTIAVLLSAQCTDNLVNRVTQSLFRKYRTPEDYLNVSDEELQNDIRSIGLYRNKAKNIKKLCHSLIEQFNGQIPQTHKELESLAGVGRKTANVVMSVAFGEPSLAVDTHVERVSKRLGINRWKDSVRQVEDRLCDIIPRDRWNKSHHQLIFFGRYHCFARKPKCEICPLLNDCREGQKRHKAKIKEA

SEQ ID NO: 3226 - protein, 79 aa, Staphylococcus epidermidis
GVMMSKEKQSFEEMMKELENIVQKLDNEAVSLEESLDLYQRGMKLSANCDSTLKEAEKKVNELMQEEVGDKGNEETTDE

SEQ ID NO: 3227 - protein, 443 aa, Staphylococcus epidermidis
NLMIVSKRTFRSLYIPILIEQLFILIMGQADTLMLNSYSTDAVAASGMISQILMLITFLITIIHVGTNIRIVHLKEHQPSSISQEIYHNLLFNSIVSIVFTIVIGIAFELILRLFQVPQDIFKLTYQFGMIILSVLTLTTCHMYIGTVLRVMNHASSATRITIISNVTNIILNGIVLFIIPEYVGNPVLGVAVVTAFSRLLGCTLALIALIQIFRPFKHYFKLSWKKIYQVSTLGIPTAGEQISYNFAQTFTTAFIAMLGTQVIAAKSVSTVLSGLSFSCAMAFSAASQIYLGKFISRRRYRTLKKVVIKSIWFNITQSFMIMTCVFIGFIVCGRWITHDIQTYHLIIYYLVILFGLEPIRAINNLIVDLLNVTGDVRYPVTVSVVTTWLLLLPGSYLLGIHWRLGYTGIILVSIADEALRFIIMYLRWRNDRWQARMKQIGV

SEQ ID NO: 3228 - protein, 591 aa, Staphylococcus epidermidis
NLVMNRLNSVVIKLWLTIILIVATVLILLSVSLITFIQYYFTQETENAIKEDAKRISSLVEKSHNKTLAIQNSQTLIDGDGPGGLIIMKDMSEKPDSSYKDTKKQMFNEIKKSTKFKKVFKEGEYETQNITIKNKGNSQSYLLLGYPMKAQKGAQSHYSGVFIYKDLKSIEDTNNAITIIILITAIIFTIASTIFAFFLSNRITKPLRQLKTQAQKVSEGDYSQISTVATKDEIGDLSRAFNNMNVEIQEHIKAISSSKNIRDTLLNSMVEGVLGINNQREIILSNKMADDIMRHIDDFSKESIEQQIEATFESQQNEYLELEINTRYYVFISSYIDRIQTNGRSGIVMVIRDMTNEHNLDQMKKDFIANVSHELRTPISLLQGYTESIVDGIVTEPDEIRDSLAIVLDESKRLNRLVNELLNVARMDAEGLSVEKELQPIQHLLDKMESKYRMQSEELGLTMTFDSNNDEQLWNYDMDRMDQVLTNLIDNATRYTQAGDSIKISIDEDSDFNILTITDTGTGIAPEHLKQVFDRFYKVDAARKRGKQGTGLGLFICKMIIEEHGGRIDVESELGKGTSFIIRLPKSKQIS

SEQ ID NO: 3229 - protein, 328 aa, Staphylococcus epidermidis
NGWMHMSKYSQDVIRMLYEHQSNYISGQYIADQLNISRAGVKKVIDLLKEDGCDIKSINHKGHQLNSLPDQWYSGIVKPILDELGLFNHLEVYHTVDSTQLKAKRALVGNKDTFLILSDEQTEGRGRFNRNWESSKGKGLWMSLVLRPDVPFSMIPKFNLFIALGIRDAIQQFSNERVTIKWPNDIYIGNKKICGFLTEMVANYDEIEAIICGIGINMNHVESDFDEDIKDKATSIRMHSDSIINRYTFLTALLTQIIHRFDQFLHQTFESIREEYIHATNIWHRQLKFTENNHQFLGEAIDIDSDGFLIVKDEKGQLHRLMSADIDL

SEQ ID NO: 3230 - protein, 61 aa, Staphylococcus epidermidis
CKGIQTVHFLIITSARCTQNNYAVFSMKHSFNILIFCMYYSSLMRFSLTYIIIKNIRIHTE

SEQ ID NO: 3231 - protein, 130 aa, Staphylococcus epidermidis
TLHLKCKSLYFVIYYIRIAIKEYFYMKSMEQMQQEVDDYISQFKAGYFSPLANLARMTEEVGELAREINHRFGEKKKKDTEEDNTIKAELGDNLFVLLCIANSLNIDMTESFNDTMNKFNTRDKNRFERK

SEQ ID NO: 3232 - protein, 156 aa, Staphylococcus epidermidis
EMNFKEIKELIEILDQSSLTEINIEDNKGSVVNLKKEKETEIVTPQVTQQPTQPINHTHNETQQKPSHSSKDEQSSDNEYNTINAPMVGTFYKSPSPDEKAYVQVGDKVTNESTVCILEAMKLFNEIQAETTGEIIEILVEDGQMVEYGQPLFKVK

SEQ ID NO: 3233 - protein, 61 aa, Staphylococcus epidermidis
INIVCKLNVNNIYLILISLFSFLLIKDLKCCLINVLSLLFFEKLQTKNFDLRKLKFEKSLL

SEQ ID NO: 3234 - protein, 326 aa, Staphylococcus epidermidis
EEYVMKRLLIIHTGGTISMSQDQTNKVITNEENPISQHQNIISQYAEVDEINLLNIPSPHMTISNVVRLRDEIITYSKENIYDGFVITHGTDTLEETAFLIDLLIDIQEPIVITGAMRSSNEIGSDGLYNFISAIRVASSSEANHKGVMVVFNDEIHTARNVTKTHTSNINTFQSPNQGPLGVLTKNRVQFYHHPYRQTTYQYIDVNLRVPLVKAYMGMEDDVLSFYSQQHVDGIVIEALGQGNLPKSCLNGLQQCLKKNIPLVLVSRSFNGIVSPVYAYEGGGADLKNNGVIFSNGLNGPKARLKLLVGLSQDMTQNQLERYFEE

SEQ ID NO: 3235 - protein, 467 aa, Staphylococcus epidermidis
SYNVIELIKMEGMIVVSNNNFKDDFEKNRQSINPDEHQTELKEDDKTNENKKEADSQNSLSNNSNQQFPPRNAQRRKRRRETATNQSKQQDDKHQKNSDAKTTEGSLDDRYDEAQLQQQHDKSQQQNKTEKQSQDNRMKDGKDAAIVNGTSESPEHKSKSTQNRPGPKAQQQKRKSESTQSKPSTNKDKKAATGAGIAGAAGVAGAAETSKHHHNKKDKQDSKHSNHENDEKSVKNDDQKQSKKGKKAAVGAGAAAGVGAAGVAHHNNQNKHHNEEKNSNQNNQYNDQSEGKKKGGFMKILLPLIAAILILGAIAIFGGMALNNHNDSKSDDQKIANQSKKDSDKKDGAQSEDNKDKKSDSDKNADDDSDNSSSNPNATSTNNNDNVANNNSNYTNQNQQDNANQNSNNQQATQGQQSHTVYGQENLYRIAIQYYGEGTQANVDKIKRANGLSSNNIHNGQTLVIPQ

SEQ ID NO: 3236 - protein, 207 aa, Staphylococcus epidermidis
KCPVRFKKYFIELCLVRKKMVKTVYITGYKSFELNIYKDDAPEVYYLKQFIAHKLKHLLDEGLEWVLIQGQMGIELWSAEVVIELKKDFPDIKLGIITPFIGHTQRWNDKNQAKYTNIIQQADFTESIHHTEYMGAYQFKQADQFMLDHTDYTILIYDDEQEASPKYFKAMLVEFMEKTNYTCDIVTFDELTDFINDLQWSQDQSFE

SEQ ID NO: 3237 - protein, 262 aa, Staphylococcus epidermidis
EGQVNTSNDSSNESSQKDEAKEKETPKQSTPNSSESENTQDNSQQRINATPSARRHARKNGVDLSEVSGKGNDVLRKDDVENSQKSSSQTAKSESKSQNSGSKQSNNNPSKPVIREKMSRRKKTAAKKLLEVSNQTAMLTTFNEVDMTNVMDLRKRKKEQFIKDHDGTKLGFMSFFTKAAVAALKKYPEVNAEIDGDDMITKQFYDIGIAVSTDDGLLVPFVRDCDKKNFAEIEQEIANLAVKARDKKLGLDDMVNVSFTIN

SEQ ID NO: 3238 - protein, 307 aa, Staphylococcus epidermidis
SMEVTFFGTSAGLPTKERNTQSIALNLEPYSNSIWLFDVGEGTQHQILRHSIKLGKIDHIFITHMHGDHIFGLPGLLTSRSFQGGENKPLTIIGPKGIQNYIETSLQLSESHLNYPITYIEINQQLAYHHNGFTVQAEMLNHGIPSFGYRIEAPITPGTINVEALRGIGLEPGPKYQEVKLQETFEYKGLIYNSDDFKGKAKPGPIISIFGDTKPCENEYELAKNSDLMIHEATYIEGDKKLANNYHHSHIDDVFNLIKQANVNKSLITHISNRYNIDEVTSIYNELSLDQTSPHFYFVKDFDTFKI

SEQ ID NO: 3239 - protein, 67 aa, Staphylococcus epidermidis
LREVKAILTNTEQQAIQHIDQLMNIYCHQCPLKKHNRKTHGKTQAHHFCINECTVGKQIKQIGNELQ

SEQ ID NO: 3240 - protein, 64 aa, Staphylococcus epidermidis
IKKVLNVFYLMICLNLLNNSTNIMEMIMPLIKLKGMTPDTITIFTLLSTSPKLNIIPYNGSNTK

SEQ ID NO: 3241 - protein, 474 aa, Staphylococcus epidermidis
TREVSNMTQQIGVVGLAVMGKNLAWNIESRGYSVSVYNRSRQKTDEMVKESPGREIYPTYSLEEFVESLEKPRKILLMVKAGPATDATIDGLLPLLDDDDILIDGGNTNYQDTIRRNKALAESSINFIGMGVSGGEIGALTGPSLMPGGQKDAYNKVSDILDAIAAKAQDGASCVTYIGPNGAGHYVKMVHNGIEYADMQLIAESYAMMKDLLGMSHKEISQTFKEWNAGELESYLIEITGDIFNKLDDDNEALVEKILDTAGQKGTGKWTSINALELGVPLTIITESVFARFISSIKEERVTASKSLKGPKAHFEGDKKTFLEKIRKALYMSKICSYAQGFAQMRKASEDNEWNLKLGELAMIWREGCIIRAQFLQKIKDAYDNNENLQNLLLDPYFKNIVMEYQDALREVVATSVYNGVPTPGFSASINYYDSYRSEDLPANLIQAQRDYFGAHTYERKDREGIFHTQWVEE

SEQ ID NO: 3242 - protein, 1151 aa, Staphylococcus epidermidis
TKGVILMAINEQLDTLYKLKKELEKSNNRPLINTINQVIKKVYLNQYTATFVGHFSAGKSTLINLLLEQDILPSSPVPTTSNTAIVSVAKEDEIIANLTQQQYTKLKTYNDVKQMNRQNVDVESIEINFPSNKFNLGFTFQDTPGVDSNVATHQSSTEQFMYTSNLLFYTVDYNHVQSALNFKFMKRINEVGIPIIFVINQIDKHNEEEITFETFKSRVEKSIKDWDIKLQDTYYVSKFDHPQNEIDKLSNFLVFMDQHRESTEDYVNRTIQFITDAQYIYIQNEMQSILDTLQINEEQFEEAYIQFQQNQEVSAEAQLLNDSNQLFNYLKQKRKDILDNAYIMTYDMRESLRNYLESMATDFKVNGFFNKRKKKEEEQIKRLNEATTQLQEKVNQQVRQPLREDMSFLTRFINKHAVNEKILNQEYDVVPSLISELYQTQTSISNTYVLTFSDEVIKALNKKIENESTPLFEEAVNHVQVNELSSDENEDRYEYDRYIELNTLKDSLTSHNYKHYYIHLDDSLDKLIGRTETHFELKQENSTAYHRKHETQHRNEFVTSNQDIKRALDIVKDVPLFDRTKQDITDTILRLDNQITKVGVFGTFSAGKSSLINALLGDNYLVSSPNPTTAATTELSYGKESQITLKSKEQLLEEVNHVLEFYEISFNTLDNFIKSDLEKLKSKLEKNQLAFISAIEKHYEMYTSMLEHSLIHTVSLEEIKKWSAEDEYATFVKTVHLKLPLDWLKGKIIIDSLGLHSNNQRHTNETEQILTSSDLILYVTYFNHSFTDNDKAFIEHMKDMNQLNENQAFKMIINAVDLAEDKQDIQAVEDYVADALGQVNLHSDIYSVSSRQSLNGNNIGINELRESIQYFAKVESRTILEQQMTYQLQQMNNSFKKMIKDFHDDNAKLSARQHKLNHYKNQTLLNQELIDTTAQRTFNEVEEQVYHLNERLKLQLLDEVKSVFNSQMTQNNDFNEEKKISTKIYLDQIHQRLFLEQSLITERIKKYFNSQLEEQILPVMKKLNQIHVIINAKFNVEPSLVDTALLQIELNSMLQSLPKQLTKRKIVNPKSQKDIQVHIANQTLELLQDDLNSLRRQLNDYIHEMTQLAEHQFQMLETSIQQQIDELLSFTIDDTLIQQLELKTTQLDNIL

SEQ ID NO: 3243 - protein, 155 aa, Staphylococcus epidermidis
KQLLVEEHFMMNGYEAYMKELAQQMRAELTDNGFTSLETSDDVNQYMQNIDNDDTTFVVINSTCGCAAGLARPAAVAVAEQNEVKPDHKVTVFAGQDKEATQTMRDYIQQVPSSPSYALFKGQHLVHFIPREHIEGRDINDIAMDLKDAFDDNCQ

SEQ ID NO: 3244 - protein, 258 aa, Staphylococcus epidermidis
INIFKKLAKVIKKEVMKMAENQAKKEQVHTVFQNISQKYDRLNNIISFEQHKVWRKHVMSTMNVQKGSKALDVCCGTADWTIALSEAVGSKGQVTGLDFSENMLEVGKQKTASLENIQLVHGDAMNLPFDDNSFDYVTIGFGLRNVPDYLSALKEMHRVLKPGGMVVCLETSQPTLPLFKQIYSLYFKFVMPIFGKMFAKSKEEYEWLQQSTFNFPDKQTLKGLFFEAGFNDIIVRSFTGGVAAMHLGYKENSSSKGD

SEQ ID NO: 3245 - protein, 61 aa, Staphylococcus epidermidis
VHSLTDTPLFIFTDNIITYFVTLEYDEHSYKDRYLFVVDLLFIRKIKHTDWLNILYVLKCN

SEQ ID NO: 3246 - protein, 353 aa, Staphylococcus epidermidis
GASFMFLAWNEIKRNKIKFSLVIGILVLISYLLFLLSGLANGLIKMNTEGIEKWNADAIILKKEANQTVEQSLFNISKVQNTYEKSTTLKQQGVIISNHHREENALLFGVTHKSFLIPPIIKGHQVESSNEIVIDQTLADKGFKIGDILSLSQSDEKLKVVGIVESAKYNASPVLFSNNQTIEKLNPKLSKDKTNAIVIKDSNWKNHKLNKDLESISISQFIKNLPGYKAQNLTLNFMIVFLFIISATVIGVFLYVITLQKTHLFGVLKAQGFTNCYLAKMVFAQTFILSLIGTIIGFLLTLLTGTFLPPVVPIHFNLLTMLIYGIVLIIISLLGSLFSVLSIIKINPLKAIG

SEQ ID NO: 3247 - protein, 183 aa, Staphylococcus epidermidis
TIALDNIAILEALLYTSGDEGLEQKQIIDILDINLNQLEDLVSKYHSHGLTIQRYGSTYVLTTKKETFTYIEQLVKEKSKMKLSQAAMETLSIIAYNQPLTRGDIEMIRGINSDGAVKTLIARGLVEAKDVDHSRSHHLITTDLFLNVFGIENLDALPTTEEDEAEMDEFFSNLVNQKGESNE

SEQ ID NO: 3248 - protein, 387 aa, Staphylococcus epidermidis
FNKLKGDSVMFQLLAVCPMGLEAVVAKEIQELGYDTQVENGRIFFEGDESAIVRCNLWLRTADRIKIVMGRFNATTFDELFEQTKSLPWETVIDKEGNFPVQGRSVKSTLYSVPDCQAITKKAIVERLKHAHQEKGWLSETGAKYPVEVAILKDNVLLTIDTAGSGLNKRGYRIAQGEAPIKETLAASLIRLANWNGNTPLIDPFCGSGTIAIEACLIAQNIAPGFNRDFVSEQWNMMPPNIYDKFRDEADQLADYDKDIQVYASDIDPEMIEIAKRNAEEVGLGDIIQFNVKDVNTLSIDTDKPVALVGNPPYGERIGDREEVEEMYRYIGTLLKQHPHLSAYILTSNKEFEYLVNRKATKRRKLFNGYIECTYYQYWGKKQSNKN

SEQ ID NO: 3249 - protein, 215 aa, Staphylococcus epidermidis
YGLSEVMNISHRNRFIANPGCYATATELALYPLISNHLIRVDSIIVDAKSGLTGAGKKLNQSSHYVNVNNNYVTYKLNKHQHIPEIVQTLQFFNKSLQNIQFSTSLIPVNRGIVATIYTRLENGVKINQIESTYKDVYKNKPFIRIKDGLPQLNEVIGTNYTDIGFVYNETTGVLTISSVIDNLIKGAAGQAIQNMNLMFNFDETDGLILAPLYI

SEQ ID NO: 3250 - protein, 357 aa, Staphylococcus epidermidis
KAYSSKQDLTISLYVALQVALLQCTLAIKKTVLAKVINVAKLNINNEIKKVEKRLEEAIISSDQTLQEASFHLLSSGGKRVRPAFVILSGQFGSNNKPSEDTYRVAVALELIHMATLVHDDVIDKSDKRRGRLTISKKWDQSTAILTGNFLLAMGLKHLSEISDTRVHSTISKSIVDVCRGELFQFQDQFNSNQTITNYLRRINRKTALLIQLSTQVGAITSNASNDVIRKLKMIGHYIGMSFQIIDDVLDFTSSEKKLGKPVGSDLMNGHITLPVLLEMRKNKTFKDKISQLNPDSPQHAFETCITIIRQSESIEQSKQISEKYLNKAINLIDELEDGPNKELFRKLIKKMGSRNK

SEQ ID NO: 3251 - protein, 187 aa, Staphylococcus epidermidis
MNDSLIRIKQNFIEYILFNYRFKSRITVWVLNYLKANQDKLNNVHFVNSKINNHYTLEIAEVDATASAIQLSKDNKSYINTNQIFNYIANHTLRLDIQIHFANCHIRESRLDDLILMQLIHSPSYSSYVQDLYSISMDKRKQTFIIQTLQNNIDLSLQMNEPDYFYQLTQILNVLKSKDIQSTLHER

SEQ ID NO: 3252 - protein, 314 aa, Staphylococcus epidermidis
GRCPMILTLTLNPSVDISYPLDQFNLDTVNRVSQTSKTAGGKGLNVTRVLSEFGEDVIASGFLGGALGQYIEEQIETTRIKQAFFKIKGETRNCIAILHEGQQTEILEKGPTIELKESEEFKSHLLKLFKETDVAVMSGSLPKGLNTDYYADIVRLAKEQGILTILDSSGQSLEEVLISNVKPTVIKPNIDELSQLLNYKVTNDIKELKAAVSQPIFNDIEWIIVSLGSEGAFAKHNQKFYKVNIPNIKVVNPVGSGDSTVAGIASGLIHQQTDEELLKKANAFGMLNAMEQQTGHINTDKFDEIFKQIEVIEV

SEQ ID NO: 3253 - protein, 221 aa, Staphylococcus epidermidis
GGNTVGQKINPIGLRVGVIRDWEAKWYAEKDFASLLHEDLKIRKFIDNELKEASVSHVDIERAANRINIAIHTGKPGMVIGKGGSEIEKLRNKLNTLTDKKVHINVIEIKKIDIDARLVAENIARQLENRASFRRVQKQAITRAMKNGAKGIKTQVSGRLGGADIARAEQYSEGTVPLHTLRADIDYAHAEADTTYGKLGVKVWIYRGEVLPTKNTSEGGK

SEQ ID NO: 3254 - protein, 83 aa, Staphylococcus epidermidis
GRDTMADNNNQNGQDATQQFINILKSFKWRIIGFLAFLIIAILFLTLGFWKTILIIVLCLIGIGIGYIKDRTQDFLNFLNRWS

SEQ ID NO: 3255 - protein, 187 aa, Staphylococcus epidermidis
LSWFLVFFYNVNTFHNDTVFFWFSSYYFTFFTFVFTCDNFYVVTFFDMHVGTSLNYVNLFDWYYSTSGASDTIFMKFPSRNSRATGPKIRVPRGPLSSRMITHAFSSNLIYEPSSRRTPDFVRTTTAFTTSPFLTTPPGVAFLTVHTIISPMFAVLRPDPPNTLIVRTSRAPELSATFKRVSCWIIR

SEQ ID NO: 3256 - protein, 171 aa, Staphylococcus epidermidis
RRDTFMARREEETKEFEERVVTINRVAKVVKGGRRFRFTALVVVGDKNGRVGFGTGKAQEVPEAIKKAVEAAKKDLVVVPRVEGTTPHTITGQYGSGSVFMKPAAPGTGVIAGGPVRAVLELAGITDILSKSLGSNTPINMVRATINGLQNLKNAEDVAKLRGKSVEELYN

SEQ ID NO: 3257 - protein, 163 aa, Staphylococcus epidermidis
FIRTAIMNEAFIFRRTIIMRQTFMANESNIERKWYVIDAEGQTLGRLSSEVAAILRGKNKVTYTPHVDTGDYVIIINASKIEFTGNKEQDKMYYRHSNHPGGLKSISAGELKRTNPERLLETSIKGMLPSTRLGEKQGKKLFVYGGAEHPHAAQQPENYELRG

SEQ ID NO: 3258 - protein, 340 aa, Staphylococcus epidermidis
RGGTMKAIGFKSSFQLDEGNCFEEFNFDIPHPSGHELLVKVQSISVNPVDTKQRTMPVDKAPRVLGFDAVGVIEKIGDQVSMFQEGDVVFYSGSPNQNGSNEEYQLIEEYLVAKAPTNLKSEQAASLPLTGLTAYETLFDVFGISKEPSENKGKSLLIINGAGGVGSIATQIAKFYGLKVITTASREDTIKWSVNMGADVVLNHKKDLSQQFKDNHIEGVDYIFCTFDTDMYYEMMVNLVKPRGHIATIVAFNSQQDLNLLKSKSVTFTHEFMFSRPLHHTDDVIKHHEYLKDITEKVEQGYYQPTTTKVIDGLDVDSLYEAHQILESHSMIGKLVINLK

SEQ ID NO: 3259 - protein, 123 aa, Staphylococcus epidermidis
INMARIAGVDIPREKRIVISLTYVYGIGTSTANKIVEEANVSADTRVKDLTDDELGRIREVVDGYKVEGDLRREQNLNIKRLMEISSYRGIRHRRGLPVRGQKTKNNARTRKGPVKTVANKKK

SEQ ID NO: 3260 - protein, 279 aa, Staphylococcus epidermidis
ATMALKKYKPITNGRRNMTTLDFAEITKTTPEKSLLQPLPKRAGRNNQGKLTVRHHGGGHKRQYRVIDFKRNKDGITAKVDSIQYDPNRSANIALLVYADGEKRYIIAPKGLQIGQTVESGAEADIKVGNALPLQNIPVGTVIHNIELKPGKGGQLARSAGASSQVLGKEGKYVLIRLRSGEVRMILSTCRATIGQVGNLQHELVNVGKAGRSRWKGVRPTVRGSVMNPNDHPHGGGEGRAPIGRPSPMSPWGKPTLGKKTRRGKKSSDKLIVRGRKKK

SEQ ID NO: 3261 - protein, 654 aa, Staphylococcus epidermidis
IMNFNQFINKQNIIMTEDEHNVYDFLKHHNPNWSSNYIDHLLDGRDKVSQRLITSLHRENLVKSRDHSRILNRHQFAGYGVNVIAILEIYFPTSNIYLYAPITGMHAFDRIDVEGPFYFKNLSKEDDFERVLHPNQILDWILIEDENLNNEASVQFRNDLNNSAANMTFALSFQHYTMRNERAPLYNLIKNANDSYLRSEQSVIEGHPLHPGAKLRKGMNAEENFMYSSEFGNVIHLRAVFIHKSISRIQSSNVDYNVAVKQMFPDLIKTLEKEFGEDFNLQNYHLMMVHPWQIKHILQSDYRDELNEKLILISNHSVPYYAGLSFRTLVPKQPDLSPHIKLSTNVHITGEIRTLSEQTTYNGPLVTQILREIMSKDEDFSHYQSTYIDENAGIHFYNRNDNEAIQTDRSEQLGTLFRNNLYQFISNETVPVIPSSLVATYPYNTEAPICTLIKTYQNTYQYKNYEEAAKQWIKDYSKALLGLVIPLYSKYGISLEAHLQNSVATFNKDGSLNMIYIRDFEGLRIDNEQLNNAGFTTRHFHEKSRILTNSKTSVFNKMFYSTVQNHLGELVITIAKYSNSKVLEQEIWQIISQTVEDIFNHMTHISKQHLNNIKRTIFASEIDYKCVTTMRLEDQAHEYTYIKVHNPLHRKNDL

SEQ ID NO: 3262 - protein, 123 aa, Staphylococcus epidermidis
LMGYRKLGRTSDQRKAMLRDLATSLIVSERIETTEARAKEVRSVVEKLITLGKKGDLASRRNAAKTLRNVEILNEDDSTQTALQKLFGEIAERYSERQGGYTRILKVGPRRGDGAESVIIELV

SEQ ID NO: 3263 - protein, 192 aa, Staphylococcus epidermidis
EASQNVVLQKKTEEVDGYNAIQVGFEDKQAYKKGSKSNKYANKPAEGHAKKADTAPKRFIREFRNVNVDEYEVGQEVSVDTFETGDIIDVTGVSKGKGFQGAIKRHGQGRGPMAHGSHFHRAPGSVGMASDASKVFKGQKMPGRMGGNTVTVQNLEVVQVDTENSVILVKGNVPGPKKGLVEITTSIKKGNK

SEQ ID NO: 3264 - protein, 123 aa, Staphylococcus epidermidis
RMIQQETRLKVADNSGAREVLTIKVLGGSGRKTANIGDIIVCTVKNATPGGVVKKGDVVKAVVVRTKSGVRREDGSYIKFDENACVIIRDDKGPRGTRIFGPVARELREGNFMKIVSLAPEVL

SEQ ID NO: 3265 - protein, 109 aa, Staphylococcus epidermidis
GGAHMHIKKGDNVKVIAGKDKGKEGKVVATEPKKDRVVVEGVNVVKKHQKPTQLNPEGGILETEAAIHVSNVQLLDPKTNEPTRVGYKTVDGKKVRIAKKSGEEIKANN

SEQ ID NO: 3266 - protein, 60 aa, Staphylococcus epidermidis
VMAKLQITLTRSVIGRPETQRKTVEALGLKKTNSSVVVEDNPAIRGQINKVKHLLTIEEK

SEQ ID NO: 3267 - protein, 73 aa, Staphylococcus epidermidis
SMAKQDVIELEGTVLDTLPNAMFKVELENGHEILAHVSGKIRMNYIRILPGDKVTVKMSPYDLSRGRITYRYK

SEQ ID NO: 3268 - protein, 66 aa, Staphylococcus epidermidis
KEANKVAKTSMVAKQQKKQKFAVREYTRCERCGRPHSVYRKFKLCRICFRELAYKGQIPGVRKASW

SEQ ID NO: 3269 - protein, 194 aa, Staphylococcus epidermidis
LMYNLKLTFAKEVTCEVKRLKNFILGLLIVAIVGFLLFMYIDDSRIQSYQDYFLQFNWFQPLLIGLAGLLILIGLILVLSIFKPTHRKPGLYKNFDDGHIYVSRKAVEKTIYDTIAKYDQVRQPNVVSKLYNKKNKSFIDIKADFFVPNHVQVKSLTESIRADIKSNVEHFTEIPVRKLEVNVRDQKTSGPRVL

SEQ ID NO: 3270 - protein, 174 aa, Staphylococcus epidermidis
FKNKGECIMAVDNNKAKQAYDNQTGVNEQERKEQQQAQNNQPQFENKLTFSDEVVEKIAGIAAREVKGILDMKGGFTDSFTNAFSNGNNVTTGVSVEVGEKQAAVDLKVILEYGESAPKIFRKVTDLVKEQVKYITGLEVVEVNMQVDDVMTKKEWQQKNEKDNKENNEREGLK

SEQ ID NO: 3271 - protein, 256 aa, Staphylococcus epidermidis
EVNKSMNKYDRLDEITKLVNKRGSVRTNEIVEDLNVSDMTVRRDLAELEEKGVLTKIHGGARSNSAFQYKEMSHQEKHTRFIEEKRFIAKNAVDLIEDGDTIFLGPGTTVQKLAEEINHYSLTIITNCLPVFNILIKKQTLHFRVYLLGGEMRDLTEAFVGEMTNQLLSQLRFSKMFFSSNGVKDGLAMTSSIEEAYTQQIALSHSLEKYLLIDSSKIGKDDFSSFCELRELNAVLTDNNDLEKKEKIESYVEVIS

SEQ ID NO: 3272 - protein, 168 aa, Staphylococcus epidermidis
FRCKDLKALFQKHMCLITLIQKRRLIMTIIIGSDVDGKRLKELIKDYLEDNDYDVLDVTEGKDLDFVDSTVSVAKEVQKSDDNLGIAIDAYGAGSFIVATKIKGMIAAEVSDERSAYMTRSHNNARMITMGAEIVGDTLAKNVAKEFVNGHYDGGRHQIRVDMLNKMC

SEQ ID NO: 3273 - protein, 290 aa, Staphylococcus epidermidis
YTVNLNYCRMFSDIKILGVVDVNGSNPIIEFKDVSFQYQSDAAFTLNRVSFSIPAGQWTSIVGHNGSGKSTIAKLMVGIEEPSEGQILFQNLPVDSQNKREVRKHIGIVFQNPDNQFVGSIVKFDVAFGLENQLVPYKEMVSKVNQVLTEVDMINKADDEPHSLSGGQKQRVAIAGVLALNPDVLILDEATTMLDPHGKSSLLNLVNEVKVNNHVTIISITHDLDEAMHADQIIVLNKGTVFKQGTPQDIFKCEDALISVGLDLPFPLKMNRLLGFDSTYVTYEGLIKKL

SEQ ID NO: 3274 - protein, 326 aa, Staphylococcus epidermidis
FMTKSQQKVSSIEKLSNQEGIISALAFDQRGALKRMMAEHQSETPTVEQIEQLKVLVSEELTKYASSILLDPEYGLPASDARNNDCGLLLAYEKTGYDVNAKGRLPDCLVEWSAKRLKEQGANAVKFLLYYDVDDTEEINIQKKAYIERIGSECVAEDIPFFLEVLTYDDNIPDNKSAEFAKVKPRKVNEAMKLFSEDRFNVDVLKVEVPVNMNFVEGFSEGEVVYTKEEAAQHFRDQDAATHLPYIYLSAGVSAELFQDTLKFAHDSGAQFNGVLCGRATWSGAVKVYIEEGEQAAREWLRTVGFKNIDDLNTVLKTTATSWKNK

SEQ ID NO: 3275 - protein, 591 aa, Staphylococcus epidermidis
IIQKRELTPMNKLIAWIEKGKPFFEKISRNIYLRAIRDGFIAAIPIILFSSIFILITYVPNVFGFTWSKTMEGILMKPYNYTMGIVGLLVAGTTAKSLTDSYNRKLDKANQINFISTMMAAICGFLFLAADPVKDGGFSSAFMGTKGLLTAFISAFITVIVYNFFVKRNITIKMPKEVPPNISQVFKDIFPLSAVILILYALDLLSRAIVHTNVANAVLKVFEPLFTAADGWIGVTLIFGAFAFFWFVGIHGPSIVEPAIAAITYANLETNLHLIQAGEHADKVITPGTQMFVATMGGTGATLVVPFMFMWLTKSKRNKAIGRASVVPTFFGVNEPILFGAPLVLNPVFFIPFIFAPIVNIWIFKFFVDVLNMNSFSIFLPWTTPGPLGIVMGTGFAFWSFVLAILLIVVDVIIYYPFLKVYDEQVLEEELGNKEANNELKEKVSANFDTKKADAILATAGASEADTDDTSSVDETTSTSSTDTISEQTNVLVLCAGGGTSGLLANALNKAAEEYEVPVKAAAGGYGAHMDIMKDYQLIILAPQVASNFEDIKQDTDRLGIKLAKTEGAQYIKLTRDGEAALEFVKQQFNN

SEQ ID NO: 3276 - protein, 134 aa, Staphylococcus epidermidis
RRQNLMARKQVSRKRRVKKNIENGVAHIRSTFNNTIVTITDEFGNALSWSSAGALGFKGSKKSTPFAAQMASETASKTAMEHGLKTVEVTVKGPGPGRESAIRALQSAGLEVTAIKDVTPVPHNGCRPPKRRLV

SEQ ID NO: 3277 - protein, 248 aa, Staphylococcus epidermidis
KQMKKPDIQQLKDIVNNSNQIVFFTGAGVSVASGIPDFRSMGGLYDEISKDGQSPEYLLSIDHLHDNKESFINFYHERLLIADKKPNIVHQWIAQLENQQKSLGVITQNIDGLHEDAGSHNIDELHGTLNRFYCINCYEEYSKSYVMTHHLKYCEKCGNVIRPDIVLYGEMLNQKTVFKALDKIQHADTLIVLGSSLVVQPAAGFVSEFKGDNLVIINRDATPYDHTASLVIHDDMTNVIEEILNSNS

SEQ ID NO: 3278 - protein, 354 aa, Staphylococcus epidermidis
CMANVRVNLSKIKYNAKVLQSLLERRHIHFTPVIKCVAGDKRIVSSIKSLGITHFAESRLDNIEQLKDLDITFTLLRPTVEADLEKMISRVEMSIQTELTTIKKLNTLAKSLDIKHQIMLMVDWKDGREGVLTYDVVRYVQEVLRLSHIQLVGLAFNFMCFKSEAPNEKDVRMINKFIHNVENETHFKFRIISGGNSSMLPQTLYNHLDKINDLRIGEALLRGIDTTTNHSINSLYQNAIVLEAEIIEIKPRLYQKNNQSYLQAIVDIGYLDTFIEGIKPLGNDIRILGASSDHLMIDLNNQDHYQIGDKLQFSLNYEALSQSMYMKNLTKLYSSDSKIESLVQNFDMHIYSQC

SEQ ID NO: 3279 - protein, 78 aa, Staphylococcus epidermidis
NVKNWVVKQMKAKEIRDLTTSEIEEQIKSSKEELFNLRFQLATGQLEETARIRTVRKTIARLKTVAREREIEQSKANQ

SEQ ID NO: 3280 - protein, 150 aa, Staphylococcus epidermidis
GGAEMKLHELKAAEGSRRVRNRVGRGAATGNGKTSGRGQKGQKARSGGKVRPGFEGGQLPLFRRLPKRGFTNINRKEYAIVNLDQLNKFEDGTEVTPALLVESGVVKNEKSGIKVLGNGSLDKKLTVKAHKFSASAAEAIDAKGGAHEVI

SEQ ID NO: 3281 - protein, 128 aa, Staphylococcus epidermidis
HSKERSIEMISKIDKNKVRLKRRARVRTKLSGTAEKPRLNVYRSNKHIYAQIIDDVKGVTLAQASSQDKDIANTSASKVDLATTVGQAIAKKANDKGIKEIVFDRGGYLYHGRVKALADAARENGLEF

SEQ ID NO: 3282 - protein, 94 aa, Staphylococcus epidermidis
LKEEVTKVSERNDRKVYVGRVVSDKMDKTITVLVETYKTHKLYGKRVKYSKKYKTHDENNSAKLGDIVKIQETRPLSATKRFRLVEIVEESVII

SEQ ID NO: 3283 - protein, 123 aa, Staphylococcus epidermidis
VEEEILMEAKAVARTIRIAPRKVRLVLDLIRGKNAGEAIAILKLTNKASSPVIEKVLMSALANAEHNYDMNTDELVVKEAYANEGPTLKRFRPRAQGRASAINKRTSHITIVVSDGKEEAKEA

SEQ ID NO: 3284 - protein, 615 aa, Staphylococcus epidermidis
LHLLLWELALSVFHSFFISYNVFRIWRRAIMNHKEWLLADKNIQYRTINAMIKEHIVSEGMRIKEGTCKVEIFLNNHLLSLKVARKSALKRYVFTGDIVLKNKKLSQSIESLEELLQILTEIFHINISKRLYDELIHSRDSLYETYKHFYNRQTLIHQSMKFSKLPDSINFIAWLQHLQDSGITDDLSYSESLVIEGHPTHPLTKTKLPLSTNELKLYAPEFEKVIPLNIMLIEKNHVVTTAINDDQNFILNQVIPEYRDRLKCYLEPLRLNLNDYRVMLIHPWQYDHTIGEQFEEWIAKKILLPTPFTVESKATLSFRTMDLIHTPYHVKLPVNVQATSAVRTVSSVTTVDGPKLSHALQGLLQEFPELQVAMEPYGAYAHTASDLSKQLALIIRQKPTIYDYGCTVVTASLVNPNPIDNQAVVDSYLKWIENEITLDHIKHFIAIYTQTLVTPLIAYIQNYGIALEAHMQNTIVNLGPNYKMKFIVRDLGGSRIDLNTLKQKVPQIDVTNESLIADTIEEVIAKFQHAVIQNQLAELIHHFNQYDEVIEEELFEIVREEIEMAIDNDKPHAEKLKKILFGSTITVKALLSMRMENKVKKYLNTKLDNPIKKEV

SEQ ID NO: 3285 - protein, 112 aa, Staphylococcus epidermidis
KLIWVCGVKLHAHNKKGGAQMARSIKKGPFVDDHLMKKVEAQDGSEKKQVIKTWSRRSTIFPNFIGHTFAVYDGRKHVPVYVTEDMVGHKLGEFAPTRTFKGHAADDKKTRR

SEQ ID NO: 3286 - protein, 440 aa, Staphylococcus epidermidis
CKRWSTRGDLMFQTFVRFFTTKEVRNKIFFTLAMLVIFKIGTYIPAPGVNPEAFNHPQGSQGATELLNTFGGGALKRFSIFAMGIMPYITASIVMQLLQMDIVPKFTEWAKQGEMGRRKINNVTRYFAIILAFIQSIGMAFQFNNYLKGQLIIEKSVMSYLLIAVVLTAGTAFLIWLGDQITQFGVGNGISLIIFAGILSTLPSSLEQFAQSVFVGQDDTSLAWLKILGLIVALILLTVGAIFVLEAKRKIPIQYAKKQSAQRLGSQATYLPLKVNSAGVIPVIFAMAFFLLPRTLTLFFPKAEWAQNIADTANPSSNIGMIIYVVLIIAFAYFYAFVQVNPEKMADNLKKQGSYVPGIRPGEQTKKYITKVLYRLTFVGSIFLAAIAILPIIATKFMGLPQSIQIGGTSLLIVIGVAIETMKTLEAQVTQKEYKGFGGR

SEQ ID NO: 3287 - protein, 96 aa, Staphylococcus epidermidis
GGARIMEARDVLKRPVITEKSSEAMAEDKYTFDVDTRANKTQVKIAVEEIFDVKVDSVNIINYKPKKKRMGRYQGYTNKRRKAIVKLKEGSIDLFN

SEQ ID NO: 3288 - protein, 121 aa, Staphylococcus epidermidis
KQQLHHGKTNNVREDIQMNRDEVQLLGFEIVAYAGDARSKLLEALNAAKDSEFDKAEQLVEEANECIANAHKAQTNLLAQEAKGEDIAYSITMIHGQDHLMTTLLLKDLMKHLIELYKKGS

SEQ ID NO: 3289 - protein, 222 aa, Staphylococcus epidermidis
IICRRAFMNIILMGLPGAGKGTQASEIVKKFPIPHISTGDMFRKAIKDETDLGKEAKSYMDRGELVPDEVTVGIVKERISEDDAKKGFLLDGFPRTIDQAESLNQIMSELDREIDAVINIEVPEEELMNRLTGRRICEKCGTTYHLVFNPPKVDGICDIDGGKLYQREDDNPETVSNRLSVNVKQSKPILEYYNNKGVLKNIDGSKDIDEVTNDVIDILDHL

SEQ ID NO: 3290 - protein, 275 aa, Staphylococcus epidermidis
SCIRSGIMKNKLIIGRYLPMQSIIHQLDPRAKLIFVFFFIILIFFCHSLGTYAWLFLFIILFIKLARIPFWFLIKGLTPIFFFLVFTFSMHVLFTNGGIVLFQWKFITIESSGVMEGIYISLRLIFIVMIATIMTLSTSPIDLTDAFEKLFAPLKVIKVPVHQLSMMMSIALRFIPTLMDELEKIILAQKSRGSEISSGSLITRIRAFIPIMIPLFISAFQRAEELAIAMEVRGYDINIKRTSYRLLHWQYKDTLTVLLLIPIATILFILKFSGV

SEQ ID NO: 3291 - protein, 140 aa, Staphylococcus epidermidis
ESERRQQSMTMTDPIADMLTRVRNANMVRHEKLELPASNIKKEIAEILKSEGFIKNVEYVEDDKQGVIRLFLKYGQNNERVITGLKRISKPGLRVYAKANEVPKVLNGLGIALVSTSEGVITDKEARKRNVGGEIIAYVW

SEQ ID NO: 3292 - protein, 288 aa, Staphylococcus epidermidis
KIMSIQFNQVSYIYQQGTPYEFEAIKNVSLTLEQGKYYAIIGQTGSGKSTLIQHLNALLKPTTGSVNINGLEVTNKTKDKHLRHIRKEVGVVFQFPESQLFEDSVEKEIEFGPKNFNMNLKNVKDKAFQLLLELGFSRNVMSSSPFQMSGGQMRKIAIVSILAMDPQVIILDEPTAGLDPNSKHQVMSLIKKIQIEENKTIILVSHDMDDVARYSDEVVVMNKGTIVEKSNPRNLFNQKTQLLKWHIELPKVVKLQKDIEKKYNMLFPKLATNEEEFVKLYKEWHHEE

SEQ ID NO: 3293 - protein, 185 aa, Staphylococcus epidermidis
IIRRCHNMSRVGKKIIDIPSDVTVTFDGSHVTVKGPKGELERTLNERMTFKQEENTVEVVRPSDSKEDRTDHGTTRALLNNMVLGVSQGYEKTLELVGVGYRAQMQGKDLVLNVGYSHPVEIKAEEGITFAVEKNTTVKVSGVSKEQVGAIASNIRSVRPPEPYKGKGIRYQGEYVRRKEGKTGK

SEQ ID NO: 3294 - protein, 348 aa, Staphylococcus epidermidis
MKRRCVFMRLSLLDYVPLFEGRTPNDALKHSIKLAQHAEKLGYLRYWVAEHHQVYSVVSSAPEIIMMSILEHTQHIRVGSGGVMLPHYSPYKVAEQFKIMEARHPQRIDMAIGRSPSFKNVNAALNENKNEKLPFNTQITDLLKYFNNDTTQDHRFKSLLATPMVTSFPQLYILGMSNRSAKLAAQRGLPFVIARMGQSETDLHEAISTYRKYFKAYHGEINNAKPYVILATFVVTASNLSRVKQLLHTLQLWLMRINYLNQPKSYPSIETAQNKHYSQRELEKLEKMKSKIIYGMPNDVAEQLTLLHQQFKVDEIIILPHVFGEDARMELIELIANELIPSCSRDEF

SEQ ID NO: 3295 - protein, 215 aa, Staphylococcus epidermidis
KAKGGNCIMANYDVLKVDGSKSGSVELNDAVFAIEPNNSVLFEAINLQRASLRQGTHAVKNRSAVRGGGRKPWRQKGTGRARQGTIRAPQWRGGGVVFGPTPRSYAYKMPKKMRRLALRSALSFKVQENSFTIVDTFGFEAPKTKEFKNVLTTLEQPKKVLVVTESEDVNVELSARNIPGVQVTTAQGLNVLDLTSADSVIITEAAAKKVEEVLA

SEQ ID NO: 3296 - protein, 185 aa, Staphylococcus epidermidis
LKGGSTLNRLKEKFNTEVTENLVKKFNYSSVMEVPKIEKIVVNMGVGDAVQNSKVLDNAVEELELITGQKPLVTKAKKSVATFRLREGMPIGAKVTLRGERMYEFLDKLIAVSLPRVRDFQGVSKTAFDGRGNYTLGVKEQLIFPEIDYDKVTKVRGMDIVIVTTANTDEEARELLTNFGMPFRK

SEQ ID NO: 3297 - protein, 268 aa, Staphylococcus epidermidis
ILRILVEIAYQGNQFLGFQIQQQGRTVQQQFEKILKRMHKHHVRIHPSSRTDRGVHAYQQFFHFDTELNIDNKQWQYAMNRALPDDIYVKNVRNVDEYFHCRYDCVGKRYRYKVYQGNHRNPFKSGTETFVYETLDYDKMNKAAQEFIGTHDFTGFCSQKTEVESKVRTLYQSEIVATKEGFDYVVTGSGFLYNMVRVLVAFLIEVGKGKHEPNDVPKLLEDKNRNNVPLTAPPDGLYLEKIYLSPEELIQEYGKDIKIHYKKSLEKH

SEQ ID NO: 3298 - protein, 347 aa, Staphylococcus epidermidis
HNSINYYYKDDDDMNNEQIVFNKVPDGMPQDDTFKYEDIDVIEPSENELQLKTLYISVDPYMRGRMTNADSYIDPFKQGEPFNGHTVSKVLKSKDSNFDEGDIVVGMLPWRKINTVNSEYVNKVPTSDVPLHLYLSVLGMPGQTAYHGLLDIGQPKEGETVVISAASGAVGSVVGQIAKLKGCRVVGIAGGDKKVNYLKNELRFDAGIDYKKDNFPEALKEAVPNGIDVYFENVGGYIGDEVFKHLNTHARIPVCGAISSYNHPEKDIGPRIQQTLIKNQAMMRGFIVAEFADGFKEASKQLAQWVQENKIKTQVSVEDGFDKVPQAFRNLLTGDNFGKQVIKVASE

SEQ ID NO: 3299 - protein, 411 aa, Staphylococcus epidermidis
SILMIMIIIINEKDRWNLMAKYFFSSSFLLFLGNWIGQVGLNWFVLTTYHNAVYLGLVNFCRLIPILLLSVWAGSIADKYDKGLLLRITITSSFIITALLCLLTYSLNSIPIFIILLYATFRGILSAVETPVRQAVLPDLSSKISTTQAVSFHSFIINICRSIGPAIAGGLIAVYHTPTTFLAQAVCYFIAAVLCIPIHFEVILSQKEGKALPLKVVLNYFKSNLEGSQIFITSIIIMATGFSYTTVLPVLTNHIFPGQSQVFGIAMTFCAIGGIVATIVLPSILKHLSTVKMYYLSSILFGIALLGIIIHHLVVMFICITLIGLFSQWARTTNRVYFQHSVKDCDRGKVLSIIMMDRGMIPLGSLIMSFFADMFGILTTFTIMGISTISISLIFYIIQRISNMEESNNES

SEQ ID NO: 3300 - protein, 179 aa, Staphylococcus epidermidis
NVLIGGIKMKIAIGCDHIVTDTKMEVSQHLKSQGHEVIDVGTYDFTRTHYPIYGKKVGEKVASGEADLGVCICGTGVGISNAANKVPGVRTALVRDMTSALYSKEELNANVVSFGGKVAGELFIFDIVDAFIEAEYKPTEENKKLIAKINHLEAHNNDQADPHFFDEFLEKWNKGEYHD

SEQ ID NO: 3301 - protein, 292 aa, Staphylococcus epidermidis
RGLMMKSKFTILLFTIFSTTVLVLVIIYNKTQSQSYISTHYSNNKIKTTATLFLHGYGGSERSETFMVKQALNKNVTNEVITARVSSEGKVYFDKKLSEDAANPIVKVEFKDNKTGNFKENAYWIKEVLSQLKSQFGIQQFNFVGHSMGNISFAFYMKNYGDDRHLPQLKKEVNIAGVYNGILNMNENVNEIIVDKQGKPSRMNAAYRQLLSLYKIYCGKEIEVLNIYGDLEDGSHSDGRVSNSSSQSLQYLLRGSTKSYQEMKFKGAKAQHSQLHENKDVANEIIQFLWET

SEQ ID NO: 3302 - protein, 191 aa, Staphylococcus epidermidis
RYKILDEAKDLNDFLGINYYMSDWMRGFEGESEITHNATGDKGGSKYQLKGVGQREFDVDVPRTDWDWMIYPQGLYDQIMRVVKDYPNYHKIYITENGLGYKDVFDEKEKTVHDDARIDYIKQHLSVIADAIADGANVKGYFLWSLMDVFSWSNGYEKRYGLFYVDFETQERFPKKSAYWYKELAESKEIK

SEQ ID NO: 3303 - protein, 149 aa, Staphylococcus epidermidis
RRKIIMLLPKRVKYRRQHRPKTTGRSKGGNYVTFGEYGLQATTTSWITSRQIESARIAMTRYMKRGGKVWIKIFPHTPYTKKPLEVRMGAGKGAVEGWIAVVKPGRILFEVAGVPEEVAREALRLASHKLPVKSKFVKREELGGETNES

SEQ ID NO: 3304 - protein, 255 aa, Staphylococcus epidermidis
MIEIEKPRIETIEVSEDAKFGKFVVEPLERGYGTTLGNSLRRILLSSLPGAAVKYIEIEGVLHEFSAVDNVVEDVSTIIMNIKKLALKIYSEEDKTLEIDVKDEGEVTASDITHDSDVEILNPELKIATVSKGGHLKVRLVANKGRGYALAEQNNTSDLPIGVIPVDSLYSPVERVNYTVENTRVGQSSDFDKLTLDVWTNGSITPQESVSLAAKIMTEHLNIFVSLTDEAQNAEIMIEKEEDQKEKVIEISMEE

SEQ ID NO: 3305 - protein, 135 aa, Staphylococcus epidermidis
KEEITLAQVEYKGTGRRKNSVARVRLVPGEGNITVNERDVRDYLPFESLILDLNQPFDVTETKGNYDVLVNVHGGGFTGQAQAIRHGIARALLEADPEYRGSLKRAGLLTRDPRMKERKKPGLKKARRSPQFSKR

SEQ ID NO: 3306 - protein, 288 aa, Staphylococcus epidermidis
KGVLYMTKKLPDDFIFGGATAAYQAEGATQTDGKGRVAWDTYLEENYWYTAEPASDFYNRYPVDLELSERFGVNGIRISIAWSRIFPKGYGEVNQKGVEYYHNLFKECHKRHVEPFVTLHHFDTPEVLHKDGDFLNRKTIDYFVDYAEFCFKEFPEVKYWTTFNEIGPIGDGQYLVGKFPPGIKYDFEKVFQSHHNMMVAHARAVKLFKDENYKGEIGVVHALPTKYPYDPSNPEDVRAAELEDIIHNKFILDATYLGKYSRETMEGVQHILSVNGGQLEISDEDTKF

SEQ ID NO: 3307 - protein, 506 aa, Staphylococcus epidermidis
IDKSKFKGEKFMSEEMNDQMQVRRQKLQELIDLGIDPFGHRFNRSSTSSELKEQWDQFSKEELHEKEDESHVSIAGRLMTKRGKGKAGFAHIQDLKGQIQIYVRKDQVGDDQFNIWKMADLGDIIGVEGVMFKTNTGEISVKAKSFTLLSKSLRPLPDKFHGLQDIEQRYRQRYLDLITNEDSTQTFINRSKIIQEMRNYLNKQGFLEVETPMMHQIAGGAAARPFVTHHNALDATLYMRIAIELHLKRLIVGGLEKVYEIGRVFRNEGVSTRHNPEFTMIELYEAYADYHDIMDLTENMVRHIAQEVFGSAKVQYNDEEIDLESSWKRLHIVDAVKEVTGVDFYNVNSDEEAIRLAKEHDIEITENMKYGHILNEFFEQKVEETLIQPTFIYGHPIEISPLAKKNPNDERFTDRFELFIVGREHANAFTELNDPIDQRQRFEAQLVEKEQGNDEAHDMDEDYIEALEYGMPPTGGLGIGIDRLVMLLTDSPSIRDVLLFPYMRQK

SEQ ID NO: 3308 - protein, 64 aa, Staphylococcus epidermidis
RTRSSDFNGNVAKAGTDIKENDELIIRFGQKLVTVKVTGLSDHATKENAKGMYDLIKEERINEE

SEQ ID NO: 3309 - protein, 99 aa, Staphylococcus epidermidis; identical to SEQ ID NO: 3070

SEQ ID NO: 3310 - protein, 269 aa, Staphylococcus epidermidis
FKMPNVVGVQFQKAGKLEYYAPNQLDVKVGDWVVVQSKRGIEIGHVKFPLREVDVEDVTLPLKNIIRKMNEDDQETYYRNERDANDALELCKKVVKDQQLDMRLVNCEYTLDKSKVIFNFTADDRIDFRKLVKVLAQNLKTRIELRQIGVRDEAKLLGGIGPCGRSLCCSTFLGDFEPVSIKMAKDQNLSLNPTKISGACGRLMCCLKYENDYYEEARTQLPDVGDMIQTPDGHGKVIGLNILDISMQVKIEGLEQPLEYKMEEIEVLN

SEQ ID NO: 3311 - protein, 204 aa, Staphylococcus epidermidis
EMSTFITFEGPEGAGKTSVIKKVSERLAKEYDIVTTREPGGVLTSEEIRRIVLDGDSIDIRTEAMLFAASRREHLVEKIIPSLQAGKIVLCDRYIDSSLAYQGYARGIGIKEVKLLNEFAINGLYPDLTIYLDVDAEIGRQRILKNNREQNRLDKEEKAFHEKVIEGYQKVISDNPHRFIKVNANHSLDKVVEETYQSIIKYLK

SEQ ID NO: 3312 - protein, 106 aa, Staphylococcus epidermidis
GSLTARPTSRAGSKDGLSDPVVPHGRAIAQRIKATPGITGLSPPRVHIDGEVWHLDVGSSHPGAVICPKGWAVRPLKRYASWVQNVVRTVRSLSVVGVGKFERSCP

SEQ ID NO: 3313 - protein, 198 aa, Staphylococcus epidermidis
RPTASISSIKMIHGAFFLAFSNKSRTRLAPTPTNISTKSDPLIEKNGAPASPATARANNVLPVPGGPTSKTPFGILEPICLNFLLSFKKSTISINSCFSSSAPATSEKRTRRLLLSYILALDFPKFIIRPPPPPPWAWLRKKINNNAMINTGISVVKILTNTLCFSSSLTVNLRLSCFLAVSVIFCKSFSLLYKIVDE

SEQ ID NO: 3314 - protein, 159 aa, Staphylococcus epidermidis
MVKAYLGLGSNIGNRELQLNEAIKILHDYQGIQVTQVSHIYETEPVGYTNQPKFLNLCIEIETELNPQSLLKCCLTTEQQLHRKREIRWGPRTLDIDILLFGDQIIEQDNLSVPHPRMKERSFVLIPLNDIATKQIEPISNKSIGQLVVPDNSVKKYKE

SEQ ID NO: 3315 - protein, 69 aa, Staphylococcus epidermidis
FINLLFHVFLLKTLGAIYCFLISFNLYLSLLLYPSYLHMYCYSMKVDIASNQSKSTHFIILQDHQNVIK

SEQ ID NO: 3316 - protein, 461 aa, Staphylococcus epidermidis
SVNFNGGLAFMQRHAIILAAGKGTRMKSKKYKVLHEVAGKPMVEHVLNNVKQAGVDQIVTIIGHGAESVKDTLGNQSLYSFQDKQLGTAHAVKMAHEHLADKEGTTLVVCGDTPLITYQTLQSLIEHHESTQSHVTVLSASTINPYGYGRIIRNHNGILERIVEEKDANDSERAIKEISSGIFAFNNRVLFEKLEQVKNDNAQGEYYLPDVLSLILKDGGKAEVYCTEDFDEIIGVNDRLMLSEAEKALQQRINRYHMENGVTIIDPSSTFIGTDVKIGIDTTIEPGVRIGGHTTIEEDVWIGQYSEINNSTIHSNANIKQSVINDSIVGENTTVGPFAQLRPGSNLGSEVKVGNFVEVKKADIKDGAKVSHLSYIGDAEIGERTNIGCGSITVNYDGANKFKTIVGKDAFIGCNTNLIAPVTVGNHTLIAAGSTITDNIPEDSLALARARQVNKEGYLKK

SEQ ID NO: 3317 - protein, 298 aa, Staphylococcus epidermidis
KGDLTMTHDYIVRGLAYGGEIRAYAAITTESVQEAQTRHYTWPTASAAMGRTMTATVMMGAMLKGNQKLTVTVDGKGPIGRIIADADAQGNVRAYVDHPQTHFPLNDQGKLDVRRAVGTDGSIQVVKDVGMKDYFSGASPIVSGELGDDFTYYYATSEQTPSSVGLGVLVNPDNSIKAAGGFIIQVMPGATDETVTKLEEAISQMQPVSKLIEQGLTPEGILNEILGEGNVQILNSTSAQFECNCSHEKFLNAIKGLGEAEIHSMIKEDHGAEAVCHFCGNKYQYSESELEDLLETMK

SEQ ID NO: 3318 - protein, 181 aa, Staphylococcus epidermidis
IIMHKDLKNVLLSEEDIQNICKEMGAIITEDYKDRPLVCVGILKGSVMFMADLIKRIDTHLSIDFMDVSSYHGGTESTGEVQILKDLGASIENKDVLIIEDILETGTTLKSITELLQSRKVNSLEIATLLDKPNRRKADIEAKYVGKKIPDEFVVGYGLDYRELYRNLPYIGTLKAEVYSK

SEQ ID NO: 3319 - protein, 138 aa, Staphylococcus epidermidis
SQFNIHVTDEWIIQIAYDKLIIMAKSEMDQYILDRICIRKPGTYEFNDYQIDIHPDLPQQLYPLTVRVRQNGDVYKLNGQKGHKKVSRLFIDKKVTLAERQRIPLIINQENAVLAIGDLYVKENFKEFILISNNGDEL

SEQ ID NO: 3320 - protein, 296 aa, Staphylococcus epidermidis
MEYKDIATPSRTRALLDQYGFNFKKSLGQNFLIDVNIINKIIEASHIDCTTGVIEVGPGMGSLTEQLAKNAKKVMAFEIDQRLIPVLKDTLSPYDNVTIINEDILKADIAKAVDTHLQDCDKIMVVANLPYYITTPILLNLMQQDVPIDGFVVMMQKEVGERLNAQVGTKAYGSLSIVAQYYTETSKVLTVPKTVFMPPPNVDSIVVKLMQRQEPLVQVDDEEGFFKLAKAAFAQRRKTINNNYQNFFKDGKKNKETIRQWLESAGIDPKRRGETLTIQDFATLYEQKKKFSELTN

SEQ ID NO: 3321 - protein, 321 aa, Staphylococcus epidermidis
MLNNEYKNSSMKIFSLKGNEPLAQEVADHVGIELGKCSVKRFSDGEIQINIEESIRGCDVFIVQPTSYPVNLHLMELLIMIDACKRASAANINIVVPYYGYARQDRKARSREPITAKLVANLIETAGANRMIALDLHAPQIQGFFDIPIDHLMGVPILAQHFENDPDINPEECVVVSPDHGGVTRARKLADILKTPIAIIDKRRPKPNVAEVMNIVGDIEGRTAIIIDDIIDTAGTITLAAQALKDKGAKEVYACCTHPVLSGPAKERIENSAIKQLIVTNSIQLEENRKPNNTKELSVAGLIAKAIIRVYERESVSVLFD

SEQ ID NO: 3322 - protein, 118 aa, Staphylococcus epidermidis
YNDKKRCIKMKMIIAIVQDQDSQELSDQLVKNNFRATKLATTGGFLRAGNTTFLCGVKDDRVDEVLSVIDNTCGNRDQLVSPITPMGGSADSYIPYPVEVEVGGATVFVMPIEAFHQF

SEQ ID NO: 3323 - protein, 293 aa, Staphylococcus epidermidis
MNIKTDGWSKKAHIVVAVSTGIDSMSLLYSLLNDYQHTYRKLTCVHVNHGLREQSYEEEAFLREYCHQHHIDIYIKRLDLSDIVADGNSIQQEARQRRYEWFGDIIAQLRADVLLTAHHLDDQLETIIYRLFTGRSTRNSLGMTYESYFNQYKVYRPMLNLKKTEILAYQYANQIPYYEDMSNQDRKYVRNDIRQRIIPAINENPHLNAHQLLKLKDWHDIELQSLKEQAETFINNEVSKSKYLTYSFSRTAFNELNVNIKSVVMDLLFQKLDCHLAMPQHAYDECFEQIRNE

SEQ ID NO: 3324 - protein, 135 aa, Staphylococcus epidermidis
QAMNKKVEHIGNQYTSQENKKKQRQKMKMRVVRRRIALFGGILLAIILILLVLLVIQRHNNDQDAVERKEKETEFQKQQDEEIALKEKLNNLNDKDYIEKIARDDYYLSNKGEVIFRLPDDKKSSQSKTSNEKGN

SEQ ID NO: 3325 - protein, 125 aa, Staphylococcus epidermidis
RRMNMNDIIFLNGMRFYGYHGVLAAENDIGQIFVVDITLKVDLSYAGQSDDVKDTVNYGEVYKDVKSIVEGPRSCLIEHLAERIAKHINSHYNRVMETKVRITKENPPIPGHYDGVGIEIVREND

SEQ ID NO: 3326 - protein, 626 aa, Staphylococcus epidermidis
SQVKSMIANYISEDNRFQELDEVFGQENILVTGLSPSAKATIIAEKYLKDHKQMLLVTNNLYQADKIETDILQYVDDSEVYKYPVQDIMTEEFSTQSPQLMSERVRTLTALAQGEKGLFIVPLNGFKKWLTPVDLWKDHQMTLKVGQDIDVDAFLNKLVNMGYRRESVVSHIGEFSLRGGIIDIYPLIGTPVRIELFDTEVDSIRDFDVETQRSNDNINQVEITTASDYIITDEVIQHLQNELKKAYEYTRPKIEKSVRNDLKETYESFKLFESTFFDHQLLRRLVSFMYEKPSTLIDYFQKNAIIVVDEFNRIKETEETLTTEVEDFMSNLIESGNGFIGQGFMKYESFDALLEQHAVAYFTLFTSSMQVPLQHIIKFSCKPVQQFYGQYDIMRSEFQRYVHQDYTVVVLVETETKVERIQSMLNEMHIPTVSNIHEDIDGGQVVVTEGSLSEGFELPYMQLVVITERELFKTRQKKQRKRTKTISNAEKIKSYQDLNVGDYIVHVHHGVGRYLGVETLEVGDTHRDYIKLQYKGTDQLFVPVDQMDQVQKYVASEDKSPRLNKLGGTEWKKTKAKVQQSVEDIADELIDLYKAREMSVGYQYVLDTAEQSAFEHDFPYELTPDQ

SEQ ID NO: 3327 - protein, 701 aa, Staphylococcus epidermidis
RMQKAFRNVLVIAIIGVIIFGLFSFLNGNGNMPKQLTYTQFVNKLNKGDLKTLEIQPEQNVYMVSGKTKKDEDYSSTILYNNEKDLQKITDTAKKQDNLKFTVKEEEKQSVFVSILTTLIPVLIIALLFIFFLSQAQGGGGGGRMMNFGKSKAKMYDSNKRRVRFSDVAGADEEKQELIEIVDFLKDNKKFKQMGSRIPKGVLLVGPPGTGKTLLARAVAGEAGAPFFSISGSDFVEMFVGVGASRVRDLFENAKKNAPCIIFIDEIDAVGRQRGAGVGGGHDEREQTLNQLLVEMDGFGENEGIIMIAATNRPDILDPALLRPGRFDRQIQVGRPDVKGREAILHVHAKNKPLDETVDLKAISQRTPGFSGADLENLLNEASLIAAREGKNKIDMRDIEEATDRVIAGPAKKSRVISEKERNIVAHHEAGHTIIGMVLDEAEIVHKVTIVPRGQAGGYAMMLPKQDRFLMTEPELLDKICGLLGGRVSEDINFGEVSTGASNDFERATQIARSMVTEYGMSKKLGPLQFSSNSGGQVFLGKDMQGEPNYSGQIAYEIDKEVQRIVKEQYERCKQILLEHEEQLKLIAKTLLSEETLVAEQIQSLFYDGVLPEVDYDSAKVVKNENSDYSDGKYGKSYNDIRKEQLEDDDKEDDDNHEKDEVNQDNTDREADNTSHTNEPGHQQSPNIDKPYNPNDPNHRQ

SEQ ID NO: 3328 - protein, 242 aa, Staphylococcus epidermidis
WVSEEQVRRIQCLNLEIRKVEIRMASLKSIIRQGKQTRSDLKQLRNSGKVPAVVYGYGTKNTSVKVDEVEFIKVIREVGRNGVIDLGVGSKTIKVMVSDYQFDPLKNQITHIDFLAINMSEERTVEVQVQLVGEAVGAKEGGVVEQPLFNLEVTATPENIPETIEVDISELQVNDSLAVSDIKISGDFTIENNPEDSIVTVVPPTDEPSEEEVEAMEGESATEEPEVVGEDKEDDEEENKED

SEQ ID NO: 3329 - protein, 284 aa, Staphylococcus epidermidis
YRRDNMTTLYLVGTPIGNLGDITFRAIETLKKVDVIACEDTRVTRKLCNHYEIQTPLKSYHEHNKEQQTDYLIKQLQTGLNIALVSDAGLPLISDPGYELVVEARKNNINIETVPGPNAGLTALMSSGLPSFTYTFLGFLPRKEKEKIEVLEDRMFQNSTLILYESPYRVTDTLKAIAKIDSQRWITVGRELTKKFEQVLTLTVDDMLKLINHDKLPLKGEFVILIEGALPKSGESWFESYTVKEHVDYYIETKHVKPKKAIKFVATDRHMKTGDIYNIYHNID

SEQ ID NO: 3330 - protein, 319 aa, Staphylococcus epidermidis
IVKLKGVFWMAQKPVDYVTQIIGNTPVVKLRNVVDDDAADIYVKLEYQNPGGSVKDRIALAMIEKAEREGKIKPGDTIVEPTSGNTGIGLAFVCAAKGYKAVFTMPETMSQERRNLLKAYGAELVLTPGSEAMKGAIKKAKELKEEHGYFEPQQFENPANPEIHELTTGPELVEQFEGRQIDAFLAGVGTGGTLSGVGKVLKKEYPNVEIVAIEPEASPVLSGGEPGPHKLQGLGAGFVPDTLNTEVYDSIIKVGNDTAMDMARRVAREEGILAGISSGAAIYAAIQKAKELGKGKTVVTVLPSNGERYLSTPLYSFDN

SEQ ID NO: 3331 - protein, 116 aa, Staphylococcus epidermidis
PLNRNELFERLMKLEHHVEQLTTDMSELKDLTVELVEENVALQVENENLKRLMNKTEESVETHLDKDNYKHVKTPSPSKDNLAMLYREGFHICKGELFGKHRHGEDCLLCLNVLSD

SEQ ID NO: 3332 - protein, 62 aa, Staphylococcus epidermidis
QLKRITFGYYKNWTYSNGYSFNLNELCINNKRKLHNLMKMGINKDYNNKESEHIFNVQTHLK

SEQ ID NO: 3333 - protein, 288 aa, Staphylococcus epidermidis
SLLSKIIRIEGFEKMRYKRSERIVFMTQYFMNHPNKLIPLTYFVKKFKQAKSSISEDVQIIKNTFQNEKLGTIITTAGASGGVTYKPMMSKSEATEVVDEVIEQLQEKDRLLPGGYLFLSDLVGNPSLLNKVGKLIASIYMNEELDAVVTIATKGISLANAVANVLNLPVVVIRKDNKVTEGSTVSINYVSGSSRKIETMVLSKRTLAENSNVLVVDDFMRAGGSINGVMNLMNEFKAHVKGVSVLVESKEVKQRLIEDYTSLVRLSDVDEYNQEFKVEPGNSLSKFS

SEQ ID NO: 3334 - protein, 110 aa, Staphylococcus epidermidis
RYTRGAHYMKVTDVRLRKIQTDGRMKALVSITLDEAFVIHDLRVIEGNSGLFVAMPSKRTPDGEFRDIAHPINSDMRQEIQDAVMKVYDETDEVIPDKNATSDNEESDEA

SEQ ID NO: 3335 - protein, 68 aa, Staphylococcus epidermidis; identical to SEQ ID NO: 3076

SEQ ID NO: 3336 - protein, 265 aa, Staphylococcus epidermidis
YNLRIGEIMMLIDTHVHLNDEQYDEDLNEVISRAREAGVDRMCVVGFDTPTIERTMELIDKYDFIYGIIGWHPVDAIDCTDERLEWIESLSKHPKIIGIGEMGLDYHWDKSPSDVQKEVFKKQITLAKRVQLPIIIHNREATQDCIDILIEEHAEEVGGIMHSFSASPEIADVVINKLNFYVSLGGPVTFKNAKQPKEVAKHVPMDRLLCETDAPYLSPHPYRGKRNEPERVTLVAQQIADLRGMTYEEVCRQTTENAERLFNLN

SEQ ID NO: 3337 - protein, 94 aa, Staphylococcus epidermidis
CVVRWGNMPKSILDIKNSIDCHLGNRIVLKANGGRKKTIERSGVLKETYPSVFIVELDQDKHNFERVSYTYTDVLTENVQVSFEEDNHQEAVAH

SEQ ID NO: 3338 - protein, 535 aa, Staphylococcus epidermidis
HGKSKTMDRLLCGDVGYGKTEVAVRAAFKAVMDGKQVAFLVPTTILAQQHYETLLERMQDFPVEIQLVSRFRTAKEIRETKEGLKSGYVDIVVGTHKLLGKDIQYKDLGLLIVDEEQRFGVRHKERIKTLKKNVDVLTLTATPIPRTLHMSMLGVRDLSVIETPPENRFPVQTYVLEQNTNFIKEALERELSRDGQVFYLYNKVQSIYEKREQLQMLMPDANIAVAHGQMTERDLEETMLSFINHEYDILVTTTIIETGVDVPNANTLIIEEADRFGLSQLYQLRGRVGRSSRIGYAYFLHPANKVLNETAEERLQAIKEFTELGSGFKIAMRDLNIRGAGNLLGKQQHGFIDSVGFDLYSQMLEEAVNEKRGIKERSPDAPDIEVELHLDAYLPAEYIQSEQAKIEIYKKLRKVETEEQLFDVKDELIDRFNDYPIEVERLLDIVEIKVHALHAGVELIKDKGKSIQIILSPKATEDINGEELFKQTQPLGRAMKVGVQNNAMNVTLTKSKQWLDSLKFLVRCIEESMAIKDED

SEQ ID NO: 3339 - protein, 323 aa, Staphylococcus epidermidis
VVFLHNEYHKGSKSLMDEQQQLANAYHSNKLSHAYLFEGDDAQTMKRVAIHFTKLILCNNSNQCELKVDTFNHPDFSYVSSDENTIKKEQIEQLVHHMNQLPIEGQYKVYIIEDFEKLTVQGENSILKFLEEPPDNTIAILLSTKPEQILDTIHSRCQHVYFKPIDKRQFIERLVEMSIARPVAEMLSTYTTQIEAASSLNEEFDLVTLRKSIIRWCQLILSNKAMALIGVIELLKQAKNRKLQLLTLSAVNGFFEDIMHAKIEMDNYYTFSDLTEEIENYANQLTFNQLILMYDQITEAHKKLNQNVNPTLVFEQIVIKGVI

SEQ ID NO: 3340 - protein, 86 aa, Staphylococcus epidermidis
KVFIMDKHFVYIVKCNDGSLYTGYAKDVNARVIKHNNGKGAKYTKIRRPVELVYQETYTTKSEALKREYEIKTYTRQQKLKMIQEG

SEQ ID NO: 3341 - protein, 61 aa, Staphylococcus epidermidis
LVIIHLLLANMKSIAHTCLLSIITMRDDNNIFTKSLKMYWYKLYIKKSLFTQFIREQKETY

SEQ ID NO: 3342 - protein, 281 aa, Staphylococcus epidermidis
EYIIEKGEIMIKTKIMGILNVTPDSFSDGGQYHSVDQAVKRAKEMIDEGVDIIDVGGVSTRPGHKEVSHKEVSLKEEMNRVLPVVESIVKYDVQISVDTFRSEVAEACLKLGVSMINDQWAGLFDSNMFNVVSQYGAEIVLMHNGDGHRDKPVVEEMLVSLLAQANKAELAGIPHNKIWLDPGIGFAKTREEENEVMARLDELVATEYPVLLGTSRKRYIKEMMNQDSSPSDRDEATAATTAYGIMKGVRGVRVHNVLLNTRLAQSMDFLKENEYERHHLS

SEQ ID NO: 3343 - protein, 201 aa, Staphylococcus epidermidis
RYIILIVEVTIMKCIVGLGNIGKRFELTRHNIGFEVVDDILERHQFTLDKQKFKGAYTIERLNGEKVLFIEPMTMMNLSGQAVAPLMDYYNVDVEDLIVLYDDLDLEQGQVRLRQKGSAGGHNGMKSIIKMLGTDQFKRIRIGVGRPTNGMSVPDYVLQKFSKEEMIIMEKVIEHSARAVESFIESSRFDHVMNEFNGEVK

SEQ ID NO: 3344 - protein, 134 aa, Staphylococcus epidermidis
KMSIEVGNKLKGKITGIKKFGAFVELPEGKSGLVHISEVADNYVENVEDHLSVGDEVEVKVLSIADDGKISLSIKKAKDRPRKPRHSKANHGKPVQKTEDFEKKLSNFLKDSEDKLTSIKRQTESRRGGKSSRR

SEQ ID NO: 3345 - protein, 182 aa, Staphylococcus epidermidis
FMKINEFIVVEGKDDTERVKSAVDCDTIETNGSAIDTYTLEVIQHAQQTRGVIVLTDPDFPGDKIRNTIREHVSGVKHAYVDREKAKSKRGKIGIEHANIKDIQEALMHVSSPLEEAKETIDKSVLIDLGLIIGKDARYRRNILGRKLHIGHSNGKQLLKKLNAFGYTEDDVRKALFEEEEN

SEQ ID NO: 3346 - protein, 426 aa, Staphylococcus epidermidis
CIRIQRNKALTFWRQIISNEERKTVMTHTITIVGLGNYGIDELPLGIYRFLEKESKVYARTLNHPVINTLKKEIEFESFDSIYEAHDRFEDVYEAIVTSLIELAQSEDIVYAVPGHPRVAETTTVKLLEYSHFNKDISVKVLGGKSFIDDIFEAVDVDPNDGFTLLDGTSLKESALNVRTNTVITQVYSVMIAADLKLTLMERYPDDFNVKIITGSHSDGAHVIECPLYEIDRYDDYFNNLTSLFIPKINEDTLLYQDFDYAVQTIDLLVDNEKGCPWDKVQTHDSLKRYLLEETFELFEAIDNEDDWHMIEELGDILLQVLLHSSIGKKEGYIDIKEIIESLNTKMIHRHPHIFGNAHVTSQEDLKDIWSRAKEKEGKVPRVKFEKVFADHFLKLYDKTKNRQFDEDISNNFYNKERKFMRLDKY

SEQ ID NO: 3347 - protein, 180 aa, Staphylococcus epidermidis
ERGMTLIIRALEKTDLSFIHHLNNEYSIMSYWFEEPYQSLSELENLYTKHILDETERRFIVEEGSTSVGVVELLEINFIHRTCEVLIIIDPQYANNGYAKKAFKMAIDYAFLVLNMNKVYLYVDIKNEKAVHIYQSNNFEIEGTLKEHFYTRGEYRDCYVMGLLKRNWVNKNDDDLSHIR

SEQ ID NO: 3348 - protein, 299 aa, Staphylococcus epidermidis
RLYVKIILITIQSEGGKMIYETAPAKINFTLDTLFKRDDGYHEIEMVMTTVDLNDRLSFEKRTDNKIVVDIEHNYVPNDNKNLAYKAADLMFERFNINEGVTISIDKDIPVSAGLAGGSADAAATMRGLNRLFGLGQSLDALAALGIQIGTDIPFCIYNQTAVCTGRGEQVTFLKRPPSAWVVLAKPNIGISSPDVFKALDLTEEHIVHNEKCKQALENNDYHLLCNSLSNRLEPVSMAMHPDIKKIKDNMLQCGADGALMSGSGPTVYGLAQKERQAKNIYNAVNGCCNEVYLVRLLG

SEQ ID NO: 3349 - protein, 133 aa, Staphylococcus epidermidis
KRSVKFIMKIINSDKVPEALGPYSHATVINGFVFTSGQIPLTLDGTIVSDDVQEQTKQVLENLTVVLKEAGSDLNSVVKATIYISDMNDFQQINQIYGNYFVEHQPARSCVEVSRLPKDVKVEIELIGKVKEL

SEQ ID NO: 3350 - protein, 660 aa, Staphylococcus epidermidis
GGPVMAKDTFYITTPIYYPSGNLHIGHAYSTVAGDVIARYKRMQGYDVRYLTGTDEHGQKIQEKAQKAGKTELEYLDEMISGIKNLWSKLEISNDDFIRTTEERHKQVVEKVFERLLKQGDIYLGEYEGWYSVPDETYYTESQLVDPVYENGKIVGGKSPDSGHEVELVKEESYFFNINKYTDRLLEFYDENPDFIQPPSRKNEMINNFIKPGLEDLAVSRTSFDWGVRVPSNPKHVVYVWIDALVNYISSLGYLSDDETLFNKYWPADIHLMAKEIVRFHSIIWPILLMALDLPLPKKVFAHGWILMKDGKMSKSKGNVVDPNVLIDRYGLDATRYYLMRELPFGSDGVFTPEAFVERTNYDLANDLGNLVNRTISMINKYFHGELPAYQGPKHELDEKMEAMALETVKSFNDNMESLQFSVALSTVWKFISRTNKYIDETQPWVLAKDENQREMLGNVMAHLVENIRFATILLQPFLTHAPREIFKQLNINNPDLHQLDSLQQYGMLSEAITVTEKPTPIFPRLDTEAEIAYIKESMQPPKSIKQSDEPGKEQIDIKDFDKVEIKAATIIDAENVKKSEKLLKIKVELDNEQRQIVSGIAKFYRPEDIIGKKVAVVTNLKPAKLMGQKSEGMILSAEKDGVLTLISLPSAIPNGAVIK

SEQ ID NO: 3351 - protein, 249 aa, Staphylococcus epidermidis
HPFFRSKDMLEDNERVDHLIKEGYEIIQNDEVFSFSTDALLLGYLTEVRKNDKVMDLCSGNGVIPLLLAAKSTQPIEGIEIQEQLVSMARRSFKLNDLNDRLTMHHMDLKDVYQTFQPAQYTLVTCNPPYFKMNQNHQHQKEAHKIARHEIMCNLKDCIEAARHLLKEGGRFIMVHRAERLMDVLTELRHGKIEPKALTLVYSKHDKPAQTIVVEGRKGGNQGLDIRNPLYIYNEDGSYSDEMKGVYYG

SEQ ID NO: 3352 - protein, 112 aa, Staphylococcus epidermidis
SSLFSSSSSSLSSPTTSGSSVADSPSIASTSSSEGSSVGGTTVTIESSGLFSIVKSPEILISETAKLSLTCNSLISTSIVSGIFSGVAVTSKLNNGCSTTPPSLAPTASPTN

SEQ ID NO: 3353 - protein, 524 aa, Staphylococcus epidermidis
LDVLKKVWRLKMKTKSETAFNGVVILTLALIIVKILSAIYRIPYQNVLGDDGLYAYQQIYPVVALGVILSMNAIPSAVTQVIGVNRSDEVYTRVMFRLQCIGFIVFILLFMFANMITRWMGDSNLAPMLKMASFSFILIGVLGVLRGFYQSKQVMTIPAISQVIEQVIRVSLIIVAIIMFSMKHWSIYQAGALAILASSIGFLGSMLYLLLKKPLKLKLCYRFNNTSIQWKQLFISISIFALSQLIVILWQVVDSFTIIRLLQHSGIAFKEAIIQKGIYDRGASFIQMGLIVTTTFSFVLIPLLTQAIREHNQIHMNRYANASIKITVVISTAASIGLINLLPLMNVVFFKSNHLTLTLSIYMFTVICVSLIMMNISLLQVQTSIRPIIMGVIIGILSKIILNVILIPFWGIVGASVSTVLSLLLFVIILQVAVLKYYRFNRISLFIVKLILGMIIMSIVVQTVMLALPSKSRMLGLLELIVSSIIGIVIIMLYIVIFNVLGYKEIKHLPFGDKLYQMKRGRRS

SEQ ID NO: 3354 - protein, 456 aa, Staphylococcus epidermidis
DEKLNLERVINMKRPIIQKLNHLIEKKAISMHVPGHKNMTIGYLNRLDLAMDMTEITGLDDMHYPEGIILESMENFRKHKNYDAFLLVNGTTSGILSVIQAFSTRKGKYLISRNVHKSVFHGLDITQQQATITKTDVSKKTNQYVNPKINQDKNQYYKLAICTYPNYYGETFDISQYIKQLHHRGIPILVDEAHGAHFGLDGFPESSMNFNADYVVQSYHKTLPALTMGSVIYIHKDAPLRQQVIDYLTYFQTSSPSYLIMSSLELANKFYKEYDSTLFDQRRKMLIDLLVNMGFTVIEPEDPLKLVVSFEGVEGYDVQKWFEDKEIYVELADMYQVLLVLPLWHEGDKFPFKLLIEKIREINVPKKCTRDIKPLNFMTGFSEYKTVHFQNTKEVSIKRAEGKVLAQHIVPYPPGIPVMFKGEVVTSHMIDLLNKYDKQNIKVEGLNHKKILVKDE

SEQ ID NO: 3355 - protein, 466 aa, Staphylococcus epidermidis
MNTSQKFRGDNRLLLGIILGVITFWLFAQSLVNLVVPLQSSYNSDIGTINIAVSLSALFSGLFIVGAGDIADKIGRVKVTYIGLALNIVGSVLIIITPLPSLLIIGRAIQGLSAACIMPATLAIINEYYIGTARQRALSYWSIGSWGGSGVCTLFGGLMATNLGWRSIFIVSIILTILSMFLIKHTPETKAEPIGDQPTETKKFDVVGLIILVVSMLSINVIITQTSQFGLFSPFILGLIAIFVISLIIFVIYENKIKQPLVDFDIFKNKGYTGATISNFMLNGVAGGTLIVVNTFYQQKLDFNSQETGYISLTYLIAVLIMIRVGEMILQSLGPKRPLLLGSALTVIGLILLSLTFLPNAWYIASSVIGYLLFGTGLGVYATPSTDTAVAQAPDDKVGVASGVYKMASSLGNAFGVAISSTVYSVLAAQLNLTLGGFTGVMFNALIALLAFLSILFLIPKKQSNV

SEQ ID NO: 3356 - protein, 76 aa, Staphylococcus epidermidis
GIIPYIYESTTIPTNNTAKIVPIVTKVLTAFLGAGFLKFVTALDIASTPVSDDAPDENAFKSKNNVTPGTVLPTVE

SEQ ID NO: 3357 - protein, 414 aa, Staphylococcus epidermidis
TYMLIGIVLFAFMRALGELLLSNSKFNSFVDIANEYLGPFGGFVIGWTYWVCWIVSSMSDLTAMGQYFAYWYPQVPHWLTVLFIVLLLISFNLLGARLFGELEFWFSIIKVVTIITMVIVGLVLIFLSFKTEYGHASFGNLIHHGGMFPHGAAGFLMSFQIAVYSFIGIELIGVTAGETKNPEKTIPKAINNVPIRILLFYIGGLLVIMSVIPWFKVDPDSSPFVKLFTLIGVPFAAGIVNFVVLTAAASATNSGIYSNSRILFGLAKQGLGPKVLTKTNSNGVPYLSMLVSSITLLIAALLNFIFPDAIKLFIYVTTLSTVLFLVVWGMIIVSYIAYVKKNPEQHQSSAFKLWGGKIIAYIVLSFFIFIFILLFFSKDTRVAIFISPLWFIFLFFYYKKYKNNAESLADRQRH

SEQ ID NO: 3358 - protein, 527 aa, Staphylococcus epidermidis
TNYLCLSKRWGAYIVSKTNLGEKWGLLAGGSLLVDYILTVAVSISSGADAFVAAFPHLYHFKVLIACLLVLFILMMNLRGLTESATVLSYPVYLFIIGLIVLIVVGTFRVATGQIAPHIHSTVGSTVPGVTLFLLLKAFSSGASSLTGVEAISNAVTNFKNPAPKNAVKTLVTMGTILAVLLVGIVVLSYIYGIMPQTETTVLSQLASQIFGENVAFYFIQATTVMILVLAANTGFTAFPMLAASMSKDKYMPRMFTVRGDRLGYSNSIIILGVLAIILIILFEGMTENLIPLYAVGVFIPFTLAQFGMVLKWLRERPERWGIKLTINLIGGTITFIVFMILLITKLNQVWPILLFLPFIVFIFIRIHVHYENIACELRSEIDIHDIPVVDRNLAIVPIQSITTVVDKSIYYAKLLANDDVIAVHVTFGDEDEQAFMTKWKKHFPDVRLVILHSEYRSIIHPISRFIDKIRKKANDKNYLITVVVPEFIPKKAWQHLLHNQTSLRLKLHLIYQKNVTLCTIPFKLIK

SEQ ID NO: 3359 - protein, 86 aa, Staphylococcus epidermidis
VCIACLKCGFLMLRCYFNVFSFYQNGKLYLLKITKPVTWLWLDRHLQLNISNVKVTMIKQTPKLHLLILSREVDKKEYSLLQIPTK

SEQ ID NO: 3360 - protein, 92 aa, Staphylococcus epidermidis
NNLAPNPLPNAPEPAIAIFIYSISLQFYIVFKILLYYIPVNIIRLICKNFLLIKNKYYLSNVHCSFDILLPICTVNRFFVNLLFYFSCVFKI

SEQ ID NO: 3361 - protein, 263 aa, Staphylococcus epidermidis
FHINLLRRNTLMKALIVDDEPLARNELQYLLNLNDAIDEIEEAENIEETLEKLLYNTFDLIFLDINLMDESGIDLAQKINKMKRSPHIIFATAHEKFAVKAFELNATDYILKPFEKERINQAVNKVDMAKDKPKNKDKTITPKYIDYSDDERAQTHVLPIEVDERIHILNFTDIIALSVNNGITTIDTTKQSYETTETLNHYEKKLPSSLFIKIHRATIVNKEHIQTIEHWFNYTYQLTLTHEFKYQVSRSYMKTFKQQLGLQ

SEQ ID NO: 3362 - protein, 234 aa, Staphylococcus epidermidis
AMIEHLGINTPYFGILVSLIPFVIATYFYKKTNGFFLLAPLFVSMVAGIAFLKLTGISYENYKIGGDIINFFLEPATICFAIPLYRKREVLKKYWLQIFGGIAVGTIIALLLIYLVAITFQFGNQIIASMLPQAATTAIALPVSDGIGGVKELTSLAVILNAVVISALGAKIVKLFKISNPIARGLALGTSGHTLGVAAAKELGETEESMGSIAVVIVGVIVVAVVPILAPILL

SEQ ID NO: 3363 - protein, 596 aa, Staphylococcus epidermidis
MRIDVMLNLFILLLERVGLIILLAYILMNINHFKTMMSERDKWRSKFQLIIIFGIFSMISNFTGIEIENGHIVSGDIYYHLSKDASMANTRVLTIGVSGLIGGPWVAIIVGIISGLCRLYIGGADAYTYLISSIVIAIISGYFGHQTIKQNTYPSIKKGAIIGAITEIIQMGCILLFTNNLHHAITLVSFIALPMIIINSLGTAIFLTIILSTIKQEEQMRAVQTHDVLQLANETLPYFRSGLNEKSAQQAAEIILKLMQVSAVAITNKKDILTHIGAGSDHHVARKEIITDLSKEVIQSGKLKVAHTREGIGCHHPNCPLEGAIVVPLYIHNEVAGTLKFYFTDNNIISTSDQQLAKGLANIFSSQLELGQAEMQGQLLKDAEIKSLQAQVNPHFFFNAINTISALVRIDSEKARRLLIQLSQFFRSNLNGARNNTITLQKELQQVAAYLSLEQARYPNRFNIHYRIDDQCQDALIPPFIIQILVENSIKHAFKNRKKNNHIDVDVSMKQDYLSISVQDNGQGIPADQLDTIGYTTVTSTTGTGNALVNLNKRLTGLFGTTSALNIQSSQSGTTVSCLIPYKSSKEEHFNESVNR

SEQ ID NO: 3364 - protein, 91 aa, Staphylococcus epidermidis
TKNEQVEQFLAKESQWQDCYKFLRNLIFNETELEENYKWMHPCYTINNKNAVLIHGFKGYVALLFQKGAILEEKYHTLIQQTERLQAEAVP

SEQ ID NO: 3365 - protein, 324 aa, Staphylococcus epidermidis
KYLDKWEELTLKKYLNYTLILIALSLIVLSGCSLPGLGDGNAKDDVKITTTETSETKIIGHMEKLLIEHETDGKIKPTLIGNLGSSIIQHNALQRGDANMSAVRYTGTELTSVLAAKPTKDPDKAMSETQRLFKKKYDEKYYHSLGFANTYAFMVTKETAKKYHLKKVSDLEKYKDELRLGMDTQWMNRAGDGYPAFVKDYGFKFDSARPMQIGLVYDALKNNKLDVAVGYSTDGRIAAYDLKILEDDRKFFPPYDGSPLANEQLIKDNPEIDKALKKLEGKISTEEMQKLNYEADGKGKEPAVIAEEYLKKHHYFEEKKGGHK

SEQ ID NO: 3366 - protein, 317 aa, Staphylococcus epidermidis
NCKEMEYMKIAIAGSGALGSGFGAKLFQHGYDVTLIDNWEPQVTTIQQDGLHIDINGEAHHFRLPMYRLTEIPKATSYDIVFLFPKSMQLEEVLSHIQPHLHDNTIVVCTMNGLKHERLIQQYVSIDRIVRGVTTWTAGIDQPGHTHLMGQGPVEIGCLVPEGKESVDIIVNLLQNAELKGVKSEHLHQSIWKKICVNGTANSLCTILECNLAALNNSDDAKNLIYKITQEIVHVATVDDVHLNVDEIFDYLIALNDKVGPHYPSMYQDLIKDNRTTEIDYINGAVSKLGKENHIATPVNDFVTNLVHAKENQRGAQ

SEQ ID NO: 3367 - protein, 64 aa, Staphylococcus epidermidis
PMTLDAIYQALGKNVKDNNINPMTVKALPSNKGLLGPNDCNIISPTRIIINTAIRYVSEIYPVS

SEQ ID NO: 3368 - protein, 510 aa, Staphylococcus epidermidis
SRGCSMKIKLFVIVVIFLMTILSIISITTREIAHSKNETILTHASQKHIDKMVETAMKKGDIPGLAILIIKDNKIFLNKGYGYANIEKKAKVNPHTQFEIASNTKAFTGYAILQLAQEGKINLNDKVSTFIPGFKMKYEDKERDITIEQLLAQTSGIPGDITEENRYSKQYDSIENIVNFAKGKRLNHVPGETFEYSNMNYDILGLIIQNVTHQSYTSYIQKHVLAPLKMKHTTFKVNNTKSNNEALGYIWEDNENKVAQPEFNIGDTPAAYMMSSTSDLAKWVQLQIHPTSKSQAKLIRQSHQVLSNSLNSEPNADSYGSGWFINTDDHLVFHTGVLDNFSSQILLNIRKSYGIVVLANTNSNQVTRLAEHLNTQIMNNRHYTTIEEKVNQTKDMQLIISTLADIFMVIFSILVFSKILKLREGHIFIRKCLRTSIMFSIILLGFVAMNILFYLLPLIILGDATWGFVLSWLPLHSKYLVVSVYLAITMLLVWLSLISITYRSDKKKKH

SEQ ID NO: 3369 - protein, 460 aa, Staphylococcus epidermidis
KYISKGLCLLFNFSHYLFNNCIRGLFLGHGTRHSLYRKGKTIMLSIKNLTKIYSGNKKAVDNISLDIQSGEFIAFIGTSGSGKTTALRMINRMIEATDGQIMMNGKDVRNMNPVELRRSIGYVIQQIGLMPHMTIRENIVLVPKLLKWSKEKKDEKAKELIKLVDLPEEYLDRYPAELSGGQQQRIGVVRALAAEQDIILMDEPFGALDPITRDTLQDLVKELQQKLGKTFIFVTHDMDEAIKLADKICIMSKGKVVQYDTPDNILRYPANDFVRDFIGQNRLIQDRPNMKSVESAMIKPVTVKADDSLNDAVNIMRTRRVDTIFVVNNQNKLLGFLDIEDINQGLRARKELIDTMQRDVYKVHINSKLQDSVRTILKRNVRNVPVVDNDEHLIGLITRANLVDIVYDSIWGEEDSDSYEIPNESLDENNHDLPQNQTDTRTNINEDVNDYHDAQHRGED

SEQ ID NO: 3370 - protein, 284 aa, Staphylococcus epidermidis
QKGSITMHKRLFITLLGFIILLAGCDYSKEENQTGIFYNVFVKSMDGFLHFLGRVFQDNYGFAIISIVLIVRFILLPFMLIQVKNMHMMREKTKVVQPELDAIRDKMKHATSQEERNAANQLLMKKYQSYGINPLKNMLGCLPVLIQMPILMGLYMSLKYPSSHGITEYPHFLWFDLTQPDLIMTIIAAIMYFVQPLVNSIHYPKDQRKTYYFMMVFSPIFITYASLHSAAALGLYWSISAAFLIVQMHFAHSHYKKVALHEAKKLKQKLEQNKDNSELLTEES

SEQ ID NO: 3371 - protein, 157 aa, Staphylococcus epidermidis
RKQRGMVILEQTHLVKNKTVDNKKSMKYSIFQQALTIAVILLISKIIESFMPIPMPASVIGLVLLFIALCTGIVKLGQVETVGTALTNNIGFLFVPAGISVINSLPILKQSPILIILLIIISTLLLLICTGFASQLLVTKSLFPSKEKNEETSHVGG

SEQ ID NO: 3372 - protein, 232 aa, Staphylococcus epidermidis
VMKGNLLHSIIEYYSLNWAFLLELFFKHLLMSVYGVLFACIIGIPIGIFIAKYKRLSWPVITIANIIQTVPAIAMLAILMLAMGLGPTTVVVTVFLYSLLPIIKNTYTGIVEVDENIKDAGKGMGMTGNQILRMIELPLSLSVIIGGVRIALVVAIGIVAIGSFIGAPTLGDIIIRGTNSTDGTTFILAGAIPIALIAIIIDIGLRYLEKRLDPTRKNKKDSMQKHQVQKLH

SEQ ID NO: 3373 - protein, 116 aa, Staphylococcus epidermidis
VFRGILDIFIVLGNYNKIGASIGTTATTITPTMTTAILPIDSSVSPNSLAAATPKVCPLVPSASPLAIGLDILNNLTILAPKAEMTTAFKITASEVNSLTPPIPSDTGNAIAVVAA

SEQ ID NO: 3374 - protein, 354 aa, Staphylococcus epidermidis
GVFIMKAAVWYGQKDVRVEDREPKAIKDNEVQVKVSWAGICGTDLHEYLEGPIFISTDQPDPLLGQTAPVTLGHEFSGVVENVGKNVSRFKKGDRVVVNPTVSKREKPENVDLYDGYSFIGLGSDGAFAEFTNAPETNVYHLPDNVSAREGALVEPTAVAVQAVKEGELLFGDTVAVFGAGPIGLLTIVAAKAAGASKIFVFDLSEERLAKAKSVGATHVYNSGNVDPVQTVYEHTDNGVDVSFEVAGVGITLQQSIEVTRPRGTAVIVSIFGHPVEFNPLLQMNKGVKLTTTIAYTPTTFQQTIDLIANGSLNVKDVVTDQIELDNIVESGFNQLVNDKSQAKILVRLNGDQK

SEQ ID NO: 3375 - protein, 214 aa, Staphylococcus epidermidis
GLIMKAFLQEYGSQLLSKAVEHFYISMFALLLAIVVAVPLGILLSKTQRTANVVLTVAGVLQTIPTLAVLAIMIPIFGVGKTPAIVALFIYVLLPILNNTVLGVKNIDKNVIQAGQSMGMTKFQLMKDVEMPLALPLIISGIRLSSVYVISWATLASYVGAGGLGDLVFNGLNLYQPPMIISAAIVVTLLALVIDFILSLVEKWVVPKGLKVSR

SEQ ID NO: 3376 - protein, 114 aa, Staphylococcus epidermidis
VKEVGVMFIQFKRLLIGRPKRNRDLKNEKISKFKGLAILSSDALSSVAYGPEQILITLSVIGAVASWYTLPIAGAVLILLTALILSYRQIIYAYPKGGERILFLKQILVRNGDC

SEQ ID NO: 3377 - protein, 84 aa, Staphylococcus epidermidis
GTPLELVFVNTLGPKPCFAKPNKILLLEYIPLFVADAAAVKTTKLTMPAAKGTPISVNNLTNGLLSGSTLNHGMTDMITSKPPI

SEQ ID NO: 3378 - protein, 220 aa, Staphylococcus epidermidis
NSSSLQTFKIFKSSICNNKTLIFYKYGYKSLLKFYLKGCHYMGIRSKLTNNITNKVGNSLLNIEEIKEKGDLPTTQEELRQRRERAETLVKKKSLLSSGASIVPIPGLDFGVDLKLMRDIIEDVNKIYGLDHDQVNSLSDQVKERIMSAAAIQGSQFIGRKVSEALLKVVIKDVAKRAAAKQTKWFPFVGQAVSASISYYFMSKLGKDHINKCEKVINNL

SEQ ID NO: 3379 - protein, 357 aa, Staphylococcus epidermidis
MKRFFQLIISAIVIGILCLMISHWFKSKDNTHSNEKLYVYNWGEYIDPSLIKKFEKETGIQVVYETFDSNEAMEAKIRNGGTHYDVAFPSEYTVQKLKKAKLLETLNHDKIPNIRNLDNDYMNLSYDPNNRYSIPYFFGTVGILYDKEKYPNETFDSWDDLYHSQFKNDILLVDGAREIIGMGLNKLGYSLNDKNPTHIYQAEKDLHNLAPQVRGIVGDEITMMLQQNEGHVAVVWSGVAAPLVQENTRYNYVIPKEGSNLWFDNMVIPKTAQNKEGAYKFMNFLLDAQNSAQNTEWVGYATPNKAARSKLPKKVRNDYRFYPSNQEQQRLEVYKDLGQTSLSEYNESFLNFKMSLK

SEQ ID NO: 3380 - protein, 318 aa, Staphylococcus epidermidis
FTISLYYMRNLRRGIMNKDQTLSHTTGRVSFKELQQIIKMALVQGNLIPAFAGAWLAIVMTNHSFLSSIPQILLMLVGSTLIMGGACALNNYYDQDIDRIMPSKQSRPTVNDRISDRNLLMLSFGMMLIGEACLFLLNIPSGVLGLIGIVGYVSYYSIWSKRHTTWNTVVGSFPGAVPPLIGWVAIDGSLSLAAVALFLVVFCWQPIHFYALAIKRSDEYALANIPMLPSVKGFKRTRVSMFIWLVLLLPLPFLLSNLGVTFVVIATLLNLGWLALGFTTFRKESNQTKWATQMFVYSLNYLVVFFALVVVVSLIKMI

SEQ ID NO: 3381 - protein, 413 aa, Staphylococcus epidermidis
VKFLASQLFKGGFFIDYLGVDISKRSSVVAHYKNGKFQKEFFIQNNKNGYNYLLKYLNDLHHPQLIFESTGIYSRGMQRFCCVNQINYIQMNPLEAKFKTSTLRSWKTDQADAHKLACLGPTLKQTGNLPIHELIFFELRERVRFHLEIENEQNRLKFQILELLHQTFPGLERLFSSRYSIIALNIAEIFTHPDMVLDIDKDVLITHIFNSTDKGMSMDKATKYALQLRVIAQESYPNVDRHSFLVEKLRLLIQQLKQSIHHLKQLDDAMIQLAQQLDYFENIHSIPGIGKLSTAMIIGEIGDIKRFKSNKQLNAFVGIDIKRYQSGHTHCRDTINKRGNKKARKLLFWVIMNIIRGQHHYDNHVVDYYYKLRKQPNEKPHKTAIIACINRLLKTIHYLVMNHKLYDYQMSPH

SEQ ID NO: 3382 - protein, 574 aa, Staphylococcus epidermidis
IIMSKLIKGIAASDGVAIAKAYLIVEPDLSYDSNEKVTDIESEVEKFNDAIEASKIELTKIRNNAEAQLGADKAAIFDAHLLVLDDPELIQPIQDKIRNDKVNAATGLDEVTTQFISIFESMDNEYMKERAADIRDVSKRVLAHILGVDLPNPSLINESAVIVGNDLTPSDTAQLNKEFVQGFVTNIGGRTSHSAIMSRSLEIAAVVGTKSITEEVKQGDMIIVDGMSGDVIIDPTEDELIAYQNKRERFFEDKKELQKLRDADTVTVDGVHAELAANIGTPDDLSGVIDNGAQGIGLYRTEFLYMGRDQMPTEEEQFEAYKKVLETMDGKRVVVRTLDIGGDKELPYLDLPKEMNPFLGYRAIRLCLAQPEIFRPQLRALLRASVYGKLNIMFPMVATIKEFRDAKSMLLEEKENLLREGYEVSDDIELGIMVEIPATAALADVFAKEVDFFSIGTNDLIQYTLAADRMSERVSYLYQPYNPSILRLVKQVIEASHKEGKWTGMCGEMAGDQTAVPLLLGLGLDEFSMSATSILKARRQINGLSKNEMAELANRAVECSTQEEVVDLVNQLAK

SEQ ID NO: 3383 - protein, 350 aa, Staphylococcus epidermidis
IYLFFIDSFPPYYVKSLRLKSLRLFLFRYRNNPIPCYALIIMKYGDDDMSIPIIIDTDPGIDDATAISIALSHPQFDVKMISTVNGNVGIEKTTANALKLKRFFNSSVPVHRGASQPLINDIFEATSIHGESGMDGYEFPQINQDDLTSIHAVEAMRNLLVNTQEPLTLIAIGPLTNIAILLTSYPEVQPFIKEIVLMGGSTGRGNVTPLAEFNIYCDPEAAQIVFNSGLPLTMIGLDLAREALFTHHFVKDFKDTNATSNMLYNLFQHYKSEDFEIGFKLYDVFTILYLLDPEAFNVKEAYTQIELNGNFTRGATVVDFNMEHPNCTVVLSPVERQYEDLFLNALSYCK

SEQ ID NO: 3384 - protein, 234 aa, Staphylococcus epidermidis
VSLLYEGKAKRVFTTNIDGQLRVEYKDEVTAGNGAKKDTMIGKGKLNNQITSIIFDYLTHNHIDNHFIKQLSQTEQLVQQVDIIPLEVVVRNIATGSITKRLGFKKGHTFEEPLVEFFYKKDELNDPLITDDHVKLLGIANDEEIKQLKQMAKDINQVLIQLMNEMSLRLVDFKVEFGKTNGGKILLADEISPDTCRIWDKNTDTNFDKDVYRNNTGSLIETYQTFLNKLEDLK

SEQ ID NO: 3385 - protein, 73 aa, Staphylococcus epidermidis
SQLFLRYFFFTLNPTPNVAMRSINVKIINGTLATPNAKLNKVKKMTANIEKIQKIPLDFFCCIPYPTFYLSFQ

SEQ ID NO: 3386 - protein, 77 aa, Staphylococcus epidermidis
EDNTTMAVFKVFYQHNKDEVIVRENTQTIYVEGQTEEQVRRYLKDRNFNIEFITKLEGAHLEYEKEHSTHFNVENAE

SEQ ID NO: 3387 - protein, 85 aa, Staphylococcus epidermidis
TSNTKMANTVKINVPTIASIFLKPNFMMNNNKNTSNTVINAPTINGMPKIKSNAIALPITSAISVAIIANSAIIQNIIATGLFKK

SEQ ID NO: 3388 - protein, 97 aa, Staphylococcus epidermidis
RMNTIVKHTVGFIASIVLTLLAVFVTLYTNMTFHAKVTIIFGFAFIQAALQLLMFMHLTEGKDGRLQSFKVIFAIIITLVTVIGTYWVMQGGHSSHL

SEQ ID NO: 3389 - protein, 79 aa, Staphylococcus epidermidis
TKLTRCLMYKDYNMTQLTLPMETSVLIPTNDISRHVNDIVETILETEFRHHRDAISYHPKIMLKVVLYAYTQSVFSGRR

SEQ ID NO: 3390 - protein, 634 aa, Staphylococcus epidermidis
YNKTVAIKSGSIHKKGIYKMTNLREDVRNIAIIAHVDHGKTTLVDQLLKQSGIFRENEHVDERAMDSNDLERERGITILAKNTAIDYKGTRINILDTPGHADFGGEVERIMKMVDGVVLVVDAYEGTMPQTRFVLKKALEQNLKPVVVVNKIDKPAARPEGVVDEVLDLFIELEANDEQLDFPVVYASAVNGTASLDSEKQDENMQSLYETIIDYVPAPVDNSDEPLQFQIALLDYNDYVGRIGVGRVFRGKMRVGDNVSLIKLDGTVKNFRVTKIFGYFGLKREEIEEAQAGDLIAVSGMEDINVGETVTPHDHRDPLPVLRIDEPTLEMTFKVNNSPFAGREGDYVTARQIQERLDQQLETDVSLKVTPTDQPDSWVVAGRGELHLSILIENMRREGFELQVSKPQVILREIDGVLSEPFERVQCEVPSENAGAVIESLGARKGEMLDMMTTDNGLTRLIFMVPARGMIGYTTEFMSMTRGYGIINHTFEEFRPRVKAQIGGRRNGALISMDQGQATSYAIINLEDRGVNFMEPGTEVYEGMIVGEHNRENDLTVNITKAKHQTNVRSATKDQTQTMNRPRILTLEEALQFINDDELVEVTPESIRLRKKILNKSAREKEAKRVKQLMQDEQ

SEQ ID NO: 3391 - protein, 87 aa, Staphylococcus epidermidis
IMKTIELHITLQPQVLDTQGQALNRAVHDLGYEQVNDIRVGKVLYMTVNEPTDEAVDNIITTLSEKLFANTVIEEYSYKVIDEKEKA

SEQ ID NO: 3392 - protein, 80 aa, Staphylococcus epidermidis
IIYLIRFEIISFIFEFLTKRSLELKVLKLVKRDNFYIISYRNCLFYNFQTIISLLIYYLTYISSFNTNHIPSITSQLFLV

SEQ ID NO: 3393 - protein, 65 aa, Staphylococcus epidermidis
KLFYMTMHHLKEHSINKLKQYILLLTYLKSDTSYRHIIQLNSFYIRSYFSISNILFLYLIDKIYQ

SEQ ID NO: 3394 - protein, 248 aa, Staphylococcus epidermidis
VKSYLLIQSLKNIAIKLSMKRRKHNMKFAVLVFPGSNCDRDMYNAAIKSGVDAAYVDYRETTLDGFDGVLIPGGFSFGDYLRSGAMASVAPIIKEVKRFAKEGKPVLGVCNGFQILTEIGLLPGALLHNDSHLFISRNETLKITNNQTPFTHLYVKNENVVYPVAHGEGHYYCTDEIYRELNDNNQIILKYTNNPNGSYEDIAGIVNKEGNVCGMMPHPERALETLLGTNSGVKLFESMVKSWREQNV

SEQ ID NO: 3395 - protein, 608 aa, Staphylococcus epidermidis
KRYHIDFQTLSNWSDVSMYYTNSNYEAFARPKKPENVDNKSAYLIGAGLASLAAACFLIRDGQMKGENIHILEELDISGGSLDGINMEHHGYVVRGGREMENHFECLWDLFRSIPSLEQTNASVLDEFYWLNKEDPNYSKCRAIESGGKRIDTDGDFTLTKKAIKEILNLCLMKEEDLDDVKITDVFSRDFLNSNFWLYWKTMFAFEPWHSAMEMRRYLMRFVHHIGGLADFSALKFTKYNQYESLVLPMIEYLKSHSVNFEFGVQVNNILVDATPSTKIAREIILTRDDKEESIPLTVNDLVFVTNGSITESSTYGDNDHPAPITHSLGGSWTLWKNLANQSPEFGRPEKFCDHIPAKSWFVSATATTDNKKIISYIEQLCKRDVLSGRTVTGGIISVANSSWQLSFTVNRQQQFKKQPKNQVSVWIYALYSDEKGDFIKKPITECTGSEICQEVLYHMGVPQEEIVELAQSECNTIPVYMPYVTAYFMPRAYKDRPLVVPNGSKNLAFIGNFAETARDTVFTTEYSVRTAMEAVYQLLDVDRGVPEVYASEFDARVLMDAFYELNDRKSLHELVNKNFIKRSVLNTVLKKIRGTFIEELLRKHKLL

SEQ ID NO: 3396 - protein, 202 aa, Staphylococcus epidermidis
VMSHDANTIDSRTHEGELNKLGFWIFLTAEFALFGTLFATLLTLQHGGGYGGKLTTDLFELHLILIMTFALLISSYTCGIAIYYMRQEKQNLMMFWMIITVILGLVFVGFEIYEFAHYASEGVNPTIGSFWSSFFILLGTHGAHVSLGIVWVICLLIQIGTRGLDSYNAPKLFIVSLYWHFLDVVWVFIFTAVYMIGMVYSG

SEQ ID NO: 3397 - protein, 297 aa, Staphylococcus epidermidis
HMIQKLLNDIQQDDYAWKMDVLKKWKVNTLFERWKKRHTFVDDVNIITKLLLGIALFFFIIFIHNFDFMIYIVILMFMFLLLFNGTEFKITAIFILVTTLFALMSSLFMILYGDGEHMLVKFGILQISTESIVRGLHLSMRTITVSIFGILIALTSQIVMIFYSLMQHLKVKPKFAYAFMAAIRMVPLIISSLIQLRRSLKMRYQMIDASNYKGIKRLNHLVIPLLSQNIRRAHQLSVAMESKGFKDGPRTYYYRVPFSYKDIVFIACILIIITLSFVLSSYLPITGIHDVRFGQLD

SEQ ID NO: 3398 - protein, 210 aa, Staphylococcus epidermidis
LLTHNFPREGCAFFRRMFFMSKGLKLSEILVTVLISVVFAIIYNLWWFVYNIVQVAGIHLEQLTYGVWFMAAVVCYLIIPKPGIALLAEIAAGAGETIVMGKFDIPTIIYAILQGLACEIIFAIFKYKSRSAAVAMLAGLATALISFPVDYFYGYLNEVAGWNLLLFIVFRSISGIVLAGLVSYWIVKALDKTGVTKFFRPASQQDYDNL

SEQ ID NO: 3399 - protein, 407 aa, Staphylococcus epidermidis
SVRQTIKMKLNKFKIVFFIIVLLTLVVSIGILGVEWTRHLELKKQTLSQESGNTNYIEKRDKTVEKPKKIKTKYDKKDPTSKSINKYLEKTQFNGTVAVFDNGKVKMNKGYGYQDIEKGKKNTANTMYLIGSAQKFTTGLMLKQLEVENKVNLQDSVTKYIPWFKTNKEITIKDLMLHKSGLYKYEASTNIKNLEQAVRAIQARGIDDTVYHKHQYNDANYLVLAKVIENVTGKPYVKNYYERLGNKYNLKHTAFYDEKPLQSEMAKGYKFKNNTFSFLKPNILDQYYGAGNLYMTPHDMGKLIYTLQQNKIFNARQTRPILHEFGTQEYPEEYRYGFYITPYLNRVNGVFFGQIFTVYFNDRYIVILGTNVSNTPGLVSNEDKMRHIFYNILDQKKPYNTAGVKVE

SEQ ID NO: 3400 - protein, 222 aa, Staphylococcus epidermidis
INFKSLCYNIHNHIKRRHIMTQYTFSPKDFKAFEVEGLDQRMEALNDYVRPQLHQLGSYFEEYFTTQTGETFYAHVAKHARRSVNPPIDTWVAFAPNKRGYKMLPHFQIGLFRNQLFIMFGIMHEGRNKEEKVKIFDKHFDKLTSLPSDYSVSLDHMKTEKHYIKDMSNEELHAAIDRVKNVKKGEFFVARTLSPTDKRLKSDKSFLKFVEETFDEFLKFYQ

SEQ ID NO: 3401 - protein, 290 aa, Staphylococcus epidermidis
EWFKVVAKILDGKQIAKEYRQRLKNQVNDLKEYGFTPKLSVILVGNDGASQSYVKSKKKAAEKIGMISEIIHLDESTSEEVVLSELNRLNNDDTVSGILVQVPLPKQVSEQKVLEAINPEKDVDGFHPINIGKLYIDEQTFVPCTPLGIMEILKHADINLEGKNAVVIGRSHIVGQPVSKLLLQANATVTILHSRTKNMNAHLKQADVIVSAVGQPGLVTKENVKKGAVIIDVGNTPDENGKLKGDVAYDEVKEIASAITPVPGGVGPLTITMVLNNTLLAEKLRRGLTK

SEQ ID NO: 3402 - protein, 91 aa, Staphylococcus epidermidis
VVLKSLLAKICCTSSLLLSVFSKLAIDVSLLKDTSAINIETIVNMSKNTQLNQPNIFSVSRFAGRLICVYCSPNIRYNSLTYLSHYYIKKF

SEQ ID NO: 3403 - protein, 370 aa, Staphylococcus epidermidis
MAPKLQAQFDAVKVLNETQSKFEMVQILDEDGNVVNEDLVPDLTDEQLVELMERMVWTRILDQRSISLNRQGRLGFYAPTAGQEASQLASQYALESEDFILPGYRDVPQIIWHGLPLTDAFLFSRGHFKGNQFPEGVNALSPQIIIGAQYIQTAGVAFGLKKRGKNAVAITYTGDGGSSQGDFYEGINFASAYKAPAIFVIQNNNYAISTPRSKQTAAETLAQKAISVGIPGIQVDGMDALAVYQATLEARERAVAGEGPTVIETLTYRYGPHTMAGDDPTRYRTSDEDAEWEKKDPLVRFRKYLEAKGLWNEDKENEVVERAKSEIKAAIKEADNTEKQTVTSLMDIMYEEMPQNLAEQYEIYKEKESK

SEQ ID NO: 3404 - protein, 516 aa, Staphylococcus epidermidis
FRRKNKRKRFRYQTKMGRGYSSMSNYSGLNEECGVFGIWNHPEAAQLTYMGLHSLQHRGQEGAGIVVSNHETLKGERGLGLLTEAIKDEHMSNIKGYPHAIGHVRYATSGNKGIENIQPFLYHFYDMSVGICHNGNLINAKSLRQNLEEQGAIFHSSSDTEVIMHLIRRSKAPTFEEALKESLRLIKGGFTFAILTKDALYGAVDPNAIRPLVVGKMENGAYILASETCAIDVLGAEFIQDIHAGEYVVITDEGIEVKTYTRQTTTAISAMEYIYFARPDSTIAGKNVHAVRKASGKRLAQENPAKADMVIGVPNSSLSAASGYAEEIGLPYEMGLVKNQYVARTFIQPTQELREQGVRVKLSAVKDIVDGKDIVLVDDSIVRGTTIKRIVKMLKDSGANRIHVRIASPEFMFPCFYGIDVSTTAELISASKSPEEIKNHIGADSLAYLSVDGLIESIGLDYDAPYHGLCVESFTGDYPAGLYDYEKNYKKHLSERQKSYIANNKHYFDSEGNLHV

SEQ ID NO: 3405 - protein, 473 aa, Staphylococcus epidermidis
WRGKNMVVGDFPIETDTIVIGAGPGGYVAAIRAAQLGQKVTIVEKGNLGGVCLNVGCIPSKALLHASHRFVEAQNSENLGVIAESVSLNYQKVQEFKTSVVNKLTGGVEGLLKGNKVEIVRGEAYFVDNNSLRVMDEKSAQTYNFKHAIIATGSRPIEIPNFEFGKRVIDSTGALNLQEVPNKLVVVGGGYIGSELGTAFANFGSEVTILEGAKDILGGFEKQMTQPVKKGMKEKGIEIVTEAMAKSAEETENGVKVTYEAKGEEQTIEADYVLVTVGRRPNTDELGLEELGLKFADRGLLEVDKQSRTSIENIFAIGDIVPGLPLAHKASYEGKVAAEAIDGQAAEVDYIGMPAVCFTEPELAQVGYTEAQAKEEGLSIKASKFPYAANGRALSLDDTNGFVKLITLKEDDTLIGAQVVGTGASDIISELGLAIESGMNAEDIALTVHAHPTLGEMTMEAAEKAIGYPIHTM

SEQ ID NO: 3406 - protein, 69 aa, Staphylococcus epidermidis
SIFNSSYFIGSSIKLGTIPLNTLSNVLLPDPEGPSKSTFSLFLISRFKLLNIFLSPFGYFKRKFLTRNN

SEQ ID NO: 3407 - protein, 106 aa, Staphylococcus epidermidis
VMNKLLQSLSALGVSATLVTPNLNAEATTNTEPQLKGVNDIVIEKGQEYNLLKGISAYDKEDGDLTHKIKIDGQVDTSKAGKYKVKYQVTDSDGAEKTSIRNIEVK

SEQ ID NO: 3408 - protein, 356 aa, Staphylococcus epidermidis
LIINIILIVREIYMSKAYEESGVNIQAGYEAVERITSHVERTLRKEVLGGLGGFGATFDLSQLKMKAPVLVSGTDGVGTKLKLAIDYGKHDTIGIDAVAMCVNDILTTGAEPLYFLDYIATNKVVPSTIEQIVKGISDGCEQTNTALIGGETAEMGEMYHEGEYDIAGFAVGAVEKEDYIDGSNVEEGQAIIGLASSGIHSNGYSLVRKMIKESGVQLHDQFNGQTFLETFLAPTKLYVKPILELKKHIDIKAMSHITGGGFYENIPRALPKGLSAKIDTQSFPTLEVFNWLQKQGNISTNEMYNIFNMGIGYTIIVDKKDVQTTLTTLRAMDTTAYEIGEIIKDDDTPIHLLEVE

SEQ ID NO: 3409 - protein, 318 aa, Staphylococcus epidermidis
RNPNKNSKTTKTEQFKQVNKDAENPKPKERIGTWIGKDIKTLTHHYGQADRSYPYKNGLKNYVFKQKDEYYIVSTNKGTITSVYATGKGVKVSPLKIGESSSHIFEDTSINPEPTVKTKGKTYKFEMSDEDLKTQTLIKYGDVYAQIYSDQQTNKILAVRFLDANTLATLQPYKLNRAEDEGQISESSDDKIPHEQNPNQLITLYEVTNKMREMKNLNSLKVNNDIARIAAINLYEATDKGSNSVEFTENALTQQLDERHVSYKSASQNVGYDFDDVPTLIHSWINSDIHRSRLLSNKYDEMGGEVMSDYYSLIFVEK

SEQ ID NO: 3410 - protein, 408 aa, Staphylococcus epidermidis
YMKNFKNIMRYIGKTSKFIDYPLLITYVVLCLIGLVMVYSASMVAATKGTLTGGVPVSGTYFYNRQLLYVIMSFVIVFFMAFIMNVKVLKKPNVQKGMMIGIFILLLLTLVIGKNINGSKSWINLGFMNLQASELLKISIILYIPFMIEKKMPAVRHNIKLILGPILFVVTCLILVLFQKDVGQTMLIVIIFFSIIFYSGIGVQNMLKWGALVAIGFIIVATFMFMLDMVPSYLQARFSTLTNPFSQESGTGYHISNSLLAIGNGGLFGRGLGNSIMKLGYLPEPHTDFIFAIICEEMGLIGGLIVLILEYFIVYRAFQLANKTQSYFYKLVCVGIASYIGSQTFVNIGGISATIPLTGVPLPFISFGGSSMISLSIAMGLLLITAKQIKQDDKRLKQRKVDIKRRYN

SEQ ID NO: 3411 - protein, 183 aa, Staphylococcus epidermidis
VVRKMDIGYKLRNLRRIKNLTQEELAERTDLSKGYISQIESNHASPSMETFLNLIEVLGTSASDFFKEPSDEKVLYKKKEQTIYDEYDKGYILNWLVANSNEFDMEPLILTLRPNASYKNFKPSESDTFIYCLNGEVSLQLGNQVYKACKEDVLYFKAKDKHRLYNETDKEVKVLIVATASYL

SEQ ID NO: 3412 - protein, 178 aa, Staphylococcus epidermidis
LNRKVEKRLAWIANILSLLFLIFGILSIFVINNTSNQQQYNELMKQFSGNNQDMSSEMFLVSLIASLVILGFSTLLGFVGTMVIEGIKNLAATLLIAAAIVGLFTTNLIAMVLWMIAAIRLFAKKDKTDVNENATAQLRQNHSKSQSDWNHQQNQQHKDAWDPEQEINKQKKDDPYIY

SEQ ID NO: 3413 - protein, 140 aa, Staphylococcus epidermidis
YNLKIKEFDLFMKQSFIKIGEGLTDLFEFTTLIEYNHKRINRIVYFHTPHSEKQLSSVAIIMNPTAEKHFQAMYIMTNALKYPYPEGNKKFNMINSAAENYDIPVVGIDVQPPDVYPDLELYFNYLISVLRLQRWIPPLQ

SEQ ID NO: 3414 - protein, 76 aa, Staphylococcus epidermidis
SHMKWSITQLRKYQGKPFEFNQTVNFEHLRESLDLIDLSDINVEGQLTVKSNEVIADMHVTGTYTMPCAVFTTRGW

SEQ ID NO: 3415 - protein, 210 aa, Staphylococcus epidermidis
QFMNFKKTVAIVLTSAVLLAGCTIDKKEIKKYDDQVQKAMDQEKTVNQVSKKINELEEKKQKLFKKVNDKDQSTRKKAAEDIVENVKQRQKEFEKEEKALDNSEKEFKQAKQYLEHVENKAKKKEVEQLDSAIKEKYKSHDAYAKAYKKALNKEKELFSYLNEDNATQSEVDGKSKDLSKAYKEMNNKFNAYSKAIEKVKREKQDVDQLK

SEQ ID NO: 3416 - protein, 158 aa, Staphylococcus epidermidis
VRMKLMNVPILPTISTSCIVISAILVAIGWALIWKRQVHKHKNIMLWAAFFALTFFIIYAARTIFIGNTAFGGPSSIKVYYTIFLVFHIILATVGGVLGLIQIILAFKDKLHIHRKIGPWASIIWFFTAITGVAVYVLLYVLYPGGETTSLLKATLGL

SEQ ID NO: 3417 - protein, 223 aa, Staphylococcus epidermidis
WRTNMDKEYVVIGLGRFGGSIVRELNALDMDVMAIDRDENRVNEYSDIATHAVVADTTDEAVMKSLGIRNFDHVIVAIGENIQSSTLTTLILKELGVKKVTAKAQNDYHAKILNKIGADTVVHPERDMGRRIAHNVASASVLDYLELADEHSIVELKSTEKMAGQTIIELDIRAQYGINIIAIKRAKEFIVSPDPNINIEIGDILIMIGHDNDLGRFEKNISK

SEQ ID NO: 3418 - protein, 437 aa, Staphylococcus epidermidis
EDKNVAFEFRLPDIGEGIHEGEIVKWFIKAGDTIEEDDVLAEVQNDKSVVEIPSPVSGTVEEVLVDEGTVAVVGDVIVKIDAPDAEEMQFKGHGDDEDSKKEEKEQESPVQEEASSTQSQEKTEVDESKTVKAMPSVRKYARENGVNIKAVNGSGKNGRITKEDIDAYLNGGSSEEGSNTSAASESTSSDVVNASATQALPEGDFPETTEKIPAMRKAIAKAMVNSKHTAPHVTLMDEIDVQELWDHRKKFKEIAAEQGTKLTFLPYVVKALVSALKKYPALNTSFNEEAGEVVHKHYWNIGIAADTDKGLLVPVVKHADRKSIFEISDEINELAVKARDGKLTSEEMKGATCTISNIGSAGGQWFTPVINHPEVAILGIGRIAQKPIVKDGEIVAAPVLALSLSFDHRQIDGATGQNAMNHIKRLLNNPELLLMEG

SEQ ID NO: 3419 - protein, 187 aa, Staphylococcus epidermidis
MKWKCESMRVIAGKHKSKALESLEGRNTRPTMDKVKEGIFNSLYDVSGLGLDLFAGSGALGIEALSRGMDKMIFVDQNFKAVKVIKANLNQLDLMSQAEVYKNNADRALKALAKREIQFDVIFLDPPYNKGLINEAISRIAEFNLLKENGIIVCEFSHNEKITIAPFQMIKRYHYGLTDTLLLEKGE

SEQ ID NO: 3420 - protein, 79 aa, Staphylococcus epidermidis
CMTDTVIIYTQDDCPPCAFIKNYLVNKNIKFTEKNIKNQKYKNEMMDYDAFATPFILLKGMPMYQVDMEKLNDELNITP

SEQ ID NO: 3421 - protein, 149 aa, Staphylococcus epidermidis
IKDDSVITEETLDILDDIEDISDMIVQSDIYVSYRRAKMQLDADDEASLLYQAFLKVKDKYDDVMRFGKYHPDYKDIMLETRKRKRAYEMLPVVMEYKAKEVALQNLIDEVMSKIALAVSEHVKIETGNPFFQTGHDGCASGGTCNCSL

SEQ ID NO: 3422 - protein, 300 aa, Staphylococcus epidermidis
FSGEDVGVNGGVFRVTEGLQKEFGEDRVFDTPLAESGIGGLALGLAVTGFRPVMEIQFLGFVYEVFDEVAGQIARTRFRSGGTKPAPVTIRTPFGGGVHTPELHADNLEGILAQSPGLKVVIPSGPYDAKGLLISSIQSNDPVVYLEHMKLYRSFREEVPEEQYKIDIGKANVKKEGNDITLISYGAMVQESLKAAEELEKDGYSVEVIDLRTVQPIDIDTLVASVEKTGRAVVVQEAQRQAGVGAQVAAELAERAILSLEAPIARVAASDTIYPFTQAENVWLPNKKDIIEQAKATLEF

SEQ ID NO: 3423 - protein, 60 aa, Staphylococcus epidermidis
SNYDILFIHIRPPLYKRGMITNIPQSLIISFLPHMLCRKQIILIIILTMELIKVNLKQKQ

SEQ ID NO: 3424 - protein, 63 aa, Staphylococcus epidermidis
LQQDIDNMKRYTHKSRVFYYKVDRKVTLYTKYDKKVQVSERITLTTMGLNYNLCFVSNTMIEL

SEQ ID NO: 3425 - protein, 167 aa, Staphylococcus epidermidis
KFREWAFMIQIKGAVNFPISLDSTTWIFDDRKVTIDDLERGVFDGTRPINFDDNKEWNRAILEGQTNPPTLDSEIKYKKRSVLDETFVINMTPFFKNAEPMENASTIKLSNKDYSINVPMDLLPYLFFQFSSNGKRLYSDNAVDSFIYIPEEGYSHQFKYVTHIEVI

SEQ ID NO: 3426 - protein, 112 aa, Staphylococcus epidermidis
YLALLYSWQYSLKSIKVQHLLLKYHLHTLRQHQYQLCHAFHSQLLILTLYPHRQYLIPELALSFLIETNQMLHQIHLNHLILLCAMYVQHDLLFFRLLHILLEYLHQIPHML

SEQ ID NO: 3427 - protein, 172 aa, Staphylococcus epidermidis
QILCYLKKENNMSKTRAVIPGSFDPITYGHLDIIERSADRFDEIHVCVLKNSSKGGTFDSEERMTLIEESVKHLPNIQVHHFNGLLVDFCDQVGAKTIIRGLRAVSDFEYELRLTSMNKKLNSNIETMYMMTSANYSFISSSIVKEVAAYQADISPFVPPHVERALKKKFNV

SEQ ID NO: 3428 - protein, 1154 aa, Staphylococcus epidermidis
GVSWLLKQIKKLLVANRGEIAIRIFRAAAELNISTVAIYSNEDKSSLHRYKADESYLVGSDLGPAESYLNIERIIEVALRAGVDAIHPGYGFLSENEQFARRCAEEGIKFIGPHLEHLDMFGDKVKARTTAINANLPVIPGTDGPIESFEAAEQFANEAGYPLMIKATSGGGGKGMRIVRESSELEDAFHRAKSEAEKSFGNSEVYIERYIDNPKHIEVQVIGDEFGNIIHLYERDCSVQRRHQKVVEVAPSVGLSNKLRERICDAAIQLMENIKYVNAGTVEFLVSGDEFFFIEVNPRVQVEHTITEMITGIDIVKTQILVANGESLFGDKISMPQQNEIQTLGYAIQCRITTEDPTNDFMPDSGTIIAYRSSGGFGVRLDAGDGFQGAEISPYYDSLLVKLSTHAVSFKQAEEKMERSLREMRIRGVKTNIPFLINVMRNDKFRSGDYTTKFIEETPELFDIAPTLDRGTKTLEYIGNVTINGFPNVEKRPKPEYESTKIPKISQKKINQLFGTKQILEQHGPTGVTNWVREQEDVLITDTTFRDAHQSLLATRVRTKDMMNIASKTAEVFKDSFSLEMWGGATFDVAYNFLKENPWERLERLRKAIPNVLFQMLLRASNAVGYKNYPDNVIKKFVHESAKAGVDVFRIFDSLNWVDQMKVANEAVQEAGMVSEGTICYTGDILNAERSNIYTLDYYVKMAKELEREGFHILAIKDMAGLLKPKAAYELIGELREATHLPIHLHTHDTSGNGLLTYKQAIDAGVDIIDTAVASMSGLTSQPSANSLYYALNGFPRNLRTDIDGLEELSHYWSVVRPYYADFESDIKSPNTEIYQHEMPGGQYSNLSQQAKSLGLGERFDEVKEMYRRVNFLFGDLVKVTPSSKVVGDMALYMVQNDLDEDTVINDGYKLDFPESVVSFFKGDIGQPVNGFNKKLQDVILKGQQPITERPGEYLEPVDFEAIRQELSDIQQDEVTEQDIISYVLYPKVYKQYIQTKEQFGNVSLLDTPTFLFGMRNGETVEIEIDTGKRLIIKLETISEPDENGKRTIYYAMNGQARRIYIQDENVKTNANVKPKADKSNPNHIGAQMPGSVTEVKVSVGDEVQANQPLLITEAMKMETTIQAPFDGIIKQINVANGDAIATGDLLVEIEKQS

SEQ ID NO: 3429 - protein, 383 aa, Staphylococcus epidermidis
SQKWRKCKMNFSKLKFGATIGIIGGGQLGKMMAQSAQKMGYKVIVLDPNEDCPCRYVAHQFIHANYDDEQALNQLGENSDVVTYEFENISSEQLKKLTQLYHIPQGYQAIELLQDRLTEKQTLLEANTQIVPFVQIHTNQDLLKAIEKLGFPCIVKTRFGGYDGKGQILVRNDSELDEAYQLVEKQECVAEQYLDIQKEVSLTVTIGNEQQTTYFPLQENEHQNQILFKTVVPARSDKENEARKEVEKITRAIHFVGTFTVEFFIDKENNLYVNEIAPRPHNSGHYSIEACDYSQFDTHILAITGQKLPQAIELLKPTVMMNLLGRDLDLLENEFSRHPDWHIHIYGKKERKPDRKMGHMTLLTDDVNQTEQYMLMKFEGRDK

SEQ ID NO: 3430 - protein, 668 aa, Staphylococcus epidermidis
SWRWTLMNFPWDQLLVKGNWMIISAQIAAPFLVIGLIAVISYFKLWKYLYKEWFTSVDHKKIGIMYLISAVLMFVRGGIDALMLRTQLTIPDNKFLEANHYNEVFTTHGVIMIIFMAMPFIFGLWNVVIPLQLGARDVAFPVMNNVSFWLFFAGMILFNLSFIVGGSPAAGWTNYAPLAGEFSPGPGVNYYLIAIQISGIGSLMTGINFFVTILRCKTPTMKFMQMPMFSVTTFITTLIVILAFPVFTVALALMTADRIFGTQFFTVANGGMPMLWANFFWVWGHPEVYIVILPAFGMYSEIIPTFARKRLFGHQSMIWATAGIAFLSFLVWVHHFFTMGNGALINSFFSISTMLIGVPTGVKLFNWLLTLYKGRITFESPMLFSLAFIPNFLLGGVTGVMLAMASADYQYHNTYFLVAHFHYTLVTGVVFACLAGLIFWYPKMMGYKLNETLNKWCFWFFMIGFNVCFLPQFILGLDGMPRRLYTYMPSDGWWLLNFISTIGAVLMAIGFLFLVASIVYSHIKAPREATGDNWDGLGRTLEWSTASAIPPKYNFAITPDWNDYDTFVDMKEHGRHYLDNHNYKDIHMPNNTPVGFWMGIFMTIGGFFLIFESIVPALICLAGIFITMIWRSFQIDHGYHIPASEVAETEARLREARIKEREAVSHES

SEQ ID NO: 3431 - protein, 566 aa, Staphylococcus epidermidis
CGERRIMKQLHSNEVGVYALGGLGEVGKNTYAVEYKDEIVIIDAGIKFPDDNLLGIDYVIPDYTYLEQNQDKIVGLFITHGHEDHIGGVPFLLKQINVPIYGGPLALGLIRNKLEEHHLLRTTELHEIDESSVIKSKHFEISFYLTTHSIPEAYGVIVDTPEGKIVHTGDFKFDFTPVGEPANIAKMAQLGHEGVLCLLSDSTNALVPDFTLSEREVGQNVDKIFRNCKGRIIFATFASNIYRVQQAVEAAIKYNRKIVTFGRSMENNIKIGMELGYIKAPPETFIEPNKINSVPKHELLILCTGSQGEPMAALSRIANGTHKQIKIIPEDTVVFSSSPIPGNTKSINRTINALYKAGADVIHSKISNIHTSGHGSQGDQQLMLRLIQPKYFLPIHGEYRMLKAHGETGVQCGVDEDNVFIFDIGDVLALTHDSARKAGRIPSGNVLVDGSGIGDIGNVVIRDRKLLSEEGLVIVVVSIDFNTNKLLSGPDIISRGFVYMRESGQLIYDAQRKIKGDVISKLNSNKDIQWHQIKSSIIETLHPYLYEKTARKPMILPVIMKVNEDK

SEQ ID NO: 3432 - protein, 466 aa, Staphylococcus epidermidis
PNILFRLIYSHILMGVILLNSNNNNHEQQRSLDEINNTINFNHNDSASQKFLAFLGPGLLVAVGYMDPGNWITSMQGGAQYGYTLLFIILISSLSAMLLQSMTVRLGIATGMDLAQMTRHFLNKPVAIMFWIIAELAIIATDIAEVIGSAIALDLIFGIPLIVGALITVFDVFLLLFIMKFGFRKIEAIVGTLIFTVLAIFVFEVYISSPHIIDMLNGFVPHKEIITNQGILYIALGIIGATIMPHNLYLHSSIVQSRKYDRHSIHEKAQAIKYATIDSNIQLSIAFVVNCLLLTLGAALFFGTKTEDLGGFYDLYLALKTEPALGATLGGIMSTLFAVALLASGQNSTITGTLAGQIVMEGFLKLSIPNWLRRLITRSLAVIPVIICLIVFKGNTEKIEQLLVFSQVFLSIALPFSLIPLQLATSNQNLMGPFKNKTWINIISWLLIIVLSGLNVYLIIQTFQEL

SEQ ID NO: 3433 - protein, 299 aa, Staphylococcus epidermidis
VCILNQKQYTSWYQVKLKKNLISELKVMRTIIMHNINKWLLVPYLLWMVIFIIIPVILLVYFSFIDIHGHFSFTNYEQVFSTRYLKMFIDSIWYAALITMITLIISYPAAYFISYSRFQNILLMLLIIPTWINLLLKTYAFIGLLGHDGVINQALHIFQIPKLNLLFTSGAFLLVASYIYIPFMILPIFNSMKAIPNNILQASNDLGASTFTTFRKVIVPLTREGIKTGVQVTFIPALSLFMITRLIAGNKVINVGTAIEEQFLTIQNYGLGSTIALFLIIFMAFLLIITKSKSSNGKG

SEQ ID NO: 3434 - protein, 100 aa, Staphylococcus epidermidis
KVFRTKNKKHLQSRKIDVEPVFGFMKAILGFTRMSVRGINKVKRELGFVLMALNIRKVTAQRAENNQKNNKKDNFYIISIEIVFFIYLGTLSPTLFIYVR

SEQ ID NO: 3435 - protein, 170 aa, Staphylococcus epidermidis
QSKSFERVYKVKVAVIMGSSSDWKIMKESCSMLEEFEIPYEKKVVSAHRTPQMMFNFASQARQNGFDIIIAGAGGAAHLPGMVASMTTLPVIGVPIESKSLKGLDSLLSIVQMPGGIPVATTAIGKSGAKNAGILAARMLGITNESVQNNLENYEKSLVAKVEEMQNELQ

SEQ ID NO: 3436 - protein, 73 aa, Staphylococcus epidermidis
LITGVNHCPPAEPILLIVHVAPFISSEVNLPSRAFTASSLISSEISNIDLRSACLTTGTNNPLSVSAAIPIFQ

SEQ ID NO: 3437 - protein, 384 aa, Staphylococcus epidermidis
RMLGEQYTQIKRPANRLTEKILGWFSWVFLLILTIVSMFIALVSFSNDTSIANLENTLNNNELVQQILANNDLSTTQFVIWLQNGVWAIIVYFIVCLLISFLALISMNIRILSGFLFLIAAIVTIPLVLLIVTLIIPILFFIIAMMMFARRDRIETVPSYYNEYDQPYYDERGFYEPESRNEHGYNDDVYEPMHTKKEDRNTRRQFNRNAQQQDSYNGITDNQPDEDTSSDQLYSDEYVDNEDKYSQFPKRAVESEYASQQTEDEPTVMSRQAKYNKKSKNTDFEDAQQEHMEGNQFDDVGVVEPQIDPKELKAQRKREKAEIRAKKKEKRKAYNKRMKERRKNQPSAVNQRRMNYEERRQMINNEQEDTDNNLNQQEDSKKEN

SEQ ID NO: 3438 - protein, 95 aa, Staphylococcus epidermidis
LYKGEFNMEQKSYVITDETGIHARPATMLVQTASKFDSDIQLEYNGKKVNLKSIMGVMSLGVGKDAEITIYADGSDETDAIQSITDVLSKEGLAE

SEQ ID NO: 3439 - protein, 382 aa, Staphylococcus epidermidis
RSEGFNRCHSFIFIGGNCMNPLLSFKDVSKGFEDVQILNEINIDIEPGYFYTLLGPSGCGKTTILKLIAGFEYPDSGDIIYKDKPIGKMPPNKRKVNTVFQDYALFPHLNVFDNIAYGLKLKKLSKSEIKRKVTEALQLVKLSGYEHRQIQGMSGGQKQRVAIARAIVNEPEILLLDESLSALDLKLRTEMQYLLRELQSRLGITFIFVTHDQEEALALSDYIFVMKDGKIQQFGTPIDIYDEPVNRFVADFIGESNIVHGTMVEDFVVNIYGQNFDCVDMGIKENKKVEVVIRPEDISLVSQNDGLFKAKVDSMLFRGVHYEICCKDRKGYEWVIQSTKKANVGSEVGLYFEPEAIHIMVPGETEEEFDKRIESYEDYHHA

SEQ ID NO: 3440 - protein, 735 aa, Staphylococcus epidermidis
KVGGNKMSKFIEPSNEEIKLEKLYQDIGLSDKEYDKVVEILGREPNFTEVGIFSVMWSEHCSYKHSKPFLKQFPTTGEHVLMGPGEGAGVVDIGDNQAVVFKVESHNHPSAIEPYQGAATGVGGIIRDIVSIGARPINLLNSLRFGELTVKQNQRLLKGVVSGIGGYGNCIGIPTTAGEIEFDERYDGNPLVNAMCVGIIDHDMVQKGTAKGVGNSVIYVGLKTGRDGIHGATFASEELTEESESKRPSVQIGDPFVGKKLMEATLEAITFDELVGIQDMGAAGLTSSSSEMAAKGGSGLHLRLDQVPTREPGISPYEMMFSETQESMLLVVEKGTEQKFLDLFNKHELDSAVIGEVTDTDRFVLTYDDEVYADIPVQPLADEAPVYILEGEEKEYNTSKNDYSNIDVHDTFIKLLQHPTIASKHHLYEQYDQQVGANTIIKPGLQASVVRVEGTQKAIASTIDGEARYVFNQPYEGGKMVVAEAYRNLIAVGATPLAMTDCLNYGSPEKKEIYQQLIDSTKGMSEACKVLQTPVVSGNVSLYNETRGTSIFPTPVVGMVGLIEDVSYLKEFKPKAGDKIYLVGETRDDFGGSQLEKLLYGSVNHEFESIDLSDEVSKGKLIKQAIRNGIASHVQTVGKGGLLVTLAKISAHYDLGMQAQLDVTNAQLFSETQGRYIVVVKEGQTLDIDQAQEIGHLTHQQLFDISNSDVKIKENVSDIKQKWEGAIVQCLTTQD

SEQ ID NO: 3441 - protein, 419 aa, Staphylococcus epidermidis
KERGNLLKVLIVGAGGREHTLASKINQSPIVDKVYAIPGNDAMVNIAEVHSEIAESDHQAILHFAQHNAIDWVIIGPEQPLIDGLADLLRNANIKVFGPGQDAAQIEGSKLFAKQLMDKYRIPTAEYKEVSSRNEALQYVETCDLPIVIKKDGLAAGKGVIIAFTREDALEGVKKIYQEEKGKVVFESYLEGEEFSLMTFVNGDYAVPFDCIAQDHKRAFDNDQGPNTGGMGAYCPVPHIDASVLEQTNKEIAQPIAKAMAQEGHDFFGLLYIGAILTKDGPKVIEFNARFGDPEAQVLLTRLESDLMQLIIDLENCQPIHFNWKDEAVVGVMLASKGYPGSYEKGHEISGFNLDSHYYVSGLKKEGQCFVNSGGRVILAIGEGPTVEKAQANAYEHARQIKSDNLFYRNDIGNKAITK

SEQ ID NO: 3442 - protein, 391 aa, Staphylococcus epidermidis
TKIIGKPYICSIRRSKKVSKFKSLLLLFGTLILLSGCSNIEVFNAKGPVASSQKFLIIYSIIFMLVIVAVVLSMFAIFIFKYSYKKNSESGKMHHNSLIETIWFVVPILIVIALAIPTVKTLYDYEKPPEKDKDPLVVYAVSAGYKWFFAYPDQHIETVNTLTIPKDRPVVFKLQSMDTMTSFWIPQLGGQKYAMTGMTMNWTLTADQLGTFRGRNSNFNGEGFSRQTFKVHSVSQNDFDKWVKEAKGKKTLSQDTFDKQLLPSTSNKELTFSGTHMAFVDPAADPEYIFYAYKRYNFEQKDPNFTAEEDLYKDVKDKPIKPARKVHITNPNYERHGMKPMILGNNEKYDNEFKKEEDHNSKEMEKISKGAKDENASKLHKKEHDDHGGGH

SEQ ID NO: 3443 - protein, 84 aa, Staphylococcus epidermidis
EMNIIPRTSLIIYLKHMKHERQIRKYGHIVHSNRQRKYVVMYINEADADNIVHKLMQLKYVHEIQGSPYKYLKKTYEKEKHEIQ

SEQ ID NO: 3444 - protein, 442 aa, Staphylococcus epidermidis
TIFIYNNFEVNSMSFLRKHTEIIFSYIIGIVSLFTGLIIFINLPLIKQFKGDKKVDTHVHNVWEFLNAFFAEIIKVMSKFIGGFPITSAIVIIVFGILVMLLGHTLFRTIKYDYDISIFFLVIGIMYFIITLLLMTQVYGFFAIVFIIPFTVHIGYIVYKDELNQDNRKNHYMWIIVTYGMSYLITQISLYGRIDANEIESIDILSVNTFFIIMWLLGQMAIWNFLFLRRSLPLTKEELGEEEPELSRTNKGNVSNQTKVHLKQLQNKTTEYARKTRRSVDLDKIRAKRDKFKQKINSIVDIQEDDIPNWMKKPKWVKPMYVQLFCGVIILFFAFLEFNNRNALFLTGEWELSQTQYVVEWVTLLLLLFIIIIYIATTLTYYLRDKYYYLQLFMGSILFFKFLTEFINIMVHGLLLSIFITPILLLMLIAMIVAYSLQLREK

SEQ ID NO: 3445 - protein, 281 aa, Staphylococcus epidermidis
YVVIGDDTMALYDFAKGLILEAGNKVRLMMQEELDIKTKSNPNDLVTNVDKATENYLYETILHNYPDHQVIGEEGHGHNLEYLKGVIWVIDPIDGTLNFVHQKENFAISIGIYHDGKPYAGFVYDVMKDVLYHAKVGQGAFENTHKLEMIQNTELKRSIIGINPNWLSKPILSDIFSSIVNEARSARAYGSAALEIISVAKGQLAAYLTPRLQPWDFAGGLLILNEVGGIGTNLLGDKLDFNQPNSILIANPSLHREILNHHLNQQRDTLITLHEKRFGKR

SEQ ID NO: 3446 - protein, 210 aa, Staphylococcus epidermidis
SNKIFEYLLMYLCLSYLIYYLIRKVYDMITMKDIIRDGHPTLREKAKELSFPLSNNDKETLRAMREFLINSQDEETAKRYGLRSGVGLAAPQINEPKRMIAVYLPDDGNGKSYDYMLVNPKIMSYSVQEAYLPTGEGCLSVDENIPGLVHRHHRVTIKAQDIDGNDVKLRLKGYPAIVFQHEIDHLNGIMFYDYIDANEPLKPHEEAVEV

SEQ ID NO: 3447 - protein, 382 aa, Staphylococcus epidermidis
KGEMQMKSVGLITEYNPFHNGHLFHATLSKQRSETNVTIAIMSGNFVMRGEPAIYHKFKRTKMALSAVDLVVELPLIGSLSSSDTFAEIAIKTAQYLDIDIISFGSESASLKDLQYLATQMIDYEKHPDFKEKLKQGKSYPRILSELTHNDTLLQSPNNILGISYLKAMQQFAPHMSALTIKREGSLHHQKVIDHHHFASGTSIRRSLMNDNVDWKNVVPNQIQSLYCKPHTTVEDTFPFIKHQLITQPKESLHSIYTINEGFENRLQTMIHRSDSFESLLSNLKTKRYTQTYIQRVLMNVLLNITKDDVNKEINAVRVLGMSEKGRSYLKYLKANYPNRHYITNVNQKTAHYFKNEIKATHVYNLLSNQSQTDFNTPLVRI

SEQ ID NO: 3448 - protein, 340 aa, Staphylococcus epidermidis
NKMIYAYIGITVLWVFLFCYIIIASIDFGAGFFALHSKMTGNEKKVNHLIHRYLNPVWEVTNVFFVFFFVGFIGFFPDSAKYLGTVLLVPGSIALILISIRSSFYAFENYGQDTKLPWIVLYGLTGLLIPASLATALTISEGGYIYEHGTHIDLDWIQLLLSPFAWSVVFLAIVSVLYISSGFLTYYAHKANDQPAYDMTRQWHIFWGPPMIVISLFVFLSLRIQNSDHFRTAIFNYWWMFAISFIFFIIAGLLTIFKKKHGLAFIMVILQMLFAFFGYGMSKLPYLLYPFIKITDSHVNPEMGLSLVIVFVLGLLLLIPSLILLLRLFVFDKAYVEGKK

SEQ ID NO: 3449 - protein, 312 aa, Staphylococcus epidermidis
EDSIMAHSKKWFINGTLATAGIISSLFYFLKNKNKSPQQLKSIPPFFSGQAPYIFAHRGGMAMRPEQTQLAFDNAVEYGLDGFETDVRLTKDEQLIVFHDALVDRTTNGSGKVSEHTLAELKRLDAGYHFTDINNQTPYRGHDKAKILSFEELLELYPNMYINVDLKDAPDTYEGRIAPKVIYDNIIKHGAQHRVLVTSFHKKQIQRFTEYNQADIAIGASEGEVAEGFIKFNGMLGHTFKPQADTFQMPVAYKGISLTSKRFIQWLNLNNIVPGYYGVNSIDLMTDLYHKGVHTLVTDRPDLGQQFKETLK

SEQ ID NO: 3450 - protein, 67 aa, Staphylococcus epidermidis
DGTVSILSLLANIIIAMIKNKIGMIRVTINNTSGIVTIAAIKKRKPDKILIFIEINAKNEMSKQTIK

SEQ ID NO: 3451 - protein, 95 aa, Staphylococcus epidermidis
GEYVMSNQSKLNSAAYDQLNKDADRILHLIKVQMDNLTLPSCPLYEEVLDTQMFGLQKEVDFAVQLGLVDKEDGKQLMLRLEKELSKLHEAFTNV

SEQ ID NO: 3452 - protein, 467 aa, Staphylococcus epidermidis
LLRVKNLRLKYPNGDRKIFNNLNLEIKNKEKVLLLGPSGSGKSTLLNVLSGIVPNLIELPMKYDELNIDHDSGVIFQDPDNQFCMPKVYEELAFVLENRNIPRSEMDQEIEDALKSVDLNVTHKTYVNNLSGGMKQKLAIVETILQKSKTLFLDEPTAMLDVKATEDLWKKLINLWEDQTVLIVEHKVEHIWQHVDRVLLLNYDGEIVADDTPEQILDHYEALLTEYGVWHPRAWHSAPRPIPLPNQTKNLLFHFDDGQIIRGKKTLFSSKELKLYSGEWLTITGKNGAGKTSLLEAMLQLIKYEGDMFYRDQLLSKIKQAAKHMYLVYQNPELQFITNSVYDEVYIHYNHLDPKHANDETMDLLKLLHLDQVKDHHPFEISTGQKRRLSVATALSSKAEIILLDEPTFGLDSHNTFQLIKLFQERVNQGQTIIMVTHDPEIIKRYPTRRLRVEDGCLKEMEGEHIV

SEQ ID NO: 3453 - protein, 73 aa, Staphylococcus epidermidis
NKCLYIFLAKMIMTFLFNHTTTLKRLKDFKYFNCNLIILWLSVTHPVTFKNYNATNIMIFIMSTNTNTCSRTL

SEQ ID NO: 3454 - protein, 451 aa, Staphylococcus epidermidis
MDSVEIARLLTGMTLAVHIIFATIGVGMPLMFAIAEFIGIKKNDANYITLAKRWSKGYTITVAVGVVTGTIIGLQLSLVWPTFMKMGGHVIALPLFMETFAFFFEAIFLSIYLYTWERFKNKWTHFFISIPVIIGGSFSAFFITSVNSFMNTPAGFEIKNGRMVNVQPLEAMFNSSFMVRALHVVATAGMTMAFILAAIAAFKLLRHNHTEDRTYHTKALNLSMIVGFINTVLSMIAGDLSAKFLHKVQPDKLAAYEWHYDTQSHANLVLFGVLNEKTHEVSGALEIPGLLSFLADNSFNTKVKGLNEFPKNELPPMIVHYFFDLMVSMGIFCFIISGLYMLFLIVKKLRKYVTSNMMLYAILLTGPASMLAIEFGWFLTEMGRQPWIIRGYMRVSEAATQAGGITLVTTLFGLLYLLLLVTSAYVLIRMFKNQPAYKDVEKVIKERGETK

SEQ ID NO: 3455 - protein, 102 aa, Staphylococcus epidermidis
KIKVYEGEDTMEYQYPLDLHWTNDEMMKVIHFFNKIENYYEASVKGDEVLNAYKNFKHIVPGKADEKQIFKEFENKSGYNSYKVVQEIKKNPNQTLFSKDFD

SEQ ID NO: 3456 - protein, 276 aa, Staphylococcus epidermidis
WEGVISVKWYGKLYIALLISVLYIPIFFLMIYSFNSAGNMSHFEHFTLEHYHSLFHNDRLMSVIFNTVAVALLSASIATVIGTFGAIALYYLRNKRFKVTLLTMNNVLMVSSDVVIGASFLIMFTAIGHFTGLGLGFSTVLASHIAFCIPIVVIIVLPQLYEMNDNMLNAARDLGANESQLLTSIIIPNIMPSIIGGFFMALTYSLDDFTVSFFVTGNGFSVLSVEVYAMARKGISMEINAISTIIFIAIMFGVFGYYFIQHIVNRQKKMKRGVNE

SEQ ID NO: 3457 - protein, 503 aa, Staphylococcus epidermidis
LKSLNRGVSYRMKKAILSVSNKSGIVEFAKALTNLDYELYSTGGTKRVLEDANINIKSVSELTQFPEIMDGRVKTLHPAVHGGILADRDKEHHLEQLREQHIDLIDMVVVNLYPFQQTVAQPDVTETDAIENIDIGGPTMLRAAAKNFKHVTTIVHPSDYNEVIERIKNHQLDEAYRKSLMVKVFQHTNEYDHAIVNYFKDNKETLRYGENPQQSAYFVRTSDSKHTIAGAKQLHGKQLSFNNIKDADAALSLVKKFNEPTAVAVKHMNPCGVGIGQSIDEAFQHAYEADNQSIFGGIIALNRTVDVKLAEALHSIFLEVVIAPQFTEEALKILTQKKNIRLLQIDMTIDNAEQEFVSVSGGYLVQDKDNKDVTRNDMTVATDIQPTEAQWEAMLLGWKVVSAVKSNAVILSNNKQTVGIGAGQMNRVGSAKIAIERAIEINDNVALVSDGFFPMGDTVEYAAEHGIKAIIQPGGSIKDQDSIDMANKYGITMVMTGMRHFKH

SEQ ID NO: 3458 - protein, 312 aa, Staphylococcus epidermidis
YFKLMMGCLSLFRKQNLKWLGVLATIIMTFVQLGGALVTKTGSEDGCGSSWPLCNGALLPENLPIQTIIELSHRAVSAISLIVVLWLVITAWKNIGYIKEIKPLSIISVGFLLVQALVGAAAVIWQQNPYVLALHFGISLISFSSVFLMTLIIFSIDKKYEADILFIHKPLRILTWLMAIIVYLTIYTGALVRHTKSSLAYGAWPIPFDDIVPHNAHDWVQFSHRGMAFITFIWIMITFIHAIKNYSDNRTVRYGYTASFILVILQVITGALSVITNVNLIIALFHALFITYLFGMIAYFILLMLRTTRSLK

SEQ ID NO: 3459 - protein, 198 aa, Staphylococcus epidermidis
YTYSFIGGRIVTNIAIFASGSGSNFENIVKHIQTGQLSGINVTALYTDNEGVPCIDRAKNLNIPIHINKPKDFSSKSLYEQHLLKLLSSEEVQWIVLAGYMRLVGQDLLQAYEGRILNIHPSLLPKFKGLDAIGQALESGDTVTGSTVHYVDSGMDTGEIIEQQQCDIKPDDTKEQLEDRVKHLEYELYPRVIAKIIK

SEQ ID NO: 3460 - protein, 395 aa, Staphylococcus epidermidis
ERYSFMKLATLNKGKETKYLNHYPLIDEEDLFEHDHLKEGDLITLVTEQQQYIATGYIGRQHKGLGWVLSYNQNEEINTLFFKRLFEAALEERQYYFNIEGTNAFRLFNAEGDGVGGLTIDNYNGHLLIQWYSKGIYKFRFPILEAIKEVYEYTSIFEKMRFKGTSYTGGFVEGNAPEFPIVVEENFTFYNVDLNDGLMTGIFLDQKEVRKKLRDQFSERRHVLNLFSYTGAFSVIAAENANSTTSVDLANRSRGLTEENFGLNGINPKSQYIYVMDTFDFYNYAGRHGHQYDTIVIDPPSFARNKKKTFSVQKDYNLLIEGALNILSPGGTLLLCTNSSAFSLKAFKNVIKKTLAQNNIVYEINEVMGLPKDFKTHPHYKPSKYLKAVFVTIKH

SEQ ID NO: 3461 - protein, 269 aa, Staphylococcus epidermidis
FLLSVECIDLFGCSGAPDCAGVPGSTGLPGSTGLPDSAGLPGSAGVPGSAGLPGSAGVPGSAGLPGSAGVPGSAGLPGSAGVPGSAGVPGSAGLPGSAGLPGSAGLPGSAGVPGSAGLPGSAGVPGSAGLPGSAGLPGSAGLPGSAFVGPYSTISSTGCLVTFSVDLPSPTFSPVIGLTNIGVVIVFVPGSPFCLTRSSPGFKSGLNTRFLSNGISSVDVIGLPTFGPYFVTSSTGGVTTSPVSGFLTPGLPGTSVLLSTGAFGSNSSL

SEQ ID NO: 3462 - protein, 125 aa, Staphylococcus epidermidis
VMTSIVVVSHSHKIAEGVKQLINQMTDGGVDLIAVGGLSDDEIGTSFDQIVSVINGLENDALCFYDIGSAGMNLDTALEMYEGDHKIVKMEAPIVEGSFIASVGIKSNMSMDSVISEVRAKYPEE

SEQ ID NO: 3463 - protein, 538 aa, Staphylococcus epidermidis
KLGSYSTNPTITCIQYSTSSIFGDDSMKTYKPYRHQLRRSLFASTIFPVFMVMIIGLISFYAIYIWVEHRTIHQHTYQTQTELQRIDKHFHTFVTQQQKQWRHVDLSHPADITKMKRQLLKQVHQQPAILYYDLKGSSQSFTNNYEQLDTTKMYLISKYRIDFKDDTYILKIYMSSTPLLKNIKKNSGQSALIVDSYDTVLYTNDDRFSIGQKYQPPQFGFINESLKLNSHHAHLIIYKDIHETIEDGIALLVVMGVVLILLVIFGYISADRMAKRQSEDIEAIVRKIDDAKNRHLGSYEPLKKHSELEEINNYIYDLFESNEQLIQSIEQTERRLRDIQLKEIERQFQPHFLFNTMQTIQYLIPLSPKVAQTVIQQLSQMLRYSLRTASHTVKLAEELSYIEQYVAIQNIRFDDMIQLYIDATEGVQHQTIGKMMLQPLVENAIKHGRDSEPLKITIRIRLTKRKLHILVHDNGIGMSPSHLEHVRQSLHHDVFDTTHLGLNHLHNRAMIQYGTYARLHIFSRSQQGTLMCYQIPLV

SEQ ID NO: 3464 - protein, 2404 aa, Staphylococcus epidermidis
CKLFMSYYGNEYERRTLMNIEALYFQKYFYFKHLNQSSSEHRVTYWVKLSRDIELRRLMYALLDVVQSQPVLRTQFVTDDFNQLKINLRDFFPFIEIKEVNEMSQSIDLEAFFTRNLNSYHFNQLPLFNFKIYQFLDEAYLLLDFHATIFNESQLTPFLQQLNIAYTHSLKSEYSISDFYNWIKEMNQKMDQNQVVCPSKHFNVLNADGDNYAYIPVKNTCEKKKMCSLHAELPSLDIDVWIVSIYLAHHFISQSSDVTLGIHFSIDNKNTENMMVLNTDIAPLNLSISQSDVVKDMVDECSALLEELQMCGASFVVQPKAVQIDVETMIHIEKVQEQFELNHICHHIHRLYNEASSFADLEFYPHVQDGFDIVYNDNVYDDLTVHTLVKLINGIYMQITQNPSLLIKDIKLSDRSDLAKYNDINLQNNDINYSEVTYKTVVERFERQVHQHPDSIALQYEQRSMTYHQLNQCANLLAYRLRLNHQIEPNDMVALIAERSLEMIIGMLGILKAGAGYIPIDPDYPEERMNYIIEDAKPKAVVTYRTSFQSGLPQMDIELIVDSREHDIDNPRGINCSEDIAYVIYTSGTTGKPKGTLVPHRGIDRLVHNPNYVELNENTTVLLSGTVAFDAATFEIYGPLLNGGRLVITSKDTLLNPQLLDQAITENKVNTMWLTSSLFNQIASERIEALESLTYLLIGGEVLNAKWVHLLNSRECHPQIINGYGPTENTTFTTTFAIPQEMPSRIPIGLPISGTTVYVMQGDRICGVGVPGELCIGGAGLAKGYLNQPKLTAERFIQSPFNNEMLYRSGDLVRLQEDGYIDYISRIDKQVKIRGFRIELSEIEKALEAIRDINKAVVIVREQDQDKQIVAYYEASQLKSTGQLKDILSETLPEYMIPVHFMKVDRIPITMNGKLDVRALPEINLKNNRNYVEPRNDIERTVCRIFEEILHVDQVGVKDNFFELGGHSLRATLVVNRIEERLKKRLKVGDLMKSPTVEQLGQQIEELQNDVYEVIPKANESYQYDLSASQKSMYLLWKVNPKDTVYNIPFLWRLSSELNVMQLQRALSKLIERHEILRTQYVIDDNEVKQRIATHVSPDFEEVTTSLTNEQDIIQSFMEPFDLEQPSQMRVKYIHGPQQDYLFMDTHHSINDGMSNTILLSDLNALYQDKSLPELKLQYKDYSEWMVHRDLSKQRHFWLQQFENQVPILNMPTDYPRPSIKTTNGNMLTFHYNRQIKQQLKSYVEQHQVTDFMFFASAIMVLLHKYTRQDDIAIGSVISARTHRDTENMLGMFANTLVYRGRPHDQKTWDQLMAEMKEMCLGAYEHQEYPFESLVNDLVDERDASHNPLFDVMLVLQNNETNHANFGHSQLTHIPPQSTTAKFDLSFIIEEDQDDYVVNIEYNTDLYKQETIHHIAEQLQMIIKHVISTENLKIQDIDENDDLLIWLDKHVNDCSLDLPKNKSIQQLLHDVMKAKADDVALKMNGQSMTYQELDDYSNSMAQTLIQNGIQKGERVALLTERSFEMVASMIAVLKVGGSYVPIDVTYPDKRIEFIIEDAEVAAVLTYGKAISSHIPVIKIEDIDNTENNKRLNIEYAGNLEDDMYHIYTSGTTGKPKAVSVKQRNILNLVCAWTKRLNLSDDEVYLQYANYVFDASATDFYCSLLNGYPLVIATSVERTNTDLLEKLISQENITIASIPLQVYNVMHHFYIPKVITGGAPSTPAFVQHISKHCDMYVNAYGPSENTVITSCWIYEKGDAIPSTIPIGKPLANVDIFIMSGGKLCGVGIPGELCIAGESLTSGYLNRPELSAEKFINNPFGPGQLYRSGDLARLMPDGQIEFLGRIDKQVKVHGYRIELGEIENIINSVDTVTDSVVILAKQGEREVLHAYYVGSQEDENHISQHLNQYLPKYMIPKTLTAISEIPLTGNDKVDESRLPVPNVHKNKFVAPRNNIEREIAQIVSGVLDVSSMSIDDDFFEMGGTSLDAMVVVSKLKSNGIHITMQDVYQFKTVRYIANHTEKRQALPEVVLPDHLPQLQSLVERRYQLKSQHLTQSSLGHVLLTGATGFLGAYLIDEMQDDADQITCIVRGHDINQAKTNLENNLNCYFDTAHVDKLMKHIDIILADLSELDHLIIDSAIDTIIHAGARTDHFGDDETFFDVNVRSTQALIDLAKNKKAKLIYISTISVGTVFEVHQDDITFSEKDLYKGQLFTSPYTKSKFYSEIKVLEAVNEGLAAQIIRLGNLTSASTGPLNMKNLTTNRFSIVMHDLLKMPFIGESISKAKVEFSFIDVTARHIIKLARSNAIPIIYHVYAPCSITMKQVIDNAKGSEMTVVSDSEFEQKLHELGMHELIGLNSNGDNQISGVTDSNMTQTVMKELQGEWPHLSYQWLQQWYHLLFEKFDAN

SEQ ID NO: 3465 - protein, 312 aa, Staphylococcus epidermidis
AYHPLKNGVENKFLIISMYFNLKIKRMNKMKFKKSLITALATITLVPSLMILDTQHEAKAVGNYYYNGMEDHNASAAYHKAKKVDNSQIVIKRYNYAHKNKYKAVGRVSNMDGWKGPGKDSMGTGFMVGNHTFVTNAHVVDKKNGQRTSPSKIKFQLNRDGKKIPYQFHAKKIYKIPSYDMVVVETKENMAQKANVQPLKLATNQKIKSLKFNKKLYSLGYPVMNGNNTYAYWNKLRFLQEASNKSELMTKDKFRAGDSGSPMVDSQYVVYGVRTYGYNLRGSSNHPYAQQEVAGAESLYGNPRDFILKHNK

SEQ ID NO: 3466 - protein, 71 aa, Staphylococcus epidermidis
IKVPPFILNNNIPSLRIIENRIPGASCVGTSSSHNKGMNAFDIKVKIGVRDNRLTIRQIPIKIGKACTINI

SEQ ID NO: 3467 - protein, 207 aa, Staphylococcus epidermidis
LKKFLKGFILFFLIVMLGFAGGLGYSHYKDSKANTDVSSKETQTSNKNTHEDTISQDEMQNQVDSQTNEVSNETSTKTLSEKAKRLREAFNVNDEEAQILADEIDRADVNKDGTITMDEMTPTLDRFAKEGKFQPSAGGTTNEAHHPKYTAEDARNMSDDEFLDAYTEGMSDDEAATIHESAQESNEYMKFLRGQVEARAKGQGGNY

SEQ ID NO: 3468 - protein, 320 aa, Staphylococcus epidermidis
MKKLIQDKNTILKDMLDGITVSNNDVEVVSDTIVVRKHKKQSGVALVSGGGSGHEPAHAGFVAEGMLDAAVCGEIFTSPTPDKILDAIKAVDNGDGVLLVIKNYAGDVMNFEMAQEMAQMEDIKVESVIVRDDIAISDPEKRRGVAGTVFVHKYAGYLAEKGVALDEIKSKVEALLPDIKSIGMALTPPMVPTTGKNGFDIEDNQMEIGIGIHGEKGLHREDVQPINVIVERLLDQLYKEIEKKPLIVMVNGMGGTPLSELNIVTKYLDEQFNQNDIDVKQWFVGDYMTALDMQGFSITVLPFSEELSEALAAPTASKYF

SEQ ID NO: 3469 - protein, 280 aa, Staphylococcus epidermidis
WEKLFQRRTVALLLPWCIVRRFRLIMSNYQQKNNAVNTVVNVNQLSILDQEKVLLKDVDLTVTKGAFHCIIGESGSGKSLLTRTILGMKQSQLCYQGDIDIDLTQTDAVFQDVQSNMFQNITLAKHFQYIYEANRTHLTKQRIKEDVLQMMQLLGLRQGEQLLERYPFELSGGMAQRVAFIMSLIRRPNYLFLDEPTSALDQENIKKFMHYLLRAQERYQMTIVFITHDINLVKDCATHISIMQQGKLIENGEAASILTKPTHNYTKKLITIAHRRQPYA

SEQ ID NO: 3470 - protein, 76 aa, Staphylococcus epidermidis
APITIPITVFVAPKSCPLRGMKTLSMAFALKNINVKIYNLKKGQDMAPFILSLLRLIVVYQSVLLYNHFVAYAIHL

SEQ ID NO: 3471 - protein, 327 aa, Staphylococcus epidermidis
KKELKIMTLNLAQRVLNREPLTKEEALTIFESSELDTFDLLNEAYTVRKHYYGKKVKLNMILNAKSGICAEDCGYCGQSVKMKEKQRYALVEQDQIKEGAQVATENQIGTYCIVMSGRGPSNREVDHICETVEDIKKIHPQLKICACLGLTKEEQAKKLKAAGVDRYNHNLNTSERYHDEVVTTHTYEDRVNTVEMMKDNNISPCSGVICGMGESNEDIIDMAFALRAIDADSIPINFLHPIKGTKFGGLDLLSPMKCLRIIAMFRLINPTKEIRIAGGREVNLRSLQPLALKAANSIFVGDYLITGGQPNEEDYRMIEDLGFEIDS

SEQ ID NO: 3472 - protein, 129 aa, Staphylococcus epidermidis
FRWFTWFCWRTWFRWFTWFCWRTWFRWFTWFCWRTWFRWFTWFCWRTWFCWRTWFRWFTWFRWFTWFRWFTWFCWRTWFRWFTWFCWRTWFRWFTWFRWFTWFRWFTWFCFCWTILNNFVNRLFSDFFC

SEQ ID NO: 3473 - protein, 142 aa, Staphylococcus epidermidis
MEITSVNHICFSVSDLNTSIQFYKDILHGDLLVSGRTTAYLTIGHTWIALNQEKNIPRNEISHSYTHIAFSIDEEDFQQWIQWLKENQVNILKGRPRDIKDKKSIYFTDPDGHKIELHTGTLKDRMEYYKCENTHMQFYDEF

SEQ ID NO: 3474 - protein, 273 aa, Staphylococcus epidermidis
KHVTLLKVAHLGIKDTWSDETLVDNVNFTVQCGETLGIIGESGSGKSITCKALIGLNAQRLSVSGDIFFEHQNLNTITEKQLRKIRGKDIAMIMQQGTRAFDPSTKVGKQMIETLRAHTTLSKQQIKQELIHYMTYMKLKDPQSLLKAYPYMLSGGMLQRMMIALALALKPKLIIADEPTTALDTITQYEVINAFKDIKHHFDCAMIFISHDLTVINKIADRVVVMREGRVIEEGRTNMVLQQPRHHYTAYLLSTKKTIYDYFQFVLRGDFNA

SEQ ID NO: 3475 - protein, 309 aa, Staphylococcus epidermidis
FHYLKERNEMKRHFLAIGAITITTLLAGCDFGDLVGQHQSDKQSENSNTQTEQASNNKNSNSDNDHSNNNDESRDRVEDLTQSQKVALAINDPSVSQYVVNASELRNHSFYANYNGGGQRKSIHTYKLESLPKKVEGAPNDMTFYTAKPSKGSFVTLIGIGNEKVLIAGTQSSGTYQQYAHSEAARELDLHELLDKYGKSSNYKNLANQITFTQGQLSNASEYTSDEGTSNNDASNDDKVTRDNVIDKVEAYEGHQLDTDTYTFKEPEQNEDGDWGFSILDKEGNLEGSYIVTSDGEVTKYDENGEEIE

SEQ ID NO: 3476 - protein, 65 aa, Staphylococcus epidermidis
LLYFKIIIVFKYIILVISILIVSEIKFNSTTTQKREGEFVLSFLGFLKVNKKVLSNGMELLNIFS

SEQ ID NO: 3477 - protein, 327 aa, Staphylococcus epidermidis
VLYLEMTYCSLSIKIYTLKILIVLTIGGHVVIMSQFKDTLYKLFEPMMKIEFYQNLLVNLLIILAYILMGMIVIAISRKLVTKFFNVNEKKKNRHKIKRSETLSTLIQNLISYVVWFIVLTSILSRFGISVSAILAGAGVVGVAVGFGAQTIVKDIITGFFIIFEGQFDVSDYVQINASGVTIAEGTVKTIGLRSTRIQSDTGEIYTLPNGMISEIVNYSATDVSPIVMIPISPNENYKVIEEKLLTFLPTLKNKYDIFVSAPDLLGLDSVDGNEMVIKLLAHVKPGMHFPGQRLLRKEVIQYFSEEGIHIPKPTLVKLDKELNKKE

SEQ ID NO: 3478 - protein, 208 aa, Staphylococcus epidermidis
IMYLYVTKMTETLEEVELLLNRSSRQLKKPERIHYRFLKDRLMHQLGDALIQYAIEQCAGLTPKEWEYHITTMGKVEIRSSCHIYVSISYSYPYIICIIDNQPIGIDIEEMKDLDYKHLAKNFTKNEFNQVTTLKDFYEIWTKKESYTKLIGEGLMNGLDCYDVTQNLRFLKKHVQFTSVDYFKRLIQICHMSKHSLNFEVVPLTQLL

SEQ ID NO: 3479 - protein, 292 aa, Staphylococcus epidermidis
QFNLKIYIKKECFMQRQVVEFSKYNPSGNMTILVHSKHQPSEYAAIAHQLMATTHMCCEQVGFIESVNYENGDNYHLVMSGNEFCGNATMSYIHYLKERLLIQHQQFQLRVSGCSHPVECKVHSQHYEVTMPKVHQVKERFVKLGEQQFKAFEISYDTYIHYVMMCDDVDLAIKQCVEDFVSAQTWHRQFKTIGVMLFQQDKQFIYPLIHIPAIDSLIWENSCGSGAASIGVLVNYLTDHDIQDYLVNQPGGSIIVSSRKSGQNEYQTTIKGQVSTVATGQAYIEQETMTQI

SEQ ID NO: 3480 - protein, 503 aa, Staphylococcus epidermidis
YINLERNMHMSEANHKNIVVVGAGIIGTSVATMLSKVSPNWHIDMFERLEGAGIESSNENNNAGTGHAALCELNYTVEQDDGSIDASKAQEINEQFELSRQFWGNLVKNGDISNPEEFIQPLPHISFVMGPTNVNFLRKRYETLRTLPMFDTIEYTEDMETMRKWMPLMMENREPGHQMAASKIDEGTDVNYGALTRKLAHYLEQKSNVSLKYNHDVVDLTQREDGKWEVVVENRETKEKVTKIADKVFIGAGGHSIPLLQKSGVKQREHLGGFPISGQFLRCTNPDIIKQHAAKVYSKEPQGKPPMTVPHLDTRYINGKQTLLFGPYANIGPKFLKFGSNLDLFESIKPYNITTMLASAVKNVPLIKYSIDQMIKTKEGCMNYLRTFIPDAKDEDWELYTAGKRVQVIKDSEQHGKGFVVFGTEVVNSDDNSMIALLGESPGASTSLSVVLEVLEKNFADDKEAWEPVVKEMVPTYGRSLINDEKLMRETRRETSKNLHLNR

SEQ ID NO: 3481 - protein, 415 aa, Staphylococcus epidermidis
NKCYIQFERVAKNFSKGVLFMKKKLSYMITIMLAFTLSLALGLFFNSAHADSLPQKNGANQKTTKVTVSNKDVPDAVRKLAEEQYLSRVALLDKASNHKATSYTLGEPFKIYKFNKESDGNYYYPVLNKKGDVIYVVTISPNPSNSKASKQQNNYSINVSPFLSKILNQYKNQKITILTNTKGYFALTEDGKVTLVLKTPRNNEKTYENATESTKPKDLNDFKQTASVTKPTLEYQSTRNEMYAEYVNQLKNFRIRETQGYNSWCAGYTMSALLNATYNTNRYNAESVMRYLHPNLRGHDFQFTGLTSNEMLRFGRSQGRNTQYLNRMTSYNEVDQLTTNNQGIAVLGKRVESSDGIHAGHAMAVAGNAKVNNGQKVILIWNPWDNGLMTQDAHSNIIPVSNGDHYEWYASIYGY

SEQ ID NO: 3482 - protein, 298 aa, Staphylococcus epidermidis
EKRYRIGYFKKVQGIGKEVVPTVVIDLVDQLKVKYSIKLILEVLNIPKSTYYRWKNKTYKNDTVTQKVIELCKANHYTYGYRKITALINQCYTSPINHKRVQRMMQKHHLNCRVRPKKTTRIGKPYYKTDNLLQRQFKASCPIEVLTTDITYLPFGHSMLYLSSIMDIYNGEIVAYKIDDKQDQSLVNDTLNQIDIPEGCILHSDQGSVYTSYAYYQLCEEKGIIRSMSRKGTPADNAPIESFHPSLKSETFYINNELNRSNHIVIDIVEKYIKNYNNNRIQQKLGYLSPVKYRELIA

SEQ ID NO: 3483 - protein, 79 aa, Staphylococcus epidermidis
NTLYCTSKRIYITNNGGHHDFNYFIYLFLYSTHQLKDIYATRKTAKGRGRGGIWCEKFKISSHYACINLHECSYRNIHS

SEQ ID NO: 3484 - protein, 170 aa, Staphylococcus epidermidis
LDDFHLYQVIDFYYLLNALIYLVVLVHLIVLAYLVPLVYLVPLVYLIPLVYLVLLAYLVPLVYLVLLAYLVPLVYLVLLAYLVPLVYLVLLAYLVLLAYLVPLVYLVPLVYLVPLVYLVLLAYLVPLVYLVLLAYLVPLVYLVPLVYLVPLVYLVLLLLDHTQQFRQQVV

SEQ ID NO: 3485 - protein, 261 aa, Staphylococcus epidermidis
EKRYDVMKKYQTYIAIGSLLSLMVVLITYGLMQDTQHLNPLESPNGQHWLGTDQLGRDFLVRLIVGSLVTLSLTGIVILLSVCMGLIFGLIAGIERRWLDQIIMFVADMLLAIPSFIIALVILSLVSNSMIGLILALTIGWIGRYLRYFRNLTRDIQKRPFVQYARLSGNSTFKTTVTHVIPHLLSSIFALVTADFGKMMLSISGLAFLGLGIKPPTPELGTILFDGKSYFNGAPWLFFFPGVLLGGFALLCQIINKKITQ

SEQ ID NO: 3486 - protein, 493 aa, Staphylococcus epidermidis
MMDFWSSKRGKMLEITVLVFITIFGVGSQFFSNLAYSLNQGILQTSFGIGSQYLIIPSVLANFTFALGIPLGHTLTHKYGFKRNYLCFVFIFLIGSILGLLSFNLIILSIAKMIQSFSSGVLFFTLLPKLFLNFPKQYRNVFLLMVIVGLFGSNALGGLSGSLSLELDRWHWIFVVNIISAILCLILGNVILRKNEYHQTSDIHISRSMMITLVLSTISLMIPMSLLTQKGYHSLWVWPILLIAIFFIVNFIITNRQATHPIVHFHTLFSKKPFVGATMAISSHLTLLTGIAGINVYIVRILKLPFDISLHFYFFFFVGVIITGILKMFFYSSVGAGFLGTLGSSALLYVSIHWIILGNTINIPLLYIQGLLLGFGASMTLVSGSMATLLDGDLKEAAQRSQTMHTIRNFSAAMLIPIIAYTIKNHIQKGTQSIYAENITDKMIYLKKLQDVAIDADHQIFLLMIIFNMVMFVSSIIQMILGKGRRITPPRES

SEQ ID NO: 3487 - protein, 477 aa, Staphylococcus epidermidis
KEYHSMSNISMTTSKRNAIVTVMLISAFVSMLNQTILNTALPAIIKGLNITETTAQWLITGFMLVNGIMIPLTAFLMDKYSTRHLYIFSMAIFLIGSIVAAFSPTFTILMISRIIQAIGAGILLPLMQFTVFTLFPAEQRGFAMGLAGVVVQSAPAIGPTLTGLFVDLFSWRMPFYLVSAIAAVAFILGFFFVENNTKTKDIVLDKISVVYSTFGFGLILFAFSSVSTFGITSLPVIVTFVLGIAIIIIFTTRQLKLKHPLLNMRVFKNKVFTLSAVSSMLVYITMVSPALLIPIYIQTGLGQSALLSGVVVLPGAVINGLTMVYTGKIFDKHGIKVLVIPGFILLISMTFLYSFLTTGTPYWFVILVYTIRMIALGLLVMPLNTVGLNALESDDVSHGTAIMNSLRIIAGAMGTAVSVTILSIVAKQYTASHSTMSKMKLTQEATVHGIDVAFIFTTVLIIIGFILALFIKEEKNH

SEQ ID NO: 3488 - protein, 464 aa, Staphylococcus epidermidis
CELHMLKVTFNLRDGTFTDIPDDAHYFLIEDYDKLTPSQQTLLKRYIIKHQLDISLQHAILSSPLHSLNMIKKLETFVKESKAYHPQFHNIICGWCFIVLMFALPIYLSYHVSDGLQYYVSHWLTKLSQISLFQENKLQHILFGHYGVISLGTYSFVWALPVVFMISLSTALIDITHLKHYIVWSIEPTMMRLGLHGSDIIPLLEGFGCNAAAITQATHQCHRCTKVQCMSLVSFGTACSYQIGATLSIFNASHRSWLFLPYIGMVFLGGIIHNKLWYSHQTPKTTPSVFQRQLVRWPKPNLLLKAAWKSIQMFIVQALPIFIGICLIVSLLSLTPILTFISNAFIPLLWLLDVPTQLAPGILFSMIRKDGMLLFNMNGGTLIQRLSAFQLLLLVFFSSTFTACSVTMTMLMRRLGSILGIKMIMKQMVSSTICVTILVIAMLSITKISDLGVMLWKSLLSVVF

SEQ ID NO: 3489 - protein, 220 aa, Staphylococcus epidermidis
LRLHIGDNLMLKIERLTKYIDTQLIFKEISCTINDQHLLISGESGCGKSTLAKIIAGLDTDYQGELYLNGRLRESYTSKEWMKHIQYVPQYQRDTLNQRKTVLATLLEPLKNYKVNKQRYTSSIEAVLDQCNLPHDILNHKVSTLSGGQFQRVWIAKALILEPEILILDEATTNLDVINEEAILQMLISLKMTQLIIISHDTYVLSQFEGIQLQLNKLNN

SEQ ID NO: 3490 - protein, 127 aa, Staphylococcus epidermidis
TMKHHRCLLHCKQKKEAMQKHLNLSQRRQKKEAMQKHLNLSQRRQKKEAMQKHLNLSQRRQKKEAMQKHLNLSQRRQKKEAMQKHLNLSQRRQKKEAMQKHRMFQLSKLIQIMIHKHNFQKPLQEMT

SEQ ID NO: 3491 - protein, 281 aa, Staphylococcus epidermidis
LSFKNDTGGMKMTNRLILFDFDETYYKHRTNQADIPYLKEMESLLQNITAKNNVITAILTGSTIESVLKKMSKVNMSYKPQHIFSDLSSKMFTWNNCEYIESDEYKNEVLIEPFLLEDILDILKHVSSKHKVEFIPQRIFRENETLYNFYLYSSGDTHLDKTILEDLSQYSKTRDYTMTFNRCNPLAGDPENAYDINFTPKNAGKLYATKFLMNKYGVPKELIIGFGDSGNDEAFLSYLDHAMIMSNSQDEEMKSKFKNTKYPYYKGIYTHVREFIEYENV

SEQ ID NO: 3492 - protein, 304 aa, Staphylococcus epidermidis
CNIKSAFKGGNEMIVLRRLFQDRGAIFAIAIITIYVVLGVLAPLITFYEPNHIDTANKFAGISWSHWLGTDHLGRDVLTRIIYAIRPSLLYVFVALIISVVIGAILGFISGYFPGYIDAIIMRICDVMLAFPSYVVTLALITLFGMGVENIIIAFILTRWAWFCRVIRTSVMQYIEADHVKFAKVIGMNDLTIIRKHILPLTFTDIAIIASSSMCSMILQMSGFSFLGLGVKAPTAEWGMMLNEARKVMFTHPGMMMTTGVAIVIIVMAFNFLSDALQMAIDPRMSAKEKRLALKKGVKARDTA

SEQ ID NO: 3493 - protein, 474 aa, Staphylococcus epidermidis
KHCLIIHLKQLTKHNGDVKNYKHDRSRFLILHFIVKWHQKLVLNMSKILMVGSGPVAIQLARLCNLHGEHMVDMVSRVHASTKSKRVFDAYHRDGFFSVMTQNDAHQCFLGKFTVRHFFKDVKDITQYYDVVILACTADAYRPILQQLSKSTLKRIKQIILVSPTLGSHMLVKQILSDVHCEGEVISFSTYLGDTRIFDKAQPHCVLTTRVKSKLFVGSTHSQSITLYKLKSLFDYLNIELTTMDTPLHAEIHNSSLYVHPPLFMNQFSLKAVFEGTKVPVYVYKLFPEGPITMTLIHEMRLMWQEMMMILKKLKVPSVNLLKFMVKENYPIRDETMREVDIESFENLSAIHQEYLLYVRYTAILIDPFSNPDDQGAYFDFSAVPYKHVDTDEQGVIHIPRMPSEDYYRTLMIQAIGRALNVATPMIDTLLLRYETTVKQYCDTHLHQQLSKQFELHHFKQDLALVTNYLTFYK

SEQ ID NO: 3494 - protein, 378 aa, Staphylococcus epidermidis
YKYKRCFGGILMSKFIYQSPGRYVQGKGIVSSIAEETERLGSHALIIADEVVWNITEEKIKESFSANNNVDFEYEVFKGESSEEEIQRIVKQYKEKNIDVVIGLGGGKALDTGKAVAFELKASVIDFASTASMDAPTAAVSVIYNEDGSFSGYEFYPKNPDTVIVDSEIVAQAPVRLFASGMSDGLATLIEVESTLRRQGQNMFHGKPTLASLAIAQKCEEVIFEYGYSAYTSVEKHIVTPQVDAVIEANTLLSGLGFENGGLAGAHAIHNGFTALEGDIHHLTHGEKVAYGILVQLVLENAPTEKFMKYKTFFDNINMPTTLEGLHIENTSYEELVQVGERALTPNDTFANLSDKITADEIADAILTVNDLSKSQFN

SEQ ID NO: 3495 - protein, 66 aa, Staphylococcus epidermidis
FTDNAVYIVVTTAIPNAAPSVEVILIIPDAVPAFSAGTLDTAVDSAGVAKNPNPRPIKIKPIHATI

SEQ ID NO: 3496 - protein, 405 aa, Staphylococcus epidermidis
TTINLRSDNMKGAMSWPFLRLYILTLMFFSANAILNVFIPLRGHDLGATNTVIGIVMGAYMLTAMLFRPWAGQIIARIGPIKVLRIILLINAMALVLYGFTGLEGYLIARIMQGVCTAFFSMSLQLGIIDALPEKYRSEGVSLYSLFSTIPNLLGPLIAVGIWHVENMSIFAIVMIFIAVTTTLFGYRTTFANTQKEVSPKDEVLPFNAMTVYVQFFKNKALFCSGMIMILSSIVFGAMSTFIPLYTVREGFANAGIFLTIQAITVVIARFYLRKYVPSDGLWHHRFMMIVLTLLMVASVIVAFGPHIVSIFVYISAIFIGITQALVYPTLTTYLSFVLPKIGRNMLLGLFIACADLGISLGGVLMGPISDTVGFKWMYILCALLVTIAMTLSKIRQRQSVSKAS

SEQ ID NO: 3497 - protein, 341 aa, Staphylococcus epidermidis
FIHKELLLMKNLRNRSFLTLLDFSRQEVEFLLTLSEDLKRAKYIGTEKPMLKNKNIALLFEKDSTRTRCAFEVAAHDQGAHVTYLGPTGSQMGKKETAKDTARVLGGMYDGIEYRGFSQRTVETLAQYSGVPVWNGLTDEDHPTQVLADFLTAKEVLKKEYADINFTYVGDGRNNVANALMQGAAIMGMNFHLVCPKELNPTEELLNRCERIATENGGNILITDDIDKGVKDSDVIYTDVWVSMGEPDEVWQERLKLLKPYQVNQALLEKTGNPNVIFEHCLPSFHNAETKIGQQIYEKYGISEMEVTDDVFESKASVVFQEAENRMHTIKAVMVATLGEF

SEQ ID NO: 3498 - protein, 255 aa, Staphylococcus epidermidis
GGSKMLKGHLHSVESMGTVDGPGLRYILFTQGCLLRCLYCHNPDTWKINEPSREVTVDEMVNEILPYKPYFEASGGGVTVSGGEPLLQMPFLEQLFKELKANGVHTCIDTSAGCVNDTPAFNRHFDELQKHTDLILLDIKHIDNDKHIKLTGKPNTHILKFARKLSDMKQPVWIRHVLVPGISDDKEDLIKLGEFINSLDNVEKFEILPYHQLGVHKWKNLGIPYQLENVEPPDDEAVKEAYRYVNFNGKIPVTL

SEQ ID NO: 3499 - protein, 70 aa, Staphylococcus epidermidis
FVLKKQCYSIDNLIRRREYNVEHVSKLAEAIANTVSAAQAEDGAELAKSIVNIVANAGGIIQDIAHAFGY

SEQ ID NO: 3500 - protein, 77 aa, Staphylococcus epidermidis
IHKNTETFDDVSDIYHISLVDLSTCLFKSQLTSVIIYTTLFNNKTLFVKLNPHVVIYDVQLYLYDIKPENFSTTVMP

SEQ ID NO: 3501 - protein, 454 aa, Staphylococcus epidermidis
LMMKNKLTLKENLFIGSMLFGLFFGAGNLIFPIHLGQTAGSNVWTANLGFLITAIGLPFLGIIAIGVSKTNGVFEISSRISKIYGYLFTIGLYLVIGPFFALPRLATTSFEIAFSPFISSGTAQALLPIFSILFFGVAWLFSRKPSKILDYIGKFLNPVFLILLGIVVVLAFIRPMGGISHAPVSADYSNSVLLKGFIDGYNTLDALASLAFGIIIVTTIKKLGITNPNTIAKETLKSGTISIIAMGVIYTLLALMGTMSLGRFKVSENGGIALAQIAQHYLGDYGIIILSLIIIVACLKTAIGLITAFSETFTELFPKSNYLWLATGVSILACIFANVGLTKIIMYSTPVLMFIYPLAITLILLALLSPLFKHSKIVYRFTTLFTMVAAFVDGVKASPEFFVNTKFAQTIIGFGENYLPFFNIGMGWIVPAFIGFIIGIIVYFMTAKKSSHVQ

SEQ ID NO: 3502 - protein, 150 aa, Staphylococcus epidermidis
NKVKQSYYSHTPQSKIKSVAINKHAHQSISIGIVFVVVIFVSVIQILLHQRLKQNAPLERLYLVPYSQLKLYLTYISVHVVILMLMLLMISLLMHQPLSILFYLKTLIIVLFYEAGIALLLFKINVLSHRIFMAIIYTVAIGIIYLWIQL

SEQ ID NO: 3503 - protein, 74 aa, Staphylococcus epidermidis
ERPNYGMNLGHKSMFQVFYNVKTVMNFWALTECISIDKAIWLSTIKEWHNEGIMNICLILQLFSRKSNGLMVVK

SEQ ID NO: 3504 - protein, 175 aa, Staphylococcus epidermidis
EMRKCVLMTVAASATLLLAGCGNGQKEDKDVTVSLPTEAKADKLDAQGYDAAMPVYSAVYDALVKYDKDKGIKAGLADKWSVDESGKVYEFHLKKNVKFSDGSALDAKDVKFSIDRAKAMNKDSTVETLKKLDKVVVKNEHVVQIRLKSPSNQVLNELTQVRPLRIMSPHSVEGC

SEQ ID NO: 3505 - protein, 263 aa, Staphylococcus epidermidis
IRRKIDMSKTAIITGAAGGLGKGIAERLANDGFNIVLQDINEALLLETEKEFKEKGYQAVAFKSDVSKKKEQEELVQFAVTEFGQLDVMVNNAGVDAVTPILEIGEEELSKLFNINVFGTLFGIQAAANQFIKQKSKGKIINACSIAGHESYEVLGTYSATKHSVRSFTQTAAKELADKGITVNAYCPGVAKTEMWDRIDEEMVKLDDSLEIGDAFEAFSSEIKLGRYQEPSDVANLVSFLASNDSDYITGQSILTDGGLVYR

SEQ ID NO: 3506 - protein, 119 aa, Staphylococcus epidermidis
ISFDSWNIRCFCIASFFCLRWLRLRCFCIASFFCLRWLRLRCFCIASFFCLRWLRLRCFCIASFFCLRWLRLRCFCIASFFCLRWLRLRCFCIASFFCLQCRRHLWCFIVYSRLICVFK

SEQ ID NO: 3507 - protein, 445 aa, Staphylococcus epidermidis
CKIELRLIYMRLITFFKDLKSIICFNRERRMNVKQLSTTLKVRLICDFFQNIIVTAFLPFIALYLTDMVNQHFSGLFLFGLVMINFPISLISGHIIERLPKKTLTLSYQFILSLMLVIMAISISQHTFKIILFCIAYTIFSITIGMQQPIMDTIIMDAITPEVEQYIYKISYWLTNIAVAFGALIGGLMYGAHKSMLFFIAFVIYIMVFIALIVWLPKDLNIVTQSHTHHANEKQFSMGQILKSYKPAFKDTTYLLLIIGFSILTMGELSASSYISVRLKQEFDPMILFSLHINGVKMYSLLLMTNTIIVIIFTYFISKIVMRMNVKTALLVGIIFYVIGYSNLTYLNDFTLLIIFMIIATIGEMVYSPILEENRFKMVPSHKRGTYSAVHALGFNLAELLARFGIILGVFLTSMEMGIYMFVLLLLGGMSLYIAVSRFNNTNSQ

SEQ ID NO: 3508 - protein, 80 aa, Staphylococcus epidermidis
KTTDNNDFHNITPKSEILVMLNIAMTSMVTQIVDDTICFIIILIPRIEPSRRMSIVIVTEHAVNVELKKTSNNNWNAESL

SEQ ID NO: 3509 - protein, 175 aa, Staphylococcus epidermidis
PQLDDTTPFKKGVGIDLARLSLEKAETLKGQRPLTYYLTDKPQETKHVFDTAVSTSVLYLIEDIPQHAKDLKEVLKPGGVYYASFADLTNNPSRQFMDDTINQYGATPSQNHSLKHIVDSFVDAGFEVAVMKEHVPDVIDLTHYSDFYLSPNDYLQTLYEESFLIKASVKEGTEK

SEQ ID NO: 3510 - protein, 491 aa, Staphylococcus epidermidis
YKKDRGALNMKNKKNSYSIRKLSVGASSIIVASMLFIGGGSVHAAESNHLENQEQSEVSASHSIEMQHKNQETQQTENKDNKTNHSETIDKTPTIHNNGYSYHETPSTDVKSNEDKQIDSQFNQPQTSMPNNDQQNPKKVAEHTTKSINAKKEETRKNENAKSLVQPQQDDKTTSEQTKMKESREQEITNEQKQLQSKDVKNAQQENQNIDQEKSQEKIKVQQSNIEKAQKSSRIDGKLDNQYNKDATQSDEGTASENVSEQHITAKDGGVTRNNRGDKHLNQEKPTTSSDKELKVDDIDKDLSTKESPENEKDDSRKGIKAITKNSQATTRNTATTEASKELKDQTNKVASQKEYKNHDPIILVHGFNGYASGTGPVTGKGNYWGGDRLKIIQDYRAKGYNVMEASVSAFGSNYDRAVELYYYIKGGRVDYGAAHAAKYGHERYGKTYAGAYKDWKPGQKIHLIGHSMGGQTIRYLEELLRHVVLTPGRA

SEQ ID NO: 3511 - protein, 327 aa, Staphylococcus epidermidis
IMKENFWSTLPRPFFILAPMEDVTDIVFRHVVSEAARPDVFFTEFTNTESYCHPEGIHSVRGRLTFSDDEQPMVAHIWGDKPEQFREMSIGLADMGFKGIDLNMGCPVANVAKKGKGSGLILRPETAAEIIQASKAGGLPVSVKTRLGYYDIDEWRDWLKHVFEQDIANLSIHLRTRKEMSKVDAHWELIEAIKTLRDEIAPNTLLTINGDIPDRQTGLELANKYGIDGIMIGRGIFHNPFAFEKEPREHSSKELLGLLRLHLSLFEKYDKDEARHFKSLRRFFKIYVRGIRGASELRHQLMNTQSIAEARELLDTFEARMDARSEV

SEQ ID NO: 3512 - protein, 170 aa, Staphylococcus epidermidis
QTMEDIMILTILFIFFCIRLISLKISMQHAKQLKVEGAVEYGVKNSKYLAITHVLIYMSAAIETFIHKDTFNLLNGIGLIILIVAYIMLFIVIKTLGRIWTLKLFILPNHPIIKSGLYKVTKHPNYFLNIIPELIGVLLLTNATYTTLLLVPYAYFLIVRIRQEEKLMNI

SEQ ID NO: 3513 - protein, 325 aa, Staphylococcus epidermidis
SLKEDNMKNYKKYLIVLVLCLTVLSGCNLPGLKNSHSDDDVRITSLGTSESQIISHMLRLLIEHDTKGEIKPTLINNLGSSTIQHNAVTSGQANMSGTRYTGTDLTGALKEDPIKDPKKAMKATQEGFKKKYNQTFFNSYGFENTYALIVTKETAKKYHLETVSDLEKHAKDLRVGMDSSWMDRKGDGYPAFKKEYGYSFGTVRPMQIGLVYDALSSGKLDVAVGYSTDGRISAYDLKVLEDDRRFFPPYDASPLASDQLLKEKPELKPIVKKLEGKISTEQMQELNYQADGKGKEPATVAEDFLKKHHYFEDDDNKKDKQKGGQ

SEQ ID NO: 3514 - protein, 525 aa, Staphylococcus epidermidis
LSKEMKPLEQAINDNKKKKRFNFRMPGAFMILFILTVVAVIATWIIPAGAYSKLSYEPSSQELKIVNPHHQVKKVPGTQKELDRLGVKIKIEQFKSGAINKPVSIPNTYERLKQHPAGLDQITSSMVKGTIEAVDIMVFILVLGGLIGVVQASGSFESGLLALTQKTKGHEFMLIAFVSILMIIGGTLCGIEEEAVAFYPVLVPIFIALGYDSIVSVGAIFLASSVGSTFSTINPFSVVIASNAAGTTFTDGLYWRIGACIIGAIFVISYLFWYCKKIKKDPKSSYSYEDKAAFEKQWSVLHDDGSSEFTLRKKIILTLFVLPFPIMVWGVMTQGWWFPVMASAFLIFTIVIMFIAGTGQYGLGEKGTVDAFVNGASSLVGVSLIIGLARGINLVLNKGMISDTILHFSSSIVQHMSGPLFIIVLLFIFFCLGFIVPSSSGLAVLSMPIFAPLADTVGIPRFVIVTTYQFGQYAMLFLAPTGLVMATLQMLNMRYSHWLRFVWPVVAFVLIFGGGLLITQVLIYS

SEQ ID NO: 3515 - protein, 292 aa, Staphylococcus epidermidis
GSSFNCRNRTSIYRTGDNDANMNEHTKIENQLQYYLEQFTYLHQLVLEDSRHIVDLENLIDEYSQWILQPLAEHHYLTWNDLETKISFTKKLQEVSAKCVKQVEVIRAQRLLNGRASTSGYFENIEHCINEEFGRWQIGQNDKLLLIGSGAYPMTLIQVAKETGAAVIGIDIDSEAVDLGQRVVNVLAPNEDIVISNQTVDQLEDIQSVTHIIFSSTIPIKYDILNELYTLTNDEVVVAMRYGDDMKALFNYPSQATDETQWRCEELQTRPKQIFDIALYRKVASKVGVEHV

SEQ ID NO: 3516 - protein, 306 aa, Staphylococcus epidermidis
KIKLLEVLMMQKVVLTAAITGAGDTIQKNENVPVTPQELADSAIKCARAGATVAHIHVRDPETGGVSHDPELYAETVRLIREADEDIVINVTSGGGGDFIPSLEHPETGGEGTWIQTPEERFKPIGDLLPEMCTLDCGSVNMGDAIYLSPASWLRKQAQMVKDAGVKPELECFDTGHVSFAKQMIEEGLIDGDPMFQFCLGIPWGAENDPETIEYLKSRIPENAHWSAFGIGKMQLPTVRKVAQRGGNVRVGLEDNIYLRKGVKATNEALVEEAKRILAELDIEPLTPAEAREKFNLRNPHGKGDK

SEQ ID NO: 3517 - protein, 652 aa, Staphylococcus epidermidis
GKKLIEVIFLKNNNETRRFSIRKYTVGVVSIITGITIFVSGQHAQAAEMTQSSSDSNEQSQQTEQVEHKEDTTHLSNELNQEGETASQSKTSQENQSDGNVQKKSNQIQQDSTQTSPLNDQKQTSMEQQSKDNHVTPNSRQDTYPKGQNQDDKGKQQFKDNQHSQTGHQPNTQNQNNDQDSSDKKQHPSDQTQDSSSKGTQPKQSQSIEDRDKTVKQPSSKVHKIGNTKTDKTVKTNQKKQTSLTSPRVVKSKQTKHINQLTAQAQYKNQYPVVFVHGFVGLVGEDAFSMYPNYWGGTKYNVKQELTKLGYRVHEANVGAFSSNYDRAVELYYYIKGGRVDYGAAHAAKYGHKRYGRTYEGIMPDWEPGKKIHLVGHSMGGQTIRLMEHFLRNGNQEEIDYQRQYGGTVSDLFKGGQDNMVSTITTLGTPHNGTPAADKLGSTKFIKDTINRIGKIGGTKALDLELGFSQWGFKQQPNESYAEYAKRIANSKVWETEDQAVNDLTTAGAEKLNQMTTLNPNIVYTSYTGAATHTGPLGNEVPNIRQFPLFDLTSRVIGGDDNKNVRVNDGIVPVSSSLHPSDEAFKKVGMMNLATDKGIWQVRPVQYDWDHLDLVGLDTTDYKRTGEELGQCYMSMINNMLKVEELDGITRK

SEQ ID NO: 3518 - protein, 301 aa, Staphylococcus epidermidis
NFRLRSDVMEIIIIGGFLGSGKTSAINHLIADALENNLNPAVIMNEFGKRSVDGQLIERPEVPMSEITEGCICCAMKSDVSQQLHELYLKYQPDIIFIECSGVAEPLAVVDACFTPVLAPFITLRSMVGIIDASMYSRIKSYPQDIAALFYEQLRHCSTLFVNKIDKIEVEETARLLRQLERLNSDANIQVGQFGELNLKSLLEPTHINSNACGTLHSNINHQFIENPRLQTKEEMISALDNLPQDVYRVKGFVRFSDQQHVYLVQYAQGNIELSPIQLKNDVPLYLIVIGKHLKQIQLDL

SEQ ID NO: 3519 - protein, 239 aa, Staphylococcus epidermidis
TLKCNKFTLKIGDMINMNIFVTGTNTDIGKTYVTKYLYKALRTRGYRVCIFKPFQTEEIGGGRYPDLEIYKNECDLDYDVTSLYTFKDPVSPHLAFKIERHQQLNHQTMIDKLESLKAQFDMILIEGAGGIAVPIYEYSDHFYMTTDLIKDTSDFIVSVLPSKLGAINDAIVHQKYIDHQELPPNVLIMNNYTDSAIEQDNLHTIEKLIHKSVYTLGHQATQESFSEAFIQRIIGGSNG

SEQ ID NO: 3520 - protein, 267 aa, Staphylococcus epidermidis
IERCENMQHSSKIIVFVSFLILTIFIGGCGFINKEDSKETEIKQNFNKMLDVYPTKNLEDFYDKEGYRDEEFDKDDKGTWIIRSEMTKQPKGKIMTSRGMVLYINRNTRTAKGYFLIDKIKDDSNGRPIENEKKYPVKMNHNKIFPTKPISDDKLKKEIENFKFFVQYGNFKNLKDYKNGDILYNPNVPSYSAKYQLSNNEYNVQQLRKRYDIPTKKAPKLLLKRDGDLKGSSVGHKDLEFTFVENKKENIFFTDSINFKPTERDES

SEQ ID NO: 3521 - protein, 222 aa, Staphylococcus epidermidis
TERWSINMEGNLIQQLVHYYQMNFGYLWELFVNHLLMSVYGVLLACLVGIPLGIIIARFGKLSGVIITIANIIQTVPVIAMLAILMLSMGLGMNTVIFTVFLYALLPIIKNTYTGINEVDPNIKDAGKGMGMTRNQVLTMIELPLSLSVIIGGIRIALVVAIGVVAVGSFIGAPTLGDIVIRGTNATDGTLFILAGAIPIVIIVILIDVLLRLLEKKLDPAT

SEQ ID NO: 3522 - protein, 320 aa, Staphylococcus epidermidis
IAMLKRTIKFILYLIVSSFIIFILVEKTSGNPAILYLQRHGYTSITQDNIEAAQHQLGLGQHVLLRYIDWVGHALTGNLGYGFSTNEAVTAMIMEAIVPTLVLIIVSSCIMLPFGYIVGYFVGTRPHTRYANGIRGFAQVMTSMPEYWLAILFIYYLGVRWQLLPFVGSDSWQHFVLPIFTIVVIEGCHILLMTAHLITQTLDQDAYQLAQLRHFSLKARIIVQIKEIFAPLMTISINSIIHLIGKAVILEVIFSMSGIGKLLINAINQRDYPLIQGIVIFIIVFIMLMNYLGDVIILKNEPRLRRRHTQQSGNEKRGTM

SEQ ID NO: 3523 - protein, 109 aa, Staphylococcus epidermidis
KGVLMHNYNNINIVSDDSKYQEICWFHTLEGIWHPVEVETSPLNITFNKDITPNYVCTLINEDSRKIILSNVDNPNIIIEMILINSKKLVFNAISKEGLGTSPKITFTK

SEQ ID NO: 3524 - protein, 344 aa, Staphylococcus epidermidis
ILKRNNFDLGDVHMYKKGLILFFVAVLTLALAACGKDSHNQSSDHKGKLDVNTTVYPLKSFAQQIGGKYVNVESVYPKGVDPHTYDPSQKQMVDIGKSDLFLYTGDNLDPVAKKIAKAINDKDKTLSLESTLDKNKDLLKGEEHEHEHGEGHEHGESHEDEHEHEHHHHGKYDPHIWLDPVVSQKFAKAIKDELIEKDSKHKSYYEKNYNQLVKELKDLDKDMKHAVKGNEDKTVYISHDSIGYLAERYHFEQEGIENMNAEEPSQKDLTNIVKQIKEDKVKNILIEENVSHKVADTVRKETNAKTIKFYNMGSHTKQQDDDNNTYQSFMKENIKAIEKALQNE

SEQ ID NO: 3525 - protein, 64 aa, Staphylococcus epidermidis
SNILEGLRENNHATPKNKILKIGNNAWAVPDEINGENAISNDVVASLGNAKNGPITRYKPIVNK

SEQ ID NO: 3526 - protein, 466 aa, Staphylococcus epidermidis
RKSRRPLTMSEQFNKGKQLIVAIILGILTYWLFAQSFLNIAPHVQRFYHVDMSIVNIAVSLTSLLTGVFIVVAGGLSDKIGRVKITNAGLILSILGSIALIISHAPILLLLGRVLQGLSAACLLPATIALINSFFQGEERQKVLSYWSFGSYGGTGLASLFAGIIATFIGWRWIFVLSIIFSIIALILLRGIPESKDESAYNKKFDIVGIIIFVVMMLSINVVITQGDRIGWLNPLILILIAIFIVTLIAFYIFEKRQDEPFIDLSLFSNNVYIGTTLANLMVNMDIGSLALFNIYVQDDKHLSAAQAGLITIPYMLCSLLMIRVGERFMQKRGPQLPLMLGPVSITVGIILLAFTSLPNMIYYIVACIGFIFIGLGLGFFATPALSTAVSNVPAEKAGTASGIIKMTSTLGAAFGIAVVTTIYTALSVNHPAYLAATIAFIVGAGLVFIAFIAAYCLIPKKNVDI

SEQ ID NO: 3527 - protein, 315 aa, Staphylococcus epidermidis
KEVSEMAKIVVALGGNALGKSPQEQLELVKNTAKSLVGLITKGHEIVISHGNGPQVGSINLGLNYAAEHDQGPAFPFAECGAMSQAYIGYQLQESLQNELHSMGIDKQVVTLVTQVEVDEGDPAFNSPSKPIGLFYTKEEANRIQQEKGYQFVEDAGRGYRRVVPSPQPISIIELESIKTLVENDTLVIAAGGGGIPVIREQHDSFKGIDAVIDKDKTSALLGADIHCDQLIILTAIDYVYINYHTDQQQALKTTNIDTLKTYIEEKQFAKGSMLPKIESAISFIENNPNGSVLITSLNQLDAALEGKIGTLITK

SEQ ID NO: 3528 - protein, 111 aa, Staphylococcus epidermidis
IIRRFFSMKRASYSVETKYKAVEMKAAGFSTKEIMKELNIRNRTQVKTWWRWYRNGESYRFSQQVGKQYTYGKGLEELSEVEQLKLENKRKDIELDILKKYKALERKWYQQ

SEQ ID NO: 3529 - protein, 81 aa, Staphylococcus epidermidis
YNRRNSKMKVYKLNYQHHKDIVDDNVLTMFVTADNQDEVEAFAKKLHYKIEHLSPLTKKEFEDEKAKDSHYRLEHVDHYLN

SEQ ID NO: 3530 - protein, 1183 aa, Staphylococcus epidermidis
IHGRYNMGKRRQGPINKKVDFLPNKLNKYSIRKFTVGTASILLGSTLIFGSSSHEAKAAEEKQVDPITQANQNDSSERSLENTNQPTVNNEAPQMSSTLQAEEGSNAEAPQSEPTKAEEGGNAEAPQSEPTKAEEGGNAEAPQSEPTKAEEGGNAEAPQSEPTKAEEGGNAEAPQSEPTKTEEGSNAEAPNVPTIKANSDNDTQTQFSEAPTRNDLARKEDIPAVSKNEELQSSQPNTDSKIEPTTSEPVNLNYSSPFMSLLSMPADSSSNNTKNTIDIPPTTVKGRDNYDFYGRVDIESNPTDLNATNLTRYNYGQPPGTTTAGAVQFKNQVSFDKDFDFNIRVANNRQSNTTGADGWGFMFSKKDGDDFLKNGGILREKGTPSAAGFRIDTGYYNNDPLDKIQKQAGQGYRGYGTFVKNDSQGNTSKVGSGTPSTDFLNYADNTTNDLDGKFHGQKLNNVNLKYNASNQTFTATYAGKTWTATLSELGLSPTDSYNFLVTSSQYGNGNSGTYASGVMRADLDGATLTYTPKAVDGDPIISTKEIPFNKKREFDPNLAPGTEKVVQKGEPGIETTTTPTYVNPNTGEKVGEGEPTEKITKQPVDEIVHYGGEEIKPGHKDEFDPNAPKGSQTTQPGKPGVKNPDTGEVVTPPVDDVTKYGPVDGDPITSTEEIPFDKKREFNPDLKPGEERVKQKGEPGTKTITTPTTKNPLTGEKVGEGEPTEKVTKQPVDEITEYGGEEIKPGHKDEFDPNAPKGSQEDVPGKPGVKNPDTGEVVTPPVDDVTKYGPVDGDSITSTEEIPFDKKREFDPNLAPGTEKVVQKGEPGTKTITTPTTKNPLTGEKVGEGEPTEKITKQPVDEIVHYGGEQIPQGHKDEFDPNAPVDSKTEVPGKPGVKNPDTGEVVTPPVDDVTKYGPKVGNPITSTEEIPFDKKRVFNPDLKPGEERVKQKGEPGTKTITTPILVNPITGEKVGEGKSTEKVTKQPVDEIVEYGPTKAEPGKPAEPGKPAEPGKPAEPGTPAEPGKPAEPGTPAEPGKPAEPGKPAEPGKPAEPGTPAEPGTPAEPGKPAEPGTPAEPGKPAEPGTPAEPGKPAEPGTPAEPGKPAESGKPVEPGKPVEPGTPAQSGAPEQPNRSMHSTDNKNQLPDTGENRQANEGTLVGSLLAIVGSLFIFGRRKKGNEK

SEQ ID NO: 3531 - protein, 64 aa, Staphylococcus epidermidis
RIYGYWSLIPKFSYYIFNEIPCHFHIFNSINNYIIFLKIKYIKIFFFIFNIIISVYLPTLPLAL

SEQ ID NO: 3532 - protein, 105 aa, Staphylococcus epidermidis
SSHGTICFKPSLIILSSSQITTLNIFIPPRQVVFGNTLMSLAGFLRKCADVHMFHIESWLYYVNDLNLGVSYQKHRDEGIGARVLNVMETYRCHYHEPEYVICAS

SEQ ID NO: 3533 - protein, 375 aa, Staphylococcus epidermidis
IQKGCTIMSHHRIIIIGAGAAGVGMAITLQEFNIKDVLIVEKGTIGHSFKHWPLSTKTITPSFTTNGFGMPNMNAIAKDTSPAFTFNEEHLSGKRYAEYLSLVATHYNLNVKTNTNVSRVTYIDGIYHVSTDYGVYTADYIFIATGDYSFPYHPFSYGLHYSEIQTFTQLKGDAFTIIGGNESAFDAAINLSQTGAKISIYTSKTGLKKEDADPSIRLSPHTQQRLQNAIQEGALIEMHVGYQARKITYQNHSYKIHFDNGHIVHSHTEPIIATGFDVTQNPLIEQLFQVRQSEVQLTELDESTKFPNVFLIGATVRHQNAILCYIYKFRARFAVLARIVSLREGLPEDTSLIQSYRQKNMFLDDYSCCDVNCTC

SEQ ID NO: 3534 - protein, 312 aa, Staphylococcus epidermidis
VERGSQKVKTLMIKAMGTVIRLSIEHQHPDTLLQEAEIKIRAWESQFSANDPKSDLMNVNQHAGIAPVKVSSEIFNMIRYGYETTLSSNFKMNILIGPLVKLWKIGFKDALKPKEVDIQRALLCMNPENLVLNSKTHEVFLTQSGMEIDLGAIVKGYFADQLQQYFLAHGVSSGIIDLGGNVLTIGRQPETLEKWHVGVRNPFHKDTLPLVTLSVEHQSVVTSGIYERYFIQENQLFHHILDSTTGYPVDNDIASVTIISDHGIDGEVWSTICSFGQSQKNIELLNLIDGIEGIIVTRDGSVLMTSKMQKYL

SEQ ID NO: 3535 - protein, 327 aa, Staphylococcus epidermidis
WDIMKVKLYTLLLLLIFLIACAPTSTSQSPHPLRTLIVYSPYPSHLIRPILNDFEKREHVKVEIKHGSTQVLLSNIHKEALSKRGDVFVGGVLSEMIDHQEDFVPYHNRSTLKQIEDYRSNNPLVTSFLLMPTVIVVNTDLQGDMTIHGYKDLLQSSLKGRVVYSNPHSTTTGYQHMRAMYHMRHQVSDVHQFQHHAVQLSKSSQVIEKVAKGAYYAGLSYEQDARTWKQKGYPISIIYPTEGTMLNVDGIALVNNAQPHPKRKKLVQYLTSRSVQQRLAEEFDAKSIRKDVTETNHSSIENLDHIPLIPQSRVSNIPHHQFLEMIQ

SEQ ID NO: 3536 - protein, 258 aa, Staphylococcus epidermidis
AKIMAHITLNYLSKTLGMHQTINVILPEDKSYFDTNENAKPLKTMLLLHGLSSDTSSYMRYTSIERYANTHQLAVVMPNADHSFYSNMAYGHSYYDYILEVYDYVHQILPLSKKREDNFIAGHSMGGYGAIKFALTQSYRFSKAAMLSAPYDVSMIGQYQWYDFTPEAIVGNTQHVAGTSFDPYYLVEQAIDNGQALPQLYITCGTEDELYQGNIDFVNYLDEKGIPYQFKKAPGNHDYAFWDKAIEDVIDRFTSSHI

SEQ ID NO: 3537 - protein, 64 aa, Staphylococcus epidermidis
TYVMYTKCYTCTLYSTSLFFLSKYGTTNITNKAHPIANKKPKFSNLFTPYFVYNINTIILQKYS

SEQ ID NO: 3538 - protein, 130 aa, Staphylococcus epidermidis
LVYIINILIFKILGDAQMLKINFFNKEYGVLKSQNYERISLELLNKHYHITENDFKNKDYCLDKFNSKDTFIGDIAHTEKELISLIEDNIKNPKNMEHQNLSSIFDYTDHHNNQRVYHSILDLIQDNTSS

SEQ ID NO: 3539 - protein, 257 aa, Staphylococcus epidermidis
SPYIHGYYLYGSDRYYIFMDSIVKESYSMIDIQNVSKSYKKKHIFDSLDMQFQNHKITILLGENGAGKSTLLRLIAGIENADEGRIQYFNQYLSRRRIRHIVGYVPQDIALFEHMTVMENIEFFKSLCENPISDETLHSYLSQLNFTDTKVKVSNLSGGNKRKVNIMIGLLSRPKILILDEPTEDIDLESRYDIHNLLQQMTDQCLIIMTTHHLDEVEALADDIKVIGQNPFYHDILENKGWSFKKYANALADNTKS

SEQ ID NO: 3540 - protein, 72 aa, Staphylococcus epidermidis
IINIEATQYEGRAVSRKAIERIARSGNLPLVKALTMPSTTDVIITTTLEIKVSFNVFINAGPIRSDTGSPVI

SEQ ID NO: 3541 - protein, 131 aa, Staphylococcus epidermidis
EANISLKIRCISMKRLIFIVVILFIQACSYVVINFFFFDMWVIHSSEQQLNQSIQHHDTKQLHKIAKDKQTYQFLKTIKKADFENATDNQGGGPIGYYRLDINKKPVGLTINIKYNFLPEKTTIKSIKLYQ

SEQ ID NO: 3542 - protein, 1017 aa, Staphylococcus epidermidis
CENIHKKLGGFAMSKEIFDTFKFKCGAELKNRVLMAPMTIQAGYFDGSVTSEMIDYYQFRAGDASAIIVESCFVENHGRGFPGAIGIDNDDKIPGLKRLAEAIQAKGSKAILQLYHAGRMANPKFNEGEQPISASPIAALRPDAVPPREMTHAQINQMIDDFGEATRRAIEAGFDGVEIHGANTYLLQQFFSPHSNRRQDSWGGSREKRTRFPIEVLTKVQHVVAEKEASHFIIGYRFSPEEIEEPGIRFEDTMFLLNTLAEYEPDYFHISANSYQRTSIVNQEDTEPLINKYIKMQSAQLAKIPLIGVGSIAQRQDAEHALELGYDLLSVGKAYLVEPQWTDKISQNEEVEQFVDIHDQKVLHIPSPLWKVMDFMILDKEEEHRKYEKLKALQNKKVKFNKGTYHVYAKGHNGNLPMKVQLSEDKIVSIEVDDSGESEGIANPVFERLPQDIINGQTLNVDVISGATVTSEGIVQGIADAIEQAGEDPDILRARPKPVVQWSDEVVEETTDVVVIGTGGAGLSAAATVLDEGKEVIMLEKFAAIGGNTIRTGGQVNAAEPKWQNAFPALAGEKETLIQLLNHDENDIDEAYIEDFNTLKRQIKDYLENSSNEDEYLFDSVELHRIQTYLGGKRKDRNNVEISGDYDLVKTLTDNVLESVYWLKDKGVHFDRSFVDMPVGALWRRGHKPMKAQGLEYIENLGDYVKHNHGRIFTETTAEKLIKEGNQVVGIEARKANGAKVKIHTRHGVVLATGGFGANTKMLQQYNTYWDNIPDDIKTTNSPAITGDGIRLGVQAGADIVGMGFSQMMPISDPKTGALFTGLIVTPSNFVFVNKEGQRFVNEFESRDVLSKAALEQKDGIFYIIADANIKALAMNTTEDKINQELEDGTLVKADTLEALAQKLNIDTTTFVNTIERYNTFVEQGQDEDFNKNAFDLKIEKAPFYATPRKPAIHHTMGGLKINTHAQVIDVEGHIIEGLYAAGEVAGGIHAGNRLGGNALADIFTFGRIAGQSAVTK

SEQ ID NO: 3543 - protein, 63 aa, Staphylococcus epidermidis
YEILSCTFTPSLHQYLTSKRLALSSYISRLKRQALINFIHIYLSCLTYLYTNPPSVKMDWPVI

SEQ ID NO: 3544 - protein, 406 aa, Staphylococcus epidermidis
VCLIKKLKKWLKFSTKPYIKHWVRSKRGFMDIKAQLKQIQDKGLYRELQPIQSVEKQYIYINDQSYINFTSNDYLGIGQLEYQPQNFLDFIKTYSIHLSSSRLVSGNSVVYQQLEQAISEHFNFEDALIFNSGYDANLAVFNIFKNNNVVIFSDQQNHASIIDGIKLSGLSKVIYQHLNYDDLESHLARHTNPDVQKVIVSDSVFSTNGTKADINRLVHLKQRYNAILIIDASHSLGLNLFEYHADIDIVTSSLSKAWGAHGGLILSSKDIKDLIINKGRSLIYSSSLPSYHLYFIQVSLQHVIEDTYRREKLNALSEYFNHQFMELFPNQPLSNTPIKNIVCDSLASAQAQYDMLFEHGIFVSYLRYPTVSQPTLRISLSYFHDTDDINRLFNVMKQYDEGDSYV

SEQ ID NO: 3545 - protein, 106 aa, Staphylococcus epidermidis
CDFFKKMCRKILVYKHTITVIKGFFLHTSHNFFNTPLLSIVIEFNYIPFDIGKLNKTFQTYKQLNIPLLFKRILSNELYTIIKVLQKFESLNFTYFIYIAHFIIML

SEQ ID NO: 3546 - protein, 294 aa, Staphylococcus epidermidis
GESMNKLSKYIAIATLASTVTISAPIHTYACESHTKDNHNQTTQHQNDPNLGEQNVMAVSWYQNSAEAKALYLQGYNTAKYQLDEHIKKNKGKKKLAIALDLDETVLDNSPYQGYASMHDTSFPEGWHEWVAAAKAKPVYGAKSFLKYADKKGIDIYYISDRDKEKDFKATKENLKNIGLPQAKDNHILLKGKNDKSKASRRQQVEKNHKLVMLFGDNLLDFTDPKKSTAKEREKLVKKHAKDFGKKYIIFPNPMYGSWESTLYHNQYEISKNEKDELRKASIKQFNPKTGEVK

SEQ ID NO: 3547 - protein, 454 aa, Staphylococcus epidermidis
EDPMANTRELNHKDAQYVWHPFTQMGVYAKNDNIIIEKGRGSYLYDTEGNKYLDGYASLWVNVHGHQHKKLNKAIHKQLDKIAHSTLLGSSNIPSIELAEQLVKLTPDRLQKVFYSDTGSASVEIAIKMAYQYWKNIDAKRYAKKNKFLTLHHGYHGDTIGSVSVGGIDSFHKIFKDLIFENIQIETPCLYKSKYRNEAEMLNSILNQIENILSERNDEIVGFILEPLIQGATGLFVHPHGFLKAVEQLCRKYDVLLICDEVAVGFGRTGEMFACNHEDVQPDIMCLGKAITGGYLPLAATLTSQKIYDAFLSQSHGKNTFFHGHTYTGNQLVCSVALENINLFKKKHLIGHIQKTSQTLKQRLEALQPHKNIGDIKGRGLMYGVELVENKSTQTPLDIPTVELIIRRCKENGLMIRNLENVITFVPILSMSNKEIKKMVKIFNKALHQTLGKK

SEQ ID NO: 3548 - protein, 195 aa, Staphylococcus epidermidis
IITIIYYLEFDKEGDEMPRISKRQLILESAAAIINEKGADYLTLDAVAQRAGISKGGLFYHFKSKDELIKELVNYANNLYRENVNQHIGNEKNKKGQWLNAFIEATRAHRTDNAPITSGMLAAQGTNRSLLSPLKTSYQEWQYQITHDGLDEVDATIIRLAVDGLWLSEIFGISAIDEEMREKVIERLKMQIEKK

SEQ ID NO: 3549 - protein, 271 aa, Staphylococcus epidermidis
MYTIIERCEKMKYYGKCISYISILILTFFIGGCGFMNKENNKEAEIKENFNKTLSMYPIKNLEDLYDKEGYRDEEFEKEDKGTWIINSEMNIQKKGQAMKSRGMVLYMNRNTRKTTGHFYTNIITEDKKGRVHSKDKEYPVRLKNNKIEPTKSIADEKLKNEIKNFQFFSQYGNFKNLKDYKNGNVSYNPNVPSYSAEYQLSNEDDNVKQLRKRYDIPIKRAPKLILKGDGDLKGSSIGYKDIEFSFVDNKEESVYFVDSLEFNPSDVNNE

SEQ ID NO: 3550 - protein, 64 aa, Staphylococcus epidermidis
VIQMNHFGKLHRISLILNIMFLILMPKIYSFDNIYLSIIWTLLGIANAVYLLIKQKQENTIKRK

SEQ ID NO: 3551 - protein, 325 aa, Staphylococcus epidermidis
RRQIMKFAVVGTGVIGSGWITRMLAHGHEVIATDPSEGAYERMLTQVKQNWPYAEQMGLAENASIQNLTFTPHLEEAVKDADHIQENVPEVEEIKDAVLKEIDFYAKPEATIGSSTSGIMPSELQANLSHPERLVVAHPFHPVYILPLVEIVPGKQTSEETTVKAEQIYESIGMDVLHVRHEIEGHIADRLMEALWRESLHIVNDGIATTEEVDKAFTHAAGLRYAQYGPFMTFHLAGGEGGMRHMLKQFGPALKKPWTKLIAPELTDDLYHKVVSGSEASSQGYTMSELDQKRNEFLIKVKELAEQYWPSDSKAMKKSNGAELQ

SEQ ID NO: 3552 - protein, 418 aa, Staphylococcus epidermidis
KVKIITKNEEDCEMTVLSEQDKIRLLADIVKIQTENDHEIEVCEYLKDLLSQYDIDSKIVKVNDSRANLVAEIGSGAPVLAISGHMDVVDAGDHDDWTFPPFELTDKDGKLFGRGTTDMKGGLMAMVIAMIELKQSNALKQGTIRLLATTGEETEQYGAQLLADEGYLDDVSGLIIGEPTSNIAYYAHKGSMSCVVTAKGKAAHSSMPHLGTNAVDILVDFVNEMKQEYKNIKEHDKVHELDAVPMIEKHLHRKIGEEESHIYSGFVMLNSVFNGGKQVNSVPHKATAKYNVRTVPEYDSTFVKDLFEKVIRHVGEDYLTVDIPSSHDPVASDRDNPLIQNITRIAPNYVHEDIVVSALIGTTDASSFLGTNENNVDFAVFGPGESIMAHQVDEFIRKDMYLSYIDVYKDVFKAYLEK

SEQ ID NO: 3553 - protein, 756 aa, Staphylococcus epidermidis
QYEMEAESMLETNNHTNAWQGFKTGRWNKNIDVREFIQLNYSLYEGDDEFLEGPTKATETLWDQVMQLSKEERERGGMWDMDTKVASTITSHDAGYLDKDLEKVVGVQTEKPFKRSMQPFGGIRMAKAACEAYGYELDPETEKIFTEYRKTHNQGVFDAYSREMLNCRKAGIITGLPDAYGRGRIIGDYRRVALYGVDFLMEQKLKDFNTMSTEMSEDVIRLREELSEQYRSLQDLKELGQKYGFDISRPATNFKEAVQWLYLAYLAAIKEQNGAAMSLGRTSTFLDIYAERDLQNGDITEQEVQEIIDHFIMKLRIVKFARTPEYNELFSGDPTWVTESIGGVGIDGRPMVTKNSFRFLHSLDNLGPAPEPNLTVLWSTRLPENFKIYCAKMSIKTSSIQYENDDLMRESYGDDYGIACCVSAMKIGKQMQFFGARANLAKALLYAINGGKDEKSGKQVGPSYEGIKSDVLDYDEVFERYEKMMDWLAGVYINSLNIIHYMHDKYSYERLEMALHDTEIIRTMATGIAGLSVAADSLSAIKYAQVKPIRNEEGLVTDFEIEGDFPKYGNNDSRVDEIAVDLVERFMTKLRSHKTYRNSEHTMSVLTITSNVVYGKKTGNTPDGRKAGEPFAPGANPMHGRDQKGALSSLSSVAKIPYDCCKDGISNTFSIVPKSLGKEEADQNKNLTSMLDGYAMQHGHHLNINVFNRETLIDAMEHPEEYPQLTIRVSGYAVNFIKLTREQQLDVISRTFHESM

SEQ ID NO: 3554 - protein, 167 aa, Staphylococcus epidermidis
RSGITMMNQQYVFHTKVHRDWVDHNGHLNDAMYNRIFSDTTDDWLGHLGLTINAIQSYQYTVFTLENHVMFLNEMKENEDVIVKVHLHDYDSKRLHVLMEMFNADDDLCATYEVMLMGIDTTSGRPSAFPNDILNNIEHYYNIENVEMTSQYIGHRIGIKKKPKSKE

SEQ ID NO: 3555 - protein, 84 aa, Staphylococcus epidermidis
YVMMDFLHYILPVIIYAVLLAIHYFLSRTGNKILGLIVPVGVIASLVYMYQADIIHMKMIGVIIIGIVALLFLAEEWQRAQKDK

SEQ ID NO: 3556 - protein, 213 aa, Staphylococcus epidermidis
DTMIKFISEHSGMLFAKTFEHLYISIVALVIAMIVAVPLGILLSKKEKLSKVSLTIAGVLQTIPTLAVLALMIPLFGVGKTPAIIALFLYVLLPILNNTIIGIQNIDSNLREAGRSMGMTNFQLMKDVELPLALPLILSGIRLSSVYVISWATLASYVGAGGLGDFIFNGLALFEPSMIITATILVTAIALIVDYVLSLIEKWVVPKGLKVSR

SEQ ID NO: 3557 - protein, 63 aa, Staphylococcus epidermidis
LNSITIDSKGVLKKLCEVWRKKPLITVIVCLYTRILRHIFLKKSHYQKLKNIIIINVVKNVLD

SEQ ID NO: 3558 - protein, 236 aa, Staphylococcus epidermidis
NNTMKVIAMYSIKMRASHEDVHISGAETMCEFEDLENYLKKYFNKAFNHENGNIDFLNLKIEKVKAPIQTLVALPVVENLNDTLTQLAKQTGVSEYALNKGLEFIKNDITYTGAIILSAQTGQRLDSTEQRGIRVTQLAFKTCKCNGEISERVKDARALATCINAFEGVKAELCVSDDLHYTTGYFASPKLGYRRIFNIKEKGTRHGGRIIFVDEGINLNEYVSFLETVPKEIIEK

SEQ ID NO: 3559 - protein, 192 aa, Staphylococcus epidermidis
RMNVADIKARLLDLENTFKEKESELTDLDRAIGDGDHGVNMVRGFEHLKEKIDDQSMQALFKSTGMTLMSNVGGASGPLYGFGFIKMASAVNDEIDHDNLKEVLKAFADGIQQRGKVELNEKTMYDVIERAREAVEKNETVDLDKLQSFANETKDMVATKGRASYFNEASKGYIDPGAQSSVYILNAIIGGE

SEQ ID NO: 3560 - protein, 75 aa, Staphylococcus epidermidis
NICFLYLIYHNIVQFNLKFTMFNIYSSFYILYKKHGLYLTVCSFTFRPTICLSNQSKTYFYVTFVNCSRFTTTKY

SEQ ID NO: 3561 - protein, 315 aa, Staphylococcus epidermidis
RSVVMVKFIMKRLTLMIPLLIVVTFMTFMMTYLTNEDPAVTILHAQGTPNITQDLIAETKEKYGLNQPIFTQYKNWLVDALQFKFGTSYITGDPVSERMGPAFMNTLKLTLISSVVVMITSVVLGIVSALTSGRFPDRAIRSIAFLLTALPSYWVASILIIYVSVKLNLLPTSGLTGPESYILPVFVITITYAGIYFRNVRRSMLEQLNEDYVLYLKASGVPRLTMLLHVLRNALQVAISIFCMSIPMIMGGLVVIENVFAWPGLGPLSIKAITEHDFPVIQAYVLIVAVLFILFNTLADIINAILNPRLREAMK

SEQ ID NO: 3562 - protein, 257 aa, Staphylococcus epidermidis
LTMVNIMEKFKLTGKVAMVIGGATGIGKAMAEALAQAGANIVIADLQSNIGQETATTISTQSGVKTTSLKLDITHLDEVNQIVDYVVREYGKIDILVNNASISIQDDTENISYEEWLKEINLSLNGAFSVAQTVGRQMIEKGSGSMINVSSVLGLIANKTQDQSSYETSKAGVTMLTKSLAREWSRYGIKVNAIAPGYMRTIETEKILNDNTETNTTPMERVGEPEELAGITVYLASDASSFTQGSVFNIDGGYSAL

SEQ ID NO: 3563 - protein, 194 aa, Staphylococcus epidermidis
LILLQEKKLAKVNQQKKSLNNLLTKLLSMVQQKQNQVNQRNQVNQRNQVNQRNQVRQQNQVNQRNQVRQQNQVNQRNQVNQRNQVNQRNQVRQQNQVRQQNQVNQRNQVRQQNQVNQRNQVRQQNQVNQRNQVRQQNQVNQRNQVNQWNQVNQWNQVRQHNQVHQNNQIDQCIQQIIKINYLIQVKIVKLMREL

SEQ ID NO: 3564 - protein, 473 aa, Staphylococcus epidermidis
CDIFFLTKMIGVLGMNFFDIHKMPNKGIPLSVQRKLWLRNFMQAFFVVFFVYMAMYLIRNNFKAAQPLLKEEIGLTTLELGYIGLAFSITYGLGKTILGYFVDGRNTKRIISFLLILSAITVLIMGFVLSYFGSVMGLLIVLWGLNGIFQSVGGPASYSTISRWAPRTKRGRYLGFWNTSHNIGGAIAGGVALWGANTFFHGNVVGMFIFPSVIALIIGIVTLFIGKDDPEELGWNRAEEIWEEPIDQENIDSQGMTKWDIFKKYILGNPVIWILCISNVFVYIVRIGIDNWAPLYVSEHLHFNKGDAVNTIFYFEIGALVASLLWGYISDLLKGRRAIVAIGCMFMITFVVLFYTNATSVTMVNISLFALGALIFGPQLLIGVSLTGFVPKNAISVANGMTGSFAYLFGDSMAKVGLAAIADPTRNGLNIFGYTLSGWTDVFIVFYVALFLGMILLAIVAYYEEKKIRKLKI

SEQ ID NO: 3565 - protein, 543 aa, Staphylococcus epidermidis
VYIFSKRKRKTMNKLTKLSTVIFVSGIILAGCGSNKELTEKKENKVLSYTTVKDIGDMNPHVYGGSMSAESMIYEPLVRNTKDGIKPLLAKKWDISPDGKTYTFYLRDDVSFHDGTKFDADAVKKNIDAVQQNKKLHSWLKLSTLIDDVKVKDKYTVQLHLKEAYQPALAELAMPRPYVFVSPKDFKHGTTKDGVKSFDGTGPFKMGEHKKDISAEFNKNNQYWGEKAKLNKVEAKVKPAGETAFLSMKKGETNFAYTDDRGTDSLDKDSLKQLKETGSYQVKRSQAMNTKMLVVNSGKKDSAVSDKAVRQALGHMVNRDKIAQDILNKQEKPATQLFAKNVTDINFNLPTRTYDKKKAQALLDKAGWVLSKDRQVRQKEGKDLNLKLYYDKGSSSQKEQAEFLEAEFKKLGVQLDINGETSDKVAERRSSGDYDLMFNQTWGLLYDPQSTLAAFKTKTGYESATLGIKNKSQLYKDIDEAFKIQDAKARSKAYQQILKQVDDEGVFIPITHGRMTVVAPKDLQKLSFTQSQYELPFNEMQYK

SEQ ID NO: 3566 - protein, 171 aa, Staphylococcus epidermidis
FMILCFFCKYSICQIFIMYESYTHSSQIRGSYSMSKKKILIFISVILIIFGGVYLKMKYDEKAKQKEIYYKEQQERITLYLKYNTKKPNTIKSVHFTSLKQGPMGDAIIEGYINNNKENEFVAFASSEDNFQFQGDMIESKKVSNLIKYQTKTPDEIKKDLDKKKNAKDFY

SEQ ID NO: 3567 - protein, 69 aa, Staphylococcus epidermidis
CPPLFVIYILLLVQYKVFYIENVSNAINYLLTLAPTHNSSNTSHIKFSFSDNLILLRILSAYIDVIYFF

SEQ ID NO: 3568 - protein, 341 aa, Staphylococcus epidermidis
TVKFEKAIGTGAFVVDKTVKEKTTLKPNKYFDHGHPINYHLAFQTIEDGDSRNSPVQSGFVDISGGALGMLSDEQIKQDKKNKNLTIEDRPSTVSHFMAFNPKNDVLNQRTIREAISKSIDAKDIAGKSVNGLFQKNVQFVTKNNQQPHDYDMKAAERLLKSEGYHKNDDGIFEKNGKPLSFNLVIQTAEFPNWKDKAEKVQRQLKQAGIKLNVKTLDSQSYYDTLWTKKDYDLIFYRTYSDALMPYNFISSVFKNNDGQPGVLADDETLTKQLDDFPSTVSKEDQQCSFDDIFKHFNQQYYGVPIAYPNETFVVSDKVKQFKFSGLTDAPIDYKALKVNE

SEQ ID NO: 3569 - protein, 253 aa, Staphylococcus epidermidis
GVISMLKVQNVIKFYGKKSMFRDKRIPVVKGVSFDCPTGASVAIIGESGSGKSTLSRMILGLEKPDQGQVTLDGQPVHLKKVRRHRIAAVFQDYTSSLHPFHTVKDILFEVMNQCRCTSKENMEEYVTVLLREVGLKSDCLYCYPHMLSGGEAQRVAIARAICMQPDYILFDEAISSLDMSMQTQILDLLKRLRHSHQLSYIFITHDIQAATYICDDLLIFKNGCIEARTSISELHRQQNGYTRELIDKQLSI

SEQ ID NO: 3570 - protein, 406 aa, Staphylococcus epidermidis
QIELPIERNGHMLSIKNLSKVYAGGKKAVDNMTIDIESGDFIAFIGTSGSGKTTALRMINRMIESTEGEITIDGKNIKELNPVELRRSIGYVIQQIGLMPHMTVKENIVLVPKLLKWSQEKKDEKAKELIRLVDLPEEYLDRYPSELSGGQQQRIGVVRALAAEQDIILMDEPFGALDPITRDTLQDLVKKLQQQLGKTFIFVTHDMDEAIKLADKICIMTNGQVVQYDTPDNILRSPANDFVRDFIGQNRLIQDRPNIRTVKDAMIKPVTVHVDRSLNDAVNIMREKRVDTIFVVGNDEHLLGYLDIEDINEGLRHHKELIDTMQRDIYRVRIDSKLQDSVRTILKRNVRNVPVVDSDNKTLLGLVTRANLVDIVYDSIWGELESDNNDNHSGIVEPESTGVETP

SEQ ID NO: 3571 - protein, 286 aa, Staphylococcus epidermidis
SHDSIWNICTSAHFLKKPARDINVLPNTTCLGGIKMFKVVICDDERIIREGLKQMVPWEDYHFTTVYTAKDGVEALSLIRQHQPELVITDIRMPRKNGVDLLDDIKDLDCQIIILSSYDDFEYMKAGIQHHVLDYLLKPVDHTQLEHILDILVQRLLERPHSTNDDAAYHTAFQPLLKIDYDDYYVNQILSQIKQHYHKKVTVLDLINPIDVSESYAMRTFKEHVGITIVDYLNRYRILKSLHLLDQHYKHYEIAEKVGFSEYKMFCYHFKKYLHMSPSDYNKQSK

SEQ ID NO: 3572 - protein, 84 aa, Staphylococcus epidermidis
SAFLSILSPLFKGSTWKRTSKPPCKSRTKLTFLTTFLYVIPIPVNSRAMRSMNAIILLVFFTCTPHYLLMYLEYSMNKLSCKLK

SEQ ID NO: 3573 - protein, 109 aa, Staphylococcus epidermidis
GVTSMKTLKLLKKTRAFTLIEMLLVLLIISLLLILIIPNIAKQTSHIQSTGCDAQVKMVNSQIEAYALKHNRNPSNIDDLVSDGFIKEGQKTCKSGQTISIANGEAVAN

SEQ ID NO: 3574 - protein, 531 aa, Staphylococcus epidermidis
LIMSKIYCIKVIKTLLYQRYIEVTGYKDESEKDKMDKQERYNRRENIRNFSIIAHIDHGKSTLADRILENTKSVETREMQDQLLDSMDLERERGITIKLNAVRLKYEAKDGETYTFHLIDTPGHVDFTYEVSRSLAACEGAILVVDAAQGIEAQTLANVYLALDNDLELLPVVNKIDLPAAEPDRVKQELEDVIGIDQEDVVLASAKSNIGIEEILEKIVDVVPAPDGDPEAPLKALIFDSEYDPYRGVISSIRIIDGVVKAGDRIKMMATGKEFEVTEVGINTPKQLPVEELTVGDVGYIIASIKNVDDSRVGDTITLAERPADKPLQGYKKMNPMVFCGLFPIDNKDYNDLREALEKLQLNDASLEFEPESSQALGFGYRTGFLGMLHMEIIQERIEREFGIELIATAPSVIYQCILKDGSEVSVDNPAQMPERDKIEHIYEPFVKATMMVPNDYVGAVMELCQRKRGQFINMDYLDDIRVNIVHEIPLSEVSFSISLINLNLTQKGMLLLIMNLLRIKKVILLKWTYY

SEQ ID NO: 3575 - protein, 336 aa, Staphylococcus epidermidis
ANMSGQVILLLDEIHRLDKAKQDFLLPHLENGKIVLIGATTSNPYHAINPAIRSRAQIFELYPLDQDDIRLALDRAINDKERGLSTYHPIVDEDAIEYFSTQSQGDVRSALNALELAVLSAHIGEENERHITLDDAKDCLQKGAFVSDKDGDMHYDVMSAFQKSIRGSDVNAALHYLARLIEAGDLPTIVRRLLVISYEDVGLASPNAGQRTLAAIQSAERLGFPEARIPLSQAVIELCLSPKSNSGITAIDKALGDIRNGHIGQIPDYLKDGHYSGAKKLGRAIGYKYPHNYENGHVVQQYLPEKLKNRVYYEPKTTSKSEQQFKTIYDNLRNKT

SEQ ID NO: 3576 - protein, 248 aa, Staphylococcus epidermidis
RIRSGSILVMNQYEDMSLVYDKLTQDQPYHSWFNIVEHFLPSDSHDLLDIGCGTGNLTQLLTSLGEVTGMDISVDMLSIARQKTNQVKWIEGNMTHFNLNKKFNMITIFCDSLNYLETLNDVKMTFERVYQHLNKNGVFIFDVHTVHKMKTLFNNKSYIDESDNVFVGWDAICGDEPLSVYHEMTFFVSQQNGLYQRFDESHYQRTYEEQIYRNLLKDVGYHSVKTFTDFNIHSHEEDAHRLFFVAKK

SEQ ID NO: 3577 - protein, 174 aa, Staphylococcus epidermidis
WYFPSGHVENIHFVSHAQLNNINLNKIANFLTEHFSFNRKVLTQNIESYFSQKEELLLANEVVEMINLQIGNQSNSIYMGGKVKLIDALNESNVSSIQPILQYIESNKITELLEDISTSQINVRIGKEIDDSLSDISIVTSQYHFDESLKGQIAVIGPTAMHYQNVIQLLNRIW

SEQ ID NO: 3578 - protein, 226 aa, Staphylococcus epidermidis
FFVFNINRRYIDFFMKWKLYILIILIMLTTFFFYLLNDNNNDLIQNSQERQSKISDQQIKNSKKLNKKEVSIQKDNTKETKIFIDIKGAVKHPNVYEMSSSNRVIDALNKAEVLKDADLSQLNLSEKLVDQKLIYVPKKGENSMKINSQQSTLNSSDVKINTNQPLNLNSATEEQLKNIPGIGPSKAKEILNYREQNHGFNSIDDLMKIKGFGKKTFEKLKEHFTI

SEQ ID NO: 3579 - protein, 467 aa, Staphylococcus epidermidis
GEAFMVKNMDTIVQLAKHRGFVFPGSDIYGGLSNTWDYGPLGVELKNNIKKAWWQKFITQSPYNVGIDAAILMNPKTWEASGHLGNFNDPMIDNKDSKIRYRADKLIEDYMQNEKGDENFIADGLSFDEMKKIIDDEGIVCPVSKTANWTDIRQFNLMFKTFQGVTEDSTNELFLRPETAQGIFVNYKNVQRSMRKKLPFGIGQIGKSFRNEITPGNFIFRTREFEQMELEFFCKPGEEIEWQNYWKTFASEWLTDLNISEDNMRLRDHDEDELSHYSNATTDIEYKFPFGWGELWGIASRTDYDLRQHSEHSGEDFKYHDPETNEKYIPYCIEPSLGADRVTLAFLCDAYAEEGVEGSKDARTVMHFHPALAPYKAAVLPLSKKLSSEAIKIFEQLSSSFAIDFDESQSIGKRYRRQDEIGTPYCITFDFDSLEDNQVTVRDRDSMEQVRMPISELETFLAEKVKF

SEQ ID NO: 3580 - protein, 355 aa, Staphylococcus epidermidis
PMNTLILLTKRGNNLNIEDFDYHLPESLIAQTPLKNRDQSRLLVLSKDTGELTHLHFRDVIHYFEPGDTLVLNDTRVMPARLFGLKEETGAKVEMLMLTQIEGNDWEVLLKPAKRIKKGHRLNFGDGKIVAECIEELEQGGRIMRLHYEGILQERLDELGEMPLPPYIKERLDDPDRYQTVYAKESGSAAAPTAGLHFTDDLLNKIKQKGVHIAFITLHVGLGTFRPVSVENIDDHEMHSEYYQMTQETADLLNKTKESGKRVISVGTTSTRTLETIRRDHPQFVATSGWTDIFIYPGFEFKAIDGLITNFHLPKSTLVMLVSAFSNKKYILNAYHKAVEMEYRFFSFGDAMLII

SEQ ID NO: 3581 - protein, 91 aa, Staphylococcus epidermidis
RGVTKMELTSLIIPILLLVVMYFLLIRPQQKRAKEHRAMINRVEAGQKITTIGGIKGTIKAVDETSVIITVNSNGTEMTFEKPAIKQVDPS

SEQ ID NO: 3582 - protein, 330 aa, Staphylococcus epidermidis
KVMTDIILAADIGGTTCKLGIFDKDLEQLHKWSIDTDTSDHTGELLLKNIYNSFTEKIAEYKYDFNNVVGVGIGVPGPVDFDTGVVYGAVNLHWPDSVNVREIFKQYVNCPVYVDNDANVAALGEKHKGAGEGADDVVAITLGTGLGGGIISNGEIVHGHNGSGAEIGHLRADFDQRFQCNCGKSGCIETVASATGVVNLVNFYYPKLTFKSSILQLIKDNQVTAKAVFDAAKAGDQFCIFITEKVANYIGYLCSIISVTSNPKYIVLGGGMSTAGLILIENIKTEYRNLTFTPAQNNTEIVQAKLGNDAGITGAAGLIKTYIIDKEGAK

SEQ ID NO: 3583 - protein, 380 aa, Staphylococcus epidermidis
HMPAVTYEHIKTCKQSGARLGIVHTPHGSFETPMFMPVGTKATVKTMSPEELRNIEAKIILGNTYHLWLQPGNDIIKHAGGLHKFMNWDGPILTDSGGFQVFSLSNLRKISEEGVEFRHHTNGSKLFLSPEKSMQIQNDLGSDIMMAFDECPPMPAEYDYVKDSIERTTRWAARCLKAHQRPGDQALFGIIQGGEYKDLREQSAKELVSLDFPGYAIGGLSVGEPKPVMYDMVEHTEQFMPKDKPRYLMGVGSPDALIECSIRGMDMFDCVLPTRIARNGTCMTSNGRLVVKNAKYADDLRPLDEQCDCYTCQHYTRAYIRHLVKAEETFGIRLTTIHNLHFLLKLMEDIRQAIREDRLLDFKDEFFEQYGLNVENPKNF

SEQ ID NO: 3584 - protein, 201 aa, Staphylococcus epidermidis
LFMAFELPNLPYAYDALEPHIDKQTMEIHHDKHHNTYVTKLNSAVEGTDLEAKSIEEIVANLDSVPSNIQTAVRNNGGGHLNHSLFWELLSPNSEEKGEVVDKIKEQWGSLDEFKKEFADKAAARFGSGWAWLVVNNGQLEIVTTPNQDNPITEGKTPILGLDVWEHAYYLKYQNKRPDYINAFWNVVNWEKVNELYNATK

SEQ ID NO: 3585 - protein, 253 aa, Staphylococcus epidermidis
VDNLQRYFMNQSADENQCFFIENKEDYHHIVNVMRYKEGQNIIVTFSDENVFKCKIISINDQSIEIKLVEKQQINTELPQNITICSGLIKADKYEWMIQKATEMGANEFIAVAMERSVVKLTDSKVEKKLSRWQKIIKEAAEQSYRLTIPNIKFKSNLKEIYGMISQYDYVLIAYEEQAKHGELSQFKQTIKQFKTQDRVLIIFGPEGGLSDSEISLFGDVSTIVGLGPRILRAETAPLYALSAVSYEKELLG

SEQ ID NO: 3586 - protein, 739 aa, Staphylococcus epidermidis
PMFYIALAFLVGVLWIKFKVISISLILTLLLLIMIKRLNIIILLLMFISAISFFFLISSYNQTEIKNINSLYNEPFIDDFVTFKSFTPKSTYYTGILNYKNKDYRYFYKILKSNFKQDLTHKSCRVKGEFKFEKELSLLNISTVQFKSCQENNIFTPIYHHQNYITKIIHISGVTHPERILALITGDTSLIDEYYKSNIKDIGIYHLLAISGTHVGTIIVLVYQLLVRLNIPLVLIKGVTILLLLIYAVYTGFVPSAMRAISIAIIILMLPIHFRKSSIHVLSFIFVLMILLNPQFINHIGFQFSFLISLFIILAKPYISALKPLKCLFIISFLAQLGSIVINTYHFNQFQWIGLLSNFIFVPFYSFILFPSVIIYFILIHFFQHSFLLNTYINMLFKIHDWLVQLFLNLNHLKWYIPKLNQYSLLILIILTLIFLYILVYRGFVTSVLSFLIVLIIFTHLIRPHYAELTLFDVGQGDSILFKTKSNKSVLIDTGGKKNENVSFKHNNIAKYKILPIIKKKGITTINYLVITHPHADHMGELIYFLNNINVNNLVLNIESFPLKLLKEVTTKCKEKKINILDVNQVKKIDIDNSKISFLNSFIPLIDDKNEHSIVTLIEYNGINILLMGDATVNNEDILMKRYNLPKIDILKVGHHGSRTSSSKLFIKDIEPKISLISSGKNNKYHLPNLDVIQRLKYYGSKVFDTQDNGELTINLDEEVYIVYRDNLNQKSLARESVS

SEQ ID NO: 3587 - protein, 243 aa, Staphylococcus epidermidis
ILSYSFLIHIRSLKMINLNQRLSIVCSFIKRGTLADIGSDHAYLPIYAIQNDLCTKAIAGEVIQGPYKAAKRNIANYELNQQVDVRLGDGLSVINSEDQIDNITVCGMGGPLIAKILNDGKDKLVNHPRLILQSNIQTQALRQTLNKLSYEIVDERIIEEKGHIYEIVVAEFNNNLVKLNILQEKFGPFLLRECNNIFQKKWQRELEALRDIKSQLNSTSHHERLKEIEDEINLIQEVLINEN

SEQ ID NO: 3588 - protein, 90 aa, Staphylococcus epidermidis
GVSYMENFDKTMKFSYEEIPKEDVKSVLQNVHRTLEERGYNAVNQIVGYLLSGDPAYIPRQNEARNQIRHIDRDVIMEELVSNYLKESKN

SEQ ID NO: 3589 - protein, 295 aa, Staphylococcus epidermidis
LRHQRTLSVRKTFVLRIFMYIIIKKHRYNELESKELKMKHQFSRNELAIGQEGLNLLKNKTVAVLGVGGVGSFAAEALARTNIGHIILIDKDDVDITNVNRQIHALTSTIGQSKVTLMEERIKLINPDCKVTSLHMFYTEETYKDIFNNYDIDYFIDASDTIIYKVHLMKECLERGIELISSMGAANKTDPTRFEIADISKTHTDPMAKVIRNRLKRLGIRKGVKVVFSDESPIVIREDVKETVGDKNAINRKGQMPPSSNAFVPSVVGLICASYVVNDILKDIPVRRIKDKGQN

SEQ ID NO: 3590 - protein, 449 aa, Staphylococcus epidermidis
ILSHRYIPLTEQDKNEMLNSIGAKSISELFDDIPTDILLKRNLNIAESEAETILLRRLNRLAAKNTTKETHATFLGAGVYDHYTPAVVDAMISRSEFYTAYTPYQPEISQGELQAIFEFQTLICELTDMDVANSSMYDGMTSFAEACILALSHTKKNKIVVSSGLHYQALQILHTYAKTRDEFEIIEVDLKGTITDLEKLEQLIDDNTAAVAVQYPNFYGSIEDLEQINNYIKDKKALFIVYANPLSLGLLTPPGTFGADIVVGDTQPFGIPTQFGGPHCGYFATTKKLMRKVPGRLVGQTQDDEGNRGFVLTLQAREQHIRRDKATSNICSNQALNALASSIAMSALGKQGIYEIAVQNLKNANYAKNKFEEHGFEVLKAQSFNEFVVKFNQPIKNINLKLAEYGYIGGFDLGEVSDDFKNHMLVAVTELRSKDEIDDFVTKAGELND

SEQ ID NO: 3591 - protein, 364 aa, Staphylococcus epidermidis
TKCLKKVLYVKKLSINTFKYKRNKYLTEIQSIDLLQRLQQLLSHGFTLYQSFKFLNSYFKYKERTINKKIIQHLQNGATCYDILKIIGYPELVLLQIKFAENYGNIEEALVDTVQYMKRNLKAKKRLIKTLQYPVALISIFLFILTILNITVIPQFQQLYETMNVKLSTFQNLLTLIITRLPKLTFIFIFISGIAFFITYKFYYYLPIEKKLKSILKIPMINTYYKIYRTYQLSNQLSLFYRNGTSLQQIVRIYRNEQDNDFLKFLGDYLFKEANKGLPLPVILMNLKCFQNDLIKFIEQGEKNGKLDIELKLYSQMLLQQFEEKVLKQTKFIQPIIFFILGIFIVSLYLVIMLPMFELMQTIK

SEQ ID NO: 3592 - protein, 593 aa, Staphylococcus epidermidis
KGSLKMNKRTTYCGLVTEEFLNEKVTLKGWVHNRRDLGGLIFVDLRDREGIVQIVFNPDFSEEALQVAETVRSEYVVEVEGVVTKRDAETINPKIKTGQVEVQVSNIEIINKSETPPFSINEENVNVDENIRLKYRYLDLRRQELAQTFKMRHQTTRSIRQYLDNNGFFDIETPVLTKSTPEGARDYLVPSRVHEGEFYALPQSPQLFKQLLMISGFDKYYQIVKCFRDEDLRADRQPEFTQVDIEMSFVDQEDIIAMGEDMLRKVVKDVKGIDVSGPFPRMTYAEAMDRFGSDKPDTRFGMELINVSQLGKEMNFKVFKDTVDNNGEIKAIVAKDAANKYTRKDMDALTEFVNIYGAKGLAWVKVVDDGLSGPIARFFEDVNVETLKQLTEAKPGDLVMFVADKPNVVAQSLGALRIKLAKELGLIDESKLNFLWVTDWPLLEYDEDAKRYVAAHHPFTSPKREDIEKLDTEPENVQANAYDIVLNGYELGGGSIRIHDGELQQKMFEVLGFTNEQAQEQFGFLLDAFKYGAPPHGGIALGLDRLVMLLTNRTNLRDTIAFPKTASATCLLTDAPGEVSDKQLQELSLRIRH

SEQ ID NO: 3593 - protein, 486 aa, Staphylococcus epidermidis
MNINKLYWKALYYWIRYLNYNVIYRDKEDDEIWLSHKRKHSIVVFRKDVTSTQEIRFDKSKIMERPEEIQQFIGYIPESYEFYYFTDKELSKENLNEEKPIKLKFKIISNEQSLNSLPINFLLLKMLINNEDKRTYLHYKRKVLTQNLVDKHMQRFTPITYTLILINIVIWLCMILYLNRFSDVKLLEVGGLVHFNVVHGEWYRLISSMSLHFNFEHILMNMLSLFIFGKIVESIIGSWRMLIIYIISGLYGNFVSLSFNTTTISVGASGAIFGLIGSIFVIMYLSKNFNKKMIGQLLIALVVLIVFSLFMSNINIMAHLGGFISGVLITLIGYYFKTQRSLFWSFLIVFLLIFIILQIRIFTISEDNIYDKLIRDEMIKGNYSEAKNVVKQTLNNNYADDETYYLSGLITATKSSQAEAVSEWERGLRKFPNSGVLNYELAIANRSLSDDKKALKYIKKAVAINPNNKKYVNLKKELSKSNDTKN

SEQ ID NO: 3594 - protein, 146 aa, Staphylococcus epidermidis
MDIKKIEEVIKLVKANDVKKFKYKDSHNEIELDFTNGASQQHSQQSSQDIQQENIKSLDEKQESISNDQQEIKSPMVGTFFLQDSKELTEPKIKVGDTVTEGDIIGYIEAMKVMNEVTTDVTGEVTEILVEHGDNVEYDQLLVRVK

SEQ ID NO: 3595 - protein, 122 aa, Staphylococcus epidermidis
LEINMKRFKYAYEGFCAILKKDQNFLLHILAAIIIIILGFVLNIDRIDWILIIVAIGLVLSFEAINTSIEFVVDLITTDYHEYAKYAKDIAAFSVVIVSIVSICIGLIVFLPYILEIFKGGM

SEQ ID NO: 3596 - protein, 185 aa, Staphylococcus epidermidis
NHYKGKGEKIVGIIKKLFMPNAYVKSIFEIDIEKLADSGVKGIITDLDNTLVGWDVKEPTKGVKSWFAKAKDLGITVTIVSNNNKSRVSSFSSNLGVDYIFKARKPMGKAFKMAIKKMKIQPRETVVVGDQMLTDVFGGNCNGLYTIMVVPVKRTDGLITKFNRLIERRLLNHFRKKGYIKWEEN

SEQ ID NO: 3597 - protein, 231 aa, Staphylococcus epidermidis
RGDKMNIGIIIFIISVIITGVSALRDKSHEDRQNQRPNQKTSNEQHQEGGFFEKLEKTFQEISDELNDEPEKKQSKPFETSLPPLNEDWNENEKKKTSHHKEKQNTSQSKRQTTSTHEHQNIPQPDKTTSRDDNYEKLKQELEQDVTKNLIDVRKEIDKEKEKQLVMIERKAQDIINDKYLSERTKRYRIKQLLNSRNVEKNMSRSAFQYDSDEVINGIIWSEILNKPKQL

SEQ ID NO: 3598 - protein, 502 aa, Staphylococcus epidermidis
MISKSSPLIFERSKKDRYAYSLPQNDIENISIASLLDDKYIRKHKAEFPEVSELDLVRHYTELSNKNFGVDTGFYPLGSCTMKYNPKINEKVARISGFSESHPLQEEEHVQGSLEIIYSLQEELKEITGMDEVTLQPAAGAHGEWTALMIFKAYHEKNGQSHRDEVIVPDSAHGTNPASASFAGFKSVTVKSNQRGEVDIEDLKRVVNDNTAAIMLTNPNTLGIFEQNIIEIGKIVHEAGGLLYYDGANLNAILDKVRPGDMGFDAVHLNLHKTFTGPHGGGGPGSGPVGVVEKLASYLPKPMVIKDNDRYKYDNDIPNSIGRVKPFYGNFGIYLRAYTYIRSMGANGLKEVSEAAVLNANYIKSRLKNHFEIPFNQYCKHEFVLSGTLQKQYGVRTLDMAKRLLDFGVHPPTIYFPLNVEEGMMIEPTETESKETLDYFIDAMIQIADETKNDPDKVLEAPHTTIIDRLDETTAARKPILKFEELKDEKYKEHTNIDSEDN

SEQ ID NO: 3599 - protein, 423 aa, Staphylococcus epidermidis
YSILIGGQKMGENTKQDFNQKGQNFKFTKKHRRLLYGSVFLMATSAIGPAFLTQTAVFTAQFYASFAFAILISIIIDIGAQINIWRILVVTGLRGQEISNKVLPGLGTIISILIAFGGLAFNIGNIAGAGLGLNAMFGLDVKWGAAITAIFAILIFVSRSGQKIMDVISMILGIVMILVVAYVMVVSNPPYGDALVHTFAPEHPFKLILPIITLVGGTVGGYITFAGAHRILDSGIKGKSYLPFVNRSAVAGILTTGVMRTLLFLAVLGVVVTGVTLSSENPPASVFQHALGPIGKNIFGVVIFAAAMSSVIGSAYTSATFLKTLHKSLLNKNNLIVITFIVISTFVFLFIGKPVSLLIIAGAINGWILPITLGAILIASRKKSIVGNYQHPTWMLVFGIIAVIVTIMTGIFSLQDLASLWKG

SEQ ID NO: 3600 - protein, 897 aa, Staphylococcus epidermidis
IILNYDYLTAITKTYEGEFLFMKKMKASEIRQKYLNFFVEKGHMIEPSAPLVPIDDDSLLWINSGVATLKKYFDGRETPKKPRIVNSQKAIRTNDIENVGFTARHHTFFEMLGNFSIGDYFKHEAIEFAWEFLTSDKWMGMEPEKLYVTIHPEDTEAFRIWHEDIGLEESRIIRIEGNFWDIGEGPSGPNTEIFYDRGSAYGKDDPAEEMYPGGENERYLEVWNLVFSEFNHNKDNTYTPLPNKNIDTGMGLERMTSISQNVRTNYETDLFMPIIKEVEHVSGKKYLIDDAQDVAFKVIADHIRTISFAIADGALPANEGRGYVLRRLLRRAVRFSQSLGINEPFMYKLVDIVADIMEPYYPNVKDKSNFIKRVIKSEEERFHETLEEGLTILNELIKEAKNSDQVIKGHDAFKLYDTYGFPIELTEELATQENLSVDMPTFEQEMQQQRDRARQARQNSQSMQVQSEVLKNIQDESQFVGYETTDYQSLITHIIYNGEEVKHVEAGETIYFILRETPFYAVSGGQVADKGTVGNESFEINVTDVTKAPNGQNLHKGIVQFGEATQNAKVEARVNKEDRRLIQKNHSATHLLHAALKEVLGDHVNQAGSLVEPERLRFDFSHFGPMTQEEINLVERRVNEEIWRAIDVRIQEMSIEEAKSIGAMALFGEKYGDIVRVVNMAPFSIELCGGIHVNNTAEIGLFKIVSESGTGAGVRRIEALTGKGAFLHLEEIETQFNNIKNHLKVKSDNQVVEKVKQLQEEEKGLLKQLEQRNKEITSLKMGNIEEQVELINNLKVLATEVEIPNPKAIRSTMDDFKSKLQDTIIVLVGQVDGKVSVIATVPKSLTNQVKAGDLIKNMTPIIGGKGGGRPDMAQGGGTQPEKITEALRFIKDYIKNL

SEQ ID NO: 3601 - protein, 165 aa, Staphylococcus epidermidis
KKDKKHVNPVRQLVLQMEKQLPIKNIKAFSLVEMIFTLFIISCLLITTLWSRSLFDIQLIDEEYEIKQLITKFNYYKSKAISNNESITLLFFNNSNRVQVIEENGDKYSFKLNKGKVINIAKIQTLNFDKNGNINHFGSLILQYNSHAYRLIFHIEKGRLRFVKI

SEQ ID NO: 3602 - protein, 132 aa, Staphylococcus epidermidis
GGCKMSISLYIAIGIIVIIIAYMIIQQILNKRAVNELDQNEFHKGLRKAQVIDVREKVDYDYGHINGARNIPITVFKQRYQGLRNDQPIYLCDANGIASYRAARILRKNGYKNIYMLKGGYKKWTGKIKSKK

SEQ ID NO: 3603 - protein, 318 aa, Staphylococcus epidermidis
WISNIYKRRMTMVELLVTPKSITHMETLIDKGADAFVIGEQKFGLRLPGEFNRDAMQEAVALAHKNNKKVYAAVNGIFHNYHLDALEDYINFLHDIQVDRIIFGDPAVVMYVKQHEHPIPLNWDAETLVTNYFQCNYWGKKGANRAVLARELSLDEIIHIKEHADVEIEVQVHGMTCMFQSKRMLLGNYYTFQERQMKIERQHDHGDLLLYDEERDNKYPVFEDYNGTHIMSPNDICLIEELEPFFEAGIDAFKIDGILQSEEYINVVTEQYREAIDLFNEDPDAYEDEKFMLVDPIEEIQPEHRPFDEGFLYKQTVY

SEQ ID NO: 3604 - protein, 461 aa, Staphylococcus epidermidis
SELNRRNSMMYRCLIANRGEIAVRIIRACRELNIETVAIYAKGDENSLHVSLADQAICIGEANPLDSYLNIDRIISAAKVTESNVIHPGYGFLSESTNFAKAVEDNHIHFIGPSKTTMEMMGDKITARQTVKQAGVPVIPGSNDAVQSVDEIKLLSKEIGFPVVLKAASGGGGKGIRIVKEASHLDQALKEAKSEGQKYFNDDRVYVEAFIPVAKHVEVQIIGDGKNNYVHLGERDCSVQRKNQKLIEEAPCAALTEERRTRICGDAVKVAQASRYRSAGTIEFLVTEDAHYFIEMNARIQVEHTVTEMRADRDLLQAQLYLLTHGELPFTQKDILFNGHVIEARINAENPEKNFLPTPGKVNKLHLPQGFNIRVDSLLYTGYQVSPYYDSLVAKVIVKDSNRQTAINKLKVALDEMVIEGFTTTADFLYAVLNYPIYAKGDASKVDIKFLEKHQIIKEVK

SEQ ID NO: 3605 - protein, 115 aa, Staphylococcus epidermidis
QSIKSTHNRMITVDITVNDEGKVTDVVMDGHANHGEYGHDIVCAGASAVLFGSVNAIMGLTSEKPDINYEDDGGYFHIRSVDTNNKEAQLILQAMLVSLQTIEEEYNENIKLNYK

SEQ ID NO: 3606 - protein, 62 aa, Staphylococcus epidermidis
ITVKPFLNHTHSAWFSLYNKEASNEFIKNSFTGYFARNYIPDSLNSKFIYITIRNRVWKVLQ

SEQ ID NO: 3607 - protein, 98 aa, Staphylococcus epidermidis
DLSKYKFKGSLIIDALLAFFIVSTITMILIPMFSNLNNQYLINLNNIKIKQIMITSLQHYKKKELYQGVVIENYEIQLFNNKICGEDKAFNTRTCISI

SEQ ID NO: 3608 - protein, 339 aa, Staphylococcus epidermidis
RNRKIKRSDLMFSIGFIIIAVIIVVALLILFSFVPVGLWISALAAGVHVGIGTLVGMRLRRVSPRKVIAPLIKAHKAGLNLTTNQLESHYLAGGNVDRVVDANIAAQRADIDLPFERGAAIDLAGRDVLEAVQMSVNPKVIETPFIAGVAMNGIEVKAKARITVRANIARLVGGAGEETIIARVGEGIVSTIGSSEHHTEVLENPDNISKTVLSKGLDSGTAFEILSIDIADVDISKNIGADLQTEQALADKNIAQAKAEERRAMAVASEQEMKARVQEMRAKVVEAESEVPLAMAEALRSGNIGVKDYYNLKNIEADTGMRNAINKRTDQNDDESPQQ

SEQ ID NO: 3609 - protein, 230 aa, Staphylococcus epidermidis
SCRNEGEKMHEQSKIYQNIKDGKLDTALKDLFENIEENPAIVENYINAGIVLSDVGEIEKAERFFQKALTIEPENGAVYYNLANIYYNEERYNEAIKLYQTALQYEVAKKDCNYMIGMSFNQLGAFKEALPFLMTAAEMDDDRDLEVQFQYGLVLCQLEMFDEAIKQLNKVLSIDSQHVDGIYNLGLATYMKNENLDEAIAYFEQAISIDEKHLLSQHALKTFKTMKEEE

SEQ ID NO: 3610 - protein, 172 aa, Staphylococcus epidermidis
INLKSIQVPIILVGFMGTGKTTVGKYLSDLYNLSYVDLDNFIEVNECKSIPNIFNDIGEKGFRSLETRYLKSCLNTFDIISTGGGIIEDTNSLKLLKNQKHVVWLDCDIEIIFKRVKNDSHRPNAKSKNLNQLDALYSSRLSRYNEIAFMKVDSAQSVSEICTLIKTKLLSD

SEQ ID NO: 3611 - protein, 165 aa, Staphylococcus epidermidis
KIMKYNYSIIKYVGRIKHLIREHVFQFNIKAFTYIEALFALFVTTLILALLPTILKLTSFYLNTAQNNEDIQFEFFRRDLLKEKMTTQNNYEIENAYTIKLKKDKDVIRYIYKNRKIYKNINQKGNITLLNHVLSTRILKTNDNIVKLLITTGETNDEHKEILFI

SEQ ID NO: 3612 - protein, 91 aa, Staphylococcus epidermidis
KGVKNVSTEPLASRMRPKNIDEIISQQHLFGPKGIIRRMVDTIRLSSMISYGPPGIGITSIAKAISGSTQSKFRQLNAGPNTKKDMHLIVD

SEQ ID NO: 3613 - protein, 69 aa, Staphylococcus epidermidis
QQEKRTMNTKKSCLYSRKAFISLYLIVIFSIYLSIISFYISQYSLKLKTIHNLDVYYNKVIVNKLKEVD

SEQ ID NO: 3614 - protein, 815 aa, Staphylococcus epidermidis
KRRNNMSDPTLFDYSMIKGTVDAILFQNTDNFYTVLKVDTIESNEKFDSMPTVVGFLPNVVEGDVYTFKGQVVQHPRYGKQLKAETFEKELPQTKEAIISYLSSDLFKGIGKKTAQNIVNTLGENAINDILTRPEILESVPSLPKKKQKQIADQINANQESEKIMIRLHDLGFGPKLSMAIYQFYMGDTLNVLDKNPYQLVYDIKGIGFNKADQLARNVGIEPHSPERLKAALLFTLEEECIKQGHTYLPRTIVIETTQNLLNEDIEKPIETEQLLEIIDVLSEEKKLISEADQVSIPSLYYSELKSVQNLYRIKTNTSKLKEIEQSDLQIHIGDIESQNEVNYSASQKEALETAINSKIMLLTGGPGTGKTTVIKGIVELYAEIHGLSLDYDDYNEDDYPVVLAAPTGRASKRLHESTGLEAMTIHRLIGWNQDTQPQDILENEINARLIIIDEMSMVDTWLFHQFLSAVPLEAQIVFVGDEDQLPSVGPGQVFKDLIDSEIIPRVNLTEVYRQQDGSSIIDLAHRMKLNEPIDITKRYHDRSFIRCGTNQIPDVVDKVVKSAVAKGYDMSDIQVLAPMYKGNAGIKRLNQVLQSILNPKQQDDREIEFGEAVFRKGDKVLQLVNRPNDNIFNGDIGIIVGIFWAKENALNKDVLVVDFEGNEITFTKQDLMELTHAYCTSIHKSQGSEFPIVIMPIVRQYYRMLQRPILYTGLTRAKQSLVLLGEQEAFDIGLKTNGQIRLTQLNDLLKSYFGQNKDNLTTNKQTINEQKENNNHLDLKNEKENDIQLNESTIFQIDPMINMGEMTPYDFVER

SEQ ID NO: 3615 - protein, 62 aa, Staphylococcus epidermidis
LSLEGSINITFSSFSMKYVLVSTIPNVKFEIRIIIHHYGLDVFVLILIYHSFFLIYLDDHQF

SEQ ID NO: 3616 - protein, 89 aa, Staphylococcus epidermidis
EKNLVTITEVLFINYRPLVVFIKIYAFLCLIFTNLRYIYSISISRFRKILTRFTLTILFNCRVSRENNLIIKTFLKAYSLLLINLLVMI

SEQ ID NO: 3617 - protein, 204 aa, Staphylococcus epidermidis
RSTDMYAYIKGTLSQLFPTHVVVETCGIGYEIQTPNSYRFQKYLEKEVQIYTSLIVREDAQLLYGFINEEEKEMFLSLIKVTGIGPKSALAILASSTPHEVKLAIENENDAYLTQFPGIGKKTARQIVLDLKGKVTITEENSDDLLQTQVNGNEQNQIISEALLALQALGYSKRELTKVEKSLNKHNVNSVDEAVKIGLQTLVS

SEQ ID NO: 3618 - protein, 216 aa, Staphylococcus epidermidis
QHDEKGNWLMNQTTIIGIAGGSGSGKTTVTNAIMKNLEGHSVALLAQDYYYKDQSHLTFEERLETNYDHPFAFDNDLLIHNLKDLRNGKPVEVPTYDYSQHTRSKETIAFDPKDVIIVEGIFALENNTLRDMMDVKIYVDTDADLRILRRLTRDTKERGRTMESVINQYLNVVRPMHEQFIEPTKKHADIIIPEGGSNKVAIDIMTTKIQSLVSKK

SEQ ID NO: 3619 - protein, 259 aa, Staphylococcus epidermidis
KVGDQLMLMTQKGIIIKSVDYGESDKIITILNEYGAKIPIMARRAKKVKSGLQANTQLFVYGLFIYNKWRGMGTLNSVDVINQHYELQLDLFESSYASLCAETIDRSMEENEVSKYNYDLLQFVLSKINEGTPAQLMSVIVLLKNMSKFGFTASFDHCAITGIQDQSKLIAYSFKFDGAISESALYQDQHAFHLSNRTLYLLNILQQLPISKMNHLNIQQDILNEMSELLIMLYREYAGMFFKSQKLINQLNRLEKDSL

SEQ ID NO: 3620 - protein, 241 aa, Staphylococcus epidermidis
GRGEKMDNLHLIHMLFMAKPLNGMNWVENLAQFITQPFVSLIFTCIIFIGFLYQLYSKRINLMGIIALLALLLLFLAFLINGDVNVMSVLLFTIGLILLIVELFVIGAVIGIIGIILITLSIIILGDNILLMLGNVIVALILSIVEWVILVKIFNRKIPFLDKVILKDSTNSEAGYRSHDDRSHLVGKTAHTVTDLRPAGIITCDNDRIDAVSDGSFILRNRQVKILEVEGTRVVVREIEK

SEQ ID NO: 3621 - protein, 209 aa, Staphylococcus epidermidis
RPIELSQRQEQIIEIVKSEGPITGEHIAEKINLTRATLRPDLAILTMSGFIEARPRVGYFYSGKSKNKIINEKLRKYVVKDYMSHPVVIKENMTVYDAICTIFLEDVSTLFITNENNDFVGVCSRKDLLRASMIGEDIHTMPISVNMTRMPHVSYLKEQELVIYAANQMIDKEIDSLPIVRPKENDKFEVIGRISKTTITKLFVSLFKE

SEQ ID NO: 3622 - protein, 355 aa, Staphylococcus epidermidis
LLIDYQYLLKSGGLFMSDNQVKIKKQTIDPTLTLEDVKKQLIDKGKKEGHLSHEEIAEKLQNFEMDSDQMDDFFDQLNDNDITLVNEKDSSDTDDKINPNDLSAPPGVKINDPVRMYLKEIGRVNLLSAQEEIELAKRIEQGDEIAKSRLAEANLRLVVSIAKRYVGRGMLFLDLIQEGNMGLIKAVEKFDFSKGFKFSTYATWWIRQAITRAIADQARTIRIPVHMVETINKLIRVQRQLLQDLGRDPAPEEIGEEMDLPPEKVREILKIAQEPVSLETPIGEEDDSHLGDFIEDQEAQSPSDHAAYELLKEQLEDVLDTLTDREENVLRLRFGLDDGRTRTLEEVGKVFGVTT

SEQ ID NO: 3623 - protein, 283 aa, Staphylococcus epidermidis
LLIDALLNFDFIRYSLISGLLIGFIAPLIGAFIVVRRLSLIADALSHVTLGGISFGMFLLTIIPVFSVINPMWFGILFAVIGALLIEKLRTSFSNYQEIAIPIIMSAGIALSAIFISLADGFNQEIVGLLFGSISAVNISDLTTIIIITIIVLIFIVLFYKELFILSFDEEYSKVIGIPKWIQFLFIVIVAMVISASMRVVGILLVSALITLPIAISMRITKGFKQLIALSVILGELSVILGLIIAFYMNISPGGVIVVLLVLMLILTMIIQKLKIKFKKGVV

SEQ ID NO: 3624 - protein, 117 aa, Staphylococcus epidermidis
MNSEELLNIAVEAAENKKAEDIISLNMNEISDMTDYFVVCHGNNERQVQSIARSVKEVAHKHDIDVKRMEGYQEARWILIDLANVVVHVFHKDERSYYNLEKLYQDAPIKEYGQAVF

SEQ ID NO: 3625 - protein, 387 aa, Staphylococcus epidermidis
FDKECPNMEVYADYAATTPVKPEVIDAMMEIYQSHFGNPSSIHSIGRDARKYLDQSRRTVAQLLGANPNEVIFTSGATESNNTAIKGLVKANEQLGNHIITTKIEHHSVLHVYEQLEKEGYDVTYLDVDDTGAVDLDQLKETINDRTILVSIMFVNNEIGTVQNIYDIEDIIGDTHALFHVDAVQAIGHLDLDFHNFKIDTMSISAHKFGGPKGVGLLLVKEHTPIAYNQLGGEQETKRRAGTENLPQIVGLTKALELAITNQDVNNVHLMNLKELFLVQLQERAIPFELNGSMTDSTGHILNIYFPFIDVETMLTLLDLAHVYVSSGSACTAGSTTPSHVLAAMFEDEERAKHSVRFSFNEQTTTQEIKYIVAEIHKIYHKFKEES

SEQ ID NO: 3626 - protein, 331 aa, Staphylococcus epidermidis
YIEEGVRMSNNIFTVYGEVPELVEKKTKEIVNDYLGQEIDDFNYVKYNLYESDLTPIIEETLTMPFFSNKKAIVVKNSYVFTGEKFSKDLNHNSDELIKFLEKYDGENLIIFEVYQPKLDERKKLTKTLKKNAQLKKIEQMSEKELKHWIKNTLNNNYKDIKQDALELFIELTGVNYNIVSQELEKLILFIGERPIINKEDIDLIINRSLEQNVFLLTEYIQKGNKNKAIQLVNDLIIMKEEPIKLLALITSNYRLYYQCKILSQKGYSGQQIAKTVNAHPYRVKLALNQSRHYKLESLFNIINACAETDYKLKSSYMDKQLILELFILSL

SEQ ID NO: 3627 - protein, 390 aa, Staphylococcus epidermidis
LFHCLLPKPKTIIIITSYAIILMYKIKMYKCKRRREKMNKLRKVLDIIEHKHLDAIIVLSDYNRRYLSDLTGTSGALIITPKKQYLITDFRYIDQATEQAQDFEIINRKSSLISEIKSILERENLSNIGFEGHLISYDTYVELNKGLITLISISNEIDKIREIKNKEEIQLIQKAAKIVDQTYEYILTQVSIGMTEREIKAKLESKMLELGADGPSFDTIVASGYRGALPHGVASDKRIEKGDMITLDFGAYYRGYCSDITRTFAIGEPDPKLKEIFNIVLTSQKKAIEQIKPGMTAKEADAISREYISSHNYGEQFGHSLGHGIGLDIHEGPLLSQNSSDELKINNCVTIEPGIYIEGLGGVRIEDDILITENGCHVFTKCSKDLIILE

SEQ ID NO: 3628 - protein, 313 aa, Staphylococcus epidermidis
SMNWMELSIVVNHEVEYDVTEILESYGSNGVVIEDSNILEEQPVDKFGEIYDLNPEDYPEKGVRLKAYFNEFTYNENLKSNINYEILSLQQIDKTIYDYQEKLIAEVDWENEWKNYFHPFRASKQFTIVPSWESYVKENDNELCIELDPGMAFGTGDHPTTSMCLKAIETFVKPTDSVIDVGTGSGILSIASHLLGVQRIKALDIDEMAVNVAKENFKKNHCDDAIEAVPGNLLKNENEKFNIVIANILAHIIEEMIEDTYNTLIEDGYFITSGIIEEKYQDIESQMKRIGFKIISVEHDNGWVCIVGQKVSG

SEQ ID NO: 3629 - protein, 211 aa, Staphylococcus epidermidis
IHYWLLYCIKKTMRYAYGSEKVLPLSKKTSHHARIYIGQPTKIFNTRRCFFMSSDTNSLAHTKWNCKYHIVFVPKYRRQVIYGKIKRDIGVILRQLCERKGVEIIEAEASKDHIHMLVSIPPKLGVSSFVGYLKGKSSLMIFDRHANLKYRYGNRKFWCKGFYVDTVGRNKKVIENYIRNQLQEDIVADQISMEEYLDPFTGEEIKKRRKK

SEQ ID NO: 3630 - protein, 123 aa, Staphylococcus epidermidis
NGSCIYFTRLFRFYSIKEKLKMTEHNHDAELTINNEEELLTLYDENGNEVLYRKMLEFYHPEFKKEYVVLAEEGAQSDDEDMIELVPMINEPDESGDGGKLVPIETDEEWDMIEEVVNTEINE

SEQ ID NO: 3631 - protein, 298 aa, Staphylococcus epidermidis
IAGWENNMKKIDSWLTKHGLKNRLTLVVIVIFIIFLILLFMFVNLSDEDTGQITITENAELRTGPNAAYPVIYKIEKGKSFKKIDRKGKWIEVQNHAGTEKGWVAGWHTNLNIPADQSLSSNPLKGKTIVLDPGHGGSDQGASSSTPSKSLEKNYTLKTAKELKKLLNKEGAHVKMTRSNDKYVSLDDRNIKGDAFISIHNDALDSSNANGVTVYWFKDKQESLAQTLNSAIQKKALLTNRGSRQQNYQVLRQTDIPAVLLELGYISNPTDESMINDQLHRQVVEQAIVDGLKQYFSS

SEQ ID NO: 3632 - protein, 698 aa, Staphylococcus epidermidis
VVLLKRLKEKSNDEKMRNTMNKRINFIFGFIVFIFAIVVLRLGYLQIAQGSHYKQLIKNDENITVNESVPRGRILDRNGKVLVDNASKMSITYTRNRKTSQKEMLNTAKKLTDLIKMDTDKITERDKKDFWIQMYPSFAKKLMRKEQLMLEDGSISQDQFDTQLRDKIGKKQLKQLTKKDLQVLAIYREMNAGSTLDPQTIKNEDVSEKEYAAVSQQLSKLPGVNTTMDWDRKYPYGDTLRGIFGDVSTSTEGIPKELTEQYLSKGYSRNDRVGKSYLEYQYEDVLKGTKKQMKYTTDKSGRVISSEVLNPGSRGHDLQLTIDIDLQKKVESLLEKQISKLRSQGAKDMDNALMVVQNPKNGDILAIAGKQIDKQGKLKDYDIGNFTAQYTVGSSVKGGTLLAGYQNKAINVGETMVDEPLKFQGGLTKRSYFNKNGHVSIDDKQALMHSSNVYMFKTALKLAGDPYTSGMSLPNNIADAGRKLRKGLNQVGLGLKTGIDLPNETPGQIEPLTNNPGNYLDLAIGQYDTYTPLQLSQYVSTIANDGYRIQPHIGLSIYESTNKDETGPLKRKIKGNVLNKVNNSNDEIKEVQEGFKMAFNEKQGTGYASFRNTVVPSAGKTGTAEVFQDGEPRVNSTYIGYAPVDDPKLSFSIVYTNQPVPPPWLNGGDLGRDVINYYFKDKDNKKDDSQSNNEEKED

SEQ ID NO: 3633 - protein, 145 aa, Staphylococcus epidermidis
KGSRLRMNTNDAIKVLKENGLKYTDKRKDMLDIFVKEDKYLNAKHIQQQMDKDYPGISFDTVYRNLHLFKDLGIIESTELDGEMKFRIACTNHHHHHFICENCGETKVIDFCPIEKIKSQLPNVNIHTHKLEVYGICEECQRKAN

SEQ ID NO: 3634 - protein, 438 aa, Staphylococcus epidermidis
KTILIFFNNKGESFMIKMPRGTQDILPQDSAKWRYIENRLHTLMELYNYKEIRTPIFESTELFARGVGDSTDVVQKEMYTFKDKGDRSLTLRPEGTAAVVRSYIEHKMQGEPNQPIKLYYNGPMFRYERKQKGRYRQFNQFGVEAIGAENPSIDAEILAMVMHIYESFGLKHLKLVINSIGDSESRKEYNEALVKHFEPVIDTFCSDCQSRLHTNPMRILDCKIDRDKEAVKNAPRITDYLNNDSKSYYEQVKLHLDNLNISYVEDPNLVRGLDYYTHTAFELMIDNPEYDGAITTLCGGGRYNGLLQLLDGPDETGIGFALSIERLLMALDEEGISLDVSEDFDLFVVTMGEDADRYAVKLINDLRRNGIKVDKDYLNRKIKGQMKQADRLNAKYTVVIGDQELENNEIGVKNMISGESENVQLDELVNYFKSRKEV

SEQ ID NO: 3635 - protein, 154 aa, Staphylococcus epidermidis
LMERIKWEEYFMAQSHLLALRSTCKRLSVGATIVKDNRIIAGGYNGSVAGEVHCIDEGCLIEDGHCIRTIHAEMNALLQCAKQGVSTEGATIYVTHFPCLNCTKSIIQAGIKTIYYAQDYHNNDYAIKLLKQSGIEYKKIPFSPEYVAQYLTQE

SEQ ID NO: 3636 - protein, 600 aa, Staphylococcus epidermidis
CLLRIDQSVIDEIKNKTDILDLVSEYVKLEKRGRNYIGLCPFHDEKTPSFTVSEDKQICHCFGCKKGGNVFQFTQEIKDVSFVEAVKDLGERVNIQVDIGQNQTNSSTKIASDELKMIEMHELIKDYYHYALMKTVEGEEALNYLHERGFTDDLIKEREIGYAPDNSHFCHDFLEKKGYDIELAFEAGLLSRNEENFTYFDRFRNRIMFPLKNGQGRIVGYSGRTYTDQEPKYLNSPETPIFQKRRILYNLNKARKFIRKQDEIILLEGFMDVIKSDYAGLKQVVASMGTQLSQEHITFLQKLTQNVTLMFDGDYAGKEATLKTGQALLNQGLNVYVVQLPSGMDPDDYIRKYDNEQFLKFVQQDKQSFVLFKVKMYQNEINHNDLAYEKHFKETVRDLSLVNSGIIRNKLIQNIADIFKVNPETIQYELDATYQHQMSSNTYPTFQDEPSKQQLILGRLTKNEKAERALIKHLTKDKDTFLNYYQKIVPEDFTNSYLKRIFSYLYDYYSKNDYYTISDMMQYIESNELREVLIELDQYHLNDEPYENEIEDYIQIIKNNNNEDSLESLNYKLREASRIGDSELQKYYLQLIVNKNKNRM

SEQ ID NO: 3637 - protein, 209 aa, Staphylococcus epidermidis
IIMRISNLTLGIVDTNTYFIENEENVILIDPSSESQKIIKKLNQINKPLKAILLTHAHYDHIGALDNIIEKYQVPVYMSKDEFDFLTDPDKNGSSKFTQYGLSKIESHANPLSLSEGPAEIEGFKFKVLHTPGHSPGSLSFVFNDFAVVGDTLFKNGIGRTDLYKGDYETLIDSIKDKLFELEGDMPLFPGHGPYTTVDDEQLNPFING

SEQ ID NO: 3638 - protein, 283 aa, Staphylococcus epidermidis
YFDRGMIMTEIWNFINTGSKNPYYNMAMDEALLNFVSRGEIDPVIRFYTWNPATLSIGYFQRLQKEIDIDKVKEKGYGLVRRQTGGRGVLHDKELTYSVIVPESHPNMPSTVTEAYKIISQGLLEGFKNLGFETYFAIPRSKEERDKLKQPRSSVCFDAPSWYELVVEGRKIAGSAQTRQKGVILQHGSILQDIDIDDLFDMFKFKNERLKAKMKENFVQKAVAINDISNQHITLNEMENAFEAGFKKGLNIDFKPLELTEKQLEEVQELEDKYRSEAWMYRK

SEQ ID NO: 3639 - protein, 118 aa, Staphylococcus epidermidis
SRTRYKSNEKHSNSKIERSIMMLTGKQKRYLRSLAHNIDPTFQIGKGGINENMIQQISETLEKRELIKIHILQNNFDDKKDLAAIVSQQTQSELVQIIGSMIVLYKESEENKEIKLPQ

SEQ ID NO: 3640 - protein, 148 aa, Staphylococcus epidermidis
KSLRINMLKHKILGLDVGSKTVGIAISDLMGWTAQGLDTLRINEEQDDLGIDQLVKIIKDNQVGTVVIGLPKNMNNSIGFRGEASIKYKEKLQESIPSIDIVMWDERLSTMAAERSLLEADVSRQKRKKVIDKMAAVFILQGYLDSIQ

SEQ ID NO: 3641 - protein, 273 aa, Staphylococcus epidermidis
KLISCIVICEVKTMTTPVFELRNLDYYFDNKHVLENINIKINQGEFLAIVGPNGAGKSTLLKVILGLLPIQKGEIIVDGKPFKGNKSSLKISYVSQKASAFNAGFPASVKEVVLSGLTKTKKLFQRFNKNDYQKVTKVLERLNISHLINKNIAELSGGQQQRVLIARALISDPSVLVLDEPTNGIDAKHVSKFYDTLDKLKKQGITIILVTHDIGVVADTATEVACLNKHLHFHGSTEAFKSLDEVEISKIYGHPIQFVDHQHNRTCCNEGNE

SEQ ID NO: 3642 - protein, 106 aa, Staphylococcus epidermidis
EVQSMFAIIETGGKQIKVEEGQEIYVEKLNANEGDSFTFDKVLFVGGDSVKVGAPTVEGASVTATVNKQGRGKKITVFTYKRRKDSKRKKGHRQPYTKLTIDKINA

SEQ ID NO: 3643 - protein, 233 aa, Staphylococcus epidermidis
GVKRYMIGIIGAMEEEVTILKRKLNDMNEINIAHVKFYVGKLNHKEVVLTQSGIGKVNASISTTLLIEKFNPEVVINTGSAGALDQTLSIGDILVSNHVLYHDANATAFGYEYGQIPQMPKTYTTDPTLLKKTMHVLEQQQLNGKVGMIVSGDSFIGSSEQRQKIKQQFPEAMAVEMEATAIAQTCYQFKVPFIVTRAVSDLANGKADISFEEFLDKAALSSSETVSLLVESL

SEQ ID NO: 3644 - protein, 359 aa, Staphylococcus epidermidis
NNLSNSILKIKNDCYTSIIINYGKEASCMKNIKLSALNLVPIREGQEDKDAINDMVTLAQALDDLDYERYWIAEHHNAPNLVSSATSLLIQHTLEHTHSIKVGSGGIMLPNHAPLVVAEQFGTLETLFPQRVDLGLGRAPGTDMMTASALRRDQHNGVYQFPEEVEQLQQYFGPSHQQAYVRAYPAVDKNVPMYILGSSTDSAHLAARKGLPYVFAGHFAPQQMKEALQIYRELFEPSEVLDKPYVIVCLNTIVSDSDEQAEYLATTMSQIMVSITRGKMQPVQPPTDDLKALLTPREYELAQQRLKGSLIGSEDTVKQKLESFIKEYGDIDELMAISYIYDQDKQIESYRRLERAIKS

SEQ ID NO: 3645 - protein, 163 aa, Staphylococcus epidermidis
RKMRFMENQKQYPMTQEGYEKLEQELEELKTVKRPEVVEKIKVARSFGDLSENSEYDAAKDEQGFIEQDIQRIEHMIRNALIIEDNGDNNVVQIGKTVTFIELPGDEEESYQIVGSAEADAFKGKISNESPMAKALIGKGLNDQVRVPLPNGGEMNVKIVEIK

SEQ ID NO: 3646 - protein, 616 aa, Staphylococcus epidermidis
LNWRNYIMGKVIGIDLGTTNSCVSILEGDEPKVIQNPEGARTTPSVVAFKNGETQVGEVAKRQAITNPNTVQSIKRHMGTDYKVDIEGKSYTPQELSAMILQNLKSTAENYLGDTVDKAVITVPAYFNDGERQATKDAGKIAGLEVERIINEPTAAALAYGLDKTETDQKVLVFDLGGGTFDVSILELGDGVFEVLSTAGDNKLGGDDFDQVIIDYLVSEFKKENGVDLSQDKMALQRLKDAAEKAKKDLSGVSQTQISLPFISAGENGPLHLEISLTRSKFEELADSLIKKTMEPTRQALKDAGLSTSEIDEVILVGGSTRIPAVQEAVKKEIGKEPHKGVNPDEVVAMGAAIQAGVITGDVKDVVLLDVTPLSLGIEIMGGRMNTLIERNTTIPTSKSQVYSTAADNQPAVDIHVLQGERPMASDNKTLGRFQLTDIPPAPRGVPQIEVTFDIDKNGIVNVTAKDLGTNKEQNITIQSSSSLSDEEIDRMVKDAEENAEADKKRREEVDLRNEADSLVFQVEKTVKDLGENISDEDKKNAEEKKDALKTALEGEDIDDIKAKKEELEKVIQELSAKVYEQAQQAQQQGQEEQGSQDSTVEDADFKEVKDDEDKK

SEQ ID NO: 3647 - protein, 78 aa, Staphylococcus epidermidis
INRSFEMRKFIFYLILAIAAFGLMMNLDEFLFSIMKAIISFAIIALIIYIIYYFFFLTEDQRKYKKALRKYKRQKRKQ

SEQ ID NO: 3648 - protein, 224 aa, Staphylococcus epidermidis
TVYGSNWNCIGGQTMSEKDQSVNNTEEDFNVETEDNQNDTNIENSVSNTDNSEANASDSENNSEESIKDEESESQDTKIKELEKLANDNEEKYLRLYAEFENYKRRIQKENQINATYKAQGVLTDILPSIDNIERALQIEGDDESFKSLQKGVQMVHESLLRALKDNGLEEILAEGKEFDPNLHQAVVQDDNPDFKSGEVTQELQKGYKLKDRVLRPSMVKVNQ

SEQ ID NO: 3649 - protein, 232 aa, Staphylococcus epidermidis
SIHGLIYFVFVIVNDKGSFNDMDSNQKYLAQLHQSIDTEIEELRVYAEENQVPIVDKLTLDLIRQLIRMNRTKNILEIGTAIGYSSMQFANISKDINVTTIERNEDMIHLAKKFIKKYRYQNQIRLIEYDALNAFEQVNDKQYDMIFIDAAKAQSMKFFQLYTPLLKKGGIVVTDNVLYHGFVSNIDVVRSRNVKQMVKKVQQYNEWLMEQSQFTTNFINMDDGLAISIKGE

SEQ ID NO: 3650 - protein, 341 aa, Staphylococcus epidermidis
FLNGGSQMDKRMVDQEFHNEDTDLELSLRPTHLKQYIGQSSIKSNLEVFIKAAKLRQEPLDHVLLFGPPGLGKTTLSNIIANEMEVNIRTISGPSLERPGDLAAILSGLQPGDVLFIDEIHRLSSVVEEVLYPAMEDFFLDIIIGKGDEARSIRIDLPPFTLVGATTRAGSLTGPLRDRFGVHLRLEYYNENDLKEIITRTAEVLGTDIDKESALELARRSRGTPRIANRLLKRVRDFQQVNEDDQIYIETTKRALQLLQVDQHGLDYIDHKMMNCIINQYNGGPVGLDTIAVSIGEERVTIEDVYEPFLIQRGFLERTPRGRKATALAYEHFNTTNEKRE

SEQ ID NO: 3651 - protein, 278 aa, Staphylococcus epidermidis
RIGGKYMDNIKIIVASDSIGETAELVARAGVSQFNPKQCKHEFLRYPYIESFENVDEVIQVAKDTNAIIVYTLIKPEIKKYMISKVNEHALKSVDIMGPLMELLSNSIEETPYYEPGMVHRLDDAYFKKIDAIEFAVKYDDGKDPKGLPKADIVLLGISRTSKTPLSQYLAHKSYKVMNIPIVPEVTPPDGLFIVDPSKCIALKISEEKLNRIRKERLKQLGLGDKARYATEARIQEELDYFEKLVDKIGCPVIDVSDKAIEETANDIIHFIEQNKSK

SEQ ID NO: 3652 - protein, 296 aa, Staphylococcus epidermidis
MLIGSHVSMSGKKMLQGSAEEAHKYGESTFMIYTGAPQNTRRKNIEDLNIEKGQQAMKTYGLSNIVVHAPYIINIANTTKPEVFNLGVDFLQKEIERTQALGAKDIVLHPGAHVGAGVDKGIQKIIEGLNEVLTHDNNVRIALETMAGKGTEVGRSFEEIAQIIDGVTHNDRLSVCFDTCHTHDAGYNVKEDFDGVLEKFDSIIGVDRIKVVHVNDSKNLRGAQKDRHENIGFGHIGFDALNYVVHHDTFKNIPKILETPYVGEDKKNKKPPYKLEIDMLKSQKFDPELKNKILTQ

SEQ ID NO: 3653 - protein, 455 aa, Staphylococcus epidermidis
TFKGEQIMSKHPFEHFNLDENLIEAVKNLNFEKPTEIQNRIIPRILKGTNLIGQSQTGTGKSHAFLLPLIQLIESDIQEPQAIVVAPTRELAQQLYQVAMHLVKFKKGINVKLFIGGTDLEKDKQRCSHQPQLIIGTPTRINDLAHSGYLHAHLASYLIIDEADLMIDLGLIEDVDHIAARLDDENAHLAVFSATIPKSLQPFLNKYLSQPEFVEVDGKAHNKENIEFYLIPTKGSAKVDKTLELIDILNPYLCIIFCNSRENADELADTLNKEGIKIGMIHGGLTPRERKQQMKRIRNLDFQFVIASDLASRGIDIEGVSHVINFDVPNDIDFFTHRVGRTGRGNYKGVAITLYSPDEESNITLIEDRGYKFENVDIKNGELKPIKAYNMRKSRQRKDDHLTNEVKHKVRSKSKRKVKPGYKKKFKQEVEKMKRQERKQYSKKQNRQKRKNNKG

SEQ ID NO: 3654 - protein, 178 aa, Staphylococcus epidermidis
LSGGKTMDLKQYVSEVKDWPSAGVSFKDITTIMDNGEAYGYATDQIVEYAKEKNIDIVVGPEARGFIIGCPVAYSMGIGFAPVRKEGKLPREVIRYEYNLEYGTNVLTMHKDAIKPGQRVLITDDLLATGGTIEAAIKLVEQLGGIVVGIAFIIELKYLNGIDKIKDYDVMSLISYDE

SEQ ID NO: 3655 - protein, 736 aa, Staphylococcus epidermidis
IEWGVIKVNNEYPYSADEVLYKAKSYLSTSEYEYVLKSYHIAYEAHKGQFRKNGLPYIMHPIQVAGILTEMRLDGPTIVAGFLHDVIEDTSYTFEDVKDMFNEEIARIVDGVTKLKKVKYRSKEEQQAENHRKLFIAIAKDVRVILVKLADRLHNMRTLKAMPREKQVRISKETLEIYAPLAHRLGINTIKWELEDTALRYIDSVQYFRIVNLMKKKRSEREAYITNAINKIKNEMTKMNLSGEINGRPKHIYSIYRKMIKQKKQFDQIFDLLAIRIIVNSINDCYATLGLVHTLWKPMPGRFKDYIAMPKQNMYQSLHTTVVGPNGDPLEIQIRTHEMHEIAEHGVAAHWAYKEGKTVNQKTQDFQNKLNWLKELAETDHTSADAQEFMESLKYDLQSDKVYAFTPASDVIELPYGAVPIDFAYAIHSEVGNKMIGAKVNGKIVPIDYVLQTGDIIEIRTSKHSYGPSRDWLKIVKSSSAKSKIKSFFKKQDRFSNIEKGKFMVEAEIKEQGFRVEDILTEKNLEVVNEKYHFANDEDLYAAVGFGGVTSIQIVNKLTERQRILDKQKALNEAQEVTKSVPIKKDITTDSGVYVEGLENVLIKLSKCCNPIPGDDIVGYITKGHGIKVHRTDCPNIKNETDRLISVEWVKSKDSTQQYQVDLEVTAYDRNGLLNEVLQAVNSTAGSLIKVSGRSDIDKNAVINISVMVKNVNDVYRVVEKIKQLGDVYTVSRVWN

SEQ ID NO: 3656 - protein, 68 aa, Staphylococcus epidermidis
HVFIYFSTRGSTQISVNTRFYKNLIICQNIFVKLTPSLTRLLIILIEIIFNSKCLYVFVAIENKSYNE

SEQ ID NO: 3657 - protein, 166 aa, Staphylococcus epidermidis
VTFIQYLEFGTRGAKDMKIIVQRVKNARVTNDTIDNQINKGYCLLVGVGQNSTEEDVKVIARKIAHARLFEDENDKLNLNIQQVEGEILSVSQFTIYADVKKGNRPGFSNSKAPEQAKDLYQKFNKELEGYGLIVKTGEFGTHMNVEINNDGPVTLIYESQDGKII

SEQ ID NO: 3658 - protein, 154 aa, Staphylococcus epidermidis
NSIIRSKFFDFFDQLKSNTKGYASFDYEFIENKESNLVKMDILLNGDKVDALSFIVHRDFAYERGKALVEKLKTLIPRQQFEVPVQAAIGQKIVARTNIKSMGKNVLSKCYGGDISRKRKLLEKQKAGKAKMKAVGNVEIPQDAFLAVLKMDDE

SEQ ID NO: 3659 - protein, 456 aa, Staphylococcus epidermidis
KRIIGVKIMSTVAFHTLGCKVNHYETEAIWQLFKDANYERVEFETNADVFVINTCTVTNTGDKKSRQIIRRAIRQNPDAVVCVTGCYAQTSSAEIMEIPGVDIVVGTQDRHKLLDYIQQFQDERQPINGVGNIMKNRTYEELEVPYFTDRTRASLKIQEGCNNFCTFCIIPWARGLMRSRDPEKVVEQATQLVNSGYKEIVLTGIHTGGYGQDLKNYNLAQLLRDLDTIEGLERIRISSIEASQLTDEVIDVIGNSNKVVRHLHIPLQSGSDDVLKRMRRKYTMAHFSERLTKLHQALPDLAVTSDVIVGFPGESEDEFQETYDFIVNHHFSELHVFPYSPRIGTPAARMDNQIDEETKNVRVHKLISLSNQLAKEYASKFEDEVLEVIPEEMGEEPHTLVGYADNYMKVRFEGDDSLIGQIVKVKIVKANYPINEGKAIRVVKHATNQSEKEVLV

SEQ ID NO: 3660 - protein, 155 aa, Staphylococcus epidermidis
MFTIDFSDHTGLVETSWFDQIDQLLTFAKKKENIHNDAELSVTFVDKDEIQNINKVYRDKDKVTDVISFALEEDEPEIDFNDFDIPRVLGDIIICTDVAKEQSESYGHSFERELGFLALHGFLHLLGYDHMNDNDEKEMFGRQDAILNEFGLTRN

SEQ ID NO: 3661 - protein, 79 aa, Staphylococcus epidermidis
CKTIQGTIHRVATLFDYTDKSIIHSKRLTCAIRLLIKSTSSCVQIFKLLSTILQPRIVFLRIKCYLLHLKFQESYRFYL

SEQ ID NO: 3662 - protein, 328 aa, Staphylococcus epidermidis
EVIFLKILFEQIINHAIKQEASDIHFIPCEEHTIIKLRIKDELTIYDRLSFPIYKKLLIYMKFQSGLDVSTQHRAQSGRYSYKMKHLYYLRISTLPLSLGNESCVIRIVPQYFQTTRESYEFKDFKHFMKKKQGLLLFSGPTGSGKSTLMYQMVLYAHQKLNLNVISVEDPVEQILNGITQISVNEKAGINYESSFKAILRCDPDVILIGEIRDSTVAKYVIQASLSGHLVLSTMHANDCKGALLRLLEMGISVQELCQAINLISNQRLITTTTNYRQLVSELMFQSQINYFFEHNHSLPKNFTKLATHLNKMSKEGVICEEVVDKYI

SEQ ID NO: 3663 - protein, 99 aa, Staphylococcus epidermidis
VRCIPMLKLNLQFFASKKGVSSTKNGRDSESKRLGAKRADGQYVSGGSILYRQRGTKIYPGENVGRGGDDTLFAKIDGVVKFERKGRDKKQVSVYAVAE

SEQ ID NO: 3664 - protein, 247 aa, Staphylococcus epidermidis
FLSIFKRRDFVLRTQFINEQTMMIYFENEISESTFKKVQQTIQYIKSKNLSEITNMIPSYRAILIYFDNSGINGTELLENLELDENSNSRKQSHFKQRIIHIPVLYGGDFGPDLSEVANVNKLSQEEVIQIHTQQPYLIYMLGFMPGFPYLGGLDAKLHTPRRSEPRIKINAGSVGIANNQTGLYPMDSPGGWQIIGRTPIKVFDLNRTPMTLYEAGDYIQFYSINYQEFEKISNDINKGKFDIDKW

SEQ ID NO: 3665 - protein, 433 aa, Staphylococcus epidermidis
TNSILRRLIIKMKTLEEVKSKTQKIMKKPELLAPAGNLEKLKIAVHYGADAVFLGGQEYGLRSNADNFTMEEIAEGVDFANRYGAKIYVTTNIIAHDENMEGLEEYLQNLESTGATGIIVADPLIIETCKKVAPRLEIHLSTQQSLSNYKAVEFWKQEGLDRVVLARETGAMEMSEMKEKVDIEIEAFIHGAMCIAYSGRCTLSNHMTARDSNRGGCCQSCRWDYDLLEVDSDGELDLYYDNSDVTPFAMSPKDLKLIESIPQMMELGIDSLKIEGRMKSIHYIATVVSVYRKVIDAYAEDPENFKIKTEWLMELNKCANRDTAPAFFQGTPGYEEQMFGEEQSKKSSYDFCGLVLDYDHETQLATIQQRNHFKPGQEIEFFGPEIDSFKQVVEAIYDEEGNSLDAARHPLQIVQIKVDKPIYSNNMMRKEIG

SEQ ID NO: 3666 - protein, 95 aa, Staphylococcus epidermidis
TKIFSSLDFFSLCTTNLLFFVFLNCRFLSMPHNGTAMKIDENTPDNNPISNAKEKLNIVGAPNINIATTTTTTVNTVLIERVIVCLIERLTISSI

SEQ ID NO: 3667 - protein, 376 aa, Staphylococcus epidermidis
GGIIVSNKDIRVVVGMSGGVDSSVTAYLLKEQGYDVIGIFMKNWDDTDENGVCTATEDYNDVIAVCNQIGIPYYAVNFEEQYWDKVFTYFLDEYKKGRTPNPDVMCNKEIKFKAFLEHALKLGADYVATGHYARIRRHDDGHVEMLRGVDNNKDQTYFLNQLSQEQLSKVMFPIGDIEKSEVRRIAEEQNLATAKKKDSTGICFIGERNFKEFLSHYLPAQSGEMLTLNGKKMGQHSGLMYYTIGQRHGLGIGGDGDPWFVVGKNLNDNVLYVEQGFHHDALYSDYLIASDYSFVNPSEIDLEKGFECTAKFRYRQKDTKVYVQRENENSIRVTFAEPVRAITPGQAVVFYNQEVCLGGATIDDVYKNEGQLSYVV

SEQ ID NO: 3668 - protein, 312 aa, Staphylococcus epidermidis
IITIRIFWKGFKLMTEHKSGFVSIIGRPNVGKSTFVNRVIGHKIAIMSDKAQTTRNKIQGVMTRDDAQIIFIDTPGIHKPKHKLGDYMMRVAKNTLSEIDAIMFMVNVNEDIGRGDEYIMEMLKNVKTPIFLVLNKIDLVHPDTMMPKIEQYQSYMDFTDIIPISALEGLNVDHFIDVLKSFLPEGPKYYPDNQISDHPEQFVVSEIIREKILHLTSEEIPHAIGVNVDRMIKEDEDRVRIEATIYVERDSQKGIVIGKGGKKLKEMGKRARRDIEMLLGSKVYLELWVKVQRDWRNKVNFIRQIGYVEDQD

SEQ ID NO: 3669 - protein, 68 aa, Staphylococcus epidermidis
SLYIRHLVNFVYWYLLNYVKGPYFSKYFNVKLHINSKYFGETLEGTGQAEDYRLKLSPKKASQQNEVL

SEQ ID NO: 3670 - protein, 162 aa, Staphylococcus epidermidis
GENMITKRQLSILNAIVEDYVDFGQPIGSKTLIHRHHLDVSPATIRNEMKQLEEMHFIEKTHTSSGRVPSESGIRYYVNRLLEQTSHQSQNKIQRLNQLLIENHYDSSTALTNFAHELCMKSQYATLVVRPNHKQDVINDIHLIRANNHLIILVMVFSFWTC

SEQ ID NO: 3671 - protein, 210 aa, Staphylococcus epidermidis
NDSITSNNNNSFWFREKTMKKLILIVGASSLLMGCGSQNLAPLEDKTTELRDDNHQLKLDIQELNQEIGEHKSKIAALKQDKENTKEASSNKLKIKNLKASSDYYDSIAKTIKDYRDIESKVNKNNNKVAIQRKLDDILNDIDGTFIKYKESVDSESQSEEDKKKEKEIRQLNKDLSSAFNTIKKGYETKDNKKIEKGQKKLATINTNLN

SEQ ID NO: 3672 - protein, 371 aa, Staphylococcus epidermidis
KLLIGGTRMTTDLKKTPLYQNYVDSGAKIVEFGGWAMPVQFSSIKEEHNAVRFNVVLFEVSHMGEIEISGKDAEQFIQYILSNDTNLLTNDKAMYSALCNDEGGIIDDLVTYKLNENHYLLIVNAANTNKDYQWIKKHSSNFTVDVSNTSDKYGQLAIQGPHSRALINELVDIDVSHMAMFEFKQNVQIFGKSIILSQSGYTGEDGFEIYCKQEDTKDIWEQLLEYDVTPCGLGARDTLRLEAGLPLHGQDLSESITPYEGGIAFAAKPLIENHFIGKSVLKAQKENGSERRTVGLELLGKGIARTGYDVLDENSNEIGFVTSGTQSPSSGKSIALAIIDRDAFEMGKKVIVQIRKRQVEAKIVKKNQIEK

SEQ ID NO: 3673 - protein, 69 aa, Staphylococcus epidermidis
VNLMTRKIKSFYDVLQLLKTYGFIIYFKNPDDMYEMMIQEIKSLYSYQLLTKDEYLNCILIINQRRNEK

SEQ ID NO: 3674 - protein, 143 aa, Staphylococcus epidermidis
GYTMKISTKGRYGLTLMISLAKREGQGCVSLKTIAEENKLSDLYLEQLVGPLRNAGLIRSVRGAKGGYQLRVPSEEITAGDIIRLLEGPITFVESIDSEPPAQKQLWIRMRDAVRDVLDHTTLKYLADYKDTNEDLEGYMFYI

SEQ ID NO: 3675 - protein, 109 aa, Staphylococcus epidermidis
IMAIVDVVVIPVGTEGPSVSKYIAEIQTKLNEFKQQGKIDYQLTPMNTLIEGDLKDLFEVIQAIHELPFDKGLDRVCTNIRIDDRRDKSRKMNDKLKSVQKHLDHSGEL

SEQ ID NO: 3676 - protein, 312 aa, Staphylococcus epidermidis
IIQIDDINQSQALIGNNDENLKAIEAHFNVVIHARGQEIAVKGEKIEHVEKAELVLKNLLKVIELGNTITLKDVEAAIKMADNNTIHHLLDLYDEEITKDAYGKTIRAKTMGQRIYINAMKRNDLVFGIGPAGTGKTFLAVVYAAKQLRKGSVKRIVLTRPAVEAGESLGFLPGDLKEKVDPYLRPLYDGLNTVLGREQTQRLIERGVIEIAPLAYMRGRTLDDAFVILDEAQNTTHAQMKMFLTRLGFGSKMVVTGDQTQIDLPKGVKSGLKEAVKKLSGVSGISIMKMDQSDVVRHPLVSKIINRYEGVE

SEQ ID NO: 3677 - protein, 197 aa, Staphylococcus epidermidis
RNQIATMNKKIVLFGGQFNPIHTAHLAVASEVYHAIKPDIFFFLPSYMAPLKHHNTQLYSEHRVKMIQLVIKEIGFGEICSTDLDRKGPSYMYETILHLKEIYHNAQLYFIIGTDQYNQLDKWYKINELKKLVTFIVVNRETDNQNVSKEMISIKIPRIDISSTMIRNRVRMNQSIKVLVPKRVENYIKEEGFYGDK

SEQ ID NO: 3678 - protein, 367 aa, Staphylococcus epidermidis
LMKISELMEVLNNHVPFHQAESWDNVGLLIGNDKLDITGILTTLDCTDDVVNQAIELNTNTIIAHHPLIFKGVKRIVEDGYGSIIRKLIQNNINLIALHTNLDVNPKGVNRMLADQIGLENISMINTNSSYYYKVQTFIPKNYIEDFKDSLNELGLAKEGNYEYCFFESEGKGQFGPVGDASPYIGKLDSIEYVDEIKLEFMIKDNELEITKRAILDNHPYETPVFDFIKMNKESEYGLGIIGQLNQTMTLDEFSEYAKKQLNIPSVRYTGQHDSPIKKVAIIGGSGIGFEYKASQLGADVFVTGDIKHHDALDAKIQNVNLLDINHYSEYVMKEGLKELLEKWLFKYENQFPIYASEINTDPFKYK

SEQ ID NO: 3679 - protein, 366 aa, Staphylococcus epidermidis
LNEILKCIGCGAPLQSENKDAPGYVPEHNMFREDVICRRCFRLKNYNEVQDVGMESEDFLNLLTGLSEKKGIIVNVVDVFDFEGSFINAIQRIVGNKKIILVANKIDLLPKQINHRRVKEWLRKSARKYGLEAEDVVLISANKGWGIDELLQSINHVRNKDDVYIVGTTNVGKSTLINKLIEQSVGEKDVVTTSRFPGTTLDMIDIPLDEKSFMFDTPGIIQSHQMTNYVSENELKIIIPKNEIKQRVYQLNEKQTLFFGGLARIDYVSGGKRPLVCFFSNDLNIHRTKTEKANDLWKSQLGALLSPPQDAQQFNLNDVKAVRLETGKTKRDIMISGLGFITIDAGAKVIVRVPKHVDVILRNSIL

SEQ ID NO: 3680 - protein, 255 aa, Staphylococcus epidermidis
RGEMKLKIDLNCDLGEAFGNYTFGGDQHILPLITSANIACGYHAGDEDVMNETVQLAKKNNISIGAHPGLPDLKGFGRRKMDLTPNEIYNLVIYQLGALSGFCKINHVKMMHVKPHGALYQMGARNKEIAHAIAQAVFDFDSNLIFVGLANTLLISEAELVGLKVASEVFADRRYEDDGQLVSRKKTDATITNTDEAIQQALKMVLENKVVSKNGKIIDLKADTICVHGDGKHALEFVTQIRNELMKEGIDIQSL

SEQ ID NO: 3681 - protein, 765 aa, Staphylococcus epidermidis
PVEMRTIIMIKSKYNWDITQPNTFISESSSDQFKLSPIVKKVLESKNIVDNQEIQNLFEGTNISHDYMLLSDMQKAIDRIKLAIDQNERILVYGDYDADGVTSTTILVSTLRLLGAQVGWYIPNRFTEGYGPNELAFKNAYDEGISLIITVDNGIQGHHEISTIQELGVDVIVTDHHEIGETLPDAFAIVHPMHPNFEYPFKYLCGAGVAYKLAQGLIEHPPQHFIALAAIGTIADLVSLTDENRYIVKQGLKILNNHTPSSIKAILNQAGFNDEITEETIGFIIGPRLNAVGRLEDASLAAELLLSDEFEEAEFLAEQVEHFNHERKDIVSKITDEALLLAEEQIKQGHLFLLLAKEGWHEGVLGIVASKIVETYALPTLILNIDENQNHAKGSARSIEQVSMFDILNDHQQLIDKFGGHHMAAGMTMSIDNIEHLRKELDMWMKELTVTTSLEPSIKVDAQLEEKEINIKNIKDIFQLRPFGTDFNSPLFMVRDLIVKSTKGIGQDNKHLKLTLGHSGLTALFWNHGHLASELEPGQPIHIIGTLQINEWNGNQTPQFIIKDIAIDQLQILDYRSKRKNIQFKESESNVAYVIHPKLKKSNSHYYHYGEAIDRPYDKIVFRDLPNTMVEIEQTLEHSQISQLYLVLQHEKSIYFEGIPSKSLFKKCYKALINKKETDLIKEGMLLCEYLNIKPEILTFMLKVFKELEFIYDEKGLIKINPAPNKQDIENSRIYQMRRARMEVEERLLYDDFLNIKEWIISKLT

SEQ ID NO: 3682 - protein, 159 aa, Staphylococcus epidermidis
ICRIGVSKLVNKDNRKFYLIREDVLPESVIKTLKVKDALKNNSNLSIYDAVKQFNLSRSAFYKYRETIFPVDEKILDQREFTLILYVNDIVGMLAQVLNAISQLQLSVLTIHQSVPIEDKATITLSLNARNSNLSIDEVIESLREINHVTKVDLISMTM

SEQ ID NO: 3683 - protein, 62 aa, Staphylococcus epidermidis
HSLIREPNRFSRSAHASIGGLAKRETGHPPVYSRPNDQAIYNYGINGLYRYARLLSCVFLCI

SEQ ID NO: 3684 - protein, 94 aa, Staphylococcus epidermidis
ILLIDRHLELYYTNNCIVLLCNDYKVPLIFGGREIQMSKTVVRKNESLEDALRRFKRSVSKSGTIQEVRKREFYEKPSVKRKKKSEAARKRKFK

SEQ ID NO: 3685 - protein, 89 aa, Staphylococcus epidermidis
LIMIQVLISILSNTDQSLNNFVLIKVQISETLCALSTFMNAISLYLESLEEYKASSWLRFLLLALGLCESFLTRLKMISMSQSSQTTCF

SEQ ID NO: 3686 - protein, 274 aa, Staphylococcus epidermidis
KEVIKVKFAVIGNPISHSLSPLMHHANFQSLNLENTYEAINVPVNQFQDIKKIISEKSIDGFNVTIPHKERIIPYLDDINEQAKSVGAVNTVLVKDGKWIGYNTDGIGYVNGLKQIYEGIEDAYILILGAGGASKGIANELYKIVRPTLTVANRTMSRFNNWSLNINKINLSHAESHLDEFDIIINTTPAGMNGNTDSVISLNRLASHTLVSDIVYNPYKTPILIEAEQRGNPIYNGLDMFVHQGAESFKIWTNLEPDIKAMKNIVIQKLKGAL

SEQ ID NO: 3687 - protein, 337 aa, Staphylococcus epidermidis
HIKMSIKILKHGLFSTIQDIGRLGYQDLGFSEAGALDYYSLSIAQKLIGNHGPAIEYTLVGPNIEFLTDNTFAIVGGDSEPKLNGNKIDLLTVYHVRNGDQLDIGQITEGARGYIVFGHPLKINKVAQSYSTHVRSGMGGFKGRALKKYDVIATQVNHNYKTNLGKTIDFSSIPDNNYIHVIEGPQINEFDEETIAKFVNSDFKISDQSDRMGYRLKGNTVAPKNSADIISEPVALGSIQVPNDGNPIILLNDKQTIGGYTKIATVTQLDLRKLAQMKPGDIIQFKWITVEEASKKLKEFNTKFEQLLKRFDEQPLFNLNQLRHTSNKIAEIIKEDR

SEQ ID NO: 3688 - protein, 385 aa, Staphylococcus epidermidis
TILVKRIKGEVIMAKRDYYEVLGVNKSASKDEIKKAYRKLSKKYHPDINKEEGADEKFKEISEAYEVLSDENKRANYDQFGHDGPQGGFGSQGFGGSDFGGFEDIFSSFFGGGSRQRDPNAPRKGDDLQYTMTITFEEAVFGTKKEISIKKDVTCHTCNGDGAKPGTSKKTCSYCNGAGRVSVEQNTILGRVRTEQVCPKCEGSGQEFEEPCPTCKGKGTENKTVKLEVTVPEGVDNEQQVRLAGEGSPGVNGGPHGDLYVVFRVKPSNTFERDGDDIYYNLDISFSQAALGDEIKIPTLKSNVVLTIPAGTQTGKQFRLKDKGVKNVHGYGYGDLFVNIKVVTPTKLNDRQKELLKEFAEINGENINEQSSNFKDRAKRFFKGE

SEQ ID NO: 3689 - protein, 766 aa, Staphylococcus epidermidis
GVHVKKTSRIIAFILLIALLFTGMGMTYKNVVKNVNLVLDLQGGFEVLFQVDPLNKGDKIDKKALQATSQTLENRVNVLGVSEPKIQIEDPNRIRVQLAGIKDQAQARKLLSTQANLTIRDAEDHVLMSGSDIKQGSAKQEFKQETNQPTVTFKVKSKDKFKKVTEKISKKRDNVMVVWLDFEKGDSYKKEAKKQQEGKKPKFISAASVDQPINSSSVEISGGFNGKKGVEEAKQIAELLNAGSLPVDLKEIYSNSVGAQFGQDALDKTMFASIVGIALIYLFMLGFYRLPGLVAIIALTTYIYLTLVAFNFISGVLTLPGLAALVLGVGMAVDANIIMYERIKDELRIGRTLKQAYSKANKSSFLTIFDSNLTTVIAAAVLFFFGESSVKGFATMLLLGILMIFVTAVFLSRGLLSLLVSSNFFKKQYWLFGVKKMDRHDINEGKDVHDLKTSYERLNFVKLAKPLISLSILIVIIGLIIISIFKLNLGIDFSSGTRADIQSKNAITQAQVEKTVKSVGLEPDQIQINGSGNKNATVQFKKDLSREEDNKLSAKVKSEFGDNPQINTVSPLIGQELAKNAVTALILASIGIIIYVSLRFEWRMGLSSVLALLHDVFIIIAIFSLFRLEVDLTFIAAVLTIVGYSINDTIVTFDRVRENLHKVKVITHTDQIDDIVNRSIRQTMTRSINTVLTVVVVVVAILILGAPTIFNFSLALLIGLLSGVFSSIFIAVPLWGMLKKRQFKKTKNNKLVVHKEKKSNDEKILV

SEQ ID NO: 3690 - protein, 391 aa, Staphylococcus epidermidis
IYNVKTILNDLKIGGYKVNVKSAYIHIPFCYRICTYCDFNKYFIDKQPVDEYLDALISEMQVKNNRDLETMYVGGGTPTALNMRQLEKLLRAINQTFTISGEFSFEANPDELTYEKVALLKQYGVNRISMGVQTFKPELLKILGRTHKTEDIYDAVSHARKAGIESISLDLMYHLPQQTIDDFKDSLERAIALDIDHISSYGLILEPKTQFYNLYRKGHLKLPNEDLGAEMYRFLMERMKNSPFHQYEISNFGKLNHESNHNKVYWLNEEYYGFGAGASGYVNGVRYTNLNPVNHYIKAINEGKKPILSETSPTYNERMEEEMFLGLRMNQGVSKSRFKKKFNKLIDEVFGETIKDLRCRGLIKEEGEFISLTERGKVIGNEVFEAFLLNS

SEQ ID NO: 3691 - protein, 138 aa, Staphylococcus epidermidis
GRNVMSYQSHYFKEVREAQKNAYAPYSNFKVGAYLKTKDGRCFYGANVENAAYPMGICAERSSLVSAISEGYQPGDFESITVTVDADKPSSPCGACRQVMMELCDKDMPVYMTNQNGDMIEATVDELLPLGFSGKDLN

SEQ ID NO: 3692 - protein, 185 aa, Staphylococcus epidermidis
MISVNDFKTGLTISVDNGIWKVIDFQHVKPGKGSAFVRSKLRNLRTGAIQEKTFRAGEKVEQAMIENRRMQYLYADGDNHVFMDNETFDQIELPGDYLKDELNYLKANMEVQVQSYESEVIGVELPKTVELEVTETEPGIKGDTATGATKSATVETGYTLNVPLFVNEGDTLVINTSDGSHISRG

SEQ ID NO: 3693 - protein, 87 aa, Staphylococcus epidermidis
EVTVMPNIKSAIKRVRTTETAEERNISKKNAMRTAVKRAKTAISTDAENKDELLRFAIKQVDKASQSNLIHSNKADRIKSKLMSANK

SEQ ID NO: 3694 - protein, 439 aa, Staphylococcus epidermidis
NFGVKEVRYMFVDQVKISLKAGDGGNGITAYRREKYVPFGGPAGGDGGKGASVVFEVDEGLRTLLDFRYQRHFKAKKGENGQSSNMHGRNAEDLVLKVPPGTIIKSVESEEVLADLVEDGQRAIVARGGRGGRGNSRFATPRNPAPDFSENGEPGEELEVTLELKLLADVGLVGFPSVGKSTLLSIVSKAKPKIGAYHFTTIKPNLGVVSTPDHRSFVMADLPGLIEGASDGVGLGHQFLRHVERTKVIVHMIDMSGSEGRNPLDDYKIINQELINYKQRLEDRPQIIVANKMDLPDSQGNLSHFKEQLDNDVTVVPVSTITRDNIDQLLYQIADKLEEVKDVDFSVEEDENLGVNRVLYKHTPSADKFTISRDDDGAYVVSGNAIERMFKMTDFNSDPAVRRFARQMRSMGIDDALRERGCSNGDIVRILGGEFEFVE

SEQ ID NO: 3695 - protein, 189 aa, Staphylococcus epidermidis
TKWVNKMDKKGLRRNIIKKMKSYDKEQKYLADEWLAKKLYQSEAYRKANTIGFVLSMPHEVNTYPIITHSLNNNKKIFVPETNYQQQDMTFKQLLSIEDIEKDSKGIYHSISPVGTTNKMDLVVVPGVAFDKLGYRIGYGGGYYDRFLSQHKCNTVSLLYDFQLAQFNIEPHDQPVEQLIIYHNKVVEE

SEQ ID NO: 3696 - protein, 203 aa, Staphylococcus epidermidis
RIILKRRGFMEISRAKELVKEKLPDKRYQHSLRVADTAVKLAEIYDGDIKKAELAGILHDYCKYEDLSTMYQIVRQYELESDLLSYGGEILHGPVCAALMKHEFDVNDEEVLLAIKYHTTGRQQMTKTEKLVFIADYIEPGRKTPGVEEIRDMAYNQGSLDKTIYEISKRTVLFLIEKDITVYGATIACLNYYNYSDERIKDD

SEQ ID NO: 3697 - protein, 89 aa, Staphylococcus epidermidis
MEIFYKTQINKTFRTKSKNHLQSKKIWSGSFFGFVKSILSFTRMSVREINKAKRELEFVLMALNIRKVTVQRAKNNQKNYKKTISIFFQ

SEQ ID NO: 3698 - protein, 76 aa, Staphylococcus epidermidis
PFKPTRGEMRPPKINWNRPSKLEALPLPPVRSAIAIEKQSGAIEVTGHILIKKPISKTYNGRCNVKVNIKITTPNI

SEQ ID NO: 3699 - protein, 63 aa, Staphylococcus epidermidis
WSPTGIFNKMPKMTIKVMIVKNIKIIFQLAIDKARPPNSGAMMVIIPFMTIREVKNFANLFPS

SEQ ID NO: 3700 - protein, 154 aa, Staphylococcus epidermidis
  UNSURE (109),(135),(143): Identity of amino acid at the above locations are unknown.
VKVTQNENLKLAQRGAFLSLVIYIILSIAKYMTGYVYDSAAVRADALNNMTDILVSVAVIVGLKISIKPADQNHPYGHLKSENISTLLVSFIIMFVGIQVIIENFPRLXTHDSHIPNFITIIISMISGLVKLCVXAINYRLSXRTKSSSIKSAA

SEQ ID NO: 3701 - protein, 383 aa, Staphylococcus epidermidis
MSPYKVIIAPDSFKESMSAKEAALAIKDGFQEVFDSSTIYDIIPMADGGEGTTEVLKEALNATSYCVEVKDPLNRNIMASYARSDEHQTAIIEMAAASGLALLSKDERDPSITTSYGTGQLINDALNHDVNKIILGIGGSATNDGGVGMLKALGVSFKDKNNQEIRDGGLALSQIEYIDITRINPRLKDVNIKVACDVTNPLLGDNGATIVYGPQKGAQQKMIPKLDSALRHYHDKIERELNMNVKDIPGAGAAGGMGTALIAFLNAELRPGIDVVLEETQFKQRIKDANLVVTGEGKMDKQTIYGKTPIGVAKVAKSYDIPVIAICGSLGKDYEVIYHHGIDSVFSIMERPCHLDEALKEGALHVKHTTTNFARLLQLKIEN

SEQ ID NO: 3702 - protein, 413 aa, Staphylococcus epidermidis
NVYNRCYNFSRRIMMMTTSSKHLSKILIVILGVMTAFGPLTIDMYGPSLPKVQHAFGSSISEIQLTLSFAMIGLAIGQFVFGPLSDVLGRKKMALILLIGYLIASLLSVFTVHLTIFLIIRLIQGLAGGGAIVIAKASIGDNYDGNKLAKFLTSLMVINGIITIIAPLLGGLALSIASWKMIFIFLTIITLIVILGILLKMPVGLHQKQSQLNFKAIFKDFGLLLTKPTFVIPMLLQGLTYVMLFSYLSAAPFISQKMYHMTPLQYSAMFAINGVGLIVVSQITAIIVEKISRYAMLIYLTIIQMLGVVILIFTLTLHLPLYVLLIGFFINICPVTSIAPLCFSMAMAERTGGSGNASSLLGLFQFILGGLISPLVGLNGQHDMSPYLIIISATAVLLIALQIIYFKLFMKNT

SEQ ID NO: 3703 - protein, 496 aa, Staphylococcus epidermidis
RTERSTMNYLKQYESFFWLIGIFIFYLIMAILTPLSTTDWHAYKVNLSQYLTQENGRYLGHLFEWVAVHNIIIRALIYAITSFLVIYLVAYMVQLHTNRFYFILSFVLMVTVPNTIYSETYGWFTGFFSYIPATVLSLFILFTVVKMIESHDTVSEMQLWVFLLVSLFGQFFLENLSIANSLIILIGMVVYFFVKKRLSYFLIVGFMLSCIGNIIMFLNFNYFLIKDGLNTHYSISDSHGMIHKAGVTLFKLVPEYMFINQMIILTVISIVSIVLLKQNKSLKHMRVYIKIPLLLGLITLPIYKIFVYNQFHFELYKASFSIAVLNTTICFIYMISVIYVVFKMIQQRYIRMIVMGSFIAMASSVLPLLFVTPISYRNFYFIYTLWIVILLCLIQQCDVLFKQLEHIIKIFAIIISIIMMIGFTFIHISSVHRIDFIKEQITQHHRYQKITLERLPFERYTHMTTPKSKEQLQDFKHYYDLPKDITFKVVPYGTKQ

SEQ ID NO: 3704 - protein, 236 aa, Staphylococcus epidermidis
GDNMKRTDKYRDSYKYDDQYQNHRKRSEEDMYRQHQESQQRANSNRATQSENDREYENHPERYYNGRDYRREQQLEEENEKSSKTKKWLIAIIVILLIIVAIFITRAIINHNNDKVSNDPNVSQNYKKEVENQNDDINRQVDSAKSDIKNKKDTQSQIDKLQNQIDQLKQNEETNADSKFTKFYQNQIDKLKNANNAQLNNENQSKVNNMLEDINTKFDSIKAKLENILNGSNSGN

SEQ ID NO: 3705 - protein, 144 aa, Staphylococcus epidermidis
SSPIWYKTITVQRRNIMKLTRIHYEIIKFIIVGGINTFNYYITYLFLLKVLHVNYMVSHIVGFIVSFIISYYLNCYFVYKVKPTIEKFLRFPITQIVNMVMQTLLLYIFVKWLNIASEIAPFAGLIITIPVTFILSKWLLRDKV

SEQ ID NO: 3706 - protein, 271 aa, Staphylococcus epidermidis
VRLLMLHYNFYESKNQSKQLLVMLHGFISDATTYHSHIERLVEHTNVLTIDLPGHGLDTSSMDEVWDFPFITRQLDEVLIQYQTYDVFLLGYSMGGRVALYYAIHGNETLSGLLLVSTSAGIQNETDKVERAQVDAARAKVLEIAGLDIFVNDWEKLPLFRSQYNLAPEIRQSIRNNRLNQDANKLAKALRDYGTGHMPNLWPHLSLIRIPTLILVGEKDKKFVQIGQQLENHLQDSHKVQISNVGHTIHVEDSTEFDTIILGFLKEEQND

SEQ ID NO: 3707 - protein, 74 aa, Staphylococcus epidermidis
NSDPAGLKKAVMMTMMYAMAYIIAIKITEARLPKSIGKVFLPLALSLTRSRILLPILIKPIVMTIGILNHTAYP

SEQ ID NO: 3708 - protein, 79 aa, Staphylococcus epidermidis
NNHTEVDIMKVNKTIYIIVALILGGLGVHKFYADQVGQGILHLVFFWTGIPSVVAIIHAIIVIFTKKADEYGYITFDKK

SEQ ID NO: 3709 - protein, 340 aa, Staphylococcus epidermidis
KRRAFMTAIKDRDYFFDNARAILIFLVVLGHLLQPYTSEDKFLQALYLLIYSFHMPTFLFISGYFAKNLDKPNYLEKIAKKLLLPYVIFFAFFSLYYYFTGKEDAIQLDPFNPVFALWFLLTLFFFHVVLVIVRRYNPYIVLFISILVSVLAGFSGNIDSYMSISRTIVFFPIFFIGHLVTQSHTEKLRNKKWIPISIIILITFFIGYTIHPINGDWLLGSTPYTSLESNGEDVYSPLKRLLLYIIILLTMCAFLNLMPQTKRIYTYIGQRTMFVYLLHGIVIGVIRGFDLYPFKDQISIFTYLYLFISASVIVLILSSKWVCKWTNPFINLKRPSQFKN

SEQ ID NO: 3710 - protein, 141 aa, Staphylococcus epidermidis
NNMYKQLEKLITLTNNDLNLVNRRFGQRTDITSEQLELLRILYNYDRLSQYDLTMKISREQSIVSRWIKKLVQKGYIMSQQSHEDLRCKELILTEEARALIQQINTARCELIEARCQCLSSDEIASLNQLLNKLNSRHIFI

SEQ ID NO: 3711 - protein, 179 aa, Staphylococcus epidermidis
RGIHCSELLKGLGFKRYAYRHDKYGFKRDFKLYECDDCSECPLKQQCMNFNSKTNKKIMKNYNWEYFKAQINKKLSEPKTKTIYSQRKIDVEPVFGFMKAILGFTRMSVRGIDKAKRELGFVLMALNIRKVTAQRAENNQKNNKKDNFYIISIEIVFFYLSWDFMSHTHYEQKEICFNK

SEQ ID NO: 3712 - protein, 317 aa, Staphylococcus epidermidis
EVVHIMSDQYQQYSTVKKYWQLMRPHTLTAAVVPVLVGTAAAKIYLLGSEDHLKFSLFLAMLLACLLIQAATNMFNEYYDFKKGLDDHTSVGIGGAIVRNGMSPKQVMNLAIAFYIIAALLGIFLAIQSSFWIIPVGIVCMAIGYLYTGGPIPISWTPFGELFSGLFMGMIIILLSFFIQTGNVQGYAVWLSIPIVITIGLINMGNNIRDRVKDKASGRKTLPILLGKRASVIFMAIMYAIAYIIVIITAFFKPAGSLFYLLVLLSFPMPIKAVRRFNKNDTPETMMPAMAATGKTNTFFGLLYALGIYISALLGAI

SEQ ID NO: 3713 - protein, 60 aa, Staphylococcus epidermidis
NSNNSLNNILHVNSPYILFDILYPVFVGAKSKICYFGKYEEIFLDVIFYQKLCSRIHLLF

SEQ ID NO: 3714 - protein, 259 aa, Staphylococcus epidermidis
LMCKAFVEAVDELGGIYYDVPYNLNEPNSDDTGRIKIKKGYQKLNGDQALAVARTRHHDSDLKRGQRQMELIKILFQKAQNLKSIDKLDNVISIVGKNAKHNLTQKEIKSLAKMYLGGSTEIKTSQLKGKDDYLNDIYYYHPSVKSIMEYSNLLRNDLDLSKITNKNDFLDQRVIKRYGSLVPLTELDEDLLRKNQKESTDSQKESDSSSQNNDEEDQTNEQTDQNSLNGNEQYPNQQDNNQTNGENGMINNDNYPYAQ

SEQ ID NO: 3715 - protein, 276 aa, Staphylococcus epidermidis
RRSKMTRQWETLREYDEIKYEFFEGIAKVTINRPEVRNAFTPKTVAEMIDAFSRARDDQNVSVIVLTGEGDKAFCSGGDQKKRGHGGYVGEDDIPRLNVLDLQRLIRVIPKPVIAMVRGYAIGGGNVLNVVCDLTIAADNAIFGQTGPKVGSFDAGYGSGYLARIVGHKKAREIWYLCRQYNAQEALDMGLVNTVVPLEQVEDETVKWCKDIMQHSPTALRFLKAAMNADTDGLAGLQQMAGDATLLYYTTDEAKEGRDAFKEKRNPDFDQFPKFP

SEQ ID NO: 3716 - protein, 1335 aa, Staphylococcus epidermidis
MAKKFNYKLPSMVALTLFGTAFTAHQANAAEQPQNQSNHKNVLDDQTALKQAEKAKSEVTQSTTNVSGTQTYQDPTQVQPKQDTQSTTYDASLDEMSTYNEISSNQKQQSLSTDDANQNQTNSVTKNQQEETNDLTQEDKTSTDTNQLQETQSVAKENEKDLGANANNEQQDKKMTASQPSENQAIETQTASNDNESQQKSQQVTSEQNETATPKVSNTNASGYNFDYDDEDDDSSTDHLEPISLNNVNATSKQTTSYKYKEPAQRVTTNTVKKETASNQATIDTKQFTPFSATAQPRTVYSVSSQKTSSLPKYTPKVNSSINNYIRKKNMKAPRIEEDYTSYFPKYGYRNGVGRPEGIVVHDTANDNSTIDGEIAFMKRNYTNAFVHAFVDGNRIIETAPTDYLSWGAGPYGNQRFINVEIVHTHDYDSFARSMNNYADYAATQLQYYNLKPDSAENDGRGTVWTHAAISNFLGGTDHADPHQYLRSHNYSYAELYDLIYEKYLIKTKQVAPWGTTSTKPSQPSKPSGGTNNKLTVSANRGVAQIKPTNNGLYTTVYDSKGHKTDQVQKTLSVTKTATLGNNKFYLVEDYNSGKKYGWVKQGDVVYNTAKAPVKVNQTYNVKAGSTLYTVPWGTPKQVASKVSGTGNQTFKATKQQQIDKATYLYGTVNGKSGWISKYYLTTASKPSNPTKPSTNNQLTVTNNSGVAQINAKNSGLYTTVYDTKGKTTNQIQRTLSVTKAATLGDKKFYLVGDYNTGTNYGWVKQDEVIYNTAKSPVKINQTYNVKPGVKLHTVPWGTYNQVAGTVSGKGDQTFKATKQQQIDKATYLYGTVNGKSGWISKYYLTAPSKVQALSTQSTPAPKQVKPSTQTVNQIAQVKANNSGIRASVYDKTAKSGTKYANRTFLINKQRTQGNNTYVLLQDGTSNTPLGWVNINDVTTQNIGKQTQSIGKYSVKPTNNGLYSIAWGTKNQQLLAPNTLANQAFNASKAVYVGKDLYLYGTVNNRTGWIAAKDLIQNSTDAQSTPYNYTFVINNSKSYFYMDPTKANRYSLKPYYEQTFTVIKQKNINGVKWYYGQLLDGKYVWIKSTDLVKEKIKYAYTGMTLNNAINIQSRLKYKPQVQNEPLKWSNANYSQIKNAMDTKRLANDSSLKYQFLRLDQPQYLSAQALNKLLKGKGVLENQGAAFSQAARKYGLNEIYLISHALVETGNGTSQLAKGGDVSKGKFTTKTGHKYHNVFGIGAFDNNALVDGIKYAKNAGWTSVSKAIIGGAKFIGNSYVKAGQNTLYKMRWNPANPGTHQYATDINWANVNAQVLKQFYDKIGEVGKYFEIPTYK

SEQ ID NO: 3717 - protein, 462 aa, Staphylococcus epidermidis
NSEEKEVKKMDVNVDEQAIVDKLYESTKDWVSVEVELNKTMKPSVLFHLTEKDAGDRFYMRLNDNYSSYFGYHAIHRFKNDFENKQSIFKDWEKLKNNIELIHPHNKYHHLRLCGGFQFSSHKSDDEWREYGLNHFVLPKVLISNEGTRTYLTYTTKRQDFDLQAFKTLVAHFEQTTMDNPEEALGDVTRMEDIYKDDWRDLVKEAIDTIDDNKKIVLARRRLVKFDKKINIPYVLNRALENEKNSYIFLLEANQSIFFSQTPEQLIKVEDGVLSTKAVAGTIKRTHNEQIDNKNIEAFLKDKKNLGEHRFVVESILNDIEPFVQDVEYNETPNILKNDHMYHLYTEIKANLNDKSYIGLIDRLHPTPALGGYPKEEALDFIENKEFGTRGLYGAPVGYIDVYDDCEFIVAIRSMLIKEQQATLYAGCGIVKNSDPDSEVAETAVKFSPMMNALGVDNNDES

SEQ ID NO: 3718 - protein, 150 aa, Staphylococcus epidermidis
GKTSENGGDTVFQIAKNQTMLDDCFEIRKCVFVEEQGVPLENEFDQYEDYSFHIVGYINGVPMATARIRPLNTHICKIERVAIIKWYRGLGYGKNLIHAIETIAKKHQYNELTMNAQLQARDFYLKLGYSPFGKVFLEENINHISMNKFL

SEQ ID NO: 3719 - protein, 103 aa, Staphylococcus epidermidis
CPRLFYCKHRQQFNLKTRLISSYFNICLNPEFQTEILQTRQVGVRGPNIENFKQKFYRQGKLGFGVCLDNALITYAPLKPFIKIQSVNKINVYSFIYITHLSL

SEQ ID NO: 3720 - protein, 201 aa, Staphylococcus epidermidis
KLSINFSYQYLKGESNVIRKAKTSDNRQIAELCYLIWRDMELDITKEITKDRIIEAIELSIVNVRYRSFYEHIWVYEKDGVVAGCVIAYPGKEEMDFEQQWLKLPLEEDILQLGTPLPEKESYDDEIYIEAVVTTPKYRGQGIATQLLKYVISTHAHEKWGLNCDYDNNKARHLYHKLGFKEDATIRLYGHQYFHMTLNNK

SEQ ID NO: 3721 - protein, 559 aa, Staphylococcus epidermidis
IIMMNHSEALTEQVFSFASELYAYGVREVVISPGSRSTPLALVFEAHPNIKTWIHPDERSAAFFALGLIKGSEKPVAILCTSGTAAANYTPAIAESQISRLPLVVLTSDRPHELRSVGAPQAINQVNMFSNYVNFQFDLPIADGSEHTIDTINYQMQIASQYLYGPHRGPIHFNLPFREPLTPDLDRVDLLTSVTKTLPHYQKSISVDDIKDILQEKNGLIIVGDMQHQAVDQILTYSTIYDLPILADPLSQLRKEKHPNVITTYDLLYRAGLNLEVDYVIRVGKPVISKKLNQWLKKTDAYQIIVQNNDQIDVFPTPPHISYEISANDFFRSLMEEPLVERKKWLQQWQSLEQQARIEISDYLKHATDEAAYVGSLIQKLTKEDTLFVGNSMPIRDVDNLLFDSEASVYANRGANGIDGVVSTALGMAAHKNVTLLIGDLSFYHDMNGLLMAKLNELHINIVLVNNNGGGIFSYLPQKRSATKYFERLFGTPTGLNFEYTALLYDFTFKRFDNLTDFKYAELSKMGSHMYEVITNRDENLHQHQNLYQKLSEIVNVTL

SEQ ID NO: 3722 - protein, 168 aa, Staphylococcus epidermidis
TYVVNILKRSANMSRKTYEKIANINGMFNVLEQQIIHSKDMALFRNEFFYVNHEHRENYEALLIYYKDSLDNPVVDGACYILALPEIFNKVDVFESDLPFTWVYDENGLSDTMKSISVPLQYLIAAALEVTDVNIFKPSGFTMGMNNWNIAQLRIFWQYCAIVRKEAL

SEQ ID NO: 3723 - protein, 395 aa, Staphylococcus epidermidis
QMKLSLNSSSKFLRAPSIRQFSNRIKAIDDCVNLTIGQPDFPMPDVVKNAYIKAIKNDKTSYSHNKGLFETREAISQYFKRKYNFLYSEEEIIVTNGASEALDTSLRSIIEPGDDILIPGPIYAGYIPLVETLGGNPVYIDTTQSDFKVTPELIESHLTHKTKAILLNYPTNPTGVILERSEVKNIVDTLVNKHIFIISDEIYAENTFKGQHTSFAEFPEIRDQLLLIGGLSKSHSATGIRIGFLLGPEYLIEKLTFMHAYNCICANVPAQIACTTALNEGINAPLYMNRDYIERRNYLKEKLESLGFELTAQPEGAFYIFPSIKRFTENDFEFCVDVLEKAHLAMVPGSSFTDIGKGYIRISYAYDMETLKKGMHRLENYLQQHYPEQMTTPTK

SEQ ID NO: 3724 - protein, 99 aa, Staphylococcus epidermidis; identical to SEQ ID NO: 3070

SEQ ID NO: 3725 - protein, 116 aa, Staphylococcus epidermidis
AIIPHMTPLIVNGMAIIKCFKYTGIIILAAPMSNTTLTPRELTLKDPNKKVTQAATIPIFAAPLPKPVRLIAVAIATNEIGVTINKENVTQINIDINNGFNSVNLFTNFPSDCVIT

SEQ ID NO: 3726 - protein, 97 aa, Staphylococcus epidermidis; identical to SEQ ID NO: 3072

SEQ ID NO: 3727 - protein, 79 aa, Staphylococcus epidermidis
LRIKRLWVRLLSGALILREVAQLGRALGLGPRGRRFESCLPDSKINFGGLAQLGERLLCTQEVSGSIPLVSTNINLQTT

SEQ ID NO: 3728 - protein, 359 aa, Staphylococcus epidermidis
CFKWRFNMSHSQINGKRFFNNILNAVGAGVVIALLPNALLGELLKFFKEGNHVLETIFQLVTIIQSFMAFIIGVLAAHQFKFKGTGAAIIGISAMLGSGAVHYNGQTIELKGIGDIINVILVVILACFIYMFLEGKLGSLEMIILPVLVPVISGLIGLLTLPYVQVITQSLGKLVNRFTELNPLLMSILICVTFSLLMVTPISLVAIATAINLTGLGSGAANMGIVAACVTFLFGSLRVNSLGVNVVLLIGAAKMMIPVYLKHLIIAIPLTINGVICGIIAYILKIKGTALSAGFGYTGLVGPINALNRMSGNPSMNIILLIIGYFVIPFAGAFIVHKICKKVLSTYSDEIYKFEISKD

SEQ ID NO: 3729 - protein, 311 aa, Staphylococcus epidermidis
SHILSVYIYNLIVTTVIKKINFIIFGGYHMKKRFLSICTMTIAALATTTMVNTSYAKTDTESHNHSSLGTENKNVLDINSSSHNIKPSQNKSYPSVILPNNNRHQIFNTTQGHYDAVSFIYIPIDGGYMSGSGVVVGENEILTNKHVVNGAKGNPRNISVHPSAKNENDYPNGKFVGQEIIPYPGNSDLAILRVSPNEHNQHIGQVVKPATISSNTDTRINENITVTGYPGDKPLATMWESVGKVVYIGGEELRYDLSTVGGNSGSPVFNGKNQVIGIHYGGVDNKYNSSVYINDFVQQFLRNNIPDINIQ

SEQ ID NO: 3730 - protein, 68 aa, Staphylococcus epidermidis
LCWLSNPHHLSWWETVSGGQFDWGGRLLKCNGGAQRFPQNGWKSFIECKGIRELDCETYKSSRVERRT

SEQ ID NO: 3731 - protein, 248 aa, Staphylococcus epidermidis
KRVSLMIELSHIHKSFNETEVIKGIDLKINQGEVVTLIGRSGSGKTTLLRMINALEIPTEGTVYVNGMTYNTKDKKSQIKVRQQSGMVFQNYNLFPHKSALENVMEGLITVKKMNKATANEEAMNLLAKVGLVHVKDQRPHALSGGQQQRVAIARALAMNPKVMLFDEPTSALDPELVNDVLKVIKELADEGMTMVIVTHEMRFAKEVSNQIAFIHEGVIAEQGTPEDIFNHPKTEELQRFLNVINEK

SEQ ID NO: 3732 - protein, 275 aa, Staphylococcus epidermidis
EDMFKNNKSIEDTYATKPIIQNIVGQAQIKQVMAKQTPMRYTLKAIMAGFLLSIVTVFMLAIKTQFASTHNDGLINLMGAIAFSLGLVLVVLTNSELLTSNFMYLTVGWYYKAISVSKMIWIFIFCFIGNILGGFILFFLMKYAHVMTPEMTDSLTALVHKKTVESTWLNILIKGIFCNFFINIGIFISMQFKEGLAKAFFIACGVIVFVFMGYEHVVFNAGLYAGMMFFNMDGLSWLGVLKNIVFAFLGNYIGGGIFIGLVYAYLNGKRDSLQP

SEQ ID NO: 3733 - protein, 71 aa, Staphylococcus epidermidis
YLHTFLKKPGSANGIVSMMGGIGGFFPPLVITFVTSITGSSHLAFFFLAIFGVIALITMIHLNKKEKAIRI

SEQ ID NO: 3734 - protein, 156 aa, Staphylococcus epidermidis
ATLTRDHYMYVENSYLSKQLCFLFYVSSKEIIKKYTDYLKEYGLTYTGYIVLMAIEDDEKLNIKKLGERVFLDSGTLTPLLKKLEKKNYVIRTREEQDERNLQISLTERGKDIQNVLSDISQSVFNEFNITQEETQNLVEDLQNFVTKNFDKTVEK

SEQ ID NO: 3735 - protein, 66 aa, Staphylococcus epidermidis
TRSASYNKTPKYLIRPVQVSEQTVGIPASIRGKQNVHFSALFVFQLKYTFLYGHPVIQYLQPRQAS

SEQ ID NO: 3736 - protein, 316 aa, Staphylococcus epidermidis
WRYLLMSITYPGTVYLIGAGPGNPNLLTKKAERLIRSADVILFDRLVNPFILQYASSQTKVINVGKKPYCKHIQQEEINQKIVEAANQYQCVVRLKGGDPAIFGRITEEVQTLEDHHIHYEIVPGVTSASAAVATMNMGLTMRSIAPSVTFSTGHFKDSVNHDMDIRNLINGGTLAIYMGVKRLGQIIKQIESYTNEDYPIAIVFNASCYNEKIVIGHLSTIEEQLVSQQLEGHPGICILGNILDDINRTLLNNNKNDKGNLYLIKGDKERAIAKAETLYDEGIQCLIDFDHSYHISQQNVYNEMIKHKSIKTIYV

SEQ ID NO: 3737 - protein, 212 aa, Staphylococcus epidermidis
RREYVLIVLGKGETMKKLIGLLMILCMVLLYSCSGPMDSPKHSNNSKPVVVIYGDYKCPYCKKTEDRVMPKLKKKYIDTNKIKYQYVNLAFLGKDSIVGSRAQHAVNHYAPKKSLEFQKLMFNQQKDEHKQWITTRLVDKQIDKLSISDDKKKKIKTDYKTKGSISWKKAKEDQQIAKKNHIKQTPTAFVNDNKVEDPYDFSSYEMLLENEK

SEQ ID NO: 3738 - protein, 103 aa, Staphylococcus epidermidis
SGIQVLEFLKSRFSPLSDGFNEQDLEEYRLDILEVEDVIDVNNIKGRYHGSSIFIDVTMVVDRYLSLYEAHQICDKVEIHLHNKGISSVYEHPEPYSTKDEVK

SEQ ID NO: 3739 - protein, 62 aa, Staphylococcus epidermidis
CNSHLKLKSGISLMAWIWFSRMKLRPKLKYIINYFIIYVAIEITLYAVILNHKLFYNELHSL

SEQ ID NO: 3740 - protein, 237 aa, Staphylococcus epidermidis
ILIKRKEVKVTVESTLALIVKVVVLQFNQVKLDKKFIMKISMEGSSVINLEQLSLYQDSLGYLGQQMNFPEKMTFHPKIFEETISKSHPGYEDLLAYREVMMNYTLSEIKAIYTDTFDFSKKHPLYMTFNKFDTQKERGQMLAKLKVLYEMFGLKMVDNELSDFLPLMLQFLQVADFKNDSRAQENLQLVIMIIEDGTYEMANTLAENNNPYAYVVSALRKTLKACIVPLKEVENHA

SEQ ID NO: 3741 - protein, 802 aa, Staphylococcus epidermidis
SMAKQKLVMIGNGMAGLRTIEEILERSQSQFDITIIGKEPYPNYNRIMLSNILQKKMTVEDTIMNPYDWYQENNIELINNDPVEKVDKENKIVTTSKGIEVEYDICIFATGSKAFVLPIPGSNLPSVIGWRTIDDTNKMIEIAQTKKRAVVIGGGLLGLECARGLLDQGMEVTVLHLADWLMEMQLDRKAGEMLKADLEKQGMKIELQANSKEIIGDKDVEAIKLADGRVIETDLVVMAVGIRPYTEVAKDSGLDVNRGIVVNDYMQTSDSHIYAVGECAEHDGKVYGLVAPLYEQGKVLADYLTGKETKGYKGSTTFTSLKVSGCDLYSAGQIVEDEDIHGVEIFNSVDNIYKKVYLSHGQVVGAVLYGDTDDGSRFYNMMKKHETLEDYTLVSLLHKGDEDAGTSIADMSDDETICGCNGVDKGTIVNAITTKGLTSVDEVTKATKAGNSCGKCKGQIGELLQYTLGDDFIAAKPTGICPCTDLTRDQIVTQIRAKNLKSSKEVRHVLDFKDKDGCPKCRPAINYYLNMVYPFEHRDEKDSRFANERYHANIQNDGTFSVIPQMRGGVTDADQLIRLGEVAKKYNVPLVKVTGSQRVGLYGLKKEELPQVWKDLGMRSASAYGKKTRSVKSCVGKEFCRFGTQYTTRLGIRLEKTFEYIDTPHKFKMGVSGCPRSCVESGVKDFGVISVENGYQIFIGGNGGTDVTVGKLLTTVETEDEVIQLCGALMQYYRETGVYAERTAPWLERMGFENVKNVLLNQEKQKELYSRIMEAKKAVENEPWETIVENKEAQKIFEVEKV

SEQ ID NO: 3742 - protein, 182 aa, Staphylococcus epidermidis
GVKNMSNINIRVAHEQDAEELHSIMQIAFTPLRELGIDWPSVHADLEMVKDNLRQNTTFVLENEKEIISTITVCYAWSSVKPISGYPFVWWFATRPTYDGQGYGSQLLKYVEETFLRDTLKAAAVTLGTSARLHPWLLNIYEKRGYEIYAKHENDDGDLGVIMRKILIPEQFNDDILGRPPF

SEQ ID NO: 3743 - protein, 381 aa, Staphylococcus epidermidis
IKMNMKKGVSQLTLQTLSLVAGFMAWSIISPLMPFISQDVDISPGQISVILAIPVILGSVLRVPFGYLTNIVGAKWVFFWSFIVLLLPIFLLGQAQSPGMLMLSGFFLGIGGAFFSVGVTSVPKYFSKDKVGLANGIYGVGNIGTAVSSFCAPVLAGAIGWQNTVRSYLIILSIFAILMFFLGDKNEPKVKIPLMAQVKDLSKNYKLYYLSLWYFITFGAFVAFGIFLPNFLVDHFSIDKVDAGIRSGIFIALATFLRPVGGVIGDKFNAVQALIIDFVIMIIGALILSLSSHIVLFTIGCLAISICAGIGNGLIFKLVPSYFSKETRFSEWYCIHDGRNRRFLPTTGDYFCNEYHWFKSSRFLLLGYIWCNCSYYNDSFK

SEQ ID NO: 3744 - protein, 230 aa, Staphylococcus epidermidis
KRWKIMLNQFVWVIYPYLCLAIFVIGHIARYKYDQFSWTAKSSEMIEKKRLKWGSLLFHLGIIPVFFGHVVGLLIPANWLEAIGVNNHIYHIGAVYIGSVFGIITLIGMLLLTLRRLSIKNVRRLSSFSDIFVNIVLLIILIMGCYSTLVTNAIQPEFDYRQTIAIWFRHLFMFSPNADLMLNVPWSFKLHILLGFTVFACWPFTRLVHVWSVPLSYMNRRYIVYRKNKI

SEQ ID NO: 3745 - protein, 80 aa, Staphylococcus epidermidis
MNCCHRLLKQKQVQQCKVKVFSFNQTPYSYYSNRNKNILSRYYIIVNKELLANKCSESSNSINYYFKLFTNRNNYYLQIT

SEQ ID NO: 3746 - protein, 262 aa, Staphylococcus epidermidis
MKRLLLCIVALVFVLAACGNNSSNNKDNQSSSKDKDTLRVGTEGTYAPFTYHNKKDQLTGYDIDVIKAVAKEENLKLKFNETSWDSMFAGLDAGRFDVIANQVGVNKDREKKYKFSEPYTYSSAVLVVRENEKDITSFNDVKGKKLAQTFTSNYGQLAKDKGADITKVDGFNQSMDLLLSKRVDGTFNDSLSYLDYRKQKPNAKIKAIKGHAEQNKSAFAFSKKVDEKTIEKFNKGLEKIRDNGELAKIGKKWFGQDVSKPE

SEQ ID NO: 3747 - protein, 108 aa, Staphylococcus epidermidis
EGVRMKGKEKVKVTTMNEMIPQIGKKVVVNEKEIGIFLTDNGDLYAIGNICPHKEGPLSEGTVSGDYVYCPLHDQKIALKTGEVQQPDTGCVETYEVEVIDGDIYLCL

SEQ ID NO: 3748 - protein, 236 aa, Staphylococcus epidermidis
IIERKFLFMPKLILCRHGQSEWNAKNLFTGWADVKLSKQGIEEAQSAGKKIYDNQIEIDIAFTSLLTRALETTQYILAGSDQQWIPVYKSWRLNERHYGGLQGLNKDDARKKWGEDQVHQWRRSYDVRPPRESEEQREAYLKNRRYQHIDHRMMPYCESLKDTLERVVPFWTDHISQHLLDDKTVLVSAHGNSIRALIKYLEGLSEEDIVGYEIKTGAPLVYELTDDLVVKDKYYL

SEQ ID NO: 3749 - protein, 453 aa, Staphylococcus epidermidis
NSLRVYKYNHAKCIYIYYIITFLNISNNSYLERISFMKKLITLIVMISFVLASCGGTSSTDKDTLNVEIPLKTKSIAPYETDIPVKTGALESLFKMSKNGKVKPLLVKNYHQVSDNQLELTLKDNIKFQNGHHLTGEAVKRSLEEGMKKSDLLKGSLPIKSINAHGQKVTITTKEPYPELMSELASPFAAIYDTKAKNKVTDQPVGTGPYKIDQYKRSQKIVLKQFKDYWQGTPKLKRINVTYHEDGNTRVDHLLSGKSDLTTDVPIERVDDVKKSNKANIQSTSGFRTHLMLYNHDSKKVNKKVREALDMIINRKDIAKNVSKNYAEPASGPFNHRLKSLEKEEIQSQDIKRAKELLAQEGYSKSHPLKLNMVTYDGRPELPKIGQVIQSEAKKANVDIQLRNVDDIEGYLKNKQSWDVSMYSYLSVPRGDTGYFFNTAYLPDGALNKGNYR

SEQ ID NO: 3750 - protein, 124 aa, Staphylococcus epidermidis
VGVSMLKKLLVGVSVLTLLLAGCMSHEYADKIDKAVKLQEKKQQKIAKNDSGDEVKHFDKKDANIYVFDKGKYVVLEYKPLSDDAEARYYTYEFKDKKAYYNKDFNAKAYYQSHEPDYKEENMY

SEQ ID NO: 3751 - protein, 159 aa, Staphylococcus epidermidis
GTYMTIEKKKNKIIFTRTFSAPINKVFDAYTKRELFEQWFHPQDASVTVYDFNATKGGNAFYAIQAPQMTSYTIAEYLQVDAPYYIEYLDYFATSKGEKDTSMPGMHITLNFEEVKGKTTVTSTSTFPTESAAQQAIDMGVETGMNSTLNQLEKLLNQK

SEQ ID NO: 3752 - protein, 347 aa, Staphylococcus epidermidis
VVNMLEQTDLSLEQLLKNYYETTNEKIVFVNRQGKIIAMNDAAKDILTEEDNYNAMTNAICHRCEGYSNEYDVQSCKDCFLETTQLQHSNFQVFMKTKDNEIKPFTAMYQNIDEQRGISAFTLQNVAPQIERQEKMYQQKMLHRSIQAQENERKRISRELHDSVIQDMLNIDVELRLLKYKHRDKVLAETSQRIEGLLSQLIDDIRNMSVELRPSSLDDLGIEAAFKSYFKQFEENYGMHIKYDSNIKGMRFDNEIETVVYRVVQEGVFNALKYAEVNEIEVSTHSDGKQLVAEVVDRGKGFSLDHHPKGSGLGLYGMRERAELVNGHVNIETHINRGTIITLDIPI

SEQ ID NO: 3753 - protein, 418 aa, Staphylococcus epidermidis
RNIMKFVNLTSEEFEQFTSENFSHYTQSSIHYNNRSKTKGDVHLVGVKDGQEDVIAACLLTEARSLKFFKYFYTHRGPVMDFNNLVLVRFFFKSLTAYLKKHNCLYVLVDPYVLENLRQPNGEIIESFDNRALIKTMEELGYKHQGYTVGYDTMSQIRWLSVLNLKDKSEDQLLKEMDYQTRRNIKKTYEMGVKVKTLPIEETNTFFELFKMAEEKHGFKFREEPYFVEMQKTYEDHAMLKLAYIDLQDYLDTLQTKHQNLNQQLKDVEKTLEENPNSKKNKTKHTQVKQQFDSNARKIRQTKEKIAEEGQVLHLAAALYIYNDHEVYYLSSGSNPKYNAYMGAYRLQWDMIQFAKEHNIDRYNFYGVTGDFSENAEDAGVQKFKEGFNAKIYEYIGDFIKPIKPLFYKVKQELESRR

SEQ ID NO: 3754 - protein, 252 aa, Staphylococcus epidermidis
LFVIMIIQKGGIIMIGNILVAHGMRKGNQNEALEEFIGTLLKDEQYYYELAFLESETQNLEIIMEKMIKQGITKFRIVPLLIFSAMHYISDIPQILKEMKARYPQIDSKMSAPLGTHPYMKTLVENRIADEKVSEGSTKATIVIAHGNGSGRFTKAHDELKAFVKTLDSHHPVYARALYGTLAFKNDLDKISEQYDELVIVPLFLFDGRLVNKVKRLLGEMTLHSQLHITPSINFDPILRLIIRERLEALDI

SEQ ID NO: 3755 - protein, 522 aa, Staphylococcus epidermidis
RRSIGLKIKAQVAMVLNLDKCIGCHTCSVTCKNTWTNRPGAEYMWFNNVETKPGVGYPKRWEDQGQYKGGWVLNKKGKLELKSGNRWSKIALGKIFYNPDMPLIQDYYEPWTYNYEHLTNAKQGQHSPVATAHSLISGDRLNLKWGPNWEDDLAGGHITGPEDPNIQKIEEDIKFQFDETFMMYLPRLCEHCLNPSCVASCPSGAMYKRDEDGIVLVDQEACRGWRYCMTGCPYKKVYFNWKTNKAEKCTFCFPRIEAGMPTVCSETCTGRMRYLGVLLYDADRVQEAASAKDEKDLYEKQLDLFLDPFDEEVIAQAEKDGINQEWITAAQNSPVYKLAIEYKMAFPLHPEFRTMPMVWYCPPLSPIMSYFEGENAGQNPDMIFPAIEEMRLPIQYLANLLTAGDTKPVKEGLQKMAMMRSYMRSQITNQPFDTSKLERLGLTERQMTEMYRLLGIAKYEDRFVVPSSHKETYLDTYKAQGSQGYGGEYFGSNCEGCGVAVQSGKTGQEIYNENFYGGIFRD

SEQ ID NO: 3756 - protein, 178 aa, Staphylococcus epidermidis
VGGIEVKIVIADDHAVVRTGFSMILNYQEDMEVVATAADGVEAYQKVLEHRPDVLILDLSMPPGESGLIATSKISESFPDTKILILTMFDDEEYLFHVLKSGAKGYILKNSPDEQLILAVRTVYQGETYVDMKLTTSLVNEFVNQSQTDEVSSSSDPFKILSKRELEILPLIAKVLWQ

SEQ ID NO: 3757 - protein, 1259 aa, Staphylococcus epidermidis
YNDFVKKCTIKIRHNTYALRKDITLYGGRINKMGKFGLNFFKPTEKFNGNWSVLEHKSREWEKMYRERWSHDKVVRTTHGVNCTGSCSWKVFVKNGVITWENQQIDYPSCGPDMPEFEPRGCPRGASFSWYEYSPLRVKYPYIRGKLLDLWTEALEEQNGNRIAAWASIVENEEKAKQYKEARGKGGHVRANWKDVTDIIAAQILYTIKKDGPDRIAGFTPIPAMSMISYASGARFINLLGGEMLSFYDWYADLPPASPQIWGEQTDVPESSDWYNASYIMMWGSNVPLTRTPDAHFMTEVRYKGAKVISVAPDYAENVKFADHWLAPHPGTDAAVAQAMTHVILQEYYENQPNDMFINYAKQYSDMPFVIMLDEDENGYKAGRFLRASDLGMSGENNEWKPVIQDKLSQQLLVPNGTMGQRWEEGKKWNLKLETEDGTPIDPMLSMVESDYHVETIQFPYFDSSGDGIFERPIATRTIQLANGEEVKIATVYDLMTSQYGVQRFEHELEATSYDDASSKYTPAWQEQITGIKKELVTKVAKEFAQNAIDTGGRSMIIMGAGINHWFNSDTIYRSILNLVLLCGCQGVNGGGWAHYVGQEKCRPIEGWNTIAFAKDWQGPPRLQNGTSWFYFATDQWKYEESNVDKLKSPLAENIKHQHPADYNVTAARMGWLPSYPQFNKNSLLFGEEAKDEGDDSNEAILQKAIESVKNKDTQFAIEDPDLRKNHPKTLFVWRSNLISSSAKGQEYFMKHLLGARSGLMAEPNEDDKPEEIKWREDTEGKLDLLVSLDFRMTATPLYSDIVLPAATWYEKHDLSSTDMHPFIHPFNPAIDPLWESRSDWDIYKTLSKAVSEMAKDYLPGKFKDVVTTPLGHDSKQEISTEYGIVKDWSKGEIEGVPGKTMPNFSIVERDYTQIYDKFVTVGPKLEKGKIGAHGVSYSVSEEYEELKSMVGTWNDDNTTSVKNDRPRIDTARKVADVILNISSATNGKLSQKSYEDLENQTGMELKDISKERASEKISFLNITSQPREVIPTAVFPGSNKDGRRYSPFTTNVERLVPFRTLTGRQSYYIDHEVFQQFGESLPVYKPTLPPMVFGARDKKVKGGQDTLVLRYLTPHGKWNIHSTYQDNERMLTLFRGGPVVWISNEDAADHGINDNDWLEVYNRNGVVTARAVTSHRMPRGTMFMYHAQDKHIETPGSEITDTRGGSHNAPTRIHLKPTQLVGGYAQISYHFNYYGPIGNQRDEYVAVRKMKEVNWLED

SEQ ID NO: 3758 - protein, 153 aa, Staphylococcus epidermidis
GESVEPESLKHNQHLQMNLDKLRAQEGYDFGGIALYDYHHTSSPIKWQYVSGNTNDRYKLIILRKGRGLAGMVMKTGKRMVIADVDTALSPEEKVKFPIILSESLTAVVAVPLWLENSMYGVLLLGQRNHQPLPQSLDQLNIEKQIGIFTEIN

SEQ ID NO: 3759 - protein, 249 aa, Staphylococcus epidermidis
LKLVRNGLVKMFLNLNNEQQHALDAAKQAFGPMLEGLVKYSIPITLVTFILGLIIALFTALMRISTSKLLRGIARVYVSIIRGTPMIVQLFIIFYGIPELGRLVTNNADNQWTLAPVIAAVIGLSLNVGAYASEIIRGGILSIPKGQTEAAYSIGMNYRQTVQRIILPQAIRVSIPALGNTFLSLIKDTSLLGFILVAEMFRKAQEVASTTYEYLTIYLLVALMYWVVCFIISIIQGWYESRIERGYRS

SEQ ID NO: 3760 - protein, 67 aa, Staphylococcus epidermidis
LKELNTTFGDKQRGQVTNEILNESKKDIPNSYITYNSQIDGVNNKVRHFNVTPESIYLIDYKLSKKE

SEQ ID NO: 3761 - protein, 78 aa, Staphylococcus epidermidis
ANLSLLIEYNILVEAYIPELPADNTLVNITAFINEAAKANPAFLNTNVKGEVAILSPPPINALLSYGINIPIMKIARM

SEQ ID NO: 3762 - protein, 567 aa, Staphylococcus epidermidis
SLMLKFHLRLLLLISTITIISFIGLGAIIHNTIYQTLTSNQIKSLDSEARNYVNLFNNNKEKEITNIAHNEKNIILIKEKDKDKIIYSSGNIKDIDHRIDNEANPSKLINKNTKLGMRYTYKNTIDDKTIYISGINNEIIDLQKDLWKYLSIVGVIVLFTVYLASRSINRTYIRPINEVTYATSLLADGYYHVRVPESNVKETRALFVTTNDLARRLQKLNNSQKIQSNRLKTTLENIPSSVLMIDKHGEIVVANHAYYQVFNPDQMVENKSYIGFIDDSIEKLIIESFRTEKVIYEQLEVAINNVHTKYFDVSCIPILTKSKKNLQGMVVVLHDITNLQKLENLRREFVANVSHELKTPITSIKGFAETLIEGAKNDEQSLDMFLNIILKESNRIESLVTDLLDLSHIEQQKELEINYMNLSELAINIIDNLQTQAYNKRIKIQSEIEKDVIIEAHENKIAQVITNLLSNAINYSSEDNKVIVRVYRNDNKVYLEIQDYGIGISETDQKRIFERFYRVDKARSRDSGGTGLGLSITKHIVEAHNGRIDVKSAPGKGSIFKVLFNDN

SEQ ID NO: 3763 - protein, 82 aa, Staphylococcus epidermidis
NNTPIAIKITTNIANMINNTIYFSSYFIILHYNVILCVVKSQNQLIDRLFLKDYTKLKIVVTRYDDDKEYSNKLQTDIKTTC

SEQ ID NO: 3764 - protein, 168 aa, Staphylococcus epidermidis
EVVTMTQITFKNNPIKLSGSEVNEGDIAPNFTVLDNSLNQITLDDYKNKKKLISVIPSIDTGVCDSQTRKFNEEASAEDGVVLTISVDLPFAQKRWCASSGLDNVITLSDHKDLSFGRNYGLVMDELRLLARSVFVLNENNKVVYKEIVSEGTNYPDFEAALKAYRNI

SEQ ID NO: 3765 - protein, 382 aa, Staphylococcus epidermidis
GHVTIRLEVDNMKIGIPKEIKNNENRVGLSPSGVHALVDQGHEVLVETNAGLGSYFEDGDYQEAGAKIVDEQSKAWDVDMVIKVKEPLESEYKFFKEELILFTYLHLANEQKLTQALVDNKVISIAYETVQLPDGSLPLLTPMSEVAGRMSTQVGAEFLQRFNGGMGILLGGIPGVPKGKVTIIGGGQAGTNAAKIALGLGAEVTILDVNPKRLEELEDLFDGRVRTIMSNPLNIEMYVKESDLVIGAVLIPGAKAPNLVTEDMIKEMKDGSVIVDIAIDQGGIFETTDKITTHDNPTYTKHGVVHYAVANMPGAVPRTSTIGLNNATLPYAQLLANKGYREAFKVNHPLSLGLNTFNGHVTNKNVADTFNFEYTSIEDALK

SEQ ID NO: 3766 - protein, 126 aa, Staphylococcus epidermidis
RGMTMTKNIPTNYKLISKQLASLIEDEKNLIAILSNTSALLNDTIDQINWVGFYLIENNELILGPFQGHPACVHIAIGKGVCGTAVSSGETQRVKDVHQFPGHIACDANSQSEIVILITSSSTTGY

SEQ ID NO: 3767 - protein, 443 aa, Staphylococcus epidermidis
KDCYKEIRGNGMTKNEQIIKHIESLSIGSKISVRKIAKDLNVSEGTAYRAIKDASQLGIVATIDRVGTVRIEKRSRENLDNLTFNEIANIVEGQILAGRAGLNKSVSKFAIGAMQFDDILKYIGKHTLLIVGNRENVQIEALKRETSILITGGFRPSAEIIRYADEHELPIISSSYDTFLVANIINKAMFNQKIRKEILVVEDIVKPINELSVLFDSMTIHDYKKIANETGHTRFPIVNEEFKLVGIVTSREIINMNEEDLLGKVMTKNPLSVKLTNTVASCAHLLIWEGIELLPVTDNNKKAVGVINRQDVLKSMQLLGRQPQIGETVNDQIAKHISIHQQGINVDVSPLITNHYGTLSKAVFVGIIEETIRHEMRKYKKGNVMIESMSIIYIKTVPIESTIEVHYEMLDVGRYFAKLEVTMINNGEKVANALVICQMFDGF

SEQ ID NO: 3768 - protein, 568 aa, Staphylococcus epidermidis
EEKYMVLFIILAILVVILIAIGVLFYMRSNKRNLIEKTEERKNEIEQLPLDDNLRKLTGLNLKGETKTKYDAMKKDNTETTNKYLAPVEEKIQNAEELLEKFKFTAAQTEIDDAHELMDQYEENYQHQVTQVDDIINLHKENEALYEKCKVDYREMKRDVLANRHQFGEAAEPLENEIENYEPKLNEYENLKSEGNYVQAHNHIAALEDQIKNLKSYMDEIPELIRETQKELPGQFQDLKYGCRDLKVEGYDLDHVKVDGTIQSLKTELSFVEPMISRLELDEANNKLENINDKLDEMYDLIEYEVKAKNEVEETKDIITDDLFKAKDMNYTLQTEIEYVRENYYINESDAQSVRQFENEIQSLISVYDDILKETSKSAVRYSEVQDNLQYLEDHVSVINKEQDKLQNHLIQLREDEAEAEDNLLRVQSKKEEVYRRLLASNLTSVPERFIIMKNEIDNEVREVNEQFRERPIHVKQLKDKVAKIVIQMNTFEDEANDVLVNAVYAEKLIQYGNRYRKDHHHVDKSLNEAERLFKNNRYKRAIEIAEEALESVEPGITKHIEEQVIKE

SEQ ID NO: 3769 - protein, 370 aa, Staphylococcus epidermidis
KLYLISIELIYHHMMEVHYMTKIKEIKKVLQKEDADAAWITTPLNIFYFTGYRSEPHERLFALLIPSNEEPVLFCPKMEVEEVKQSPFKGKIIGYLDTENPFDKYSKTFSKMLIESEHLTVKRQRELTKAFNIEHYQDVDQSIKDLRNIKSEDEIINIKKAAALADKCIEIGKSFLKEGVEEREVVNHIENEIKKYGVNEMSFDTMVLFGDHAASPHGTPGDRKLQQNEFVLFDLGVVYHHYCSDMTRTIHFGTPNKEAQNIYNIVLKAETEAIKSIKPGVTIKDIDKIARDIIEEAGYGDYFPHRLGHGLGLEEHEYQDISSVNNNQLEAGMVITIEPGIYVPHVAGIRIEDDILVTENGYEILTQYEK

SEQ ID NO: 3770 - protein, 386 aa, Staphylococcus epidermidis
KPFHKETVKGKFIMAELKRGLEGVIAAETKISSIIDSQLTYAGYDIDDLAENAQFEEIIFLLWNYRLPNENELSELKEKLFDYMTLNNRVYKHFEEYVTDHVHPMTALRTSVSYVAHFDPEAENESDENKYDRAIRIQAKIASLVTAFARVRDGKEPVKPNSELSYAANFLYMLRGELPTEVEVEAFNKALILHADHELNASAFTARCAVSSLSDMYSGVVAAIGSLKGPLHGGANERVMSMLKEIGSIDNVDHYLDERFANKDKIMGFGHRVYKDGDPRAKYLREMSRKITEETGQSELFEMSLAIEKRMKEEKGLIPNVDFFSATVYHSMNIPHDLFTPIFAVSRTSGWIAHILEQYRDNRIMRPRAKYIGEQNRKYVSIEERP

SEQ ID NO: 3771 - protein, 456 aa, Staphylococcus epidermidis
GSCLMAENLQRELSNRHVQLIAIGGAIGTGLFLGAGQTIAMTGPSILLTYIIIGFMLFMFMRGLGEIIIQNTNFKSFADVTNTYIGPFAGFVTGWTYWLCWIITGMAEVTAVAKYISFWFPDIPNWISALFCVLILMSFNLLSAKLFGELEFWFAIIKIVTIIALIVIGVIMILFAFKTPFGNTSLTHLYQHGIFPKGASGFFMSFQMALFSFVGIEMIGVTARRNQRSRKTIPKAINSVPIRILIFYVGALAVIMSIIPWDKVDPDNSPFVRLFALIGIPFAAGIINFVVLTAAASSCNSGIFSNSRMLYGLSNQNQAPPTFASTNKHGVPHKAIIASSALLLIAALLNYIFPDATLVFTYVTTISTVLFVVVWALIIIAYINYSRKNPELHKKATYKLPGGQYMGYLILIFFVFVFALLFINVDTRRAIYCTPIWFILLGLMYLRYKKADKESR

SEQ ID NO: 3772 - protein, 456 aa, Staphylococcus epidermidis
MGLQTYEYGLKPQDGFEVITHFEFTSQHLDILNRLFTPLIGVESIGLYHFMSQFIDESQQLGLTHYIFMNELKINLLDFREQMDNLEAIGLIKTFVRHEKKYSHFVYELIQPPTAYQFFNDPMLSVFLFSEVDKKRYQALKSYFEKDEKDLSKYQQTTRKFTEVFNVPKKVNVSDQINLKQIKHYDGIDLSNETFDFEMLRQMLNHHFISNEIIDKEAKNLIIQLATLYGITEDGMKNVILSSITSAQQLSFEEMRKKARTYYLIEHDNQLPKLEHQTNKINDEKKDRQAEDTTNDWLQLLDETSPIDMLASWSDSEPTQSQKSMIEELINREKMNFGVINILLQFVMLKEDMKLPKSYIFEIASNWKKIGISNAKQAYEYALQVNQPKNYETHSNDKRQNNRGRQNQFLSKEKTPKWLQNRDDQEENKEINDDTLEEDRQAFLEKLNQKWKEEDN

SEQ ID NO: 3773 - protein, 412 aa, Staphylococcus epidermidis
GAVKVMQYDHLLVRYGELTLKGTNRKMFVNQLKDNVKRALIPLSGYHVKGKRDRMYIELSPEADINEIIQRLSKVYGIKSISPVIKIDKNEEKINQSAIQLSHDFEKGSTFKVDVKRVDKSFRLDTYELQRQVGGAILKKNNNITVNVKNPDYEIKIEVRMDAIYIYEKVIAGAGGLPVGTGGKTLLMLSGGIDSPVAGIEVMKRGVTVEAIHFHSPPFTSEKAKDKVIELTRILAERVGPIKLHLVPFTEIQKQINKVVHPRYTMTSTRRMMMRISDKVVHQINANAIVNGENLGQVASQTLKSMYAINHVTATPVLRPLLTLDKEDIIKKAKELGTFETSIQPYEDCCTIFTPKNPVTEPDFDKVIKYESVFNFDEMIENAVENIETLTIDQNYKSAKEQSTDSLIKDLF

SEQ ID NO: 3774 - protein, 345 aa, Staphylococcus epidermidis
WNVKKIYGNLELKINLVKERYVVMKKIAVLTSGGDSPGMNAAVRAVTRTAIYNNIEVYGVYQGYQGLLDDDIHKLELGSVGDTIQRGGTFLFSARCPQFKEEDVRKKAIENLRKRGIEGLVVIGGDGSYRGAQRISEECKEIQTIGIPGTIDNDINGTDFTIGFDTALNTIIESVDKIRDTASSHARTFIVEVMGRDCGDLALWAGLSVGAETIVLPEVNTDIKDVAEKIEQGIKRGKKHSIVMVAEGCMSGQECADELTKYINIDTRVSVLGHIQRGGSPSGADRVLASRLGGYAVELLKQGETAKGVGIRNNQLTSTPFDEIFAESDRKFNSQMYELAKELSI

SEQ ID NO: 3775 - protein, 128 aa, Staphylococcus epidermidis
IRTNDNAIMISGFKIFAGMYVAMIAPPPEATNISGNIFPTIFKSTLPERKNFNALVNVLKELANLFVPKATDGGKPTASNAGVEISPPPPTTESTNEAIKPKATIINIIDKFQSILSLTPLFLLHYEF

SEQ ID NO: 3776 - protein, 138 aa, Staphylococcus epidermidis
FMYKHILLGVDTQIKNEKALKEVSRLAGEGTIVTVLNAINEQDAQASIRAGVHLDKLTEKRSKGLESTLKTLEDYGIDYDEVIVRGNAKDELLKFANSGKYEIIVLSNRKAEENKKFVLGSVSHKVAKRATIPVLIVK

SEQ ID NO: 3777 - protein, 295 aa, Staphylococcus epidermidis
RKDNIMPELPEVEHVKRGIEPFIKSAKIEKVTFAKNVINGKNNNRETIIKGMELDTFKKLTEGYVIKKVERRSKYIIFYIADHDDDRILVSHLGMAGGFFVVNNLDEISTPNYRKHWQVIFDLDNKQKLVYSDIRRFGEIRNIVNFDSYPSLLEIAPEPFEEVAFEHYLECLTMKKYKNKPIKQTILDHRVIAGAGNIYACEALFRAGITPDKITNSLTKQERKSLFYYVREVLEEGIKYGGTSISDYRHADGKTGQMQLHLNVYKQKKCKVCGHSIETKVIAGRNSHFCPNCQR

SEQ ID NO: 3778 - protein, 476 aa, Staphylococcus epidermidis
CGNKLASTYEGKGASMKKNNKQNDGVQRGLKDRHISMIAIGGCIGTGLFMTSGGAIHDAGALGALIAYAVIGAMVFFLMTSLGEMATYLPVSGSFSTYATRFVDPSLGFALGWNYWFNWVITVAADVTIAAQVIQYWSPMQGIPAWVWSCIFLIIIFALNSLSVRVYGESEYWFALIKVVTVIIFIGIGILTILGIMGGEFVGFDTFTKGDGPILGGNLGGSLLSILGVFLVAGFSFQGTELIGITAGESENPERAVPKAIKQVFWRILLFYILAIFIIGMLIPYDSKALMGGGDSIATSPFTLVFKNAGLAFAASFMNAVILTSVLSAGNSGMYASTRMLYSMSKDKLAYNSFGKTNKSGVPYVSLIATGVLVILIFALQHLSGDAYEYIVAASGMTGFIAWVGIAISHFRFRRAFDKQNYDKSKLKYKAKLFPFGPIFAGILCVIVIIGQDVDFIKTGNFDMNRFFITSMGIPL

SEQ ID NO: 3779 - protein, 245 aa, Staphylococcus epidermidis
MYKKIRRHTMSQKILVVDDEQSIVTLLKYNLETAGYIVEVAYDGEEALKKVETEQPELIVLDVMLPKKDGIEVCKTIRSDKNLVPILMLTAKDDEFDRVLGLELGADDYMTKPFSPREVVARVKAILRRSQFVNEIEKEDVDDEDIIIGSIRIRPEFFEVYKEDELLELTPKEFELLLYLIERQGRVITREHMLNSVWNYEFAGDSRIVDVHISHLRDKLEENPKQPKLIKTVRGLGYKLERPKA

SEQ ID NO: 3780 - protein, 264 aa, Staphylococcus epidermidis
CNKNKGVRLNMDWNLSIMLMIVAFGFIASFVDSVVGGGGLISTPALLAVGLPPSVALGTNKFASSFSTLTSALKFLRSGKVDLKIVGKMFPLIFVASGGGAIIATYIPANILKPLIIIALSLVLIYTVIQKDWGNIRTFTDFTFTKAVLFTLIFIVIGFYDGFLGGGTGSFMLFTLLLFGFDFLSAAGNAKVLNFASNCGALLFFMILGQVNYFYGIIMASSMMIGVLLGAQFALKKGVGYVKALFLVVTAILIIKNLYDFIVQ

SEQ ID NO: 3781 - protein, 650 aa, Staphylococcus epidermidis
IGGKNMNQINIQFPDGNTKEFDKGTTTEDIAQSISPGLRKKAVAGKFNGQLVDLTRPLEQDGAIEIITPGSEEALEVLRHSTAHLMAQALKRLYGDVKFGVGPVIEGGFYYDFDMDDKVSSDDFDKIEKTMKQIVNENHKIVREVVSKEKAKDFFKDDPYKLELIDAIPEDESVTLYTQGEFTDLCRGVHVPSTSKIKEFKLLSTAGAYWRGNSDNKMLQRIYGTAFFDKKDLKAHLKMLEERRERDHRKIGKDLELFTNNQLVGAGLPLWLPNGATIRREIERYIVDKEVSMGYDHVYTPVLANVDLYKTSGHWDHYQEDMFPAMKLDEDEAMVLRPMNCPHHMMIYKNKPHSYRELPIRIAELGTMHRYEASGAVSGLQRVRGMTLNDSHIFVRPDQIKEEFKRVVNMIQDVYKDFGFEDYRFRLSYRDPEDKHKYFDDDEMWEKAESMLKEASDELGLTYEEAIGEAAFYGPKLDVQVKTAMGKEETLSTAQLDFLLPERFDLTYIGQDGEQHRPVVIHRGVVSTMERFVAFLTEETKGAFPTWLAPMQVEIIPVNIDLHYDYARLLQDELKSQGVRVEIDDRNEKMGYKIREAQMKKIPYQIVVGDQEVENQEVNVRKYGSEKQESVEKDEFIWNVIDEIRLKKHR

SEQ ID NO: 3782 - protein, 905 aa, Staphylococcus epidermidis
CVVNTKLAYSLCICIYAKIYVNLFWRLRILNKLVLIDGNSLSFRAFYALPLLSNHAGIHTNAVYGFAMLLEKIIKEEKPNHFLVAFDAGKTTFRHSKYSEYKGGRQKTPPELSEQFPYIRQLLDAYHIKRYELDNYEADDIIGKLSRQADEEDFETIIITGDRDLTQLATDNVTIYYTKKGVTDVDHYTPKFIAEKYNGLVPKQIIDMKGLMGDTSDNIPGVAGVGEKTAIKLLNQFESVEGVYEHIEEVTAKKLKEKLINSKDDALMSKDLATINVHSPIEVSLEDTKLTLQDDTTEKIELFKKLEFKQLLADIDTSSTNEEVIDKTFEIEQDFQNVDLNDLNEAVIHFELEGTNYLKDTILKFGFYTNHQHVVINAEDVKDYKHLVQWLEDKNTTKIVYDAKKTYVSAHRLGINIENIEFDVMLASYIIDPSRSIDDVKSVVSLYGQNYVKDNITIFGKGKKHHIPEEPILNEHIASVTEAIAAVTPTMKSQLEDYNQIELLKDLELPLARILSEMEEIGIYTDINDLKEMEFEIQKKLDVLISNIHESAGEAFNINSPKQLGVVLFETLQLPVIKKTKTGYSTAVDVLEKLQGEHPIIDDILEYRQLAKLQSTYVEGLQKVISKDHRIHTRFNQTLAQTGRLSSIDPNLQNIPIRLEEGRKIRKAFKPTSKDSVILSADYSQIELRVLAHITQDESLKHAFINGHDIHTATAMKVFNVESDQVDSLMRRQAKAVNFGIVYGISDYGLSQSLGITRKQAKAFIDDYLASFPGVKQYMSDIVKDAKAQGYVETLLHRRRYIPDITSRNVNLRSFAERTAMNTPIQGSAADIIKLAMVKFSEKIKETKYHAKLLLQVHDELIFEIPKSEVEDFSKFVEEIMEQALVLDVPLKVDSNYGATWYDAK

SEQ ID NO: 3783 - protein, 341 aa, Staphylococcus epidermidis
MATNIAINGMGRIGRMVLRIALNNKNLNVKAINASYPPETIAHLLNYDTTHGVYDKKVEPIESGIKVNGHEIKLLSDRNPENLPWNEMDIDVVIEATGKFNHGDKAVAHINAGAKKVLLTGPSKGGDVQMIVKGVNDNQLDIDTYDIFSNASCTTNCIGPVAKVLNDKFGIINGLMTTVHAITNDQKNIDNPHKDLRRARSCNESIIPTSTGAAKALKEVLPEVEGKLHGMALRVPTKNVSLVDLVVDLEQNVTVTQVNDAFKNADLSGVLDVEEAPLVSVDFNTNPHSAIIDSQSTMVMGQNKVKVIAWYDNEWGYSNRVVEVADKIGQLIDDKAMVKAI

SEQ ID NO: 3784 - protein, 388 aa, Staphylococcus epidermidis
LKFEGEVLSVIYLDNAATTKADQDVVDSFVKVNQTLYFNPNSPHHAGVQAEQLLLKAKSEINRILNLNNQFDIIFTSGATESNNILLKGIAYMKKETANEIITSVLEHPSVLEVMRYLEREKGFKLKYVDVTKEGKLDTEHLKSLMTDKVGLVTCMYVNNIMGQIQPIEEIANIVKNYPRAHFHVDAVQALGKVPMQINHIDSLSLSGHKFNGLKGQGLLLLKNIQNIEPIVHGGGQEYGLRSGTINLPMAISMVRAIKNAVDQTKELNLRLSNYKNKLLSFLAEYKNVFINSPQNASPHIINIGFPGVKGEVLVNAFSKQNVMVSTTSACSSKMNKLNEVLLAMEIAESKIEGSIRISLGAHTTENDILSFMNAFESVYKEIKELLK

SEQ ID NO: 3785 - protein, 208 aa, Staphylococcus epidermidis
RKSEIMSKVIGITGGIATGKSTVSELLTAYGFKIVDADIASREAVKKGSKGLEQVKEIFGEEAIDENGEMNRQYVGEIVFNHPDLREALNEIVHPIVREIMEQEKNNYLEHGYHVIMDIPLLYENELQDTVDEVWVVYTSESIQIDRLMERNNLSLEDAKARVYSQISIDKKSRMADHVIDNLGDKLELKQNLQKLLEEEGYIQSESE

SEQ ID NO: 3786 - protein, 315 aa, Staphylococcus epidermidis
LMLDFEKPLFEIRNKIDSLKESQEKNEVDLQDEIDMLEASLKRETTKVYTNLKPWDRVQIARLPERPTTLDYIPYIFDSFIELHGDRSFRDDPAMIGGIGYLDGKSVTVIGQQRGKDTKDNIYRNFGMAHPEGYRKALRLMKQAEKFNRPIFTFIDTKGAYPGKAAEERGQSESIAKNLMEMASLTVPVIAVVIGEGGSGGALGIGISNRVLMLENSTYSVISPEGAAALLWKDSNLAQIAAETMKITALDLLDLGIIDEVINEPLGGAQKDEEVQALSIKKMFLKHLNELNQLTPEELANDRFEKFRKIGSVVE

SEQ ID NO: 3787 - protein, 69 aa, Staphylococcus epidermidis
RHLEASNLILSISTIIIFQLIILLLLLLFKYRNISPLYLFFIFFVNYKKYNIDDIWCSTLKSITSVIKG

SEQ ID NO: 3788 - protein, 62 aa, Staphylococcus epidermidis
SILLFEKIPLLHEEAAAVKTTKLIIPAANGIPINANNLTNGLLSGSTLSHGIMDMMTANAPT

SEQ ID NO: 3789 - protein, 323 aa, Staphylococcus epidermidis
IIFRSLKGVINMEVKMNEIMEALEQSELIIIHRHLRPDPDAYGSQLGLKYYLQKKFPNKQIYAVGANEDSLKFIGLMDEIDDDMYKKATVVVCDTANAPRIDDQRYDTGTKLLKIDHHPATDQYGDINYVNTKASSTSEIIYEFILHFNDEHIIDEQVARVLYLGIVGDTGRFLFNNTTPRTMQITGKLLTYPFDHNQELNKMSEKDPKLLPFQGYILQNFDLNDKGFCKVKITKDILEKFQIQPNEASLFVNTIADIRGLKIWMFGVDEGDQIRCRLRSKGHIIINDVANTFGGGGHPNASGVSVNSWEQFEQLAEALNDKL

SEQ ID NO: 3790 - protein, 409 aa, Staphylococcus epidermidis
MSLRDDALEMHRENQGKLEITPNVKVTNKQQLSLAYSPGVAEPCKEIHEDSRKVYEYTIKGNTVAVVTDGTAVLGLGNIGAEASIPVMEGKAALFKSFAGINGVPISLDTTDTQEIIKTVKLIAPNYGGINLEDISAPRCFEIEETLKKETNIPIFHDDQHGTAIVTMAGLINALKIVDKELTNIKVVLNGAGAAGIAIVKLLHAYGVNNMIMCDSKGAIYSGRNFGMNDTKTYVAKWTNKDKVEGSLEEVIKDADVFIGVSVADILTQDMVKTMADDPIIFAMANPNPEINPNEAKQAGAKVVGTGRSDFPNQINNVLAFPGLFRGALDVEATHINEDMKKAAVEAIVHLIDENELHPDYCIPGPFDKRVAPSVAKNVAKAAMESGVARIKIDTQEIFDKTMKLTDLK

SEQ ID NO: 3791 - protein, 601 aa, Staphylococcus epidermidis
ISKRIINLNLFGRIIKMRKTKIVCTIGPASESEEMLEKLMNAGMNVARLNFSHGSHEEHKARIDTIRKVAKRLNKTIGLLLDTKGPEIRTHNMKDGLIVLEKGKEVIVSMNEVEGTPEKFSVTYENLINDVNIGSYILLDDGLVELQVKEINKDKGEVKCDILNTGELKNKKGVNLPGVKVNLPGITDKDADDIRFGIKENVDFIAASFVRRPSDVLDIRQILEEEKAEITIFPKIENQEGIDNIEEILEVSDGLMVARGDMGVEIPPESVPMVQKDLIRKCNKLGKPVITATQMLDSMQRNPRATRAEASDVANAIYDGTDAVMLSGETAAGQYPEEAVKTMRNIAVSAEAAQDYKKLLSDRTKLVETSLVNAIGVSVAHTALNLNVKAIVAATESGSTARTISKYRPHSDIIAVTPSEKTARQCAIVWGVNPVVKEGRKTTDALLNNAVATAVETGRVSNGDLIIITAGVPTGEKGTTNMMKIHLVGDEIAKGQGVGRGSVVGHAIVADSASDLEGKDLSDKVIITNSVDETLVPYVEKAIGLITEENGITSPSAIIGLEKGIPTVVGVEQATKEIKNDMLVTLDASQGKVFEGYANVL

SEQ ID NO: 3792 - protein, 307 aa, Staphylococcus epidermidis
LMKSFRNIMGDSQNLDKRIQKIKQNVINDTDVKHFLEKNRSNITNEMIDEDLNVLQEYKDQQKVYDGHRYDDCPNFVKGHVPELYIENERIKIRYLPCPCKIKHDEERFDSQLITSHHMQRDTLHAKLKDIYMNNRERLDVAMAADQICTAITNDEKVKGLYLYGPFGTGKSFILGAIANQLKSQKISSTIVYLPEFIRTLKGGFKDGSFEKKLQRVREANILMLDDIGAEEVTPWVRDEVIGPLLHYRMVHELPTFFSSNFNYSELEHHLSITRDGTEKTKAARIIERIKTLSTPYYLTGKNFRNN

SEQ ID NO: 3793 - protein, 425 aa, Staphylococcus epidermidis
TNDGGQCLMSKLILAVNAGSSSLKFQLIKMPEEKLVTKGVIERIGLSDSIFTIHVNGEKLTDIRDIHNHEEAVNIMLDSFKEHEMIKDITDIQGTGHRVVHGGETFPKSVVVTDEVESQIEELSELAPLHNPANLMGIRAFRKLLPEIPHVAVFDTSFHQTMPEQAYLYSLPYHYYEDYGIRKYGFHGTSHKYVSRRAAQIVGRPIEDLRIISCHIGNGASIAAIDGGESIDTSMGFTPLAGVTMGTRSGNLDPALIPFIMEKTGKTADEVLEILNKESGLLGLTGTSSDLRDLTEEAKHGRQRSRVALDLFASKIHKYIGSYAARMHGVDVIVFTAGIGENSHIIRGKVLEGLEFMGVYWDPKKNESLHGEEGYINYPHSPVKVLVVPTDEEVMISRDVIKYGKLNDNTPKKEEFDTNESIEVN

SEQ ID NO: 3794 - protein, 68 aa, Staphylococcus epidermidis
SLYIRHLVNFVYWYLLNYAKGPYFSKYFNVKLHINSKYFGETLEGTGQAEDYRLKLSPKKASQQNEVL

SEQ ID NO: 3795 - protein, 189 aa, Staphylococcus epidermidis
LLLIKYSVYYVKIELRKIKGAIMMISYKNILIAVDGSHEAEWAFNKAVGVAKRNDAQLTIVNVIDSRTYSSYEVYDAQFTEKSKHFSEELLKGYKEVATNAGVKNVDTRLEFGSPKAIIPKKLARDVGADLIMSGTSGLNAVERFIVGSVSEAIVRHAPCDVLVVRTEEMPEDFQPQVATPQLREKYQD

SEQ ID NO: 3796 - protein, 167 aa, Staphylococcus epidermidis
CTVIKLGRVTYMKCPKCNSTHSRVVDSRHADEANAIRRRRECENCGTRFTTFEHIEVSPLIVVKKDGTREQFLREKILNGLVRSCEKRPVRYQQLEDITNKVEWQLRDEGQTEISSREIGEHVMNLLMHVDQVSYVRFASVYKEFKDVDQLLESMQGILSDNKRSDK

SEQ ID NO: 3797 - protein, 90 aa, Staphylococcus epidermidis
VKLVLPNGVLNANKIMITPITIKAMIVTILMIANQNSSSPNNFALNKLKDIRISTQNKALIQLGMSGNQKLIYLATAVTSAIPVIIQHSQ

SEQ ID NO: 3798 - protein, 63 aa, Staphylococcus epidermidis
NISVSGFFINNKFKINLFLSYLEHSLCLNFIFLLLKFPLRKYMLKLLFRIIVKGKFITFIKIM

SEQ ID NO: 3799 - protein, 337 aa, Staphylococcus epidermidis
LFRVNSYYQSRMDTFLNRKGYFMSEENTIMERLFHKLDDKAKTLNKENGQSFIENLGLAMEDIYTNQRELLEQATLQDRRKAFQFAYLSLLQEENIQANHQITPDSIGLILGFLVQRFLEHKKEMHIVDIASGAGHLSAAVKEVLSDKTIMHHLIEVDPVLSRVSVHLANFLEIPFDVYPQDAIMPLPLEEADVVIGDFPIGYYPLDERSREMKLGFEKGHSYSHHLLIEQSINALKGAGYAFLVVPSHLFEDDKVKQLENFIATETEMQAFLNLPKTLFKNEKARKSILILQKKKSGETRPVEVLLANIPDFKNPQQFQGFISELNQWIVTNHTKK

SEQ ID NO: 3800 - protein, 1067 aa, Staphylococcus epidermidis
ETMVAHLNIHTSFDLLDSSLRIDALIDKAKKEGYRALAITDTNVLYGYPKFYDACIAAHIHPIFGMTIYLTDGLYTIETVVLAKNNQGLKSLYQISSAIMMRNKEEVPIEWLKRYDEHLIIIFKEAELSHKQIIDAFEGKKELYLNHNSNNTLTGKRVWMQSARYLNEDDAETIPALHAIRDNTKLDLIHEKETLDEHFPSIEELQTLNLSEDMITNANEIEELCQAEIAYHQSLLPQFVTPNGETSKDYLWTILIHRLREWELNDKTYFNRLKHEYKIITDMGFEDYFLIVSDLIHFAKTHEVMVGPGRGSSAGSLVSYLLGITTIDPLKYNLLFERFLNPERVTMPDIDIDFEDTRREKVIKYVQDKYGEHHVSGIVTFGHLLARAVARDVGRIMGFDETSLNEISKLIPHKLGITLEEAYQKPEFKAFVHRNHRNERWFEVSKKLEGLPRHTSTHAAGIIINDQPLFKFAPLTTGDTGLLTQWTMTEAERIGLLKIDFLGLRNLSIIHQIILQVKKDLNINIDIEAIPYDDKKVFDLLSNGDTTGIFQLESDGVRSVLKRLQPEHFEDIVAVTSLYRPGPMEEIPTYITRRHNPNQVAYLHPDLEPILKNTYGVIIYQEQIMLIASQVAGFSYGEADILRRAMSKKNRAILESERQHFIDGAKNNGYGEQISKQIFDLILKFADYGFPRAHAVSYSKIAYIMSYLKVHYPHYFYANILSNVIGSEKKTAAMIDEAKHQRISILPPNINQSHWYYKASNKGIYLSLGTIKGIGYQSVKLIIDERQQNGPYRDFFDFSRRIPKRVKNRKLLESLILVGAFDTFGKTRATLLQAIDQVLDLNSDVEQDEMLFDLLTPKQSYEEKEELPDQLLSDYEKEYLGFYISKHPVEKKFEKKQYLGIFQLSNGSHYQPILVQFDHIKQIRTKNGQNMAFVTMNDGRTMMDGVIFPDKFKKYETSISKEQMYIVLGKFEKRNQQMQLIINQLFEVEAYEQTKLSNSKKVILRNVTHLEPQFEHSKVESNEQHALNIYGFDESANKMTMLGQIERQRQNFDLLIQTYSPADIRFI

SEQ ID NO: 3801 - protein, 428 aa, Staphylococcus epidermidis
NMEVNCMSAEKITQSKDGLNVPNEPIIPFIIGDGIGPDIWKAASRVIDAAVEKAYNGEKRIEWKEVLAGQKAYDETGEWLPQETLETIKEYLIAVKGPLTTPIGGGIRSLNVALRQELDLFTCLRPVRWFKGVPSPVKRPEDVDMVIFRENTEDIYAGIEFKQGTSEVKKVIDFLQNEMGATNIRFPETSGIGIKPVSKEGTERLVRAAIQYALDNNRKSVTLVHKGNIMKFTEGSFKQWGYDLAHNEFGDKVFTWQQYDEIVEQKGKDAANEAQSKAEQEGKIIIKDSIADIFLQQILTRPAEHDVVATMNLNGDYISDALAAQVGGIGIAPGANINYETGHAIFEATHGTAPKYADLNKVNPSSEILSSVLMLEHLGWQKAADKITDSIEATIASKIVTYDFARLMDGAKEVSTSDFADELIKNIR

SEQ ID NO: 3802 - protein, 243 aa, Staphylococcus epidermidis
GILLKDITFRRVTLMKLSFHGQSTIYFEGNGKKVIVDPFISGNDKCDLDEQTLEVDYIILTHGHADHFGDVVELANRNHATVIGSAELQGYLSTYHGVENVHGMNIGGKAKFDFGTVKFVQAFHSSSFTHDNGVPVYLGMPMGIIVEAEGKTIYHTGDTGLFSDMKLIADRHPVDVCFVPIGDNFTMGIEDASYAINEFIKPTISVPIHYNTFPLIEQDPEQFKDAVQVGEVQILKPGESVEF

SEQ ID NO: 3803 - protein, 293 aa, Staphylococcus epidermidis
QRIFGGLPMFKDFFNRSKKKKYLTVQDSKQNDVPAGIMTKCPKCKKIMYTKELNENLNVCFNCDHHIALTAYKRIEAISDEGSFIEFDRGMTSANPLDFPGYEEKIEKDQQKTGLNEALVSGTAKLDGIQYGVAVMDARFRMGSMGSVVGEKICRIIDYCTEHRLPFILFSASGGARMQEGIISLMQMGKTSVSLKRHSDAGLLYISYITNPTTGGVSASFASVGDINLSEPKALIGFAGRRVIEQTINEKLPDDFQTAEFLLEHGQLDKVIHRKDMRETLSNILKIHQEVSN

SEQ ID NO: 3804 - protein, 102 aa, Staphylococcus epidermidis
STALDLEKMIPTTKITVNRANIIPKIRFAVKKEKIESAADRIVKTINPILKNFCLLFFCVCSSSKVSFNFSYKFSFSCNSKTCCVYSFFFSKVSSGTSSFST

SEQ ID NO: 3805 - protein, 420 aa, Staphylococcus epidermidis
MIFTSMSHKVVVLMNNEALTLFRKRQQAIRKEKNYYNKFIFNGHFTVFLLILLGAFIFGYGEWLSHIPPQIDYALFASIALAVVSLFPIRTLLKEADQIFLLPFERHMKNYINASLFYSYISRISLPFILLIVFFPLFYKLSHNHYGFYIAFSISTLLYPYLVLLIKWQWVKLNKNVFIINILLFIPLAVTHYMILRFHNYLAFLIMIILFVIYLVLKTKADHYLLPWEKVIAIEQQHHTNYYKFVNMFTDVKHLRESAVRRSYLDFLLPVPKGAKFNENRMYLYLFIRSFVRGRDAFSIILRLVIIAIILMVWLSQPVVSLIIGSLFMYIILLQMSQFYTQQAYGLWPQVWPVSDTKVIAGYQQFLNRLMIIIAITFTIVYVIKHHDLFFFAVLFFIVGWLTIRNAVKKLKYQETLLRD

SEQ ID NO: 3806 - protein, 207 aa, Staphylococcus epidermidis
MFETITTAAILYIATAVDLLVILLIFFARANNYQQYKDIYIGQYLGSLTLIFVSLFFAYVLNYVPDKWILGLLGLIPIYLGIKVAIFDDCEGERRAKDELNKKGLSELSKSVAVVTLASCGADNIGLFVPYFTTINNYELVITLITFVILIFILVFTAQKLANIPGLGEVIERFSRWIMSIVYIGLGLFIIIENGTVQKLFHFVFLV

SEQ ID NO: 3807 - protein, 173 aa, Staphylococcus epidermidis
RSAARNEKRFANEERTKMTNHIVLYQPEIPANTGNIARTCAGTLTHLHLIKPLGFSTEDKMLKRAGLDYWEHVNITYHDSIEEFFANTEGHYYLLTKFGKQTYSDFNFSNTNEDYYFIFGKETTGLPEWVKEKYAKTALRIPMSDNIRSLNLSNTAALLIYEALRQQDYPNLS

SEQ ID NO: 3808 - protein, 168 aa, Staphylococcus epidermidis
AMYLYTSYGTYQFLNQIKLNHQERNLFQFSTNDSSIILEESEGKSILKHPSAYQVIDSTGEFSEHHFYSAIFVPTSEDHRQQLEKKLLHVDVPLSNFGGFKSYRLLKPTEGSTYKIYFGFANRTAYEDFKASDIFNENFSKDALSQYFGASGQHSSYFERYLYPIEDH

SEQ ID NO: 3809 - protein, 386 aa, Staphylococcus epidermidis
NIFYLKGVYMMHTILLVVFMIILGAIIGGVTNMIAIKMLFHPFKPYYIFRFRIPFTPGLIPKRREEIARKIGQVIEEHLITEELIRQKLNQPQSRNMIQQLIHKQISKLKNDDVTIKKIAGFLGIDVNELVDYKLTTKFLNKLNFWYESNKYRKLSEILPQSFLDQCKGQIEYITDFLCERARNYLSSEKGERDIYEMLDTFFNEKGRIIGLLQMFMTKESIADRIQHELIRLTQHPQSQKIITKVLNDEYETFKDKNLDEIIKEQQFKNYSQLVLNELKTYLNLKDKTERPIKQVVPQFIQFLEDDTSKRMTDFIIKGTSKHLTNIMKKINLRQLVEEQINTFDLKYIENLIIDIANKELKLIMTLGFILGGIIGFFQGVIAIFV

SEQ ID NO: 3810 - protein, 417 aa, Staphylococcus epidermidis
TILYIFSINFADILRRIKLMVKFIHCADLHLDSPFKSKSYLSPNIFEDVQKSAYESFKNIVDLALKQEVDFIIIAGDLFDSENRTLRAEVFLNEQFERLRKEQIFVYICHGNHDPLTSKITSQWPNNVSVFSNQVETYQAITKSGETIYIHGFSYQNDASYENKIDAYPSSQGQKGIHIGVLHGTYSKSSVKDRYTEFRLEDLNQRLYHYWALGHIHQREQLSDMPVINYPGNIQGRHFNELGEKGCLLVEGDHLKLTTQFYPTQFIKFEEATIETDHTSKQGLYDVIQSFKDKVRTEGKSFYRLNVRINSEDIIAPQDLIQLKEMITEFEENENQFVFIEDLNLQYVQNDEMPIVKEFSPELLDDASLFDSAMTDLYLNPRASKFLDDYNEFDKVELVNHAERLLKDEMRGEQNDN

SEQ ID NO: 3811 - protein, 330 aa, Staphylococcus epidermidis
RSYQLMKLMNKIIVPVTASALLLGACGSNATESKDNTLISSKAGDVKVADVMKKMGKEQIANTSFSIVLNKVLADKYKDKVDTKDIDKDIKKEEKQYGGKDQFESMLKQQGMSLDDYKEQKKLSAYQKQLLLDKVNVSDKEIKENSKKTSHILIKVKSKSSDKEGLSDKKAKEKAEKIQKEVEKNPNKFGEIAKKESMDSSSAKKDGSLGYVIKGQMVDSFEKALFKLKEGEVSKVVKTDYGYHIIKADKETDFNSEKSNIKQKLIEEKVQKKPKLLTDAYKELLKEYKVDYKDRDIKKAIEDSILDPDKIKQQQQQQSQGGSGLTNSGS

SEQ ID NO: 3812 - protein, 200 aa, Staphylococcus epidermidis
IIRNEYSHREEAYIMFLCTRQIDIHARFGIQRIAFLSLVATIFTFLVSYEVMYYFLDTPLSDRHFFVLIVFILLMYPIHKIVHLLFFLPYYKSFKIHKLSSKKWVPYFNTYVNTPVHKIYFCINLILPIFFLSGIFIMLSIYLPQYGHYFMFLLSLNIGCSMMDILYLKILLFSNDGHYVEEHQSGLHILNKVDNPYIQH

SEQ ID NO: 3813 - protein, 211 aa, Staphylococcus epidermidis
RSILMHKVILVDDHYIVRQGLEFLLSTVDDLSVLKGFKDGATFLSYLKNNERPDIVLLDLVMPEMNGIEITEILKQQYPEIKVLVLTSYVDDEHVISAIDKGADGYEMKDVEPQKLIETIHKVLQGERIIHPQAKSVIKAVSKKPHYTNKLSKREKEVLKEMVKGKTNKEIARALFVSEKTVKTHVSHIFSKLEVSDRTQAAIYAMENKLI

SEQ ID NO: 3814 - protein, 983 aa, Staphylococcus epidermidis
EVNKMIIKSLEIYGYGQFVQRKIEFNRQFTEIFGENEAGKSTIQAFIHSILFGFPTKKSKEPRLEPRLGNQYGGKLSLIFDDGIEAEVERIKGSAHGDVKIYLKDGTIRDEVWLNKKLNYISKKTYQGIFSFDVLGLQDIHKNLDEEQLQDYLLEAGALGSTEFTSMRDRIGQKKEELYKKSGKNPIINQQIEQLKQLENQIRNEESKLDTYHRLVDDKDKSSRRLENLKQNLNQLSKMHEQKQKEVALHDQTQEWKRLEQSLNIEPINFPEKGIDRYETAKSHKQSLERDKSLREERLSILNKEAESINPVDQKYIDSFNSLYQQETEIKQKEFELRSIEKDIADKQRELEALQSNIGWQEVFYDADSTEAMKSHMSDLVLGKQEQIAYINQLERGLEENKIERNSNSNEINQVENELVPDETFEKKKEYTQQVLELHEKENLYEKLKETFEEEQTQKNKRQKFLRIGFIVLTILSAALSIFSFFTANLIFGIIFALLTVIFVVGIIFSRSKAVDYSTAISQEINDLENQLTQLEKEYNLDFDLEYQQQVREQWRHAKKNKKILEEKHQYINQSLTTANERLDSLKHSIIEIKKELRLSEKLSDELVVESISTIGQIKAHDKYIIDLNQQRNNLLKDINHFYERAQSVTEPHLKLFNQMSFFHDVKQWLKNAEEQNEAWNKNQTETQLLNNELKQLKSRLSETNQMIKQLFDYVDVDNEEDYYTHHHHFETYQSDLNRFNDLNQYLENQNYTYEMSSQLSEKTTAQLEEEDHRLAKQVDDYNDQFLEMQAEVSDLNAQINHMETDRTLAQLRHEYYSLKNRLNDIAKDWASLSYMQALVEEHIKQIKDKRLPQVINEAVSIFKNLTNGTYNMIHYTENHKIHVKHSNGQVFEPVELSQSTKELLYVALRISLIKVLKPYYPFPVIVDDAFVHFDKYRKERMLKYLRELSEHYQILYFTCTKDHVIPAKEVLTLNKLQEGGKK

SEQ ID NO: 3815 - protein, 330 aa, Staphylococcus epidermidis
NKGKIGVIKRKGTNGHEDKKISSLNRLPEAILSVKSGKVTGVVVEKPVGEAYLKQNSELTFSKIKFNEEKKQTCIAVPKNSPVLLDKLNQTIDNVKEKNLIDQYMTKAAEDMQDDGNFISKYGSFFIKGIKNTILISLVGVVLGSILGSFIALLKISKIRPLQWIASIYIEFLRGTPMLVQVFIVFFGTTAALGLDISALICGTIALVINSSAYIAEIIKAGINAVDKGQTEAARSLGLNYRQTMQSVVMPQAIKKILPALGNEFVTLIKESSIVSTIGVSEIMFNAQVVQGISFDPFTPLLVAALLYFLLTFALTRVMNFIEGRMSASD

SEQ ID NO: 3816 - protein, 86 aa, Staphylococcus epidermidis
GFSNMFCGVPDSTTTPSAINTTLSLISLAKFISCVTITIVILSFANCLITFKTSPTTSGSSADVGSSNNITSGSIAKALAIATLCF

SEQ ID NO: 3817 - protein, 134 aa, Staphylococcus epidermidis
MLRKYWIHFVIVTVIVSLISIKGFPLALGALYLPLLFKIVQLQLNLSKGLIDNVNVHTFIKSNQSGVVISVICCLLITGVLTYTLDDFYNELPGFLGVLVSISPVTLTIGVILFVLTAIAIVQATKAKYQQSKN

SEQ ID NO: 3818 - protein, 60 aa, Staphylococcus epidermidis
MMANKKDSKLNYHEEENAMVTDLDDLKELGKEMEQISQENDEEKLNQSHDNEVRSDLKKQ

SEQ ID NO: 3819 - protein, 326 aa, Staphylococcus epidermidis
IPNLTSLIQIKDLKGRFLLMTKTIGLLVMAYGTPYKESDIEPYYTDIRRGKKPTEEELQDLKDRYEFIGGLSPLAGTTDRQAEALLEALNKEQDDVNFKLYLGLKHISPYIEEAVEQMHNDGIKEAVTVVLAPHYSSFSVGSYDQRAQEKADEYGIQLTHIKHYYQQPKFIKYWTEKINETLEQIPNQEHDETVLVVSAHSLPKGLIERNNDPYPHELHETAEILKQESNIIHVAEGWQSEGNTGTPWLGPDVQDLTRDLYKEHQFKHFIYTPVGFVCEHLEVLYDNDYECKVVCDDIGVNYYRPEMPNTHPLFIGAIVDEIQSHI

SEQ ID NO: 3820 - protein, 388 aa, Staphylococcus epidermidis
NSICNFKKVAKLMNNKLKKEIIDFAHSIGIDSIGFTTADPFDELKQKLEEYHAKGYASGFEESNISLRTEPKLSLPSARSIIAIAVGYPNKLKGAPKSVKGDRRGMFARASWGQDYHSIMRKRLDKLADFIKEKVPDVEIQSMVDTGVLSDRAVAERAGLGFTGRNGFVISPELGTWSYLGEMLVSIPFEPDDPLLDSCGDCTICVDRCPTGALVGNGQLNSQKCISFLTQTKGYLQDEYRYKIGNRLYGCDTCQQVCPKNRGINTQHDDIVLEPEILKPRLVPLLQMSNKKFKSTYGHLAGAWRGKKPIQRNAIIALAHFKEESAIPELKEVALNDPRPMIRGTAYWAIGQILEDDAISFIDEHYENEIEEVQLEMKKGLQMRREQK

SEQ ID NO: 3821 - protein, 461 aa, Staphylococcus epidermidis
MSVRIEHDTFGEIEVPEDKYWGAQTERSKRNFPVGKEHMPIQVIYGFAQLKRGAALANHELGKLSDEKKNAIVYACDRILNGELDNHFPLVIWQTGSGTQSNMNVNEVVSYVANEYLKKHGSKETIHPNDDVNKSQSSNDTFPTAMHVALFHEVETKLEPALNHLRQTFKEKEDQYQSIIKIGRTHLQDATPIKLGQEISGWRYMLEKCEQLLSESKKHILNLAIGGTAVGTGINAHPEFGHKVAKYISQNTGYAFVSSENKFHALTSHDEIVQLHGTLKALATDLMKIANDIRWLASGPRAGLAEISIPENEPGSSIMPGKVNPTQCEMLTMVAVQVMGNDTTVGIASSQGNFELNVFKPVIMHNTLQSIYLLADGMNTFNKNCAIGIQPIEENINNYLNQSLMLVTALNPHIGYEKAAQIAKKAHKEGLTLKESAIESGYVTESQFEEWIKPEDMVDPH

SEQ ID NO: 3822 - protein, 77 aa, Staphylococcus epidermidis
NICSIFCYFFTIIKYFKIHCHVNYTPLSLLFYLSRFNLKYTLCINYQTIIFYWLTINITFLGFILHLLYLLALIMKG

SEQ ID NO: 3823 - protein, 320 aa, Staphylococcus epidermidis
ITGRREKMRNVEKLNPGDSVDHFFLIHRATQGVTAQGKDYMTLFLQDKSGDIEAKLWTATKDDMQTLKPETIVHVKGDIINYRGRKQMKIHQIRLAQAEDKVSTKDFVDGAPMSPTEIQEELSHFMLDIENANLQRITRHLIKKYQDRFFTYPAASSHHHNFASGLSYHVLTMLRIAKSVCDIYPLLNRSLLYSAIILHDLGKVRELSGPVATTYTVEGNLLGHISIASDEVAETAKELGIDGEEVMLLRHMILAHHGKMEFGSPKLPHLKEAEILYFIDNIDAKMNMFDKAFKKTEKGQFTERIFGLENRQFYNPTTLD

SEQ ID NO: 3824 - protein, 231 aa, Staphylococcus epidermidis
SQWRCLMTVKVEHLTGGYGKKPVIKDLNFELEKGEIVGLIGLNGAGKSTTIKHMLGLINPMEGKLSISNIKINEDIENYRRKLSYIPESPVIYDELTLEEHIEMTAMAYQLSREEVMRRAKPLLKVFRLENELKVFPSHFSKGMKQKVMIICAFIVDPELYIIDEPFLGLDPLGIQSMLDLMVEKRNENRTVLMSTHILATAERYCDRFIILDKGEIVAFGNLDELRNKQD

SEQ ID NO: 3825 - protein, 199 aa, Staphylococcus epidermidis
SVFIYNRINKGVRGKMTDIIIVHSKHGNSKNHWYEWLRHNLTLEGYDVSLFNLEANDHAQIDEWVNEMKQQLHIRKKDTYFVTHGFGSIAALKFLEETHHHIEGFFSIAGFKEDAQDIDEDVDLKGVTIDYDKIKEQVDKFYGLTSKDDQYVSYKETQRLMNSLNGHTRVVEDGGHFLEEEGFVTFTSLINRMQGYMTR

SEQ ID NO: 3826 - protein, 485 aa, Staphylococcus epidermidis
SRYMAYFNKFLSNSERKRGKVSKKVAIIGAGITGLSSAYFIKKQDPSIEVTIFEASNRVGGKIQTYRSDGYTIELGPESYLGRKTIMTDVAKDIGLENDLITNTTGQSYIFAKNKLYPIPGGSIMGIPTDIKPFIKTRLISPIGKLRAGLDLFKKPIEIEDDISVGSFFRQRLGNEVLENLIEPLMGGIYGTDIDQLSLMSTFPNFKEKEEQFGSLIKGMKDEKEQRIKKRQLYPGAPKGQFKQFRHGLSSFIEALVKDIESKGVHIRYNTPVKDILISQKDYEILLEDDSKEKFNGLLVTTPHQVFLNWFSHDPAFDYFKNMDSTTVATVVLAFDEKNITNTYDGTGFVIARTSQTDITACTWTSKKWPFTTPEGKVLIRAYIGKPGDTVVDDHTDEEIVSIVRKDLSQMMTISGNPDFTIVNRLPKSMPQYHVGHIKMIKEIQQHIKTTYPRLRVTGAPFEAVGLPDCIQQGKNAVDEILEEL

SEQ ID NO: 3827 - protein, 157 aa, Staphylococcus epidermidis
INSIDRQSFTDLIQTKFKMVRIEAGYTQDTMAQTIGLSKKTLVQIEKERVLPNWTTCVSICALFRDSDVLNSTFGCDPLEIVQTISRNHCAYPNHSTTSDIYWNTIDTRNGFILQSNKVSNIYRVLNNEKQPIFGTSKMREAETYFNRNAKEELIHV

SEQ ID NO: 3828 - protein, 146 aa, Staphylococcus epidermidis
RSVIIMSETIFSKIISGEIPSFKIYENDYVYAFLDISQVSKGHTLLVPKKPSANIFETDEETMKHIGVALPKVANAIKNAFHPDGLNIIQNNGEYADQSVFHIHFHLIPRYENDIDGFGYKWETHEDVIDDETKQKIATQIQAQIS

SEQ ID NO: 3829 - protein, 371 aa, Staphylococcus epidermidis
HLSILKYLIKCNMLSLVRMIQLWGDSRVRSKNDTILKAIKGESTSHTPVWFMRQAGRSQPEYRKLKEKYSLFEITHQPELCAYVTHLPVDNYQTDAAVLYKDIMTPLKPIGVDVEIKSGIGPVISNPIQTVKDVERLSQIDPKRDVPYVLDTIKLLTEEKLNVPLIGFTGAPFTLASYMIEGGPSKNYNFTKAMMYRDEETWFALMNHLVDISIDYVVAQVEAGAEIIQIFDSWVGALNVKDYRYYIKPAMNKLISGIKAYYDVPIILFGVGASHLINEWNDLPIDVLGLDWRTTIKQADKMGVNKAIQGNLDPSVLLAPWDVIESRLKDILNQGLNRGKHIFNLGHGVFPEVKPETLRKVTEFVHNYTAK

SEQ ID NO: 3830 - protein, 380 aa, Staphylococcus epidermidis
GDKMEKPTRLALLKEIAEFLNEETEIYSMMQGALRLLINGSDFSTGWIFYIDEEGHHDLVSSVDLPEALSKNHCYYLTNGSCWCVQAYQNHKLTKASNIINCSRINLANHAYDKETNHITHHATVPLQSGSERFGLLNVASPNKEHYSEEDLELLESVAFQIGSAIKRIQLTNKEKENAKINERNRLARDLHDSVNQMLFSLKLTAHAAKGITTDEQAQRAFKTIEETSQNAVNEMRALIWQLKPVGLEQGLIHALHYYSKMLGLDLKVTINGLIDLSNDIEENVYRIIQEAMNNVIKHAKTNKVYLDLSQNVDYLEVDIRDNGQGFDTQSINTFLFNGLKNIKQRTQYLNGKVTIESKINQGTRIYIKIPLKLKEHPYA

SEQ ID NO: 3831 - protein, 277 aa, Staphylococcus epidermidis
EEKMKFTIPKQFNDYTLREIFQYLKLPKKDLHQLNMSKEILINKEYGTLLNNVKTGDHVEIPTPNEVSNYLPSYRYAQIYYEDDDLAIVMKPKGVKTHPNDLKESNTLMNHVIYTVDSEYVEPIHRLDQETVGLLIVAKNPLMKKILDRMLEYNEITRIYKANVKALLPIKPQTIDMPIGKDKFHSNKRRISNTGQRAITHIINSKMIKEGVCQLDIKLDTGRTHQIRVHLAEIGHPVIGDPLYGTSTLRQLELNSHQIEFTHPLTQEIISVSLDDK

SEQ ID NO: 3832 - protein, 242 aa, Staphylococcus epidermidis
VPVINIKNLNKKFGANEVLRDINLTVEKGEVVAIIGPSGSGKSTLLRCMNLLDVPSKGKVIFEDNELTQHNVHLDNLRQKMGMVFQNFNLFPHKKVIENVMLAPLLLHKDSKDQLKEKALYLLEKVGLKDKADSYPNQLSGGQKQRVAIARALAMEPDVMLFDEPTSALDPEVVGDVLKVMRQLANESMTMVIVTHEMNFAKEISDKVVFMADGVVVESGTPQNIFENPQHSRTENFLSRVL

SEQ ID NO: 3833 - protein, 204 aa, Staphylococcus epidermidis
RSVVNMAMNFKVFDNSEKVAEYTADILRKQFNNNPTTIAGFHLSKEHAPVFDELKKNVENHTVDFSQINILDYDDNHSYYEALGVPTGQIYSISYENDAIDFISDKIKTKENKGKLTMQVLTIDENGKLDISVRQGLMEAREIFLVITGANKRDMVEKLYRENGKTSFEPSDLKAHRMVNVILDKEAAAGLPEDVKEYFTARFA

SEQ ID NO: 3834 - protein, 121 aa, Staphylococcus epidermidis
LKGVQRLMAVNLYDYANQLEQALRDSDEYKAIKDAFAKVKENEESKKLFDEFRETQMSFQQKQMQGEEIPEEDLQKAQEQAQAIEKDENISELMNAEQKMSQVFQEINQIIVKPLDEIYAD

SEQ ID NO: 3835 - protein, 148 aa, Staphylococcus epidermidis
SCIFLVILGMKYYYNYPTNKVRRIIMKVSRILFGLGVGAVAGFAVALRHRDNQSVKNHTIDASQPTGAQSELQREIENMKQSFNDILNYGSQIKNESIEFGSSIGEEFKGLIGNFKSDINPNIEKLQSHIENLQNRGEDISNNLSNDK

SEQ ID NO: 3836 - protein, 61 aa, Staphylococcus epidermidis
DLISVELYYCTLENKKGASFNETPFCYSVLGGIRTPDRWLRRPLLYPAELPGHFQHKNYYI

SEQ ID NO: 3837 - protein, 60 aa, Staphylococcus epidermidis
INDSNRFIHTSSPLFLQLPYIVSQYHITVDIYVYSSCKVIFLSLFYNHQKMTKARLPWSL

SEQ ID NO: 3838 - protein, 457 aa, Staphylococcus epidermidis
VYGLECIKLLNYTELENKNVLVVGLAKSGYEAAKLLLKLGANVKVNDGKDLSQDAHAKDLESMGIEVISGSHPFSLLDDDPIIVKNPGIPYTVSIIKEAANRGLKILTEVELSYLISEAPIIAVTGTNGKTTVTSLIGDMFQKSVLTGRLSGNIGYVASKVAQEVKSDEYLITELSSFQLLGIEEYKPHIAIITNIYSAHLDYHETLENYQNAKKQIYKNQTKDDYLICNYHQRHLIESENLEAKTFYFSTQQEVDGIYIKDGFIVFNGIRIINTKDLVLPGEHNLENILAAVLASIIAGVPVKAIVDSLVTFSGIDHRLQYIGTNRTNKYYNDSKATNTLATQFALNSFDQPIIWLCGGLDRGNEFDELIPYMENVRVMVVFGETQDKFAKLGNSQGKYVIKATDVEDAVDKIQDIVEPNDVVLLSPACASWDQYHTFEERGEKFIDRFRAHLPSY

SEQ ID NO: 3839 - protein, 68 aa, Staphylococcus epidermidis
NMSPSSKVYNSIVSEYISFSKSIMMYSLKLIYPLKINQICISFISAILILKRMIIVLKTEKIFNNYFI

SEQ ID NO: 3840 - protein, 802 aa, Staphylococcus epidermidis
TIMLISNEWLKDYVNVDQSVQALAERITRTGIEVDDIIDYTKDIKKLVVGHVLSKTPHPDADKLNICQVDLGEEEPVQIVCGAPNVDEGQHVIVAKVGGRLPGGIKIKRAKLRGERSEGMICSLQEIGISSHVTPKNYESGIYVFPEAVKPGTDALEAIYLNDQVMEFDLTPNRADALSMVGTAYEVAALYQTKMNKPQLTSNESQESAKDELTIEVKNEDKVPYYSTRVVHDVTIGPSPVWMQFRLIKAGIRPINNVVDISNYVLLEYGQPLHMFDQEQIGSQSIEVRQAKKDETMRTLDGEERRLLDTDIVITNGKDPIALGGVMGGDFSEVTEQTRHVVVEGAIFDPVSIRHTSRRLNLRSESSSRFEKGIATEFVDEAVDRACYLLERYASGTVLKDRVSHGDLGSFVTPIEITADKVNRTIGFNLTDEEIIDIFEQLGFDTENKNGEITVNVPSRRKDISIKEDLIEEVARIYGYDEIPSTLPVFKDVTSGELTDRQFKTRTVKETLEGAGLDQAITYSLVSKNHATDFALQNRPTIELLMPMSEAHSTLRQSLLPHLIDAVSYNVARKNTNVKLYEIGRVFFGNGEGELPDEVEYLSGILTGDFVNNTWQGKKESVDFYLTKGVVERIAEKLNLQFDFRAGQIDGLHPGRTAIVSLNGKDIGFIGELHPTLAANNDLKRTYVFELNYDAMMEVSVGYINYEPIPRFPGVTRDIALEVNHEVTSSELLSIIHENGEDILNDTLVFDVYEGEHLEKGKKSIAIRLSYLDTENTLTDERVNAVHDKILEALKKHGAIIR

SEQ ID NO: 3841 - protein, 62 aa, Staphylococcus epidermidis
RIKTYPIVLELLTHLGVLIMKLFNAFKDILEAAITNDGTQLGASIVNIIESSVDMVNRFLGN

SEQ ID NO: 3842 - protein, 155 aa, Staphylococcus epidermidis
NKETKGDNVMGEVKHLQINYKTDELFADFREFGNKNLYMIEELKGQMIDASSDSPFYGIFVGNKLVARMALLDKGEVEETYFPNSNDYILLWKLEVLDTYQRRGYAKQLLNFAKENKKPIKAIARNNSKEFFLKQGFKDVETKNPEGHDILIWNP

SEQ ID NO: 3843 - protein, 631 aa, Staphylococcus epidermidis
INIYKININKDWGITLSNCSSFILFSLINLIMERRSPLEEYQKKIKEKLNVVPLEPGCYLMKDRNDQVIYVGKAKRLRNRLRSYFTGAHDAKTTRLVGEIRNFEFIVTSSETESLLLELNLIKQYQPRYNILLKDDKSYPFIKITKEKHPRLLVTRTVKKNSGKYFGPYPNAYSAQETKKLLDRIYPFRKCDNMPDKLCLYYHIGQCMGPCVYDVDLEKYAQMTKEITDFLNGEDKTILHHLEDRMNKASEQLDFEQAKEYRDMIQHIHNLTKKQKIMSSDNTIRDVFGYSVSKGWMCVQVFFVRQGNMIKRDATMIPLQQTEEEEFYTFIGQFYSLNQHLLPKEVHVPKNLDKDIIQSVVDTKIVQPVRGAKKDMINLANHNAEVQLDNKFELIARDESRTIKAIEELGERMGIQTPIRIEAFDNSNIQGVDPVSAMVTFVDGKPHKKDYRKYKIKTVEGPDDYKSMREVVRRRYTRVLNEGLPLPDLIIVDGGKGHMNGVMDVLENELGLDIPVAGLQKNDKHQTSELLYGASAEIVPLKKNSQAFYLLHRIQDEVHRFAITFHRQTRQKTGLKSVLDDIDGIGTKRKTSLLRTFGSIKKMKEASFDELRQAGLPEKVAKNLQNALQNK

SEQ ID NO: 3844 - protein, 541 aa, Staphylococcus epidermidis
RSKYMKCNTLKLTEQDQFINKIKNSESQITSFYEYDAAKKESFYRRLKTPNNGREFHLSRVIKSYMNELKLTHQQLNNIDALADGAKVVIGGQQAGLFGGPLYTFHKIFSIITLSRQLSEEYDTPIVPVFWIAGEDHDFEEVNHTYAFNNKETTLKKVKYHTMTPPDSNVSRYTPDKNELKASLNHFFKEMKETVHTQDVYQMCVNIINQFDSWTDIFKGLIHEVFKDYGILLIDAQYPELRQMEKPLFKEILEKRNQVDQSFRETQIRTTQQQLPSMIQTETNTHLFIHEDGMRQLLNFDGTYFKLNKTEKRYTKQNLLDIIEREPERISNNVVTRPVVEEWLFNTVAFIGGPSEIKYWAELKGVFDTLNVEMPIVMPRLRITYLYARTKKLLKQYNLSIESVIANGVEQERQRFVREKASNNFINEVEEMKIQQQELYNNLFTYVENNHDNQLLLEKNNQIHLNQYDYLIKRYLLNIERENDISMRQFREISETLHPMGGLQERVWNPLQIMNDFGIDVFSPSTYPPLSYSFDHLIINP

SEQ ID NO: 3845 - protein, 233 aa, Staphylococcus epidermidis
IGDLNMKFKNILFDFDDTLVDFYDAEKKAFYNLAQKYNHQPTQQDFEHFKKVNQAHWEAFQQNKLTKDEVLSQRFINYFNDYQIHVNGKEADKCFRAELAMAPVKLFDHTLEVIQQLKLNHSLYIVTNGVTETQLRRIAQTQFNEIFQDVFISEKAGFQKPMTEFFDFVFEHIGENNRNQTLIVGDSLTSDILGGKNANISTCWFNIRQKENHTSIQPDYIINDLSEMIRIVE

SEQ ID NO: 3846 - protein, 311 aa, Staphylococcus epidermidis
MFHHVSVMLNETIDYLNIKEDGVYVDCTLGGAGHALYLLNQLNDKGRLIAIDQDLTAIENAKEVLKEHLHKVTFVHNNFRELTNILNELEIEKVDGIYYDLGVSSPQLDVPERGFSYHNDAKLDMRMDQTQSLSAYEVVNQWSYEALVRIFFRYGEEKFSKQIARRIEAHREQQPIETTLELVDVIKEGIPAKARRKGGHPAKRVFQAIRIAVNDELSAFEDSVEQAIECVKVGGRISVITFHSLEDRLCKQIFQEFEKGPDVPRGLPVIPEAYTPKLKRVNRKPITATDDDLNENNRARSAKLRVAEILK

SEQ ID NO: 3847 - protein, 252 aa, Staphylococcus epidermidis
RWRHILMEQITSAQNSKIKNANKLKKKRERDKTGLALIEGIHLIEEAYQSQIEVIQLFIVDSDRMSSSIIDYAKEVYQINLKVAEALSGTVTPQGFFAIIKKPTYDKTLAKQVLLIDRIQDPGNLGTLIRTADAAGLDLIVMEKGTADPFQDKVIRASQGSIFHIPVIFDDINNYIHQFNGPVYGTALENAVSFNDVEAQVNFALILGNEGEGVNPDLLKETTQNLTIPIYGKAESLNVAIAGSILMYQLKG

SEQ ID NO: 3848 - protein, 99 aa, Staphylococcus epidermidis
NHFNPRSGEISMGEFKNRINVTINDQHFTIIGEDSPEHIRYVAHLVDEKMQELGQKSAGLDTTRKAILTSVNIMHEKVILEEENRRLQQEINQLKQRDE

SEQ ID NO: 3849 - protein, 281 aa, Staphylococcus epidermidis
VMANQSLKETPKTQSNPQTQVQGQNQQPKQKTVKLIIKRQDNSESKPYEESFEIPYKENLNVIACLMEIRRNPVNSKGEKTTPVTWDMNCLEEVCGACSMVINGRARQSCSAIVDQLEQPIRLEPMSTFPVIRDLQVDRSRMFDNLKRMKAWIPIDGTYDLGPGPRMPEKKRQTAYELSKCMTCGVCLEVCPNVTKNNKFVGAQAISQVRLFDLHPTGSMTKDERLDALMSAGGLQECGNSQNCVNACPKGIPLTTSIAAMNRETSFHMFKSFFGSDHQVD

SEQ ID NO: 3850 - protein, 173 aa, Staphylococcus epidermidis
RVNNMSKWIILSDNHKETGILYHIYELHKDADKFLHLGDSEFSYNDTELSLYQRVKGNCDFYPEFLEEEITEENGIRAFYTHGHLYQVNQTRMKLAEKAKELGCLFAFYGHTHVAKYEQIGGIHVINPGSISQSRSQIEETFAELVYKEDENTIILNFRNRENQIIETVKIEF

SEQ ID NO: 3851 - protein, 334 aa, Staphylococcus epidermidis
KELKLESEEKEIYMIFIYAIIALLITFILVPILIPTLKRMKFGQSIREEGPQSHMKKTGTPTMGGLTFLISIIITSIIAIIFVDHSNPIILLLFVTIGFGLIGFIDDYIIVVKKNNQGLTSKQKFLAQIIIAVIFFVLSDVFHLVHFTTDLHIPFVNFDIPLSFAYVIFIVFWQVGFSNAVNLTDGLDGLATGLSIIGFAMYAVMSYMLDSPAIGIFCIIMIFALLGFLPYNLNPAKVFMGDTGSLALGGIFATISIMLNQELSLILIGFVFVVETLSVMLQVASYKLTKKRIFKMSPIHHHFELSGWGEWKVVTVFWTVGLITGLIGLWIGVH

SEQ ID NO: 3852 - protein, 318 aa, Staphylococcus epidermidis
KSTKKERIQLMGNVVYKLTSKEIQSLMAQTTFETTKLPQGMKARTRYQNTVINIYSSGKVMFQGKNADQLASQLLPDKQSTTGKHTSSNTTSIQYNRFHCIGSDEAGSGDYFGPLTVCAAYVSQSHIKILKELGVDDSKKLNDTKIVDLAEQLITFIPHSLLTLDNVKYNERQSIGWSQVKMKAVLHNEAIKNVLQKIEQDQLDYIVIDQFAKREVYQHYALSALPFPDKTKFETKGESKSLAIAAASIISRYAFVKHMDHISKKLHMEIPKGASNKVDLIAAKVIQKYDIQQLDTISKKHFKNRDKAIHLMNQKYNK

SEQ ID NO: 3853 - protein, 269 aa, Staphylococcus epidermidis
RSMNKPIGVIDSGVGGLTVAKEIMRQLPNETIYYLGDIARCPYGPRPGEEVKKFTTELAQKLMEFDIKMLVIACNTATAVALNYLQNILPIPVIGVIEPGARTAIMTTKNQNVLVLGTEGTIKSEAYRTHIKKINPNVNVYSVACPGFVPLVEQMRYKDPTITNIVIHQTLKQWRNSDADTVILGCTHYPLLYQPIYEYFSGTKTVISSGLETAREVSALLTFSNEHASYTEHPQHRFFATGDTTHIKNIIDEWLNMKVEVQRITVDDS

SEQ ID NO: 3854 - protein, 173 aa, Staphylococcus epidermidis
MLIDIVVLLIICYFIVIGFRRGIWLSILHFASSIVSLYIASQHYQSIAQRLVVFVPFPKTVAFDMVYTIPYDHLQYRFEKVIAFIIIFGMCKLILYLVVVTFDNIITYKKIHLVSRISSVVLSIISVFIYLQIGLYLLSLYPHSFIQYQLSQSLVSRVVIEQIPYLSQFILNL

SEQ ID NO: 3855 - protein, 608 aa, Staphylococcus epidermidis
FISEIKSRALDLNIQGSDISMAEKKIIVVGGGLAGLMSTIKAAEQGAHVDLFSIVPVKRSHSVCAQGGINGAVNTKGEGDSPWIHFDDTVYGGDFLANQPPVKAMADAAPKIIHLLDRMGVMFNRTKEGLLDFRRFGGTLHHRTAFAGATTGQQLLYALDEQVRSFEVDGLVTKYEGWEFLGIVKDEEDAARGIVAQNMTTSEIQSFGSDAVIMATGGPGIIFGKTTNSMINTGSAASIVYQQGAIYANGEFIQIHPTAIPGDDKLRLMSESARGEGGRIWTYKDGKPWYFLEEKYPDYGNLVPRDIATREIFDVCINQKLGINGENMVYLDLSHKDPHELDVKLGGIIEIYEKFTGDDPRKVPMKIFPAVHYSMGGLYVDYDQMTNIKGLFAAGECDFSQHGGNRLGANSLLSAIYGGTVAGPNAIKYVENVEKSYTDLDDSIFEARVKEEKERFDHLLNMRGTENAYKLHRELGEIMTANVTVVRENEKLLETDKKIQELMKRYEDIDMEDTQTWSNQAVFFTRQLWNMLVLARVITIGAYNRNESRGAHYKPEFPERNDEEWLKTTMARYKGRSEKPEFTYEPVDVSLIPPRKRDYTSKSKGGNK

SEQ ID NO: 3856 - protein, 465 aa, Staphylococcus epidermidis
MLMEENKNQPNKENMSNKDDNATHLNDSHRNEDLELFRRNKNARQRRRRRIDNQSKEKDATSTQSQLETKPMDKFIDNHKSHNQNKEIKSDLIEENVNDENDNQKNINDKLNDRIVQETNESRQSTEDDEEFPLDHRSEQQPKASRHSKKHKLLSKFTSKKEKETSTSFNSNEKVTQIKPLSLEEKRAIRRKKQKRIQYTIITLLILIIVLILLYMVTPLSKISNVNVKGNNNVSTSKIKKELNVTSRSRMYTFSKNKAIRNLKQNPLIKEVDIHKQLPNTLTVNVTEYQIVGLEKNKDKYVPIIEDGKELTEYKDEVSHDGPIIDGFKGDKKTRIIKALSEMSPKVRNLIAEVSYAPTKNKQSRIKIFTKDNMQVIGDITTIADKMQYYPQMSQSLSRDDSGELKTNGYIDLSVGASFIPYQGSSTVQSGTEQNVTKSTQEENDAKEELQNVLNKINKQSKENN

SEQ ID NO: 3857 - protein, 591 aa, Staphylococcus epidermidis
HEVRTNSNVNVMSWSSFYGVILMTKKDVIQLLEKIAIYMELKGENTFKVSAYRKAAQSLEVDERTLEEIDDVTELKGIGKGVGEVINEFKTQGQSSTLQTLQDEVPEGLVPLLKIQGLGSKKIAKLYHELQITDKETLQQACEEGKVSTLKGFAKKTEQNILEAVKSIGAKKDRYPIELMRGLNQEIVKFIEQLEGVEQYSTAGSFRRYKEMSKDLDFIISTSEPKKVQQQLLRIPNKVKDVAVGDTKISLELAYDDETIGVDFRLIEPAAFYHTLQHFTGSKDHNIRIRQLAKARDEKVSEYGIEQQDGKLLQLQSEEAIYHHFGVDWIAPAMREDGSEFDKDLSQIIQLDDINGDLHMHTTYSDGAFSIKEMIEANIEKGYEFMVITDHSQSLKVAHGLQVDRLLRQNEEIKQLNEEYKEIDIYSGTEMDILPDGTLDYDDEVLAQLDYVIAAIHQNFNQSEDEIMKRLETACRNPYVRHIAHPTGRIIGRRKGYKANIEKLMNLAEETNTILEINANPHRLDLNAEIVRKYPKVKLTINTDAHHTNHLDFMKYGVATAQKGFVNKERVINTMTKEAFRSFVETNKYKK

SEQ ID NO: 3858 - protein, 390 aa, Staphylococcus epidermidis
FVRRCLSMEEHYYVSIDIGSSSVKTIVGEKFHNGINVIGTGQTYTSGIKNGLIDDFDIARQAIKDTIKKASIASGVDIKDVFLKLPIIGTEVYDESNEIEFYEDTEIDGTHIESVLEGIRDKNDVPETEVINVFPIRFVVDKDNEVSDPKELIARHSLKVDAGVIAIQKSILINMIKCVEACGVDVLDVYSDAYNYGSILTPTEKELGACVIDIGEDLTQVAFYERGELVDAESIEMAGRDITDDIAQGLNTTYDTAEKVKHQYGHAFYDSASDQDVFSVDQVDSDEHVQYTQKDLSDFIEQRVEDIFFEVFDVLQELGLTKVNGGFVVTGGSANLLGVKELLQDMVSEKVRIHTPSQMGIRKPEFSSAISTISSSIAFDELLDYVTISY

SEQ ID NO: 3859 - protein, 111 aa, Staphylococcus epidermidis
KLRRIGIMAIVKVTDSDFDSKIESGVKLVDFWATWCGPCKMIAPVLEELAGDYDGKADILKLDVDENPSTAAKYEVMSIPTLIVFKDGEPVDKVVGFQLKENLAEVLDKHL

SEQ ID NO: 3860 - protein, 202 aa, Staphylococcus epidermidis
FIEGENDMEDIVIATNNQGKINDFKAIFKNQHVIGISELIEDFDVEETGATFEENARLKSEAAAHALNKRVIADDSGLEVFALNGEPGVYSARYAGLGKNDEDNIEKLLTNLEDVQDRRAQFVCVISMSAPNEKTKTFKGTVSGVITTERHGKNGFGYDPIFFVPELNKTMAEITNDEKGKISHRGNAIRLLKEYLEGEQHV

SEQ ID NO: 3861 - protein, 62 aa, Staphylococcus epidermidis
INKGVLIFRKNLRKYANLSKECTVIGVSNRIEIWDRETWNDFYDESEESFEDIAEDLIDFDF

SEQ ID NO: 3862 - protein, 361 aa, Staphylococcus epidermidis
RDYIRRNSVMTQNDLMSELKQQALVDINEAKDAQALQEVKVKYLGKKGSVSGLMKNMKDLPNEDKPAYGQKVNELRQTIQSELDERQKLIKEEKLNQQLSEETIDVTLPSRHIEIGSKHPLTRTVEEIEDLFLGLGYEIVDGYEVEQDYYNFEALNLPKSHPARDMQDSFYITEEILMRTHTSPVQARTMEKRKGQGPVKIICPGKVYRRDSDDATHSHQFTQIEGLVVDKDIKMSDLKGTLELVAKKLFGADREIRLRPSYFPFTEPSVEVDVSCFKCKGQGCNVCKHTGWIEILGAGMVHPNVLEMAGFDSKEYSGFAFGMGPDRIAMLKYGIEDIRHFYTNDVRFLDQFKAVEDRGEQ

SEQ ID NO: 3863 - protein, 101 aa, Staphylococcus epidermidis
KMFMGEFDHQLDTKGRMIIPSKFRYDLNERFIITRGLDKCLFGYTLEEWQQIEEKMKTLPMTKKDARKFMRMFSSGAVEVELDKQGRINIPQKFKEICQFK

SEQ ID NO: 3864 - protein, 98 aa, Staphylococcus epidermidis
FSIIFNICFCFIIISIYFSIFICTASITLFSILIVLFSITLLRILIIIIILCTLICLIPVLTISWCIILIWIRGCFSVLIWSRSRFNRSTGLISCSRC

SEQ ID NO: 3865 - protein, 571 aa, Staphylococcus epidermidis
DNYIQRRDYIMKKSSKFSKDFPTRKNHYAIRKFTVGTASIIVGSFLFFGQTQAHAEQAEEFERVTTGTVDTGGQPARADQGQEGPQAGADTHNTASQPGVTGQDAPNENHAGDQNAAVTHPANQENNAPQVGAGTPGAENTPQAGGENHNQDTAVTSAGTNGEQNGGKPATSTTGQDAAQSNGPQGTSVAQPGNDASSQGHDTPQADAGTHNTEGQPAVTTGEQTGGKPAATKPEGASAETAPAPNNADENHAQPSPQTGGTTATQAGQVKPSGDSTPTGEPNKADDQDTQIKPTSNQGTTATTNEIGNQKPSGQTGNTENTPNDGTQVKPNNDPAVTGTPNTNGEQTGQPNATVTPGQGNEEINGASKPGEVSPKPEENNPTATEPGTTAPGNTNQDTQVKPNTDQTATGTPAGTDNQNTQQGNTEQNNQNAQPSAPGTTDQAGATVKPGSAPNQDAEATPNPDQNNTPTNGQDGDQTNQSTQDDNDNQNTQQGNTKQNNQNAEQGNTGGTDKDAKVNTNDDETKTDVKNDTELPETGLSNEYDYTTTVFGSIALISSLLLLRRQRKESK

SEQ ID NO: 3866 - protein, 785 aa, Staphylococcus epidermidis
RDCMRQKTLDVLEFEKIKSFVADETISDLGREKVQEMAPASNFDTVEFQMNETDEISQIYNKHRLPSLSGLAKVSPLVHRASIGGVLNVGELNRIKRLVQVQNQFKTFYNQMLEEDEEVKYPILHDKMNHLPILTDLFKEINEKCDAHDLFDHASYTLQSIRSKISRTNQRIRQNLDRIVKNQGNQKKLSDAIVTVRNDRNVIPVKAEYRQDFNGIVHDQSASGQTLYIEPNSVVEMNNQISRLRNDEAVERERILTELTGLVSAESDALLVAESVMGQIDFLIAKARYARTIKGTKPTFKEDRTIYLPNAFHPLLDKDTVVANTIEFIDDVETVIITGPNTGGKTVTLKTLGLIIVMAQSGLLIPTLDGSQLSIFENVYCDIGDEQSIEQSLSTFSSHMKNIVEILQDADQNSLILFDELGAGTDPSEGAALAMSILDYVRRLGSLVMATTHYPELKAYSYNREGVMNANVEFDVDTLSPTYKLLMGVPGRSNAFDISKKLGLSLNIINKAKTMIGTDEQEINAMIESLEHNSKRVDQQRIELDRLVREAQETHDALSKQYQQYQNYEKSLMEEAKEKANQRVKSATKEADEILKELRNLRDHKGAEVKEHELIDKKKQLDDQYEAKSIKQHVQKKKYDTIHAGDEVKVLSYGQKGEVLELVGNEEAVVQMGIIKMKLPIEDLEKTKKKKEKPTKMVTRQNRQTIKTELDLRGYRYEEALNELDQYLDQAVLSNYEQVYIIHGKGTGALQKGVQQHLKKHKSVRQFRGGMPSEGGFGVTVAELK

SEQ ID NO: 3867 - protein, 61 aa, Staphylococcus epidermidis
GGLIMAVPKRRTSKTRKNKRRTHFKISVPGMTECPNCGEYKLSHRVCKNCGSYNGEEVVSK

SEQ ID NO: 3868 - protein, 778 aa, Staphylococcus epidermidis
CVIMAKRKIKIKKNKIGAVLLVGLFGLLFFILVLRFSYVMITGHSNGQDLIMKANEKYLVKNSQQPERGKIYDRNGKVLAEDVERYKLVAVVDKKASKESKKPRHVVDKKKTAKKLAEIIDMDADEIEKRLNNKKAFQIEFGQKGTNLTYQEKEKIEKMKLPGIALYPETERFYPNGNFASHLIGMAQKDPDTGELNGALGVEKIFNSYLNGSRGALKYIHDIWGYIAPNTKKEQQPKRGDDVHLTIDSNIQVFVEEALDDMVERYAPKDLFAVVMDAKTGEILAYSQRPTFNPETGKDFGKKWANDLYQNTYEPGSTFKTYGLAAAIQEGKFKPDEKYKSGHRNIMGSEISDWNKTGWGRIPMSLGFTYSSNTLMMHLQDLVGADKMKSWYERFGFGKKTGGMFDGEAAGNIGWANELQQKTSAFGQSTTVTPAQMIQAQSAFFNKGNMLKPWFVSSIDNPITKKNYYSGKKEFAGKPVTEETANKVEEELDKVVNSKKSHAMNYRVKGYDIEGKTGTAQVADSNGGGYVKGENPYFVSFIGDAPKKKPKVIVYAGMSLAQKNDQEAYEMGVSKAFKPIMENTLKYLNVGKSSDTSSKTDFSKVPNVQGDEVQKAEDSVNAQSLKPITIGNGKQIKQQSVKSGTKVLPHSKVMLMTDGELTMPDMTGWTKEDVLAFEDLTKIKVSTKGNGFVTNQSISKGQIIKNKDKIEVSLSAEDTDDDQEKTDEDSSDNKSKKDKADEDHSNTSSSTKNDKSNADSKNDSDDSTNETSGSERNN

SEQ ID NO: 3869 - protein, 137 aa, Staphylococcus epidermidis
GVSVMAVEKIYQPYDEATQTSIPQRQPQSSPEKQTVKRKVVVQLTRFEKILYIALITVIALISIYMLSLKMDAYDTRGKIADLDQKIEKQSSENSALKSEIKKNSSYERIYDKAKKQGMSLENDNVKVVRNNGEAKN

SEQ ID NO: 3870 - protein, 216 aa, Staphylococcus epidermidis
QFKLYVSQGGLFLAQSKNEFYLRRLHSLLGVIPIGAFLIVHLMVNHQATQGAEAFNRASGFMESLPFLIVMEFILIYIPLLYHGLFGLHIAFTAKENIGHYSLFRNWMFFFQRVSGILAFVFIAMHLWQTRLQKAFYGKSVDYNLMHETLQHPLWAIFYIICVIAVVFHFANGLWSFCVTWGFLQSKKSQRVFTWISLIVFLVISYIGVAAVIAFI

SEQ ID NO: 3871 - protein, 78 aa, Staphylococcus epidermidis
GGISMVHELGTVGMVCPFPLIEAQKKMNQLNQGDELKIDFDCTQATEALPNWAAENGYPVTNYEQLDDASWTITIQKA

SEQ ID NO: 3872 - protein, 75 aa, Staphylococcus epidermidis
EEWLAFGKIRMEAPVNGGRKYNGPKVAKFLVGKVRTRTKGVTIWALSQREIGEIIVPVKMQVTRDRTERPRGALL

SEQ ID NO: 3873 - protein, 154 aa, Staphylococcus epidermidis
KLITIHNLNEMDKFAQILVKHLSAKDLILLNGDLGAGKTTLTQFIGKALGVKRTINSPTFNIIKSYKGSSIRLHHMDCYRLEGEEDDLGFDEYFEDNAIIVIEWSKFIKDFLPPNHLTINISVKNANERQVSIETHGQHYALVKEAILNELSSN

SEQ ID NO: 3874 - protein, 82 aa, Staphylococcus epidermidis
NGGLLMERTIHFTLVDQVSTLNRITSAFVRLQCNIDELHVKHSDKEGISNMKLKVNIKDDDTFKIVLKKLSQQVNVLSVKSE

SEQ ID NO: 3875 - protein, 97 aa, Staphylococcus epidermidis; identical to SEQ ID NO: 3072

SEQ ID NO: 3876 - protein, 424 aa, Staphylococcus epidermidis
KTVTVRTKVSTKDIDEAYLRLKNIVKETPLQFDHYLSQKYNCNVYLKREDLQWVRSFKLRGAYNAISVLSNEEKNKGITCASAGNHAQGVAYTAKKLNLKAVIFMPVTTPRQKINQVKFFGDSNVEIVLIGDTFDHCLAQALNYTKQHKMNFIDPFNNVYTIAGQGTLAKEILNQAEKEDKTFDYVFAAIGGGGLISGVSTYFKAHSPHTKIIGVEPTGASSMYQSVVINHSIVTLENIDKFVDGASVARVGDITFDIAKDKVDDYVQVDEGAVCSTILDMYSKQAIVAEPAGALSVSALEQYKKQIENKTIVCIVSGGNNDINRMKEIEERSLLFEEMKHYFILNFPQRPGALREFVNDVLGPQDDITKFEYLKKTSQNTGTVIIGIQLKHHDDLIQLKDRVCQFDPSNIYINENKMLYSLLI

SEQ ID NO: 3877 - protein, 112 aa, Staphylococcus epidermidis
VLVAKMTLKKMNIKNQKTLLKGKLTIKKIRKLKKIKNLKKKRNLKKMKIISLHKKIILLIIKKHKILQLKGKNKLNKIINKTMMTNNLTTNQQKMRYMSGINKIYLEVQIMV

SEQ ID NO: 3878 - protein, 173 aa, Staphylococcus epidermidis
MDFLQQNWTNILKIIVSLISIVTFIRVFLYERSRLKVNIIGYDQIEEYLDVYISFSNSSKLPISINEIQIFHKNTMIGEIENFTEKILGQTDGKSIVYSNPMPLNLNSYSSDKDLFRIKLVEELPLNKTLTFKFITTRKNITYKIKDFKLPQYRRSFHRKLKHHKKVSNKNKD

SEQ ID NO: 3879 - protein, 104 aa, Staphylococcus epidermidis
VDIYCNGRLKQMTQEINCNFKSHIPRIMTVPGILLIHENKLEFKAYSQNNNPFNIQFELSSIVRYRTSKGLLGNKLFIYYSDQEWYKFSNLSKSDLNKLTKYLY

SEQ ID NO: 3880 - protein, 106 aa, Staphylococcus epidermidis
FCIYIFWINQTIICTSRYILFIPLIYLIFCWFVVRLLVIIVLLIILLSLFLPLSCRILCFLIISRIIFLCRLIIFIFLRFLFFFRFFIFFSFLIFFIVSFPFSSVF

SEQ ID NO: 3881 - protein, 138 aa, Staphylococcus epidermidis
GVTYKMKKIFILLLSSLLVLAACGKNYEISDITNKFKKEGLSVENLRKMKREDFGMAPMKTENAKIFTVSDDKNARILKFKNEDDLKEMKKYYEELGKSSAAFYSHVYTKDRFLIQMNGDIDDHLFEKYKKAMNEALD

SEQ ID NO: 3882 - protein, 622 aa, Staphylococcus epidermidis
TYQQLNKLLSFYYTRKDSNFRKVLTSKCLSPISSWMGLNNVPIFIGTFFYFLNNYMGERYMRSDMIKKGDHQAPARSLLHATGAFKQPTDMNKPFVAICNSYIDIVPGHVHLRELADIAKEAIREAGAIPFEFNTIGVDDGIAMGHIGMRYSLPSREIIADAAETVINAHWFDGVFYIPNCDKITPGMLLAAVRTNVPAIFCSGGPMKAGLSAQGKALTLSSMFEAVGAFKEGTISKEAFLDMEQNACPTCGSCAGMFTANSMNCLMEVLGLALPYNGTALAVSDQRREMIRQAAFRLVENIKNDIKPRDIITQDAIDDAFALDMAMGGSTNTVLHTLAIANEAGIDYDLERINEIAKKTPYLSKIAPSSSYSMHDVHEAGGVPAIINELMKKDGTLHPDRLTVTGKTLRENNEGKNIKNFEVIHPLENPYDKQGGLSVLFGNLAPKGAVIKVGGVDPSIKVFTGKAICFNSHDEAVEAIDNHTVREGHVVVIRYEGPKGGPGMPEMLAPTSSIVGRGLGKDVALITDGRFSGATRGIAVGHISPEAASGGPIGLIRDGDKITIDLINRTLNVDQSEEELYRRKNQLEPFRAKVKTGYLARYTSLVTSANTGGIMQVPENLI

SEQ ID NO: 3883 - protein, 133 aa, Staphylococcus epidermidis
SSGHYNKLKIISILKRRNNKMSNLEQNIKQMKNEVIEAELNTKINTVITMIGEHMDSNERFKSHLDAQGKVMESYMLKEYYQNYYVLMAVLNSILKDVNFMNDEITTFHDRALDELDKTKASSENFGEESLNA

SEQ ID NO: 3884 - protein, 584 aa, Staphylococcus epidermidis
EMIKMSNQKSMVSPHPSEHQTKESQPLITRSGSQLLVEALQQEDVDFIFGYPGGAVLPLYDTFYDGKIKHILARHEQGATHAAEGYARVSGKTGVVVVTSGPGATNAITGITDAYSDSLPLVVFTGQVATPGIGKDAFQEADLLSMTTPITKHNYQVKKIEDIPRIVHEAFHLANTGRKGPVVIDFPKDMGVLKTDVELTKDINIPGYEVNSSPNKEDINKLIYMIKEAKKPLILAGAGINHSKSNHLLTEFVTRHQIPTVTTLLGLGAVPYHHPLFLGMGGMHGSYASNMALTNCDLLINLGSRFDDRLASKPDAFAPNAKVVHVDIDPSEINKVINTDLGIVADCKHVLENLCHEQVLTSSHEEWNDYCINNKSNYPFKYDENDKTFCKPQKAIEYIGKVTNGNAIVTTDVGQHQMWTAQFYPFKNYGQWVTSGGLGTMGFGIPSAIGAQLAEPEKTVVCFVGDGGFQMTNQEMALLPEYGLNVKIVLINNGTLGMVKQWQDKFFNKRFSHSVFNDQPDFMKMAEAYGIKGFLIDSPDKLESSIDEAFAYHGPALIEVRISPIEPVNPMVPSGKSNHEMEGY

SEQ ID NO: 3885 - protein, 69 aa, Staphylococcus epidermidis
MNNNQFKVIKEIYNTLQKTIEDKSTEYKHKIKDGNNEWIETVNREEHLQALIEWALQQIENNFDFEEEK

SEQ ID NO: 3886 - protein, 189 aa, Staphylococcus epidermidis
LEIKPITIYTGKTVPLFYDNIDTDQIIPKVHLKRVSKSGFGPFAFDEWRYLPDGSDNPDFNPNKPEYHGASILITGDNFGCGSSREHAAWALKDYGFNIIIAGSFSDIFYMNCTKNAMLPICLNQKEREHLAQFDEITVDLPNQTVSTVSQSFHFDIDETWKNKLIHGLDDIAITLQFENLIEKYEKTF

SEQ ID NO: 3887 - protein, 372 aa, Staphylococcus epidermidis
EFAKYGPFYYNTLVFISEKGDKMVWTIISGLVVGILLGFVMQRTRFCLAGGFRDMYVQKSNKMFYALLIAITVQSIGLLILKHLNIIEVPAETFPVIGTILGSFIFGIGIVLAGGCATGTWYRAGEGLIGSWVALIFYALTSAVTKTGVLLPIMNQINKTTQVNTSMTSTTGIPQWILVMLLILITVFLVVKTIRKPKIMVPQLKQKYSGIRHYLFEKRYHPFVAGIAVGFIALLAWPMSESTGRMGGLGITTPSANLVNYLISGDLKFIDWGVFLVLGIFLGSYIAAKGSKEFRWRLPDIKTIRNSAIGGIFMGFGASVAGGCSIGNGLVETATMSWQGWIALASMIIGVWFMSYFIFVQPMKKLQQVTQS

SEQ ID NO: 3888 - protein, 319 aa, Staphylococcus epidermidis
FFMKNISDIAKLAGVSKSTVSRFLNNGSVSPATKEKITKIIEENNYQPNQFAQSLRARRTNLIGAIIPRMNSYAVDETIKGLVHQCNQHRYQLLLNYTGLEIDGEISALKTLSRSKVDGIVLMATHITEAHIEVIEKIDVPVIIVGQKHDRLYSIYHDDYEAGYKIGVLIGEKGCRNVHFFGVSEEDIAVGIQRKLGVIQALKDYHISPKIYETTFKHEQAFKDVSQQLERVHHADAIVGATDTIAFAIHKYCSDHQQRFYNCSIYGFGGDPMTQIVSPVIQTVSYNYFEAGEQALKEINQLLKGEQTALKIKIPIQLN

SEQ ID NO: 3889 - protein, 215 aa, Staphylococcus epidermidis
MNMNIEIIANQFETRAATLLRYYTGLLESSRDNHFAFKIYNDPFDMVYVMMNGKLFGHVYIKDCKVRNSFELASSKHTEGQIRSIEGYYNGFEIHDDKHLSISDMMARQLFEDEYFMYGLETFAESNNTDMFTYIEGGLNVEELEGVQSSNADVIGNIEILYQLATGINEPASELVESLKLVTAFVQDENATQDDYKTLERKLSELKTSYYSVSK

SEQ ID NO: 3890 - protein, 69 aa, Staphylococcus epidermidis
KLMNKVLGYRKMLGKTQQQMAKELNISEQSYRNREKGKINFKKNEMIKFKIMLLEKGLKDITLDDIFFS

SEQ ID NO: 3891 - protein, 649 aa, Staphylococcus epidermidis
KGENRMILLQLNDISKSFDGEDIFTDVNFEVKTGERIGVVGRNGAGKSTLMKIIAGVENYDSGHISKIKNLTMSYLTQQMTLNSEATVFEEMSKPFEHIKKIENLIKDETDWLARNGQDYKSDEYQSHIEKYETLTNRYEQLDGYQYESKIKTVLHGLNFTESDFNKPINDFSGGQKTRLSLAQMLLKEPDLLLLDEPTNHLDMETTKWLEDYLKYFKGAIVIISHDRYFLDKIVTQVYDVALGNVKHYVGNYEQFIKQRNQYYEKRMQEFEKQQEEIKRLETFVEKNITRASTSGMAKSRRKTLEKMERIDKPMIDARSANIQFGFDRNTGNDVMHIHDLKIGYDSPITLPINLEVFKGDHIAIIGPNGVGKTTLIKTIAEKQNKLGGQIIFGANLQIGYYDQKQAEFKSNKTILDYVWDQYPHMNEKDVRAVLGRFLFVQEDVKKIINDLSGGEKARLQLALLMLQRDNVLILDEPTNHLDIDSKEMLEQALKDFEGTIIFVSHDRYFINQLANKVFDLNINGGQMFLGDYQYYIEKTEEAAAIKAHETVTQNNFENKEINQDANTSTYISQKQQKRQQRKLERQIEHCERQIEELEAQISHIEEQLTQPEVFNDPLKASKFANQKSDIEQKLEQIMLEWEKLQEKL

SEQ ID NO: 3892 - protein, 461 aa, Staphylococcus epidermidis
EEEKIMGQTLFDKVWKKHVLHGKEGEPQLLYIDLHLIHEVTSPQAFEGLRIQNRKLRRPDLTFATLDHNVPTIDIFNIKDEIAHKQITTLQQNAKDFGVHIFDMGSDEQGIVHMVGPETGLTQPGKTIVCGDSHTATHGAFGAIAFGIGTSEVEHVFATQTLWQTKPKNLKININGSLPTGVYAKDIILYLINQYGVDFGTGYALEFTGETIKNLSMEARMTICNMAIEAGAKYGLMQPDETTFDYVKGRPYATDFDSSMAWWKKLYSDDDAYFDKVIELDVTNLEPQVTWGTNPEMGVSFSNPFPEIKNANDQRAYDYMGLHPGQKAEDIKLGYVFLGSCTNARLSDLIEASHIIKGQQVHPNITAIVVPGSRTVKKEAEALGLDKLFKDAGFEWREPGCSMCLGMNPDQVPEGVHCASTSNRNFEGRQGKGARTHLVSPAMAAAAAINGKFIDVRKVVV

SEQ ID NO: 3893 - protein, 291 aa, Staphylococcus epidermidis
KLSEIKLEYDTQVSVIWYGTLDSRSFKQFSQPKWSELVNRLSIPQNNTNKYARGVAVYGDMKDDTDENGNEYKKYRKDGNVIYRDVLVLDYDDIPKLRLLHDAITETLKGVSWMYHTTFNHRTESPRIRLYIALSERISADDYRKYTKVLANKIGHLVDEGSFQPSRAMALPVYIKGKHPFLHQYNDAPILNVEMLEKWSKETNIQTDQPSKTNFNKRDDTYWRDISFSVTKGNRNNSLASLIGHLFSRHVNEYIVYSYALLWGQNACNPPLNEREINATFQSILKKHRNK

SEQ ID NO: 3894 - protein, 103 aa, Staphylococcus epidermidis
LMTDAKLRERSVCMPYVNLQNLPTKANVVTEPNQVVVKPIMAKPNVIAKLFGISYSSVNRILKEWEKDSKGIDDLYYSLSSTMTVISISRFEQYMKKRHKDWM

SEQ ID NO: 3895 - protein, 492 aa, Staphylococcus epidermidis
NIVEWTREERYQRIEDVDETYLEQLKHQVDTSLYRQTFHIQPEMGLLNDPNGLIYYNGHYYISHQWFPLGAVHGLKYWFNYKSKDLLHFEPQGTLLKPDTKYDSHGVYSGSAFEYQNHLYYMYTGNHRDQHWNRISSQMIARMNKDGKIEKFPKPVIHGQPEGYTSHFRDPKVFEKNSQLYAILGAQNENEMGRLLLYRSQDVVDWHFEGEIKTNLTQFGYMWECPDYFRLSNKDVILMCPQGVEAEGDKFRNIYQSGYMIGDLNFNNLFFDHESFQELDNGFDFYAPQTFVDADGQRILIGWMGLPDTEYPTDKEGWAHCLTIPRVLTIENGKLKQRPFKQLEDLRTNKETALGYANKFKRKLHPYEGKQYEMIIDILENDASEIYFELRSSRSESTLITYNKHENKLTLDRTDSGTLPSNVDGTTRSTILDSPLKQLQIFVDTSSIEIFCNDGERVLTSRIFPNEDATGIKASTESGQVYLKFTKYELKG

SEQ ID NO: 3896 - protein, 417 aa, Staphylococcus epidermidis
WVALLPFLFRRDKMWHEKFTNKHGDVQYRYYEKYKDPLTNKWRRVSVVLNKNGKQSQKEAQKLLNKRIEAKINDKTPIDLKTLTFHQACDEWLDRYIKTSGSKQSTIKTKKYKIKHIKRNINSDILVKNMNSDVVQKSVDNAVKDNLSHKVVKDAMSIIRNIMKYIQRKYKLTDISYLDDIVIPKKATTREEVKAKRENYLEMDEVKAIVDNLHEIANSKRADYMKRSFIMTAYIMEFQALNGMRIGELLAIQPNNIDFDKKTLEIDGTIHWRNEGNAVGFKDTTKTESSYRTISLTTRSCDILRKVMLENKKAIQWESMYQDRGFIFTNYRGNPMSLSTINRNMQQSANNVGITKHITSHTMRHSHISLLSQLGISLKAIMQRVGHTDHKTTLQIYSHVTDQMDKDMMNKLEKVGN

SEQ ID NO: 3897 - protein, 181 aa, Staphylococcus epidermidis
RRIRMKRLLGTLFAATLVLSACSQDDTKEDEHKKSENTAERKADDKKDKKTKEDKKSKKEKKSQENEDNKSTQEDNSTDNQETQDPATQGQKQTQQDNQQNYDDQQSYHEPTKDEVYEWDKQNIPGGTDYGLIDPEDVNTESEDNARQNRIDEINEEMEDPNISVSDYNKLVDEYNELNNE

SEQ ID NO: 3898 - protein, 68 aa, Staphylococcus epidermidis; identical to SEQ ID NO: 3076

SEQ ID NO: 3899 - protein, 354 aa, Staphylococcus epidermidis
VERRYTYMSYKIVALPGDGIGPEILSGTLELLKLISEKYHFEYHLESHHFGGVSIDYYGTPLTNETLQSCKNADAILLGAIGGPKWTDPNNRPEHGLLKLRKSLNLFANIRRTFVTKGASHLSPLKQDIVEGTDLVIVRELTSGIYFGEPSYVKKTEALDSLKYSSQEIERIVRIAFNLANRRRKKLTSVDKENVLSSSKLWRQIVNDVKKDYPEVEVNHMLVDACSMHLITQPTQFDVIVTENLFGDILSDEASVIPGSLGLSPSASFGQTGTRLYEPIHGSAPDIANEDKANPFGMVLSLALCLRESLNQNDAANELESIVYSFIQSNKTTADLGGQYRTSEIFKLLKEKYL

SEQ ID NO: 3900 - protein, 321 aa, Staphylococcus epidermidis
FIMRRLFAIGEALIDFIPNVTHSKLKDVEQFSRQVGGAPCNVAATVSKLGGKSEMITQLGNDAFGDIIVETIEQLGVGTQYIKRTNKANTALAFVSLQDDGQRDFSFYRKPSTDMLYQPENIDDIQIFQDDILHFCSVDLIESDMKNAHEKMIEKFESVGGTIVFDPNVRLPLWEDKLECQRTINAFIPKAHIVKISDEELLFITGKKNEDEAIQSLFRGQVNVVIYTQGAQGATIYTKDDYRIHHEGYQVQAIDTTGAGDAFIGAIIYCILESRHSECKDLFKEKGKDILAFSNRVAALTTTKHGAIESLPTKEDIKDYY

SEQ ID NO: 3901 - protein, 145 aa, Staphylococcus epidermidis
KLSGDSLGTSTHFEKILKKFWRLHMDKEQLKQHMYDYVKEHKEIPIYQLEDLFKELDHDYKGKASVTNEHDKNIVFWSGWNKLTMYALIELVKGEHLDLIYRASYVMRYLLDGRVPSLPLAITYPEYGQQTEVPSWVPMLLRVTK

SEQ ID NO: 3902 - protein, 282 aa, Staphylococcus epidermidis
FCVGLRKFFVHYNHFRRKMMDIDKLEVGKRIKNIRLNKSKNLREFGELISKNLKEDKNISDSIVSRWEKGVSIPSAKRLKEIADIGNVSVNYLLYGVKVTYKDIHNNINTVSMKNEIMDNLEKFLKYYLLYSEYNNYSIKTAELLDLLFENAGYDITTLTKDLCALVSDKRFSFYQHGVYLLLNEDFSKLHVQLYLSEFIYNLLVQITLDYPNIYIKNLVLQITETKERIKDISHKKDAYTEFEIETHLADFINHKEYKKLLDNLSQLEKKITNDNSLIDNN

SEQ ID NO: 3903 - protein, 546 aa, Staphylococcus epidermidis
KEKGELNFMTNNQTLVLIILTFIILITLVNVIISIIERRKQIAKINTLWDNKLKLESFIRPNSRFDAQYHAYRDHYNEQSFIDDKTWSDLNMDTLFHKINFNFTAIGEMRLYATLRGMFKVNQTSLINKFKDNKVFRLNVSYILSKIGKNVYPLFPDQMLPTKRNILLMFCPLLPFIGVAFIFLIPSKGILICLTFMILNAILSFKLKKSYDQDLKSIFYTANVIKQSQALSKIESTPAISVDFTHFKASRRFSGLLVRVESQDMASSIIMFIKLVFMIDYFLFHLIQRSYFKYQEEVMACYDYISILDNHYSIAMYQHTLTHYCYPKINHNINGLQMKSIIHPLLDEENAIANTIDISNHILLTGSNASGKSTFMKAVALNLILAQSIQTATAHSFIYQPGYVMTSMANADDVLSGDSYFMSELKSIRRLFNTHQCNKIYCFIDEIFKGTNTTERIAASESVLSYLDNQKAYQVIAATHDVELSTLLENTYNNYHFNESIQENSIFFDYKIKPGKANTRNAIELLRITQFPIDIYQRAQQNIRNL

SEQ ID NO: 3904 - protein, 160 aa, Staphylococcus epidermidis
IIRGGTKLVKPTREQLNIRKMSVEDVPKVFDIERNSFSHSSWSIDAFYHEIENNEFATYFVIEFSDKIIGYVGLWLVVDQAQITTIAISKAFRGYGLGQLLLKYAMNYARFSCDVMSLEVRIDNDVAQHVYRNLGFQNGGKRKNYYGEGEDALVMWVNLK

SEQ ID NO: 3905 - protein, 69 aa, Staphylococcus epidermidis
  UNSURE (54),(65): Identity of amino acid at the above locations are unknown.
SSTGSFRPVAGNLHLHRYYDFTDLSLRQCPNRYAFRAGSNFTDKEFRYLRTVIXTAAVYWGFHSXLPKS

SEQ ID NO: 3906 - protein, 575 aa, Staphylococcus epidermidis
VERGKYMELTKDDILHEIEKTKQEKDAIHEVIPKGYEIEQHQNGVALYQIIPSKKDGEPDKKIFITNTIPQITERFEDIESNEVSYNMLFYDNQIPVNLGVSAEEIADSRQLLKLVNRKFDVTSTTSTRLVDYINKSKRHNPPVNIKVATRLGHVKGYFIYPYKEEMKNRNIKLFNNDKGFQKLIDSFQSKGTLESYSEHVFSKIKSLPMVMVMLYASLGSVLLREFELQPFIVEISGSTSTGKTFTLNLVSSVWGTSNLITTWSSTNNSIEAMASFLNSFPMFKDDTRNTHPKFVANATYNFSSGESKSRSNINLTLNAKKEWRNILLSTGEASISNMADEKAGVSARVVTLQDQPYPDNFDFTTLDKAFRDNYGTLGKVFIKQYQSKQESYKNAFESYQRYFNQKGSNEIMQRLGHAFALLQVSGEILNDIEGFEHDHFKIIEQAYNSMVRNNKTIDKPKQLLEELLQYLDANRNNIAGEGYSSVKNGDIKAIYKRDYLCILGETVKEKLRYEMQTITGQWDKKGYLIKGEKDRLQKQVKHETVKYRGFAIRQEVLEELGFDFSNSYNPNSDY

SEQ ID NO: 3907 - protein, 437 aa, Staphylococcus epidermidis
PYLILLFKKTLIMMFLKEVVSMNMNDTIFLFLCTLLVWLMTPGLSLFYGGLVQSKNALNTVMQSMVAIVIVTFVWIIIGFSLSFDGGNQWIGGLKFLGLHHVGFETSKTLSPHIPLSLFMLFQMMFCTIAVSILSGSIAEKMRFIPYLIFVSLWVLLIYSPVAHWVWGGGWISKIGAIDYAGGTVVHITSGVSGLVLGIMIGIGKKKEKHTPHNLLITLIGGILVWLGWYGFNVGSAFTFDHIAMISFVNTVIGASAGAFGWLIFEYILKKTTSLLGLLSGALSGLVAITPAAGYVSYMSAMIIAIIGGICCYIVINLIKVKLQYNDALDAFGIHGVGGILGAVLTGVFQSHQINSAVQNGFIYTADFKVVVIQLGAAIATVVFSAIVTFLIARFIKIFTPLATTQEEDKTGLDAIVHGEKAYFYGELNKFNRHIKF

SEQ ID NO: 3908 - protein, 178 aa, Staphylococcus epidermidis
NSRILTESKINKTEITDIVVAKGPGSYTGLRIGVTVAKTLAYALNTNLYGVSSLKALASTVKDSTKLLVPIFDARREAVYAGVYQYQDNELITIIDDTYIPIFELIEKLHQLNQPYVFVGYHTEKIKHLLDSDIVEQLPQASSMKQLIQKPENIHSFTPKYHKLSEAERNWLNQQENN

SEQ ID NO: 3909 - protein, 368 aa, Staphylococcus epidermidis
EFGIPKWWQKKELLWRRRGRISHVGEFEMTNNKLILAIETSCDETSVSVIKNGTELLSNTVLSQIDSHKRFGGVVPEVASRHHVEGITATIDESLVSAKVKMEDIDAIAVTQGPGLIGALLIGINAAKALAFAYDKPIIPVHHIAGHIYANHLEQPLTFPLMSLIVSGGHTELVYMKNHLDFEVIGETRDDAVGEAYDKVARTINLPYPGGPHIDRLAAKGKDVYDFPRVWLEKDSYDFSFSGLKSAVINKLHNLRQKNIEIVAEDVATSFQNSVVEVLTYKAIHACKTYHVNRLIVAGGVASNKGLRTALSEACKKEGIHLTIPSPVLCTDNAAMIGAAGYYLYQAGLRGDLALNGQNNIDIETFSV

SEQ ID NO: 3910 - protein, 249 aa, Staphylococcus epidermidis
VFVVDNYLYYEMTFNICFNSFTDFNDTCIIYAKKGVRYMPDDFKIPRATLKRLPLYYRFVSILKGKGIDRVNSKTISEALQIDSATIRRDFSYFGELGKKGYGYNIDSMLEFFKSELSESDQIKIAIIGIGNLGRALLTYNFSIHDEMTITEAFDIRPDIIGENIGDVVVKHSDDIKMTLESEDIDVVILTTPDNVAQQVADELVKAGVKGILNFTPRRIKTPQDVQVHHIDFGIELQSLLFFMKNYSK

SEQ ID NO: 3911 - protein, 530 aa, Staphylococcus epidermidis
CHSLNLKVLKNNNIRGVFLMEEHIQIFDTTLRDGEQTPGVNFTFDERLKIAKQLEKWGVDVLEAGFPASSTGSFKSVEAIAKTLTTTAVCGLARCKKSDIDAVYEATKEAIKPQVHVFIATSPIHLEHKLKMTQDEVLTSIKEHVSYAKQFFEVVQFSPEDATRTEIPFLIECVQTAINAGATIINIPDTVGFSYPTEYGEIFKQLTQAVKSNSKIIFSAHCHDDLGMAVANSLAAIEGGARRIEGTVNGIGERAGNASLEEVALALYVRKDHYGLESQINLKETKKTSDLISRYAGIRVPRNKAIVGQNAFSHESGIHQDGVLKHRETYEIMTPQLVGVNTTELPLGKLSGKHAFAEKLKALGYEIKLEDQVTLFKQFKEIADKKKNVSDRDIHAIIHGSEHEHNAIFQLDNLQLQYVSKGLQSAVVVIKERNGQVKQDSSIGTGSIVAIYNAVDRIFKKDAELIDYRIDSVTEGTDAQAEVHVRIIINHIEVTGIGIDHDILKASCKAYIDAHAKYISEYELKEGIRT

SEQ ID NO: 3912 - protein, 63 aa, Staphylococcus epidermidis
LFSSIILVIFSFVAGLTDPLFKKRETVLFDTPANFAISDIFFIKNHLSRHQSFFFILPYEPTL

SEQ ID NO: 3913 - protein, 339 aa, Staphylococcus epidermidis
LEEFIMTKVYYDETVTQDALQGKKIAVIGYGSQGHAHAQNLKDNGYDVVIGLRPGRSFNKAKEDGFDVYTVSEATQQADVVMVLLPDEIQGEVYNKEIKPYLEKGNALAFAHGFNIHFSVIEPPSDVDVFLVAPKGPGHLVRRTFVEGSAVPALFGVQQDATGQARNIALSYAKGIGATRAGVIETTFKEETETDLFGEQAVLCGGVSKLIQSGFETLVEAGYQPELAYFEVLHEMKLIVDLMYEGGMENVRYSISNTAEFGDYVSGPRIITPNVKENMKKVLEDIQNGNFSRRFVEDNKNGFKEFYQLREDQHGHQIEQVGRELREMMPFIKSKSIEK

SEQ ID NO: 3914 - protein, 109 aa, Staphylococcus epidermidis
DYRSVYKKLLEGRVRKPKVSVSIKSQRINIDDRQVNEPYMKDRHIKDITLREIKNSDGDTIPPGAFFVLNDNNNKHSDSRTYGLIDKKDIIGDVSLKYYPFKEFNYQFK

SEQ ID NO: 3915 - protein, 406 aa, Staphylococcus epidermidis
LLPSFQMEAIDTCPNKYSTIRRVLIMNKKTQMIHGGHTTDNYTGAVTTPIYQTSTYLQDDIGDLRQGYEYSRTANPTRASLESVIANLEHGKHGFAFGSGMAAISAVIMLLDKGDHLVLNSDVYGGTYRALTKVFTRFGIDVDFVDTTKIENIEQYIKPETKMLYVETPSNPLLRVTDIKASAKIAKKYDLISVVDNTFMTPYYQNPLDFGIDIVLHSATKYIGGHSDVVAGLVATADDDLAERLGFISNSTGGVLGPQDSYLLIRGIKTLGLRMEQINRNVEGIVQMLQKHPKVQQVFHPSIKEHMNYTIHQNQATGHTGVVSFEVKDTEAAKQVIHATNYFTLAESLGAVESLISVPALMTHASIPSDVRAKEGITDGLIRLSIGIEDTEDLVNDLEQALNTLR

SEQ ID NO: 3916 - protein, 69 aa, Staphylococcus epidermidis
VAESWYCYFVVQMFELGEESFERHHFLHIQYKLSVGYVIRVVEMSEWFYPLILVFELPVRVTVYLQQLI

SEQ ID NO: 3917 - protein, 273 aa, Staphylococcus epidermidis
KELSTMDPSLILPYLWVLLVLVFLEGLLAADNAIVMAVMVKHLPPKQRKKALFYGLLGAFIFRFIALFLISIIANFWWIQAAGAVYLIYMSIKNLWQFFHQSNEKHHKETGDEHHFDETGNEKEVGPKSFWGTVFKVEFADIAFAIDSMLAALAIAVTLPKVGIHFGGMDLGQFIVMFLGGMIGVILMRFAATWFVELLNKYPGLEGAAFAIVGWVGIKLIIMVLAHPDIGVLPEAFPHSALWQTIFWVVLVGLVLIGWLTSAIGNKKKGNQK

SEQ ID NO: 3918 - protein, 375 aa, Staphylococcus epidermidis
KEFFIQNNKNGYNYLLKYLNDLDHPQLIFESTGIYSRGMERFCCVNQINYIQMNPLEAKFKTSALRSWKTDQADAHKLACLGPTLKQTDNLPIHELIFFELRERVRFHLEIENEQNRLKFQILELLHQTFPGLERLFSSRYSIIALNIAEIFTHPDMVLDIDKDVLITHIFNSTDKGMSMDKATKYALQLRVIAQESYPNVDRHSFLVEKLRLLIQQLKQSIHHLKQLDDAMIQLAQQLDYFENIHSIPGIGKLSTAMIIGEIGDIKRFKSNKQLNAFVGIDIKRYQSGHTHCRDTINKRGNKKARKLLFWVIMNIIRGQHHYDNHVVDYYYKLRKQPNEKPHKTAIIACINRLLKTIHYLVMNHKLYDYQMSPH

SEQ ID NO: 3919 - protein, 86 aa, Staphylococcus epidermidis
SFLFITFIITLLMYFFLCQLLYSCFSQIIFNTFLIDFSLMLFSFSLIFLLYFLTSYALFSLYVMKVFTSFTSILTAWYDLFFIVIH

SEQ ID NO: 3920 - protein, 312 aa, Staphylococcus epidermidis
YSLLSSEPKIMIAYDLIGQTPLVLLESFSDENVKIYAKLEQFNPGGSIKDRLGKYLIEKAIDEGRLKEGDTIVEATAGNTGIGLAIASNRHKVKCIIFAPEGFAEEKISIMKALGADVRRTPKAEGMTGAQQEALAYATRYGYLYMNQFETKDNPGAYTQTLAKQLTDELSHIDYFVAGVGSGGTFTGVAQHLKTYDVKNYIVEPEGSVLNGGVSHPHATEGIGSEKWPSFLEKELVDGIFTVADKDAFNNVKLVANKEGLLVGSSSGAALQGALELKKSIQNGVIVTIFPDGSDRYMSKQIFNYKESFNNE

SEQ ID NO: 3921 - protein, 274 aa, Staphylococcus epidermidis
CMDPYKVLIEVMKTESFTRAAENLYTSQPSVSRDIKRLELKYNVKIFEFKSPYLKLTRDGEKLLQYALQRESIEQELWQNLTSESEIISGTLTIGSSYTYGEYLLSEQLTSLMQQYPKLHIHLRVNNSDSVINDIKHNRVDIGIVEKEIQDNAIKCKEIMEDEMVYIYKKSIQPRMDICFVREKGSGTRFYQEVGLSELKLNPYLIEINNIKIIKQMVEAGNGFAIISKSALHPEDYEKLMITTLNVKRHYYLAQHVDKYIGENIRAVIEMIMK

SEQ ID NO: 3922 - protein, 100 aa, Staphylococcus epidermidis; identical to SEQ ID NO: 3071

SEQ ID NO: 3923 - protein, 184 aa, Staphylococcus epidermidis
GAALIMTKQDLSLSVFTNENYKNLHYTSSSFRNSMYDELEVNKSRFKNCNFNEGIFKNIEAICNCKFTTCGFNNCIFEDVHFYKNQFKDSTFVNTPFDQSVFNSTLFQNAMFDSNLIRSVKWTDIIFKNVSFKNVEIEGTTFKDVKFKNCEFKNVIITNSTMSQKLMNELQKQDVTLENIDTSI

SEQ ID NO: 3924 - protein, 274 aa, Staphylococcus epidermidis
YMQPYLICLDLDGTLLNDNKEISPYTKQVLTELQQCGHYVMIATGRPYRASQMYYHELNMSTPVVNFNGAFVHHPKANDFKVIHEVLDVEISKNIITALQQSHITNIIAEVKDYVFINSYDPRLFEGFSMGNPKIQTGNLLENLNEAPTSLLVEAEEENIPEIKDMLTHFYAENIEHRRWGAPFPVIEIVKRGINKARGIKHVQNYLNIADDHIIAFGDEDNDIEMIKFATHGIAMANGLKDLKEIANETKFSNNEDGIGRYLNDFFNLKMRYY

SEQ ID NO: 3925 - protein, 373 aa, Staphylococcus epidermidis
CIRPKNAKIKEVKVMTETVLEVNDLHVSFDIAAGEVQAVRGVDFHLNKGETLAIVGESGSGKSVTTKAITKLFQKDTGRIKKGEILFLGEDLAQKSEKELIQLRGRDISMIFQDPMTSLNPTMQIGKQVMEPLIKHKKLSKAKAKQRALEILNLVGLPRAEKRFKAYPHQFSGGQRQRIVIAIALACEPKILIADEPTTALDVTMQAQILDLMKELQNKIETSIIFITHDLGVVANIADKVAVMYGGQMVETGDVNEIFYDPKHPYTWGLLSSMPDLTTSNDTDLIAIPGTPPDLLHPPIGDAFARRSRYALDIDFKEEPPWFKISPTHFVKSWLLDARAPKVTPPSMVQKRLRTMPSNYEQPHRVERVAFNE

SEQ ID NO: 3926 - protein, 79 aa, Staphylococcus epidermidis
IKKPVNEFMKTHLLSILIGIMSQAHRSVEKPSVLSLILLRGDNNKHTHLFVEFEEFDRANEEKHAKVEYHSSKNKTDTL

SEQ ID NO: 3927 - protein, 410 aa, Staphylococcus epidermidis
LLFTKERVLEMAKIPVTVLSGYLGSGKTTLLNHILKNREGRRIAVIVNDMSEVNIDKDLVAQGGGLSRTDEKLVELSNGCICCTLRDDLLREVERLVHKGGIDQIVIESTGISEPVPVAQTFSYIDEELGIDLTSICRLDTMVTVVDANRFVNDIRSEDLLADRDESVDDEDERTIADLLIDQVEFCDVMIINKIDLISDEALEKLENVLRALQPEAKIIKTVNAKVELSDVLNTQLFDFEKASESAGWIKELTAGGHATHTPETEEYGITSFAYTRRLPFHAKRFHQWLEQMPENIVRTKGIVWLAQYNDVACLLSQAGSSCNIHPVTYWVATMSESQQQAILEARQDVVEDWDIEYGDRQTQFVIIGTDLDQEKISRELDACLIHSSEIDEDWRLLDSPYQWTYDRRM

SEQ ID NO: 3928 - protein, 86 aa, Staphylococcus epidermidis
GGDTLFTKKILIYIALLITLIRFFIPLHPDFDTLLVWLFILYIIPIILCIIGFKSDKLIATMIMIPNLMGIGYRIFIFFNDFLHLK

SEQ ID NO: 3929 - protein, 206 aa, Staphylococcus epidermidis
SRRLIKMKNVSKALIWFVISFIIFHAILFVMWGEHQEYWYLYTGIMLIAGISYVFYQRDIASKRLLTSIGMGIITSVALIIIQLIFSLISSELSYASLIKELSRTGVYFKWQMLVTLLFVIPCHELYMRTVLQKELIKYNLPKWASILIVAICSSSLFIYLDNWWIVFFIFVAQFILSLSYEYTRRIATTTIGQIVAIILLLIFHG

SEQ ID NO: 3930 - protein, 564 aa, Staphylococcus epidermidis
TKLTRCLMYKDYNMTQLTLPMETSVLIPTNDISRHVNDIVETIPETEFDEFRHHRGATSYHPKMMLKVVLYAYTQSVFSGRKIEKLLNDSIRMMWLSQNQKPSYKTINRFRVNPKVDALLESLFIQFHSQCLKQNLIDDQAIFIDGTKVEANANRYTFVWKKSIQNHESRMNENSKALYHELVINKIIPEIKKDHDNDLTKEEIDLIGSHLDKEIEDLNQHIDNEKCTKIRKQIRLKRTKIKKYKKQINDYSQRKHKYEVQKSILKDRNSYSKTDHDATFMRMKEDHMKNGQLKPGYNLQIATNSQFVLFYDVYQNPTDTRTMIPFLNTIQETYGHLPEYIVADAGYGSEANYMAIIDNFNRTPLITYGMFIKDKTKKYKSDIFNTQNWDYDEINDEFICPNNKRLGFKRYAYRHDKYGFKRDFKLYECDDCSECPLKQQCMNFNSKTNKKIMKNYNWEYFKAQINKKLSEPKTKTIYSQRKIDVEPVFGFMKAILGFTRMSVRGIDKAKRELGFVLMALNIRKVTAQRAENNQKNNKKDNFYIISIEIVFFYLSWDFMSHTHF

SEQ ID NO: 3931 - protein, 62 aa, Staphylococcus epidermidis
VIQTIKLSYKYIGMLLNKLEKIHNNLLIKIGFLNKFCYISFIMWFILCFTRSNRFMVCKENN

SEQ ID NO: 3932 - protein, 262 aa, Staphylococcus epidermidis
SMSAITILGFLLLLIMVIFGGKKGLISFFTLFLNFIILVISILLIIYGVSIYLVTFIFCFIIAAINLFVLNSYNVKTQAAFLGTLVTILILILMIYFSVEMGHLQGFATEQQDETYVYSMNIGINMVQFMVFTIVLAVIAAVIDLAITISSPMYELNETNPNLNQHQLFQSGMRVGREILATSANTIYLAFFGGQLTLFFWFFKLKYSFGHIINSKIFTQEFIAILLGGIAVAISIPITAWITAFMIKHFSQKKTLTNQQNK

SEQ ID NO: 3933 - protein, 63 aa, Staphylococcus epidermidis
ELHAYILTKIFSPTLNRKYSVHFMYSHNREIIYDFDQFSNRLVLALIIVYSVMSLCPVLTFAF

SEQ ID NO: 3934 - protein, 63 aa, Staphylococcus epidermidis
CQCAKGSCSNNGSNIFFLHLKSSSTLGFVYSRFNNTKILYSLIMYSMFALDDILITNIILNKK

SEQ ID NO: 3935 - protein, 452 aa, Staphylococcus epidermidis
HFSALKGVGNLSGHSQWKTSTGFILASAGSAIGLGAMWKFPYMAGIYGGGAFLLMFLIFTIFVGLPLLIMEFTVGKMGRTYTTQIYKKLTGKKWLNIIGWNGNLAVFILFGFYSVIGGWIIIYIGYVIAQIMVFKSSTLTNIQFETIISNPWLTVLGQGIFILITMVIVMLGVEKGLEKASKIMMPLLFIFLIIVVAQSLTLEGALEGVRYILQPRVEDMSIQGVLFALGQSFFTLSLGTTGMITYASYAPKNMTIKSSALSIVVMNILISVLAGLAIFPALKTFGYQPQEGPGLLFKVLPLVFSEMTFGTFFYFIFLLLFLFAALTSSISLLELNVSNFTKNDNSKRQKVAIIGSILVFIISIPATLSFSSLSHLRFGAGTIFDNMDFIVSNILMPLGALGTTLVVGQLLDKKLLKESFGKDKFNLFLPWYYLIKFIMPIVIILVFIVQLF

SEQ ID NO: 3936 - protein, 267 aa, Staphylococcus epidermidis
KYMAEELRIMENKSREDTNLSPVSKIEIYSFFDPFSKDCFKLSAILSKLRIEYNKYIKIRHILNPSLKVLTKCQAQSTSDFDNIALAYKAAELQGRIRAERFIHLMQNEIIPKRDIITEDMISDCINNAGIDYQVFKEDLQKDKLTDSLKVDLHIAREMEIEQAPSLVFFSENVHEEGLKVEGLYPYHIYTYIINELMGQPIEKNLPPKLEYYIQKKQLVTMEELLTIYEWPEKLLNKELKKLTLQQKVEKLQYPEGEFWKSKMPQC

SEQ ID NO: 3937 - protein, 75 aa, Staphylococcus epidermidis
ALNFVRKGDRFVVESIDRLGRNYDEVIHTVNYLKDKEVQLMITSFPRMDEVIGKPLLYIESHALCVWFRKGFTVI

SEQ ID NO: 3938 - protein, 123 aa, Staphylococcus epidermidis
EALYFGATGVLSYRKFFPFIYNLFQKGYFENSLTIIGSGLNELTTDEFREKVKNAIQNNIENSKEIGAFLKRLFYKQQDANSKDSYQKFLEMSLELDDKFDLKENRLFYLAMSPKFLELQQTT

SEQ ID NO: 3939 - protein, 301 aa, Staphylococcus epidermidis
MKFLSFKHNDRTSYGVKVKREDAVWDLPMVFAEFGDKDFNPKTLIAGLQQNQTLDFQEQVRKAVVAAEESGRDEEFKLLFTDIDFLPPVTPPNNVIAFGRNYEDHASELNHEVDSLYVFTKAASSLTGDEATIPNHKDITEQLDYEGELGIVIGKSGEKIPRGLALDYIYGYTIINDITDRTAQSSHDQAFLSKSLTGACPMGPYIVTKDELPAPENVNIVTKVNNEIRQDGNTGEMILKIDELIEKISKYVALHPGDIIATGTPAGVGAGLQPPQFLQPGDEVKVTIDNIGTLTTYISKN

SEQ ID NO: 3940 - protein, 81 aa, Staphylococcus epidermidis
RASYSVETKYKAVEMKAAEFSTKEIMKELNIRNRTQVKSWWLWYQNEESMFVLYLYPQSLIICLSLHFSTNQCYNLDNEND

SEQ ID NO: 3941 - protein, 199 aa, Staphylococcus epidermidis
NMHYPEPISKLIDSFMKLPGIGPKTAQRLAFHTLDMKEDDVVKFAKALVDVKRELTYCSVCGHITENDPCYICEDKQRDRSVICVVEDDKDVIAMEKMREYKGLYHVLHGSISPMDGIGPEDINIPALVERLKNDEVKELILAMNPNLEGESTAMYISRLVKPIGIKVTRLAQGLSVGGDLEYADEVTLSKAIAGRTEM

SEQ ID NO: 3942 - protein, 270 aa, Staphylococcus epidermidis
IMRYTILTKGDSKSNALKHKMINHMKDFQMVEDSENPEIVISVGGDGTLLQAFHQYSHMLSKVAFVGIHTGHLGFYADWLPHEVEKLIIEINNSEFQVIEYPLLELIVRYNDNGYETRYLALNEATMKTENGSTLVVDVNIRGKHFERFRGDGLCISTPSGSTAYNKALGGALIHPSLEAMQIAEIASINNRVFRTVGSPLVLPKHHTCLITPVNHDTIRTTIDHVSIKHKNVNAIQYRVANEKVRFARFRPFPFWKRVHDSFISSDDER

SEQ ID NO: 3943 - protein, 876 aa, Staphylococcus epidermidis
NPIYRKSSIIFKTILVKEDRIMLQSDINELVNQAKRVITPLSPISTFAARNPWEGLEDASFDQVARWLKSVRDIDIYPNASTIHRAISNKEIDLKVFEERLDENRAHYNNRSLSDSDINTYIQRAKNLKTIEEGYFNTKDNEKLEKWVQTNFKDYKKKEDVIAQSASVFTKEGTRLIDILNAHMIKWSKLYVDDFQSSWTMPKREKGFYHAWQRLVKHDPLFTKKQRLTLTHLPNQATEAIEYAFQELGVKEEHRQSYIESHLLSLPGWAGIMYHRSQTQSNDAYLLTDYVAIRLSIEMVLLNDHHTTLLKKSIYLQKKLEQIRYLLFNIQMNVEQWLNLSSKKQQAYIELGTRFSPFYFKKLWLDAWEETHERRLVDEIYRVPTEDTDQAKAKVQLAFCIDVRSEPFRRHLESEGPFETIGIAGFFGLPIQKEVLDEQFAHPSLPVMVEPAYRIKEYADQHEMKIYNQQQHTLTSMFYNFKLMKNNVLPSLLLPELSGPFLSIATIANTIFPKKAKRIVHRFSQKWLRKPTGKLTIQREQDAYSKLPIGFTLEEQIQFSKKALQLMDLTDDFAPLIVLCGHGSESHNNPYHASLECGACGGASSGFNAKLLAVMCNQENVRRGLLMEGIDIPRHTVFIAAEHQTSVDELEYIYVPPLTTEAQNAFDELKHVMPKVCYKTNLERLASLPNINNTDHNPNAEAHRHASDWSEVRPEWGLARNAEFIIGKRQITQNSNLEGRAFLHNYDWTKDEDGEILNTIISGPALVAQWINLQYYASTVAPHYYGSGSKTTQTVTSGVGVMQGNASDLMYGLPWQSVMMNDKEAYHAPIRLLIVIQAPDAYIQRLLKHHNHFRQKVDHQWIRLASIDENNSWKDW

SEQ ID NO: 3944 - protein, 101 aa, Staphylococcus epidermidis
GYLFVYNRTQCGFVKCVRKWTYYLLSLISSNLGILIYTQPQCGFSNRLNNSIYLLSSNVSVLINNTNADALSQCIRKRKYSFSKIKLNTAEMSALVDISQR

SEQ ID NO: 3945 - protein, 1529 aa, Staphylococcus epidermidis
SNLYIEQINKLHYSNYYQTKLSENSNKGVCIMYNEKLKKGLYDYREEHDACGIGFYANMDNKRSHDIIEKSLEMLRRLDHRGGVGADGITGDGAGIMTEIPYQLFEQLTEFKVPGEGYYAVGLFFSKEKVRDSIHEEMFNQYFESEGFKVIGYRDVPVDTRAIAQHVADTMPYIQQVFVDITGVKEVEKRLFLARKQIEKYSETQSIDLYFTSLSHRTIVYKGWLRSDQIKGLYLDLQNEAYQSKLGLVHSRFSTNTFPSWKRAHPNRMLMHNGEINTIKGNVNWMRARQNKLVETLFEDEKDKVHFIVDEDGSDSSIVDNALEFLSLAMEPEKAAMLLIPEPWLYNESNDKKVRSFYEFYSYLMEPWDGPTMISFCNGDKIGALTDRNGLRPGRYTITKDNFIVFSSEVGVIDVPEENVAFKGQLNPGKLLLVDFLQNKVVENNELKTNIANELPYEQWLKDYKNKNDLDNIYYQSSDWDDQTLFRLQKQFAYTKEDINKYMTDLVINKKDPIGAMGYDAPIAVLNDKPESLFNYFKQLFAQVTNPPIDAYREKIVTSELSYLGSEGNLLCPDESVLERIQLKKPVLNEAQLSSIDHSYFNVTYLSTLYTGDLESSLNELGNRAIQAVHEGAKILVLDDTSLTHENSYAMPILLALSHVHQLLIREGLRMETSLIAQSGETREVHHVACLLGYGANAVVPYLAQRTIEQLTRQGQLSGTVAENVATYTNVLSEGVIKVMAKMGISTVQSYQGAQIFEAVGLSNSVIEKYFTGTQSKLSGISIEQIDKENKARQSDDSDYLESGSVFQWRQQGQHHAFNPRTIFLLQHACRENDYELFKKFSKTVNLKRTDHIRHLLEFKTRQSIDISRVEPASEIVKRFNTGAMSYGSISAEAHETLAQAMNQIGGKSNSGEGGEDSSRYEIQKDGSNKISAIKQVASGRFGVTSDYLQHAKEIQIKVAQGAKPGEGGQLPGSKVYPWIAETRGSTPGIGLISPPPHHDIYSIEDLAQLIHDLKNANRRADIAVKLVSKTGVGTIASGVAKAFADKIVISGYDGGTGASPKTSIQHAGLPWEIGLAETHQTLKLNDLRSRVKLETDGKLLTGKDVAYACALGAEEFGFATAPLVVLGCIMMRVCHNDTCPVGVATQNKDLRALFRGKAQHVVNFMYFIAEELREILASLGLETVEELVGRTDLLQRSTQLKPNSKAASLQIERLIEQFDGVNTKEISQNHHLDEGFDLNYLYPDARYSIENGHSFTGNYVVNNEQRDVGVITGSAIAKQYGEEGLPEDTILAYTEGHAGQSLAAYAPRGLTIHHTGDANDYVGKGLSGGTVIVNAPNSQRENEIIAGNVNFYGASRGKAFINGKAGERFCIRNSGADVVVEGIGDHGLEYMTGGHVIILGDVGKNFGQGMSGGVSYIFPSDVEKFKKVNALETLEFSSIRFDEEKSLIKDMLEAHFKHTRSNKARQLLDQFDNIEKLAIKVIPKDYKLMMQKIDLKKRQMEREDEATLAAFYDDRETIEQELQPAVIY

SEQ ID NO: 3946 - protein, 333 aa, Staphylococcus epidermidis
KHEYVKLIPGIKNFLRRCTTMNVGIKGFGAYAPKNIIDNAYFEQFLETSDEWISKMTGIKERHWADEDQDTSDLAYNASIKAIEDAGIQPVDIDMIIVATATGDMPFPSVANILQERLGTGKVATMDQLAACSGFMYSMITAKQYIQSGDYKHILVVGADKLSKITDMTDRSTAVLFGDGAGAVVMGEVAEGRGIISYEMGSDGSGGKYLYLDRETGKLKMNGREVFKFAVRIMGDASTRVVEKAGLSSEDIDLFVPHQANIRIMESARERLGIEREKMSVSVNKYGNTSAASIPLSINQELQNGKIKDDDTLVLVGFGGGLTWGAIVIKWGK

SEQ ID NO: 3947 - protein, 180 aa, Staphylococcus epidermidis
NGGYMHIYLSTLTEVDYETSLNSIENNYNLNPESSWQDRARVKNLRKLESYNYELEVIAKNELNEVIGHVVLAEVKLSSKNKKAIALAIGALSVDKSIRNQGLGQALLKAVEERAKEQGYCAIFVNNHPQYFEKSDYEAAHLYNIHIEEKRNHQSLLVKFLKPVQNEWSGMTVYYPEVLD

SEQ ID NO: 3948 - protein, 503 aa, Staphylococcus epidermidis
DGGYAMLSSELILFMFFITLVIAILSGLIFLNHRVPIQYIKFHIYLLVLPIITGLSGLIFFGERANVGPFVVDHLTWLMMTFILTLGFIIQKFSMRYLIGDMHYRKYFPFFTLITAFASLAWLSGDLRLMTMFWGATLFVLTRLIKVNKLWKVPREAARISAWSFILAWLSLLIAVILLYIATGDWYIYSNMSDDNAINYGMRLCINLLIVLAVIIPAAQFPFQGWLIESVAAPTPVSAIMHAGIVNAGGVILTRFSPVFNDEIAISLLLIIASISVLSGSGITLVHVDYKRQLVRSTISQMGFMLVQCALGAYSAAIVHLILHGVFKATLFLQSGSVVKRFNIPTSPSVKKSYGWLVFGRLLAILIAIIFWLNSDRHAYDVLSALILAWSLMVSWNQLVAFSHGLIGRVIGVCMIIVVAIVYIITHHYFFTTLSNVDIHIVSPPLISIILSIAIIVFGSMLSIWVSRRRESKAFAKLYLWLIKVGEAKTQSIESHPSYLKRF

SEQ ID NO: 3949 - protein, 412 aa, Staphylococcus epidermidis
VTHLNRMKSMERFLCMQDSSSSNYSSNRNFVMMLVILFLMEFARGMYILSYINFLPTVTSIAIAITSFAFSIHFIADAATNFVIGFLLKKFGSKLVLTSGFLLAFISLFLVIWFPASPFIIIFSAIMLGIAVSPIWVIMLSSVDERNRGKQMGYVYFSWLLGLLVGMVIMNLLIKFHPTRFAFLMALVVLIAWVLYYFVNINLTNYNTKPVKAQLKQIVDVTQRHLILFPGILLQGAAIAALVPILPKYATQVVKVSTVGYTVAIIIGGIGCAFSMLFLSKIIDNNSKGFMYGVIFSGFILYTILIFGLSTITNIYIVWAIGLFIGLMYGILLPAWNTFMAGHINPNEQEETWGVFNSVQGFGSMIGPLVGGLITQFTNNLNNTFYFSAMIFLALAVFYGYYFIKTNRRVKP

SEQ ID NO: 3950 - protein, 70 aa, Staphylococcus epidermidis
RDNLYGYLYFLRSNKNKLHTPSFPTSEVQKQPLKPMPKGFHYSMLLFPLDDMYFSHVFSTIDIRCHIRVL

SEQ ID NO: 3951 - protein, 102 aa, Staphylococcus epidermidis
LLIHLINNDIERKDKMKKCSISSLSSIIVTLISIFICFTTMFTNIYNNTDFNFWYFPGAIIFVISIIINIIAMFKGNKTLNIILFFINFFALLIFTTPFAIV

SEQ ID NO: 3952 - protein, 391 aa, Staphylococcus epidermidis
MVTQNKKILIITGSFGNGHMQVTQSIVNQLNEMNLNHLSVIQHDLFMEAHPIMTSICKKWYINSFKYFRNTYKRFYYSRPNELDKCFYKYYGLNKLINLLIKEKPDLILLTFPTPVMSVLTEQFNINIPIATVMTDYRMHKNWITPYSQRYYVATKDTKDDFIEAGVPASYIKVTGIPIADKFEESIDKEEWLSQQHLDPSKPTILMSAGAFGVSKGFDYMINNILEKSPNSQVVMICGRSKELKRSLKAKFKDNPSVIILGYTNHMNEWMASSQLMITKPGGITISEGLSRCIPMIFLNPAPGQELENAYYFESKGFGKIADTPNEAIDIVSDLTNNEETLKVMSSKMLESKVGYSTRKICKDLLDLIGHSSQPDEIYGKVPLYARFFVK

SEQ ID NO: 3953 - protein, 397 aa, Staphylococcus epidermidis
FFSHHGYNDIIQYFIYCFDLYCRHFIWCYRSKNSCTRGQEIMSNKEDVTNINGDISNATMSHTSNDISNTDFIIRDLDLNQEPEMPRQSKNFWQDAWSQLKRNKLAVIGMIGLLLIVIMAFIGPLMNKHDFAEQNVDHRNLPAKIPLLDHVSFLPFDGKGTDGKNAYKEAGAKENYWFGTDQLGRDLWTRTWKGAQISLYIGVVAALLDICIGVVYGAVSGFFGGRVDDVMQRILEIIASIPNLIVVILFVLIFEPSIWTIILAMSITGWLGMSRVVRGEFLKLKNQEFVLASQTLGASKFKLIFKHILPNTLGAIVVTSMFTVPSAIFFEAFLSFIGIGVPAPKTSLGSLVNDGRAMLLIHPHELFIPAIILSLLILFFYLFSDGLRDAFDPKMRK

SEQ ID NO: 3954 - protein, 180 aa, Staphylococcus epidermidis
RRIHMKKLLCTLFAAALVLSACGQDDTKEDENKKSEITTEKKSDDKKDKKTNEDKKSGEQKKSQEKKNNKSMQESATNEQVQSQQQTQQANQQAQQSDNHEPTKEEIYEWDKQNIPGGTDFGLIDPEDVNEASESQNEEPDEWIKGQEEWNNATQSEKEELRKQNAQKYGYEYDPKDYEE

SEQ ID NO: 3955 - protein, 576 aa, Staphylococcus epidermidis
VIVNGGATVDYQALYRMYRPQSFDDVVGQTHVTKTLRNAISKGKQSHAYIFSGPRGTGKTSIAKVFAKAINCLNSDDGEPCNECAICKGITQGTNNDVIEIDAASNNGVDEIRNIRDKVKYAPSESKYKVYIIDEVHMLTTGAFNALLKTLEEPPAHAIFILATTEPHKIPPTIISRAQRFDFKAISSDQIIDRLKYVANSQSLDYDDAALEFIAKASEGGMRDALSIMDQAIAFGDERLTLQDALNVTGSVDEAALNELFNDIVKSDVKAAFNRYHHFISEGKEVNRLINDMIYFVRDTIMNKTSNESVHFESLIHFDLDMLYRMIDIINDTLVSIRFSVNQSVHFEVLLVKLAEMIKTQPQTVQNVATASVANEPDNEMLLQRLEQLENELKTLKEQGIKTNKVSQQPKKPTRTIQRSKNTFSMQQIAKVLDKANKDDIKLLKNHWQEVIDHAKSNDKKSLVSLLLNSEPVAASEDHVLVKFDEEIHCEIVNKDDEKRNNIESVVCNIVNKTVKVVGVPADQWLRVRAEYLQNRNTNETHQSEKQSTQQSQQIDIAQKAKDLFGEETVHLVDED

SEQ ID NO: 3956 - protein, 93 aa, Staphylococcus epidermidis
FMTKQANASRLSRLFNVAGFIVDGYNGIRYNAKNKQLVYLSLGLSALGTIIDFYISIKSASKLRKLSALGSFAINGVRLFTSFKKVRDEYDYH

SEQ ID NO: 3957 - protein, 415 aa, Staphylococcus epidermidis
RMNKNNRVVITGIGALSPIGNDAKTTWDNALKGVNGIDKITRIDTDDYNVHLAGELKDFNIEDHIDRKEARRMDRFTQYAVVAAREAVKDAQLNINEKNADRIGVWIGSGIGGMETFEVAHTTLVERGPRRVSPFFVPMLIPDMATGQVSIDLGAKGPNGSTVTACATGTNSIGEAFKIIQRGDADAMVTGGTEAPITHMAIAGFSASRALSTNNDPETACRPFQEGRDGFVMGEGAGIVVLESLDSAKERGAEIYAEVVGYGSSGDAHHITAPAPEGEGGSRAMQAALDDAGIKAQDVQYLNAHGTSTPVGDLYEVQAIKNTFGDAAKSLKVSSTKSMTGHLLGATGGIEAIFSALSIRDSKVAPTIHAITPDEECDLDIVLNVAQDLDITYAMSNSLGFGGHNAVLVFKKFED

SEQ ID NO: 3958 - protein, 132 aa, Staphylococcus epidermidis
LSCNSIIAFYWRFVGYLIYWCKENFKEVILMEEALKDSILGALEMVIDPELGIDIVNLGLVYKVDVDDEGLCTVEMTLTSMGCPLGPQIIEQVKSVLAEIPEISDTEVMIVWSPPWNKDMMSRYAKIALGIG

SEQ ID NO: 3959 - protein, 69 aa, Staphylococcus epidermidis
GCINNIARPSLTRDPNDVLGAGTPIPIKLKNASKNIALGTVNIDVTTIAPNVLGNICLKINLNLEAPNV

SEQ ID NO: 3960 - protein, 347 aa, Staphylococcus epidermidis
RYNNNVLRFHIEVKVHMKSITQASFMKGIMFTFTIAIISYILAKFPILHTIGALAIAIIFAMIYRQVIGYPEHIRPGITFASKRLLKFAIILYGLKLNMGDILGKGWKLLLIDIIVIIFSISLTLLLNQIIKGNKDISILLGIGTGVCGAAAIAATAPILKSKEKDIAISVGIIALVGTIFALIYTAIEAIFNIPTITYGAWTGISLHEIAQVVLAAGIGGSEAMTFALLGKLGRVFLLIPLSIVLILYMRYKSHSSQVQQKIDIPYFLIGFIIMACINTFVPIPSLLMNIINVITTLCMLMAMVALGLNIVLKEVISKALKPFIVICITSICLSGVTLLVTSIMFK

SEQ ID NO: 3961 - protein, 73 aa, Staphylococcus epidermidis
RINKWRLYNMRYLMTFIWAVLLLQMVNFVLNSLNSGPELNVINPIIIAVIFTIVVAILDPILKPSKGSNQYES

SEQ ID NO: 3962 - protein, 104 aa, Staphylococcus epidermidis
SGNNRSIIYLKEGSQKLMIINRGPIVDIDNQKYIFDYSACNYPVGVVEDQIYYFNEDNIDKVVFEGYSDQDEMRFQELFKEMKNNLDDDIQQGIVQKQDNLGLI

SEQ ID NO: 3963 - protein, 143 aa, Staphylococcus epidermidis
KVVKKGVTYKMKKFFIFLLSSLLVLAACGKNYEISDITSKFKKEGLSVENLRKMDREDFGMAPMKTENAKIFTVSEDKNARILKFKNEDDLKEMKKYYEELGKSSATFYSHVYTKDKFLIQMNGDIDDHVFEKYKKAMNEALN

SEQ ID NO: 3964 - protein, 60 aa, Staphylococcus epidermidis
YYQNFTSIEIELRNMMLIFKPYLLIIDKFLNPRIHCRRYIFTVIDIEPFHVSNFMIGFNF

SEQ ID NO: 3965 - protein, 85 aa, Staphylococcus epidermidis
VFKNHVQRENINYENEDIDHSKKHLNYDLINDGKQNFNDLIDEKIERNYTGKRKIRKDAVKHIDGMITSDNEFFSNQTPVNTKFF

SEQ ID NO: 3966 - protein, 130 aa, Staphylococcus epidermidis
SLKNPMQFYYSNCEQNASNLLVINVQPNEGFSLCVNGKKSNQNNEMQKVKLSYTMPIKDKMNTVDAYENLIYDTLIGEQTNFTHWEELKILGNLLMILKMYGNKNSHSFLIMPLDAMGLKKVKNYLVKTD

SEQ ID NO: 3967 - protein, 192 aa, Staphylococcus epidermidis
TLKKEILEWIVAIAVAIALIAIITKFVGKSYSIKGDSMDPTLKDGERVVVNIIGYKLGGVEKGNVIVFHANKKDDYVKRVIGTPGDSVEYKNDTLYVNGKKQSEPYLNYNEKRKQTEYITGSFKTKNLPNANPQSNVIPKGKYLVLGDNREVSKDSRSFGLIDKDQIVGKVSLRYWPFSEFKSNFNPNNTKN

SEQ ID NO: 3968 - protein, 518 aa, Staphylococcus epidermidis
HLMNGTCYTKFKERSGSMEKNENKIVDVIATSDMHSHFLNGDYGSNIYRAGTYVNEARKNNENVILLDSGGSLAGSLAAFYYAVVAPYKRHPMIKLMNAMQYDASGISPNEFKFGLSFLTRSVALSRFPWLSANIEYTVTREPYFSTPYTIKMYSDLKIAIVGLTSDGLMKNEYAEMEEDVCIEKTLVSAKRWIRYIHEVEEPDFLIVIYHGGLNKISSANKRNEKNANEAEKIMEELGVIDVIITAHQHQTVVGKDHGTIYVQAGQNAEELVHLSIKFKKRTTSYEIEHIDSKVIDLNDYHEDEQLLKETYYDRKAVKHWANSVVSNKNNGLTVQCIEDIICKPHPFTQLLHDAIRLAYNYDISCVHIPKNGEEGLKGTIRNRDIYDAYPHPDKPIDITVKGKNIKDILEYSYAHIDFNKRQLSMTMIDETLFTVWQGFDYCIDMSQSPFNRVKLNGLNEEDSYRITMTDYCYRNYKMYLQEAIVHDTYSETMGGLIRKNLKCDMYSVKLNHNFKVY

SEQ ID NO: 3969 - protein, 213 aa, Staphylococcus epidermidis
NKMNQWDQFLTPYKQAVDELKVKLKGLRKQYEVGEHNSPIEFVTGRVKPISSVIDKANKRGIPFDCLHEEMYDIAGLRIMCQFVDDIDIVVDILRQRQDFKVIEERDYIRNTKASGYRSYHVIIKYPIETLSGQKHILAEIQIRTLAMNFWATIEHTLRYKYDGAYPDEIQHRLERAAEAAYLLDEEMSEIKDEIQEAQKYYTQKRAKKHEND

SEQ ID NO: 3970 - protein, 248 aa, Staphylococcus epidermidis
IGVNVKMKVKSPQSIYLKGHRQQAVLLLHSFTGTVRDVKHLAQQLNEEGFTCYVPSYPGHGLPLKEFTQHNINDWWEQVTAAYQFLRNEGYSRINVTGVSLGGLFTLRLAEHFDLERIAVMSAPHKKRESEIAWRLERYGHRMNEILSLSEEERRHQMETILSYDKEIEVFQGVIDEIMAYLANITVPVNIMYGEEDDPLYAQSAQYIYDNVNSQDKELLKFEKSGHLMTYGDHAYRVEQSIIQFFSK

SEQ ID NO: 3971 - protein, 121 aa, Staphylococcus epidermidis
IKKNIYNNVIALLFDWFVIFSSILISVTFNNILIYLVAIILIGSRMRAFDNLMHEACHRSLFTNKFWNKWITCLFVAFPVFTSYTAYRNAHHCTGFFKTTLPGFYSVVKDIFTPNYERKES

SEQ ID NO: 3972 - protein, 381 aa, Staphylococcus epidermidis
LSFDIYLLSMKKNKIGGSQSMFNKVWFRTGIFFIMLFILIKLFMEVHEVFAPIATIIGSVFLPFLISGFLFYICLPFQNILEKWGFPRWASITTIFIGLIAIIAIVVSFIAPIIISNINNLIKQTPSLQKEAEQLINFSLRQMDKLPDDVTHRINKAVKSMGDGATSILSNSVSYITSFISTVFLLIMVPFFLIYMLKDHEKFIPAIGKFFKGERKVFVVDLLKDLNFTLKSYIQGQVTVSIILGIILYIGYTIIGLPYTPLLVLFAGVANLIPFLGPWLSFAPAAILGIIDGPSTFIWVCVVTLIAQQLEGNVITPNVMGKSLSIHPLTIIVVILAAGDLGGFTLILVAVPLYAVIKTLVSNIFKYRQRIVDKANSNVKD

SEQ ID NO: 3973 - protein, 463 aa, Staphylococcus epidermidis
NQIEINVEVKIMSVLSQLLKKSSPQQGIILYYLFAIVVAFLLLNLPYVHKQGVEVNPIDTLFVAVSGISVTGLSPITIVDTYSTFGQIIILIILNIGGIGVMAIGTMLWVVLGKHIGIRERQLIMLDNNRDTMSGTVKLILEIVRTIFIIEFIGALLLAFYFYRDNPDLKNALMQGIFVSVSATTNGGLDITGESLVPYAKDYFVQTIVMFLIVLGSIGFPVLLELKAYIKNRVTNFRFSLFTKITTTTYLFLFLFGVIVVLILEHSNAFKGLSWHQSLFYALFQSSTTRSAGLQTIDVSHFSDATNIVMGLLMFIGSSPSSVGGGIRTTTFAILILFVINFNNTGDKTGIKIFNREVHIMDVQRSFAVFTMASLITFISMIIISATEQGKLSFLQIFFEVMSAFGTCGLSLGVTSDVNDITKAVLMILMFIGRVGLISFIIMLAGRKEPEKYSYPKERIQIG

SEQ ID NO: 3974 - protein, 110 aa, Staphylococcus epidermidis
GGNEIMRGGGNMQQMMKQMQKMQKKMAQEQEKLKEERVAGTAGGGMVTVTVTGHKEVVDVEIKEEAVDPEDIEMLQDLVLAATNEAMNKADELTQQRLGKHTQGLNIPGM

SEQ ID NO: 3975 - protein, 109 aa, Staphylococcus epidermidis
GLRFKISYIPLAIVIETSITAPSVPISTEARKTSLGGRVRKVIVSYFIPFPPVNLMMTSVIPTHKNVPISVLTIVIKVRLCQPVTSSKVKEVEMIIAQVIKKNKLIAPY

SEQ ID NO: 3976 - protein, 203 aa, Staphylococcus epidermidis
NMIEVTFMSTNNEIEFKQILNQDTYSKIYELYFKNQSPFKQTNFYIDTENFKLKQHQAALRIRVKDYMYEMTLKVPAEVGLTEYNHSVNIEPKLDMSLQLSQLPNDIRNILEQDFNILENELKVLGNLTTYRLETEYQNELLVLDKSEYLGKTDYELEFEVHSYDEGYSKFKSLLQHFNLQHQKPLNKVQRFFQEKQNASDKD

SEQ ID NO: 3977 - protein, 332 aa, Staphylococcus epidermidis
WGEEMLMAINQQGQKILAQHANKFDKYQCPHCKSEVILKQGMTLIAHFAHKTRFNHRCSKSESVEHYEAKLYLARIYKALNFNVEIEPYYKEVLQYPDIVINQENAIEVQFSKISISKIIRRTTGLKRIGLNVIWIIKDVPLKYKYVKLSPFQSAFIHPINRTLVTWDSKKFVLILYSQLQHVGGKNFVAQRKVLKFEDIINMTFQSNNVPNFRLSASNIQRYINYCRKRHSVLEPTLSAMYQLNMYDSDVICKLGYVVPHQIYLITHPIEWQLKYLLLRRTLNDNELCKQLLSQVKFRVFATFQYDKRQILSTILREFDYLYEHESLNVQK

SEQ ID NO: 3978 - protein, 507 aa, Staphylococcus epidermidis
NKGELIMIYTVTTTLPLSHGGRTQALLRRIKLLDEEFKIPSKILTTNYHGNYPSIYKKYRQENKVTENIQFENMYEWLSNFKLFKVPKTLITRNPKYIKTPRKIKGLIDKQGKKSGLIHYYNNECHVRSRKYYGQSNVLEYEDFISPTSGLKYERHQYNLYGQLHRKEYYYDDSSLKHSDELFDTEGSMYCKRYFKTKPNSKINGVEIYRNKKLYKTFKNDKLLAQFYFQNRFKNQDIVFNDARFLDKPLLKQTHQTKNILVLHSSHLSGDQIKKSYRFALNQSKNVYKYIVLTHQQKHDIQQHFHISDDQFQLVPHFIELDTEVEQDSSNNQNRFIYIGRFSTEKQIDHIIRAYHKFLQSGYQTELHLFGRDEDNQIPLMNTLISELKLSDKVKIFKYTNQPLQKFKNSKASLLTSQYEGFGLTLMESIEMGCPVLSYNVRYGPSEIIQNGINGYLIEKNDIDSLSKHMINIIEHPLQKVKNKDTLKYNAAVNNYKQLMQSLDLLK

SEQ ID NO: 3979 - protein, 871 aa, Staphylococcus epidermidis
NNLDINQMTYAVQGALQKAVAYSKEYELQNIEVEALLKAAMNENDSLFKSILERANIDVDQLIKAYDNQLSHYPTVQGDNVQYGQYISAKTNELLDKAEKYMKSYEDEFISMEHILRAAIDTDETTQKWVGNKVEVIKEIITKVRGGNHVTSQNPEVNYEALEKYGRDLVEEVRQGKMDPVIGRDEEIRNTIRILSRKTKNNPVLIGEPGVGKTAIVEGLAQRIVRKDVPESLLDKTIFELDLSALVAGAKYRGEFEERLKAVLKEVKESEGRIILFIDEIHMLVGAGKTDGAMDAGNMLKPMLARGELHCIGATTLNEYREYIEKDSALERRFQKVGVSEPDVENTISILRGLKERYEVYHGVRIQDRALVAAAELSDRYITDRFLPDKAIDLVDQACATIRTEMGSNPTELDQVNRRVMQLEIEESALKNESDNASKHRLEELQEELSNEKEKQSSLKSRVEQEKEKIAKVQEKRAELDSSRQALEDAQTEGNLEKAAELQYGTIPQLEKELQEFEEAFQDETGEDSERMIREVVSDEEIGDIVSQWTGIPVSKLVETEREKLLSLSDILHKRVVGQDKAVDLVSDAVVRARAGIKDPNRPIGSFLFLGPTGVGKTELAKSLASSLFDSEKHMIRIDMSEYMEKHAVSRLIGAPPGYVGHDEGGQLTEAVRRNPYSVILLDEVEKAHSDVFNVLLQILDEGRLTDSKGRSVDFKNTIIIMTSNIGSQVLLENVKDAGEISDDTEKAVMDSLHAYFKPEILNRMDDIVLFKPLSVDDMSMIVDKILTQLNMRLLDQHISIEVTEEAKKWLGEEAYEPQFGARPLKRFVQRQIETPIARMMIKESLPEGTIIKVDLNDNKELDFKVVKPTS

SEQ ID NO: 3980 - protein, 209 aa, Staphylococcus epidermidis
NKMDYVYTIYKNPRYNIIQKDNRYLMVDLEQNWYSYLCPMLNWFIPIKFTELTYQEFNNINIFHNGGQKSHGMMAAGVGVTISVLLRSLVGYIDINISRIWIVFMFLIGFVAVITLRLSIRKKLNHPAFNKKSKQKVILIPSFKNMILVVFCYFMMLFFSIAPFQMIFEEKKNILGYILWVGVLFIFTTLNMASISDRKVHAKIKNIRR

SEQ ID NO: 3981 - protein, 132 aa, Staphylococcus epidermidis
KKEEIMKNVSPFIYVKDVDKSLCYYKDVFNAQTEILMGKDGRTYHAQLIIGDETFVHFSDTFHKHPVSKNPHLIIECDSLEELERVYKRLIDDGGHAKVKLNKTFFNAYHAEVKDRLNGIIWVFNYFLDEHI

SEQ ID NO: 3982 - protein, 62 aa, Staphylococcus epidermidis
IGGFINVHKFLFDFVIIYASFINNYMVILFKSLYKFNQYLILYIIHYFYSCFPYFTHSRRNI

SEQ ID NO: 3983 - protein, 127 aa, Staphylococcus epidermidis
YVKLVWNKEETSMRIYINEIKLKDDGVYCFSEESTEGLEEVGQMLVDSDNYGFAYLLDDGQSYSYLIFVQETWSMLHENRDKRIIINNHLELKHFQEELDYVLNNIEGNNNYGKEFVSAVEKTFELE

SEQ ID NO: 3984 - protein, 128 aa, Staphylococcus epidermidis
MIKCVCLVEEKNHQLLLVQVRHRDKYYFPGGKIDEGESLVEALQRELKEELRLELAKDELEFIGTIVGEAYPQPNMLTELNGFKVNRAIDWSKVETDHEITDMKWFDINDSENIAPAVNTWIKEFIND

SEQ ID NO: 3985 - protein, 85 aa, Staphylococcus epidermidis
SEKCLISKSISSFLANSLTFSQAFVSLDATPMVTFLPLLPPHADKTKIATIKKLKIFFINEFPLNIYKTLTSILISTDNPSDKVT

SEQ ID NO: 3986 - protein, 86 aa, Staphylococcus epidermidis
IKECRNMKRTFLLTYTTVSGKTYTEFKTFENGPDYDTCVSRIIDEFDELAYLYIKKDVVHYINVDHIESLDIEEVTEGQHITYDFE

SEQ ID NO: 3987 - protein, 96 aa, Staphylococcus epidermidis
FVIRKASYGQTPHVHFEIVPITEDGRLSAKDVVGNKKALASFQDKFNEYVNERGYELEQGTSRELTNRQHDQVNSYKQKTEYHKKEYERRYKIQPI

SEQ ID NO: 3988 - protein, 454 aa, Staphylococcus epidermidis
KGIRVSISYIYKGETAMNKIIIVGAVAGGATCASQIRRLDKESEIIVFEKDRDMSFANCALPYYIGNVIEDRRKVLAYTPNQFYDKKQITVKTYHEVIQINDERQKVTVLNHQTNQTFEESYDTLILSPGASANRLNTHSDISFTVRNLEDTETIDTFITNTKAQRALVVGAGYISLEVLENLHHRGLDVTWIHRSTNINKLMDQDMNQPIIDEIEKRNITYRFNEEISHVNGHEVTFTSGKVENFDLIIEGVGTHPNSQFIKSSNVILNDKGYIPVNHNFQTNIPNIYALGDVITSHYRHVNLPAQVPLAWGAHRGASIIAEQLSGNSSIHFKGYLGNNIVKFFDYTLASVGIKPNELKNFDYDMVEVKQGAHAGYYPGNSPLHLRVYFEKDSRKLIRAAAVGKQGADKRIDVLSMAMMNNATVDDLTEFEVAYAPPYSHPKDLINLIGYKAQ

SEQ ID NO: 3989 - protein, 164 aa, Staphylococcus epidermidis
KAMRYVYGSEKVLPLSKKTSHHARIYIGQPTKIFNTRRCFLMSSDTNGLAHTKWNCKYHIVFAPKYRRQVIYGKIKRDIGVILRQLCERKGVEIIEAEACKYPVGVVEDQIYYFNEDNIDNVIFEGYSDQDETRFQELFKEMMGNLDEDIKRGTVQQKDSYGLI

SEQ ID NO: 3990 - protein, 500 aa, Staphylococcus epidermidis
KKERYILNASALFKKIRVKNVIGTLDIQVDDITTDSRTAKEGSLFVASKGYTVDSHKFCQNVVDQGCGIVVVNRELELKGNVTQVVVPDTLRVASLLAHELYEFPSHQLTTYGVTGTNGKTSIATMIHLIYRKLNKNSAYLGTNGFQVNETKTKGANTTPETVALTKKIKEAVDANAEAMTMEVSSHGLALGRLRGVEFDVAIFSNLTQDHLDFHGTMEAYGHAKSLLFSQLGEDLSKEKYVVLNNDDDFSDYLASVTPYEVFTYGITHEAQFMAKNIKESLQGVEFEFCTPFGSFPVKSPYVGRFNISNIMAAMIAVWSKGTNLNEIINAVTELEPVEGRLEVLDPSLPIDLIIDYAHTADGMNKLIDAVQPFVKQKLIFLVGMAGERDLTKTPEMGRVACRADYVIFTPDNPANDDPKMLTAELAKGATHNNYIEFDDRAEGIRHAIDIAEPGDTVVLASKGREPYQIMPGHVKVPHRDDLIGLKAAYQKFGGGPLED

(The sequence listing continues in the following parts.)

What is claimed is:

1. An isolated and purified polypeptide consisting of the amino acid sequence of SEQ ID NO: 5277.

2. An immunogenic composition for inhibiting *S. epidermidis* infection comprising an effective amount of the polypeptide of claim 1.

3. The immunogenic composition of claim 2, further comprising a pharmaceutically acceptable carrier.

4. The immunogenic composition of claim 3, wherein the pharmaceutically acceptable carrier is an adjuvant.

5. A method of inhibiting *S. epidermidis* infection in a subject comprising administering to said subject the immunogenic composition of claim 2, such that *S. epidermidis* infection is inhibited.

* * * * *